United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 4

SEQ ID NO: 128200 - RNA, 22 nt, Human
gugugcagggggccagcgcagc

SEQ ID NO: 128201 - RNA, 22 nt, Human
ucaggcugguggucagauggcu

SEQ ID NO: 128202 - RNA, 22 nt, Human
gaaaucugaacaacagcuguca

SEQ ID NO: 128203 - RNA, 22 nt, Human
cauuauggcagccaggauauug

SEQ ID NO: 128204 - RNA, 22 nt, Human
ugcaggcugggaagagggacaa

SEQ ID NO: 128205 - RNA, 22 nt, Human
aagcagagccaccagcuuugga

SEQ ID NO: 128206 - RNA, 22 nt, Human
uccaugccaggcagucgaugca

SEQ ID NO: 128207 - RNA, 22 nt, Human
cugagcgcaugguugcugggga

SEQ ID NO: 128208 - RNA, 22 nt, Human
gaggaagaagggauuagaacuc

SEQ ID NO: 128209 - RNA, 21 nt, Human
aggugcaggccucaagcccca

SEQ ID NO: 128210 - RNA, 19 nt, Human
ggugugaagugaggaguua

SEQ ID NO: 128211 - RNA, 19 nt, Human
ugcagaggguaggaaggcc

SEQ ID NO: 128212 - RNA, 22 nt, Human
aaggggaauagaguggguugug

SEQ ID NO: 128213 - RNA, 22 nt, Human
aagagccagcuagugaagaggc

SEQ ID NO: 128214 - RNA, 22 nt, Human
gcacccagaauaaggacaggac

SEQ ID NO: 128215 - RNA, 22 nt, Human
ccagggcaacgcugucucagag

SEQ ID NO: 128216 - RNA, 22 nt, Human
aaguggagccagggaaacugaa

SEQ ID NO: 128217 - RNA, 22 nt, Human
ucgggcucgcucuccuagcgga

SEQ ID NO: 128218 - RNA, 22 nt, Human
aaagaaaccuaucagccacaug

SEQ ID NO: 128219 - RNA, 22 nt, Human
cccaggacucggcacucuccuu

SEQ ID NO: 128220 - RNA, 22 nt, Human
cagagcuggcucugcauguaca

SEQ ID NO: 128221 - RNA, 22 nt, Human
cugccaggacugacgucuucag

SEQ ID NO: 128222 - RNA, 22 nt, Human
ucucugagcaugccauauugcu

SEQ ID NO: 128223 - RNA, 22 nt, Human
aagccaggcugcacuugcuggg

SEQ ID NO: 128224 - RNA, 22 nt, Human
ccuggaguuuuuugguugacuc

SEQ ID NO: 128225 - RNA, 22 nt, Human
ugcagggcacggugcgcguggg

SEQ ID NO: 128226 - RNA, 22 nt, Human
ccagggcaaaugagaucauagc

SEQ ID NO: 128227 - RNA, 22 nt, Human
gugcugagcugcagaugcgcuc

SEQ ID NO: 128228 - RNA, 21 nt, Human
ucucacaauaugaugccagau

SEQ ID NO: 128229 - RNA, 22 nt, Human
agcagggcagcuuuuuucagaa

SEQ ID NO: 128230 - RNA, 22 nt, Human
cugcugugaguuuggaggucua

SEQ ID NO: 128231 - RNA, 22 nt, Human
ggaccugaacauaaaacgaggc

SEQ ID NO: 128232 - RNA, 22 nt, Human
cuccagugcgcaggacagcccc

SEQ ID NO: 128233 - RNA, 22 nt, Human
ccagguguaggacaccaaggga

SEQ ID NO: 128234 - RNA, 22 nt, Human
gcagaggagaugaagauacuuu

SEQ ID NO: 128235 - RNA, 22 nt, Human
ggagcacccugcucagccaagc

SEQ ID NO: 128236 - RNA, 22 nt, Human
acuguggccugcuguaugggcu

SEQ ID NO: 128237 - RNA, 22 nt, Human
ggcuguggcagcuggaaguggu

SEQ ID NO: 128238 - RNA, 22 nt, Human
gaggcaguggucugaugcaagg

SEQ ID NO: 128239 - RNA, 22 nt, Human
gaaggccugugguagugagacg

SEQ ID NO: 128240 - RNA, 22 nt, Human
aaugggaaagagacuagaugcu

SEQ ID NO: 128241 - RNA, 22 nt, Human
ucaggcugguccccacagugga

SEQ ID NO: 128242 - RNA, 22 nt, Human
ggagaagcaggugcuuuggguc

SEQ ID NO: 128243 - RNA, 22 nt, Human
cacagcuggggaagcugaggcc

SEQ ID NO: 128244 - RNA, 22 nt, Human
caggaagagaacauggaggcug

SEQ ID NO: 128245 - RNA, 22 nt, Human
aggagguggcugaacuugaggg

SEQ ID NO: 128246 - RNA, 22 nt, Human
ccugggcaacauagggagaccc

SEQ ID NO: 128247 - RNA, 20 nt, Human
ucaggcaguggggaaaggca

SEQ ID NO: 128248 - RNA, 22 nt, Human
aggacugacuuuugccaugaaa

SEQ ID NO: 128249 - RNA, 22 nt, Human
ucagggcaaugucccucagaag

SEQ ID NO: 128250 - RNA, 22 nt, Human
gaggcacaccagggagucuugu

SEQ ID NO: 128251 - RNA, 19 nt, Human
caggccagugucagggggc

SEQ ID NO: 128252 - RNA, 23 nt, Human
agcagcaaaaauuuaucuuucug

SEQ ID NO: 128253 - RNA, 22 nt, Human
cggucaggugcagcguuggcac

SEQ ID NO: 128254 - RNA, 22 nt, Human
gaggagggagcuggaagcucuu

SEQ ID NO: 128255 - RNA, 21 nt, Human
aggcagcaggauccagggaca

SEQ ID NO: 128256 - RNA, 19 nt, Human
aggcugugagggaggacuc

SEQ ID NO: 128257 - RNA, 22 nt, Human
ggugaaggcacaagagggcaag

SEQ ID NO: 128258 - RNA, 22 nt, Human
uggggcagcuccaucuauucca

SEQ ID NO: 128259 - RNA, 22 nt, Human
caaaugcaggucagcagguguc

SEQ ID NO: 128260 - RNA, 22 nt, Human
aaagggagcauggcugcaggga

SEQ ID NO: 128261 - RNA, 22 nt, Human
gggagaaguggaaaucucauua

SEQ ID NO: 128262 - RNA, 22 nt, Human
ucaccaggauugggcuguaggc

SEQ ID NO: 128263 - RNA, 22 nt, Human
agagcugauuugauuacagugc

SEQ ID NO: 128264 - RNA, 22 nt, Human
augagcugggccauccagugau

SEQ ID NO: 128265 - RNA, 23 nt, Human
acucagagaccccgggaagugac

SEQ ID NO: 128266 - RNA, 22 nt, Human
aggggcagccucacaauccucu

SEQ ID NO: 128267 - RNA, 22 nt, Human
cagaggcagaggucaucucugg

SEQ ID NO: 128268 - RNA, 22 nt, Human
agguggagacccagagaaggcg

SEQ ID NO: 128269 - RNA, 22 nt, Human
guggggcaugcacgcugcuccu

SEQ ID NO: 128270 - RNA, 21 nt, Human
gccaaggggguagcuauuccu

SEQ ID NO: 128271 - RNA, 22 nt, Human
cuccagugggggugagccuaga

SEQ ID NO: 128272 - RNA, 22 nt, Human
ugcccauguuucucuguauccc

SEQ ID NO: 128273 - RNA, 22 nt, Human
gccuggaguuguggugaagcca

SEQ ID NO: 128274 - RNA, 22 nt, Human
caugcagugacucagacacagg

SEQ ID NO: 128275 - RNA, 22 nt, Human
ggccaggccaagaggguuggaa

SEQ ID NO: 128276 - RNA, 22 nt, Human
ucagaggagaaguugggaaaau

SEQ ID NO: 128277 - RNA, 22 nt, Human
gugugcagcagagacaggacuc

SEQ ID NO: 128278 - RNA, 22 nt, Human
uggcagagaugaagaguuguuu

SEQ ID NO: 128279 - RNA, 22 nt, Human
ccugcccagcuucccgagugca

SEQ ID NO: 128280 - RNA, 22 nt, Human
agccaggccuuuucucaagguu

SEQ ID NO: 128281 - RNA, 22 nt, Human
acuaaauaguuuugacagaaca

SEQ ID NO: 128282 - RNA, 22 nt, Human
acagggcauuuccucuaugugu

SEQ ID NO: 128283 - RNA, 22 nt, Human
ggcaguggguuccccaaggcac

SEQ ID NO: 128284 - RNA, 22 nt, Human
cuguacucaagguaaaccagga

SEQ ID NO: 128285 - RNA, 22 nt, Human
aauucugugcaggcagagcuau

SEQ ID NO: 128286 - RNA, 22 nt, Human
agccaccaccacugaaagguua

SEQ ID NO: 128287 - RNA, 22 nt, Human
agcugaggcauggacaggcugc

SEQ ID NO: 128288 - RNA, 22 nt, Human
aaggggaaguagcaccagaggu

SEQ ID NO: 128289 - RNA, 22 nt, Human
cagagcugagucuucaagguug

SEQ ID NO: 128290 - RNA, 22 nt, Human
caggacccaaccucccugcucu

SEQ ID NO: 128291 - RNA, 22 nt, Human
aaaugcagauugucauucagga

SEQ ID NO: 128292 - RNA, 18 nt, Human
gugugcaguugcaggggu

SEQ ID NO: 128293 - RNA, 22 nt, Human
ccagagagucgaugggggacac

SEQ ID NO: 128294 - RNA, 23 nt, Human
cagaggcaucggauucaacauca

SEQ ID NO: 128295 - RNA, 22 nt, Human
aggaagccuggcauuaaaaagc

SEQ ID NO: 128296 - RNA, 22 nt, Human
uggcagaguaggauggcccugu

SEQ ID NO: 128297 - RNA, 22 nt, Human
aggcagccuauggggagcucag

SEQ ID NO: 128298 - RNA, 22 nt, Human
caccugggcuaaacuaugcagg

SEQ ID NO: 128299 - RNA, 22 nt, Human
aggcagguguuaacccucugag

SEQ ID NO: 128300 - RNA, 22 nt, Human
agcagguguagggcucuuugua

SEQ ID NO: 128301 - RNA, 22 nt, Human
uggcagagacaaggccgggccu

SEQ ID NO: 128302 - RNA, 22 nt, Human
gggcucagacaucccuccugga

SEQ ID NO: 128303 - RNA, 22 nt, Human
ugacauuuaucuucuacaauga

SEQ ID NO: 128304 - RNA, 22 nt, Human
acuuucuauucccacagagaua

SEQ ID NO: 128305 - RNA, 22 nt, Human
gagggaggcaucaugaauccag

SEQ ID NO: 128306 - RNA, 22 nt, Human
agaagccauagucugggaggca

SEQ ID NO: 128307 - RNA, 22 nt, Human
auuugauuagcuguguaauuuu

SEQ ID NO: 128308 - RNA, 20 nt, Human
cuccaggggaagagccuucc

SEQ ID NO: 128309 - RNA, 22 nt, Human
gagucugaugucccccaggcca

SEQ ID NO: 128310 - RNA, 22 nt, Human
aguggcagggcuggcugcugca

SEQ ID NO: 128311 - RNA, 22 nt, Human
ugccaggccaauucuauuugac

SEQ ID NO: 128312 - RNA, 22 nt, Human
auggaguucugccagcgcugcu

SEQ ID NO: 128313 - RNA, 22 nt, Human
caggagaaacauaauuuucugg

SEQ ID NO: 128314 - RNA, 22 nt, Human
agaagccacuggagguugagau

SEQ ID NO: 128315 - RNA, 22 nt, Human
aggcuuguggauuggagcgagu

SEQ ID NO: 128316 - RNA, 22 nt, Human
gcugagagcaaagcaugucuag

SEQ ID NO: 128317 - RNA, 22 nt, Human
ucaaaggcauugccaauaagua

SEQ ID NO: 128318 - RNA, 22 nt, Human
ggcugagcccccucugcguagg

SEQ ID NO: 128319 - RNA, 22 nt, Human
aguccaaagcagaugagggcca

SEQ ID NO: 128320 - RNA, 22 nt, Human
uggcugaguaaguugugauaug

SEQ ID NO: 128321 - RNA, 22 nt, Human
uccuuuggagcuugacugguag

SEQ ID NO: 128322 - RNA, 22 nt, Human
aggcagcauuugaauccagguc

SEQ ID NO: 128323 - RNA, 22 nt, Human
agcagggcagugaucagaaagg

SEQ ID NO: 128324 - RNA, 22 nt, Human
caccagguuccgggcagagcug

SEQ ID NO: 128325 - RNA, 22 nt, Human
aagggcaggaaaagauggaugu

SEQ ID NO: 128326 - RNA, 22 nt, Human
uggcugaggagggucuucuggu

SEQ ID NO: 128327 - RNA, 22 nt, Human
uggcucagaggggaagugguuu

SEQ ID NO: 128328 - RNA, 19 nt, Human
aguggcagaucuggaagua

SEQ ID NO: 128329 - RNA, 22 nt, Human
gaggaagggcugccugccgggc

SEQ ID NO: 128330 - RNA, 22 nt, Human
ugaggcucaaggucugguggag

SEQ ID NO: 128331 - RNA, 22 nt, Human
gagacguggccuuugccugagc

SEQ ID NO: 128332 - RNA, 22 nt, Human
gggaagguauuuagcugcugaa

SEQ ID NO: 128333 - RNA, 22 nt, Human
guggcagugugaggauccugcu

SEQ ID NO: 128334 - RNA, 22 nt, Human
gcaggcagagguggaggagaca

SEQ ID NO: 128335 - RNA, 20 nt, Human
cugcugugauucccuccucc

SEQ ID NO: 128336 - RNA, 22 nt, Human
caugccaguuuugagaugcacc

SEQ ID NO: 128337 - RNA, 22 nt, Human
ucagaggauugccucagcgagc

SEQ ID NO: 128338 - RNA, 20 nt, Human
cuguggcaucugucauggug

SEQ ID NO: 128339 - RNA, 22 nt, Human
caucccugcccucaugccuaua

SEQ ID NO: 128340 - RNA, 22 nt, Human
cgcagagggcaggcagugcugg

SEQ ID NO: 128341 - RNA, 22 nt, Human
cacaucuucuuaacuccaaagu

SEQ ID NO: 128342 - RNA, 22 nt, Human
caggcagcugcgacaagagagc

SEQ ID NO: 128343 - RNA, 22 nt, Human
acagggcagagaggcaggcuug

SEQ ID NO: 128344 - RNA, 22 nt, Human
ggcugaaggaugaaagcugcag

SEQ ID NO: 128345 - RNA, 22 nt, Human
aggcugagauagguggaucauu

SEQ ID NO: 128346 - RNA, 22 nt, Human
ugccaggcccugugcuggaugc

SEQ ID NO: 128347 - RNA, 22 nt, Human
agggucagggagugaguauuua

SEQ ID NO: 128348 - RNA, 22 nt, Human
aggcugaggggcgagggacccu

SEQ ID NO: 128349 - RNA, 20 nt, Human
caggcagaggaugcugacca

SEQ ID NO: 128350 - RNA, 22 nt, Human
augggcagagcuggugggaggc

SEQ ID NO: 128351 - RNA, 22 nt, Human
uggcugagccuuuggggcuuuc

SEQ ID NO: 128352 - RNA, 22 nt, Human
cagagcagaagcgguccucaca

SEQ ID NO: 128353 - RNA, 22 nt, Human
gcagguggagcaguagucuggu

SEQ ID NO: 128354 - RNA, 22 nt, Human
uggcugagggcacuaugaagcc

SEQ ID NO: 128355 - RNA, 22 nt, Human
uggcugaguuucaugcaucaug

SEQ ID NO: 128356 - RNA, 22 nt, Human
ccagagcagggcagcagggcuc

SEQ ID NO: 128357 - RNA, 22 nt, Human
agcagggcucuguggagggugg

SEQ ID NO: 128358 - RNA, 22 nt, Human
caaagccauagaguagauaaga

SEQ ID NO: 128359 - RNA, 22 nt, Human
ugaggcucagagaagugcuguu

SEQ ID NO: 128360 - RNA, 22 nt, Human
ucucucugccaacucacagcca

SEQ ID NO: 128361 - RNA, 22 nt, Human
ugaggcuccagccaggccagca

SEQ ID NO: 128362 - RNA, 22 nt, Human
cggcugugucuucacaggagcc

SEQ ID NO: 128363 - RNA, 22 nt, Human
cacccuagcugucauuucaguu

SEQ ID NO: 128364 - RNA, 22 nt, Human
agggcugacagugaggagucaa

SEQ ID NO: 128365 - RNA, 22 nt, Human
cagggccagcgcccaggcccag

SEQ ID NO: 128366 - RNA, 22 nt, Human
ggcagggagagcaugcugauaa

SEQ ID NO: 128367 - RNA, 21 nt, Human
acauuuucuguuuuaggaagu

SEQ ID NO: 128368 - RNA, 22 nt, Human
ggcaccaggcugggcauaggcc

SEQ ID NO: 128369 - RNA, 22 nt, Human
ccuccuagaggaaccccagggc

SEQ ID NO: 128370 - RNA, 22 nt, Human
cacccacauggaaauucacagu

SEQ ID NO: 128371 - RNA, 23 nt, Human
gguggcaggaguggaugcugagc

SEQ ID NO: 128372 - RNA, 22 nt, Human
cacagcugcacagaggaggugc

SEQ ID NO: 128373 - RNA, 22 nt, Human
cagcugggcuaagaguagaggc

SEQ ID NO: 128374 - RNA, 19 nt, Human
gggcaguggcacuagggag

SEQ ID NO: 128375 - RNA, 22 nt, Human
gggcugagccauuugaaccuug

SEQ ID NO: 128376 - RNA, 22 nt, Human
ccaaaggccaggcacugagguu

SEQ ID NO: 128377 - RNA, 22 nt, Human
cagcuggacuuuugauagaagu

SEQ ID NO: 128378 - RNA, 22 nt, Human
agaguuaagacguacaugagug

SEQ ID NO: 128379 - RNA, 22 nt, Human
cagagcugguaagugguagagg

SEQ ID NO: 128380 - RNA, 22 nt, Human
uguggcaggaagagcuucugag

SEQ ID NO: 128381 - RNA, 22 nt, Human
aggcaguuguugcugagcagcu

SEQ ID NO: 128382 - RNA, 22 nt, Human
cugccaggccuccgcugucccc

SEQ ID NO: 128383 - RNA, 22 nt, Human
uuuugaaagccagguuuguaug

SEQ ID NO: 128384 - RNA, 22 nt, Human
agauggggcugaaaguuccaau

SEQ ID NO: 128385 - RNA, 22 nt, Human
gauuuucauuauagcuaguuuc

SEQ ID NO: 128386 - RNA, 22 nt, Human
acucaguacaucuggaguuggc

SEQ ID NO: 128387 - RNA, 20 nt, Human
caucagugccugacaggucc

SEQ ID NO: 128388 - RNA, 22 nt, Human
agcagggcuggggcacgagcca

SEQ ID NO: 128389 - RNA, 22 nt, Human
aggaggaggcuggaguacaccc

SEQ ID NO: 128390 - RNA, 22 nt, Human
cagugaggaagcugucuggacc

SEQ ID NO: 128391 - RNA, 22 nt, Human
aggcucaggaggagcugccgga

SEQ ID NO: 128392 - RNA, 22 nt, Human
cucagaaguucagccuagagua

SEQ ID NO: 128393 - RNA, 22 nt, Human
caggaggagcauuagcgucuca

SEQ ID NO: 128394 - RNA, 22 nt, Human
cagaggcaaaagagguggaggu

SEQ ID NO: 128395 - RNA, 22 nt, Human
uagggcaguuucauguuaucuu

SEQ ID NO: 128396 - RNA, 22 nt, Human
cagccaccauacagcagaagcu

SEQ ID NO: 128397 - RNA, 22 nt, Human
aucaggaagccagucuaaugga

SEQ ID NO: 128398 - RNA, 18 nt, Human
aaagaaggauuggagagc

SEQ ID NO: 128399 - RNA, 22 nt, Human
ugcaggagaaaguacggagcgu

SEQ ID NO: 128400 - RNA, 22 nt, Human
cuguggcaggaagggacuagca

SEQ ID NO: 128401 - RNA, 22 nt, Human
agggagaaaauuggaugcacaa

SEQ ID NO: 128402 - RNA, 22 nt, Human
cagugcccaagaugugccaugc

SEQ ID NO: 128403 - RNA, 22 nt, Human
auucacaaagaagggaaguaca

SEQ ID NO: 128404 - RNA, 22 nt, Human
gaggaaaauauucagggagguu

SEQ ID NO: 128405 - RNA, 21 nt, Human
gcagaggaaugguauacauaa

SEQ ID NO: 128406 - RNA, 22 nt, Human
uggcagagugcagaagaggcau

SEQ ID NO: 128407 - RNA, 22 nt, Human
ggcaggaggugaguggcgggug

SEQ ID NO: 128408 - RNA, 22 nt, Human
agggugucagccacggaauggg

SEQ ID NO: 128409 - RNA, 22 nt, Human
cuggagcagcagguggccaggg

SEQ ID NO: 128410 - RNA, 20 nt, Human
gcugaagauucccaugcaag

SEQ ID NO: 128411 - RNA, 22 nt, Human
aagggcagaaagggacgcuuug

SEQ ID NO: 128412 - RNA, 22 nt, Human
gcuguggccuggcgcagagcug

SEQ ID NO: 128413 - RNA, 22 nt, Human
agagccugugauugucaucacc

SEQ ID NO: 128414 - RNA, 22 nt, Human
gugagaguguuuggaaauagaa

SEQ ID NO: 128415 - RNA, 19 nt, Human
agggcuaggcacauagggc

SEQ ID NO: 128416 - RNA, 22 nt, Human
aggaagcaaaaggcagggucua

SEQ ID NO: 128417 - RNA, 22 nt, Human
ucuguuccauguuuuguuccau

SEQ ID NO: 128418 - RNA, 22 nt, Human
ugaggcagugugagauaauaaa

SEQ ID NO: 128419 - RNA, 22 nt, Human
ucagggcaggacaguguaggcc

SEQ ID NO: 128420 - RNA, 22 nt, Human
uugcaagacacuuggaagcaca

SEQ ID NO: 128421 - RNA, 22 nt, Human
aaggcagauauaaagacuagag

SEQ ID NO: 128422 - RNA, 22 nt, Human
agccaggcuaaaugagccauga

SEQ ID NO: 128423 - RNA, 22 nt, Human
ucacagaaggcaucacagaaga

SEQ ID NO: 128424 - RNA, 19 nt, Human
gacucacaccuuccgcugu

SEQ ID NO: 128425 - RNA, 22 nt, Human
augggcaguaacaguggcaguc

SEQ ID NO: 128426 - RNA, 22 nt, Human
ugggcagcagcaaagccagacu

SEQ ID NO: 128427 - RNA, 22 nt, Human
acacuucucccaucuccuguug

SEQ ID NO: 128428 - RNA, 22 nt, Human
cauguuauuuauccauuaaaca

SEQ ID NO: 128429 - RNA, 22 nt, Human
ccagggcagccaacccagaugc

SEQ ID NO: 128430 - RNA, 22 nt, Human
cagggcuguggaaaacuggugc

SEQ ID NO: 128431 - RNA, 22 nt, Human
cagagcugggaucccaugggcg

SEQ ID NO: 128432 - RNA, 22 nt, Human
acagggcaaccucugggagacu

SEQ ID NO: 128433 - RNA, 22 nt, Human
agcagggcaguuaaaggguccu

SEQ ID NO: 128434 - RNA, 22 nt, Human
gagcugcagcggcugacgcaac

SEQ ID NO: 128435 - RNA, 20 nt, Human
agggucaguagcacagagcu

SEQ ID NO: 128436 - RNA, 19 nt, Human
ugagacagggauucaggug

SEQ ID NO: 128437 - RNA, 22 nt, Human
gcucccagucugauggaggaga

SEQ ID NO: 128438 - RNA, 22 nt, Human
gcagggcaguaagagcuagagu

SEQ ID NO: 128439 - RNA, 22 nt, Human
ggaagccaggcugggggaucug

SEQ ID NO: 128440 - RNA, 22 nt, Human
aguggcaguggggcagggcccu

SEQ ID NO: 128441 - RNA, 22 nt, Human
ccaggagccugggccaggcugg

SEQ ID NO: 128442 - RNA, 22 nt, Human
aagggugggcaccgccagguca

SEQ ID NO: 128443 - RNA, 22 nt, Human
ccaaugauggugcccacgauga

SEQ ID NO: 128444 - RNA, 22 nt, Human
caugucuugcccugauuaguag

SEQ ID NO: 128445 - RNA, 22 nt, Human
ucuguccuguuuccuccugaca

SEQ ID NO: 128446 - RNA, 22 nt, Human
gggcagagaaauggacaguugg

SEQ ID NO: 128447 - RNA, 22 nt, Human
acuuucauuuguaauaaacuuc

SEQ ID NO: 128448 - RNA, 22 nt, Human
gaggagcacaugaggcugaggg

SEQ ID NO: 128449 - RNA, 22 nt, Human
uuuacaaguuuacagaaugaug

SEQ ID NO: 128450 - RNA, 22 nt, Human
uguucccauuuucugcauaauc

SEQ ID NO: 128451 - RNA, 22 nt, Human
ugaagccagucaauguuaaguu

SEQ ID NO: 128452 - RNA, 22 nt, Human
ugaggcagggaguuuaauuguc

SEQ ID NO: 128453 - RNA, 22 nt, Human
agugcugacucugggcacagug

SEQ ID NO: 128454 - RNA, 22 nt, Human
aaagccaaaugaaagaugguuc

SEQ ID NO: 128455 - RNA, 22 nt, Human
ggcagaggaggggugaauuugc

SEQ ID NO: 128456 - RNA, 22 nt, Human
agguagaggccuccaggcagca

SEQ ID NO: 128457 - RNA, 21 nt, Human
ucaggcagugcaaauacaugg

SEQ ID NO: 128458 - RNA, 22 nt, Human
ugaggcagggagaguggauaug

SEQ ID NO: 128459 - RNA, 22 nt, Human
auucaguuucauggcacagcua

SEQ ID NO: 128460 - RNA, 23 nt, Human
ggggaaguggcagugagugaggc

SEQ ID NO: 128461 - RNA, 22 nt, Human
agggcaguucagccacaggcuc

SEQ ID NO: 128462 - RNA, 22 nt, Human
ucucccaggucauacacagaga

SEQ ID NO: 128463 - RNA, 22 nt, Human
agaagccauucccuguaggcuc

SEQ ID NO: 128464 - RNA, 20 nt, Human
ggagcugcccugggcuggag

SEQ ID NO: 128465 - RNA, 22 nt, Human
cuccaggguuccccgauccacu

SEQ ID NO: 128466 - RNA, 22 nt, Human
ccagguguggggaggacucaca

SEQ ID NO: 128467 - RNA, 22 nt, Human
uuacaaguauuuaagaugcugu

SEQ ID NO: 128468 - RNA, 22 nt, Human
gcagggcaaauguggaaaggag

SEQ ID NO: 128469 - RNA, 22 nt, Human
gguggcagaggugcaucagccc

SEQ ID NO: 128470 - RNA, 22 nt, Human
ugcaggcuggaggagggacuaa

SEQ ID NO: 128471 - RNA, 22 nt, Human
gaaggcacugaacuccuucugg

SEQ ID NO: 128472 - RNA, 22 nt, Human
acuguggaugccaaaggggagg

SEQ ID NO: 128473 - RNA, 22 nt, Human
ucaguggagagcuuccaggauu

SEQ ID NO: 128474 - RNA, 22 nt, Human
uuuucucaggugcuuaucuaag

SEQ ID NO: 128475 - RNA, 22 nt, Human
aggcucagagagcuguguccau

SEQ ID NO: 128476 - RNA, 22 nt, Human
uuugcuuguucaagauuucugu

SEQ ID NO: 128477 - RNA, 22 nt, Human
ucacauuuuaucugagauugac

SEQ ID NO: 128478 - RNA, 21 nt, Human
cagagcugaaggguguagugu

SEQ ID NO: 128479 - RNA, 19 nt, Human
ucaaaggcuuuuaggagac

SEQ ID NO: 128480 - RNA, 22 nt, Human
ucuggagcuggcagggcccugg

SEQ ID NO: 128481 - RNA, 22 nt, Human
ucucccaggugggugccuggag

SEQ ID NO: 128482 - RNA, 22 nt, Human
aaagagcucacaguccacugga

SEQ ID NO: 128483 - RNA, 22 nt, Human
ugaaggcauugaugaaggaauc

SEQ ID NO: 128484 - RNA, 22 nt, Human
cugcugugugaccauggacagg

SEQ ID NO: 128485 - RNA, 22 nt, Human
aaagggcugucaaauaagcaac

SEQ ID NO: 128486 - RNA, 22 nt, Human
aggcucagccccugggaggaga

SEQ ID NO: 128487 - RNA, 22 nt, Human
acagcugugaagcaagcacucu

SEQ ID NO: 128488 - RNA, 22 nt, Human
agauuaugcuggcugcuacaag

SEQ ID NO: 128489 - RNA, 22 nt, Human
aagagcuggaguuugcagcccu

SEQ ID NO: 128490 - RNA, 22 nt, Human
ccuggagccccucuggccagcc

SEQ ID NO: 128491 - RNA, 22 nt, Human
cccaguuguugccggcucugga

SEQ ID NO: 128492 - RNA, 22 nt, Human
ucagggcauggcugcacuuggc

SEQ ID NO: 128493 - RNA, 22 nt, Human
caggcaggugcagauuccucuu

SEQ ID NO: 128494 - RNA, 22 nt, Human
gaaggcuggaaggcaaguagga

SEQ ID NO: 128495 - RNA, 22 nt, Human
agaauuagaggccauguacuug

SEQ ID NO: 128496 - RNA, 22 nt, Human
gccagaaagaggaggaccuggg

SEQ ID NO: 128497 - RNA, 22 nt, Human
caggaccccauauucacugaac

SEQ ID NO: 128498 - RNA, 22 nt, Human
acucagaggcagcugcucaccc

SEQ ID NO: 128499 - RNA, 22 nt, Human
ucaucaaagucaaagaaugacu

SEQ ID NO: 128500 - RNA, 22 nt, Human
agggcagccugagugcuggccc

SEQ ID NO: 128501 - RNA, 22 nt, Human
ucucugagacaguagccucugc

SEQ ID NO: 128502 - RNA, 17 nt, Human
cagggcugucugccuag

SEQ ID NO: 128503 - RNA, 22 nt, Human
aggcugagcaaagggccuuacc

SEQ ID NO: 128504 - RNA, 22 nt, Human
caggaggaggguacaccaucag

SEQ ID NO: 128505 - RNA, 22 nt, Human
cagggcaguuugugccuaugag

SEQ ID NO: 128506 - RNA, 18 nt, Human
aggaagcaggaggaaggc

SEQ ID NO: 128507 - RNA, 22 nt, Human
agaagcuugaaggagcagugac

SEQ ID NO: 128508 - RNA, 22 nt, Human
aggcugagcuggcccuugaaau

SEQ ID NO: 128509 - RNA, 22 nt, Human
uaauccaggguauucuaguuuc

SEQ ID NO: 128510 - RNA, 22 nt, Human
caugggcaguuggcagggcuca

SEQ ID NO: 128511 - RNA, 22 nt, Human
gcaugggcuuucucagaguucu

SEQ ID NO: 128512 - RNA, 22 nt, Human
aacauugccaugguuaauuuua

SEQ ID NO: 128513 - RNA, 22 nt, Human
caguggagagacuuuuacucuu

SEQ ID NO: 128514 - RNA, 22 nt, Human
gucagcaccucuuuggggagcu

SEQ ID NO: 128515 - RNA, 22 nt, Human
aggcagugugggccaagcuucc

SEQ ID NO: 128516 - RNA, 23 nt, Human
gagugcagaauagacaugcagug

SEQ ID NO: 128517 - RNA, 22 nt, Human
ugccaggccucaggagucucca

SEQ ID NO: 128518 - RNA, 17 nt, Human
ugaagaugcauggcagc

SEQ ID NO: 128519 - RNA, 22 nt, Human
uggcugaggucuggggcuucug

SEQ ID NO: 128520 - RNA, 22 nt, Human
aggcugagucgggaggaucacu

SEQ ID NO: 128521 - RNA, 22 nt, Human
acaguggaaagaaacgaauuag

SEQ ID NO: 128522 - RNA, 22 nt, Human
agagccuggagguucugcugaa

SEQ ID NO: 128523 - RNA, 22 nt, Human
ucaucacauguguagucauccc

SEQ ID NO: 128524 - RNA, 21 nt, Human
uaagccaccaugugaaaccag

SEQ ID NO: 128525 - RNA, 22 nt, Human
gaagccaggggccugacaggca

SEQ ID NO: 128526 - RNA, 22 nt, Human
gggggacuaacuggauccugga

SEQ ID NO: 128527 - RNA, 22 nt, Human
uggcagaguuggagguggaaga

SEQ ID NO: 128528 - RNA, 22 nt, Human
aaggugucggcagagccgcuuc

SEQ ID NO: 128529 - RNA, 20 nt, Human
gggagaagggcugaugagag

SEQ ID NO: 128530 - RNA, 22 nt, Human
uuugagaagcaucugguccacu

SEQ ID NO: 128531 - RNA, 18 nt, Human
gagagcugcuaccuagcu

SEQ ID NO: 128532 - RNA, 22 nt, Human
aggcugagcugguagugaguac

SEQ ID NO: 128533 - RNA, 22 nt, Human
gugggcagugguuugcgcgguc

SEQ ID NO: 128534 - RNA, 22 nt, Human
ucuaguucuagaucccugagga

SEQ ID NO: 128535 - RNA, 22 nt, Human
ggguuggggcccagcagucugc

SEQ ID NO: 128536 - RNA, 22 nt, Human
uccugguggcuuucccugccuu

SEQ ID NO: 128537 - RNA, 20 nt, Human
uuggcucugaucaguggagc

SEQ ID NO: 128538 - RNA, 22 nt, Human
uagggcagccuuauagcuccca

SEQ ID NO: 128539 - RNA, 22 nt, Human
agcugcagugaacuguuuuguc

SEQ ID NO: 128540 - RNA, 22 nt, Human
aagcaguguucccagcuggccc

SEQ ID NO: 128541 - RNA, 22 nt, Human
uucagauguggcuuugucaggc

SEQ ID NO: 128542 - RNA, 22 nt, Human
uuccucaggcuucccuuugucc

SEQ ID NO: 128543 - RNA, 22 nt, Human
auucacaauuagaaguagauaa

SEQ ID NO: 128544 - RNA, 22 nt, Human
uuucacaaucaaauggugaaau

SEQ ID NO: 128545 - RNA, 22 nt, Human
agggccagaaucccucagucua

SEQ ID NO: 128546 - RNA, 22 nt, Human
uggaggcaguaacugagcaaca

SEQ ID NO: 128547 - RNA, 22 nt, Human
gggcaggugcccagggccagag

SEQ ID NO: 128548 - RNA, 22 nt, Human
uaguggagaggauguggagaaa

SEQ ID NO: 128549 - RNA, 22 nt, Human
augaggcaggauuaagcuauca

SEQ ID NO: 128550 - RNA, 22 nt, Human
ucaggcugcaucuguaagggug

SEQ ID NO: 128551 - RNA, 22 nt, Human
uggaaguggcagaaaaugaaca

SEQ ID NO: 128552 - RNA, 22 nt, Human
uugcucugaacccagggcacca

SEQ ID NO: 128553 - RNA, 22 nt, Human
gaggcucagggaguauaugaau

SEQ ID NO: 128554 - RNA, 22 nt, Human
agugcccuggcccagcuggacc

SEQ ID NO: 128555 - RNA, 22 nt, Human
aagccaguguccagaaugggca

SEQ ID NO: 128556 - RNA, 22 nt, Human
cuccagggaaaggggcguccgc

SEQ ID NO: 128557 - RNA, 22 nt, Human
cugagcagcaacccagagccuc

SEQ ID NO: 128558 - RNA, 17 nt, Human
agggucaggugaaguuc

SEQ ID NO: 128559 - RNA, 22 nt, Human
cugagcacugggcacauagcug

SEQ ID NO: 128560 - RNA, 22 nt, Human
uuagagccaguuacaaggucaa

SEQ ID NO: 128561 - RNA, 22 nt, Human
cagagcuggacuuaaauauauu

SEQ ID NO: 128562 - RNA, 22 nt, Human
uggcucaguuucaguccugguu

SEQ ID NO: 128563 - RNA, 20 nt, Human
ucccaggcugggcuccagcu

SEQ ID NO: 128564 - RNA, 21 nt, Human
uuagaagcuaaugcagcuggu

SEQ ID NO: 128565 - RNA, 22 nt, Human
cgagcaugaugacggcuguggc

SEQ ID NO: 128566 - RNA, 22 nt, Human
gagaggaguaggcugauggugc

SEQ ID NO: 128567 - RNA, 22 nt, Human
gaggggaaagugugaggcugcg

SEQ ID NO: 128568 - RNA, 22 nt, Human
aggagggcaggcuggcugccua

SEQ ID NO: 128569 - RNA, 22 nt, Human
ucagaggaugcuguucuuuaau

SEQ ID NO: 128570 - RNA, 19 nt, Human
ucaguggaugaacauguuu

SEQ ID NO: 128571 - RNA, 22 nt, Human
aagaggaagucuccauggagag

SEQ ID NO: 128572 - RNA, 20 nt, Human
caggaggcaaggucaagguc

SEQ ID NO: 128573 - RNA, 22 nt, Human
aaguggagucccuacaaccagc

SEQ ID NO: 128574 - RNA, 23 nt, Human
ugcagggcaaguuagagacccca

SEQ ID NO: 128575 - RNA, 22 nt, Human
aggcugaggcuuuccuuggaga

SEQ ID NO: 128576 - RNA, 23 nt, Human
acagggcauugcuggccucgagg

SEQ ID NO: 128577 - RNA, 22 nt, Human
aggagcagaacuguuguggagg

SEQ ID NO: 128578 - RNA, 22 nt, Human
gaggaagaauugguuauuggag

SEQ ID NO: 128579 - RNA, 22 nt, Human
gacuucaaaggucaaacaucgc

SEQ ID NO: 128580 - RNA, 22 nt, Human
aggcagguccccuggaaggcac

SEQ ID NO: 128581 - RNA, 22 nt, Human
aauggcugccagggcaggaggu

SEQ ID NO: 128582 - RNA, 18 nt, Human
ccgggcuuuggugacaca

SEQ ID NO: 128583 - RNA, 22 nt, Human
acaguggaugugauguccaggu

SEQ ID NO: 128584 - RNA, 22 nt, Human
ggaggagacggagugauuagug

SEQ ID NO: 128585 - RNA, 22 nt, Human
uggcaggaaaaacauuggagau

SEQ ID NO: 128586 - RNA, 22 nt, Human
gcuguggccgucagggaaaugg

SEQ ID NO: 128587 - RNA, 19 nt, Human
aauucuguuucagcagauc

SEQ ID NO: 128588 - RNA, 22 nt, Human
gugaggcagcaggagccucugu

SEQ ID NO: 128589 - RNA, 22 nt, Human
agagucugaaugcucagaguug

SEQ ID NO: 128590 - RNA, 22 nt, Human
gacccuggaguuaguccugugu

SEQ ID NO: 128591 - RNA, 22 nt, Human
accacccucagcagagcugaaa

SEQ ID NO: 128592 - RNA, 22 nt, Human
auuccaaaaggauguuagaaug

SEQ ID NO: 128593 - RNA, 22 nt, Human
ucagaggauuggacuuuuaugu

SEQ ID NO: 128594 - RNA, 22 nt, Human
ccagggcauguaacuaauggug

SEQ ID NO: 128595 - RNA, 22 nt, Human
ucccacuggacgucugugcugg

SEQ ID NO: 128596 - RNA, 17 nt, Human
uggcaagaauggaaaug

SEQ ID NO: 128597 - RNA, 18 nt, Human
uggugaaggguggaggag

SEQ ID NO: 128598 - RNA, 22 nt, Human
cauuuucaugaguuucuguuca

SEQ ID NO: 128599 - RNA, 16 nt, Human
uagggcugggaaggag

SEQ ID NO: 128600 - RNA, 21 nt, Human
agcagaggcagaauguaugca

SEQ ID NO: 128601 - RNA, 22 nt, Human
aaggugugaagagaugggaaga

SEQ ID NO: 128602 - RNA, 22 nt, Human
aaguccagaacuccugugauag

SEQ ID NO: 128603 - RNA, 22 nt, Human
gggcaggugccagcucccuguc

SEQ ID NO: 128604 - RNA, 22 nt, Human
gauuuauuuuuaaucagcaggg

SEQ ID NO: 128605 - RNA, 22 nt, Human
agggcagcaaugcagcugcugc

SEQ ID NO: 128606 - RNA, 22 nt, Human
ucaggcugcagcugucagcagc

SEQ ID NO: 128607 - RNA, 22 nt, Human
uggggcagcagaccuuucuugg

SEQ ID NO: 128608 - RNA, 22 nt, Human
ugccaggcccugcgggguccca

SEQ ID NO: 128609 - RNA, 22 nt, Human
acaaaggcagccaaucaucugc

SEQ ID NO: 128610 - RNA, 19 nt, Human
uugcuucaugucuuuugcu

SEQ ID NO: 128611 - RNA, 22 nt, Human
cugggguuggccagggcccuag

SEQ ID NO: 128612 - RNA, 19 nt, Human
ucucccaugccugugucua

SEQ ID NO: 128613 - RNA, 22 nt, Human
augcaguuagguaauagucuca

SEQ ID NO: 128614 - RNA, 22 nt, Human
cuucauuucaggcugaagaaua

SEQ ID NO: 128615 - RNA, 22 nt, Human
guuauucuauuaaugugauugu

SEQ ID NO: 128616 - RNA, 22 nt, Human
cuggugcuguagccugauugag

SEQ ID NO: 128617 - RNA, 22 nt, Human
caaguaugagaaagcuauuacc

SEQ ID NO: 128618 - RNA, 22 nt, Human
gugagagugguuuauguccaug

SEQ ID NO: 128619 - RNA, 22 nt, Human
uuuuggcucugcagguuugcac

SEQ ID NO: 128620 - RNA, 22 nt, Human
uuccuccagccuggagcacuuc

SEQ ID NO: 128621 - RNA, 23 nt, Human
uugguuacuggauuugaggggcc

SEQ ID NO: 128622 - RNA, 22 nt, Human
auucuugauauagauaguuaau

SEQ ID NO: 128623 - RNA, 22 nt, Human
cacuuggaggaaggccuauuca

SEQ ID NO: 128624 - RNA, 22 nt, Human
aagguggcggcugccagguccu

SEQ ID NO: 128625 - RNA, 22 nt, Human
guauuucuuuacauaugcucau

SEQ ID NO: 128626 - RNA, 22 nt, Human
ugcaugguguaauucuaaugcu

SEQ ID NO: 128627 - RNA, 22 nt, Human
aauucagguuauauuugcaacu

SEQ ID NO: 128628 - RNA, 22 nt, Human
ggcaguggugggaggcucgcuc

SEQ ID NO: 128629 - RNA, 23 nt, Human
ucucaggguggcugggcccaucc

SEQ ID NO: 128630 - RNA, 22 nt, Human
ucuucaugucucugcuugaguc

SEQ ID NO: 128631 - RNA, 22 nt, Human
cacugcccuggggguugccauc

SEQ ID NO: 128632 - RNA, 22 nt, Human
auuguacucuagccucugggca

SEQ ID NO: 128633 - RNA, 22 nt, Human
aucuaugugggaaucauaauag

SEQ ID NO: 128634 - RNA, 21 nt, Human
gucuuuuuaauugcgauuucc

SEQ ID NO: 128635 - RNA, 22 nt, Human
cugaaacuauggggaggggagc

SEQ ID NO: 128636 - RNA, 22 nt, Human
acuuaccagagaggauccgccc

SEQ ID NO: 128637 - RNA, 22 nt, Human
cauuuugugcuagacacuaugg

SEQ ID NO: 128638 - RNA, 22 nt, Human
ccuguacuuguauuaaaggucc

SEQ ID NO: 128639 - RNA, 22 nt, Human
uugggauuacagguguaagcca

SEQ ID NO: 128640 - RNA, 22 nt, Human
uuucccaggcuggaaugcagug

SEQ ID NO: 128641 - RNA, 22 nt, Human
aguucaauuguuuuguaaaagu

SEQ ID NO: 128642 - RNA, 22 nt, Human
uggaucuugaugcuccaagagu

SEQ ID NO: 128643 - RNA, 22 nt, Human
ucucugucucccguguguccgg

SEQ ID NO: 128644 - RNA, 22 nt, Human
guccuuucgagggugagugaaa

SEQ ID NO: 128645 - RNA, 22 nt, Human
auuguuacuggguuaauuugga

SEQ ID NO: 128646 - RNA, 22 nt, Human
gcagccuccgcacugcgagucc

SEQ ID NO: 128647 - RNA, 22 nt, Human
cuuuggaaaaauaccuggcaua

SEQ ID NO: 128648 - RNA, 22 nt, Human
acucaucuuugaauuuucagua

SEQ ID NO: 128649 - RNA, 22 nt, Human
ucaucuccauacggucucgcag

SEQ ID NO: 128650 - RNA, 22 nt, Human
augguuuuguccucuuugguuc

SEQ ID NO: 128651 - RNA, 22 nt, Human
guuuuguucaugaacauugggu

SEQ ID NO: 128652 - RNA, 18 nt, Human
cuggucucccuucgcuuu

SEQ ID NO: 128653 - RNA, 22 nt, Human
aucccugugacgagcaucccua

SEQ ID NO: 128654 - RNA, 22 nt, Human
uuggauggagguucaagcacua

SEQ ID NO: 128655 - RNA, 16 nt, Human
ucucugcuucauaggu

SEQ ID NO: 128656 - RNA, 22 nt, Human
gucaggggccaugggccaagga

SEQ ID NO: 128657 - RNA, 22 nt, Human
auauggcuguugcacaucuaag

SEQ ID NO: 128658 - RNA, 22 nt, Human
augggagugacagggccacugg

SEQ ID NO: 128659 - RNA, 22 nt, Human
cuauacagcagcuuacuaguua

SEQ ID NO: 128660 - RNA, 22 nt, Human
uugacuauacucuggcggaaaa

SEQ ID NO: 128661 - RNA, 22 nt, Human
cauguguauuauucuuguggaa

SEQ ID NO: 128662 - RNA, 22 nt, Human
uccuuagagugguugugcuaug

SEQ ID NO: 128663 - RNA, 22 nt, Human
uucuacauugugaaguucuuua

SEQ ID NO: 128664 - RNA, 18 nt, Human
ucugugggaucagugagg

SEQ ID NO: 128665 - RNA, 22 nt, Human
aggugcugccccgagaaggaug

SEQ ID NO: 128666 - RNA, 22 nt, Human
uacaucucaucugugcucuccg

SEQ ID NO: 128667 - RNA, 22 nt, Human
uacaguaaccagucuacuuaga

SEQ ID NO: 128668 - RNA, 22 nt, Human
uuuugguaauuaaguagauauu

SEQ ID NO: 128669 - RNA, 22 nt, Human
cugcacagucauuuccucucaa

SEQ ID NO: 128670 - RNA, 18 nt, Human
uccuuucaccccuucucu

SEQ ID NO: 128671 - RNA, 22 nt, Human
cggcuucucgggucggauuccg

SEQ ID NO: 128672 - RNA, 22 nt, Human
agggcccuagggaaugagacau

SEQ ID NO: 128673 - RNA, 22 nt, Human
cucuaaauguggucugcagaua

SEQ ID NO: 128674 - RNA, 22 nt, Human
gcagcuuuggagguggaacucu

SEQ ID NO: 128675 - RNA, 22 nt, Human
uuucuacauuuguaaccagauu

SEQ ID NO: 128676 - RNA, 22 nt, Human
gcuguagguaaggauggcaaag

SEQ ID NO: 128677 - RNA, 22 nt, Human
uuccuuucucuggacugcagcc

SEQ ID NO: 128678 - RNA, 22 nt, Human
caggccugugacaccgugucug

SEQ ID NO: 128679 - RNA, 22 nt, Human
guaguucuuucucaauguucaa

SEQ ID NO: 128680 - RNA, 22 nt, Human
ucaucuguuaugggaguuuuug

SEQ ID NO: 128681 - RNA, 22 nt, Human
cuucucuuggguguggugucuu

SEQ ID NO: 128682 - RNA, 22 nt, Human
acauuucuccuacuuguuauuu

SEQ ID NO: 128683 - RNA, 22 nt, Human
uauacuacgcaccaaacaaagg

SEQ ID NO: 128684 - RNA, 22 nt, Human
augcauugaggaugacaugagu

SEQ ID NO: 128685 - RNA, 22 nt, Human
ucugccaucaagaugcucuggc

SEQ ID NO: 128686 - RNA, 22 nt, Human
ggugggugagcccugggagcug

SEQ ID NO: 128687 - RNA, 22 nt, Human
cuucagggaggagcauggguuc

SEQ ID NO: 128688 - RNA, 22 nt, Human
ucacagcugggguuuuggcagc

SEQ ID NO: 128689 - RNA, 22 nt, Human
cuuuggucuccgucaucaauca

SEQ ID NO: 128690 - RNA, 22 nt, Human
uggugcugccaccuccucugcu

SEQ ID NO: 128691 - RNA, 22 nt, Human
ugaggucuguccugucuuugga

SEQ ID NO: 128692 - RNA, 22 nt, Human
guucuucagauuccauuucagu

SEQ ID NO: 128693 - RNA, 22 nt, Human
augcacuaugaugagcuagucu

SEQ ID NO: 128694 - RNA, 22 nt, Human
gucauuuuugacuuugaaguga

SEQ ID NO: 128695 - RNA, 22 nt, Human
uucuucauucccuuacuuccga

SEQ ID NO: 128696 - RNA, 22 nt, Human
uucuguuuauaauuugcaguug

SEQ ID NO: 128697 - RNA, 22 nt, Human
ugggugguugcugaggcuccuu

SEQ ID NO: 128698 - RNA, 15 nt, Human
uggugguguugagac

SEQ ID NO: 128699 - RNA, 22 nt, Human
cuucagggguguuaguuuugug

SEQ ID NO: 128700 - RNA, 19 nt, Human
auucuucucuuccugcugu

SEQ ID NO: 128701 - RNA, 22 nt, Human
cuggcccugucagcacagaauc

SEQ ID NO: 128702 - RNA, 22 nt, Human
uucugugcucaaaacuuuccaa

SEQ ID NO: 128703 - RNA, 18 nt, Human
cuacauucauaggaaagg

SEQ ID NO: 128704 - RNA, 22 nt, Human
ccuuuuggccaggucagugcag

SEQ ID NO: 128705 - RNA, 22 nt, Human
gagcccuuuuccuagauacugu

SEQ ID NO: 128706 - RNA, 22 nt, Human
aucaucaucuaaauugugucgc

SEQ ID NO: 128707 - RNA, 22 nt, Human
uuuggucuggaaucuucagggu

SEQ ID NO: 128708 - RNA, 22 nt, Human
uuucuucucacccaggacagag

SEQ ID NO: 128709 - RNA, 22 nt, Human
ucucucugcagcccgggacacu

SEQ ID NO: 128710 - RNA, 22 nt, Human
uuagacagagcuccuugagggc

SEQ ID NO: 128711 - RNA, 22 nt, Human
uuacaguuuacauaagaauugu

SEQ ID NO: 128712 - RNA, 22 nt, Human
ucuucaugaaauugauugcuua

SEQ ID NO: 128713 - RNA, 19 nt, Human
cauaauacaguggaucuga

SEQ ID NO: 128714 - RNA, 22 nt, Human
ccucuucagcaaaguucggccc

SEQ ID NO: 128715 - RNA, 22 nt, Human
cucuggaucugcccugacgcca

SEQ ID NO: 128716 - RNA, 22 nt, Human
caagucugaccucugggugaag

SEQ ID NO: 128717 - RNA, 22 nt, Human
gcugcuuugucuguaaaaugga

SEQ ID NO: 128718 - RNA, 22 nt, Human
acagcugugggcucugcauaua

SEQ ID NO: 128719 - RNA, 22 nt, Human
uguguuuuggaaggaacaugca

SEQ ID NO: 128720 - RNA, 22 nt, Human
uucucuucacagggaucauccu

SEQ ID NO: 128721 - RNA, 22 nt, Human
uuuggauugcuuggaugcuucg

SEQ ID NO: 128722 - RNA, 22 nt, Human
uaucaguccaggguuuugugac

SEQ ID NO: 128723 - RNA, 22 nt, Human
cuacauuuacacaguuaggcuu

SEQ ID NO: 128724 - RNA, 22 nt, Human
ugucauuggugaucugaugccu

SEQ ID NO: 128725 - RNA, 22 nt, Human
gauggugcaggugaagugcugg

SEQ ID NO: 128726 - RNA, 17 nt, Human
ucugcagggggccgugu

SEQ ID NO: 128727 - RNA, 22 nt, Human
uccucuucaaaauagcucugaa

SEQ ID NO: 128728 - RNA, 22 nt, Human
gccuucugaucgcuggacugac

SEQ ID NO: 128729 - RNA, 22 nt, Human
gccccucuccuugugcaccugc

SEQ ID NO: 128730 - RNA, 22 nt, Human
aaggaggaauguagccagcucc

SEQ ID NO: 128731 - RNA, 22 nt, Human
ugucuucuaccuugacagcauu

SEQ ID NO: 128732 - RNA, 21 nt, Human
cacuccacuuagaacaggguu

SEQ ID NO: 128733 - RNA, 22 nt, Human
ucacacuuuauuuauuucaugc

SEQ ID NO: 128734 - RNA, 22 nt, Human
uuuugucagugagaacagaguu

SEQ ID NO: 128735 - RNA, 22 nt, Human
gccuucugauugcuggacugac

SEQ ID NO: 128736 - RNA, 22 nt, Human
gugcugucguggaacugggcug

SEQ ID NO: 128737 - RNA, 22 nt, Human
gugggaguggagcucagcaugu

SEQ ID NO: 128738 - RNA, 22 nt, Human
gauccacagcugcgguaggaga

SEQ ID NO: 128739 - RNA, 22 nt, Human
ucuggauggucagcucuuccug

SEQ ID NO: 128740 - RNA, 22 nt, Human
augcauaucuccuaucuccuca

SEQ ID NO: 128741 - RNA, 22 nt, Human
auacuaagcucauuacauuuug

SEQ ID NO: 128742 - RNA, 22 nt, Human
auggcauuugaaucugucuuuu

SEQ ID NO: 128743 - RNA, 22 nt, Human
aggauugugccuccagucagaa

SEQ ID NO: 128744 - RNA, 22 nt, Human
cacaucucagggcuacaggcag

SEQ ID NO: 128745 - RNA, 22 nt, Human
gcugucucauacaaggcccugc

SEQ ID NO: 128746 - RNA, 22 nt, Human
aguucugggaggugcacgucca

SEQ ID NO: 128747 - RNA, 22 nt, Human
gucuuuuuuacaccuuacauca

SEQ ID NO: 128748 - RNA, 22 nt, Human
ugguacauggguagguaucucu

SEQ ID NO: 128749 - RNA, 21 nt, Human
uggacauuuacccuucaggga

SEQ ID NO: 128750 - RNA, 22 nt, Human
acuuuggugcgaagucacuuua

SEQ ID NO: 128751 - RNA, 22 nt, Human
gggcuucuugagcugccggccc

SEQ ID NO: 128752 - RNA, 22 nt, Human
auuuuguaucuuacggggacua

SEQ ID NO: 128753 - RNA, 22 nt, Human
uauuacaguucgaguuucuagg

SEQ ID NO: 128754 - RNA, 22 nt, Human
agugaauuagccuauuuguaaa

SEQ ID NO: 128755 - RNA, 22 nt, Human
agugacauuauuuuguguacua

SEQ ID NO: 128756 - RNA, 22 nt, Human
uaauuuugucacagugacaugc

SEQ ID NO: 128757 - RNA, 22 nt, Human
uugugcccucaaagggugcguc

SEQ ID NO: 128758 - RNA, 22 nt, Human
ugcacauggccugagugccuga

SEQ ID NO: 128759 - RNA, 22 nt, Human
augacuuaaucauacuugcauu

SEQ ID NO: 128760 - RNA, 22 nt, Human
uugcuauuuugagagucauagu

SEQ ID NO: 128761 - RNA, 22 nt, Human
uacuguauacuacugcuguucu

SEQ ID NO: 128762 - RNA, 22 nt, Human
acacauggucuacuucuucuca

SEQ ID NO: 128763 - RNA, 22 nt, Human
ugaugggaggugcugcaggacc

SEQ ID NO: 128764 - RNA, 20 nt, Human
uucaugcagugguugcugug

SEQ ID NO: 128765 - RNA, 22 nt, Human
uggcacguuggauugggaguuc

SEQ ID NO: 128766 - RNA, 22 nt, Human
cuugcuuuaucugguuucucau

SEQ ID NO: 128767 - RNA, 22 nt, Human
cuucauuuggcaggcuggccuc

SEQ ID NO: 128768 - RNA, 22 nt, Human
uacuacauacagaauuuagaga

SEQ ID NO: 128769 - RNA, 23 nt, Human
gggugcugccuguagucaugcug

SEQ ID NO: 128770 - RNA, 22 nt, Human
acuucacagauauuuauuuggu

SEQ ID NO: 128771 - RNA, 22 nt, Human
ccugguuuaaugcucacuguug

SEQ ID NO: 128772 - RNA, 22 nt, Human
agucaguaugacuuauaguucu

SEQ ID NO: 128773 - RNA, 22 nt, Human
aucaacuuguccuugauguuaa

SEQ ID NO: 128774 - RNA, 22 nt, Human
uguuggcagugcuacagucagu

SEQ ID NO: 128775 - RNA, 22 nt, Human
auguuguugaacucuuugcaug

SEQ ID NO: 128776 - RNA, 22 nt, Human
ccacugauucugccaggucucu

SEQ ID NO: 128777 - RNA, 22 nt, Human
cuaguucugccauucaguguca

SEQ ID NO: 128778 - RNA, 22 nt, Human
uuugaacuucuaccugucauau

SEQ ID NO: 128779 - RNA, 22 nt, Human
uuucuacacuucgugguguuuu

SEQ ID NO: 128780 - RNA, 22 nt, Human
gucuccugaggcauccauugaa

SEQ ID NO: 128781 - RNA, 22 nt, Human
ucucuccuccacaccgggugcu

SEQ ID NO: 128782 - RNA, 22 nt, Human
ccugugggcgcagcuggaguca

SEQ ID NO: 128783 - RNA, 22 nt, Human
ugucaaguuguuaaguucuggg

SEQ ID NO: 128784 - RNA, 21 nt, Human
ucugaugguagaugagaugug

SEQ ID NO: 128785 - RNA, 22 nt, Human
gagggugguggcuuaaggugcu

SEQ ID NO: 128786 - RNA, 22 nt, Human
cugguuuuuagugcuuaggagu

SEQ ID NO: 128787 - RNA, 21 nt, Human
ugcuggguuugcccaucaggc

SEQ ID NO: 128788 - RNA, 22 nt, Human
caguuuuucaaaauuacaugau

SEQ ID NO: 128789 - RNA, 22 nt, Human
cucuccaggcgagguccuacug

SEQ ID NO: 128790 - RNA, 22 nt, Human
cuauucaguugugggcaacaau

SEQ ID NO: 128791 - RNA, 22 nt, Human
gagguggcugcuugcugggaaa

SEQ ID NO: 128792 - RNA, 22 nt, Human
auggugguagaagcacuaugug

SEQ ID NO: 128793 - RNA, 19 nt, Human
gaugcucauucagguggaa

SEQ ID NO: 128794 - RNA, 22 nt, Human
cuggcccagguggucguugagg

SEQ ID NO: 128795 - RNA, 22 nt, Human
uugcacgcuugcgguuccugcc

SEQ ID NO: 128796 - RNA, 22 nt, Human
uguaauguuagaaacaauugcu

SEQ ID NO: 128797 - RNA, 22 nt, Human
ugugcuauuuuugcauaugugu

SEQ ID NO: 128798 - RNA, 22 nt, Human
uggucccugaagagagaccuug

SEQ ID NO: 128799 - RNA, 22 nt, Human
uaagaaacauuuuuaugacagu

SEQ ID NO: 128800 - RNA, 22 nt, Human
uuccuucuucauuguguuacag

SEQ ID NO: 128801 - RNA, 22 nt, Human
cuucuucagaggccagccucug

SEQ ID NO: 128802 - RNA, 23 nt, Human
ugucuccaucucauuacuugggg

SEQ ID NO: 128803 - RNA, 22 nt, Human
uaaugccuuucuguacuauaug

SEQ ID NO: 128804 - RNA, 22 nt, BK polyomavirus
gugcuugauccauguccagagu

SEQ ID NO: 128805 - RNA, 22 nt, Human
ccugcagcuguaggagaaggcg

SEQ ID NO: 128806 - RNA, 22 nt, Human
ggucauugaaaucagaaggguu

SEQ ID NO: 128807 - RNA, 22 nt, Human
agcuggcuccagaaggagucgu

SEQ ID NO: 128808 - RNA, 22 nt, Human
gggcuggcaucgguugcugaga

SEQ ID NO: 128809 - RNA, 22 nt, Human
auaugucgcuacaucauuagau

SEQ ID NO: 128810 - RNA, 22 nt, Human
uugcugaaaacaguggguauug

SEQ ID NO: 128811 - RNA, 22 nt, Human
augggugugaaaauggucaucu

SEQ ID NO: 128812 - RNA, 22 nt, Human
gcacagggagacagccguggcc

SEQ ID NO: 128813 - RNA, 22 nt, Human
gggaaauugugugagaucuuug

SEQ ID NO: 128814 - RNA, 22 nt, Human
acaggugauucaggcucuggga

SEQ ID NO: 128815 - RNA, 22 nt, Human
uucuucuuuaucucaguauccu

SEQ ID NO: 128816 - RNA, 22 nt, Human
gauauuuuuaguauuucugccu

SEQ ID NO: 128817 - RNA, 22 nt, Human
aggccugacuugaauuuagggc

SEQ ID NO: 128818 - RNA, 22 nt, Human
gucaggaucucccaguacauau

SEQ ID NO: 128819 - RNA, 22 nt, Human
uggcagaggagaauuaagauua

SEQ ID NO: 128820 - RNA, 22 nt, Human
acaggcagggaccuuggcuaag

SEQ ID NO: 128821 - RNA, 22 nt, Human
gcaggcagguggcaucuuguga

SEQ ID NO: 128822 - RNA, 22 nt, Human
cuacaguagagguugucaggga

SEQ ID NO: 128823 - RNA, 22 nt, Human
cagaggcucaccagccuuucac

SEQ ID NO: 128824 - RNA, 22 nt, Human
cuguacauauacauuuuuuucc

SEQ ID NO: 128825 - RNA, 22 nt, Human
ggcugggagcuggacaggccgg

SEQ ID NO: 128826 - RNA, 22 nt, Human
uaugcacacaucgcagcaggaa

SEQ ID NO: 128827 - RNA, 22 nt, Human
uaaauguguuguggaugaaguu

SEQ ID NO: 128828 - RNA, 22 nt, Human
uggcagagcccagacuccaguc

SEQ ID NO: 128829 - RNA, 20 nt, Human
ccugggcuccaggagccccg

SEQ ID NO: 128830 - RNA, 22 nt, Human
aguauauugcucuuaaucauag

SEQ ID NO: 128831 - RNA, 22 nt, Human
ggguggcuccuaugggcauagc

SEQ ID NO: 128832 - RNA, 22 nt, Human
uuugaaauaugaggcauuauga

SEQ ID NO: 128833 - RNA, 15 nt, Human
cuccaugauuuugca

SEQ ID NO: 128834 - RNA, 22 nt, Human
uuugaaagcaccauuugaguag

SEQ ID NO: 128835 - RNA, 22 nt, Human
ccaaaguccauaguuuacauaa

SEQ ID NO: 128836 - RNA, 22 nt, Human
ccugggugaugugcugcccucg

SEQ ID NO: 128837 - RNA, 22 nt, Human
uuugacaaaggaaaaaugcaca

SEQ ID NO: 128838 - RNA, 22 nt, Human
aucugccugcaguggagguggg

SEQ ID NO: 128839 - RNA, 22 nt, Human
uggucucuucuuccaagauggc

SEQ ID NO: 128840 - RNA, 22 nt, Human
ugucaugcagguuuguuauaga

SEQ ID NO: 128841 - RNA, 22 nt, Human
uccuuccugcaggccaaguccu

SEQ ID NO: 128842 - RNA, 22 nt, Human
cuggucugagggcucuugaggc

SEQ ID NO: 128843 - RNA, 22 nt, Human
uuccagcaggcagacaggagau

SEQ ID NO: 128844 - RNA, 22 nt, Human
uuuccaagagcuuauuucugaa

SEQ ID NO: 128845 - RNA, 22 nt, Human
ggcucagguuuaaagugcuuua

SEQ ID NO: 128846 - RNA, 22 nt, Human
gggcagcugccaagugcaucgc

SEQ ID NO: 128847 - RNA, 22 nt, Human
uggccugauuuugcuaagagaa

SEQ ID NO: 128848 - RNA, 22 nt, Human
uuuaaauucugucugccgcuua

SEQ ID NO: 128849 - RNA, 22 nt, Human
gcagcagaggcccuacucuuug

SEQ ID NO: 128850 - RNA, 22 nt, Human
uugaaaggccuguuuauccagc

SEQ ID NO: 128851 - RNA, 22 nt, Human
agagacaggauaucugcucaug

SEQ ID NO: 128852 - RNA, 22 nt, Human
aagagcugauuaagucaugagg

SEQ ID NO: 128853 - RNA, 22 nt, Human
gcccuggaaucucuccauggga

SEQ ID NO: 128854 - RNA, 22 nt, Human
acuuuguucuaauaguaucucu

SEQ ID NO: 128855 - RNA, 22 nt, Human
ugcaagagguaaaaugaaagga

SEQ ID NO: 128856 - RNA, 22 nt, Human
augggaugaacuugaucugcuu

SEQ ID NO: 128857 - RNA, 22 nt, Human
agccacaccuguccugccagcu

SEQ ID NO: 128858 - RNA, 22 nt, Human
uguacaguuuuaacucugaggg

SEQ ID NO: 128859 - RNA, 22 nt, Human
guaucuuugucuucauguugga

SEQ ID NO: 128860 - RNA, 22 nt, Human
agccccacacucucucugagaa

SEQ ID NO: 128861 - RNA, 22 nt, Human
aggauccugcgcuuugggggag

SEQ ID NO: 128862 - RNA, 22 nt, Human
guugaaaguggagaaccugguu

SEQ ID NO: 128863 - RNA, 21 nt, Human
uggcucuguucaauauaugga

SEQ ID NO: 128864 - RNA, 22 nt, Human
gccagcuggagacuggcagggg

SEQ ID NO: 128865 - RNA, 22 nt, Human
aguguaugaguuucaguucuuc

SEQ ID NO: 128866 - RNA, 20 nt, Human
ugacucugcaaccgucucuc

SEQ ID NO: 128867 - RNA, 22 nt, Human
uggggguguccuggugcacaca

SEQ ID NO: 128868 - RNA, 22 nt, Human
agucccagaucuacaggaggga

SEQ ID NO: 128869 - RNA, 22 nt, Human
uauaaaguuucgaaagauguau

SEQ ID NO: 128870 - RNA, 22 nt, Human
uuucaaauggagucgugaaaug

SEQ ID NO: 128871 - RNA, 22 nt, Human
auccuugagccuuaucuuuugu

SEQ ID NO: 128872 - RNA, 23 nt, Human
gaguguucauagcaggcucuugc

SEQ ID NO: 128873 - RNA, 22 nt, Human
uacaaagugugcccaugcugag

SEQ ID NO: 128874 - RNA, 22 nt, Human
gagccuucaucgcagccuuguu

SEQ ID NO: 128875 - RNA, 22 nt, Human
uggaggaaguggcuggccagaa

SEQ ID NO: 128876 - RNA, 22 nt, Human
guguggcuguuuagugacuuuc

SEQ ID NO: 128877 - RNA, 22 nt, Human
agggcagcuagcuguagaaaga

SEQ ID NO: 128878 - RNA, 22 nt, Human
cacauacaaugguguuauuugg

SEQ ID NO: 128879 - RNA, 22 nt, Human
ugagccagucugucugggugaa

SEQ ID NO: 128880 - RNA, 22 nt, Human
auacuaaaguauagaacuuagu

SEQ ID NO: 128881 - RNA, 22 nt, Human
uugugugugagccuucaccaca

SEQ ID NO: 128882 - RNA, 22 nt, Human
agggcagcagcggcccaggccu

SEQ ID NO: 128883 - RNA, 22 nt, Human
cuggcugugugucuucauucag

SEQ ID NO: 128884 - RNA, 22 nt, Human
cuguuuauuacacuggauagca

SEQ ID NO: 128885 - RNA, 20 nt, Human
acuuuacagagaagacugac

SEQ ID NO: 128886 - RNA, 22 nt, Human
uccauggggcccaggaugagag

SEQ ID NO: 128887 - RNA, 22 nt, Human
ggugggugagcccugggagcug

SEQ ID NO: 128888 - RNA, 22 nt, Human
cauacuuuugcccugacauucu

SEQ ID NO: 128889 - RNA, 22 nt, Human
augaccccuaaaauuuacuguc

SEQ ID NO: 128890 - RNA, 23 nt, Human
uuacaaguucugaaauuuccuuc

SEQ ID NO: 128891 - RNA, 22 nt, Human
uggagccaugccuggccuuucc

SEQ ID NO: 128892 - RNA, 22 nt, Human
gaacccaguccaggugcagccu

SEQ ID NO: 128893 - RNA, 22 nt, Human
gccaggcucagcagucaaccug

SEQ ID NO: 128894 - RNA, 22 nt, Human
acaacaggguaaggcaggccau

SEQ ID NO: 128895 - RNA, 22 nt, Human
cagaaauguuuauauguggugu

SEQ ID NO: 128896 - RNA, 22 nt, Human
ugauuuccuagcugacaugaaa

SEQ ID NO: 128897 - RNA, 22 nt, Human
uaauuauaacaguuacaucuua

SEQ ID NO: 128898 - RNA, 22 nt, Human
agagcugaggauccagcugagc

SEQ ID NO: 128899 - RNA, 18 nt, Human
gcucugcccaggcugccc

SEQ ID NO: 128900 - RNA, 22 nt, Human
gucaugugaauaaguguggggu

SEQ ID NO: 128901 - RNA, 22 nt, Human
caaaugugacuuuugggcuucu

SEQ ID NO: 128902 - RNA, 22 nt, Human
uuugaaagaauuuauguacuuu

SEQ ID NO: 128903 - RNA, 22 nt, Human
cuugaaagcacuccuuugacug

SEQ ID NO: 128904 - RNA, 22 nt, Human
ggggcugguggugguuucucca

SEQ ID NO: 128905 - RNA, 22 nt, Human
agcaugaaagcauaggacaguc

SEQ ID NO: 128906 - RNA, 22 nt, Human
ggcugccugcucaggugcggcg

SEQ ID NO: 128907 - RNA, 22 nt, Human
ggaugcugcuaucaggcuucga

SEQ ID NO: 128908 - RNA, 17 nt, Human
agcugccagggagugug

SEQ ID NO: 128909 - RNA, 22 nt, Human
uccuugaauugugccacuuacc

SEQ ID NO: 128910 - RNA, 22 nt, Human
ccagcccuugagauggaaggga

SEQ ID NO: 128911 - RNA, 22 nt, Human
uuuguuaaauauuuauugagug

SEQ ID NO: 128912 - RNA, 22 nt, Human
cauuuguaucugggcugcugug

SEQ ID NO: 128913 - RNA, 22 nt, Human
uuccuggugguggugacagcac

SEQ ID NO: 128914 - RNA, 22 nt, Human
aguuuucuucauuuuguggcca

SEQ ID NO: 128915 - RNA, 22 nt, Human
acuuugcaauacuuaauacaaa

SEQ ID NO: 128916 - RNA, 22 nt, Human
agaauaguggcaaugacugcac

SEQ ID NO: 128917 - RNA, 23 nt, Human
uccugagaugagacagugcugcc

SEQ ID NO: 128918 - RNA, 22 nt, Human
uauuucucagcauuuuacaucc

SEQ ID NO: 128919 - RNA, 22 nt, Human
ugccaggcgugguggugcgcac

SEQ ID NO: 128920 - RNA, 22 nt, Human
agccuccaguagcugaagagac

SEQ ID NO: 128921 - RNA, 22 nt, Human
ggugauuuucgaguuucauguu

SEQ ID NO: 128922 - RNA, 19 nt, Human
auaaggcagugacuuuuuu

SEQ ID NO: 128923 - RNA, 22 nt, Human
gccuggugguauccuggcaaga

SEQ ID NO: 128924 - RNA, 21 nt, Human
gccugcagaccccaccaggcu

SEQ ID NO: 128925 - RNA, 22 nt, Human
auuaguaaaacauuguauaugu

SEQ ID NO: 128926 - RNA, 22 nt, Human
ucccuuaaaacucauguguugu

SEQ ID NO: 128927 - RNA, 22 nt, Human
uguuugugcugccuggugggca

SEQ ID NO: 128928 - RNA, 22 nt, Human
agagcccuuucuccaggcaccu

SEQ ID NO: 128929 - RNA, 22 nt, Human
agacucaagacugcagaagacg

SEQ ID NO: 128930 - RNA, 22 nt, Human
gagguauguaugcuacauucuu

SEQ ID NO: 128931 - RNA, 22 nt, Human
uccacugcagcuucugauggaa

SEQ ID NO: 128932 - RNA, 22 nt, Human
cugacccauauaagaguggagg

SEQ ID NO: 128933 - RNA, 22 nt, Human
uuuucuuggaguggcuguccuu

SEQ ID NO: 128934 - RNA, 22 nt, Human
aucuuuacaguguaagugcaga

SEQ ID NO: 128935 - RNA, 22 nt, Human
uugcucuguaauaaucuggggu

SEQ ID NO: 128936 - RNA, 22 nt, Human
agcuguguagggaaucagagaa

SEQ ID NO: 128937 - RNA, 22 nt, Human
gcugagguaggagguugcagug

SEQ ID NO: 128938 - RNA, 22 nt, Human
acugaaggaaacuuuuguguuu

SEQ ID NO: 128939 - RNA, 22 nt, Human
gcucugggcugcccucuggaca

SEQ ID NO: 128940 - RNA, 22 nt, Human
gccagccccuuagggcucuccc

SEQ ID NO: 128941 - RNA, 20 nt, Human
aaaauauguauaacucuucu

SEQ ID NO: 128942 - RNA, 22 nt, Human
ccagggugugggcgucggcacg

SEQ ID NO: 128943 - RNA, 22 nt, Human
uccugggcuugcuccuccagcu

SEQ ID NO: 128944 - RNA, 22 nt, Human
ugagccugguugcagugucugg

SEQ ID NO: 128945 - RNA, 22 nt, Human
uuucucuaaauagggaggcuua

SEQ ID NO: 128946 - RNA, 17 nt, Human
cucuccuuccucugagg

SEQ ID NO: 128947 - RNA, 20 nt, Human
ucucagcauaagaacccuuc

SEQ ID NO: 128948 - RNA, 22 nt, Human
aaguuaugaaauuuggacagcu

SEQ ID NO: 128949 - RNA, 22 nt, Human
gacaaaggaucagagguuggga

SEQ ID NO: 128950 - RNA, 22 nt, Human
agcugggccugagcuggaagcu

SEQ ID NO: 128951 - RNA, 22 nt, Human
gagggcugauaaaugcgcaugg

SEQ ID NO: 128952 - RNA, 22 nt, Human
ucuggcuccguguccgcuccca

SEQ ID NO: 128953 - RNA, 22 nt, Human
acagaaauauagaagguaggaa

SEQ ID NO: 128954 - RNA, 22 nt, Human
gcucccugcacucugcagcccu

SEQ ID NO: 128955 - RNA, 22 nt, Human
gcugcagcuguaggacacaauu

SEQ ID NO: 128956 - RNA, 23 nt, Human
uucucuuuagauuuacauuacuc

SEQ ID NO: 128957 - RNA, 22 nt, Human
gcugucugacuccaaguuggag

SEQ ID NO: 128958 - RNA, 22 nt, Human
uguacaguaggaacuuguuauu

SEQ ID NO: 128959 - RNA, 22 nt, Human
agucucugcugguugugccuau

SEQ ID NO: 128960 - RNA, 22 nt, Human
acuuuguuguuccuugucuaaa

SEQ ID NO: 128961 - RNA, 22 nt, Human
cagcaggguuaagugacucacc

SEQ ID NO: 128962 - RNA, 22 nt, Human
ucuggcagggguucugcacuug

SEQ ID NO: 128963 - RNA, 20 nt, Human
ugugcccaauguccagguuc

SEQ ID NO: 128964 - RNA, 22 nt, Human
ugcaggagcagagauggcugga

SEQ ID NO: 128965 - RNA, 22 nt, Human
aagucagagcaacugagacauu

SEQ ID NO: 128966 - RNA, 22 nt, Human
ucccaggaucugagggcagaga

SEQ ID NO: 128967 - RNA, 20 nt, Human
auguauauuacuggcuguga

SEQ ID NO: 128968 - RNA, 22 nt, Human
gggcagugguuacacagcugag

SEQ ID NO: 128969 - RNA, 22 nt, Human
cugcccaggcugaaggaacauc

SEQ ID NO: 128970 - RNA, 19 nt, Human
gggcucuggccucaguggg

SEQ ID NO: 128971 - RNA, 22 nt, Human
cugggcugcgggcgccccucca

SEQ ID NO: 128972 - RNA, 22 nt, Human
aggcacugaagugguaaaugua

SEQ ID NO: 128973 - RNA, 22 nt, Human
agcaggguuccaggaguugcag

SEQ ID NO: 128974 - RNA, 22 nt, Human
cuguggaaauaaacaaugcuaa

SEQ ID NO: 128975 - RNA, 22 nt, Human
uagucuuuugagaaguauaucu

SEQ ID NO: 128976 - RNA, 22 nt, Human
aaugaacacagcccucuacuuu

SEQ ID NO: 128977 - RNA, 22 nt, Human
gggcuggcucugucuagaaagg

SEQ ID NO: 128978 - RNA, 22 nt, Human
agugugcugcuuaaacaguugu

SEQ ID NO: 128979 - RNA, 22 nt, Human
acacaugagaaacaucaguugu

SEQ ID NO: 128980 - RNA, 22 nt, Human
uucuggagcuaaaguccacucu

SEQ ID NO: 128981 - RNA, 22 nt, Human
ucaucaaagcgcuuggaguagg

SEQ ID NO: 128982 - RNA, 22 nt, Human
uggagccagagcgcagccuggg

SEQ ID NO: 128983 - RNA, 22 nt, Human
agugugugcaugcauucgugca

SEQ ID NO: 128984 - RNA, 22 nt, Human
ggaggacaggggcugcagcaca

SEQ ID NO: 128985 - RNA, 22 nt, Human
uucaggaucauuuguuuuaucu

SEQ ID NO: 128986 - RNA, 22 nt, Human
uaucuugagagacaacacagca

SEQ ID NO: 128987 - RNA, 22 nt, Human
ccagugggugcugggcucugcc

SEQ ID NO: 128988 - RNA, 22 nt, Human
cagagcucuauguucauggagg

SEQ ID NO: 128989 - RNA, 22 nt, Human
cagaagcauuccagcaaauagu

SEQ ID NO: 128990 - RNA, 20 nt, Human
gugcauuucaccuguacugu

SEQ ID NO: 128991 - RNA, 22 nt, Human
aggcccuguuaugagccacugu

SEQ ID NO: 128992 - RNA, 22 nt, Human
gggagggaggugcugguucacg

SEQ ID NO: 128993 - RNA, 22 nt, Human
aggcuguguaaagugcuuuccc

SEQ ID NO: 128994 - RNA, 22 nt, Human
agagccagcauuugacacuggc

SEQ ID NO: 128995 - RNA, 22 nt, Human
caggggccaggcugucugcugu

SEQ ID NO: 128996 - RNA, 22 nt, Human
ccagcucugccaagcgucagcu

SEQ ID NO: 128997 - RNA, 22 nt, Human
aacagaaaagguagguggcuuu

SEQ ID NO: 128998 - RNA, 22 nt, Human
agaaaauauucauugagaggcu

SEQ ID NO: 128999 - RNA, 22 nt, Human
aauagguagccagauauauaaa

SEQ ID NO: 129000 - RNA, 22 nt, Human
cuugccuguggcuaguuggcuc

SEQ ID NO: 129001 - RNA, 22 nt, Human
ccacagggugucaucagcuuga

SEQ ID NO: 129002 - RNA, 22 nt, Human
cagcugcaggaacaaaaaugug

SEQ ID NO: 129003 - RNA, 22 nt, Human
agcugcccugggucuugcugcu

SEQ ID NO: 129004 - RNA, 18 nt, Human
cucucuuuccacucuuug

SEQ ID NO: 129005 - RNA, 22 nt, Human
uggggcugaggagccucacucu

SEQ ID NO: 129006 - RNA, 18 nt, Human
ucaaagucuggcuccacu

SEQ ID NO: 129007 - RNA, 22 nt, Human
cugaagccaugugcucacuggu

SEQ ID NO: 129008 - RNA, 20 nt, Human
cuuugccuauucucugccug

SEQ ID NO: 129009 - RNA, 22 nt, Human
cagcugccaagaaucuuuucua

SEQ ID NO: 129010 - RNA, 22 nt, Human
aggagagucuugagucacuggu

SEQ ID NO: 129011 - RNA, 22 nt, Human
aaugcugcucucauaauuauag

SEQ ID NO: 129012 - RNA, 22 nt, Human
cagccugcccuggaagcccagc

SEQ ID NO: 129013 - RNA, 22 nt, Human
agcagcauuaagggaacugcag

SEQ ID NO: 129014 - RNA, 22 nt, Human
cuggaaauuggagaugauguuu

SEQ ID NO: 129015 - RNA, 22 nt, Human
acuuugaaacuaaaauucauua

SEQ ID NO: 129016 - RNA, 22 nt, Human
cugcaggaauucaaagugagcu

SEQ ID NO: 129017 - RNA, 22 nt, Human
gcccucagaguuccccacagug

SEQ ID NO: 129018 - RNA, 22 nt, Human
acagacauuuucuguauugccu

SEQ ID NO: 129019 - RNA, 22 nt, Human
aguaacuaugcuugagaaucag

SEQ ID NO: 129020 - RNA, 22 nt, Human
aaaucaguucacguucugaggu

SEQ ID NO: 129021 - RNA, 22 nt, Human
uggcuuccacugugugcccccu

SEQ ID NO: 129022 - RNA, 22 nt, Human
agcuggccuuagugagcaccug

SEQ ID NO: 129023 - RNA, 22 nt, Human
uuauuauaaugagggauaaaaa

SEQ ID NO: 129024 - RNA, 22 nt, Human
uggcucagucuggguugacuga

SEQ ID NO: 129025 - RNA, 22 nt, Human
aguuuucugauguguagugaga

SEQ ID NO: 129026 - RNA, 22 nt, Human
auuuuuucagauugaguguuaa

SEQ ID NO: 129027 - RNA, 22 nt, Human
uuucaguguaagguuuccagga

SEQ ID NO: 129028 - RNA, 22 nt, Human
gggcugcacagaucuucaaggg

SEQ ID NO: 129029 - RNA, 18 nt, Human
guucaaggucaagagaga

SEQ ID NO: 129030 - RNA, 22 nt, Human
uucagucagugacuaagcaguu

SEQ ID NO: 129031 - RNA, 22 nt, Human
acauuucuaauuuaauguaaca

SEQ ID NO: 129032 - RNA, 22 nt, Human
gggguugguuuaaaugcuugag

SEQ ID NO: 129033 - RNA, 22 nt, Human
agggaagaaaauccaucgcugc

SEQ ID NO: 129034 - RNA, 22 nt, Human
ugggccuggaguuuguccagag

SEQ ID NO: 129035 - RNA, 22 nt, Human
ggcucugcccagguggacagca

SEQ ID NO: 129036 - RNA, 22 nt, Human
agugaaaacacuaguucuugcc

SEQ ID NO: 129037 - RNA, 22 nt, Human
agggcaaguugagugugcgugg

SEQ ID NO: 129038 - RNA, 22 nt, Human
cggggcugcucguccuccugug

SEQ ID NO: 129039 - RNA, 20 nt, Human
guccugggagccacagcaca

SEQ ID NO: 129040 - RNA, 22 nt, Human
ccagcugcugugcagggaggcu

SEQ ID NO: 129041 - RNA, 22 nt, Human
accagcuguguccuggcugcag

SEQ ID NO: 129042 - RNA, 22 nt, Human
uuugcauuugcaaauaaugaaa

SEQ ID NO: 129043 - RNA, 22 nt, Human
acuggcugaaguuuacuuuuug

SEQ ID NO: 129044 - RNA, 22 nt, Human
cauaucccauuggccaggacau

SEQ ID NO: 129045 - RNA, 22 nt, Human
uuccaagaguaaauucaaauug

SEQ ID NO: 129046 - RNA, 22 nt, Human
ugguggcaauguccuggagaag

SEQ ID NO: 129047 - RNA, 19 nt, Human
cugcucaggucagucuguc

SEQ ID NO: 129048 - RNA, 22 nt, Human
ggcugccuucagacuccagcuu

SEQ ID NO: 129049 - RNA, 22 nt, Human
auacaguaauuuguaacucauc

SEQ ID NO: 129050 - RNA, 19 nt, Human
auaaggcaggaggaaauuu

SEQ ID NO: 129051 - RNA, 22 nt, Human
guuauuuucauuggcucagacu

SEQ ID NO: 129052 - RNA, 22 nt, Human
aucucuuugauggcuccuguga

SEQ ID NO: 129053 - RNA, 22 nt, Human
ugggcagagaguagaggcaacg

SEQ ID NO: 129054 - RNA, 22 nt, Human
cuacauuuuaauaagcugcuua

SEQ ID NO: 129055 - RNA, 22 nt, Human
aaggcugagggcuguaccuggc

SEQ ID NO: 129056 - RNA, 22 nt, Human
auauuuuuccaugugggacucu

SEQ ID NO: 129057 - RNA, 22 nt, Human
ggcucaggacacagugguuuag

SEQ ID NO: 129058 - RNA, 22 nt, Human
uuauacagggaguuucccugca

SEQ ID NO: 129059 - RNA, 22 nt, Human
ggcugccuucccugagccccgg

SEQ ID NO: 129060 - RNA, 22 nt, Human
gccuuccuuacaccugcucagc

SEQ ID NO: 129061 - RNA, 22 nt, Human
gcuggcaccugcaccaagcagg

SEQ ID NO: 129062 - RNA, 22 nt, Human
ggucccaggaagugcggcggcg

SEQ ID NO: 129063 - RNA, 22 nt, Human
ccucccucuuucagucccacag

SEQ ID NO: 129064 - RNA, 22 nt, Human
cuguggaauugaugcuuagugu

SEQ ID NO: 129065 - RNA, 19 nt, Human
gcuccugggccucacucau

SEQ ID NO: 129066 - RNA, 22 nt, Human
ucauugaauuucacagcuuuau

SEQ ID NO: 129067 - RNA, 22 nt, Human
gaggcucugugaugugccaggc

SEQ ID NO: 129068 - RNA, 22 nt, Human
cugcccugaccugccucagagu

SEQ ID NO: 129069 - RNA, 22 nt, Human
ucagagaugcagugccaccuac

SEQ ID NO: 129070 - RNA, 18 nt, Human
uguuuauuuuucucuuac

SEQ ID NO: 129071 - RNA, 22 nt, Human
cacacaugagucuccccauugg

SEQ ID NO: 129072 - RNA, 22 nt, Human
agcugucagugcugugccugua

SEQ ID NO: 129073 - RNA, 22 nt, Human
gagaagguggaccugaaggagc

SEQ ID NO: 129074 - RNA, 22 nt, Human
auaauuuacaacugcuuuuaau

SEQ ID NO: 129075 - RNA, 22 nt, Human
uuugaaaggguuaugagacuga

SEQ ID NO: 129076 - RNA, 22 nt, Human
gcuccaggagagggaagcagau

SEQ ID NO: 129077 - RNA, 22 nt, Human
ugggcagauguccucugaagug

SEQ ID NO: 129078 - RNA, 22 nt, Human
uggagcaagcuggagagaacau

SEQ ID NO: 129079 - RNA, 18 nt, Human
uggguggcuagggaguuu

SEQ ID NO: 129080 - RNA, 22 nt, Human
aucuuuacuuucagugcugagc

SEQ ID NO: 129081 - RNA, 22 nt, Human
cccagguggguuggccucuguc

SEQ ID NO: 129082 - RNA, 22 nt, Human
gaaggagacccugaagaugcug

SEQ ID NO: 129083 - RNA, 22 nt, Human
gcucucagguacaaagcugugu

SEQ ID NO: 129084 - RNA, 22 nt, Human
aaggugucacugggacaggaaa

SEQ ID NO: 129085 - RNA, 22 nt, Human
ugugcuucaucacuucucaguu

SEQ ID NO: 129086 - RNA, 22 nt, Human
uuaguuuucucaucuaucucac

SEQ ID NO: 129087 - RNA, 22 nt, Human
gcucccuguucucagccaugau

SEQ ID NO: 129088 - RNA, 20 nt, Human
cugugcuuuggaaccuggaa

SEQ ID NO: 129089 - RNA, 22 nt, Human
uucuucaaacaaaaguggcaug

SEQ ID NO: 129090 - RNA, 22 nt, Human
gcagggcacagacagugccaag

SEQ ID NO: 129091 - RNA, 22 nt, Human
uauuuccugcauggugauguaa

SEQ ID NO: 129092 - RNA, 22 nt, Human
acaccagggccuagccagggcg

SEQ ID NO: 129093 - RNA, 22 nt, Human
agggcucugagugggaaagagg

SEQ ID NO: 129094 - RNA, 22 nt, Human
ucugcucagugcuuaucucuaa

SEQ ID NO: 129095 - RNA, 22 nt, Human
aaaaugugcaguuuuuaagcug

SEQ ID NO: 129096 - RNA, 22 nt, Human
acagugucaugucguguucccc

SEQ ID NO: 129097 - RNA, 22 nt, Human
aaaaaucuaugacugcuucucc

SEQ ID NO: 129098 - RNA, 22 nt, Human
agaggcaguauacaauccgagc

SEQ ID NO: 129099 - RNA, 22 nt, Human
auuucagaugaccaaauggaaa

SEQ ID NO: 129100 - RNA, 22 nt, Human
acucugugugaguagagccugu

SEQ ID NO: 129101 - RNA, 22 nt, Human
ccugggcuucugucuagauguu

SEQ ID NO: 129102 - RNA, 22 nt, Human
acacagccaggguaguaaggcu

SEQ ID NO: 129103 - RNA, 18 nt, Human
gagacacaagggccugga

SEQ ID NO: 129104 - RNA, 22 nt, Human
agcagagaagacacaggcuuca

SEQ ID NO: 129105 - RNA, 22 nt, Human
ucagugcagaauagugaugcau

SEQ ID NO: 129106 - RNA, 22 nt, Human
aggcucagcccaagguggagag

SEQ ID NO: 129107 - RNA, 22 nt, Human
gccuggcuccuaaggacuggcu

SEQ ID NO: 129108 - RNA, 22 nt, Human
agggucaggagacacuggcaac

SEQ ID NO: 129109 - RNA, 22 nt, Human
guggcucuccauugacauggaa

SEQ ID NO: 129110 - RNA, 22 nt, Human
uggcagugugugagcuguuauu

SEQ ID NO: 129111 - RNA, 22 nt, Human
uucucuucuguucagugcccaa

SEQ ID NO: 129112 - RNA, 22 nt, Human
gcaaggagacuguagggccaag

SEQ ID NO: 129113 - RNA, 22 nt, Human
ccaccagcuuugccacccugcu

SEQ ID NO: 129114 - RNA, 22 nt, Human
ucuguguaagaccagugcuggg

SEQ ID NO: 129115 - RNA, 22 nt, Human
ggcugccugugcccaggcacac

SEQ ID NO: 129116 - RNA, 22 nt, Human
acauugaucagccucccaugca

SEQ ID NO: 129117 - RNA, 23 nt, Human
ggucccaguggagaggccucacc

SEQ ID NO: 129118 - RNA, 22 nt, Human
acucaggaagaaagcagcuggu

SEQ ID NO: 129119 - RNA, 22 nt, Human
acuuccuguguuggucuugcug

SEQ ID NO: 129120 - RNA, 22 nt, Human
agggcugcaucugccuggugaa

SEQ ID NO: 129121 - RNA, 22 nt, Human
caaaguuaucaacugcaacauu

SEQ ID NO: 129122 - RNA, 22 nt, Human
acaugucaauuuaguacucuua

SEQ ID NO: 129123 - RNA, 22 nt, Human
caucaucaaaagugacagagaa

SEQ ID NO: 129124 - RNA, 22 nt, Human
ucuuuaaggugauuucugcuac

SEQ ID NO: 129125 - RNA, 22 nt, Human
ugggccugacucaccugccucc

SEQ ID NO: 129126 - RNA, 22 nt, Human
cugguguggcggcgcccuguag

SEQ ID NO: 129127 - RNA, 22 nt, Human
ugacacagaaauuaagcuguca

SEQ ID NO: 129128 - RNA, 22 nt, Human
ucaagagagugcugcuuggggu

SEQ ID NO: 129129 - RNA, 22 nt, Human
ugugucugaacuaguugcucuc

SEQ ID NO: 129130 - RNA, 22 nt, Human
gcucccagcauugcuucccagg

SEQ ID NO: 129131 - RNA, 22 nt, Human
aucccuggacggcgccucccca

SEQ ID NO: 129132 - RNA, 22 nt, Human
ggaggccaggaaggcucggaga

SEQ ID NO: 129133 - RNA, 22 nt, Human
ggccaggcuggucucagacuuc

SEQ ID NO: 129134 - RNA, 22 nt, Human
ucucagagcaucauuuucuuag

SEQ ID NO: 129135 - RNA, 22 nt, Human
ucaagagacaggacguguuuca

SEQ ID NO: 129136 - RNA, 21 nt, Human
uaaauaauaaguugcugagau

SEQ ID NO: 129137 - RNA, 22 nt, Human
agcaccugcacaguggaggaaa

SEQ ID NO: 129138 - RNA, 22 nt, Human
cacugcuuuuuuggcuauguac

SEQ ID NO: 129139 - RNA, 22 nt, Human
uaauacuuuugccuuguauuca

SEQ ID NO: 129140 - RNA, 22 nt, Human
agccagccaguucacuaggaaa

SEQ ID NO: 129141 - RNA, 22 nt, Human
gagacacacacaggagguggca

SEQ ID NO: 129142 - RNA, 23 nt, Human
uggugccucagaagcagugggcu

SEQ ID NO: 129143 - RNA, 22 nt, Human
agggcagauggaacuuccccga

SEQ ID NO: 129144 - RNA, 22 nt, Human
agcuucuuggcucagcacuugg

SEQ ID NO: 129145 - RNA, 22 nt, Human
agauaauuugaguaaauuaauu

SEQ ID NO: 129146 - RNA, 22 nt, Human
ugggugggagcacccugucugg

SEQ ID NO: 129147 - RNA, 22 nt, Human
ucuuccaguguagacaucugcc

SEQ ID NO: 129148 - RNA, 22 nt, Human
ggcuggcuggcugguagacaag

SEQ ID NO: 129149 - RNA, 22 nt, Human
uccaguggcacuggagacuaga

SEQ ID NO: 129150 - RNA, 21 nt, Human
cugcuuuacuucagaggaucu

SEQ ID NO: 129151 - RNA, 22 nt, Human
uacauguaggugacauuuuaau

SEQ ID NO: 129152 - RNA, 22 nt, Human
uuauucuucuucucuugccagg

SEQ ID NO: 129153 - RNA, 22 nt, Human
agggcuggagccacagcuggga

SEQ ID NO: 129154 - RNA, 22 nt, Human
cccagggucccugcucucugug

SEQ ID NO: 129155 - RNA, 22 nt, Human
aguuuuucugggaggcacugcu

SEQ ID NO: 129156 - RNA, 23 nt, Human
cauuucugggagauuuauaaaau

SEQ ID NO: 129157 - RNA, 23 nt, Human
gcucugagggcuuaucccuccca

SEQ ID NO: 129158 - RNA, 22 nt, Human
aaggcucucugauggcagcagu

SEQ ID NO: 129159 - RNA, 22 nt, Human
gccuggagcuacuggacacuga

SEQ ID NO: 129160 - RNA, 22 nt, Human
cuggcagcguguuuaugaacau

SEQ ID NO: 129161 - RNA, 20 nt, Human
uucuuucaucuacacguugu

SEQ ID NO: 129162 - RNA, 22 nt, Human
gagaaacuuggaguuauucugg

SEQ ID NO: 129163 - RNA, 22 nt, Human
ggaugcaggggcagcagagccu

SEQ ID NO: 129164 - RNA, 22 nt, Human
ucugucacuauuggccagaaca

SEQ ID NO: 129165 - RNA, 22 nt, Human
ucucccagaggaucccagugga

SEQ ID NO: 129166 - RNA, 22 nt, Human
gcucucugccuuucucaaugac

SEQ ID NO: 129167 - RNA, 22 nt, Human
ucuuuacuuguguauuguauau

SEQ ID NO: 129168 - RNA, 22 nt, Human
aucuggcuccuacacuugaaga

SEQ ID NO: 129169 - RNA, 22 nt, Human
agggacaguuacaucaucagac

SEQ ID NO: 129170 - RNA, 22 nt, Human
gugugcugagugacugucauca

SEQ ID NO: 129171 - RNA, 22 nt, Human
aauugugcuaugauuaugaaag

SEQ ID NO: 129172 - RNA, 22 nt, Human
cuucagggugacgcaggcugca

SEQ ID NO: 129173 - RNA, 22 nt, Human
ccugugugcugaugacgacaga

SEQ ID NO: 129174 - RNA, 22 nt, Human
aaaaaugugaccacaggguguu

SEQ ID NO: 129175 - RNA, 21 nt, Human
ucagggcagugggagguuccu

SEQ ID NO: 129176 - RNA, 22 nt, Human
ugaagcaguucucagaaguggg

SEQ ID NO: 129177 - RNA, 22 nt, Human
uucaucaauguguuuaauaaug

SEQ ID NO: 129178 - RNA, 22 nt, Human
gcuggagcugcagccugggccu

SEQ ID NO: 129179 - RNA, 22 nt, Human
gccuuucaguuccaucaaagga

SEQ ID NO: 129180 - RNA, 22 nt, Human
cugagccaguagucagggacaa

SEQ ID NO: 129181 - RNA, 22 nt, Human
auacauauaugguacuuccugg

SEQ ID NO: 129182 - RNA, 22 nt, Human
cauguauauuuuauguggagag

SEQ ID NO: 129183 - RNA, 22 nt, Human
uggcgugcccuccagacuuggc

SEQ ID NO: 129184 - RNA, 22 nt, Human
ugcuagaaaucugaaacuagca

SEQ ID NO: 129185 - RNA, 22 nt, Human
aguggcuggaauugcaggugcg

SEQ ID NO: 129186 - RNA, 22 nt, Human
aagcugccuagaguugaauguc

SEQ ID NO: 129187 - RNA, 22 nt, Human
guuacaguuugggcuugauuca

SEQ ID NO: 129188 - RNA, 21 nt, Human
aaucauacaaaacaugucagg

SEQ ID NO: 129189 - RNA, 22 nt, Human
auuuacagccuugaaaacagca

SEQ ID NO: 129190 - RNA, 23 nt, Human
gggggcugguugacucucugcag

SEQ ID NO: 129191 - RNA, 22 nt, Human
cugccuuggaaaaugugguaau

SEQ ID NO: 129192 - RNA, 22 nt, Human
gagagugaggccugggaaucua

SEQ ID NO: 129193 - RNA, 22 nt, Human
uccaggagguuuggaggaagca

SEQ ID NO: 129194 - RNA, 22 nt, Human
cuguggcugcagaccuuaaaca

SEQ ID NO: 129195 - RNA, 22 nt, Human
gcccuuccuuagacagcaggau

SEQ ID NO: 129196 - RNA, 22 nt, Human
uuacaguccuuuguauuguuua

SEQ ID NO: 129197 - RNA, 22 nt, Human
uuucuucacaggguauugggug

SEQ ID NO: 129198 - RNA, 22 nt, Human
gucucagaguccuacuuauucc

SEQ ID NO: 129199 - RNA, 22 nt, Human
ccugucugcaugaucccugcca

SEQ ID NO: 129200 - RNA, 22 nt, Human
ucagggcauccauugccuguug

SEQ ID NO: 129201 - RNA, 21 nt, Human
ucagaguguguuacagcaagc

SEQ ID NO: 129202 - RNA, 22 nt, Human
uugucuguaaagacggccacca

SEQ ID NO: 129203 - RNA, 22 nt, Human
gcugucuggguugagggcccug

SEQ ID NO: 129204 - RNA, 22 nt, Human
augcugcacaagccacauguag

SEQ ID NO: 129205 - RNA, 22 nt, Human
cccucagcuucucccugcagcu

SEQ ID NO: 129206 - RNA, 22 nt, Human
ucuuuccacauucucuguuuag

SEQ ID NO: 129207 - RNA, 22 nt, Human
ucucuggaauuuugagagugac

SEQ ID NO: 129208 - RNA, 20 nt, Human
ugugugcacacaugacauuc

SEQ ID NO: 129209 - RNA, 22 nt, Human
cacugaaggacaguaggaaggg

SEQ ID NO: 129210 - RNA, 22 nt, Human
uccuuuccaugcuucuagaggc

SEQ ID NO: 129211 - RNA, 22 nt, Human
gguguguagcauguuuaagacc

SEQ ID NO: 129212 - RNA, 22 nt, Human
acuuccuggcguagcugacauu

SEQ ID NO: 129213 - RNA, 22 nt, Human
caguauuuuuaagcugcuuugu

SEQ ID NO: 129214 - RNA, 22 nt, Human
agcugcugaaugacacugcaag

SEQ ID NO: 129215 - RNA, 22 nt, Human
ucagagaguuggaaagaauuaa

SEQ ID NO: 129216 - RNA, 19 nt, Human
uauauuugagugugcaugc

SEQ ID NO: 129217 - RNA, 22 nt, Human
cugugugugagaagcagguuga

SEQ ID NO: 129218 - RNA, 22 nt, Human
gcagcugggacacugaggccag

SEQ ID NO: 129219 - RNA, 18 nt, Human
acagaacucaggggcacc

SEQ ID NO: 129220 - RNA, 22 nt, Human
acauuugaggauguuaagaaug

SEQ ID NO: 129221 - RNA, 22 nt, Human
aauggacaggagagcauaguca

SEQ ID NO: 129222 - RNA, 22 nt, Human
uugaacaguuuugucagguuca

SEQ ID NO: 129223 - RNA, 22 nt, Human
agggcugccauuucuggcccaa

SEQ ID NO: 129224 - RNA, 22 nt, Human
gcugccucugcgacucugggcg

SEQ ID NO: 129225 - RNA, 22 nt, Human
cugccaaggcuggggaggacaa

SEQ ID NO: 129226 - RNA, 22 nt, Human
cugcagcuguagaggacagugg

SEQ ID NO: 129227 - RNA, 22 nt, Human
guguguccucaguaguggcaug

SEQ ID NO: 129228 - RNA, 22 nt, Human
gagcagaacaggccggguggga

SEQ ID NO: 129229 - RNA, 22 nt, Human
agcuucuguucaucuuccaggc

SEQ ID NO: 129230 - RNA, 22 nt, Human
gugguaauagagcuccaaacua

SEQ ID NO: 129231 - RNA, 20 nt, Human
cacaggcuauaugagagcca

SEQ ID NO: 129232 - RNA, 22 nt, Human
uccaugagacagauacuguaag

SEQ ID NO: 129233 - RNA, 22 nt, Human
guuuucucaggaugguguguac

SEQ ID NO: 129234 - RNA, 22 nt, Human
uugugugguagcuucauugaac

SEQ ID NO: 129235 - RNA, 22 nt, Human
uuucacauaugguuguugauug

SEQ ID NO: 129236 - RNA, 22 nt, Human
ucagagaggcaauacuguuuaa

SEQ ID NO: 129237 - RNA, 22 nt, Human
agaugaagacucaggagcaggu

SEQ ID NO: 129238 - RNA, 22 nt, Human
auuugcuuuaagguauaaaagg

SEQ ID NO: 129239 - RNA, 22 nt, Human
gagagcacaugaacauggagga

SEQ ID NO: 129240 - RNA, 22 nt, Human
ucuggcaggcaaucggcucugg

SEQ ID NO: 129241 - RNA, 22 nt, Human
aaaauguaaagcuugaguguag

SEQ ID NO: 129242 - RNA, 22 nt, Human
gccugagccgccugagcggcgg

SEQ ID NO: 129243 - RNA, 22 nt, Human
aggaggcccuagagcucuagag

SEQ ID NO: 129244 - RNA, 22 nt, Human
auguguauuaguuaguuuaaug

SEQ ID NO: 129245 - RNA, 22 nt, Human
ucccuggagauaacuucuggga

SEQ ID NO: 129246 - RNA, 22 nt, Human
uagccgggugugguggaacucc

SEQ ID NO: 129247 - RNA, 22 nt, Human
agccaggauuggcugagccuua

SEQ ID NO: 129248 - RNA, 23 nt, Human
cccuguagcccaggacaggcuuu

SEQ ID NO: 129249 - RNA, 22 nt, Human
uuuauguacauauccacaagga

SEQ ID NO: 129250 - RNA, 22 nt, Human
auacaguaauugcauaggcuuc

SEQ ID NO: 129251 - RNA, 22 nt, Human
ucaggauguccaaaauccagcc

SEQ ID NO: 129252 - RNA, 22 nt, Human
ggcagaaggccucccagcuccu

SEQ ID NO: 129253 - RNA, 22 nt, Human
gaaaggucaguuccacuuccau

SEQ ID NO: 129254 - RNA, 22 nt, Human
uuugcauucuagaaaaauuucu

SEQ ID NO: 129255 - RNA, 22 nt, Human
gcuggguggaucggaggcucug

SEQ ID NO: 129256 - RNA, 22 nt, Human
gaggucaggcuugcagcagggu

SEQ ID NO: 129257 - RNA, 22 nt, Human
gggcuucucccuaaggacucug

SEQ ID NO: 129258 - RNA, 22 nt, Human
ucacauuuucuacuacuguacg

SEQ ID NO: 129259 - RNA, 22 nt, Human
uuggcuguuuuaucuccuggug

SEQ ID NO: 129260 - RNA, 20 nt, Human
ucaggcaguggggaaaggca

SEQ ID NO: 129261 - RNA, 22 nt, Human
aguagauucucauugaucuggu

SEQ ID NO: 129262 - RNA, 22 nt, Human
ucaccacugaacagaccuuugg

SEQ ID NO: 129263 - RNA, 22 nt, Human
caugggagcuaucuccaucacu

SEQ ID NO: 129264 - RNA, 22 nt, Human
cuggugccauucuguggccuag

SEQ ID NO: 129265 - RNA, 22 nt, Human
ccaggacuuauuacaguauaac

SEQ ID NO: 129266 - RNA, 22 nt, Human
cccagcuaccucugcuaggaga

SEQ ID NO: 129267 - RNA, 22 nt, Human
cagggcaguaccgcccucuggc

SEQ ID NO: 129268 - RNA, 22 nt, Human
acagucuacaaagugaugugug

SEQ ID NO: 129269 - RNA, 19 nt, Human
uuucaauggcuuagagaaa

SEQ ID NO: 129270 - RNA, 22 nt, Human
gcugcagcagaaguucucagag

SEQ ID NO: 129271 - RNA, 22 nt, Human
ccucugggagacugcuacugag

SEQ ID NO: 129272 - RNA, 22 nt, Human
gggaguguugagcgcccugcca

SEQ ID NO: 129273 - RNA, 22 nt, Human
ccucagagccuccagaaggaau

SEQ ID NO: 129274 - RNA, 22 nt, Human
agacaggcagaggcugcagagg

SEQ ID NO: 129275 - RNA, 23 nt, Human
cugucuccugggcuagguggaau

SEQ ID NO: 129276 - RNA, 22 nt, Human
acugagcugugacaaugcuuaa

SEQ ID NO: 129277 - RNA, 22 nt, Human
agcagggggaguuagacuagau

SEQ ID NO: 129278 - RNA, 21 nt, Human
ugagagccuccaaccggcuac

SEQ ID NO: 129279 - RNA, 22 nt, Human
ccuggcugucguuuugugaaau

SEQ ID NO: 129280 - RNA, 22 nt, Human
gcagggacaaggcagguguucu

SEQ ID NO: 129281 - RNA, 22 nt, Human
aucuucaacuugaucauuugaa

SEQ ID NO: 129282 - RNA, 22 nt, Human
ucaugcccagagcaguaaauua

SEQ ID NO: 129283 - RNA, 22 nt, Human
caggaaggcccaccuguccugu

SEQ ID NO: 129284 - RNA, 22 nt, Human
uguauguguggauagauguaua

SEQ ID NO: 129285 - RNA, 22 nt, Human
guguaucaaagcacagacuuca

SEQ ID NO: 129286 - RNA, 22 nt, Human
ugucacuucaggaaugcaggga

SEQ ID NO: 129287 - RNA, 22 nt, Human
aucuuuacaagaaauucuuuua

SEQ ID NO: 129288 - RNA, 22 nt, Human
ucucuguaguugggcagcugcu

SEQ ID NO: 129289 - RNA, 22 nt, Human
aaugucugagucucuguauccc

SEQ ID NO: 129290 - RNA, 22 nt, Human
uucuaugccauguucagcuacu

SEQ ID NO: 129291 - RNA, 22 nt, Human
aucaguuucacuugcuugcaaa

SEQ ID NO: 129292 - RNA, 22 nt, Human
gggcugugagaguggggcugcu

SEQ ID NO: 129293 - RNA, 22 nt, Human
aguauauuuguuaagauuauuc

SEQ ID NO: 129294 - RNA, 22 nt, Human
uuucucaucuggaaacagugcu

SEQ ID NO: 129295 - RNA, 22 nt, Human
cauuuguauguuccuccuuagg

SEQ ID NO: 129296 - RNA, 22 nt, Human
gcagaggccaucaacuuugcca

SEQ ID NO: 129297 - RNA, 22 nt, Human
cugucucuguugccuguaggug

SEQ ID NO: 129298 - RNA, 22 nt, Human
ggcuucagugagcugagcucac

SEQ ID NO: 129299 - RNA, 22 nt, Human
ugacacaggcagcucccagcac

SEQ ID NO: 129300 - RNA, 22 nt, Human
agucaguggcuccgagccuggu

SEQ ID NO: 129301 - RNA, 22 nt, Human
ggagcauguggggugagcaggg

SEQ ID NO: 129302 - RNA, 22 nt, Human
aggucauuggggacuaucuccg

SEQ ID NO: 129303 - RNA, 22 nt, Human
ggcugccaggagggaggccagu

SEQ ID NO: 129304 - RNA, 22 nt, Human
ucauaacagcuaagucccuuuc

SEQ ID NO: 129305 - RNA, 19 nt, Human
agggaguuuauauuugcac

SEQ ID NO: 129306 - RNA, 22 nt, Human
agaggccuccgaaaggugggcu

SEQ ID NO: 129307 - RNA, 22 nt, Human
acagaauucucucugcagaggc

SEQ ID NO: 129308 - RNA, 22 nt, Human
cacagggcagugcugcccacuc

SEQ ID NO: 129309 - RNA, 22 nt, Human
ggcuucccuuuccgagaggaga

SEQ ID NO: 129310 - RNA, 22 nt, Human
ugaggcuggcaaggcugguauu

SEQ ID NO: 129311 - RNA, 22 nt, Human
uuuucaguuugcacugcagugc

SEQ ID NO: 129312 - RNA, 19 nt, Human
gagcugccuuuugaagacc

SEQ ID NO: 129313 - RNA, 22 nt, Human
uacagucagagugccuuucuaa

SEQ ID NO: 129314 - RNA, 22 nt, Human
cacugccugugagcugugugcc

SEQ ID NO: 129315 - RNA, 22 nt, Human
uucaguauucaaauaugucuua

SEQ ID NO: 129316 - RNA, 22 nt, Human
ccagggugugagaaggaaguag

SEQ ID NO: 129317 - RNA, 22 nt, Human
augggcugugagguccggcagg

SEQ ID NO: 129318 - RNA, 22 nt, Human
uuugcauuuccagaguagcaga

SEQ ID NO: 129319 - RNA, 22 nt, Human
cccaggucuaugccagcucuga

SEQ ID NO: 129320 - RNA, 22 nt, Human
uacagcuaugucuugguguucu

SEQ ID NO: 129321 - RNA, 22 nt, Human
aaauuauucucauguguuucuu

SEQ ID NO: 129322 - RNA, 22 nt, Human
gccuggcacucacugaagaggc

SEQ ID NO: 129323 - RNA, 22 nt, Human
uaguaucuauuaguaacaagag

SEQ ID NO: 129324 - RNA, 22 nt, Human
uccugggaagagaccugagcau

SEQ ID NO: 129325 - RNA, 22 nt, Human
ccaggccugcaucugcugcgca

SEQ ID NO: 129326 - RNA, 22 nt, Human
uagcaggguccaaugugaggca

SEQ ID NO: 129327 - RNA, 22 nt, Human
gcuuccugucccucagccauga

SEQ ID NO: 129328 - RNA, 22 nt, Human
auguuaaaugguuuauuauuaa

SEQ ID NO: 129329 - RNA, 22 nt, Human
cacagggccuggggcagcugcu

SEQ ID NO: 129330 - RNA, 22 nt, Human
ucuacagugucaaugugucuug

SEQ ID NO: 129331 - RNA, 23 nt, Human
uugauacagaagaaucaguuugu

SEQ ID NO: 129332 - RNA, 22 nt, Human
ccaguggguaggccauggugag

SEQ ID NO: 129333 - RNA, 22 nt, Human
uauuucuguaugcauaaaagga

SEQ ID NO: 129334 - RNA, 22 nt, Human
agggagguaggagcuucuagcu

SEQ ID NO: 129335 - RNA, 22 nt, Human
uccuucaguuaaagaucucaca

SEQ ID NO: 129336 - RNA, 22 nt, Human
guggcugggcuccgagcggcuu

SEQ ID NO: 129337 - RNA, 22 nt, Human
gggucagcugcugggggcugac

SEQ ID NO: 129338 - RNA, 22 nt, Human
caugcacaaagguaagaugcgu

SEQ ID NO: 129339 - RNA, 22 nt, Human
uggcuuccgccgcgggccucgg

SEQ ID NO: 129340 - RNA, 22 nt, Human
cagagcuguccaaacccugaca

SEQ ID NO: 129341 - RNA, 22 nt, Human
ugcaggcuuuagccccauggcu

SEQ ID NO: 129342 - RNA, 22 nt, Human
augugucaauuuucaaaugcuu

SEQ ID NO: 129343 - RNA, 22 nt, Human
gugaaugcaaacuguuucugau

SEQ ID NO: 129344 - RNA, 22 nt, Human
cugggcuguaauguggcacuga

SEQ ID NO: 129345 - RNA, 17 nt, Human
agcagcuggcacaggag

SEQ ID NO: 129346 - RNA, 22 nt, Human
uggagcuggaauuugagcugga

SEQ ID NO: 129347 - RNA, 22 nt, Human
cagccagggagggcaaaugaga

SEQ ID NO: 129348 - RNA, 22 nt, Human
gccuggagagcacugugcgcuu

SEQ ID NO: 129349 - RNA, 17 nt, Human
ucuucucuuccagucuu

SEQ ID NO: 129350 - RNA, 22 nt, Human
ggccuuggggaggauggugucc

SEQ ID NO: 129351 - RNA, 22 nt, Human
aggcaucugaguuugcaagcuu

SEQ ID NO: 129352 - RNA, 22 nt, Human
uugcacuaggaaaaggcagcca

SEQ ID NO: 129353 - RNA, 22 nt, Human
ugcucuguaacaaauugacaug

SEQ ID NO: 129354 - RNA, 22 nt, Human
ucacaggguguacaucaccuau

SEQ ID NO: 129355 - RNA, 22 nt, Human
agaacuguccuuggaggagagu

SEQ ID NO: 129356 - RNA, 22 nt, Human
acucuuuagagguacaucucuu

SEQ ID NO: 129357 - RNA, 22 nt, Human
ggauggcaggacaaggacccag

SEQ ID NO: 129358 - RNA, 22 nt, Human
agagcugggugaagugccauca

SEQ ID NO: 129359 - RNA, 18 nt, Human
gcuuuuuagugcaucuuc

SEQ ID NO: 129360 - RNA, 22 nt, Human
uccuccuucgggacugcuugac

SEQ ID NO: 129361 - RNA, 23 nt, Human
agcacagacuagaaaggucuuuc

SEQ ID NO: 129362 - RNA, 22 nt, Human
uguugauuaguguuuagacuua

SEQ ID NO: 129363 - RNA, 22 nt, Human
guccaugauucugugacacccu

SEQ ID NO: 129364 - RNA, 22 nt, Human
ugcugccagggcucugcccaca

SEQ ID NO: 129365 - RNA, 22 nt, Human
ugcagaagaauguaggcauaag

SEQ ID NO: 129366 - RNA, 22 nt, Human
gagagugaugaaugguuaaaca

SEQ ID NO: 129367 - RNA, 23 nt, Human
ggccuccuggucuaggcuagacu

SEQ ID NO: 129368 - RNA, 22 nt, Human
agagaauuacagaagaauguca

SEQ ID NO: 129369 - RNA, 22 nt, Human
cuggagccccagacagggagag

SEQ ID NO: 129370 - RNA, 22 nt, Human
agugcauauaugaagaguauga

SEQ ID NO: 129371 - RNA, 22 nt, Human
acagagcaauaacagggagagg

SEQ ID NO: 129372 - RNA, 22 nt, Human
ugugcuucuugcagcuccugua

SEQ ID NO: 129373 - RNA, 22 nt, Human
ggccugggcccacugucaagag

SEQ ID NO: 129374 - RNA, 22 nt, Human
ggguacuuaauauuuacggggu

SEQ ID NO: 129375 - RNA, 22 nt, Human
cugcagagguugguucuaagau

SEQ ID NO: 129376 - RNA, 22 nt, Human
cccuggaggucagaggccuggg

SEQ ID NO: 129377 - RNA, 22 nt, Human
ucuucacauucacguaacauag

SEQ ID NO: 129378 - RNA, 22 nt, Human
ggucccaggauugguugcgcag

SEQ ID NO: 129379 - RNA, 22 nt, Human
cugaaggauucaaaauggcagg

SEQ ID NO: 129380 - RNA, 22 nt, Human
cuuuacacaaugauuuucuuua

SEQ ID NO: 129381 - RNA, 22 nt, Human
aaaggccacugcaagggaaggu

SEQ ID NO: 129382 - RNA, 22 nt, Human
gcucagaggagcaucauaagga

SEQ ID NO: 129383 - RNA, 22 nt, Human
aaauauaguaaaugcauaguuc

SEQ ID NO: 129384 - RNA, 22 nt, Human
cacugccuggaaggagagacau

SEQ ID NO: 129385 - RNA, 22 nt, Human
cacaauguauauguauaucaaa

SEQ ID NO: 129386 - RNA, 22 nt, Human
cuucuucacacuggucugaagc

SEQ ID NO: 129387 - RNA, 22 nt, Human
aggccuuccucggagacaggga

SEQ ID NO: 129388 - RNA, 22 nt, Human
cucugagcagaggccguggcua

SEQ ID NO: 129389 - RNA, 22 nt, Human
uuuuguauccucccuuucacug

SEQ ID NO: 129390 - RNA, 22 nt, Human
cucuccuuucacuaaauauucu

SEQ ID NO: 129391 - RNA, 22 nt, Human
acucccacuccagaguagaagc

SEQ ID NO: 129392 - RNA, 20 nt, Human
caucaucacaugagccaauu

SEQ ID NO: 129393 - RNA, 22 nt, Human
gccaggaguucagaugcauguu

SEQ ID NO: 129394 - RNA, 22 nt, Human
ugauugaacugagcuucaagau

SEQ ID NO: 129395 - RNA, 22 nt, Human
aaaggccagguuggcugguauu

SEQ ID NO: 129396 - RNA, 20 nt, Human
ccaggcacugucccaugcag

SEQ ID NO: 129397 - RNA, 22 nt, Human
uacaguauuacuguguuguuuu

SEQ ID NO: 129398 - RNA, 22 nt, Human
caggaggaggugagguagaacu

SEQ ID NO: 129399 - RNA, 22 nt, Human
aagccagggucaggggccuccu

SEQ ID NO: 129400 - RNA, 22 nt, Human
gcagcaugagcuauacaaagua

SEQ ID NO: 129401 - RNA, 22 nt, Human
aaagagcuucauuuccauuuau

SEQ ID NO: 129402 - RNA, 22 nt, Human
ucucauguauugcccuggugug

SEQ ID NO: 129403 - RNA, 22 nt, Human
uguucucucuggcugccaguac

SEQ ID NO: 129404 - RNA, 22 nt, Human
ggcaggagauaaaauauuaguu

SEQ ID NO: 129405 - RNA, 22 nt, Human
uauguacaucguugaauucaaa

SEQ ID NO: 129406 - RNA, 22 nt, Human
gccagggagucugggccacaga

SEQ ID NO: 129407 - RNA, 22 nt, Human
cugugcaguaggucagggcugg

SEQ ID NO: 129408 - RNA, 21 nt, Human
agauuguauggaggugagagg

SEQ ID NO: 129409 - RNA, 22 nt, Human
ucagaaauacuaucagcuuuug

SEQ ID NO: 129410 - RNA, 19 nt, Human
ccugggaggcggagguugc

SEQ ID NO: 129411 - RNA, 22 nt, Human
agacaaaugguaauuaugucua

SEQ ID NO: 129412 - RNA, 22 nt, Human
agagucuuccaggcagccugag

SEQ ID NO: 129413 - RNA, 22 nt, Human
gaaguucaggugggaauugagc

SEQ ID NO: 129414 - RNA, 21 nt, Human
gcagccagccgagaccaugcc

SEQ ID NO: 129415 - RNA, 22 nt, Human
cagugcagccaaggacaggcac

SEQ ID NO: 129416 - RNA, 22 nt, Human
aaggcugauuagacugauagcu

SEQ ID NO: 129417 - RNA, 22 nt, Human
uggagcagagaugguggccuuc

SEQ ID NO: 129418 - RNA, 22 nt, Human
augauggugagguugagcacag

SEQ ID NO: 129419 - RNA, 21 nt, Human
agccuggcccagggggaggcu

SEQ ID NO: 129420 - RNA, 22 nt, Human
uggccugaggcucggcaugggu

SEQ ID NO: 129421 - RNA, 22 nt, Human
gagagcuguccggcugagcagc

SEQ ID NO: 129422 - RNA, 22 nt, Human
aaggcaguagguguuucaaacu

SEQ ID NO: 129423 - RNA, 22 nt, Human
ugugccagaaaauaugcugagg

SEQ ID NO: 129424 - RNA, 22 nt, Human
gaugaggggucauuggcuggga

SEQ ID NO: 129425 - RNA, 22 nt, Human
aagagcuguaugccauaugauu

SEQ ID NO: 129426 - RNA, 22 nt, Human
cccuggccagcucaugucugag

SEQ ID NO: 129427 - RNA, 22 nt, Human
aaucgguugaacccaggaagug

SEQ ID NO: 129428 - RNA, 22 nt, Human
ccuuuuucaauauagaauugca

SEQ ID NO: 129429 - RNA, 22 nt, Human
ucaugacaacuauauuauucca

SEQ ID NO: 129430 - RNA, 22 nt, Human
agaugauggccauguccucucc

SEQ ID NO: 129431 - RNA, 22 nt, Human
ugaggcagaaauuccuguuuuc

SEQ ID NO: 129432 - RNA, 22 nt, Human
ggcacagggagccgcaguugca

SEQ ID NO: 129433 - RNA, 22 nt, Human
auuacaguaggauuggaaagga

SEQ ID NO: 129434 - RNA, 20 nt, Human
ccugccuguguuugugauga

SEQ ID NO: 129435 - RNA, 20 nt, Human
uaucaguaggauauucugcc

SEQ ID NO: 129436 - RNA, 22 nt, Human
cuccagggggcauccacacagc

SEQ ID NO: 129437 - RNA, 22 nt, Human
acagcagcuaaccccugggcca

SEQ ID NO: 129438 - RNA, 22 nt, Human
gcugugcacuaccuauacaucc

SEQ ID NO: 129439 - RNA, 22 nt, Human
uccuucagaggacggcagccag

SEQ ID NO: 129440 - RNA, 22 nt, Human
gcugggagucgcgucuguggcc

SEQ ID NO: 129441 - RNA, 23 nt, Human
ugcaggggaggcuuaaagcaggu

SEQ ID NO: 129442 - RNA, 18 nt, Human
ucuggcucaggacugaac

SEQ ID NO: 129443 - RNA, 22 nt, Human
caugugugaaucuugugaucau

SEQ ID NO: 129444 - RNA, 22 nt, Human
agcaggagaacacuguggcucu

SEQ ID NO: 129445 - RNA, 22 nt, Human
cugcccugcccaggccuugggc

SEQ ID NO: 129446 - RNA, 19 nt, Human
acccagagcccuuugcagg

SEQ ID NO: 129447 - RNA, 22 nt, Human
ucucagaggucuucagccucug

SEQ ID NO: 129448 - RNA, 21 nt, Human
gcagccacugccuucaacaau

SEQ ID NO: 129449 - RNA, 22 nt, Human
cagggccucuccuccaggaacu

SEQ ID NO: 129450 - RNA, 22 nt, Human
uuauguaauuuguuugcucuuc

SEQ ID NO: 129451 - RNA, 22 nt, Human
gcucucugguuccagucaggaa

SEQ ID NO: 129452 - RNA, 22 nt, Human
uccugucugucuuuggucccuu

SEQ ID NO: 129453 - RNA, 22 nt, Human
agggcugagacuaaggccagau

SEQ ID NO: 129454 - RNA, 22 nt, Human
gccaggcuguggggaacuugaa

SEQ ID NO: 129455 - RNA, 21 nt, Human
uggcucuggguaggagagugc

SEQ ID NO: 129456 - RNA, 22 nt, Human
ucaaaguuuguggcaauuuauu

SEQ ID NO: 129457 - RNA, 22 nt, Human
agccagggagguggagguugca

SEQ ID NO: 129458 - RNA, 22 nt, Human
cagagcugguaagugguagagg

SEQ ID NO: 129459 - RNA, 20 nt, Human
accucugcaucaauccuuug

SEQ ID NO: 129460 - RNA, 22 nt, Human
auugucucugaauuuucagcug

SEQ ID NO: 129461 - RNA, 22 nt, Human
agcugccacaugcccaagggca

SEQ ID NO: 129462 - RNA, 22 nt, Human
ggagggagcauccccuugcuga

SEQ ID NO: 129463 - RNA, 22 nt, Human
cuucccugauaagagccucaga

SEQ ID NO: 129464 - RNA, 21 nt, Human
uucaagauauuuaaaaggugg

SEQ ID NO: 129465 - RNA, 22 nt, Human
uccucaggugacuagguaucuu

SEQ ID NO: 129466 - RNA, 22 nt, Human
ucuucuuccuccacagggccca

SEQ ID NO: 129467 - RNA, 22 nt, Human
ucaucuaagagucuuacauuua

SEQ ID NO: 129468 - RNA, 22 nt, Human
gugccugccccacuccucagca

SEQ ID NO: 129469 - RNA, 22 nt, Human
gcucugagauugagccuuuggu

SEQ ID NO: 129470 - RNA, 18 nt, Human
gagcccugagucugcaca

SEQ ID NO: 129471 - RNA, 21 nt, Human
ugguggagugugcugagcaug

SEQ ID NO: 129472 - RNA, 22 nt, Human
ucacauuuucauauucucugag

SEQ ID NO: 129473 - RNA, 22 nt, Human
ugucagugguagacccagaggu

SEQ ID NO: 129474 - RNA, 22 nt, Human
gcaaggcuuugugaauuuuaaa

SEQ ID NO: 129475 - RNA, 22 nt, Human
gaggcagagugcaccccaggag

SEQ ID NO: 129476 - RNA, 22 nt, Human
ucucacucauuuccuaggucuu

SEQ ID NO: 129477 - RNA, 22 nt, Human
uuaacagauguuuauggagcau

SEQ ID NO: 129478 - RNA, 22 nt, Human
cuugcugggguaagucugugcu

SEQ ID NO: 129479 - RNA, 22 nt, Human
ccagcaggacuuuggaaauaug

SEQ ID NO: 129480 - RNA, 22 nt, Human
uccaugaggcagggaggcuggc

SEQ ID NO: 129481 - RNA, 21 nt, Human
uucuucaugaugauuaauggc

SEQ ID NO: 129482 - RNA, 22 nt, Human
agucccagagaggucggggcca

SEQ ID NO: 129483 - RNA, 22 nt, Human
ggccuguguccuccuugcccug

SEQ ID NO: 129484 - RNA, 22 nt, Human
uaucuguuccaggcacucagcu

SEQ ID NO: 129485 - RNA, 22 nt, Human
agucucugcaugccugcugugc

SEQ ID NO: 129486 - RNA, 22 nt, Human
gccucugcaggugcgguuaucc

SEQ ID NO: 129487 - RNA, 20 nt, Human
acugugugaucuggaaagcu

SEQ ID NO: 129488 - RNA, 22 nt, Human
uucuucaacaaggacacuguua

SEQ ID NO: 129489 - RNA, 22 nt, Human
ugcaagggcuuagggggcugug

SEQ ID NO: 129490 - RNA, 22 nt, Human
ugcuggccaauggcagaggcgg

SEQ ID NO: 129491 - RNA, 22 nt, Human
cagauggccagaggcagcugca

SEQ ID NO: 129492 - RNA, 22 nt, Human
uugauacauuuuuaggauaaac

SEQ ID NO: 129493 - RNA, 22 nt, Human
uacuuacagagcuuauaaguua

SEQ ID NO: 129494 - RNA, 22 nt, Human
agcucacaguguccuuccucaa

SEQ ID NO: 129495 - RNA, 22 nt, Human
gcaucuaaacuugcaucauugu

SEQ ID NO: 129496 - RNA, 22 nt, Human
gugcuguacuucuguguugaag

SEQ ID NO: 129497 - RNA, 22 nt, Human
aggcaguguguagcuggaagag

SEQ ID NO: 129498 - RNA, 22 nt, Human
ugaugugugauucauucucaaa

SEQ ID NO: 129499 - RNA, 22 nt, Human
cuucaggauuuaggaagaugaa

SEQ ID NO: 129500 - RNA, 21 nt, Human
gccacugcacuccagccuggg

SEQ ID NO: 129501 - RNA, 22 nt, Human
uuuauucuaacuugcugcucua

SEQ ID NO: 129502 - RNA, 22 nt, Human
gugucacaugguuuacugcagc

SEQ ID NO: 129503 - RNA, 22 nt, Human
ggcugggcaaacaagacucuuc

SEQ ID NO: 129504 - RNA, 22 nt, Human
agacaaagaaaccguagaagca

SEQ ID NO: 129505 - RNA, 22 nt, Human
ugucccagcagcuggguucucu

SEQ ID NO: 129506 - RNA, 22 nt, Human
agagcagguggcaacucuggga

SEQ ID NO: 129507 - RNA, 22 nt, Human
cuggccuagcucucugcuugaa

SEQ ID NO: 129508 - RNA, 22 nt, Human
aucaggauucaguaucuccagc

SEQ ID NO: 129509 - RNA, 22 nt, Human
cacauguacagaagcaggcugg

SEQ ID NO: 129510 - RNA, 22 nt, Human
ugagaauuacaaaugagucaca

SEQ ID NO: 129511 - RNA, 22 nt, Human
uucuucuuuccaauuacauggu

SEQ ID NO: 129512 - RNA, 22 nt, Human
ccagcugaggcagccacacagg

SEQ ID NO: 129513 - RNA, 22 nt, Human
acaguaccugcucucaagcaaa

SEQ ID NO: 129514 - RNA, 22 nt, Human
uauguguguuucaguggaaaug

SEQ ID NO: 129515 - RNA, 22 nt, Human
cugugccuggggggcagagcug

SEQ ID NO: 129516 - RNA, 22 nt, Human
cccagcccugaccuauuggaaa

SEQ ID NO: 129517 - RNA, 21 nt, Human
gagacagacuuucguccccug

SEQ ID NO: 129518 - RNA, 22 nt, Human
aaaggugacacucugccagcug

SEQ ID NO: 129519 - RNA, 23 nt, Human
auguauuuaaauuucagugauga

SEQ ID NO: 129520 - RNA, 22 nt, Human
aaggagagguuguccguguugu

SEQ ID NO: 129521 - RNA, 20 nt, Human
uguauauuuucugguguaaa

SEQ ID NO: 129522 - RNA, 22 nt, Human
augguacaaaauguauaaaguc

SEQ ID NO: 129523 - RNA, 22 nt, Human
cuggccuuggaagggagcccgu

SEQ ID NO: 129524 - RNA, 22 nt, Human
uccaagaagucaucuaaacugu

SEQ ID NO: 129525 - RNA, 22 nt, Human
aaauacuagaauucagaguuga

SEQ ID NO: 129526 - RNA, 22 nt, Human
guucuucagauuccauuucagu

SEQ ID NO: 129527 - RNA, 23 nt, Human
cagcaggagggugccugggcugc

SEQ ID NO: 129528 - RNA, 22 nt, Human
ugccuggcaaugccagaagcca

SEQ ID NO: 129529 - RNA, 22 nt, Human
augcauguuuauagggugcuuc

SEQ ID NO: 129530 - RNA, 23 nt, Human
gggauauggaccuuggaggaguc

SEQ ID NO: 129531 - RNA, 22 nt, Human
ucuuaacugacaguuuaauggg

SEQ ID NO: 129532 - RNA, 22 nt, Human
uaaaauguuugcaagagaccag

SEQ ID NO: 129533 - RNA, 22 nt, Human
uugcacuccagcccgagcaaca

SEQ ID NO: 129534 - RNA, 22 nt, Human
ccuuagagaguacugggcugcc

SEQ ID NO: 129535 - RNA, 22 nt, Human
gaacaguaucaguagugccagu

SEQ ID NO: 129536 - RNA, 22 nt, Human
uguaugcagcaaaacaauuagu

SEQ ID NO: 129537 - RNA, 22 nt, Human
uagcuuuccuuguugccugugc

SEQ ID NO: 129538 - RNA, 22 nt, Human
gcuguaugaguucauguguaga

SEQ ID NO: 129539 - RNA, 22 nt, Human
cccagacugcagagcgggcaga

SEQ ID NO: 129540 - RNA, 22 nt, Human
cuuugcaaacugucacacuuuc

SEQ ID NO: 129541 - RNA, 22 nt, Human
aaacauugcuaaauaaugcugc

SEQ ID NO: 129542 - RNA, 22 nt, Human
ucugugucacugaggccugugu

SEQ ID NO: 129543 - RNA, 22 nt, Human
gcugcucugaaaaugacuguug

SEQ ID NO: 129544 - RNA, 22 nt, Human
ucucagggaccaugaugaugac

SEQ ID NO: 129545 - RNA, 22 nt, Human
auaaggcauauagucacuuuuu

SEQ ID NO: 129546 - RNA, 22 nt, Human
auccaggguguggagagagcuc

SEQ ID NO: 129547 - RNA, 22 nt, Human
caagggccuccaccuugcucgu

SEQ ID NO: 129548 - RNA, 22 nt, Human
ucccagcagcauagcucagaau

SEQ ID NO: 129549 - RNA, 22 nt, Human
cacucugcgcugggcgccagcg

SEQ ID NO: 129550 - RNA, 22 nt, Human
uauguguaaccuugugauuuau

SEQ ID NO: 129551 - RNA, 22 nt, Human
ucuggcucucaacaaauauuua

SEQ ID NO: 129552 - RNA, 22 nt, Human
gccagcagcccagaaggacuuu

SEQ ID NO: 129553 - RNA, 22 nt, Human
gcaggagccaggccgagcuggu

SEQ ID NO: 129554 - RNA, 22 nt, Human
cagcaggaaguacuagcuuuga

SEQ ID NO: 129555 - RNA, 19 nt, Human
gccugccuggguuucugag

SEQ ID NO: 129556 - RNA, 22 nt, Human
gcaaggcagcgcggaguagcua

SEQ ID NO: 129557 - RNA, 22 nt, Human
ccuguggcugccacuuggguga

SEQ ID NO: 129558 - RNA, 22 nt, Human
auguucuuguucaaaugucagu

SEQ ID NO: 129559 - RNA, 22 nt, Human
uuggcagggccaggcucucucu

SEQ ID NO: 129560 - RNA, 22 nt, Human
cuguggugagcaacugacugaa

SEQ ID NO: 129561 - RNA, 20 nt, Human
cucuggcuccgcgugaccgc

SEQ ID NO: 129562 - RNA, 22 nt, Human
uaagcuauuccugaagaagguu

SEQ ID NO: 129563 - RNA, 22 nt, Human
aggcucaggcaggaauggcgga

SEQ ID NO: 129564 - RNA, 22 nt, Human
aggguggccaugagggagagau

SEQ ID NO: 129565 - RNA, 21 nt, Human
aagggagauaggaaucaggcc

SEQ ID NO: 129566 - RNA, 22 nt, Human
ggcagggguccugguguugacu

SEQ ID NO: 129567 - RNA, 22 nt, Human
ugcagggcccuugggguugaac

SEQ ID NO: 129568 - RNA, 21 nt, Human
gcucccuggcugugugaccug

SEQ ID NO: 129569 - RNA, 22 nt, Human
guccucugggcuuugagcaguc

SEQ ID NO: 129570 - RNA, 23 nt, Human
uagagcagggaaaucugucagag

SEQ ID NO: 129571 - RNA, 22 nt, Human
auacacauguguaugugcaugc

SEQ ID NO: 129572 - RNA, 22 nt, Human
ucccuggacaacagacuucacu

SEQ ID NO: 129573 - RNA, 22 nt, Human
uacaaaugaccauagccacuua

SEQ ID NO: 129574 - RNA, 22 nt, Human
cuuucaaugugccugccuuggg

SEQ ID NO: 129575 - RNA, 22 nt, Human
cuguguaugacuccagagggua

SEQ ID NO: 129576 - RNA, 22 nt, Human
gcugggaggaauuuggggaaua

SEQ ID NO: 129577 - RNA, 22 nt, Human
uacagugaggugguuuccuuua

SEQ ID NO: 129578 - RNA, 22 nt, Human
ggcacugaaguggguguugggu

SEQ ID NO: 129579 - RNA, 22 nt, Human
uggccugccccgagauccuggc

SEQ ID NO: 129580 - RNA, 22 nt, Human
ucaaauaugugauagaagcuaa

SEQ ID NO: 129581 - RNA, 22 nt, Human
aggcugcagugcagguaggauu

SEQ ID NO: 129582 - RNA, 22 nt, Human
gcaggaagaugagcucagguaa

SEQ ID NO: 129583 - RNA, 22 nt, Human
agaucucaccucuguguauuau

SEQ ID NO: 129584 - RNA, 22 nt, Human
guauuauuggguaguaugguaa

SEQ ID NO: 129585 - RNA, 22 nt, Human
cuuucucuucgaaaaccugccc

SEQ ID NO: 129586 - RNA, 20 nt, Human
ucuuuagauuuaucuuaugu

SEQ ID NO: 129587 - RNA, 22 nt, Human
caguggugaagagcaggggcuc

SEQ ID NO: 129588 - RNA, 22 nt, Human
cagcaggcucugaguggcugcc

SEQ ID NO: 129589 - RNA, 20 nt, Human
cucucccagcacagcuuccu

SEQ ID NO: 129590 - RNA, 21 nt, Human
gggccuggcugcgcaggacgg

SEQ ID NO: 129591 - RNA, 22 nt, Human
ggucccaggcucccucuugucc

SEQ ID NO: 129592 - RNA, 22 nt, Human
cagagcuggagggaacccuggc

SEQ ID NO: 129593 - RNA, 22 nt, Human
cagggcuguaaauuagugcuga

SEQ ID NO: 129594 - RNA, 22 nt, Human
uuucugcugugcuuucuugcgu

SEQ ID NO: 129595 - RNA, 22 nt, Human
uguuuacauggagguuuucagc

SEQ ID NO: 129596 - RNA, 22 nt, Human
gaugcagggcuggcaggagcuu

SEQ ID NO: 129597 - RNA, 22 nt, Human
cguguguguaccugcgcauuua

SEQ ID NO: 129598 - RNA, 22 nt, Human
uguggugagaaacugguagauu

SEQ ID NO: 129599 - RNA, 22 nt, Human
cuguccuguagcuccaucaguc

SEQ ID NO: 129600 - RNA, 22 nt, Human
aaggaaagacauauaaaugacu

SEQ ID NO: 129601 - RNA, 22 nt, Human
caaggccaaagggccacuguca

SEQ ID NO: 129602 - RNA, 21 nt, Human
ugccagcauuaaacagucauu

SEQ ID NO: 129603 - RNA, 22 nt, Human
aggugcuuggcucgugcacaca

SEQ ID NO: 129604 - RNA, 22 nt, Human
cugggccugucagggcuuuuug

SEQ ID NO: 129605 - RNA, 22 nt, Human
ccaggcauccauugcuuccucu

SEQ ID NO: 129606 - RNA, 22 nt, Human
guguguggggccuucggguccu

SEQ ID NO: 129607 - RNA, 22 nt, Human
cagggcuguggcuuugugcugu

SEQ ID NO: 129608 - RNA, 18 nt, Human
gagaggcccggcugugcc

SEQ ID NO: 129609 - RNA, 22 nt, Human
cucugagcugaaacaugagcau

SEQ ID NO: 129610 - RNA, 18 nt, Human
gcugugugcaccugauaa

SEQ ID NO: 129611 - RNA, 22 nt, Human
caagcagagacuagauagcugu

SEQ ID NO: 129612 - RNA, 22 nt, Human
gagcucaggagcaucagaagaa

SEQ ID NO: 129613 - RNA, 22 nt, Human
auuuacaguuuagcauuucaag

SEQ ID NO: 129614 - RNA, 22 nt, Human
uguauuagagcaguagaauuau

SEQ ID NO: 129615 - RNA, 22 nt, Human
cagcuuucaucagugacacuca

SEQ ID NO: 129616 - RNA, 22 nt, Human
gauuucaagcccccagagauuc

SEQ ID NO: 129617 - RNA, 22 nt, Human
uaacuuugagaacuuucuggug

SEQ ID NO: 129618 - RNA, 22 nt, Human
cagagcagugaggaguugugua

SEQ ID NO: 129619 - RNA, 22 nt, Human
aaggccagccugagagcuaaca

SEQ ID NO: 129620 - RNA, 22 nt, Human
aaaguuagaaugauaucaacga

SEQ ID NO: 129621 - RNA, 22 nt, Human
uaauacagaaguguauuaaaau

SEQ ID NO: 129622 - RNA, 22 nt, Human
ggucccaguccucucccugcua

SEQ ID NO: 129623 - RNA, 22 nt, Human
gcuuucucuucacugauguuca

SEQ ID NO: 129624 - RNA, 22 nt, Human
acccagaggcggagguugcagu

SEQ ID NO: 129625 - RNA, 22 nt, Human
cagggcagagccaggauuucaa

SEQ ID NO: 129626 - RNA, 22 nt, Human
augggaggaaggaggcccuuga

SEQ ID NO: 129627 - RNA, 22 nt, Human
ggcugccuccugcugggcugga

SEQ ID NO: 129628 - RNA, 22 nt, Human
aaugaaauguagcuuauccaua

SEQ ID NO: 129629 - RNA, 17 nt, Human
uccagagcacagagcuc

SEQ ID NO: 129630 - RNA, 22 nt, Human
uggugugggcguggcaggcaag

SEQ ID NO: 129631 - RNA, 22 nt, Human
aaggcacugaacuuaaauucug

SEQ ID NO: 129632 - RNA, 22 nt, Human
cuuaaaaucuggcaguuagcua

SEQ ID NO: 129633 - RNA, 22 nt, Human
uggcacugccaaccugcuaggu

SEQ ID NO: 129634 - RNA, 22 nt, Human
gccugcaguucugugcuaggca

SEQ ID NO: 129635 - RNA, 22 nt, Human
uguacaguauauuucaaagcca

SEQ ID NO: 129636 - RNA, 22 nt, Human
gcuguccucuuggacucagggc

SEQ ID NO: 129637 - RNA, 22 nt, Human
cagagcugggaucccaugggcg

SEQ ID NO: 129638 - RNA, 22 nt, Human
cucuuaguuuaucuuugacaaa

SEQ ID NO: 129639 - RNA, 22 nt, Human
uggacagguuugggugccuguu

SEQ ID NO: 129640 - RNA, 22 nt, Human
uucuucagucccacuagccaca

SEQ ID NO: 129641 - RNA, 21 nt, Human
aaguaaaucagagaaauaacc

SEQ ID NO: 129642 - RNA, 22 nt, Human
aggccugaggaccagauaaaug

SEQ ID NO: 129643 - RNA, 19 nt, Human
cauuuucucauugugcccc

SEQ ID NO: 129644 - RNA, 18 nt, Human
gggcuguguucaugccca

SEQ ID NO: 129645 - RNA, 22 nt, Human
gcagguggcagaggugggaucu

SEQ ID NO: 129646 - RNA, 22 nt, Human
gccaccagguuagauccagccu

SEQ ID NO: 129647 - RNA, 20 nt, Human
uguuucuuuuaaugagcggc

SEQ ID NO: 129648 - RNA, 19 nt, Human
cugccuguuauggagagaa

SEQ ID NO: 129649 - RNA, 22 nt, Human
cugaggccagcugcagagcucu

SEQ ID NO: 129650 - RNA, 22 nt, Human
ggcagagguagcuggaaccagg

SEQ ID NO: 129651 - RNA, 22 nt, Human
uuuacaaccucauauucugaug

SEQ ID NO: 129652 - RNA, 22 nt, Human
cuuugaaaacuuaaauaacagc

SEQ ID NO: 129653 - RNA, 22 nt, Human
uuacaguacagaaaauaacaga

SEQ ID NO: 129654 - RNA, 22 nt, Human
uuauuuccuaaaucucuuuguu

SEQ ID NO: 129655 - RNA, 22 nt, Human
ugggggagauugugcaucucua

SEQ ID NO: 129656 - RNA, 22 nt, Human
ccaaggagaaugacaccaugga

SEQ ID NO: 129657 - RNA, 22 nt, Human
aauuucaaacuaauaggaacca

SEQ ID NO: 129658 - RNA, 22 nt, Human
gcucacugccauucucuagaug

SEQ ID NO: 129659 - RNA, 22 nt, Human
ggcuucugguaaagaccacacc

SEQ ID NO: 129660 - RNA, 22 nt, Human
ggcacugagaacaggcugacuu

SEQ ID NO: 129661 - RNA, 20 nt, Human
gggcaguggcgcuaucucag

SEQ ID NO: 129662 - RNA, 23 nt, Human
ugggaguguugggaucucugcuc

SEQ ID NO: 129663 - RNA, 22 nt, Human
agggcuggcaagggauugaaau

SEQ ID NO: 129664 - RNA, 22 nt, Human
ccuuuggguucaaucucggucu

SEQ ID NO: 129665 - RNA, 22 nt, Human
agcaggagcccuuaucaccagg

SEQ ID NO: 129666 - RNA, 22 nt, Human
ugugaaggcagcagcucugucc

SEQ ID NO: 129667 - RNA, 22 nt, Human
aacaucuacuaagugccaggca

SEQ ID NO: 129668 - RNA, 20 nt, Human
ggccuuggccucuuugcagc

SEQ ID NO: 129669 - RNA, 22 nt, Human
gaaggcuggcuuucugagagca

SEQ ID NO: 129670 - RNA, 22 nt, Human
cagacacaccaggcccauucug

SEQ ID NO: 129671 - RNA, 22 nt, Human
uggcucaguuucugcccagcug

SEQ ID NO: 129672 - RNA, 22 nt, Human
agggccugagcuggcugaccuc

SEQ ID NO: 129673 - RNA, 22 nt, Human
gcaggaggaucacuugagccca

SEQ ID NO: 129674 - RNA, 22 nt, Human
ccucgaccuccccaggcucagg

SEQ ID NO: 129675 - RNA, 22 nt, Human
uugacaguugaggguugucuaa

SEQ ID NO: 129676 - RNA, 22 nt, Human
cuggcuguauuaguuugauccu

SEQ ID NO: 129677 - RNA, 22 nt, Human
aagaggaagucuccauggagag

SEQ ID NO: 129678 - RNA, 22 nt, Human
uauuaucuaguaacugauagug

SEQ ID NO: 129679 - RNA, 22 nt, Human
gcuguucugcgucccaggcugg

SEQ ID NO: 129680 - RNA, 22 nt, Human
uggagcauauucuggagcuugg

SEQ ID NO: 129681 - RNA, 22 nt, Human
uuguuuuuaugaacauccagga

SEQ ID NO: 129682 - RNA, 21 nt, Human
acaguucaugauaacuccauc

SEQ ID NO: 129683 - RNA, 22 nt, Human
ugccugucuuaauaucuggaaa

SEQ ID NO: 129684 - RNA, 19 nt, Human
ugagaggcuuaaggcagcu

SEQ ID NO: 129685 - RNA, 22 nt, Human
ugcuuuggccacuagaauucag

SEQ ID NO: 129686 - RNA, 22 nt, Human
aaagaaggaccuggaggaggau

SEQ ID NO: 129687 - RNA, 22 nt, Human
cuuggggcugucacucuggcau

SEQ ID NO: 129688 - RNA, 22 nt, Human
gaggugaguggaucacgagguc

SEQ ID NO: 129689 - RNA, 22 nt, Human
uccauuggucucugugcccagg

SEQ ID NO: 129690 - RNA, 22 nt, Human
auuugcuugugcuaugaaaguu

SEQ ID NO: 129691 - RNA, 22 nt, Human
ccaggauggggagcagauagaa

SEQ ID NO: 129692 - RNA, 22 nt, Human
aucaguuuaaaugggcuguugg

SEQ ID NO: 129693 - RNA, 21 nt, Human
ucuuuacauuugccucuugca

SEQ ID NO: 129694 - RNA, 22 nt, Human
ucuccucugugccacagcuugg

SEQ ID NO: 129695 - RNA, 22 nt, Human
cacaaugugguuugucaucuuu

SEQ ID NO: 129696 - RNA, 22 nt, Human
ggcacagagcccagcuuccuag

SEQ ID NO: 129697 - RNA, 22 nt, Human
cuggcagggugggcuuugcuuu

SEQ ID NO: 129698 - RNA, 22 nt, Human
auuucucuaagcauccguuugc

SEQ ID NO: 129699 - RNA, 22 nt, Human
cagcugcccauccugggaaaug

SEQ ID NO: 129700 - RNA, 21 nt, Human
ucuccaguauccuucucugag

SEQ ID NO: 129701 - RNA, 22 nt, Human
cuucugugcaauuguggaggag

SEQ ID NO: 129702 - RNA, 21 nt, Human
uuucuucacuuugccccaugu

SEQ ID NO: 129703 - RNA, 18 nt, Human
gggcugugagaugggaag

SEQ ID NO: 129704 - RNA, 22 nt, Human
ggcauguuucaucacaucaaga

SEQ ID NO: 129705 - RNA, 17 nt, Human
agagagagcaugccacc

SEQ ID NO: 129706 - RNA, 22 nt, Human
auuucagcccaguaugagcccc

SEQ ID NO: 129707 - RNA, 22 nt, Human
auguguaugagugugcuucuuu

SEQ ID NO: 129708 - RNA, 22 nt, Human
cagggcagcuuccuuuguuagg

SEQ ID NO: 129709 - RNA, 22 nt, Human
cugggagucuggccucuggucc

SEQ ID NO: 129710 - RNA, 22 nt, Human
ccugccugauuccaggauggcu

SEQ ID NO: 129711 - RNA, 22 nt, Human
cagcagcaguggcugcagaaca

SEQ ID NO: 129712 - RNA, 22 nt, Human
uauucacauucucaggccuggu

SEQ ID NO: 129713 - RNA, 22 nt, Human
cugggccuuggauugacacugu

SEQ ID NO: 129714 - RNA, 22 nt, Human
auaucacaaacaagucuguacu

SEQ ID NO: 129715 - RNA, 22 nt, Human
auguagagcaguguuguccaau

SEQ ID NO: 129716 - RNA, 23 nt, Human
ugaguguguucccugugagauuu

SEQ ID NO: 129717 - RNA, 22 nt, Human
guaggcagauaggagugcagcc

SEQ ID NO: 129718 - RNA, 22 nt, Human
cucucagacugaagggccugug

SEQ ID NO: 129719 - RNA, 22 nt, Human
accucugcaacccuggaauggg

SEQ ID NO: 129720 - RNA, 22 nt, Human
gcauguguuauuucucuguggg

SEQ ID NO: 129721 - RNA, 22 nt, Human
uagcaguggaaucuuuugucca

SEQ ID NO: 129722 - RNA, 22 nt, Human
ccugggugacccgugagcgucc

SEQ ID NO: 129723 - RNA, 22 nt, Human
gagagugauucccucccauaga

SEQ ID NO: 129724 - RNA, 23 nt, Human
aaccagauaaauggcuccagggc

SEQ ID NO: 129725 - RNA, 22 nt, Human
aaaggcuccuucucccaugacc

SEQ ID NO: 129726 - RNA, 22 nt, Human
uuuaucugggauuuugcagucu

SEQ ID NO: 129727 - RNA, 22 nt, Human
ucugaaaugcaaauuugacuga

SEQ ID NO: 129728 - RNA, 17 nt, Human
uguggccuucugagcuu

SEQ ID NO: 129729 - RNA, 22 nt, Human
agaaagaacgcacuugugcugc

SEQ ID NO: 129730 - RNA, 22 nt, Human
ggcugccugaggcugaggcccg

SEQ ID NO: 129731 - RNA, 22 nt, Human
ucaguuuucaauuucaucagag

SEQ ID NO: 129732 - RNA, 22 nt, Human
cuuacauugucuuaguuuucaa

SEQ ID NO: 129733 - RNA, 22 nt, Human
cagaguucaaagccugcuggga

SEQ ID NO: 129734 - RNA, 22 nt, Human
uuucuuguuucauggugucuca

SEQ ID NO: 129735 - RNA, 22 nt, Human
ccagcuggugacauccccaacc

SEQ ID NO: 129736 - RNA, 22 nt, Human
uaaguucauaagcuuauucuua

SEQ ID NO: 129737 - RNA, 22 nt, Human
gagcugccugugugccaugaug

SEQ ID NO: 129738 - RNA, 21 nt, Human
acagggcaugcagcuggcugu

SEQ ID NO: 129739 - RNA, 22 nt, Human
ugcagaagacacaagguaacgu

SEQ ID NO: 129740 - RNA, 19 nt, Human
augauacaggugaaaauug

SEQ ID NO: 129741 - RNA, 22 nt, Human
cuggcuguuuucaauguugaug

SEQ ID NO: 129742 - RNA, 22 nt, Human
uaaccuuuuuaucuuaccucca

SEQ ID NO: 129743 - RNA, 22 nt, Human
caggcaggagccagggauucca

SEQ ID NO: 129744 - RNA, 22 nt, Human
ucaggcugugggcacuggccau

SEQ ID NO: 129745 - RNA, 22 nt, Human
ucuucacaccgggcagcaggaa

SEQ ID NO: 129746 - RNA, 17 nt, Human
agugaaauuuacauugc

SEQ ID NO: 129747 - RNA, 22 nt, Human
ggccccugcggacugccuagag

SEQ ID NO: 129748 - RNA, 22 nt, Human
gagggcaguagccucguacccu

SEQ ID NO: 129749 - RNA, 22 nt, Human
cccacucuggcucccuucuagu

SEQ ID NO: 129750 - RNA, 22 nt, Human
gcuggcuuugcacugggugcau

SEQ ID NO: 129751 - RNA, 17 nt, Human
gcaaucucagucuccuu

SEQ ID NO: 129752 - RNA, 21 nt, Human
acagcagggcuggcaugacag

SEQ ID NO: 129753 - RNA, 22 nt, Human
ugcugccaugcagagcaacaga

SEQ ID NO: 129754 - RNA, 22 nt, Human
caggcugcagcagcaguggccc

SEQ ID NO: 129755 - RNA, 22 nt, Human
gcugggagcaaguacucaucuu

SEQ ID NO: 129756 - RNA, 22 nt, Human
ugggcagcagcaaagccagacu

SEQ ID NO: 129757 - RNA, 22 nt, Human
gccugccugcugugugcaaguu

SEQ ID NO: 129758 - RNA, 22 nt, Human
ggacacagcugcagccacaccc

SEQ ID NO: 129759 - RNA, 22 nt, Human
ggucucagcccucgccagcagc

SEQ ID NO: 129760 - RNA, 22 nt, Human
aacaggagaguaaauauaugau

SEQ ID NO: 129761 - RNA, 22 nt, Human
gccucugcaccaguacugugcc

SEQ ID NO: 129762 - RNA, 23 nt, Human
uuucucauccagagagucagucc

SEQ ID NO: 129763 - RNA, 22 nt, Human
uucuugauuucaugcaguuaag

SEQ ID NO: 129764 - RNA, 22 nt, Human
ccuagagcucugcuuuaucuaa

SEQ ID NO: 129765 - RNA, 22 nt, Human
ucucuuuuauguacacccugac

SEQ ID NO: 129766 - RNA, 22 nt, Human
agaaguuguagguuugcauauu

SEQ ID NO: 129767 - RNA, 22 nt, Human
ucuuagaaugucaacugauguu

SEQ ID NO: 129768 - RNA, 22 nt, Human
caggaugagguagaggcagaua

SEQ ID NO: 129769 - RNA, 22 nt, Human
ucugucacucuagagauggcag

SEQ ID NO: 129770 - RNA, 22 nt, Human
agccccuuccaguucucagauc

SEQ ID NO: 129771 - RNA, 22 nt, Human
ucuuacagccacucugugaagc

SEQ ID NO: 129772 - RNA, 22 nt, Human
uuagcuuucagccuuucucacc

SEQ ID NO: 129773 - RNA, 23 nt, Human
aucauucuccaaucuggagcagg

SEQ ID NO: 129774 - RNA, 18 nt, Human
cucagggcaucagucugg

SEQ ID NO: 129775 - RNA, 22 nt, Human
ugccucuguggaaauggugguc

SEQ ID NO: 129776 - RNA, 22 nt, Human
uggccucugggaaagcagauuc

SEQ ID NO: 129777 - RNA, 22 nt, Human
gaauguaauagucaguagaaca

SEQ ID NO: 129778 - RNA, 22 nt, Human
aaggcacuagcaagcugccugg

SEQ ID NO: 129779 - RNA, 22 nt, Human
gagauuggccuggcuugccaac

SEQ ID NO: 129780 - RNA, 22 nt, Human
acagaauucuaguauguggcuu

SEQ ID NO: 129781 - RNA, 22 nt, Human
ggcauggcucggagucagaaca

SEQ ID NO: 129782 - RNA, 22 nt, Human
ucccuggaacagagagacaacg

SEQ ID NO: 129783 - RNA, 21 nt, Human
agaugcugugcuccaggagca

SEQ ID NO: 129784 - RNA, 22 nt, Human
caguauauucugcagagccuua

SEQ ID NO: 129785 - RNA, 20 nt, Human
ucucaggccccaguuuucuu

SEQ ID NO: 129786 - RNA, 16 nt, Human
ggagagugucugcaaa

SEQ ID NO: 129787 - RNA, 22 nt, Human
gcagagccccucaagccagccu

SEQ ID NO: 129788 - RNA, 22 nt, Human
ggacccugggcuugcuccuggg

SEQ ID NO: 129789 - RNA, 22 nt, Human
ucaaggcuaaacuuucagagua

SEQ ID NO: 129790 - RNA, 22 nt, Human
ucugggaacucugucauuuccc

SEQ ID NO: 129791 - RNA, 22 nt, Human
uuuacaguccccaggugaggau

SEQ ID NO: 129792 - RNA, 23 nt, Human
ccaggcaguagcuauugaaguga

SEQ ID NO: 129793 - RNA, 22 nt, Human
uuacaguaacauuuucagucug

SEQ ID NO: 129794 - RNA, 22 nt, Human
ugaaggugucuuugugaacauc

SEQ ID NO: 129795 - RNA, 19 nt, Human
ucuggcuccugccaggcug

SEQ ID NO: 129796 - RNA, 21 nt, Human
cuuuucucuccgcaggacauu

SEQ ID NO: 129797 - RNA, 22 nt, Human
uagacagauuucuuguuagaca

SEQ ID NO: 129798 - RNA, 22 nt, Human
auguguauuaccucgauuguga

SEQ ID NO: 129799 - RNA, 22 nt, Human
uauuuucuguggaggaccagau

SEQ ID NO: 129800 - RNA, 22 nt, Human
uacuacauuaauaaaacauuca

SEQ ID NO: 129801 - RNA, 22 nt, Human
gcagcuggggaggucgugggga

SEQ ID NO: 129802 - RNA, 22 nt, Human
guacauuucucuuguucuuauu

SEQ ID NO: 129803 - RNA, 21 nt, Human
aggcugcuggcucaggguccu

SEQ ID NO: 129804 - RNA, 22 nt, Human
aagaauuauugcaauacuagau

SEQ ID NO: 129805 - RNA, 17 nt, Human
aguguggcccugguuaa

SEQ ID NO: 129806 - RNA, 22 nt, Human
gaaggucaccuccccucucugg

SEQ ID NO: 129807 - RNA, 22 nt, Human
aaaguguugggaagaaagugca

SEQ ID NO: 129808 - RNA, 22 nt, Human
agccucugcacgggcacgggug

SEQ ID NO: 129809 - RNA, 22 nt, Human
uagaacagaggguugcccagau

SEQ ID NO: 129810 - RNA, 22 nt, Human
uggcccugacugauguggaggg

SEQ ID NO: 129811 - RNA, 20 nt, Human
gccugcagagaaggucagag

SEQ ID NO: 129812 - RNA, 19 nt, Human
gccucugcuggggacaggc

SEQ ID NO: 129813 - RNA, 22 nt, Human
cugccucugcgucccacagagu

SEQ ID NO: 129814 - RNA, 22 nt, Human
agugcacaccuuaguacaaagu

SEQ ID NO: 129815 - RNA, 22 nt, Human
aaaugugucauauucaaaguca

SEQ ID NO: 129816 - RNA, 22 nt, Human
uuacaaguucagauuuucucau

SEQ ID NO: 129817 - RNA, 22 nt, Human
uggcugaauaauauucuguugu

SEQ ID NO: 129818 - RNA, 22 nt, Human
ugcauccuuaaccagcaucacu

SEQ ID NO: 129819 - RNA, 22 nt, Human
uucaaauacauucuuugccacu

SEQ ID NO: 129820 - RNA, 18 nt, Human
aggcacuggaauuaaggg

SEQ ID NO: 129821 - RNA, 19 nt, Human
cagcugccuuuucuuugca

SEQ ID NO: 129822 - RNA, 22 nt, Human
gugcugugcgcuuuuucuguau

SEQ ID NO: 129823 - RNA, 22 nt, Human
uacaaaaguaauuacgguuuuu

SEQ ID NO: 129824 - RNA, 22 nt, Human
agggccuggaacuggagaccac

SEQ ID NO: 129825 - RNA, 22 nt, Human
augugaggaagaaagagguaag

SEQ ID NO: 129826 - RNA, 22 nt, Human
gcagagcucuguucuuaucucc

SEQ ID NO: 129827 - RNA, 22 nt, Human
cagucccagaagagccugggag

SEQ ID NO: 129828 - RNA, 22 nt, Human
aaauguguuucuuugugaaugg

SEQ ID NO: 129829 - RNA, 20 nt, Human
cucuccuugccgacuuggca

SEQ ID NO: 129830 - RNA, 22 nt, Human
gaggccugguuuccagcauccu

SEQ ID NO: 129831 - RNA, 22 nt, Human
aggcccugggcaguucuguagc

SEQ ID NO: 129832 - RNA, 22 nt, Human
cucuguccuugcacaguuccua

SEQ ID NO: 129833 - RNA, 18 nt, Human
gaaaggagagacaguagg

SEQ ID NO: 129834 - RNA, 22 nt, Human
uuaacugugacaguuucucaga

SEQ ID NO: 129835 - RNA, 22 nt, Human
guauauuuugaucacccucuau

SEQ ID NO: 129836 - RNA, 22 nt, Human
ucuggcugacauccuguaugag

SEQ ID NO: 129837 - RNA, 22 nt, Human
acaugcaugucuaugggcaggu

SEQ ID NO: 129838 - RNA, 23 nt, Human
aggauguaggauguauggcagag

SEQ ID NO: 129839 - RNA, 22 nt, Human
uggggagugaugccucggauaa

SEQ ID NO: 129840 - RNA, 22 nt, Human
gcagagccaggcuggggcaggu

SEQ ID NO: 129841 - RNA, 22 nt, Human
auaauaaaccaggaugggucug

SEQ ID NO: 129842 - RNA, 19 nt, Human
cuguggcugaccucuggcc

SEQ ID NO: 129843 - RNA, 22 nt, Human
ugacccugcuucuuggugcagg

SEQ ID NO: 129844 - RNA, 22 nt, Human
gcugggcagccuggccgcugcc

SEQ ID NO: 129845 - RNA, 22 nt, Human
uccaugagcuagggauucauca

SEQ ID NO: 129846 - RNA, 22 nt, Human
uuucucucuuaaggaguuuaaa

SEQ ID NO: 129847 - RNA, 22 nt, Human
aaggcaguuaauuuggcuagaa

SEQ ID NO: 129848 - RNA, 22 nt, Human
uucauuccuucuguaccuugcc

SEQ ID NO: 129849 - RNA, 22 nt, Human
gcucagccgaacuucagagcag

SEQ ID NO: 129850 - RNA, 22 nt, Human
acaggugugagaacaugccuug

SEQ ID NO: 129851 - RNA, 22 nt, Human
cagagccaggguugcaccccug

SEQ ID NO: 129852 - RNA, 22 nt, Human
auucauaacggcaaaugucacc

SEQ ID NO: 129853 - RNA, 20 nt, Human
ugaaggccauuuguuccaga

SEQ ID NO: 129854 - RNA, 22 nt, Human
aucaggaucacugggagucuug

SEQ ID NO: 129855 - RNA, 22 nt, Human
gugccagcaguuauggugauuu

SEQ ID NO: 129856 - RNA, 22 nt, Human
cuggcagcauggagccugugcu

SEQ ID NO: 129857 - RNA, 22 nt, Human
uuaauaaacaggugcagcugaa

SEQ ID NO: 129858 - RNA, 22 nt, Human
uugucugugaaauggaaauagu

SEQ ID NO: 129859 - RNA, 22 nt, Human
ccugucugagccagggugggca

SEQ ID NO: 129860 - RNA, 23 nt, Human
gcugucaguuguuuuugucucua

SEQ ID NO: 129861 - RNA, 22 nt, Human
ucuacugcacuggugucucauc

SEQ ID NO: 129862 - RNA, 22 nt, Human
uuacaagauaaccugaugcugu

SEQ ID NO: 129863 - RNA, 22 nt, Human
gagcuggcuccgccaugcugcu

SEQ ID NO: 129864 - RNA, 22 nt, Human
ucaggcugaggucaucugcauc

SEQ ID NO: 129865 - RNA, 22 nt, Human
cagagccauccaggugccuguu

SEQ ID NO: 129866 - RNA, 22 nt, Human
ggccuagggaguggccaugccu

SEQ ID NO: 129867 - RNA, 22 nt, Human
uguguguuaacuuauuuaaugu

SEQ ID NO: 129868 - RNA, 22 nt, Human
ggcugccugggagcccuccucu

SEQ ID NO: 129869 - RNA, 22 nt, Human
uaagacauuugaaaugugaucc

SEQ ID NO: 129870 - RNA, 22 nt, Human
gcugcaggcauuuuccugggca

SEQ ID NO: 129871 - RNA, 22 nt, Human
gaaaucugaacucuguauccuu

SEQ ID NO: 129872 - RNA, 22 nt, Human
agcucuggaauaaugaugugau

SEQ ID NO: 129873 - RNA, 22 nt, Human
gcccaggcuggagugcaguagc

SEQ ID NO: 129874 - RNA, 22 nt, Human
uuuagaguaaaaacugugaccu

SEQ ID NO: 129875 - RNA, 22 nt, Human
uuagaaauacaagugagguuga

SEQ ID NO: 129876 - RNA, 19 nt, Human
ucucuggggacacuuucac

SEQ ID NO: 129877 - RNA, 22 nt, Human
ggcugagccuggagcaucuggu

SEQ ID NO: 129878 - RNA, 22 nt, Human
ucuucacauggaacaugaagcu

SEQ ID NO: 129879 - RNA, 22 nt, Human
gcacagagggcagugagccucu

SEQ ID NO: 129880 - RNA, 22 nt, Human
gcuccacuugcagcuaggcuug

SEQ ID NO: 129881 - RNA, 22 nt, Human
cagcugagcucccaggccauca

SEQ ID NO: 129882 - RNA, 22 nt, Human
aagaauguuaguuucugauaca

SEQ ID NO: 129883 - RNA, 22 nt, Human
guggguggaucaccugagguca

SEQ ID NO: 129884 - RNA, 22 nt, Human
cauugcacuccagcuugggcaa

SEQ ID NO: 129885 - RNA, 22 nt, Human
cauggccucaaaggacugcaga

SEQ ID NO: 129886 - RNA, 22 nt, Human
aucagcaagacuaggggaauac

SEQ ID NO: 129887 - RNA, 22 nt, Human
uuuuuguagucauuagaagagg

SEQ ID NO: 129888 - RNA, 22 nt, Human
cugacucagcagcugaugaucc

SEQ ID NO: 129889 - RNA, 22 nt, Human
ucucacugggucacagcagagg

SEQ ID NO: 129890 - RNA, 22 nt, Human
cccagccaaggugcugguguug

SEQ ID NO: 129891 - RNA, 22 nt, Human
ugugugggcaugcuuuuaauuu

SEQ ID NO: 129892 - RNA, 22 nt, Human
aguggacucuucccagugcuug

SEQ ID NO: 129893 - RNA, 22 nt, Human
uguuuuauuucuccaagaggga

SEQ ID NO: 129894 - RNA, 21 nt, Human
ggcuguguucagggcaugcgg

SEQ ID NO: 129895 - RNA, 22 nt, Human
gucccagggaagaaggcagcac

SEQ ID NO: 129896 - RNA, 22 nt, Human
gcccugagggguggugucugua

SEQ ID NO: 129897 - RNA, 22 nt, Human
aucaguauccugcaguuucuau

SEQ ID NO: 129898 - RNA, 22 nt, Human
aucaguuucuaccauguggaau

SEQ ID NO: 129899 - RNA, 22 nt, Human
ggagggugcauuuuacccugug

SEQ ID NO: 129900 - RNA, 22 nt, Human
guuaacuugguagucuaagugu

SEQ ID NO: 129901 - RNA, 22 nt, Human
aaaugaacucuuccugcauccc

SEQ ID NO: 129902 - RNA, 21 nt, Human
gagcugggcgaggcuccgggg

SEQ ID NO: 129903 - RNA, 22 nt, Human
cauugcacgggcgucugucugu

SEQ ID NO: 129904 - RNA, 22 nt, Human
cugccucuauaggaguccacca

SEQ ID NO: 129905 - RNA, 22 nt, Human
ggugaggcagguggcugcugag

SEQ ID NO: 129906 - RNA, 22 nt, Human
ugugccuggcauucugggcuuc

SEQ ID NO: 129907 - RNA, 22 nt, Human
uuuacagucucuauagucaaaa

SEQ ID NO: 129908 - RNA, 22 nt, Human
cuugggaaugcuaacagaugac

SEQ ID NO: 129909 - RNA, 22 nt, Human
auucuucaccugagucagucua

SEQ ID NO: 129910 - RNA, 22 nt, Human
ucaggugguccuaagugccauc

SEQ ID NO: 129911 - RNA, 22 nt, Human
uuuagaguugguccccugugag

SEQ ID NO: 129912 - RNA, 22 nt, Human
ucugguuagccaauaaugccaa

SEQ ID NO: 129913 - RNA, 19 nt, Human
agucucaguguacagaggc

SEQ ID NO: 129914 - RNA, 22 nt, Human
ggaggccuagccagcuccaguu

SEQ ID NO: 129915 - RNA, 22 nt, Human
gcagcccaaaaaagagguagau

SEQ ID NO: 129916 - RNA, 22 nt, Human
uuuuccucuguuauuaguguga

SEQ ID NO: 129917 - RNA, 22 nt, Human
caaaugcaaaauauaacccugu

SEQ ID NO: 129918 - RNA, 22 nt, Human
gagagaaaugugcaguuugggc

SEQ ID NO: 129919 - RNA, 22 nt, Human
cagaguggcagucccaggccca

SEQ ID NO: 129920 - RNA, 22 nt, Human
aguugcagacgcagagauguug

SEQ ID NO: 129921 - RNA, 22 nt, Human
caagagcuacccugugccauau

SEQ ID NO: 129922 - RNA, 22 nt, Human
cugccagcucucuggaggcucu

SEQ ID NO: 129923 - RNA, 22 nt, Human
gagcuuccacucuagaaggagu

SEQ ID NO: 129924 - RNA, 22 nt, Human
gagcucauccccaugguccguc

SEQ ID NO: 129925 - RNA, 22 nt, Human
cagcaggagcagucagacuccu

SEQ ID NO: 129926 - RNA, 23 nt, Human
gagagcugacugucaagacuguu

SEQ ID NO: 129927 - RNA, 22 nt, Human
cuuaagaauauugaaguugugg

SEQ ID NO: 129928 - RNA, 18 nt, Human
ggcucaggcuauccuaac

SEQ ID NO: 129929 - RNA, 22 nt, Human
uggcauguggcuuugagucauc

SEQ ID NO: 129930 - RNA, 22 nt, Human
acagagguguuccagaccuagg

SEQ ID NO: 129931 - RNA, 22 nt, Human
guucccauacaguaucagugcu

SEQ ID NO: 129932 - RNA, 22 nt, Human
gcucccaguucccaaagugacc

SEQ ID NO: 129933 - RNA, 22 nt, Human
auguaacuguuauauuuuguug

SEQ ID NO: 129934 - RNA, 22 nt, Human
agcagccagagucugaacauua

SEQ ID NO: 129935 - RNA, 22 nt, Human
uauuugcuuugcuuuauagaga

SEQ ID NO: 129936 - RNA, 16 nt, Human
ccucucuuauuccucc

SEQ ID NO: 129937 - RNA, 22 nt, Human
uaaugaauaaacuugagaguca

SEQ ID NO: 129938 - RNA, 22 nt, Human
guccucaggaaagcagauaaca

SEQ ID NO: 129939 - RNA, 22 nt, Human
aauguguguucggggcccagag

SEQ ID NO: 129940 - RNA, 22 nt, Human
ugggcacuggaagccugcugug

SEQ ID NO: 129941 - RNA, 22 nt, Human
ucugagcuacgaugccugucac

SEQ ID NO: 129942 - RNA, 22 nt, Human
ugccuuccuggagcugaaggcu

SEQ ID NO: 129943 - RNA, 22 nt, Human
uuugaaauuaagauauugucca

SEQ ID NO: 129944 - RNA, 21 nt, Human
uuaagagcuuagcaguaggcc

SEQ ID NO: 129945 - RNA, 22 nt, Human
augggaggaucacuugaggcca

SEQ ID NO: 129946 - RNA, 19 nt, Human
gagcagcugcacccauuga

SEQ ID NO: 129947 - RNA, 20 nt, Human
uggagcugugguaaggagca

SEQ ID NO: 129948 - RNA, 22 nt, Human
guaucuuuaucccucguuggag

SEQ ID NO: 129949 - RNA, 22 nt, Human
ucccagcgcggggggaggaucc

SEQ ID NO: 129950 - RNA, 22 nt, Human
acugugcacaauucuaaguccu

SEQ ID NO: 129951 - RNA, 22 nt, Human
agccuccaaaugucaggucccg

SEQ ID NO: 129952 - RNA, 22 nt, Human
gcagugggcaacaagagcugga

SEQ ID NO: 129953 - RNA, 22 nt, Human
gccugccugaaggcuguaccag

SEQ ID NO: 129954 - RNA, 22 nt, Human
gcagagccccauugcuggcggg

SEQ ID NO: 129955 - RNA, 22 nt, Human
cugugugugcuacaggcuucca

SEQ ID NO: 129956 - RNA, 22 nt, Human
gagcuggcuaauacugacuuau

SEQ ID NO: 129957 - RNA, 23 nt, Human
uggcucucucagugcugcagagg

SEQ ID NO: 129958 - RNA, 22 nt, Human
cggggcugcgcucuuccugccg

SEQ ID NO: 129959 - RNA, 22 nt, Human
gcucccagcuggagccucaaca

SEQ ID NO: 129960 - RNA, 22 nt, Human
agugaguggacccugcaaggaa

SEQ ID NO: 129961 - RNA, 22 nt, Human
uucucuuuuugcaucucaaccu

SEQ ID NO: 129962 - RNA, 22 nt, Human
ugaaggcauugaugaaggaauc

SEQ ID NO: 129963 - RNA, 22 nt, Human
gcaggcagagagggguuuccag

SEQ ID NO: 129964 - RNA, 21 nt, Human
uguaugcacgcacaugcacac

SEQ ID NO: 129965 - RNA, 22 nt, Human
gacagcagacagaacuaccugc

SEQ ID NO: 129966 - RNA, 22 nt, Human
aucaguuuggaacauucaggcc

SEQ ID NO: 129967 - RNA, 22 nt, Human
ucccucuguguugggcaugccu

SEQ ID NO: 129968 - RNA, 22 nt, Human
uggcucagauaauucaaggggc

SEQ ID NO: 129969 - RNA, 18 nt, Human
auguggcuagugcaacug

SEQ ID NO: 129970 - RNA, 19 nt, Human
ugucccagacuccgugucu

SEQ ID NO: 129971 - RNA, 22 nt, Human
gcuggccauucucuuugagaug

SEQ ID NO: 129972 - RNA, 22 nt, Human
uucauucaucucuaaaaugccu

SEQ ID NO: 129973 - RNA, 22 nt, Human
cccaugagauucugaauuuggc

SEQ ID NO: 129974 - RNA, 22 nt, Human
aagacaauuugauacuaguugc

SEQ ID NO: 129975 - RNA, 22 nt, Human
agcauccaacaggagggaaggg

SEQ ID NO: 129976 - RNA, 22 nt, Human
agucucagcaagcauggcuagu

SEQ ID NO: 129977 - RNA, 22 nt, Human
ccacaggaccagaggagaucac

SEQ ID NO: 129978 - RNA, 22 nt, Human
gaggccuggaauuccagccugg

SEQ ID NO: 129979 - RNA, 22 nt, Human
auucccaucgucaacuucacug

SEQ ID NO: 129980 - RNA, 22 nt, Human
gugcauugcgaugcagacgacc

SEQ ID NO: 129981 - RNA, 22 nt, Human
uauacuuuccugcaacuuugau

SEQ ID NO: 129982 - RNA, 22 nt, Human
cucaggagaugacagaagguau

SEQ ID NO: 129983 - RNA, 22 nt, Human
cagauauaaauggaugugguag

SEQ ID NO: 129984 - RNA, 22 nt, Human
uucaacuuuggagauuuaauaa

SEQ ID NO: 129985 - RNA, 17 nt, Human
ggccuugggcugcucuu

SEQ ID NO: 129986 - RNA, 22 nt, Human
gcagagugggagcccagggcug

SEQ ID NO: 129987 - RNA, 22 nt, Human
auuacaguucugcagguaguuu

SEQ ID NO: 129988 - RNA, 22 nt, Human
gcucugugggugaguagaaucu

SEQ ID NO: 129989 - RNA, 22 nt, Human
gcacacaguauaugcucauuaa

SEQ ID NO: 129990 - RNA, 23 nt, Human
acagaaaucauuuguaagguacc

SEQ ID NO: 129991 - RNA, 22 nt, Human
gcaggccagcugugcagauggg

SEQ ID NO: 129992 - RNA, 22 nt, Human
gcugugugcucuggucuuucuu

SEQ ID NO: 129993 - RNA, 22 nt, Human
aagcccagcugaaagcauuuuu

SEQ ID NO: 129994 - RNA, 22 nt, Human
cauauaaauacaacauguguua

SEQ ID NO: 129995 - RNA, 22 nt, Human
auaugcacauacauacauaggu

SEQ ID NO: 129996 - RNA, 22 nt, Human
caaauccagaucccagucguag

SEQ ID NO: 129997 - RNA, 22 nt, Human
uggcugaaucugcagcaggaag

SEQ ID NO: 129998 - RNA, 22 nt, Human
cggcagcuccgcgccguaggac

SEQ ID NO: 129999 - RNA, 22 nt, Human
ccugugaggucaucugugguaa

SEQ ID NO: 130000 - RNA, 22 nt, Human
aauuuagaauucgcuagcuaau

SEQ ID NO: 130001 - RNA, 22 nt, Human
ucaaugauaguacaaucagccu

SEQ ID NO: 130002 - RNA, 22 nt, Human
uggauaaacucacuguaaguug

SEQ ID NO: 130003 - RNA, 22 nt, Human
agagaggcgaguuaccugugcu

SEQ ID NO: 130004 - RNA, 22 nt, Human
ggaggugguggcagugacaauu

SEQ ID NO: 130005 - RNA, 22 nt, Human
uacacuuuucugguuacucuug

SEQ ID NO: 130006 - RNA, 22 nt, Human
uggcuucugcuuucaguggagg

SEQ ID NO: 130007 - RNA, 22 nt, Human
uaugcacaauaugaucuauuug

SEQ ID NO: 130008 - RNA, 22 nt, Human
gggagucugggcuagacuccuu

SEQ ID NO: 130009 - RNA, 22 nt, Human
gcucugaggcugggagcacucu

SEQ ID NO: 130010 - RNA, 22 nt, Human
agcuggcauacuuugcuaggaa

SEQ ID NO: 130011 - RNA, 22 nt, Human
cagggccaaguuggugccuuuu

SEQ ID NO: 130012 - RNA, 22 nt, Human
cauuguuauagcauuacacacc

SEQ ID NO: 130013 - RNA, 22 nt, Human
ugggacaguuguccuccacucu

SEQ ID NO: 130014 - RNA, 23 nt, Human
aagcuuccuucacgucuccuggg

SEQ ID NO: 130015 - RNA, 22 nt, Human
ugucuuuaguugcuuagauuug

SEQ ID NO: 130016 - RNA, 22 nt, Human
cagggccucauccucagagauu

SEQ ID NO: 130017 - RNA, 22 nt, Human
acauauaugcugggacugugac

SEQ ID NO: 130018 - RNA, 20 nt, Human
guaaaauauggucuuugggu

SEQ ID NO: 130019 - RNA, 22 nt, Human
agcagggcagguaaggaucaga

SEQ ID NO: 130020 - RNA, 23 nt, Human
aggugccaacugagagcugagag

SEQ ID NO: 130021 - RNA, 22 nt, Human
ugcagucuggauguccucagau

SEQ ID NO: 130022 - RNA, 22 nt, Human
uccacagaauguaagauccaca

SEQ ID NO: 130023 - RNA, 22 nt, Human
gcagagcagugcuugcccagcg

SEQ ID NO: 130024 - RNA, 23 nt, Human
uggggagaguuacccuggaagcg

SEQ ID NO: 130025 - RNA, 22 nt, Human
ugcuguagcccugcacagugca

SEQ ID NO: 130026 - RNA, 22 nt, Human
uauuucugaggcccaggaagug

SEQ ID NO: 130027 - RNA, 22 nt, Human
uuaucuguuuucugugcguuuc

SEQ ID NO: 130028 - RNA, 22 nt, Human
cugcccuguggcucugagucau

SEQ ID NO: 130029 - RNA, 22 nt, Human
uauauagaaaagcagauguugg

SEQ ID NO: 130030 - RNA, 22 nt, Human
aguauuucugcucaugaaagag

SEQ ID NO: 130031 - RNA, 19 nt, Human
ucuauguggcagugauggc

SEQ ID NO: 130032 - RNA, 22 nt, Human
gaugccucuuuuggcugaauua

SEQ ID NO: 130033 - RNA, 22 nt, Human
cuucuuuacuuucuagaaauaa

SEQ ID NO: 130034 - RNA, 22 nt, Human
cuuguauuccccuaucucuaaa

SEQ ID NO: 130035 - RNA, 17 nt, Human
cgagggcuugcuggcuc

SEQ ID NO: 130036 - RNA, 22 nt, Human
uccaggacuagcauuucugaua

SEQ ID NO: 130037 - RNA, 22 nt, Human
uggccuggaagagaggucgagg

SEQ ID NO: 130038 - RNA, 22 nt, Human
cuguggcuaggaagcuguggga

SEQ ID NO: 130039 - RNA, 22 nt, Human
caggcagcgcucguggccuggc

SEQ ID NO: 130040 - RNA, 22 nt, Human
ccucuggucccagcucugcugc

SEQ ID NO: 130041 - RNA, 22 nt, Human
acauauuuccaugcagcauguc

SEQ ID NO: 130042 - RNA, 22 nt, Human
agguuauaugucauacugaagu

SEQ ID NO: 130043 - RNA, 22 nt, Human
acacaaguucuaaagauugcgc

SEQ ID NO: 130044 - RNA, 20 nt, Human
cuggcaggagcgagucuacc

SEQ ID NO: 130045 - RNA, 22 nt, Human
gcagugcuuuagucuguccuuu

SEQ ID NO: 130046 - RNA, 21 nt, Human
uaaaugugagcagggcugggc

SEQ ID NO: 130047 - RNA, 22 nt, Human
ggagugggaacaaugacauggu

SEQ ID NO: 130048 - RNA, 22 nt, Human
ccagagcccgggaccuggacuu

SEQ ID NO: 130049 - RNA, 22 nt, Human
auuguaauuuuagagaaagugg

SEQ ID NO: 130050 - RNA, 22 nt, Human
gcugccucccccauggcuggaa

SEQ ID NO: 130051 - RNA, 22 nt, Human
ccucugagagaaggccuucagc

SEQ ID NO: 130052 - RNA, 18 nt, Human
ccuggaccugucuccuuu

SEQ ID NO: 130053 - RNA, 22 nt, Human
uagaaaugauuuugaugcuuca

SEQ ID NO: 130054 - RNA, 22 nt, Human
aggagaaguaaggcuagaugau

SEQ ID NO: 130055 - RNA, 22 nt, Human
uggcucaguagcagugugguca

SEQ ID NO: 130056 - RNA, 18 nt, Human
ccucaggggaccuggcag

SEQ ID NO: 130057 - RNA, 22 nt, Human
aaaguuucaauagaggaagugg

SEQ ID NO: 130058 - RNA, 18 nt, Human
cagcagagacauucaaaa

SEQ ID NO: 130059 - RNA, 22 nt, Human
ucacaguauagaguuauuuugg

SEQ ID NO: 130060 - RNA, 22 nt, Human
agaggccaguggcugugcuguc

SEQ ID NO: 130061 - RNA, 21 nt, Human
ugugugcauaugcauguacau

SEQ ID NO: 130062 - RNA, 22 nt, Human
auauuuucacugaaccaaagua

SEQ ID NO: 130063 - RNA, 22 nt, Human
gccagcagguugucaaggagcu

SEQ ID NO: 130064 - RNA, 21 nt, Human
aaggcagaagcauggaaugag

SEQ ID NO: 130065 - RNA, 22 nt, Human
uacauuguucaugcaugagaaa

SEQ ID NO: 130066 - RNA, 22 nt, Human
uccucuggcucuuucccuagga

SEQ ID NO: 130067 - RNA, 22 nt, Human
ggguacaaagauuucauaagau

SEQ ID NO: 130068 - RNA, 22 nt, Human
ucauccuuuugcaugggaaggc

SEQ ID NO: 130069 - RNA, 22 nt, Human
cagaguguauucugcaguugca

SEQ ID NO: 130070 - RNA, 22 nt, Human
agcaugcugguguucauggcag

SEQ ID NO: 130071 - RNA, 22 nt, Human
gagcagugagugaauguugccu

SEQ ID NO: 130072 - RNA, 22 nt, Human
acccugagggguauagcagaag

SEQ ID NO: 130073 - RNA, 22 nt, Human
ccugccaggagcuggugcugca

SEQ ID NO: 130074 - RNA, 22 nt, Human
aggcuguggcaucacaucagga

SEQ ID NO: 130075 - RNA, 19 nt, Human
ucucagaggaaaaauugcu

SEQ ID NO: 130076 - RNA, 22 nt, Human
ugcaauaaggaguaauaguaaa

SEQ ID NO: 130077 - RNA, 22 nt, Human
cugcuggagguuggagcaugca

SEQ ID NO: 130078 - RNA, 22 nt, Human
gcccaggcuagcguagagugca

SEQ ID NO: 130079 - RNA, 22 nt, Human
cagccucuaagcacagccucuc

SEQ ID NO: 130080 - RNA, 22 nt, Human
auuuacagaugaugcuauuuga

SEQ ID NO: 130081 - RNA, 22 nt, Human
caucagcagucacaugaugcug

SEQ ID NO: 130082 - RNA, 20 nt, Human
cccucccagaugcuucccaa

SEQ ID NO: 130083 - RNA, 22 nt, Human
gcugagcucccagcaguaucug

SEQ ID NO: 130084 - RNA, 22 nt, Human
uccucagggggccaacccagcc

SEQ ID NO: 130085 - RNA, 22 nt, Human
guguuuccaguucagaaagcaa

SEQ ID NO: 130086 - RNA, 22 nt, Human
cacugcuuauaaauucuaggca

SEQ ID NO: 130087 - RNA, 22 nt, Human
ucccagggacugggcuaggcuu

SEQ ID NO: 130088 - RNA, 22 nt, Human
uuucuaucugagaagauaucua

SEQ ID NO: 130089 - RNA, 22 nt, Human
uucugcugguaacuauguuuca

SEQ ID NO: 130090 - RNA, 22 nt, Human
acaguaguccuuuauuuugguu

SEQ ID NO: 130091 - RNA, 22 nt, Human
caggaaauaucuccuggcagag

SEQ ID NO: 130092 - RNA, 19 nt, Human
uggcagugugggguaugaa

SEQ ID NO: 130093 - RNA, 22 nt, Human
uggccuggaaccuggcagggac

SEQ ID NO: 130094 - RNA, 22 nt, Human
uggcagcuugaaugcagucuuu

SEQ ID NO: 130095 - RNA, 22 nt, Human
ugcugugagguugagaaggaag

SEQ ID NO: 130096 - RNA, 22 nt, Human
ucuguuugcuggugcauggguu

SEQ ID NO: 130097 - RNA, 18 nt, Human
uggcagagugucuguucu

SEQ ID NO: 130098 - RNA, 22 nt, Human
uauguacaguccuuaacuuaaa

SEQ ID NO: 130099 - RNA, 20 nt, Human
uuucugugcccaggucuguu

SEQ ID NO: 130100 - RNA, 22 nt, Human
cuucacagucuuuauuuccucc

SEQ ID NO: 130101 - RNA, 22 nt, Human
guggcagcaaaauccugcauuc

SEQ ID NO: 130102 - RNA, 22 nt, Human
caugcuuucuguccaaauguua

SEQ ID NO: 130103 - RNA, 22 nt, Human
cugaaggauuuaguucuuugcu

SEQ ID NO: 130104 - RNA, 22 nt, Human
caguuuuucaaaauuacaugau

SEQ ID NO: 130105 - RNA, 22 nt, Human
ucuggccacccgaggccccugc

SEQ ID NO: 130106 - RNA, 22 nt, Human
uguuuuguuuaugagagcacag

SEQ ID NO: 130107 - RNA, 22 nt, Human
gcuuuacagggcacaaagggag

SEQ ID NO: 130108 - RNA, 22 nt, Human
gccuggguccacugaucaugcu

SEQ ID NO: 130109 - RNA, 22 nt, Human
gcuggugccuuguuguuguuac

SEQ ID NO: 130110 - RNA, 22 nt, Human
aaaguguggagauugaacuaaa

SEQ ID NO: 130111 - RNA, 22 nt, Human
ggugaggcccagugaucugugu

SEQ ID NO: 130112 - RNA, 19 nt, Human
acagaaauguaagugagac

SEQ ID NO: 130113 - RNA, 22 nt, Human
gagaggccauggcugugcagug

SEQ ID NO: 130114 - RNA, 22 nt, Human
ccucucuuggauguggaugggu

SEQ ID NO: 130115 - RNA, 22 nt, Human
gaaccucagugaaacuggaggu

SEQ ID NO: 130116 - RNA, 22 nt, Human
ucaggagcagcaugggugagag

SEQ ID NO: 130117 - RNA, 22 nt, Human
cagagcugcuucccaguuugug

SEQ ID NO: 130118 - RNA, 22 nt, Human
ccagccuucugagcugccugga

SEQ ID NO: 130119 - RNA, 22 nt, Human
ugggaggaucgcuugagcccag

SEQ ID NO: 130120 - RNA, 22 nt, Human
ucccagcauuaaugccugucag

SEQ ID NO: 130121 - RNA, 22 nt, Human
auauauuuugaauagccucugu

SEQ ID NO: 130122 - RNA, 21 nt, Human
cucaggaucuuauauauuagu

SEQ ID NO: 130123 - RNA, 22 nt, Human
uuuagcuugaaucuuguuuaaa

SEQ ID NO: 130124 - RNA, 22 nt, Human
cuccaggccagggaaguggaca

SEQ ID NO: 130125 - RNA, 22 nt, Human
uguaugcaaauuuauuagcaca

SEQ ID NO: 130126 - RNA, 20 nt, Human
uuucaguugguuaauggcau

SEQ ID NO: 130127 - RNA, 22 nt, Human
auacauguaacugcauuguaau

SEQ ID NO: 130128 - RNA, 22 nt, Human
auucuucagcaggggacacuau

SEQ ID NO: 130129 - RNA, 22 nt, Human
ccuggugcuuaccagagcuuuu

SEQ ID NO: 130130 - RNA, 22 nt, Human
cagagccacuuggagaugagaa

SEQ ID NO: 130131 - RNA, 22 nt, Human
ccuggcagacagcacugaagcu

SEQ ID NO: 130132 - RNA, 22 nt, Human
aggccagacagcuagaaacagg

SEQ ID NO: 130133 - RNA, 22 nt, Human
cucugguguccuuuagaauuua

SEQ ID NO: 130134 - RNA, 22 nt, Human
agagcccugaagcagagcuaaa

SEQ ID NO: 130135 - RNA, 22 nt, Human
gugccugugcggacucagggaa

SEQ ID NO: 130136 - RNA, 22 nt, Human
ucucagagauguuagggaagag

SEQ ID NO: 130137 - RNA, 22 nt, Human
ggucucagcuggaguccuuggu

SEQ ID NO: 130138 - RNA, 22 nt, Human
gggauggggucaacauguaccu

SEQ ID NO: 130139 - RNA, 22 nt, Human
cgcagcagccccgugguaggug

SEQ ID NO: 130140 - RNA, 22 nt, Human
auguguauccaucugucuauuu

SEQ ID NO: 130141 - RNA, 22 nt, Human
uccucugcuccaucuuuacugu

SEQ ID NO: 130142 - RNA, 22 nt, Human
cuagaaaugcucaagagaaagu

SEQ ID NO: 130143 - RNA, 22 nt, Human
agaagauuuagguugacgcuau

SEQ ID NO: 130144 - RNA, 22 nt, Human
uccaggcuagguuuacaggaca

SEQ ID NO: 130145 - RNA, 22 nt, Human
auuauaggcuugagccaccgug

SEQ ID NO: 130146 - RNA, 22 nt, Human
cagcaauaacucaaagccauuu

SEQ ID NO: 130147 - RNA, 22 nt, Human
gcuccucugucaaaugagagug

SEQ ID NO: 130148 - RNA, 22 nt, Human
gagcugggacauggguccucuc

SEQ ID NO: 130149 - RNA, 22 nt, Human
uuuacuguuuuauauuguccag

SEQ ID NO: 130150 - RNA, 22 nt, Human
uguauuuugugaggaucacucu

SEQ ID NO: 130151 - RNA, 22 nt, Human
ccagcagagucuaggaaggagg

SEQ ID NO: 130152 - RNA, 22 nt, Human
uaacaauaguguuugcuaguca

SEQ ID NO: 130153 - RNA, 22 nt, Human
gcuggggagggcgucaaggcca

SEQ ID NO: 130154 - RNA, 22 nt, Human
gugcuuccaucuagagggucac

SEQ ID NO: 130155 - RNA, 22 nt, Human
gaaugcacacgugugugcaugc

SEQ ID NO: 130156 - RNA, 22 nt, Human
ugucucugguauuaggugaaaa

SEQ ID NO: 130157 - RNA, 22 nt, Human
agauuuccaucuuuuucaugug

SEQ ID NO: 130158 - RNA, 22 nt, Human
caggugggaccaugauagggca

SEQ ID NO: 130159 - RNA, 22 nt, Human
cagcaggaggugagaugugacc

SEQ ID NO: 130160 - RNA, 22 nt, Human
ggagcugggaauuggaucaucu

SEQ ID NO: 130161 - RNA, 22 nt, Human
uggccugccucccggcuucuuu

SEQ ID NO: 130162 - RNA, 22 nt, Human
ccaggccucccuuuuccagcca

SEQ ID NO: 130163 - RNA, 22 nt, Human
uggcaguguauagguggcuccu

SEQ ID NO: 130164 - RNA, 22 nt, Human
auuguucuaaggguuuaauuaa

SEQ ID NO: 130165 - RNA, 22 nt, Human
acugaguguaggacuuugaguu

SEQ ID NO: 130166 - RNA, 22 nt, Human
aaguauauacuaaauguuaauc

SEQ ID NO: 130167 - RNA, 22 nt, Human
uauucacauguacauaugcuca

SEQ ID NO: 130168 - RNA, 22 nt, Human
uauuucuuguuauucucguuga

SEQ ID NO: 130169 - RNA, 22 nt, Human
ggauaagaaaauuguaauaacu

SEQ ID NO: 130170 - RNA, 22 nt, Human
ccucuggggugagugggccacu

SEQ ID NO: 130171 - RNA, 22 nt, Human
cuuuccagcauuuccuugugaa

SEQ ID NO: 130172 - RNA, 22 nt, Human
ccugggcuuucaaaaccagccu

SEQ ID NO: 130173 - RNA, 22 nt, Human
ucgcugugguuucuguacaugg

SEQ ID NO: 130174 - RNA, 22 nt, Human
aggccugggucucgugccuacc

SEQ ID NO: 130175 - RNA, 22 nt, Human
agaggccagcagugccuaucug

SEQ ID NO: 130176 - RNA, 22 nt, Human
caggugggagcgaggagcuacu

SEQ ID NO: 130177 - RNA, 20 nt, Human
caggccagagguuugauggc

SEQ ID NO: 130178 - RNA, 22 nt, Human
gaggaguguauuccacaccacu

SEQ ID NO: 130179 - RNA, 22 nt, Human
cuuucucuucacugucaugauc

SEQ ID NO: 130180 - RNA, 22 nt, Human
ccugccagugaagcugacgggc

SEQ ID NO: 130181 - RNA, 22 nt, Human
agauaugacuagaagcucauuu

SEQ ID NO: 130182 - RNA, 22 nt, Human
cccucugccugggaccaagucc

SEQ ID NO: 130183 - RNA, 23 nt, Human
acugagccagggccugggucagc

SEQ ID NO: 130184 - RNA, 22 nt, Human
aggaaaugcugaugcuccugga

SEQ ID NO: 130185 - RNA, 19 nt, Human
augucuguugaauuucaua

SEQ ID NO: 130186 - RNA, 22 nt, Human
gcugucuucacuuccugguuuc

SEQ ID NO: 130187 - RNA, 22 nt, Human
guccucuggugaaagcauuccc

SEQ ID NO: 130188 - RNA, 22 nt, Human
ccugagugaauucccucacugu

SEQ ID NO: 130189 - RNA, 19 nt, Human
cugggagguguucagagaa

SEQ ID NO: 130190 - RNA, 22 nt, Human
ccuggcagcgccgaagcuggcc

SEQ ID NO: 130191 - RNA, 22 nt, Human
ugcagccaggaaauauuugcug

SEQ ID NO: 130192 - RNA, 22 nt, Human
aaucagucauuagcucugaccu

SEQ ID NO: 130193 - RNA, 22 nt, Human
cuuuacauuaauuucuacugau

SEQ ID NO: 130194 - RNA, 22 nt, Human
ugaagcaggguggccagauugu

SEQ ID NO: 130195 - RNA, 19 nt, Human
ccagguggaacugagguag

SEQ ID NO: 130196 - RNA, 22 nt, Human
caugucuggguauaugcauaug

SEQ ID NO: 130197 - RNA, 19 nt, Human
ucccagagucuagagguug

SEQ ID NO: 130198 - RNA, 22 nt, Human
ugggcagaucuuugguggcuag

SEQ ID NO: 130199 - RNA, 22 nt, Human
agccaggcugcaguuggcuggc

SEQ ID NO: 130200 - RNA, 22 nt, Human
uuugcaaagugacuauuauaug

SEQ ID NO: 130201 - RNA, 22 nt, Human
cuguggaaaauuuguauguaau

SEQ ID NO: 130202 - RNA, 22 nt, Human
uggcucagaacuacuucuaguu

SEQ ID NO: 130203 - RNA, 22 nt, Human
gcagcccagguguagcucuuug

SEQ ID NO: 130204 - RNA, 22 nt, Human
gguggcugguuuuauaagaggu

SEQ ID NO: 130205 - RNA, 22 nt, Human
uugcaaaggggaauaaagcaau

SEQ ID NO: 130206 - RNA, 22 nt, Human
agcaucuggugagggccuaguu

SEQ ID NO: 130207 - RNA, 20 nt, Human
gcacugaaauucaauguuug

SEQ ID NO: 130208 - RNA, 22 nt, Human
ccugcagagccacgugccagcg

SEQ ID NO: 130209 - RNA, 21 nt, Human
caggaaaagcggaagucuagc

SEQ ID NO: 130210 - RNA, 22 nt, Human
agccucuguagaaagcagugug

SEQ ID NO: 130211 - RNA, 22 nt, Human
gcucagagggaacaaggggcug

SEQ ID NO: 130212 - RNA, 21 nt, Human
agggaaagaaaaugagcuaau

SEQ ID NO: 130213 - RNA, 22 nt, Human
cuggccuggagccucugggugg

SEQ ID NO: 130214 - RNA, 22 nt, Human
gcucucugggugugucuagaua

SEQ ID NO: 130215 - RNA, 23 nt, Human
agagcuuagggaauucacaugag

SEQ ID NO: 130216 - RNA, 22 nt, Human
cuggcuccaucacugggugaug

SEQ ID NO: 130217 - RNA, 19 nt, Human
gcaugcuugguggcuucug

SEQ ID NO: 130218 - RNA, 22 nt, Human
aguuuucugcuaaaccagcuaa

SEQ ID NO: 130219 - RNA, 22 nt, Human
ucucuuucuauugcaccaugcu

SEQ ID NO: 130220 - RNA, 22 nt, Human
auguagcaucuauccugauaaa

SEQ ID NO: 130221 - RNA, 22 nt, Human
aaguuugagagccuuuaguaua

SEQ ID NO: 130222 - RNA, 22 nt, Human
cucugggcacauuuuccaggac

SEQ ID NO: 130223 - RNA, 22 nt, Human
ggcuauguguguccaguguauu

SEQ ID NO: 130224 - RNA, 22 nt, Human
caggggccggcuguccgugccc

SEQ ID NO: 130225 - RNA, 22 nt, Human
acugucugcuggccccugguua

SEQ ID NO: 130226 - RNA, 22 nt, Human
auauguguacgugcaguauaua

SEQ ID NO: 130227 - RNA, 22 nt, Human
uccuugaaaggggcugcagggc

SEQ ID NO: 130228 - RNA, 22 nt, Human
gccaggccugcaagugcuggug

SEQ ID NO: 130229 - RNA, 22 nt, Human
agcuaggacagguagagauggg

SEQ ID NO: 130230 - RNA, 22 nt, Human
cugcagcuauauuuucccacag

SEQ ID NO: 130231 - RNA, 22 nt, Human
uaaaucucacuggguauauugg

SEQ ID NO: 130232 - RNA, 22 nt, Human
acuuuugugcaggucucuccca

SEQ ID NO: 130233 - RNA, 21 nt, Human
cagagcagcguucugcugugg

SEQ ID NO: 130234 - RNA, 22 nt, Human
cauaagaaauaaugaugaugac

SEQ ID NO: 130235 - RNA, 22 nt, Human
cucagcagugacaagagaguau

SEQ ID NO: 130236 - RNA, 22 nt, Human
acagcuuuucaauucugcugag

SEQ ID NO: 130237 - RNA, 22 nt, Human
ugagccuguccugugcauguga

SEQ ID NO: 130238 - RNA, 22 nt, Human
uaauaaaugaaagugcuggcau

SEQ ID NO: 130239 - RNA, 22 nt, Human
augggaguuuucucugaugcuc

SEQ ID NO: 130240 - RNA, 21 nt, Human
ugggggagaauugguugcuuu

SEQ ID NO: 130241 - RNA, 22 nt, Human
auuuucucucaaaccuuaaaau

SEQ ID NO: 130242 - RNA, 22 nt, Human
gucaggauuuuaaaaucccagu

SEQ ID NO: 130243 - RNA, 22 nt, Human
ccagccugguucagaauuggcu

SEQ ID NO: 130244 - RNA, 22 nt, Human
caguggguccuaaguacaguuc

SEQ ID NO: 130245 - RNA, 22 nt, Human
ugcugcucuucaccauggccuc

SEQ ID NO: 130246 - RNA, 22 nt, Human
cagcaggcccagaguuucaugg

SEQ ID NO: 130247 - RNA, 22 nt, Human
aauauuuuugaggcccuguuau

SEQ ID NO: 130248 - RNA, 22 nt, Human
augguuuguguggcccagauga

SEQ ID NO: 130249 - RNA, 22 nt, Human
cugcucugaagccaggauucug

SEQ ID NO: 130250 - RNA, 22 nt, Human
ccagcagggaaaaacccaccaa

SEQ ID NO: 130251 - RNA, 22 nt, Human
ucuucagauugcacugagcaag

SEQ ID NO: 130252 - RNA, 22 nt, Human
uaaggcacccuucugaguagag

SEQ ID NO: 130253 - RNA, 22 nt, Human
agagggcccauguugggcugcu

SEQ ID NO: 130254 - RNA, 22 nt, Human
gggauggcuuuguggcugacuc

SEQ ID NO: 130255 - RNA, 22 nt, Human
cuguggcugcagccuugguccu

SEQ ID NO: 130256 - RNA, 22 nt, Human
ucucagaguuugaaucuggagu

SEQ ID NO: 130257 - RNA, 22 nt, Human
ucaggaaagaagaugcucagug

SEQ ID NO: 130258 - RNA, 22 nt, Human
gcucccacaaccuucuugcucc

SEQ ID NO: 130259 - RNA, 23 nt, Human
uuucauaugguguggaugaagaa

SEQ ID NO: 130260 - RNA, 17 nt, Human
uagcugccccgaaugcu

SEQ ID NO: 130261 - RNA, 22 nt, Human
uuucucucagccuguagaaacu

SEQ ID NO: 130262 - RNA, 22 nt, Human
cugccucucagccugaccgcca

SEQ ID NO: 130263 - RNA, 22 nt, Human
acaugauuggacuccuuccccu

SEQ ID NO: 130264 - RNA, 22 nt, Human
ugucccagucaaggcugucauc

SEQ ID NO: 130265 - RNA, 22 nt, Human
auguuauuaaaguacagauucu

SEQ ID NO: 130266 - RNA, 22 nt, Human
gccuggagaggaagccggugga

SEQ ID NO: 130267 - RNA, 22 nt, Human
agagcugugaaaaugagguuug

SEQ ID NO: 130268 - RNA, 22 nt, Human
ggugggcacccgagacuggauc

SEQ ID NO: 130269 - RNA, 22 nt, Human
uccagccacucagcagggauug

SEQ ID NO: 130270 - RNA, 22 nt, Human
gugccucagcaccgccugcagc

SEQ ID NO: 130271 - RNA, 22 nt, Human
uuugcauuuguucaaguauuga

SEQ ID NO: 130272 - RNA, 17 nt, Human
uggagcugcguguguuc

SEQ ID NO: 130273 - RNA, 22 nt, Human
uucuuuaccacuacucuuccaa

SEQ ID NO: 130274 - RNA, 22 nt, Human
agacagagauacuauguuguca

SEQ ID NO: 130275 - RNA, 22 nt, Human
uccagggagauacuggcugcca

SEQ ID NO: 130276 - RNA, 22 nt, Human
gaaaugugcagaauguguuaga

SEQ ID NO: 130277 - RNA, 22 nt, Human
uuggcugugagggguugcacag

SEQ ID NO: 130278 - RNA, 22 nt, Human
cuuuucucugcgggucuuucau

SEQ ID NO: 130279 - RNA, 20 nt, Human
ugaugguucuuuccggguug

SEQ ID NO: 130280 - RNA, 22 nt, Human
ggugugugaggagucacuuagu

SEQ ID NO: 130281 - RNA, 22 nt, Human
agccccaguccgcugcgggcgg

SEQ ID NO: 130282 - RNA, 22 nt, Human
cuggagaggcugggaacagguu

SEQ ID NO: 130283 - RNA, 20 nt, Human
agugccagggcaggugagag

SEQ ID NO: 130284 - RNA, 22 nt, Human
uggcucaggggucuggcucugu

SEQ ID NO: 130285 - RNA, 22 nt, Human
uggacucagaaguguucuuuua

SEQ ID NO: 130286 - RNA, 18 nt, Human
gcaggugccacugcuguu

SEQ ID NO: 130287 - RNA, 19 nt, Human
agcagccauagacaauaug

SEQ ID NO: 130288 - RNA, 22 nt, Human
uguguugugucaccuaucaugc

SEQ ID NO: 130289 - RNA, 22 nt, Human
accuuuuuucagaacucuaaag

SEQ ID NO: 130290 - RNA, 22 nt, Human
ugggcaaguaucggacucugag

SEQ ID NO: 130291 - RNA, 22 nt, Human
cacagcuugggcucugacaaua

SEQ ID NO: 130292 - RNA, 22 nt, Human
ugugaugguucacugggcauga

SEQ ID NO: 130293 - RNA, 20 nt, Human
auacaguaggugcucaauau

SEQ ID NO: 130294 - RNA, 22 nt, Human
cagugcaugaaacaauaugcag

SEQ ID NO: 130295 - RNA, 22 nt, Human
uuuaaagaaauuccucaucuuu

SEQ ID NO: 130296 - RNA, 22 nt, Human
aguccaaggagagacagcauuu

SEQ ID NO: 130297 - RNA, 22 nt, Human
aggggugugcauccuggaggau

SEQ ID NO: 130298 - RNA, 22 nt, Human
cuuauguauauuuggaacguac

SEQ ID NO: 130299 - RNA, 22 nt, Human
agcugcucaggagagccagguc

SEQ ID NO: 130300 - RNA, 22 nt, Human
ugcugccaccugguggcugaag

SEQ ID NO: 130301 - RNA, 22 nt, Human
aagcuccccgaaacccaccucu

SEQ ID NO: 130302 - RNA, 22 nt, Human
gauauuuucauucggaugcuca

SEQ ID NO: 130303 - RNA, 22 nt, Human
agugccaggagcaaggagcucc

SEQ ID NO: 130304 - RNA, 22 nt, Human
ucucccacagccgugcuucaag

SEQ ID NO: 130305 - RNA, 20 nt, Human
cugugccuaaaccuccgggu

SEQ ID NO: 130306 - RNA, 22 nt, Human
cccugcugucaggugcugggag

SEQ ID NO: 130307 - RNA, 22 nt, Human
uuagauaacaguagaauaucaa

SEQ ID NO: 130308 - RNA, 22 nt, Human
gccugccuagaauugcagcuuu

SEQ ID NO: 130309 - RNA, 22 nt, Human
ugucagaacucuauugaugucc

SEQ ID NO: 130310 - RNA, 22 nt, Human
cugcugccggcgagccucccuu

SEQ ID NO: 130311 - RNA, 22 nt, Human
gugugguggcccuccuucaggc

SEQ ID NO: 130312 - RNA, 22 nt, Human
uuuuacaggugaaaaaugaaga

SEQ ID NO: 130313 - RNA, 18 nt, Human
cauuguacaaugcuuuau

SEQ ID NO: 130314 - RNA, 22 nt, Human
uccuucaguuaucacaguacug

SEQ ID NO: 130315 - RNA, 22 nt, Human
cugcugugggcaggguagcugg

SEQ ID NO: 130316 - RNA, 21 nt, Human
cugcaucucauagaacauguc

SEQ ID NO: 130317 - RNA, 22 nt, Human
gcuggcuguguuucaucucuga

SEQ ID NO: 130318 - RNA, 22 nt, Human
ucacugaauacuugucucaucc

SEQ ID NO: 130319 - RNA, 22 nt, Human
uaauuauuaugacaacaauugc

SEQ ID NO: 130320 - RNA, 22 nt, Human
gccagccuucuguggccugcaa

SEQ ID NO: 130321 - RNA, 17 nt, Human
gguggccugcaguggcu

SEQ ID NO: 130322 - RNA, 18 nt, Human
agagaugguguagaguuu

SEQ ID NO: 130323 - RNA, 22 nt, Human
gggacagcuguagugcuuggcu

SEQ ID NO: 130324 - RNA, 22 nt, Human
cccuggcagaaugucucugggc

SEQ ID NO: 130325 - RNA, 22 nt, Human
gugcuuaauacaugucaauaac

SEQ ID NO: 130326 - RNA, 22 nt, Human
cccaggcagagagcuggugagc

SEQ ID NO: 130327 - RNA, 22 nt, Human
cacagggcagugauuguccaca

SEQ ID NO: 130328 - RNA, 22 nt, Human
caguacuuauuucuauuuaggg

SEQ ID NO: 130329 - RNA, 22 nt, Human
ccaggcagccaagugugugugu

SEQ ID NO: 130330 - RNA, 22 nt, Human
acaaaguuaacaguuggauagu

SEQ ID NO: 130331 - RNA, 22 nt, Human
caguugcuacaguucaagugug

SEQ ID NO: 130332 - RNA, 17 nt, Human
aguggcaggcagauggg

SEQ ID NO: 130333 - RNA, 22 nt, Human
uggcagaguggaccauacucaa

SEQ ID NO: 130334 - RNA, 22 nt, Human
ugcuucuggaaacaguggcugu

SEQ ID NO: 130335 - RNA, 17 nt, Human
acagggcagaaacagcu

SEQ ID NO: 130336 - RNA, 22 nt, Human
uauuucuggcuuugagggugau

SEQ ID NO: 130337 - RNA, 22 nt, Human
ucagagcugcccaugcaagggg

SEQ ID NO: 130338 - RNA, 22 nt, Human
cagguggggagaguguggagca

SEQ ID NO: 130339 - RNA, 22 nt, Human
aaauucuuucauggcuaauaag

SEQ ID NO: 130340 - RNA, 18 nt, Human
uggccuggagacaacucu

SEQ ID NO: 130341 - RNA, 22 nt, Human
cugcuguguugccagugucacc

SEQ ID NO: 130342 - RNA, 22 nt, Human
cucugcagaggcccaaggcuga

SEQ ID NO: 130343 - RNA, 22 nt, Human
gcucaaggcaggcagacaugag

SEQ ID NO: 130344 - RNA, 20 nt, Human
gcugaccccugcugucaugc

SEQ ID NO: 130345 - RNA, 22 nt, Human
aaaugcauugguuucuacuugu

SEQ ID NO: 130346 - RNA, 22 nt, Human
gaggccugaaaggggaccuaug

SEQ ID NO: 130347 - RNA, 22 nt, Human
uucugugaaucuuuuuucccac

SEQ ID NO: 130348 - RNA, 22 nt, Human
gaagaaagauuggcaugcuuca

SEQ ID NO: 130349 - RNA, 22 nt, Human
aggcacaguuucauccccgggc

SEQ ID NO: 130350 - RNA, 18 nt, Human
ugucucaggcugaaacag

SEQ ID NO: 130351 - RNA, 17 nt, Human
uuccugugguuugaucu

SEQ ID NO: 130352 - RNA, 22 nt, Human
gaguguguucuuuaugcuguga

SEQ ID NO: 130353 - RNA, 20 nt, Human
agagccuugaggaagaugau

SEQ ID NO: 130354 - RNA, 22 nt, Human
uggacaggaucugagacugaga

SEQ ID NO: 130355 - RNA, 22 nt, Human
cauagagugauguaagguaugu

SEQ ID NO: 130356 - RNA, 22 nt, Human
guggcuucugcggugugcgcag

SEQ ID NO: 130357 - RNA, 18 nt, Human
cugucuuuuuucucucca

SEQ ID NO: 130358 - RNA, 22 nt, Human
acagaguacauucagagacuau

SEQ ID NO: 130359 - RNA, 22 nt, Human
gcucccuccaugaggcagaccg

SEQ ID NO: 130360 - RNA, 22 nt, Human
cauuugcagagggugacacucu

SEQ ID NO: 130361 - RNA, 22 nt, Human
acccagcuggaugcauggaggc

SEQ ID NO: 130362 - RNA, 19 nt, Human
uugaaagauuagcuuucua

SEQ ID NO: 130363 - RNA, 22 nt, Human
gaugcacaugugaguauagaag

SEQ ID NO: 130364 - RNA, 22 nt, Human
cucucuucccgugaguguugca

SEQ ID NO: 130365 - RNA, 22 nt, Human
ucaauuaugccauugcaauauu

SEQ ID NO: 130366 - RNA, 22 nt, Human
aggagcugagucagcccgacag

SEQ ID NO: 130367 - RNA, 21 nt, Human
guauucuuuaugaagugaaaa

SEQ ID NO: 130368 - RNA, 22 nt, Human
uacagugacuggacuuugucau

SEQ ID NO: 130369 - RNA, 22 nt, Human
ggcucuggucagugaggggccu

SEQ ID NO: 130370 - RNA, 22 nt, Human
cuggcugcaggaaggagugggc

SEQ ID NO: 130371 - RNA, 22 nt, Human
uggcugccuagugucugagcag

SEQ ID NO: 130372 - RNA, 22 nt, Human
agcuguguuauuagaaaccugc

SEQ ID NO: 130373 - RNA, 22 nt, Human
acaguuauauacauguagcugu

SEQ ID NO: 130374 - RNA, 22 nt, Human
acaauucuggguauuuauauag

SEQ ID NO: 130375 - RNA, 22 nt, Human
aaaucaguuagugguaggauug

SEQ ID NO: 130376 - RNA, 18 nt, Human
gcuccuggaccaggucac

SEQ ID NO: 130377 - RNA, 22 nt, Human
ggcagcuccucaaaaaauuaaa

SEQ ID NO: 130378 - RNA, 22 nt, Human
uguguguguuuauaaaucuaaa

SEQ ID NO: 130379 - RNA, 22 nt, Human
ggcucuggugugaagcagccuc

SEQ ID NO: 130380 - RNA, 21 nt, Human
aggucccagguuugggcagca

SEQ ID NO: 130381 - RNA, 22 nt, Human
uggagcaggacugcugcccuca

SEQ ID NO: 130382 - RNA, 20 nt, Human
agaauucuuacccuuugaug

SEQ ID NO: 130383 - RNA, 22 nt, Human
aucaggaugaagcuguagcgaa

SEQ ID NO: 130384 - RNA, 22 nt, Human
uggccuggcugcccugucugga

SEQ ID NO: 130385 - RNA, 22 nt, Human
agaggcugucccuugcuauucc

SEQ ID NO: 130386 - RNA, 22 nt, Human
cagccuguagaauacaguaaau

SEQ ID NO: 130387 - RNA, 22 nt, Human
ucaugccacuuacaaaauaaug

SEQ ID NO: 130388 - RNA, 22 nt, Human
aaggcacucauucaaggagaua

SEQ ID NO: 130389 - RNA, 22 nt, Human
uucuauguuaguaugggucucc

SEQ ID NO: 130390 - RNA, 19 nt, Human
auacacauacguaaacuga

SEQ ID NO: 130391 - RNA, 22 nt, Human
cugaggcucccucgggucugcu

SEQ ID NO: 130392 - RNA, 23 nt, Human
caguauaauguauggauggggca

SEQ ID NO: 130393 - RNA, 22 nt, Human
gucagcaggguccccuugagug

SEQ ID NO: 130394 - RNA, 20 nt, Human
ugcuguguggcccagcauga

SEQ ID NO: 130395 - RNA, 18 nt, Human
gugcugugggcaguggcc

SEQ ID NO: 130396 - RNA, 22 nt, Human
agagccuggucugagauaggac

SEQ ID NO: 130397 - RNA, 22 nt, Human
cugccugggccggccacccucu

SEQ ID NO: 130398 - RNA, 19 nt, Human
uauguguguguauuuacau

SEQ ID NO: 130399 - RNA, 20 nt, Human
gcuuccuucccagcccccac

SEQ ID NO: 130400 - RNA, 22 nt, Human
agccagcuggagaccacuguuu

SEQ ID NO: 130401 - RNA, 22 nt, Human
acagagccacuuuggugccuac

SEQ ID NO: 130402 - RNA, 22 nt, Human
ucucucuucaugcuuuuagaau

SEQ ID NO: 130403 - RNA, 22 nt, Human
uugcauugauguuccuucuugc

SEQ ID NO: 130404 - RNA, 22 nt, Human
ucaaauaccagcaauuucaugu

SEQ ID NO: 130405 - RNA, 22 nt, Human
aaaugucuuucaauagagaaau

SEQ ID NO: 130406 - RNA, 22 nt, Human
cuggcuggucaucagcaguacg

SEQ ID NO: 130407 - RNA, 21 nt, Human
uaauaauuccacuacagagua

SEQ ID NO: 130408 - RNA, 22 nt, Human
auguguguauauauagucauuu

SEQ ID NO: 130409 - RNA, 22 nt, Human
ucagaggaauaaugcugcauuu

SEQ ID NO: 130410 - RNA, 22 nt, Human
uuguguauuuccugaagguaag

SEQ ID NO: 130411 - RNA, 22 nt, Human
uguuuucuauuaccugagauug

SEQ ID NO: 130412 - RNA, 22 nt, Human
ggccagagaauaugccuuacgu

SEQ ID NO: 130413 - RNA, 22 nt, Human
gguguccaucaggcugugcuuc

SEQ ID NO: 130414 - RNA, 19 nt, Human
ggcugggucuggcagguuc

SEQ ID NO: 130415 - RNA, 19 nt, Human
gugaggauacugcucagag

SEQ ID NO: 130416 - RNA, 20 nt, Human
aucuucuuggccagcuugcu

SEQ ID NO: 130417 - RNA, 22 nt, Human
aucauuacuccuguaaaauugu

SEQ ID NO: 130418 - RNA, 22 nt, Human
uacagguagggucuauguuaga

SEQ ID NO: 130419 - RNA, 22 nt, Human
ucuaggagaaccaucagggagg

SEQ ID NO: 130420 - RNA, 22 nt, Human
gugggaugguagguagguaaua

SEQ ID NO: 130421 - RNA, 22 nt, Human
ccaaggaguagagcaggaagcu

SEQ ID NO: 130422 - RNA, 22 nt, Human
cuuccaaagcacuuuauggacc

SEQ ID NO: 130423 - RNA, 22 nt, Human
ggucagguuuuuaggagugacc

SEQ ID NO: 130424 - RNA, 22 nt, Human
ucagcaaugugauacugugcaa

SEQ ID NO: 130425 - RNA, 21 nt, Human
agcugcuccagggagcucagg

SEQ ID NO: 130426 - RNA, 22 nt, Human
ugggcugcagggguugagagcu

SEQ ID NO: 130427 - RNA, 22 nt, Human
uuuacaguaagguggaugguac

SEQ ID NO: 130428 - RNA, 23 nt, Human
auuucuaggggauuuucuggugc

SEQ ID NO: 130429 - RNA, 22 nt, Human
uuacaaagcguugagacaagua

SEQ ID NO: 130430 - RNA, 22 nt, Human
ucugucacccaggcuggagugc

SEQ ID NO: 130431 - RNA, 22 nt, Human
uauuuguauguguguacauaua

SEQ ID NO: 130432 - RNA, 22 nt, Human
uacauggugguggcacuugacu

SEQ ID NO: 130433 - RNA, 22 nt, Human
gcugauguuucaaguauagcuu

SEQ ID NO: 130434 - RNA, 22 nt, Human
cauuucuguacauguuuuggug

SEQ ID NO: 130435 - RNA, 22 nt, Human
aggcacuggucuaccccuuagu

SEQ ID NO: 130436 - RNA, 22 nt, Human
cugaggucucuuuccauaguga

SEQ ID NO: 130437 - RNA, 22 nt, Human
uucaugugaucacagauuguaa

SEQ ID NO: 130438 - RNA, 22 nt, Human
cagcagggggcagcgcagauca

SEQ ID NO: 130439 - RNA, 22 nt, Human
uuucacagcugucuuccgucuc

SEQ ID NO: 130440 - RNA, 22 nt, Human
caggauauuuacguucugcuac

SEQ ID NO: 130441 - RNA, 22 nt, Human
agugaaauaugcccauugcugu

SEQ ID NO: 130442 - RNA, 22 nt, Human
uggcugccuagucccucagccu

SEQ ID NO: 130443 - RNA, 22 nt, Human
guggguggaggcgucgagggca

SEQ ID NO: 130444 - RNA, 22 nt, Human
gcagggcagcuuagucccuguc

SEQ ID NO: 130445 - RNA, 19 nt, Human
ggucacagggguuacaagg

SEQ ID NO: 130446 - RNA, 22 nt, Human
cagggacauugguggccagguu

SEQ ID NO: 130447 - RNA, 20 nt, Human
ccagguggugccuggagagg

SEQ ID NO: 130448 - RNA, 22 nt, Human
uacauguaagacaugagacucu

SEQ ID NO: 130449 - RNA, 22 nt, Human
uggcugccuuucaccucaucuc

SEQ ID NO: 130450 - RNA, 22 nt, Human
ggcugcaggcaggguauccacu

SEQ ID NO: 130451 - RNA, 22 nt, Human
cagucccagcugcucagaaggc

SEQ ID NO: 130452 - RNA, 22 nt, Human
uggcccugaggacccagugugg

SEQ ID NO: 130453 - RNA, 22 nt, Human
ugugugugcacgugcgcgcgag

SEQ ID NO: 130454 - RNA, 22 nt, Human
ugggguggauagaaagugaugu

SEQ ID NO: 130455 - RNA, 22 nt, Human
acugcuuacaaaaggaaagaau

SEQ ID NO: 130456 - RNA, 22 nt, Human
ccucauggaccucagacugucc

SEQ ID NO: 130457 - RNA, 22 nt, Human
ugugagugaaugggucugaagu

SEQ ID NO: 130458 - RNA, 22 nt, Human
ugggcuguccagcaccugggcu

SEQ ID NO: 130459 - RNA, 22 nt, Human
ugucuuuacuuaauaaauauac

SEQ ID NO: 130460 - RNA, 22 nt, Human
uauuugcugugcuuauuccauu

SEQ ID NO: 130461 - RNA, 22 nt, Human
ucaucugucccaggcuuuuuuc

SEQ ID NO: 130462 - RNA, 22 nt, Human
ugggccugaaggagcugcgccc

SEQ ID NO: 130463 - RNA, 22 nt, Human
gcugauguauauagugauugag

SEQ ID NO: 130464 - RNA, 22 nt, Human
ugcuauugugaacagugccaca

SEQ ID NO: 130465 - RNA, 22 nt, Human
uucaagauggcaccagugagug

SEQ ID NO: 130466 - RNA, 22 nt, Human
uuugcauuuuagauuuaggccu

SEQ ID NO: 130467 - RNA, 22 nt, Human
ucugcuguguccccugugcggg

SEQ ID NO: 130468 - RNA, 22 nt, Human
ucagcaaugagaacuggcauuu

SEQ ID NO: 130469 - RNA, 22 nt, Human
gugcgccagcucaaggggaggc

SEQ ID NO: 130470 - RNA, 22 nt, Human
gucauauuauaaauguucuguu

SEQ ID NO: 130471 - RNA, 19 nt, Human
gcuucccaccagccagccc

SEQ ID NO: 130472 - RNA, 22 nt, Human
uagaaaguaaaucaguuuuauu

SEQ ID NO: 130473 - RNA, 22 nt, Human
agaccuggauuccaauccuacc

SEQ ID NO: 130474 - RNA, 22 nt, Human
uccuugaagagugggcggucga

SEQ ID NO: 130475 - RNA, 22 nt, Human
uagucucuggagacucuagggg

SEQ ID NO: 130476 - RNA, 22 nt, Human
auucuucauuguugauucaugu

SEQ ID NO: 130477 - RNA, 22 nt, Human
cugugucuucaauguacuggga

SEQ ID NO: 130478 - RNA, 22 nt, Human
agaggcugggaaggguccccgg

SEQ ID NO: 130479 - RNA, 22 nt, Human
aggcugugaaauguggcaagga

SEQ ID NO: 130480 - RNA, 22 nt, Human
ugcuggcuguauaugugagagu

SEQ ID NO: 130481 - RNA, 21 nt, Human
ggccuuggcgggggccgaauu

SEQ ID NO: 130482 - RNA, 22 nt, Human
aggguagggcccggagacagac

SEQ ID NO: 130483 - RNA, 22 nt, Human
acagggcaugugcaagagacau

SEQ ID NO: 130484 - RNA, 22 nt, Human
cugcacagagcagggcagacac

SEQ ID NO: 130485 - RNA, 22 nt, Human
ucauuacagagauauaaucuac

SEQ ID NO: 130486 - RNA, 22 nt, Human
ggauggcauguugggcucuguu

SEQ ID NO: 130487 - RNA, 22 nt, Human
gcugucacaaauauuucucagc

SEQ ID NO: 130488 - RNA, 22 nt, Human
cucuggaguucucaugaggaac

SEQ ID NO: 130489 - RNA, 22 nt, Human
acagggcagagggcaguuggua

SEQ ID NO: 130490 - RNA, 22 nt, Human
ugagcccuaagggucaagcagg

SEQ ID NO: 130491 - RNA, 22 nt, Human
acagccugcugccugcuucuug

SEQ ID NO: 130492 - RNA, 22 nt, Human
ggcucaggggccaggccugucc

SEQ ID NO: 130493 - RNA, 22 nt, Human
aaggaagggaaauagugauguc

SEQ ID NO: 130494 - RNA, 22 nt, Human
aaugauuuccccuacacagaag

SEQ ID NO: 130495 - RNA, 22 nt, Human
uggcucugaccagguagaggag

SEQ ID NO: 130496 - RNA, 22 nt, Human
gggcagcugcagggauggugac

SEQ ID NO: 130497 - RNA, 22 nt, Human
uuuaucuguccuuugccaguga

SEQ ID NO: 130498 - RNA, 22 nt, Human
agcacaggaccaaggaagcugu

SEQ ID NO: 130499 - RNA, 22 nt, Human
ggguccaggucuucaggcagag

SEQ ID NO: 130500 - RNA, 21 nt, Human
ccugcagcaccagaaggagau

SEQ ID NO: 130501 - RNA, 22 nt, Human
ucacauucucagcaucuauaca

SEQ ID NO: 130502 - RNA, 22 nt, Human
agcagcauacacaucauguuga

SEQ ID NO: 130503 - RNA, 20 nt, Human
aggaagccaaaggcugucuu

SEQ ID NO: 130504 - RNA, 22 nt, Human
ccugcccuagagaugacacaau

SEQ ID NO: 130505 - RNA, 19 nt, Human
uuugaaagaguuuuauugg

SEQ ID NO: 130506 - RNA, 20 nt, Human
gaguauauuucuuccuuugc

SEQ ID NO: 130507 - RNA, 22 nt, Human
aggacuuagaacauuauguacu

SEQ ID NO: 130508 - RNA, 22 nt, Human
gagaagccgagucagcugagcc

SEQ ID NO: 130509 - RNA, 22 nt, Human
gaugcacuuucuuuucaacagu

SEQ ID NO: 130510 - RNA, 22 nt, Human
aucuguguccuuauaagagaca

SEQ ID NO: 130511 - RNA, 22 nt, Human
agccacagcccacaggacucuu

SEQ ID NO: 130512 - RNA, 22 nt, Human
auaguuugaaggcuguucuacu

SEQ ID NO: 130513 - RNA, 22 nt, Human
gcaggccucuguugagggccuu

SEQ ID NO: 130514 - RNA, 22 nt, Human
auucuccagcucacuguccaua

SEQ ID NO: 130515 - RNA, 22 nt, Human
cucaccaggaacagcugcggag

SEQ ID NO: 130516 - RNA, 22 nt, Human
cagggacagccuugggguggcg

SEQ ID NO: 130517 - RNA, 22 nt, Human
ugugugcauucacaugcaugcc

SEQ ID NO: 130518 - RNA, 22 nt, Human
caggccugucugcacaugaggc

SEQ ID NO: 130519 - RNA, 22 nt, Human
cucuuaguaaugccaugaagca

SEQ ID NO: 130520 - RNA, 22 nt, Human
aagucacagcuaaauagcuaag

SEQ ID NO: 130521 - RNA, 22 nt, Human
ucaagagaagugcuccacagua

SEQ ID NO: 130522 - RNA, 22 nt, Human
aagacccacaaggcugaauguu

SEQ ID NO: 130523 - RNA, 22 nt, Human
uucaggauuauacucucuuccc

SEQ ID NO: 130524 - RNA, 22 nt, Human
uggaggcauuuuagguugucac

SEQ ID NO: 130525 - RNA, 22 nt, Human
uggaagcagugauucuugucug

SEQ ID NO: 130526 - RNA, 20 nt, Human
aggagaugauccagagucag

SEQ ID NO: 130527 - RNA, 22 nt, Human
cucuucuuauggccguggcuga

SEQ ID NO: 130528 - RNA, 22 nt, Human
uauuugcuccuuaggcauauuu

SEQ ID NO: 130529 - RNA, 22 nt, Human
uguagugugacauaggugucca

SEQ ID NO: 130530 - RNA, 22 nt, Human
cucacugcccugaaguuggguu

SEQ ID NO: 130531 - RNA, 22 nt, Human
ucucuuccaguaagagucuuua

SEQ ID NO: 130532 - RNA, 22 nt, Human
gccaggcagccacccucugcga

SEQ ID NO: 130533 - RNA, 22 nt, Human
auuuucuauucugcugguuuag

SEQ ID NO: 130534 - RNA, 22 nt, Human
gagcucagcccaaagagcagug

SEQ ID NO: 130535 - RNA, 22 nt, Human
caggucccgccccgggcugacc

SEQ ID NO: 130536 - RNA, 22 nt, Human
ggagcugggguuggcaucuucc

SEQ ID NO: 130537 - RNA, 20 nt, Human
gacaggagaguuagguaggu

SEQ ID NO: 130538 - RNA, 22 nt, Human
ucugucucaaguucuugcacuc

SEQ ID NO: 130539 - RNA, 22 nt, Human
acaauguguuuuuauacauuug

SEQ ID NO: 130540 - RNA, 22 nt, Human
acauuucucccugcaugccugc

SEQ ID NO: 130541 - RNA, 18 nt, Human
ucacagugcucuugccua

SEQ ID NO: 130542 - RNA, 22 nt, Human
gguggggucacgacagagggaa

SEQ ID NO: 130543 - RNA, 22 nt, Human
ucuggcccagccccugagguca

SEQ ID NO: 130544 - RNA, 22 nt, Human
gcagcuuuguggagaggcccau

SEQ ID NO: 130545 - RNA, 22 nt, Human
aggaggccgauuucagaggucg

SEQ ID NO: 130546 - RNA, 22 nt, Human
ggcaaaaaccacaauuacuuuu

SEQ ID NO: 130547 - RNA, 22 nt, Human
gcagcagagcuuuguccuggcu

SEQ ID NO: 130548 - RNA, 22 nt, Human
auggccuggccagagcucugcu

SEQ ID NO: 130549 - RNA, 22 nt, Human
gugcauuugugcaugcacaugu

SEQ ID NO: 130550 - RNA, 22 nt, Human
gagcucuguguagccugagggu

SEQ ID NO: 130551 - RNA, 22 nt, Human
uggcucugagacacaggcucuc

SEQ ID NO: 130552 - RNA, 22 nt, Human
gagaccaggaaguacagcagcc

SEQ ID NO: 130553 - RNA, 22 nt, Human
gcucugcugagauaucugggag

SEQ ID NO: 130554 - RNA, 22 nt, Human
ucccuggcuguguucaggugcg

SEQ ID NO: 130555 - RNA, 22 nt, Human
cugccacuagcuuucacaucuu

SEQ ID NO: 130556 - RNA, 22 nt, Human
cugccuggaaggagcaagggga

SEQ ID NO: 130557 - RNA, 22 nt, Human
ugcuugagacacauaugaauuu

SEQ ID NO: 130558 - RNA, 22 nt, Human
uucuccgcuaaguucucugcag

SEQ ID NO: 130559 - RNA, 22 nt, Human
uggcuggggccugaauccugca

SEQ ID NO: 130560 - RNA, 22 nt, Human
uauguacauggagagcaauuga

SEQ ID NO: 130561 - RNA, 20 nt, Human
cagcuuggaugagaggcuga

SEQ ID NO: 130562 - RNA, 22 nt, Human
cuuagaaaucgaacucagguua

SEQ ID NO: 130563 - RNA, 20 nt, Human
ucagugauuuugaagaggaa

SEQ ID NO: 130564 - RNA, 22 nt, Human
caaaugaagaaccuucucaccu

SEQ ID NO: 130565 - RNA, 23 nt, Human
cccagcuuucccacugccgagag

SEQ ID NO: 130566 - RNA, 22 nt, Human
caggagcugggucuggaagcag

SEQ ID NO: 130567 - RNA, 22 nt, Human
ucuucuuugaaucauagugacc

SEQ ID NO: 130568 - RNA, 22 nt, Human
ucauugcagacuaacaaucuca

SEQ ID NO: 130569 - RNA, 22 nt, Human
ccaggcccugcuccucacacca

SEQ ID NO: 130570 - RNA, 22 nt, Human
gggcuggaucuccugcaggcag

SEQ ID NO: 130571 - RNA, 22 nt, Human
ucacugggagaugugggaaggg

SEQ ID NO: 130572 - RNA, 22 nt, Human
ggccgggcaggucucagccagc

SEQ ID NO: 130573 - RNA, 21 nt, Human
cugugcuucuuccuaagccag

SEQ ID NO: 130574 - RNA, 22 nt, Human
cagcaugcaaguccagaugugg

SEQ ID NO: 130575 - RNA, 22 nt, Human
uaaaugugcacuuuacuuuuca

SEQ ID NO: 130576 - RNA, 22 nt, Human
caggaugugaggaggccauuug

SEQ ID NO: 130577 - RNA, 22 nt, Human
auugaaagcacaaagaacaagu

SEQ ID NO: 130578 - RNA, 22 nt, Human
uuuccucuuccgagggggaggc

SEQ ID NO: 130579 - RNA, 23 nt, Human
ugucauugugacuacagaaccag

SEQ ID NO: 130580 - RNA, 22 nt, Human
uagcugccuaugugauaagaga

SEQ ID NO: 130581 - RNA, 20 nt, Human
ugcugcaguuucaugggacu

SEQ ID NO: 130582 - RNA, 22 nt, Human
uccagcagguccgagacaaguu

SEQ ID NO: 130583 - RNA, 22 nt, Human
uuuacaauugguuuucucuaau

SEQ ID NO: 130584 - RNA, 22 nt, Human
ucucucugccaacucacagcca

SEQ ID NO: 130585 - RNA, 22 nt, Human
aguuggagugaacaugagauug

SEQ ID NO: 130586 - RNA, 22 nt, Human
guuauaaaugacugcaaaaguu

SEQ ID NO: 130587 - RNA, 22 nt, Human
agagcuguuuggacaucugagu

SEQ ID NO: 130588 - RNA, 22 nt, Human
aaucuggcucagaagaagauga

SEQ ID NO: 130589 - RNA, 22 nt, Human
uagcacaucuggcgcuuauagg

SEQ ID NO: 130590 - RNA, 22 nt, Human
agauuucagaugcucggcaguu

SEQ ID NO: 130591 - RNA, 22 nt, Human
gcugggagccguaccugucacg

SEQ ID NO: 130592 - RNA, 22 nt, Human
aacugcauucagaaagcucacu

SEQ ID NO: 130593 - RNA, 22 nt, Human
uuucucacccaagaguuauuuu

SEQ ID NO: 130594 - RNA, 19 nt, Human
cauauuuuugggcuggcau

SEQ ID NO: 130595 - RNA, 20 nt, Human
gcugccagugccugaugcuu

SEQ ID NO: 130596 - RNA, 22 nt, Human
gcccagccuccaagcuccaagg

SEQ ID NO: 130597 - RNA, 19 nt, Human
ugggcuuccccagggcaga

SEQ ID NO: 130598 - RNA, 22 nt, Human
ccaaggagaaaugcugugcuuu

SEQ ID NO: 130599 - RNA, 22 nt, Human
augcaguaaaauaggagguaau

SEQ ID NO: 130600 - RNA, 18 nt, Human
aauuuccauaugaauugc

SEQ ID NO: 130601 - RNA, 22 nt, Human
uggcucaguuucaguccugguu

SEQ ID NO: 130602 - RNA, 22 nt, Human
ugccuggaugugcuggccucac

SEQ ID NO: 130603 - RNA, 23 nt, Human
aggaggaaaaguuaucugcugag

SEQ ID NO: 130604 - RNA, 19 nt, Human
cugagcagcggcagcacuu

SEQ ID NO: 130605 - RNA, 22 nt, Human
gcuauguguguuuugcugcagc

SEQ ID NO: 130606 - RNA, 22 nt, Human
agucugcacucagguggagguc

SEQ ID NO: 130607 - RNA, 22 nt, Human
ggaccagagcucgggcuucuca

SEQ ID NO: 130608 - RNA, 22 nt, Human
uacauuaacuuacguccacaug

SEQ ID NO: 130609 - RNA, 22 nt, Human
cagggcuguuagcugcugcucu

SEQ ID NO: 130610 - RNA, 22 nt, Human
ugccaggagagugcaugcaggg

SEQ ID NO: 130611 - RNA, 22 nt, Human
aggcugugaggggcccgcaugc

SEQ ID NO: 130612 - RNA, 22 nt, Human
guaucuuuuacaccaggaaauu

SEQ ID NO: 130613 - RNA, 22 nt, Human
caguacuuugaagauauuuuag

SEQ ID NO: 130614 - RNA, 22 nt, Human
agcugagccagcagcaacagga

SEQ ID NO: 130615 - RNA, 22 nt, Human
agcagcuguacuuucaucuguu

SEQ ID NO: 130616 - RNA, 22 nt, Human
ggcucuggagcacagacgucug

SEQ ID NO: 130617 - RNA, 22 nt, Human
guguguguaucugccuaucaca

SEQ ID NO: 130618 - RNA, 22 nt, Human
ucuuauacagaagauguuuaau

SEQ ID NO: 130619 - RNA, 22 nt, Human
ucauuuucccacugaagcuguc

SEQ ID NO: 130620 - RNA, 22 nt, Human
ugggcagacauugaguuuguuc

SEQ ID NO: 130621 - RNA, 22 nt, Human
uuuuuuauaucaacugaagucu

SEQ ID NO: 130622 - RNA, 22 nt, Human
augacacaauuuuagagcugaa

SEQ ID NO: 130623 - RNA, 22 nt, Human
ggcccugggcagaggagugggc

SEQ ID NO: 130624 - RNA, 22 nt, Human
gugccuguaaguuguaugggcu

SEQ ID NO: 130625 - RNA, 22 nt, Human
gaugugagugguagcugggauu

SEQ ID NO: 130626 - RNA, 22 nt, Human
cagcaggaagguuuccccugca

SEQ ID NO: 130627 - RNA, 22 nt, Human
agugaaaugauaguguaaauac

SEQ ID NO: 130628 - RNA, 22 nt, Human
ucauuucaaguucugacagcua

SEQ ID NO: 130629 - RNA, 22 nt, Human
uagcugucaccagaaauggcca

SEQ ID NO: 130630 - RNA, 22 nt, Human
aaggccugaacaugaggagaug

SEQ ID NO: 130631 - RNA, 22 nt, Human
gcagagcaguacucucuugacu

SEQ ID NO: 130632 - RNA, 23 nt, Human
aaauuauugcucuucaauugccu

SEQ ID NO: 130633 - RNA, 22 nt, Human
gagccauacaaccuauaaagug

SEQ ID NO: 130634 - RNA, 23 nt, Human
cauggcagcaagagcucauggcc

SEQ ID NO: 130635 - RNA, 22 nt, Human
ugguccugccccgugcacagag

SEQ ID NO: 130636 - RNA, 22 nt, Human
uaaggccaaggggccauagucu

SEQ ID NO: 130637 - RNA, 22 nt, Human
uccauguggccagacacuggca

SEQ ID NO: 130638 - RNA, 22 nt, Human
gcuggaggaucacuugagccca

SEQ ID NO: 130639 - RNA, 22 nt, Human
ggugcagaucuuucucuucagg

SEQ ID NO: 130640 - RNA, 22 nt, Human
uuuccucugucaugacagcuga

SEQ ID NO: 130641 - RNA, 22 nt, Human
agggaggauaguagucaguuua

SEQ ID NO: 130642 - RNA, 22 nt, Human
gcagccaccucccauggcgggg

SEQ ID NO: 130643 - RNA, 22 nt, Human
cacaauuuguuuuaucaguauu

SEQ ID NO: 130644 - RNA, 22 nt, Human
auaauuuacuaagcucuaccuu

SEQ ID NO: 130645 - RNA, 16 nt, Human
ccaccugcagcucuca

SEQ ID NO: 130646 - RNA, 22 nt, Human
ccugugucagccccugccucca

SEQ ID NO: 130647 - RNA, 22 nt, Human
uuugcaaagaaauuauugcugu

SEQ ID NO: 130648 - RNA, 22 nt, Human
gcugggagccccgagccagcgc

SEQ ID NO: 130649 - RNA, 22 nt, Human
uaagacacaugcguacaagaua

SEQ ID NO: 130650 - RNA, 22 nt, Human
aucaggaucaugcuggguggga

SEQ ID NO: 130651 - RNA, 22 nt, Human
ucuuuagaaacuuuucuucaug

SEQ ID NO: 130652 - RNA, 22 nt, Human
uaggaaaagucuagauugauga

SEQ ID NO: 130653 - RNA, 22 nt, Human
cuuugcaaacgauuaccacaug

SEQ ID NO: 130654 - RNA, 22 nt, Human
cccuggggcugagggauggccg

SEQ ID NO: 130655 - RNA, 22 nt, Human
aggaccuguagggccugcaucc

SEQ ID NO: 130656 - RNA, 22 nt, Human
aauggccagcaacaggagugaa

SEQ ID NO: 130657 - RNA, 22 nt, Human
uccucugccaaagggaguugcc

SEQ ID NO: 130658 - RNA, 22 nt, Human
uauuucagcccuacuacuuggc

SEQ ID NO: 130659 - RNA, 23 nt, Human
ucuggcuccauccuuggggaucc

SEQ ID NO: 130660 - RNA, 22 nt, Human
uuuaucugugggaguuguuugg

SEQ ID NO: 130661 - RNA, 22 nt, Human
cucccugguguccccuccagga

SEQ ID NO: 130662 - RNA, 22 nt, Human
aaaggucagcugccaucguucu

SEQ ID NO: 130663 - RNA, 22 nt, Human
uggaggcaucagagugcuuggc

SEQ ID NO: 130664 - RNA, 22 nt, Human
uuauguacucugcaauguuuga

SEQ ID NO: 130665 - RNA, 22 nt, Human
cuuuacagaaagagaacucugg

SEQ ID NO: 130666 - RNA, 22 nt, Human
acccuuucuuacucacacgcuc

SEQ ID NO: 130667 - RNA, 22 nt, Human
aagagcugcaucuaagccauga

SEQ ID NO: 130668 - RNA, 22 nt, Human
augcacgccccacacuggugug

SEQ ID NO: 130669 - RNA, 22 nt, Human
uccugcagccacugcaggcaga

SEQ ID NO: 130670 - RNA, 22 nt, Human
agugugggugagggaggcccuc

SEQ ID NO: 130671 - RNA, 22 nt, Human
ucuuagcauuucauaacaacug

SEQ ID NO: 130672 - RNA, 22 nt, Human
aggucacauggauaaugaucag

SEQ ID NO: 130673 - RNA, 22 nt, Human
ucucagaguuuuuuuccaggac

SEQ ID NO: 130674 - RNA, 22 nt, Human
uugcaucuaccauaucaaagau

SEQ ID NO: 130675 - RNA, 22 nt, Human
ucacugucugaaagaaauggcc

SEQ ID NO: 130676 - RNA, 22 nt, Human
gcuguguggcaaagggauuaca

SEQ ID NO: 130677 - RNA, 22 nt, Human
uauuuugcuuuagcugacuguu

SEQ ID NO: 130678 - RNA, 22 nt, Human
cagagagaggccacugcuauua

SEQ ID NO: 130679 - RNA, 22 nt, Human
agcaggcuuguuaugucugaga

SEQ ID NO: 130680 - RNA, 22 nt, Human
ucagcagaggggaaggcaucug

SEQ ID NO: 130681 - RNA, 22 nt, Human
gcccaggccggagagcagugcu

SEQ ID NO: 130682 - RNA, 22 nt, Human
cacauuucuaggaaauuaaaug

SEQ ID NO: 130683 - RNA, 22 nt, Human
cucaggaucgcuugcccuaggg

SEQ ID NO: 130684 - RNA, 22 nt, Human
gccaccaggagcccaguccaaa

SEQ ID NO: 130685 - RNA, 22 nt, Human
cuucugugguaaacuuuguugu

SEQ ID NO: 130686 - RNA, 22 nt, Human
uagaagcaguaauagaaauagg

SEQ ID NO: 130687 - RNA, 22 nt, Human
cccagcaucuccaggcauggcc

SEQ ID NO: 130688 - RNA, 22 nt, Human
acagaaauuagcagugaguuua

SEQ ID NO: 130689 - RNA, 22 nt, Human
ccagcucugcagggccuggggu

SEQ ID NO: 130690 - RNA, 22 nt, Human
gccuggaggaauguagcugagg

SEQ ID NO: 130691 - RNA, 22 nt, Human
ucauggcacuuagcacaguccu

SEQ ID NO: 130692 - RNA, 22 nt, Human
cagaagaauggugucugagcuc

SEQ ID NO: 130693 - RNA, 22 nt, Human
augugcauuaaaugucaauguu

SEQ ID NO: 130694 - RNA, 22 nt, Human
guuuauaaggcccaauauuucu

SEQ ID NO: 130695 - RNA, 22 nt, Human
ggcugccucaaagcucaagcuc

SEQ ID NO: 130696 - RNA, 22 nt, Human
ugcaguggaggccgugagacag

SEQ ID NO: 130697 - RNA, 22 nt, Human
agggcagagaaauguaguugag

SEQ ID NO: 130698 - RNA, 21 nt, Human
ggcuccugcuuugugaggggc

SEQ ID NO: 130699 - RNA, 22 nt, Human
aaaguauauuuacuuacuguga

SEQ ID NO: 130700 - RNA, 22 nt, Human
cacugucuuuugugaagacaau

SEQ ID NO: 130701 - RNA, 22 nt, Human
ggauggcagucugcaugagaaa

SEQ ID NO: 130702 - RNA, 22 nt, Human
gcucaggaccgaggggugggaa

SEQ ID NO: 130703 - RNA, 22 nt, Human
aucugccuccaaguccaugugu

SEQ ID NO: 130704 - RNA, 22 nt, Human
agauggaguuaguaccagaguc

SEQ ID NO: 130705 - RNA, 22 nt, Human
guguggcuuucuggguuuaauu

SEQ ID NO: 130706 - RNA, 22 nt, Human
ugugcuucugcagagacuauuu

SEQ ID NO: 130707 - RNA, 22 nt, Human
uaaauguguuagucaugguuuu

SEQ ID NO: 130708 - RNA, 22 nt, Human
gcagcuggucuggccuagagua

SEQ ID NO: 130709 - RNA, 22 nt, Human
cucaugauguagcgaaugagaa

SEQ ID NO: 130710 - RNA, 22 nt, Human
uuccagggcuaauuccugugga

SEQ ID NO: 130711 - RNA, 22 nt, Human
uaacuuguguuacauuacucuu

SEQ ID NO: 130712 - RNA, 22 nt, Human
gccugcagauauauaggauggu

SEQ ID NO: 130713 - RNA, 22 nt, Human
uugaaggacaucuuguuucuag

SEQ ID NO: 130714 - RNA, 22 nt, Human
ucugucuuagcaucuuugcuca

SEQ ID NO: 130715 - RNA, 22 nt, Human
cauucucaauaguagaugagua

SEQ ID NO: 130716 - RNA, 21 nt, Human
cugugcuuuuuaagugugaug

SEQ ID NO: 130717 - RNA, 22 nt, Human
auguguauacuugugcuuacuc

SEQ ID NO: 130718 - RNA, 22 nt, Human
acagagguguguguaggacagu

SEQ ID NO: 130719 - RNA, 20 nt, Human
agaagcugauacugauggaa

SEQ ID NO: 130720 - RNA, 22 nt, Human
cauggaaggcaaaagacacaga

SEQ ID NO: 130721 - RNA, 22 nt, Human
cuggccuggucuggccucucca

SEQ ID NO: 130722 - RNA, 22 nt, Human
uuguuuuggagaugagcuaaaa

SEQ ID NO: 130723 - RNA, 22 nt, Human
uguccucagauaugucuacucu

SEQ ID NO: 130724 - RNA, 22 nt, Human
accuuucacgguaucagacauc

SEQ ID NO: 130725 - RNA, 22 nt, Human
uguacaguacauguguagugau

SEQ ID NO: 130726 - RNA, 22 nt, Human
cuagagaggcagauguccugug

SEQ ID NO: 130727 - RNA, 22 nt, Human
uggccuggugcucaggcaguag

SEQ ID NO: 130728 - RNA, 22 nt, Human
uugcagcuucuaccacuguuuc

SEQ ID NO: 130729 - RNA, 22 nt, Human
uguuaacaucuuggacucguga

SEQ ID NO: 130730 - RNA, 22 nt, Human
auagacuugguuaguaaauuug

SEQ ID NO: 130731 - RNA, 22 nt, Human
ggguggaguagaaagaugaauu

SEQ ID NO: 130732 - RNA, 22 nt, Human
uacaguagaauuuuuaguaacu

SEQ ID NO: 130733 - RNA, 22 nt, Human
acaguaaauaaugcauguugau

SEQ ID NO: 130734 - RNA, 22 nt, Human
ugguuuauuucucugaaagguu

SEQ ID NO: 130735 - RNA, 22 nt, Human
uuuguaaagucuguucugaguu

SEQ ID NO: 130736 - RNA, 22 nt, Human
uuccugagggacuuuugagauu

SEQ ID NO: 130737 - RNA, 22 nt, Human
agggcugccugcucugcauuga

SEQ ID NO: 130738 - RNA, 22 nt, Human
ggauccuucuuugaccucacag

SEQ ID NO: 130739 - RNA, 19 nt, Human
gagguggguccccgcagcc

SEQ ID NO: 130740 - RNA, 22 nt, Human
aacagugagaagguggacagga

SEQ ID NO: 130741 - RNA, 22 nt, Human
uggcucugggaaucuguugcuu

SEQ ID NO: 130742 - RNA, 22 nt, Human
cagaauaugacaagauuuuccu

SEQ ID NO: 130743 - RNA, 20 nt, Human
agcagcuguguuuucauccu

SEQ ID NO: 130744 - RNA, 22 nt, Human
gcguguaugcaggucugugcag

SEQ ID NO: 130745 - RNA, 22 nt, Human
aagcagccuggacuugggcugg

SEQ ID NO: 130746 - RNA, 22 nt, Human
uggcucagccauucguguugcc

SEQ ID NO: 130747 - RNA, 22 nt, Human
cuggguggaaagugcugagaau

SEQ ID NO: 130748 - RNA, 22 nt, Human
agaaauguauucuguauguuuu

SEQ ID NO: 130749 - RNA, 22 nt, Human
aaguugaagcaugaaccaaggu

SEQ ID NO: 130750 - RNA, 22 nt, Human
uuagccaugcccuagaagagga

SEQ ID NO: 130751 - RNA, 22 nt, Human
gcguggcuuagagugggguacc

SEQ ID NO: 130752 - RNA, 22 nt, Human
aagagggcugcaaucuuauugc

SEQ ID NO: 130753 - RNA, 23 nt, Human
ugaguguggggacagugguuugc

SEQ ID NO: 130754 - RNA, 22 nt, Human
ucucuggguuuuuguccuguac

SEQ ID NO: 130755 - RNA, 22 nt, Human
acuuucugcaguguuggaaaug

SEQ ID NO: 130756 - RNA, 22 nt, Human
acuuguuucaacuguacucuca

SEQ ID NO: 130757 - RNA, 22 nt, Human
ggcuggcaagugucugcucaug

SEQ ID NO: 130758 - RNA, 22 nt, Human
ugugaagcuggauccuggagcu

SEQ ID NO: 130759 - RNA, 22 nt, Human
uucuucuuucccccugugguac

SEQ ID NO: 130760 - RNA, 22 nt, Human
aaaagucagucucuccuagcuc

SEQ ID NO: 130761 - RNA, 22 nt, Human
cugcugugcaggugccuaugau

SEQ ID NO: 130762 - RNA, 22 nt, Human
uaacagaauuugcuaaacuccg

SEQ ID NO: 130763 - RNA, 22 nt, Human
cagcacugcuucgcagccaggg

SEQ ID NO: 130764 - RNA, 22 nt, Human
agucccagcucugccacuuacu

SEQ ID NO: 130765 - RNA, 18 nt, Human
agcuggggccucuggucc

SEQ ID NO: 130766 - RNA, 22 nt, Human
auacaguauaacuaauaaaccc

SEQ ID NO: 130767 - RNA, 19 nt, Human
auacagauguauccaugau

SEQ ID NO: 130768 - RNA, 22 nt, Human
ccagcuggagcucgcagauagg

SEQ ID NO: 130769 - RNA, 22 nt, Human
cuuucuuucgaagacgugauua

SEQ ID NO: 130770 - RNA, 22 nt, Human
uguguuccugccuggcucuggu

SEQ ID NO: 130771 - RNA, 22 nt, Human
uguuuguaucucucucuguggc

SEQ ID NO: 130772 - RNA, 22 nt, Human
cacagugcaugaugggcagaag

SEQ ID NO: 130773 - RNA, 22 nt, Human
gaacagcccuguuaagucuguu

SEQ ID NO: 130774 - RNA, 21 nt, Human
guauugcagaguuaugugcuc

SEQ ID NO: 130775 - RNA, 22 nt, Human
ucaguguagcagacuuguagcc

SEQ ID NO: 130776 - RNA, 22 nt, Human
uccagugguaguaaagaggucu

SEQ ID NO: 130777 - RNA, 22 nt, Human
gcaggaugccagggcagcagcg

SEQ ID NO: 130778 - RNA, 22 nt, Human
uucuucucggcugucagauagu

SEQ ID NO: 130779 - RNA, 22 nt, Human
uaugcacacauuagcacagggu

SEQ ID NO: 130780 - RNA, 20 nt, Human
ucugcucagcccucaguggc

SEQ ID NO: 130781 - RNA, 22 nt, Human
uggccuggaaaaaugcagaugg

SEQ ID NO: 130782 - RNA, 22 nt, Human
gccugggugaauuugauccuaa

SEQ ID NO: 130783 - RNA, 22 nt, Human
agauacauagcugugagcacac

SEQ ID NO: 130784 - RNA, 22 nt, Human
ccagagcuucggggcggcugua

SEQ ID NO: 130785 - RNA, 22 nt, Human
cagccagagaaagggcacugcc

SEQ ID NO: 130786 - RNA, 22 nt, Human
ucagccacuacccaccuuaaca

SEQ ID NO: 130787 - RNA, 22 nt, Human
augagcugugggauuccagagg

SEQ ID NO: 130788 - RNA, 20 nt, Human
aggagaaauucgggacaccu

SEQ ID NO: 130789 - RNA, 22 nt, Human
uuuccaauaaagugucauuguu

SEQ ID NO: 130790 - RNA, 22 nt, Human
acuggcagagguuggacaccau

SEQ ID NO: 130791 - RNA, 22 nt, Human
acagggcagaaauguugcaucu

SEQ ID NO: 130792 - RNA, 22 nt, Human
cagaagcauugacuccuugcuc

SEQ ID NO: 130793 - RNA, 22 nt, Human
cagcaugacagucugcagcaga

SEQ ID NO: 130794 - RNA, 22 nt, Human
ugucuuuucuacuguaagcaua

SEQ ID NO: 130795 - RNA, 22 nt, Human
uauacagaaccgccugaagucu

SEQ ID NO: 130796 - RNA, 22 nt, Human
ucugggcuugguuagggcuguu

SEQ ID NO: 130797 - RNA, 22 nt, Human
agaaaucaugacuaagagcagu

SEQ ID NO: 130798 - RNA, 22 nt, Human
aaguuauaucaucucauugacg

SEQ ID NO: 130799 - RNA, 22 nt, Human
ggcagagacuggguuggcagag

SEQ ID NO: 130800 - RNA, 22 nt, Human
auucuuauuauaguaaaacagu

SEQ ID NO: 130801 - RNA, 22 nt, Human
uuuuccuaguaggccuauuaga

SEQ ID NO: 130802 - RNA, 22 nt, Human
uccaggagaggccugaccaggu

SEQ ID NO: 130803 - RNA, 22 nt, Human
cugucauugagccugucagggc

SEQ ID NO: 130804 - RNA, 22 nt, Human
ugcagccaucuuucuuggagga

SEQ ID NO: 130805 - RNA, 19 nt, Human
ucauuguugguuugucggg

SEQ ID NO: 130806 - RNA, 22 nt, Human
gggccccuuguaucucuggcuc

SEQ ID NO: 130807 - RNA, 22 nt, Human
aggaggcuguggagcacuccau

SEQ ID NO: 130808 - RNA, 22 nt, Human
ccuuccuggcuguccgccugau

SEQ ID NO: 130809 - RNA, 22 nt, Human
uuccaguugguagaauguaagg

SEQ ID NO: 130810 - RNA, 22 nt, Human
ucuggcucaggucagacaggga

SEQ ID NO: 130811 - RNA, 22 nt, Human
ugccuggguguaaagggccaac

SEQ ID NO: 130812 - RNA, 22 nt, Human
ucucugugacugcagcuuugca

SEQ ID NO: 130813 - RNA, 22 nt, Human
uuggcugugaaagcuucucaaa

SEQ ID NO: 130814 - RNA, 22 nt, Human
auguauguuuucaguuguauua

SEQ ID NO: 130815 - RNA, 22 nt, Human
uaacaguagccuuauguggucu

SEQ ID NO: 130816 - RNA, 22 nt, Human
acguauauugaaauaucaugag

SEQ ID NO: 130817 - RNA, 22 nt, Human
ggcugccucuggaagcuggaga

SEQ ID NO: 130818 - RNA, 22 nt, Human
ugccaggcauauggccucuuug

SEQ ID NO: 130819 - RNA, 22 nt, Human
gagguagccacagauagagacu

SEQ ID NO: 130820 - RNA, 22 nt, Human
ccugucagcugauggcuaugua

SEQ ID NO: 130821 - RNA, 22 nt, Human
guucuucagcauuagaagucau

SEQ ID NO: 130822 - RNA, 22 nt, Human
uagcugccauugcuccaggaag

SEQ ID NO: 130823 - RNA, 22 nt, Human
ucucugugucucauguuccuau

SEQ ID NO: 130824 - RNA, 22 nt, Human
uccagggaccucccugagagcu

SEQ ID NO: 130825 - RNA, 22 nt, Human
guggggggacguuggucacuuu

SEQ ID NO: 130826 - RNA, 21 nt, Human
gccaccccuggcacaggugcu

SEQ ID NO: 130827 - RNA, 22 nt, Human
cccucccagaugggcuugaggu

SEQ ID NO: 130828 - RNA, 22 nt, Human
cugucaguaggcucccaucauu

SEQ ID NO: 130829 - RNA, 22 nt, Human
gcaggcaguuugcuuuucccuc

SEQ ID NO: 130830 - RNA, 20 nt, Human
ucucccaggcucagggaaga

SEQ ID NO: 130831 - RNA, 22 nt, Human
gcugugagaaacagggaguguc

SEQ ID NO: 130832 - RNA, 22 nt, Human
aggcuccuaucgcuuucagcaa

SEQ ID NO: 130833 - RNA, 22 nt, Human
cacccaggcagguggcugagaa

SEQ ID NO: 130834 - RNA, 22 nt, Human
ucauuuguaccauuuuuuaaga

SEQ ID NO: 130835 - RNA, 22 nt, Human
gaagcagcuaggaucuucauuu

SEQ ID NO: 130836 - RNA, 22 nt, Human
ugcugcucaaugagaugccauc

SEQ ID NO: 130837 - RNA, 22 nt, Human
caguggcaugguugacugcagu

SEQ ID NO: 130838 - RNA, 22 nt, Human
gccuucccacccugcgaggcug

SEQ ID NO: 130839 - RNA, 22 nt, Human
agccagggacgcugcaggcuac

SEQ ID NO: 130840 - RNA, 22 nt, Human
cagcaggauaugguggagagag

SEQ ID NO: 130841 - RNA, 22 nt, Human
agccaucauuucugucacuggc

SEQ ID NO: 130842 - RNA, 22 nt, Human
ucucagagagaugaaacuucca

SEQ ID NO: 130843 - RNA, 22 nt, Human
aaaaacugcaauuacuuuuguc

SEQ ID NO: 130844 - RNA, 22 nt, Human
agggccugggauguccuccuag

SEQ ID NO: 130845 - RNA, 22 nt, Human
ucuccucaccaccagcagcaga

SEQ ID NO: 130846 - RNA, 22 nt, Human
gccuaggagacaagcgugaaag

SEQ ID NO: 130847 - RNA, 19 nt, Human
agcagcuggagguggagug

SEQ ID NO: 130848 - RNA, 22 nt, Human
guuuagaauucuaacuuuaagg

SEQ ID NO: 130849 - RNA, 22 nt, Human
ugguaauuaauuugauagguuc

SEQ ID NO: 130850 - RNA, 22 nt, Human
uaacuuuugugaucugucgauu

SEQ ID NO: 130851 - RNA, 22 nt, Human
gaagaacaccugcugcccagug

SEQ ID NO: 130852 - RNA, 22 nt, Human
uuuaacuggucuccugcugcuu

SEQ ID NO: 130853 - RNA, 22 nt, Human
cauuucuguucucuuccuguac

SEQ ID NO: 130854 - RNA, 22 nt, Human
aguuacaaccaugacacaagca

SEQ ID NO: 130855 - RNA, 20 nt, Human
uguuccaugacuauuuggau

SEQ ID NO: 130856 - RNA, 23 nt, Human
ggggccugcaccggucugcgcgg

SEQ ID NO: 130857 - RNA, 22 nt, Human
ugggcugcuuccucagcugaga

SEQ ID NO: 130858 - RNA, 22 nt, Human
aggggcugacuggaaagugcca

SEQ ID NO: 130859 - RNA, 22 nt, Human
gacagacauuuccugauccaau

SEQ ID NO: 130860 - RNA, 22 nt, Human
ggacacaagcuccggggcugca

SEQ ID NO: 130861 - RNA, 22 nt, Human
uauguucuaggaaugguugaug

SEQ ID NO: 130862 - RNA, 22 nt, Human
aagcugcagacccccugucuca

SEQ ID NO: 130863 - RNA, 22 nt, Human
gaugggaggaaccugggucccu

SEQ ID NO: 130864 - RNA, 17 nt, Human
uuccccugaccaagccu

SEQ ID NO: 130865 - RNA, 22 nt, Human
uucuaacucuguuauguguuuc

SEQ ID NO: 130866 - RNA, 22 nt, Human
uguggcuguugaggaccccaag

SEQ ID NO: 130867 - RNA, 22 nt, Human
cuggcccagagagcagagcuua

SEQ ID NO: 130868 - RNA, 22 nt, Human
uggucucugacucugaagaccc

SEQ ID NO: 130869 - RNA, 22 nt, Human
aagacauugucauuuuauaauu

SEQ ID NO: 130870 - RNA, 22 nt, Human
cucacagguaccagcacccucc

SEQ ID NO: 130871 - RNA, 22 nt, Human
gcacccagggacuuggcuggcc

SEQ ID NO: 130872 - RNA, 22 nt, Human
gagggcugaugcuuacuuauuu

SEQ ID NO: 130873 - RNA, 22 nt, Human
cucacugugccuuuucccaaac

SEQ ID NO: 130874 - RNA, 22 nt, Human
uauuuccaagcugaauccaaug

SEQ ID NO: 130875 - RNA, 22 nt, Human
ccucuguccuggggaguggagc

SEQ ID NO: 130876 - RNA, 23 nt, Human
ccuggcagcaaacgaggagguua

SEQ ID NO: 130877 - RNA, 22 nt, Human
cagcagagacgguaagcagaac

SEQ ID NO: 130878 - RNA, 22 nt, Human
acugucuguccugcucuccgug

SEQ ID NO: 130879 - RNA, 22 nt, Human
uucugaggcacuggcucuccca

SEQ ID NO: 130880 - RNA, 22 nt, Human
gcugccugguuucucagcugca

SEQ ID NO: 130881 - RNA, 22 nt, Human
uuuagaguccaaguucuucacu

SEQ ID NO: 130882 - RNA, 22 nt, Human
uaauuuauuucaacugccaagg

SEQ ID NO: 130883 - RNA, 22 nt, Human
ugcugggcuaggguggagcucu

SEQ ID NO: 130884 - RNA, 22 nt, Human
ugagaggcagaauggugccugc

SEQ ID NO: 130885 - RNA, 19 nt, Human
agcuuccauauucucuagu

SEQ ID NO: 130886 - RNA, 21 nt, Human
gccagagcaguacaaugaggu

SEQ ID NO: 130887 - RNA, 18 nt, Human
acccucuggcuucugagc

SEQ ID NO: 130888 - RNA, 22 nt, Human
ugucucagaguaucccugaacu

SEQ ID NO: 130889 - RNA, 21 nt, Human
gagugcaggucugaugccauc

SEQ ID NO: 130890 - RNA, 21 nt, Human
ucucugggcccuccugugggg

SEQ ID NO: 130891 - RNA, 23 nt, Human
uuucaaauuacucugcagaugac

SEQ ID NO: 130892 - RNA, 22 nt, Human
cuugccuucuguuccuauagaa

SEQ ID NO: 130893 - RNA, 22 nt, Human
auuuugaaaagcauuugaguaa

SEQ ID NO: 130894 - RNA, 22 nt, Human
gagggguguggagccaucaguu

SEQ ID NO: 130895 - RNA, 20 nt, Human
cacaggccuugugagcagac

SEQ ID NO: 130896 - RNA, 22 nt, Human
uggggugggcaugcgcuguccu

SEQ ID NO: 130897 - RNA, 22 nt, Human
ggagcugcuuugaucugaagaa

SEQ ID NO: 130898 - RNA, 22 nt, Human
acuggaagccaguugacaauca

SEQ ID NO: 130899 - RNA, 22 nt, Human
aggcugugaugagccucaugga

SEQ ID NO: 130900 - RNA, 22 nt, Human
auuguacaugcagugagucauc

SEQ ID NO: 130901 - RNA, 23 nt, Human
ccucccaccuauuucacuuucuu

SEQ ID NO: 130902 - RNA, 23 nt, Human
cauguacagaguuugauaaagug

SEQ ID NO: 130903 - RNA, 22 nt, Human
aagacagagggaagcaaugaug

SEQ ID NO: 130904 - RNA, 22 nt, Human
caaaucuauauguugauauucu

SEQ ID NO: 130905 - RNA, 22 nt, Human
uuuacagcagcaugauuuauaa

SEQ ID NO: 130906 - RNA, 22 nt, Human
aacuucuugguccugagcuguu

SEQ ID NO: 130907 - RNA, 22 nt, Human
uggcucaguuugggggauugaa

SEQ ID NO: 130908 - RNA, 22 nt, Human
ccuccagggcagacggggagca

SEQ ID NO: 130909 - RNA, 22 nt, Human
cacuguguaagaagaugggcuu

SEQ ID NO: 130910 - RNA, 23 nt, Human
cuuuccuuucuuugacacccagc

SEQ ID NO: 130911 - RNA, 22 nt, Human
agguggguccuggcucugccau

SEQ ID NO: 130912 - RNA, 22 nt, Human
agagaaaacucauugagguguc

SEQ ID NO: 130913 - RNA, 22 nt, Human
agacccagaaagcagcugcauu

SEQ ID NO: 130914 - RNA, 22 nt, Human
cugggaguugacgaggcuugua

SEQ ID NO: 130915 - RNA, 22 nt, Human
cucacugcaaguuccaccuacc

SEQ ID NO: 130916 - RNA, 22 nt, Human
aaaugcacagguuuuaaauccu

SEQ ID NO: 130917 - RNA, 22 nt, Human
aaucaguuguccaaaguucaca

SEQ ID NO: 130918 - RNA, 22 nt, Human
ggccugcuuuccgagccugcag

SEQ ID NO: 130919 - RNA, 22 nt, Human
acagaauuaaugaaaauuacaa

SEQ ID NO: 130920 - RNA, 22 nt, Human
uucagcagugcagacacccagu

SEQ ID NO: 130921 - RNA, 22 nt, Human
uuaaacagguuuuugaauggcc

SEQ ID NO: 130922 - RNA, 22 nt, Human
uccuugaauggacauuacacug

SEQ ID NO: 130923 - RNA, 22 nt, Human
aggcagagcuggguuuugaaau

SEQ ID NO: 130924 - RNA, 22 nt, Human
ucccagggacucucugccuucc

SEQ ID NO: 130925 - RNA, 22 nt, Human
aagcugcccaagacugaagcau

SEQ ID NO: 130926 - RNA, 22 nt, Human
gagcuguccuaccaggaguccu

SEQ ID NO: 130927 - RNA, 22 nt, Human
uucauguguauggaacauuuuu

SEQ ID NO: 130928 - RNA, 22 nt, Human
ugucuuuaagcaaacaguguuu

SEQ ID NO: 130929 - RNA, 22 nt, Human
aggggacacggcuucuccaggg

SEQ ID NO: 130930 - RNA, 22 nt, Human
uuuauguaaguggaaugaugcc

SEQ ID NO: 130931 - RNA, 22 nt, Human
ugcucuguugugcaugugggau

SEQ ID NO: 130932 - RNA, 22 nt, Human
gugucccagcagcacauuggcu

SEQ ID NO: 130933 - RNA, 22 nt, Human
uauauucuuucaccuucuuccu

SEQ ID NO: 130934 - RNA, 22 nt, Human
uuguaugcugaugacaccaccu

SEQ ID NO: 130935 - RNA, 22 nt, Human
uuauuauagauuaugcaagauu

SEQ ID NO: 130936 - RNA, 22 nt, Human
gugucacaagagcccaggaaac

SEQ ID NO: 130937 - RNA, 23 nt, Human
uguaacuucuuaaauucuucacu

SEQ ID NO: 130938 - RNA, 22 nt, Human
aaugcacauguuguaauaaaua

SEQ ID NO: 130939 - RNA, 22 nt, Human
ugugacuguggacuuuuguggg

SEQ ID NO: 130940 - RNA, 22 nt, Human
aaacuguaaacacagcaguaca

SEQ ID NO: 130941 - RNA, 19 nt, Human
guuuuucccagacgaggca

SEQ ID NO: 130942 - RNA, 22 nt, Human
gggcagagacucagaaacagaa

SEQ ID NO: 130943 - RNA, 22 nt, Human
acugaaggaagcgggcaggggu

SEQ ID NO: 130944 - RNA, 22 nt, Human
gaaugugugacucuauugagca

SEQ ID NO: 130945 - RNA, 22 nt, Human
agcaggaguguccccuggcugu

SEQ ID NO: 130946 - RNA, 20 nt, Human
gaguuccccauuucuccugg

SEQ ID NO: 130947 - RNA, 22 nt, Human
uugaacauuggcaauuucauau

SEQ ID NO: 130948 - RNA, 22 nt, Human
ucugccagugguuuggcccuga

SEQ ID NO: 130949 - RNA, 22 nt, Human
cugcagcuuuggaaaccuguuu

SEQ ID NO: 130950 - RNA, 22 nt, Human
acuuuugaggacuuuauuguau

SEQ ID NO: 130951 - RNA, 21 nt, Human
gauugaaaccauggcagugag

SEQ ID NO: 130952 - RNA, 22 nt, Human
gauuucaaaaguagauccauca

SEQ ID NO: 130953 - RNA, 22 nt, Human
ucagugugucucugcauuuggg

SEQ ID NO: 130954 - RNA, 22 nt, Human
aacaguaucuuuuaucagaaau

SEQ ID NO: 130955 - RNA, 22 nt, Human
cugcccuggcagccuaccaugg

SEQ ID NO: 130956 - RNA, 22 nt, Human
ggcagcugaccuagcaccaucc

SEQ ID NO: 130957 - RNA, 22 nt, Human
gacccugccaugagugacaggg

SEQ ID NO: 130958 - RNA, 22 nt, Human
ugugccuggaucucugugacaa

SEQ ID NO: 130959 - RNA, 22 nt, Human
agcuguguguuuccacugagcu

SEQ ID NO: 130960 - RNA, 19 nt, Human
uaacucuuuccuuuucccc

SEQ ID NO: 130961 - RNA, 22 nt, Human
agagaaggucacuaaggaccca

SEQ ID NO: 130962 - RNA, 22 nt, Human
uaaaugugucuuuuuaaggccu

SEQ ID NO: 130963 - RNA, 22 nt, Human
ggacuggccggcgcugaggccc

SEQ ID NO: 130964 - RNA, 22 nt, Human
ugcugccaccccucaccagagc

SEQ ID NO: 130965 - RNA, 22 nt, Human
acguuuucagugacugugcuuc

SEQ ID NO: 130966 - RNA, 22 nt, Human
uccucugccccagaugaaauuu

SEQ ID NO: 130967 - RNA, 22 nt, Human
aggggcuggaguucgagguuac

SEQ ID NO: 130968 - RNA, 22 nt, Human
gaacuguaguuaauacuacaca

SEQ ID NO: 130969 - RNA, 22 nt, Human
cucuucuuggcccccaugaggg

SEQ ID NO: 130970 - RNA, 22 nt, Human
caggcuggagugcaguugugca

SEQ ID NO: 130971 - RNA, 22 nt, Human
cugggcuucucccccuggcaga

SEQ ID NO: 130972 - RNA, 22 nt, Human
cuggcaggucucgcugacgugu

SEQ ID NO: 130973 - RNA, 22 nt, Human
gggggcuggacuuucccacaca

SEQ ID NO: 130974 - RNA, 22 nt, Human
gcugccacucugagcuugcuuc

SEQ ID NO: 130975 - RNA, 22 nt, Human
aaggcacuuuuccugagaugau

SEQ ID NO: 130976 - RNA, 20 nt, Human
uuugucuguuaaguguuucu

SEQ ID NO: 130977 - RNA, 22 nt, Human
caaagugcugagauuacaggua

SEQ ID NO: 130978 - RNA, 22 nt, Human
uuauacauguguuuugagauga

SEQ ID NO: 130979 - RNA, 22 nt, Human
gaggcagcuuggggcugugggu

SEQ ID NO: 130980 - RNA, 22 nt, Human
cacugcagcaccaugcagggcu

SEQ ID NO: 130981 - RNA, 22 nt, Human
cacagaaguuucauagucucga

SEQ ID NO: 130982 - RNA, 22 nt, Human
auauaaaguguuuagaaagcug

SEQ ID NO: 130983 - RNA, 22 nt, Human
agaccauagggaccucagguug

SEQ ID NO: 130984 - RNA, 22 nt, Human
aaaaauaggucaaccguguaug

SEQ ID NO: 130985 - RNA, 22 nt, Human
ggagccugugcccaagcccaga

SEQ ID NO: 130986 - RNA, 22 nt, Human
uuucuuguaaaagcugugggaa

SEQ ID NO: 130987 - RNA, 22 nt, Human
gaccagagaaaggcacuggaag

SEQ ID NO: 130988 - RNA, 22 nt, Human
cugccuggucucaggcaugggg

SEQ ID NO: 130989 - RNA, 22 nt, Human
cuuucacagccuucguucugaa

SEQ ID NO: 130990 - RNA, 22 nt, Human
uuuauuguuguuagucauaagu

SEQ ID NO: 130991 - RNA, 22 nt, Human
guggcugcuaagucuccuuccu

SEQ ID NO: 130992 - RNA, 22 nt, Human
gggcagagguucaacuucaaca

SEQ ID NO: 130993 - RNA, 22 nt, Human
augcaagauguauagaagacuu

SEQ ID NO: 130994 - RNA, 22 nt, Human
aggagcugacuuguaaagcauu

SEQ ID NO: 130995 - RNA, 22 nt, Human
agaggcugaaugaugucaucau

SEQ ID NO: 130996 - RNA, 20 nt, Human
ggcucugcuugugagcagcc

SEQ ID NO: 130997 - RNA, 23 nt, Human
uguaaaaugggguaguguuacca

SEQ ID NO: 130998 - RNA, 22 nt, Human
gagccaggucgggccgcggcga

SEQ ID NO: 130999 - RNA, 22 nt, Human
ugggcagacugagcccuguccc

SEQ ID NO: 131000 - RNA, 22 nt, Human
ccaggcugcagucaaggggcau

SEQ ID NO: 131001 - RNA, 22 nt, Human
uccucaggauguggaguagaau

SEQ ID NO: 131002 - RNA, 21 nt, Human
uaucuacuggugucuuucaga

SEQ ID NO: 131003 - RNA, 22 nt, Human
ucuggcucuguguccucaccca

SEQ ID NO: 131004 - RNA, 22 nt, Human
agaaggaguguacaggucaugc

SEQ ID NO: 131005 - RNA, 22 nt, Human
auugaaagauauacuguucuca

SEQ ID NO: 131006 - RNA, 22 nt, Human
uguaucaaaccaaauuaauucu

SEQ ID NO: 131007 - RNA, 22 nt, Human
gggcuguguaaugugcucuuuu

SEQ ID NO: 131008 - RNA, 22 nt, Human
ccuggagcacucucccuggcug

SEQ ID NO: 131009 - RNA, 22 nt, Human
aaauauagugacacuuauaguc

SEQ ID NO: 131010 - RNA, 22 nt, Human
uagcagugccaggauuuugcug

SEQ ID NO: 131011 - RNA, 23 nt, Human
aaggccagaauuucaauggugcc

SEQ ID NO: 131012 - RNA, 22 nt, Human
uugugaguagugccgcaauaaa

SEQ ID NO: 131013 - RNA, 22 nt, Human
agaccaagugcaggugccacua

SEQ ID NO: 131014 - RNA, 22 nt, Human
guggcagcugguaugcagacag

SEQ ID NO: 131015 - RNA, 17 nt, Human
cacaggugugguuugag

SEQ ID NO: 131016 - RNA, 22 nt, Human
ccucugccaccucccacgaggc

SEQ ID NO: 131017 - RNA, 22 nt, Human
aguaaacauaauuuaccuguag

SEQ ID NO: 131018 - RNA, 22 nt, Human
ccuccaggcugaauaucuagaa

SEQ ID NO: 131019 - RNA, 22 nt, Human
cuggcugcaggaugaggcugcc

SEQ ID NO: 131020 - RNA, 22 nt, Human
ggguggggcccaggaaaucuau

SEQ ID NO: 131021 - RNA, 22 nt, Human
uaaauguauaggcacuaaaccu

SEQ ID NO: 131022 - RNA, 21 nt, Human
gauuugcagaaacuagacagg

SEQ ID NO: 131023 - RNA, 22 nt, Human
aaauuagucgguuuaggaauuu

SEQ ID NO: 131024 - RNA, 22 nt, Human
uuggcuucucuuaacccuaaag

SEQ ID NO: 131025 - RNA, 22 nt, Human
uuccaugagcucugaguucaca

SEQ ID NO: 131026 - RNA, 22 nt, Human
uacagaaaaacuggcauugaag

SEQ ID NO: 131027 - RNA, 22 nt, Human
ucccugcucagcucaccuggca

SEQ ID NO: 131028 - RNA, 22 nt, Human
ccuaugccugucacucugcgcu

SEQ ID NO: 131029 - RNA, 22 nt, Human
cuuaaauuggaugaguuaaguu

SEQ ID NO: 131030 - RNA, 22 nt, Human
cagccagcuucagauccaagcc

SEQ ID NO: 131031 - RNA, 22 nt, Human
agacuucucaguuuuauuagua

SEQ ID NO: 131032 - RNA, 22 nt, Human
cuuauaguaugauguugagaau

SEQ ID NO: 131033 - RNA, 22 nt, Human
cagggagaaaucuccaggaggu

SEQ ID NO: 131034 - RNA, 22 nt, Human
ucagaacagaagcuggcuauaa

SEQ ID NO: 131035 - RNA, 22 nt, Human
guggccguguaacuugaguaca

SEQ ID NO: 131036 - RNA, 22 nt, Human
ggauggagguucucagaugcuc

SEQ ID NO: 131037 - RNA, 22 nt, Human
uucuaugucagugugcucugug

SEQ ID NO: 131038 - RNA, 22 nt, Human
gacuucuauuaauaccucuacu

SEQ ID NO: 131039 - RNA, 22 nt, Human
gaggaaugucagcacaggccuc

SEQ ID NO: 131040 - RNA, 22 nt, Human
gggccugugcacaguucuguua

SEQ ID NO: 131041 - RNA, 22 nt, Human
agggcaguucaacuucauagug

SEQ ID NO: 131042 - RNA, 22 nt, Human
cucauggauauaagaacuguuu

SEQ ID NO: 131043 - RNA, 22 nt, Human
gcugcagccaaauucauuguca

SEQ ID NO: 131044 - RNA, 17 nt, Human
ucagagggaugagcagg

SEQ ID NO: 131045 - RNA, 17 nt, Human
guccugggaggagagag

SEQ ID NO: 131046 - RNA, 22 nt, Human
ugccugucuccucugcagggug

SEQ ID NO: 131047 - RNA, 22 nt, Human
ggcacugaucugauuucccucc

SEQ ID NO: 131048 - RNA, 22 nt, Human
ggcuuccuggagaaggucugag

SEQ ID NO: 131049 - RNA, 22 nt, Human
gggagggaggugaugcuuggcu

SEQ ID NO: 131050 - RNA, 22 nt, Human
acuccuggggcugccaucacag

SEQ ID NO: 131051 - RNA, 22 nt, Human
gaugggggccagggccugcuuu

SEQ ID NO: 131052 - RNA, 22 nt, Human
ugcagccaauucauucauucuu

SEQ ID NO: 131053 - RNA, 22 nt, Human
ugucucugaggugagggucagc

SEQ ID NO: 131054 - RNA, 22 nt, Human
agccaggaaccagcuacagucu

SEQ ID NO: 131055 - RNA, 22 nt, Human
ucugugugugccuguuaauauu

SEQ ID NO: 131056 - RNA, 22 nt, Human
uggcagagaacacacaugauuc

SEQ ID NO: 131057 - RNA, 22 nt, Human
guccaugacugugacucacaug

SEQ ID NO: 131058 - RNA, 22 nt, Human
gcucuguccagcgugcacagaa

SEQ ID NO: 131059 - RNA, 22 nt, Human
ucagccuggcaggauggccugg

SEQ ID NO: 131060 - RNA, 22 nt, Human
ugauuuccuaggucuggagaag

SEQ ID NO: 131061 - RNA, 22 nt, Human
uucagagccacuucaagucuaa

SEQ ID NO: 131062 - RNA, 22 nt, Human
gcuggcucagggacuagaguuu

SEQ ID NO: 131063 - RNA, 22 nt, Human
uauauuuuagacacccucacgc

SEQ ID NO: 131064 - RNA, 22 nt, Human
uuuucagaggccuaagagguuu

SEQ ID NO: 131065 - RNA, 22 nt, Human
cauucuuacacaauauuuuaau

SEQ ID NO: 131066 - RNA, 20 nt, Human
auacaaagagauugauguau

SEQ ID NO: 131067 - RNA, 22 nt, Human
cugccuccugccgugcagcuuc

SEQ ID NO: 131068 - RNA, 22 nt, Human
uuauuucauugauuucuaagac

SEQ ID NO: 131069 - RNA, 22 nt, Human
gugugccaggaacuggcugcug

SEQ ID NO: 131070 - RNA, 21 nt, Human
agaaaaguagaguuuucagag

SEQ ID NO: 131071 - RNA, 22 nt, Human
uggcuuucucccccagcuucuc

SEQ ID NO: 131072 - RNA, 22 nt, Human
gcacccaggcuugggcagcaac

SEQ ID NO: 131073 - RNA, 22 nt, Human
ugucccucugaggcuucccugg

SEQ ID NO: 131074 - RNA, 17 nt, Human
ccucacagggaccagac

SEQ ID NO: 131075 - RNA, 22 nt, Human
uugaagcagcucaggaggcuua

SEQ ID NO: 131076 - RNA, 22 nt, Human
ugaggcaggagguugagaacug

SEQ ID NO: 131077 - RNA, 22 nt, Human
aaggccagcuuguagggcuggu

SEQ ID NO: 131078 - RNA, 22 nt, Human
ucccagcagggccgaccagccu

SEQ ID NO: 131079 - RNA, 22 nt, Human
ucaggaugguguggaggaaaua

SEQ ID NO: 131080 - RNA, 22 nt, Human
ugcagcucugaacagucaugaa

SEQ ID NO: 131081 - RNA, 22 nt, Human
guggccuggauagacuccaucu

SEQ ID NO: 131082 - RNA, 22 nt, Human
aaucuggcauuugagaguagga

SEQ ID NO: 131083 - RNA, 22 nt, Human
uggcuggcgccgggcuagccac

SEQ ID NO: 131084 - RNA, 22 nt, Human
ccaggaaugaaauguagauaaa

SEQ ID NO: 131085 - RNA, 18 nt, Human
gggcaucauucacaaagu

SEQ ID NO: 131086 - RNA, 22 nt, Human
uacauuguuuuuucuugccauc

SEQ ID NO: 131087 - RNA, 22 nt, Human
uuugcauuucucguaaggaaac

SEQ ID NO: 131088 - RNA, 22 nt, Human
agcagcugcagggagggucugc

SEQ ID NO: 131089 - RNA, 22 nt, Human
uuauuuaauuuucucacucaga

SEQ ID NO: 131090 - RNA, 17 nt, Human
ugcauuguaggcuagcc

SEQ ID NO: 131091 - RNA, 22 nt, Human
ucugggaaaugcuguuccuugu

SEQ ID NO: 131092 - RNA, 22 nt, Human
acagagcauuugggacagagag

SEQ ID NO: 131093 - RNA, 22 nt, Human
acagguggcauaggcaguuuga

SEQ ID NO: 131094 - RNA, 22 nt, Human
uggcucugucaaacugcacaca

SEQ ID NO: 131095 - RNA, 19 nt, Human
acagagcucucugcuucug

SEQ ID NO: 131096 - RNA, 22 nt, Human
ccuguguggaaaccgcaugacg

SEQ ID NO: 131097 - RNA, 22 nt, Human
gugcagggagcccagaaggucc

SEQ ID NO: 131098 - RNA, 22 nt, Human
aggagagagcugagcuuugcug

SEQ ID NO: 131099 - RNA, 22 nt, Human
auuuucucacaaugcagaagga

SEQ ID NO: 131100 - RNA, 22 nt, Human
ucugcugcacaaauucaucucu

SEQ ID NO: 131101 - RNA, 22 nt, Human
aguucucaagacaauuaccugu

SEQ ID NO: 131102 - RNA, 22 nt, Human
ggccagggccuggggacugucc

SEQ ID NO: 131103 - RNA, 22 nt, Human
ugguccaggguguaguacagag

SEQ ID NO: 131104 - RNA, 22 nt, Human
uuaguaauguguuaauaugaau

SEQ ID NO: 131105 - RNA, 22 nt, Human
uagaaacugauagucuugugcu

SEQ ID NO: 131106 - RNA, 22 nt, Human
gcaguggcuaagcucgcaugca

SEQ ID NO: 131107 - RNA, 19 nt, Human
ggcugccuuuccuuaccag

SEQ ID NO: 131108 - RNA, 22 nt, Human
aucaguuucugugaagaacaca

SEQ ID NO: 131109 - RNA, 22 nt, Human
caggggcuguuugccucaggcc

SEQ ID NO: 131110 - RNA, 22 nt, Human
ucaguauagcuucuaaacuaac

SEQ ID NO: 131111 - RNA, 20 nt, Human
gcugaggucauuaugccuca

SEQ ID NO: 131112 - RNA, 22 nt, Human
aucuagaaguggcaugaauuac

SEQ ID NO: 131113 - RNA, 22 nt, Human
uguguguauaauaaugucugca

SEQ ID NO: 131114 - RNA, 22 nt, Human
ucagccucucugaguccagacc

SEQ ID NO: 131115 - RNA, 22 nt, Human
agcugcagucaagcugggccac

SEQ ID NO: 131116 - RNA, 22 nt, Human
cagaggccuuucuacagugaua

SEQ ID NO: 131117 - RNA, 22 nt, Human
uucuacaugguugcucagaggg

SEQ ID NO: 131118 - RNA, 21 nt, Human
guggccugauuaugaaugggu

SEQ ID NO: 131119 - RNA, 22 nt, Human
agggucugacaaugugacuuag

SEQ ID NO: 131120 - RNA, 22 nt, Human
gaaggccuagggaugcucugcg

SEQ ID NO: 131121 - RNA, 22 nt, Human
acucccagguugccuggcaggc

SEQ ID NO: 131122 - RNA, 22 nt, Human
agcugcugugugcucaggcagg

SEQ ID NO: 131123 - RNA, 22 nt, Human
uggcaucucaaacaggcagauu

SEQ ID NO: 131124 - RNA, 22 nt, Human
aguccuucaagaaaucuggaaa

SEQ ID NO: 131125 - RNA, 18 nt, Human
aagccagagaccacugcc

SEQ ID NO: 131126 - RNA, 22 nt, Human
agcaggugacccaagcaggcug

SEQ ID NO: 131127 - RNA, 22 nt, Human
ggagccagcagggugacacuga

SEQ ID NO: 131128 - RNA, 22 nt, Human
gcaguggcuaggagucuggcgu

SEQ ID NO: 131129 - RNA, 22 nt, Human
aaacuuuuuauucuaaugucua

SEQ ID NO: 131130 - RNA, 22 nt, Human
uaagaacaguagaacaguaggu

SEQ ID NO: 131131 - RNA, 22 nt, Human
ugccagcccaccuuggggccuc

SEQ ID NO: 131132 - RNA, 21 nt, Human
gcagccagacgggauucaguu

SEQ ID NO: 131133 - RNA, 22 nt, Human
cagucccuaguggagcucacag

SEQ ID NO: 131134 - RNA, 22 nt, Human
cucucuuuuucgugugccgaag

SEQ ID NO: 131135 - RNA, 22 nt, Human
cccaggaggccaagguugcagu

SEQ ID NO: 131136 - RNA, 22 nt, Human
cacugcucgcugcagcauggcc

SEQ ID NO: 131137 - RNA, 22 nt, Human
uauuuugacuauuaaaccaaca

SEQ ID NO: 131138 - RNA, 22 nt, Human
ggauccuuaacuaucacaguga

SEQ ID NO: 131139 - RNA, 23 nt, Human
cccagcgcugagcccugcaggca

SEQ ID NO: 131140 - RNA, 22 nt, Human
augugugguacagucccguuua

SEQ ID NO: 131141 - RNA, 22 nt, Human
caggagcuacucagguuggguu

SEQ ID NO: 131142 - RNA, 22 nt, Human
agggugccugcugcagguucag

SEQ ID NO: 131143 - RNA, 22 nt, Human
aauaguguuguucacucaggag

SEQ ID NO: 131144 - RNA, 20 nt, Human
ugcagggcucugcuucucuc

SEQ ID NO: 131145 - RNA, 22 nt, Human
guguagcuuuggagugggaggc

SEQ ID NO: 131146 - RNA, 22 nt, Human
uuuaacuugaucaguagagcau

SEQ ID NO: 131147 - RNA, 22 nt, Human
ggcagcaguaggagcuaaucuu

SEQ ID NO: 131148 - RNA, 22 nt, Human
ccugugugguagccagcggugc

SEQ ID NO: 131149 - RNA, 22 nt, Human
ugggccacaagccaugggacca

SEQ ID NO: 131150 - RNA, 23 nt, Human
gccucagagaaacagcugcacac

SEQ ID NO: 131151 - RNA, 22 nt, Human
gacagagugcagggcuagaaga

SEQ ID NO: 131152 - RNA, 20 nt, Human
ugcuguaagauuagagagcu

SEQ ID NO: 131153 - RNA, 22 nt, Human
gaggucagucagaccaggguuu

SEQ ID NO: 131154 - RNA, 17 nt, Human
cauguguaugugggagu

SEQ ID NO: 131155 - RNA, 23 nt, Human
agccacuucuaucuugcuccugg

SEQ ID NO: 131156 - RNA, 20 nt, Human
ccaccuggccaaggcugugc

SEQ ID NO: 131157 - RNA, 22 nt, Human
uuuccuaguucuaagaaaugua

SEQ ID NO: 131158 - RNA, 22 nt, Human
cgccaggcuugguagcucaugc

SEQ ID NO: 131159 - RNA, 22 nt, Human
gucauauacacugcauguaauc

SEQ ID NO: 131160 - RNA, 22 nt, Human
gaugugggguugagggaccagc

SEQ ID NO: 131161 - RNA, 22 nt, Human
ucuuuuggaaaugaugugcagg

SEQ ID NO: 131162 - RNA, 22 nt, Human
gccuggagugcaguggcgugau

SEQ ID NO: 131163 - RNA, 22 nt, Human
cagcaggacguccaagugcuau

SEQ ID NO: 131164 - RNA, 22 nt, Human
gcugguuagaaaacagagcuca

SEQ ID NO: 131165 - RNA, 22 nt, Human
ggcuggcacugaggagagcucu

SEQ ID NO: 131166 - RNA, 22 nt, Human
gagcugccaagauuacaaucag

SEQ ID NO: 131167 - RNA, 22 nt, Human
accagagcagacuacuggaggu

SEQ ID NO: 131168 - RNA, 22 nt, Human
gcugucugucucugugacuuaa

SEQ ID NO: 131169 - RNA, 22 nt, Human
acauuucucagggaguuuugcu

SEQ ID NO: 131170 - RNA, 22 nt, Human
uuuguaugaacugguauguagg

SEQ ID NO: 131171 - RNA, 22 nt, Human
uaugcacagaaguuugcugaau

SEQ ID NO: 131172 - RNA, 22 nt, Human
cucaggauccaucuccugcccu

SEQ ID NO: 131173 - RNA, 22 nt, Human
augcacagcagugaguucagug

SEQ ID NO: 131174 - RNA, 22 nt, Human
ggccagaaguuggaaaagagcc

SEQ ID NO: 131175 - RNA, 22 nt, Human
uauauucugauuccaucugugu

SEQ ID NO: 131176 - RNA, 22 nt, Human
auauaauacaaccugcuaagug

SEQ ID NO: 131177 - RNA, 22 nt, Human
aaguucaaguaguguuacaugg

SEQ ID NO: 131178 - RNA, 22 nt, Human
auguguauauuuggugucaaua

SEQ ID NO: 131179 - RNA, 22 nt, Human
uggcucaggccuacgacgccuu

SEQ ID NO: 131180 - RNA, 22 nt, Human
aaaacucugcaguuaguuucua

SEQ ID NO: 131181 - RNA, 22 nt, Human
ggucagggggaucugugaggua

SEQ ID NO: 131182 - RNA, 22 nt, Human
agcugcucuuugaaggacacuu

SEQ ID NO: 131183 - RNA, 23 nt, Human
uggcaccaggcauucuaggggua

SEQ ID NO: 131184 - RNA, 22 nt, Human
aaaaagguugauccagauuagg

SEQ ID NO: 131185 - RNA, 22 nt, Human
acuuucucccacccacccgucu

SEQ ID NO: 131186 - RNA, 22 nt, Human
uguauguaaaguuuguaauaga

SEQ ID NO: 131187 - RNA, 22 nt, Human
aguggcuggagccccaggcugg

SEQ ID NO: 131188 - RNA, 22 nt, Human
gccgaagcugccgucugguccu

SEQ ID NO: 131189 - RNA, 22 nt, Human
uuaagauagaacccaguagucu

SEQ ID NO: 131190 - RNA, 16 nt, Human
gagggcagaggcggaa

SEQ ID NO: 131191 - RNA, 22 nt, Human
auucuucacaaauauauagaag

SEQ ID NO: 131192 - RNA, 22 nt, Human
gaaucucaguggaagcaggaag

SEQ ID NO: 131193 - RNA, 22 nt, Human
uaagcauucaaugcuuagcacu

SEQ ID NO: 131194 - RNA, 22 nt, Human
ucacugcaaucucugccuucca

SEQ ID NO: 131195 - RNA, 22 nt, Human
uucacaggcuuggagguggggg

SEQ ID NO: 131196 - RNA, 22 nt, Human
ccucccucuguuagagcugucu

SEQ ID NO: 131197 - RNA, 22 nt, Human
acaguauuugcgauacugauga

SEQ ID NO: 131198 - RNA, 22 nt, Human
cacucaggcugugucaggagga

SEQ ID NO: 131199 - RNA, 22 nt, Human
agaccacagucaggcuccuggu

SEQ ID NO: 131200 - RNA, 18 nt, Human
caggagcaggaguugaac

SEQ ID NO: 131201 - RNA, 22 nt, Human
auacaguaaccacauucuauag

SEQ ID NO: 131202 - RNA, 22 nt, Human
aggccucacucucagagcuucu

SEQ ID NO: 131203 - RNA, 22 nt, Human
agcaaagucaguggaaccaucc

SEQ ID NO: 131204 - RNA, 22 nt, Human
ggagccugugggaugagaugug

SEQ ID NO: 131205 - RNA, 22 nt, Human
cauguacaaaaggcaaaugccu

SEQ ID NO: 131206 - RNA, 22 nt, Human
gcuggccucaucacugacuucu

SEQ ID NO: 131207 - RNA, 22 nt, Human
uucuaacuaaagucuuuguuuu

SEQ ID NO: 131208 - RNA, 22 nt, Human
gccucugcaucuucgccgcacu

SEQ ID NO: 131209 - RNA, 22 nt, Human
gugucauggaaaauugcaaugg

SEQ ID NO: 131210 - RNA, 22 nt, Human
ggagcuggcuacagagaacucc

SEQ ID NO: 131211 - RNA, 22 nt, Human
ucugucacaauuugcuuacucu

SEQ ID NO: 131212 - RNA, 22 nt, Human
gcucccugccuacacggaccuu

SEQ ID NO: 131213 - RNA, 22 nt, Human
cagcucucuaaggucuugcuuu

SEQ ID NO: 131214 - RNA, 22 nt, Human
uaaaucaguuucucuuauuggu

SEQ ID NO: 131215 - RNA, 22 nt, Human
aauguguauaugaacauacagg

SEQ ID NO: 131216 - RNA, 22 nt, Human
auggacagugugucuguuucca

SEQ ID NO: 131217 - RNA, 23 nt, Human
ucugucaccuauggcugcucuuc

SEQ ID NO: 131218 - RNA, 22 nt, Human
agagcugagaauguggcuuccu

SEQ ID NO: 131219 - RNA, 22 nt, Human
cuguggcucugcagucccaaca

SEQ ID NO: 131220 - RNA, 22 nt, Human
ugagccagauaagggcucacgc

SEQ ID NO: 131221 - RNA, 22 nt, Human
acauaccauacauggugagaug

SEQ ID NO: 131222 - RNA, 20 nt, Human
uauuuguauuugggaaaguu

SEQ ID NO: 131223 - RNA, 22 nt, Human
cagcucuggcgucagggagcga

SEQ ID NO: 131224 - RNA, 22 nt, Human
augucuuuauaaauguauaaug

SEQ ID NO: 131225 - RNA, 22 nt, Human
ugggcuggugagggaucauuua

SEQ ID NO: 131226 - RNA, 22 nt, Human
ucucagagcuucaguuauuuuc

SEQ ID NO: 131227 - RNA, 22 nt, Human
ugccacacagcuguaugaggga

SEQ ID NO: 131228 - RNA, 22 nt, Human
uggggcuggcacagucucuauu

SEQ ID NO: 131229 - RNA, 22 nt, Human
agcugguguccuccuggagcug

SEQ ID NO: 131230 - RNA, 22 nt, Human
acagaaagaagguguauuugag

SEQ ID NO: 131231 - RNA, 18 nt, Human
ugucucuccuuucugugu

SEQ ID NO: 131232 - RNA, 23 nt, Human
aucuguguguggguagggaugau

SEQ ID NO: 131233 - RNA, 22 nt, Human
gcuuuacaugagaugaggacaa

SEQ ID NO: 131234 - RNA, 22 nt, Human
agcugccagcaucccggaaggg

SEQ ID NO: 131235 - RNA, 22 nt, Human
agucucagcuacuugggaggcu

SEQ ID NO: 131236 - RNA, 22 nt, Human
agagccugaggaugucccagcu

SEQ ID NO: 131237 - RNA, 22 nt, Human
uugacagcaaagauugugccua

SEQ ID NO: 131238 - RNA, 22 nt, Human
cccucugcugccuggcuggguc

SEQ ID NO: 131239 - RNA, 22 nt, Human
caauacuuccuuguuagaggca

SEQ ID NO: 131240 - RNA, 22 nt, Human
cagugccaugucugagccccua

SEQ ID NO: 131241 - RNA, 22 nt, Human
ugagugaggaagcgguggagga

SEQ ID NO: 131242 - RNA, 22 nt, Human
auuuucugagcacgugacagca

SEQ ID NO: 131243 - RNA, 22 nt, Human
cagcaucuaaucuucaugccgg

SEQ ID NO: 131244 - RNA, 22 nt, Human
ucugaggcccugcaggcagugu

SEQ ID NO: 131245 - RNA, 22 nt, Human
uuuuuccuuagggguuacucac

SEQ ID NO: 131246 - RNA, 22 nt, Human
gcucuuccauuucucuugaacu

SEQ ID NO: 131247 - RNA, 22 nt, Human
uugaagcagagaaauacuugaa

SEQ ID NO: 131248 - RNA, 22 nt, Human
ccuccugggccuugcucuguga

SEQ ID NO: 131249 - RNA, 22 nt, Human
aauuuucugguguguaaugaag

SEQ ID NO: 131250 - RNA, 22 nt, Human
uacagugauuucuacugguguu

SEQ ID NO: 131251 - RNA, 21 nt, Human
ggugucaguuuuggucauuag

SEQ ID NO: 131252 - RNA, 22 nt, Human
cacaggagagcugggaggugcc

SEQ ID NO: 131253 - RNA, 22 nt, Human
uccuggagagugggcgagcaca

SEQ ID NO: 131254 - RNA, 22 nt, Human
cuggcucauccagguguugcuc

SEQ ID NO: 131255 - RNA, 20 nt, Human
aagagcugacucacaguggu

SEQ ID NO: 131256 - RNA, 18 nt, Human
caguuuuuauaucuggca

SEQ ID NO: 131257 - RNA, 22 nt, Human
agauacaugucaagagacuuau

SEQ ID NO: 131258 - RNA, 22 nt, Human
uguggcugucuguucuccuagg

SEQ ID NO: 131259 - RNA, 22 nt, Human
ggagccaguauuuaguggucuu

SEQ ID NO: 131260 - RNA, 22 nt, Human
uuuauuauucucuggagaaugu

SEQ ID NO: 131261 - RNA, 22 nt, Human
gcagccagccccucugaccucu

SEQ ID NO: 131262 - RNA, 18 nt, Human
uucaccagugugaugggu

SEQ ID NO: 131263 - RNA, 22 nt, Human
uggcuggcaaggcuggagucag

SEQ ID NO: 131264 - RNA, 22 nt, Human
cacaggcucuucucacuugauu

SEQ ID NO: 131265 - RNA, 22 nt, Human
gccagcucccaagugagccccu

SEQ ID NO: 131266 - RNA, 22 nt, Human
agugugucugaucacuugugag

SEQ ID NO: 131267 - RNA, 22 nt, Human
ggcaggagaaaggucucuucuu

SEQ ID NO: 131268 - RNA, 22 nt, Human
cugaggcuuugugugcaugccu

SEQ ID NO: 131269 - RNA, 22 nt, Human
ggcuucugaaaucucugugcgu

SEQ ID NO: 131270 - RNA, 22 nt, Human
gcucucuuuaaacugcauggcu

SEQ ID NO: 131271 - RNA, 22 nt, Human
agcagcucaaagccugcaagga

SEQ ID NO: 131272 - RNA, 22 nt, Human
uggccugguuguugcugccguu

SEQ ID NO: 131273 - RNA, 22 nt, Human
cuuauguaaacuacagauaaua

SEQ ID NO: 131274 - RNA, 20 nt, Human
aucaggauucuugcuuuguu

SEQ ID NO: 131275 - RNA, 22 nt, Human
gccagagcacaggcugguagua

SEQ ID NO: 131276 - RNA, 22 nt, Human
uuguguccugauuugacacaau

SEQ ID NO: 131277 - RNA, 22 nt, Human
cagccagcuggcacugugagua

SEQ ID NO: 131278 - RNA, 22 nt, Human
ucagaagacuacuaggacacau

SEQ ID NO: 131279 - RNA, 19 nt, Human
guguauguaaguugugagg

SEQ ID NO: 131280 - RNA, 22 nt, Human
uaaagguacgaagugagggauu

SEQ ID NO: 131281 - RNA, 22 nt, Human
cugaugcuauaagccacagugg

SEQ ID NO: 131282 - RNA, 22 nt, Human
cagcuucucagaaagcugaggu

SEQ ID NO: 131283 - RNA, 22 nt, Human
acaaauaugguacucggagaaa

SEQ ID NO: 131284 - RNA, 22 nt, Human
uggaaggcaacggagugagcug

SEQ ID NO: 131285 - RNA, 22 nt, Human
ucugccugccagucugguccuc

SEQ ID NO: 131286 - RNA, 22 nt, Human
uuugacaggacuaacauauggc

SEQ ID NO: 131287 - RNA, 19 nt, Human
gcaggguguugacuguccc

SEQ ID NO: 131288 - RNA, 22 nt, Human
ugggcugcagagcccggccuuc

SEQ ID NO: 131289 - RNA, 22 nt, Human
cuucucaaaguugugaaucagg

SEQ ID NO: 131290 - RNA, 22 nt, Human
ucagagugugacuuggucauga

SEQ ID NO: 131291 - RNA, 22 nt, Human
gaggagagagggacugucugca

SEQ ID NO: 131292 - RNA, 22 nt, Human
agcagagccugggcuaggggug

SEQ ID NO: 131293 - RNA, 22 nt, Human
uaaauuauggcuggcagagcag

SEQ ID NO: 131294 - RNA, 17 nt, Human
ggcugcugugcuggugc

SEQ ID NO: 131295 - RNA, 22 nt, Human
gcagcugggccccagccucucc

SEQ ID NO: 131296 - RNA, 22 nt, Human
cccaagggagugccuggucaac

SEQ ID NO: 131297 - RNA, 19 nt, Human
cuucuucuuggcagccaag

SEQ ID NO: 131298 - RNA, 22 nt, Human
ucaaaugcucuuugcagagagg

SEQ ID NO: 131299 - RNA, 20 nt, Human
auucucugcucaaguggcac

SEQ ID NO: 131300 - RNA, 22 nt, Human
auaaauaucacuguugucccuc

SEQ ID NO: 131301 - RNA, 22 nt, Human
uauguguauugagcauuguuac

SEQ ID NO: 131302 - RNA, 22 nt, Human
agggccaggaacaccugaaggg

SEQ ID NO: 131303 - RNA, 22 nt, Human
uuuguuaauucuuauguuagag

SEQ ID NO: 131304 - RNA, 22 nt, Human
cuggccugagaaugcuacccuu

SEQ ID NO: 131305 - RNA, 22 nt, Human
cccagggagguagcaggagaaa

SEQ ID NO: 131306 - RNA, 23 nt, Human
ucuccagugucucuucauugagu

SEQ ID NO: 131307 - RNA, 22 nt, Human
agauuucccacuccauguauug

SEQ ID NO: 131308 - RNA, 22 nt, Human
uacucucuggaaauuauaguga

SEQ ID NO: 131309 - RNA, 22 nt, Human
aggcaguuguugcugagcagcu

SEQ ID NO: 131310 - RNA, 22 nt, Human
ugauuuccacagucaggggugc

SEQ ID NO: 131311 - RNA, 22 nt, Human
uucaggagcuggcugcgaagga

SEQ ID NO: 131312 - RNA, 23 nt, Human
cugaggccugcugcguucagguu

SEQ ID NO: 131313 - RNA, 22 nt, Human
cucaggacccgguccagguggg

SEQ ID NO: 131314 - RNA, 22 nt, Human
auguguguaugugccuauaucu

SEQ ID NO: 131315 - RNA, 22 nt, Human
agcagcauucucugguaugggg

SEQ ID NO: 131316 - RNA, 21 nt, Human
agaaaaaccagcauguuuuca

SEQ ID NO: 131317 - RNA, 22 nt, Human
ccucuucugagugagacucccu

SEQ ID NO: 131318 - RNA, 22 nt, Human
uggagcaggcaucuuucucucu

SEQ ID NO: 131319 - RNA, 22 nt, Human
ccugccuguacuagagacccag

SEQ ID NO: 131320 - RNA, 23 nt, Human
aaugauuucaugaugauagcagc

SEQ ID NO: 131321 - RNA, 22 nt, Human
cucugggcaggaccaguggacc

SEQ ID NO: 131322 - RNA, 22 nt, Human
ccugugccauccugagcauccc

SEQ ID NO: 131323 - RNA, 22 nt, Human
ugccagggugucaggagagcua

SEQ ID NO: 131324 - RNA, 22 nt, Human
auaaaaacugacccauccuuug

SEQ ID NO: 131325 - RNA, 22 nt, Human
ucucugggaaugggccugggua

SEQ ID NO: 131326 - RNA, 22 nt, Human
gcugaaggaggcucugguacua

SEQ ID NO: 131327 - RNA, 22 nt, Human
gcagcugauggaaguccuauug

SEQ ID NO: 131328 - RNA, 22 nt, Human
ucccacacagcccgcucaccgg

SEQ ID NO: 131329 - RNA, 22 nt, Human
gcugcagcucgccuuccggccu

SEQ ID NO: 131330 - RNA, 22 nt, Human
gcagagcugggucuguauccaa

SEQ ID NO: 131331 - RNA, 22 nt, Human
cagaguggcacucugcuggaug

SEQ ID NO: 131332 - RNA, 21 nt, Human
agcagagugcuuugacuuugu

SEQ ID NO: 131333 - RNA, 22 nt, Human
cuuugcauacaauuuuuagaaa

SEQ ID NO: 131334 - RNA, 22 nt, Human
ucugagcuuuuauuaucaaccu

SEQ ID NO: 131335 - RNA, 22 nt, Human
agggcccucuggcaggccaggc

SEQ ID NO: 131336 - RNA, 22 nt, Human
ugccucagaguugucccuacca

SEQ ID NO: 131337 - RNA, 22 nt, Human
acagagagaaacaaucagcagc

SEQ ID NO: 131338 - RNA, 22 nt, Human
aagggacuuugucagcuuucca

SEQ ID NO: 131339 - RNA, 22 nt, Human
uggagcagccaugaugacagag

SEQ ID NO: 131340 - RNA, 22 nt, Human
agcucuccacacauaggacuag

SEQ ID NO: 131341 - RNA, 22 nt, Human
agucuucagagaaauuaacucu

SEQ ID NO: 131342 - RNA, 22 nt, Human
caccagggcucugagcucugaa

SEQ ID NO: 131343 - RNA, 22 nt, Human
acaaagguggaccauguggcuu

SEQ ID NO: 131344 - RNA, 22 nt, Human
gcugagggcauguguggcgacu

SEQ ID NO: 131345 - RNA, 22 nt, Human
augaagcugaccuugucuugcu

SEQ ID NO: 131346 - RNA, 22 nt, Human
aggcacuguggaagacaugguu

SEQ ID NO: 131347 - RNA, 18 nt, Human
ccagguggugacagagau

SEQ ID NO: 131348 - RNA, 22 nt, Human
uuaugggagcaauuggggaggu

SEQ ID NO: 131349 - RNA, 22 nt, Human
cuucuugcugggggccucagug

SEQ ID NO: 131350 - RNA, 22 nt, Human
gaaagagaaccugggccuagau

SEQ ID NO: 131351 - RNA, 22 nt, Human
uuucucucuauuuagacaggua

SEQ ID NO: 131352 - RNA, 22 nt, Human
uagaaaugcccagauucugcua

SEQ ID NO: 131353 - RNA, 22 nt, Human
acuggcagcuguaggaugcaug

SEQ ID NO: 131354 - RNA, 22 nt, Human
cucuggaaaaccacuagcagga

SEQ ID NO: 131355 - RNA, 22 nt, Human
uguaggcugaagaugaagugga

SEQ ID NO: 131356 - RNA, 22 nt, Human
ggccagaggccauccuccugcu

SEQ ID NO: 131357 - RNA, 23 nt, Human
uguaacuuugggcauguugcuuc

SEQ ID NO: 131358 - RNA, 17 nt, Human
gcucccugaggacagcu

SEQ ID NO: 131359 - RNA, 22 nt, Human
ccagggcagcgccccuccacgc

SEQ ID NO: 131360 - RNA, 22 nt, Human
cucuccuugcagauggcugccu

SEQ ID NO: 131361 - RNA, 22 nt, Human
acagggcagagaggcaggcuug

SEQ ID NO: 131362 - RNA, 22 nt, Human
caagaacauugugaucacuuca

SEQ ID NO: 131363 - RNA, 22 nt, Human
uuggcucaggaccccugugacu

SEQ ID NO: 131364 - RNA, 22 nt, Human
cagcuucugagcaagccagggg

SEQ ID NO: 131365 - RNA, 22 nt, Human
cccuuccucccaggcuucugug

SEQ ID NO: 131366 - RNA, 22 nt, Human
caaagugcuaggauuacaggcc

SEQ ID NO: 131367 - RNA, 22 nt, Human
ugaaggccacuuccugugagcu

SEQ ID NO: 131368 - RNA, 22 nt, Human
agaccgagaaguucuccaggcc

SEQ ID NO: 131369 - RNA, 22 nt, Human
ucugugugcccaccugacaccu

SEQ ID NO: 131370 - RNA, 22 nt, Human
gucccaggcagagucaggaggg

SEQ ID NO: 131371 - RNA, 22 nt, Human
cuaaucaucuuucucuuaaagc

SEQ ID NO: 131372 - RNA, 22 nt, Human
uacuuccuguuuccaugucugu

SEQ ID NO: 131373 - RNA, 22 nt, Human
ccugucauacuaacguaguggg

SEQ ID NO: 131374 - RNA, 22 nt, Human
cccaggaggucgaagcugcagu

SEQ ID NO: 131375 - RNA, 22 nt, Human
cccagaaggucgaggcugcagu

SEQ ID NO: 131376 - RNA, 21 nt, Human
cugaggcagcacagcuaguca

SEQ ID NO: 131377 - RNA, 22 nt, Human
cuagaaauacaggcacgugcca

SEQ ID NO: 131378 - RNA, 21 nt, Human
ggcagccucuguggaagggga

SEQ ID NO: 131379 - RNA, 22 nt, Human
guuagaaacacauucuuauuga

SEQ ID NO: 131380 - RNA, 22 nt, Human
gcagggccuuagcagcggcugc

SEQ ID NO: 131381 - RNA, 22 nt, Human
ggaggcucccacgcagcucaca

SEQ ID NO: 131382 - RNA, 22 nt, Human
uucugugauugacauguggcuu

SEQ ID NO: 131383 - RNA, 20 nt, Human
gcugcucuccacggucugca

SEQ ID NO: 131384 - RNA, 21 nt, Human
acagcaagccuuccuuucagg

SEQ ID NO: 131385 - RNA, 22 nt, Human
ugucuucaucuccaugcacaga

SEQ ID NO: 131386 - RNA, 22 nt, Human
ucucucucagccauuacagaac

SEQ ID NO: 131387 - RNA, 21 nt, Human
ggugggcacaggagagcagag

SEQ ID NO: 131388 - RNA, 22 nt, Human
uacuuuuccagggcuggcugag

SEQ ID NO: 131389 - RNA, 21 nt, Human
ggauggauagggaagagauuu

SEQ ID NO: 131390 - RNA, 19 nt, Human
acacagggaucagaggguu

SEQ ID NO: 131391 - RNA, 20 nt, Human
gguagcagcugcugucaucc

SEQ ID NO: 131392 - RNA, 22 nt, Human
augcuuuuccaggagaaauaua

SEQ ID NO: 131393 - RNA, 22 nt, Human
cagcuggcagaaccugcaucca

SEQ ID NO: 131394 - RNA, 22 nt, Human
ugcaauaaagugcuauaaaucc

SEQ ID NO: 131395 - RNA, 22 nt, Human
uuucacagagaauauugccuug

SEQ ID NO: 131396 - RNA, 18 nt, Human
gaaaugugauucuagggc

SEQ ID NO: 131397 - RNA, 22 nt, Human
cacugcaguuccccagugcgca

SEQ ID NO: 131398 - RNA, 22 nt, Human
aaggcacugcuuugcugcgccc

SEQ ID NO: 131399 - RNA, 22 nt, Human
uguaucaaggguuuauguaagc

SEQ ID NO: 131400 - RNA, 22 nt, Human
gaaaugugggucaugacccauu

SEQ ID NO: 131401 - RNA, 22 nt, Human
ugugccaggcacuugcccaggc

SEQ ID NO: 131402 - RNA, 22 nt, Human
acuuauuuauucauucagcuca

SEQ ID NO: 131403 - RNA, 22 nt, Human
uccugccucuccaugcuaacua

SEQ ID NO: 131404 - RNA, 22 nt, Human
uuuaaaauuuagaccucuccac

SEQ ID NO: 131405 - RNA, 22 nt, Human
uacaaaguuuucuuggauugag

SEQ ID NO: 131406 - RNA, 20 nt, Human
ugggccugagccugugggcu

SEQ ID NO: 131407 - RNA, 22 nt, Human
aguguguagcacaugguaagca

SEQ ID NO: 131408 - RNA, 22 nt, Human
auuaaauuaaguggcuaauuua

SEQ ID NO: 131409 - RNA, 22 nt, Human
uuguaacagcuguuuauauagu

SEQ ID NO: 131410 - RNA, 19 nt, Human
acaaaugauguugcacuga

SEQ ID NO: 131411 - RNA, 22 nt, Human
uauuuuaucugccagaguggag

SEQ ID NO: 131412 - RNA, 22 nt, Human
ugcugccuuugggaccuggccu

SEQ ID NO: 131413 - RNA, 22 nt, Human
ugagaaagugggugccuagcaa

SEQ ID NO: 131414 - RNA, 22 nt, Human
cagggcagggccacacccccug

SEQ ID NO: 131415 - RNA, 22 nt, Human
ccucagaugucuuaaggcacug

SEQ ID NO: 131416 - RNA, 22 nt, Human
ucagugugauuaggcuaucuga

SEQ ID NO: 131417 - RNA, 22 nt, Human
caaagggcucuagacucagcag

SEQ ID NO: 131418 - RNA, 22 nt, Human
agggcagaaauauugauacugu

SEQ ID NO: 131419 - RNA, 22 nt, Human
uaagaacaagauguuccuguuu

SEQ ID NO: 131420 - RNA, 22 nt, Human
ccagcugggauuaagggaaaau

SEQ ID NO: 131421 - RNA, 21 nt, Human
ggacuuacauagguaaggggu

SEQ ID NO: 131422 - RNA, 22 nt, Human
uuugcauuuugauaagaucacu

SEQ ID NO: 131423 - RNA, 22 nt, Human
uugagaagaggcuuuguaggaa

SEQ ID NO: 131424 - RNA, 21 nt, Human
uccuccuucaaguccuggccu

SEQ ID NO: 131425 - RNA, 22 nt, Human
cucagugugaaugcucaguaaa

SEQ ID NO: 131426 - RNA, 22 nt, Human
cuggcugugcuggaguugagga

SEQ ID NO: 131427 - RNA, 22 nt, Human
caucucuucauuagcauuauug

SEQ ID NO: 131428 - RNA, 22 nt, Human
gcacugaaauuauaugcauuug

SEQ ID NO: 131429 - RNA, 22 nt, Human
ugaaaucuuauacuuugguagu

SEQ ID NO: 131430 - RNA, 22 nt, Human
cagggcaguaacgggaacaucu

SEQ ID NO: 131431 - RNA, 22 nt, Human
gagagaagaauguuccgaggcc

SEQ ID NO: 131432 - RNA, 22 nt, Human
ucuuuagcuagaaauacucuaa

SEQ ID NO: 131433 - RNA, 22 nt, Human
ggccagaaaguuaagcuguggc

SEQ ID NO: 131434 - RNA, 23 nt, Human
acaguuauagcugugaauaacau

SEQ ID NO: 131435 - RNA, 22 nt, Human
ugcugccacauuuaaagagggg

SEQ ID NO: 131436 - RNA, 22 nt, Human
uucuuaaagaggcaaaacacag

SEQ ID NO: 131437 - RNA, 22 nt, Human
guguacugcaaaugcugcugcc

SEQ ID NO: 131438 - RNA, 22 nt, Human
ucugcaggaaaaaagugccugg

SEQ ID NO: 131439 - RNA, 22 nt, Human
uuagauauguuuuugcuaaugc

SEQ ID NO: 131440 - RNA, 22 nt, Human
ucuuaaagagcgcaauuugagg

SEQ ID NO: 131441 - RNA, 19 nt, Human
uuagccauccacagugaaa

SEQ ID NO: 131442 - RNA, 23 nt, Human
auuuacagcugugugagcaaguu

SEQ ID NO: 131443 - RNA, 22 nt, Human
uggcccugcuggccaaaggcua

SEQ ID NO: 131444 - RNA, 22 nt, Human
guagaagugaugucauguuaua

SEQ ID NO: 131445 - RNA, 22 nt, Human
aucugccugagucuagguuuuc

SEQ ID NO: 131446 - RNA, 20 nt, Human
uaagaacaagacuaggaagc

SEQ ID NO: 131447 - RNA, 22 nt, Human
uuuauaguagcaugauuuauaa

SEQ ID NO: 131448 - RNA, 22 nt, Human
ggcagagcugcaugagcacuca

SEQ ID NO: 131449 - RNA, 22 nt, Human
aggcuauuuccacucuucucau

SEQ ID NO: 131450 - RNA, 19 nt, Human
gcuggcagauguggccgug

SEQ ID NO: 131451 - RNA, 19 nt, Human
uggggcuguguuuugaccc

SEQ ID NO: 131452 - RNA, 22 nt, Human
uuuccucuccaccaggaggucu

SEQ ID NO: 131453 - RNA, 22 nt, Human
uuucacucagcucucauugucu

SEQ ID NO: 131454 - RNA, 22 nt, Human
cuucuguggauguuggaugcau

SEQ ID NO: 131455 - RNA, 22 nt, Human
gauauuuuuaggugaugcaggc

SEQ ID NO: 131456 - RNA, 22 nt, Human
cacagcugcccuacuccaugug

SEQ ID NO: 131457 - RNA, 22 nt, Human
agcugagcucaggcugauguaa

SEQ ID NO: 131458 - RNA, 22 nt, Human
uucaggaugcagagguuguagu

SEQ ID NO: 131459 - RNA, 22 nt, Human
uguguauaagugagaaugcugu

SEQ ID NO: 131460 - RNA, 22 nt, Human
ggccucuggcaggcaggcccuc

SEQ ID NO: 131461 - RNA, 22 nt, Human
cugagccaaccacagcaggagc

SEQ ID NO: 131462 - RNA, 22 nt, Human
gcagcuggugcaaaugucacuc

SEQ ID NO: 131463 - RNA, 22 nt, Human
gugcagguguuuuggcugccag

SEQ ID NO: 131464 - RNA, 22 nt, Human
acguguguuggucagggggccc

SEQ ID NO: 131465 - RNA, 22 nt, Human
ugugugcucuaaugccuaguac

SEQ ID NO: 131466 - RNA, 22 nt, Human
aaucagaauuuauugaaucuuu

SEQ ID NO: 131467 - RNA, 22 nt, Human
accaggcugugaagugagacua

SEQ ID NO: 131468 - RNA, 22 nt, Human
ccuuugggugaauuccucucuu

SEQ ID NO: 131469 - RNA, 22 nt, Human
ugugugauugcacuuauaugag

SEQ ID NO: 131470 - RNA, 22 nt, Human
uuagcucagaaaauuuaaacuu

SEQ ID NO: 131471 - RNA, 22 nt, Human
ccagacuguggaguuccuggug

SEQ ID NO: 131472 - RNA, 22 nt, Human
gcagcauugugagguccugccc

SEQ ID NO: 131473 - RNA, 22 nt, Human
gaggggcagagguagagaacaa

SEQ ID NO: 131474 - RNA, 22 nt, Human
acacaguaccccaaggcugggc

SEQ ID NO: 131475 - RNA, 22 nt, Human
aaaaagauguccugaaguuuag

SEQ ID NO: 131476 - RNA, 23 nt, Human
gccucugcagccuaguuaguguc

SEQ ID NO: 131477 - RNA, 22 nt, Human
gccugguggugugcucaagugg

SEQ ID NO: 131478 - RNA, 22 nt, Human
ggguguguuccuaaggaaacca

SEQ ID NO: 131479 - RNA, 22 nt, Human
uaugcacaccuggguccuuguc

SEQ ID NO: 131480 - RNA, 21 nt, Human
agucccaggggugagugaugu

SEQ ID NO: 131481 - RNA, 22 nt, Human
cagguccccuccccuaccaggc

SEQ ID NO: 131482 - RNA, 22 nt, Human
gcagcugagcgugaggaagagu

SEQ ID NO: 131483 - RNA, 22 nt, Human
caaagguauaaguuaauauaca

SEQ ID NO: 131484 - RNA, 22 nt, Human
cucugggcaaguaugauagaaa

SEQ ID NO: 131485 - RNA, 22 nt, Human
acagacagggcaccugccuccu

SEQ ID NO: 131486 - RNA, 22 nt, Human
acacagggcagagagcuggcuc

SEQ ID NO: 131487 - RNA, 22 nt, Human
agggcagccugagugcuggccc

SEQ ID NO: 131488 - RNA, 22 nt, Human
uccugcugagcgucugucauuu

SEQ ID NO: 131489 - RNA, 17 nt, Human
ugugcgcuugugugagg

SEQ ID NO: 131490 - RNA, 22 nt, Human
aggccugcagcaggagcaaacc

SEQ ID NO: 131491 - RNA, 22 nt, Human
ggcuucaccaggugcaugcaug

SEQ ID NO: 131492 - RNA, 17 nt, Human
aaaauucuguaaagagg

SEQ ID NO: 131493 - RNA, 22 nt, Human
cuagucacucagcacugacaaa

SEQ ID NO: 131494 - RNA, 19 nt, Human
gucacauuugucucccagg

SEQ ID NO: 131495 - RNA, 22 nt, Human
gcacugcaucuacuggcaagua

SEQ ID NO: 131496 - RNA, 22 nt, Human
cuggcucaggguggucuggguc

SEQ ID NO: 131497 - RNA, 22 nt, Human
cugcucuggcuguguacuucag

SEQ ID NO: 131498 - RNA, 22 nt, Human
cacugugucuggagugagcugg

SEQ ID NO: 131499 - RNA, 20 nt, Human
ccugucugcaauggagguca

SEQ ID NO: 131500 - RNA, 22 nt, Human
cccaugagaccugguuuaaggc

SEQ ID NO: 131501 - RNA, 22 nt, Human
ucucuguucauggcacuauguc

SEQ ID NO: 131502 - RNA, 22 nt, Human
cuggagccagccagggcccucu

SEQ ID NO: 131503 - RNA, 22 nt, Human
aggcugggaaaccugaaguugu

SEQ ID NO: 131504 - RNA, 22 nt, Human
caggagacaauggcuguggggc

SEQ ID NO: 131505 - RNA, 20 nt, Human
gcagcugcccccagucccug

SEQ ID NO: 131506 - RNA, 21 nt, Human
agacagagugcagucuacaua

SEQ ID NO: 131507 - RNA, 22 nt, Human
cuuuacagccuccagaaggaac

SEQ ID NO: 131508 - RNA, 22 nt, Human
caagcuccuuacauccacaggg

SEQ ID NO: 131509 - RNA, 22 nt, Human
caggccucagagaguggcgggg

SEQ ID NO: 131510 - RNA, 22 nt, Human
agcagagcuauucuugugcaau

SEQ ID NO: 131511 - RNA, 22 nt, Human
gggcugggauugcuugcuguga

SEQ ID NO: 131512 - RNA, 22 nt, Human
ugucugagugugccugggcauu

SEQ ID NO: 131513 - RNA, 22 nt, Human
ggcuccuguccccucagcugcu

SEQ ID NO: 131514 - RNA, 22 nt, Human
cugggguggaggagcuccccug

SEQ ID NO: 131515 - RNA, 23 nt, Human
ccagcccuccaccagcucuaggc

SEQ ID NO: 131516 - RNA, 22 nt, Human
gccuggagugguccugcugccc

SEQ ID NO: 131517 - RNA, 22 nt, Human
cugagucucccggcaguggagg

SEQ ID NO: 131518 - RNA, 23 nt, Human
gggagccauggguggucauggag

SEQ ID NO: 131519 - RNA, 22 nt, Human
ugaacgcagguccacauggcuc

SEQ ID NO: 131520 - RNA, 19 nt, Human
gcaggcaguggcauucgga

SEQ ID NO: 131521 - RNA, 21 nt, Human
aaaguucaugcuuuaauauuc

SEQ ID NO: 131522 - RNA, 22 nt, Human
guaguucugcagugucaccuga

SEQ ID NO: 131523 - RNA, 20 nt, Human
aguguaugaacagaugcggg

SEQ ID NO: 131524 - RNA, 22 nt, Human
aagcagaugggacuccaaggca

SEQ ID NO: 131525 - RNA, 22 nt, Human
ggcugccugcuccuccugcacg

SEQ ID NO: 131526 - RNA, 22 nt, Human
aagcugccagcugagcugaggc

SEQ ID NO: 131527 - RNA, 22 nt, Human
acuguguguuugucuagcacag

SEQ ID NO: 131528 - RNA, 22 nt, Human
cagguggguguaugaaugcaaa

SEQ ID NO: 131529 - RNA, 22 nt, Human
agaaauguggaucguuuuaaaa

SEQ ID NO: 131530 - RNA, 22 nt, Human
ucucucuugucaccccaucugc

SEQ ID NO: 131531 - RNA, 22 nt, Human
agcugccaucugaagaacugca

SEQ ID NO: 131532 - RNA, 22 nt, Human
uuguauuucuccacuuucuguu

SEQ ID NO: 131533 - RNA, 22 nt, Human
ggccucugcaacuggcuguggc

SEQ ID NO: 131534 - RNA, 22 nt, Human
cuggugggagcagcaggcagcu

SEQ ID NO: 131535 - RNA, 22 nt, Human
acuccugggugcugaccagcgu

SEQ ID NO: 131536 - RNA, 22 nt, Human
caggcuugcugcuagagcacuu

SEQ ID NO: 131537 - RNA, 22 nt, Human
cuguccuaugaguacucacuag

SEQ ID NO: 131538 - RNA, 22 nt, Human
gcugugcuggaaggggaccugc

SEQ ID NO: 131539 - RNA, 22 nt, Human
auguggcuguggacaccuuuca

SEQ ID NO: 131540 - RNA, 21 nt, Human
uucuucaaagaagaaggcaca

SEQ ID NO: 131541 - RNA, 22 nt, Human
ugucccagauacuggacauaga

SEQ ID NO: 131542 - RNA, 22 nt, Human
ucuucugugaucuauguguuuu

SEQ ID NO: 131543 - RNA, 22 nt, Human
aguccaggaguugggugacauu

SEQ ID NO: 131544 - RNA, 22 nt, Human
uuucaguuuuugcucgauguau

SEQ ID NO: 131545 - RNA, 22 nt, Human
gucuucuuuucagucugcuugu

SEQ ID NO: 131546 - RNA, 22 nt, Human
uucuuuaaaauagugagaaaga

SEQ ID NO: 131547 - RNA, 21 nt, Human
gccuguguaaauugaguuucc

SEQ ID NO: 131548 - RNA, 22 nt, Human
cagucccacaagaucuccacaa

SEQ ID NO: 131549 - RNA, 22 nt, Human
cuuauuuaugucugucucuaau

SEQ ID NO: 131550 - RNA, 22 nt, Human
cuucuucauaggcaguccuguu

SEQ ID NO: 131551 - RNA, 22 nt, Human
gaaaggugccccauaggcagga

SEQ ID NO: 131552 - RNA, 22 nt, Human
ucaaguguaguggugucagguc

SEQ ID NO: 131553 - RNA, 22 nt, Human
gcugugagcacugcugggugga

SEQ ID NO: 131554 - RNA, 22 nt, Human
gagcuuccugaugccgaccagu

SEQ ID NO: 131555 - RNA, 22 nt, Human
ugcaagcacucaaugcaaacag

SEQ ID NO: 131556 - RNA, 19 nt, Human
uccccagcaccucugaguc

SEQ ID NO: 131557 - RNA, 22 nt, Human
agacccugcaccucucgugggc

SEQ ID NO: 131558 - RNA, 22 nt, Human
agggaauguagcaagaugccaa

SEQ ID NO: 131559 - RNA, 22 nt, Human
gaggccuggguuggaggugcau

SEQ ID NO: 131560 - RNA, 22 nt, Human
ucucuucuuguguuuuccugcc

SEQ ID NO: 131561 - RNA, 22 nt, Human
aguuuagaguucaaauuaguuc

SEQ ID NO: 131562 - RNA, 22 nt, Human
aagccagccagugccagucuua

SEQ ID NO: 131563 - RNA, 22 nt, Human
gacaggaggcagagcucaggug

SEQ ID NO: 131564 - RNA, 19 nt, Human
acuuucuccaggaccuguu

SEQ ID NO: 131565 - RNA, 22 nt, Human
ggagccuguuaguugagugcuc

SEQ ID NO: 131566 - RNA, 22 nt, Human
acugggaguucuccaugucccu

SEQ ID NO: 131567 - RNA, 22 nt, Human
ugcagaagauggucugagcacc

SEQ ID NO: 131568 - RNA, 22 nt, Human
ucuggagcaacagagcaggaca

SEQ ID NO: 131569 - RNA, 22 nt, Human
aggagucacucagggcuucauc

SEQ ID NO: 131570 - RNA, 22 nt, Human
aagggcagagggaaucccacau

SEQ ID NO: 131571 - RNA, 22 nt, Human
auguggcuuaguuaggugcccc

SEQ ID NO: 131572 - RNA, 22 nt, Human
auuugagaugguaaauaacuuu

SEQ ID NO: 131573 - RNA, 22 nt, Human
uuucuaaaugguggcugcauug

SEQ ID NO: 131574 - RNA, 22 nt, Human
augcugugccuucucugugcca

SEQ ID NO: 131575 - RNA, 22 nt, Human
ggcacugacugugcagcgcacc

SEQ ID NO: 131576 - RNA, 22 nt, Human
auaguauuuaauaguuagcuca

SEQ ID NO: 131577 - RNA, 21 nt, Human
ugcaggcaggcagagaugcug

SEQ ID NO: 131578 - RNA, 22 nt, Human
cagugcagaacacauggaaaau

SEQ ID NO: 131579 - RNA, 22 nt, Human
cagcuggcaaguggagcagggu

SEQ ID NO: 131580 - RNA, 22 nt, Human
gcacccaggccggcgacugcag

SEQ ID NO: 131581 - RNA, 22 nt, Human
uuuucugccugcguguuuagga

SEQ ID NO: 131582 - RNA, 21 nt, Human
acagcagacaggcuuaggacc

SEQ ID NO: 131583 - RNA, 22 nt, Human
augugugugugcgcgcgcagga

SEQ ID NO: 131584 - RNA, 22 nt, Human
agugaaaucagguuuugacugc

SEQ ID NO: 131585 - RNA, 22 nt, Human
uccagaggcuccaaagggagau

SEQ ID NO: 131586 - RNA, 17 nt, Human
ccuuucucuuucaucuc

SEQ ID NO: 131587 - RNA, 22 nt, Human
agaaaugcauuagcacauauag

SEQ ID NO: 131588 - RNA, 22 nt, Human
uggccucaagucugagggccuu

SEQ ID NO: 131589 - RNA, 22 nt, Human
uguaauggaagugggauugcau

SEQ ID NO: 131590 - RNA, 22 nt, Human
ucucaggaagugauauugagac

SEQ ID NO: 131591 - RNA, 22 nt, Human
ccugucugcaugagugagcaua

SEQ ID NO: 131592 - RNA, 22 nt, Human
gcaggggcuacucugagcuucc

SEQ ID NO: 131593 - RNA, 22 nt, Human
ccuucugcucccuggccagggc

SEQ ID NO: 131594 - RNA, 22 nt, Human
acauuguagacuuuucauaugu

SEQ ID NO: 131595 - RNA, 22 nt, Human
uagucaaaccucagaauacccc

SEQ ID NO: 131596 - RNA, 21 nt, Human
agaaaauggcguuuuagauuu

SEQ ID NO: 131597 - RNA, 22 nt, Human
guuuuuccugcugacuuggguc

SEQ ID NO: 131598 - RNA, 22 nt, Human
uggcucagaaggcugccuucac

SEQ ID NO: 131599 - RNA, 22 nt, Human
gcaagcugcuuaagcucauugu

SEQ ID NO: 131600 - RNA, 22 nt, Human
acucaggagggaucagcuauca

SEQ ID NO: 131601 - RNA, 22 nt, Human
uguggguguucucacuuagaua

SEQ ID NO: 131602 - RNA, 21 nt, Human
ggggcagagcuaggcccugca

SEQ ID NO: 131603 - RNA, 22 nt, Human
gccuggagggucccucucugga

SEQ ID NO: 131604 - RNA, 22 nt, Human
uuuagcagaucuauguauguga

SEQ ID NO: 131605 - RNA, 22 nt, Human
cucaaggaaagucuggagaaga

SEQ ID NO: 131606 - RNA, 22 nt, Human
aggacccugagcgggcaugccg

SEQ ID NO: 131607 - RNA, 22 nt, Human
ucagcagggcugugguguggcu

SEQ ID NO: 131608 - RNA, 22 nt, Human
acaggggauugauuggaagucu

SEQ ID NO: 131609 - RNA, 22 nt, Human
cagugcaguugguggcaggggu

SEQ ID NO: 131610 - RNA, 22 nt, Human
cauggcccucuucuggagcaau

SEQ ID NO: 131611 - RNA, 22 nt, Human
gaagcagcuggugagauggagc

SEQ ID NO: 131612 - RNA, 22 nt, Human
gggggcuguccugugcauugua

SEQ ID NO: 131613 - RNA, 22 nt, Human
cggcuggggcuguccccaugac

SEQ ID NO: 131614 - RNA, 22 nt, Human
uucaagaucgaguuuaaaguga

SEQ ID NO: 131615 - RNA, 22 nt, Human
cagcuggcguggagugauugca

SEQ ID NO: 131616 - RNA, 23 nt, Human
ggaaagagaggaguugugcauag

SEQ ID NO: 131617 - RNA, 22 nt, Human
agcugccagggacugggcaugg

SEQ ID NO: 131618 - RNA, 22 nt, Human
aggcucagagaugaguaagcac

SEQ ID NO: 131619 - RNA, 22 nt, Human
uagcagcucacagccucccauu

SEQ ID NO: 131620 - RNA, 22 nt, Human
agauguaguagugggucuuuua

SEQ ID NO: 131621 - RNA, 21 nt, Human
auacacauacacauaaaugug

SEQ ID NO: 131622 - RNA, 22 nt, Human
ucugcaggacugaggccuguuu

SEQ ID NO: 131623 - RNA, 22 nt, Human
accaaggaagaaucuauuugag

SEQ ID NO: 131624 - RNA, 22 nt, Human
ggcuguguuucuguuugacauu

SEQ ID NO: 131625 - RNA, 22 nt, Human
cugcccaguuugggagccuuuc

SEQ ID NO: 131626 - RNA, 22 nt, Human
caguguaucauuagugugauga

SEQ ID NO: 131627 - RNA, 20 nt, Human
agggucaguagcacagagcu

SEQ ID NO: 131628 - RNA, 22 nt, Human
cagcagggcccccgggugcgcc

SEQ ID NO: 131629 - RNA, 22 nt, Human
ucauucuccucuggaaaaggca

SEQ ID NO: 131630 - RNA, 22 nt, Human
ggccucugggguccugagccca

SEQ ID NO: 131631 - RNA, 22 nt, Human
agaagugccauacuguggucca

SEQ ID NO: 131632 - RNA, 22 nt, Human
ucucuucuagcuucuugugguu

SEQ ID NO: 131633 - RNA, 22 nt, Human
ggccucugguucacagggagga

SEQ ID NO: 131634 - RNA, 22 nt, Human
uggaggaugccuggggaggccu

SEQ ID NO: 131635 - RNA, 22 nt, Human
aguggcugagugacugugacuc

SEQ ID NO: 131636 - RNA, 22 nt, Human
ucaggcacugcuuucugauaug

SEQ ID NO: 131637 - RNA, 22 nt, Human
gaaaggagggaaacagagcggu

SEQ ID NO: 131638 - RNA, 22 nt, Human
acauuucuuugcuagacagcag

SEQ ID NO: 131639 - RNA, 22 nt, Human
auauguguauuugguuagccua

SEQ ID NO: 131640 - RNA, 22 nt, Human
ugcaccauacccauuccccucu

SEQ ID NO: 131641 - RNA, 22 nt, Human
cuugcuucauuagugucuuagu

SEQ ID NO: 131642 - RNA, 22 nt, Human
uagaaacucaggauacucuucc

SEQ ID NO: 131643 - RNA, 22 nt, Human
ccagguggaggugugagguccu

SEQ ID NO: 131644 - RNA, 22 nt, Human
caggaaagagcugccaggcagg

SEQ ID NO: 131645 - RNA, 22 nt, Human
ucuuuuauagugaauuuucuug

SEQ ID NO: 131646 - RNA, 22 nt, Human
guccuggggaauacagaagccg

SEQ ID NO: 131647 - RNA, 22 nt, Human
ugucucugccagcuagcagaau

SEQ ID NO: 131648 - RNA, 22 nt, Human
aaaguguaaaagcauguuaggg

SEQ ID NO: 131649 - RNA, 20 nt, Human
gaagcagcuucauguagaca

SEQ ID NO: 131650 - RNA, 22 nt, Human
cucaggauuaaggaaucuaaau

SEQ ID NO: 131651 - RNA, 22 nt, Human
uucuuugaguuaguacagucca

SEQ ID NO: 131652 - RNA, 22 nt, Human
ugucucaguucccuucucugga

SEQ ID NO: 131653 - RNA, 22 nt, Human
aaugaugguauugaugagcuaa

SEQ ID NO: 131654 - RNA, 19 nt, Human
uucacauuggaagaaguag

SEQ ID NO: 131655 - RNA, 22 nt, Human
caguggggaggccaggauagaa

SEQ ID NO: 131656 - RNA, 22 nt, Human
uggccguguuagauguuuggcu

SEQ ID NO: 131657 - RNA, 22 nt, Human
ucaggagauggucuuuauaggc

SEQ ID NO: 131658 - RNA, 23 nt, Human
aggcacugaaugugucagugagu

SEQ ID NO: 131659 - RNA, 22 nt, Human
ucuggcucaaaauacguacucu

SEQ ID NO: 131660 - RNA, 22 nt, Human
uccuuugacuucuugcagucca

SEQ ID NO: 131661 - RNA, 22 nt, Human
uggaguuccuuugaaaggcucu

SEQ ID NO: 131662 - RNA, 22 nt, Human
ccagggugagugucauggguua

SEQ ID NO: 131663 - RNA, 22 nt, Human
cacaggugcuccucggggagcu

SEQ ID NO: 131664 - RNA, 21 nt, Human
gcaaauguucaggaaaaaaga

SEQ ID NO: 131665 - RNA, 22 nt, Human
ugagacaguucugcagcugggu

SEQ ID NO: 131666 - RNA, 22 nt, Human
gaaggagcuaaagggagcccug

SEQ ID NO: 131667 - RNA, 22 nt, Human
gagggcugaagauuguggcccc

SEQ ID NO: 131668 - RNA, 18 nt, Human
acagcagguuucauucuu

SEQ ID NO: 131669 - RNA, 22 nt, Human
auaucaaacgaaguuauuuuaa

SEQ ID NO: 131670 - RNA, 22 nt, Human
ucccagagcaguacuccaggag

SEQ ID NO: 131671 - RNA, 22 nt, Human
ucccaguguggcaggccaugga

SEQ ID NO: 131672 - RNA, 22 nt, Human
cuguggaaggccuguccugaaa

SEQ ID NO: 131673 - RNA, 22 nt, Human
ugcgauguaugcaguauuuguu

SEQ ID NO: 131674 - RNA, 22 nt, Human
cagggugccuguccucagcaaa

SEQ ID NO: 131675 - RNA, 22 nt, Human
auucucuggucauugagcauau

SEQ ID NO: 131676 - RNA, 22 nt, Human
aucauuucccuuuagaucacaa

SEQ ID NO: 131677 - RNA, 22 nt, Human
gcuuccuggagggagagagcug

SEQ ID NO: 131678 - RNA, 22 nt, Human
uuuccucuaaacgcauuugcuu

SEQ ID NO: 131679 - RNA, 22 nt, Human
agucuccuuggccucaaugccu

SEQ ID NO: 131680 - RNA, 22 nt, Human
cagaaggcuggcagauugagau

SEQ ID NO: 131681 - RNA, 22 nt, Human
augcagcaguuuacaaagcaau

SEQ ID NO: 131682 - RNA, 22 nt, Human
uggcugcuuguuuuagugaggc

SEQ ID NO: 131683 - RNA, 22 nt, Human
ccuggcagcauugguagagauu

SEQ ID NO: 131684 - RNA, 22 nt, Human
uggcugaauaaaauaugguguu

SEQ ID NO: 131685 - RNA, 22 nt, Human
uagaucugauacaauucaucug

SEQ ID NO: 131686 - RNA, 22 nt, Human
gggcugcuuuuaagggucucag

SEQ ID NO: 131687 - RNA, 22 nt, Human
ggcuucuguccucuggaucugu

SEQ ID NO: 131688 - RNA, 22 nt, Human
aagagcuggauugugcugcaga

SEQ ID NO: 131689 - RNA, 22 nt, Human
ucaucaaagucaaagaaugacu

SEQ ID NO: 131690 - RNA, 22 nt, Human
caguacuuugcaucauuccacu

SEQ ID NO: 131691 - RNA, 22 nt, Human
agcugccuguccuaggccauca

SEQ ID NO: 131692 - RNA, 20 nt, Human
ucuguguuucagcugcuuga

SEQ ID NO: 131693 - RNA, 18 nt, Human
uggagccagcucuaggau

SEQ ID NO: 131694 - RNA, 22 nt, Human
agggugcagaaggagccuagga

SEQ ID NO: 131695 - RNA, 22 nt, Human
uaucuuugcaaauaucucuaag

SEQ ID NO: 131696 - RNA, 19 nt, Human
ggucucagugcagcugcag

SEQ ID NO: 131697 - RNA, 22 nt, Human
uggaaagaugaagauguuuaag

SEQ ID NO: 131698 - RNA, 22 nt, Human
ucuuuacaagucacauuuucug

SEQ ID NO: 131699 - RNA, 22 nt, Human
gaggcaggcccugaaugaguca

SEQ ID NO: 131700 - RNA, 23 nt, Human
uuucuucagaagccuugcgaggc

SEQ ID NO: 131701 - RNA, 22 nt, Human
ucuucauuccguagauauuuau

SEQ ID NO: 131702 - RNA, 22 nt, Human
cuacuucugugaugaaacuaca

SEQ ID NO: 131703 - RNA, 22 nt, Human
guuuuuauuguguaaauguggg

SEQ ID NO: 131704 - RNA, 22 nt, Human
uuacaguagcuuuauuuggagu

SEQ ID NO: 131705 - RNA, 22 nt, Human
uggggugguaauacaccguucu

SEQ ID NO: 131706 - RNA, 22 nt, Human
uucaagucaaggaaagaggucu

SEQ ID NO: 131707 - RNA, 22 nt, Human
uccagccaccaccuugauugcc

SEQ ID NO: 131708 - RNA, 22 nt, Human
ugcuggaggaguuuacuguggc

SEQ ID NO: 131709 - RNA, 22 nt, Human
acuucuugggacccuggcaccg

SEQ ID NO: 131710 - RNA, 22 nt, Human
uggagcugacucacaccagcua

SEQ ID NO: 131711 - RNA, 22 nt, Human
gauuuccuagacauggggcaga

SEQ ID NO: 131712 - RNA, 22 nt, Human
ugcucacagcccagaacauaau

SEQ ID NO: 131713 - RNA, 20 nt, Human
auguuucucugucgugauuu

SEQ ID NO: 131714 - RNA, 22 nt, Human
auuucccaugugaaucaauugg

SEQ ID NO: 131715 - RNA, 22 nt, Human
ccugagguggcugcagcacugc

SEQ ID NO: 131716 - RNA, 22 nt, Human
caggccagugugcuucccaggc

SEQ ID NO: 131717 - RNA, 23 nt, Human
cagguggcuccacgagggguggg

SEQ ID NO: 131718 - RNA, 22 nt, Human
uuucacaaaugucuuuaacuug

SEQ ID NO: 131719 - RNA, 22 nt, Human
ugcccuguuaucuuggaagagu

SEQ ID NO: 131720 - RNA, 22 nt, Human
agggccagcacuccuggcagga

SEQ ID NO: 131721 - RNA, 17 nt, Human
uuguguguaguucugau

SEQ ID NO: 131722 - RNA, 22 nt, Human
cagagcugcgcuuuuuccuggu

SEQ ID NO: 131723 - RNA, 22 nt, Human
ugugacagaucuuuaaauaaug

SEQ ID NO: 131724 - RNA, 22 nt, Human
uucacaggugacuggggauaac

SEQ ID NO: 131725 - RNA, 19 nt, Human
ugaggccaaggucacagau

SEQ ID NO: 131726 - RNA, 22 nt, Human
ucuuuauuuaagucuguuguaa

SEQ ID NO: 131727 - RNA, 22 nt, Human
caguuuuuagauuaguuggugg

SEQ ID NO: 131728 - RNA, 22 nt, Human
ugcaugcagcuggugauaagaa

SEQ ID NO: 131729 - RNA, 22 nt, Human
auauuuuccgaacuugagguag

SEQ ID NO: 131730 - RNA, 18 nt, Human
cgauguguaugugauuug

SEQ ID NO: 131731 - RNA, 22 nt, Human
agggucugacuccucuggcaag

SEQ ID NO: 131732 - RNA, 22 nt, Human
ugggauggagccugaguauagu

SEQ ID NO: 131733 - RNA, 20 nt, Human
uccuggccuucucgggcagu

SEQ ID NO: 131734 - RNA, 22 nt, Human
gcugagguggcugccuuaguaa

SEQ ID NO: 131735 - RNA, 22 nt, Human
gcuggaccaggugugcacaggc

SEQ ID NO: 131736 - RNA, 22 nt, Human
aaaugugcuugugaucagcugu

SEQ ID NO: 131737 - RNA, 22 nt, Human
gagaaagauguaggcugggagg

SEQ ID NO: 131738 - RNA, 22 nt, Human
cuggugcaggaaggagcuggca

SEQ ID NO: 131739 - RNA, 22 nt, Human
ccaggccuggccaggggaugcc

SEQ ID NO: 131740 - RNA, 22 nt, Human
guguguggcauguccuauuuug

SEQ ID NO: 131741 - RNA, 22 nt, Human
cuguggcugaacucugaagagg

SEQ ID NO: 131742 - RNA, 22 nt, Human
cucucugaggcaggccuguggg

SEQ ID NO: 131743 - RNA, 22 nt, Human
ugggcugcugagaaugagagag

SEQ ID NO: 131744 - RNA, 22 nt, Human
agggccuggcuucacuuucuca

SEQ ID NO: 131745 - RNA, 20 nt, Human
aggcucagcugagcucuugg

SEQ ID NO: 131746 - RNA, 22 nt, Human
caggggacauuaaagcuccaua

SEQ ID NO: 131747 - RNA, 22 nt, Human
uuggagcccugaggaucuggau

SEQ ID NO: 131748 - RNA, 22 nt, Human
cucugugugguccucuguauug

SEQ ID NO: 131749 - RNA, 22 nt, Human
agcugccaaguuucucaguuua

SEQ ID NO: 131750 - RNA, 22 nt, Human
guucauuuaugauguaacaugu

SEQ ID NO: 131751 - RNA, 22 nt, Human
uucauucuuugaaucugaggua

SEQ ID NO: 131752 - RNA, 22 nt, Human
ugggugugaagucuguuggccu

SEQ ID NO: 131753 - RNA, 19 nt, Human
uaaaaugucuguggucagu

SEQ ID NO: 131754 - RNA, 22 nt, Human
ggcugccuggaccuccucuuuc

SEQ ID NO: 131755 - RNA, 22 nt, Human
gcagcugcuguggcaucaagcu

SEQ ID NO: 131756 - RNA, 22 nt, Human
aaaucagucccucuuggaauuu

SEQ ID NO: 131757 - RNA, 22 nt, Human
agcagccagaaauccagaggug

SEQ ID NO: 131758 - RNA, 23 nt, Human
ugaugggaaggaacgacuaccac

SEQ ID NO: 131759 - RNA, 22 nt, Human
ucccagagauuuccucuccuuc

SEQ ID NO: 131760 - RNA, 22 nt, Human
guaagagcacugucuccugcug

SEQ ID NO: 131761 - RNA, 23 nt, Human
ucguugaauagcaauagcacaac

SEQ ID NO: 131762 - RNA, 22 nt, Human
auguuauuuuggaaaauacaaa

SEQ ID NO: 131763 - RNA, 22 nt, Human
agcaggaguuugaugcuuuuau

SEQ ID NO: 131764 - RNA, 22 nt, Human
ucaguguaaguuauguagaugu

SEQ ID NO: 131765 - RNA, 22 nt, Human
guaagggauuugaacauagguu

SEQ ID NO: 131766 - RNA, 22 nt, Human
cucuguccuaugcuugauagaa

SEQ ID NO: 131767 - RNA, 22 nt, Human
gaaauguguuguucauuucuaa

SEQ ID NO: 131768 - RNA, 22 nt, Human
agcugggaggugggcagugaga

SEQ ID NO: 131769 - RNA, 22 nt, Human
cugcucuguuucuuagcugggu

SEQ ID NO: 131770 - RNA, 22 nt, Human
agccuccuggaguuucugggau

SEQ ID NO: 131771 - RNA, 22 nt, Human
gcagggcucaacaggacacccc

SEQ ID NO: 131772 - RNA, 22 nt, Human
ggccaccuuccaguugccugca

SEQ ID NO: 131773 - RNA, 22 nt, Human
cugcagugaaaucaggaagcaa

SEQ ID NO: 131774 - RNA, 22 nt, Human
uuauuuugccacaggugaccuu

SEQ ID NO: 131775 - RNA, 22 nt, Human
cacaugggugugccuggaggaa

SEQ ID NO: 131776 - RNA, 22 nt, Human
ccagcuccagguagaugggcag

SEQ ID NO: 131777 - RNA, 22 nt, Human
ugggcagaguugugaugaacug

SEQ ID NO: 131778 - RNA, 22 nt, Human
gcugccuggagcucagccugcc

SEQ ID NO: 131779 - RNA, 22 nt, Human
aaugcaguuucauuuguagaau

SEQ ID NO: 131780 - RNA, 22 nt, Human
cgccugggaguccacaccugcu

SEQ ID NO: 131781 - RNA, 21 nt, Human
aaagagguuaauauuguaagu

SEQ ID NO: 131782 - RNA, 22 nt, Human
caggauauuaguuuucuuguua

SEQ ID NO: 131783 - RNA, 22 nt, Human
ucauuugugugagugauuugac

SEQ ID NO: 131784 - RNA, 22 nt, Human
ugcaggagaaaguacggagcgu

SEQ ID NO: 131785 - RNA, 22 nt, Human
ggcagucagugugguucauaaa

SEQ ID NO: 131786 - RNA, 22 nt, Human
cuacauuuggagaguauaggaa

SEQ ID NO: 131787 - RNA, 20 nt, Human
gcucccugguagaaauguuu

SEQ ID NO: 131788 - RNA, 22 nt, Human
guguaaggccccagguucuuua

SEQ ID NO: 131789 - RNA, 22 nt, Human
uauucaaaguaccuucauugcc

SEQ ID NO: 131790 - RNA, 22 nt, Human
ucccagauuguugauggcuuaa

SEQ ID NO: 131791 - RNA, 22 nt, Human
ugccuggauucgguuguuguca

SEQ ID NO: 131792 - RNA, 22 nt, Human
uuuuucagccaugaauuacacu

SEQ ID NO: 131793 - RNA, 22 nt, Human
gggugcaggcagcccaggcagg

SEQ ID NO: 131794 - RNA, 22 nt, Human
uguacauuuagagcucaauaga

SEQ ID NO: 131795 - RNA, 22 nt, Human
uaaggcacacaguugcugcaug

SEQ ID NO: 131796 - RNA, 17 nt, Human
cucacggaggaugaauc

SEQ ID NO: 131797 - RNA, 22 nt, Human
auucuucauguugaagcuguca

SEQ ID NO: 131798 - RNA, 22 nt, Human
uggcugucagcugccuggugcg

SEQ ID NO: 131799 - RNA, 22 nt, Human
uguacaguauugguguuaguag

SEQ ID NO: 131800 - RNA, 22 nt, Human
ucacagacacagggagaagcau

SEQ ID NO: 131801 - RNA, 22 nt, Human
acucugccaucccaggugcugu

SEQ ID NO: 131802 - RNA, 22 nt, Human
uacauauacugagugauuugcu

SEQ ID NO: 131803 - RNA, 22 nt, Human
caguguacuuggaauguaacag

SEQ ID NO: 131804 - RNA, 22 nt, Human
gcccucuggcagccuuggcugg

SEQ ID NO: 131805 - RNA, 22 nt, Human
uacuaaauaguuuaauuccuca

SEQ ID NO: 131806 - RNA, 20 nt, Human
uugcauuggaugugcaggug

SEQ ID NO: 131807 - RNA, 22 nt, Human
ucucaucugccauuugcaggag

SEQ ID NO: 131808 - RNA, 22 nt, Human
uacuuugucauucuaaccuucc

SEQ ID NO: 131809 - RNA, 20 nt, Human
ugcuuccuggccacugcggg

SEQ ID NO: 131810 - RNA, 22 nt, Human
cugggcugcaguuccugguccu

SEQ ID NO: 131811 - RNA, 22 nt, Human
caggcagcugcuggguucagcc

SEQ ID NO: 131812 - RNA, 22 nt, Human
cuggcuccauccuugagcucug

SEQ ID NO: 131813 - RNA, 19 nt, Human
acacagggcuagaguuaca

SEQ ID NO: 131814 - RNA, 22 nt, Human
cagggcuggcucaugaaaaguu

SEQ ID NO: 131815 - RNA, 22 nt, Human
ucuguagcaagugagaggcauu

SEQ ID NO: 131816 - RNA, 22 nt, Human
cguguaugauaaauguuaauaa

SEQ ID NO: 131817 - RNA, 22 nt, Human
uguguguuggcuggagagggcu

SEQ ID NO: 131818 - RNA, 23 nt, Human
uggccucuccccaccuggcagaa

SEQ ID NO: 131819 - RNA, 22 nt, Human
ucugagagucucugaggcagau

SEQ ID NO: 131820 - RNA, 22 nt, Human
aauacaaucaaauucacuagca

SEQ ID NO: 131821 - RNA, 22 nt, Human
ugucaccaguuccaggaaauaa

SEQ ID NO: 131822 - RNA, 22 nt, Human
cccaggcugauguucagcgggu

SEQ ID NO: 131823 - RNA, 22 nt, Human
cagggccagccauccugcuggg

SEQ ID NO: 131824 - RNA, 22 nt, Human
uacaguuacuguuauaugugcu

SEQ ID NO: 131825 - RNA, 22 nt, Human
ggugccaggcuguagucagggu

SEQ ID NO: 131826 - RNA, 20 nt, Human
ggcugugcccuuccguggcc

SEQ ID NO: 131827 - RNA, 22 nt, Human
augauacaagcaaaacuaauca

SEQ ID NO: 131828 - RNA, 22 nt, Human
cacaaaaguaggaggcaggcgg

SEQ ID NO: 131829 - RNA, 19 nt, Human
ucauaaggagagaggaaau

SEQ ID NO: 131830 - RNA, 22 nt, Human
ucucaagcuuguugguauguuu

SEQ ID NO: 131831 - RNA, 22 nt, Human
uuagccauggacugaauugacu

SEQ ID NO: 131832 - RNA, 22 nt, Human
uuacuuuccagcucuagcuuca

SEQ ID NO: 131833 - RNA, 22 nt, Human
uuucucucuacaguacuuucau

SEQ ID NO: 131834 - RNA, 22 nt, Human
uauguggccauucuguuugugu

SEQ ID NO: 131835 - RNA, 22 nt, Human
guggaggacaaaagaagccuuu

SEQ ID NO: 131836 - RNA, 22 nt, Human
ggagagugggagcaacuguugc

SEQ ID NO: 131837 - RNA, 22 nt, Human
agugaaaugauucugagcaaga

SEQ ID NO: 131838 - RNA, 22 nt, Human
uaagaacauuuucggaaagaua

SEQ ID NO: 131839 - RNA, 22 nt, Human
gccugaugagcuuccagcugag

SEQ ID NO: 131840 - RNA, 22 nt, Human
ccuggaugauccaugucaugga

SEQ ID NO: 131841 - RNA, 19 nt, Human
ugucacugucauggcccag

SEQ ID NO: 131842 - RNA, 20 nt, Human
uuucuugucggcuguugcug

SEQ ID NO: 131843 - RNA, 22 nt, Human
augcaguaaauguuaagaaaaa

SEQ ID NO: 131844 - RNA, 23 nt, Human
aggaggccugaaacugaggcuga

SEQ ID NO: 131845 - RNA, 22 nt, Human
gugcaugcaguaaguguuuuaa

SEQ ID NO: 131846 - RNA, 22 nt, Human
cagcagugaugugugaggguuc

SEQ ID NO: 131847 - RNA, 22 nt, Human
auugaaagagaauguagcucuu

SEQ ID NO: 131848 - RNA, 22 nt, Human
aacuuucuuggaugucucaaca

SEQ ID NO: 131849 - RNA, 22 nt, Human
ucagagagugcaaaauauagcu

SEQ ID NO: 131850 - RNA, 22 nt, Human
gggcugcugccaccagguggau

SEQ ID NO: 131851 - RNA, 22 nt, Human
ucauuuguggaagugauugugg

SEQ ID NO: 131852 - RNA, 21 nt, Human
uuagcuuucuagaaucuuugu

SEQ ID NO: 131853 - RNA, 23 nt, Human
uuugacagcgugguuucuguggg

SEQ ID NO: 131854 - RNA, 22 nt, Human
cagguggggcagcugugggagc

SEQ ID NO: 131855 - RNA, 22 nt, Human
ugcacagagagaugagacacgu

SEQ ID NO: 131856 - RNA, 22 nt, Human
aguaucaaggaucuccagcacc

SEQ ID NO: 131857 - RNA, 22 nt, Human
aagaacauguuaaaagauucac

SEQ ID NO: 131858 - RNA, 22 nt, Human
ugggcuggagcuuguugcuucc

SEQ ID NO: 131859 - RNA, 22 nt, Human
uggccugacugucaggcuguau

SEQ ID NO: 131860 - RNA, 22 nt, Human
uggguagaggaauugggcuacc

SEQ ID NO: 131861 - RNA, 22 nt, Human
ucuucucuccugcuuggcagaa

SEQ ID NO: 131862 - RNA, 22 nt, Human
uaagacaugguugaucuagugu

SEQ ID NO: 131863 - RNA, 22 nt, Human
aggccuguuccaggccccuuuu

SEQ ID NO: 131864 - RNA, 22 nt, Human
ucuggaaguuagaggaggaaag

SEQ ID NO: 131865 - RNA, 22 nt, Human
agaggcuccuucacucuggcac

SEQ ID NO: 131866 - RNA, 22 nt, Human
gagcagcuuaugucaagccaga

SEQ ID NO: 131867 - RNA, 22 nt, Human
aagauuuaccacuuuauucaag

SEQ ID NO: 131868 - RNA, 22 nt, Human
ccucagggaaugggaggcuggg

SEQ ID NO: 131869 - RNA, 22 nt, Human
aguggcagaagucacuggguag

SEQ ID NO: 131870 - RNA, 22 nt, Human
ggcugcagggcagcuggugugg

SEQ ID NO: 131871 - RNA, 22 nt, Human
agccuggauccauguggcuacc

SEQ ID NO: 131872 - RNA, 22 nt, Human
gauuucaaggaguuuucacagu

SEQ ID NO: 131873 - RNA, 22 nt, Human
gccuggagcucggcugagggcg

SEQ ID NO: 131874 - RNA, 21 nt, Human
aggagggcacaaggccaggaa

SEQ ID NO: 131875 - RNA, 22 nt, Human
cauucacucagcgaugccagua

SEQ ID NO: 131876 - RNA, 22 nt, Human
gcaggggcaggagaucucaggc

SEQ ID NO: 131877 - RNA, 23 nt, Human
gccucugcucugcguuggggacu

SEQ ID NO: 131878 - RNA, 22 nt, Human
ucugccugagggagcugaggaa

SEQ ID NO: 131879 - RNA, 22 nt, Human
aagaaauguagagccuaguaaa

SEQ ID NO: 131880 - RNA, 22 nt, Human
ucaggauccauagacucccaaa

SEQ ID NO: 131881 - RNA, 22 nt, Human
ucuggagcuuccucauuuacag

SEQ ID NO: 131882 - RNA, 22 nt, Human
uucaagaugacccagucacacg

SEQ ID NO: 131883 - RNA, 22 nt, Human
cacuggggugggccugguagag

SEQ ID NO: 131884 - RNA, 22 nt, Human
guuugcauuucuugaacuauau

SEQ ID NO: 131885 - RNA, 22 nt, Human
agucccagugagaugagccacg

SEQ ID NO: 131886 - RNA, 22 nt, Human
ggccugcuccgggggcugagcu

SEQ ID NO: 131887 - RNA, 22 nt, Human
aagguacagaaauuaacaagga

SEQ ID NO: 131888 - RNA, 22 nt, Human
uagcugccuagacagcuauagc

SEQ ID NO: 131889 - RNA, 18 nt, Human
cugcugcaggcacucagg

SEQ ID NO: 131890 - RNA, 20 nt, Human
cuguagggugcagcaggcuc

SEQ ID NO: 131891 - RNA, 22 nt, Human
ucugcagcuugcacaggcaggc

SEQ ID NO: 131892 - RNA, 22 nt, Human
agcaccugcuaugugucaggga

SEQ ID NO: 131893 - RNA, 22 nt, Human
gucccagagagcacuaguccau

SEQ ID NO: 131894 - RNA, 22 nt, Human
aagaacagauucagccugaacu

SEQ ID NO: 131895 - RNA, 22 nt, Human
agcuguucccucacugcaguca

SEQ ID NO: 131896 - RNA, 22 nt, Human
cagccaucaguaaagacagcuu

SEQ ID NO: 131897 - RNA, 22 nt, Human
ucagggugaaccaggcaggaau

SEQ ID NO: 131898 - RNA, 22 nt, Human
agccacagggggugagggacaa

SEQ ID NO: 131899 - RNA, 22 nt, Human
cgggcagaucacacagggcuug

SEQ ID NO: 131900 - RNA, 22 nt, Human
aggcugccucgugagcucgcug

SEQ ID NO: 131901 - RNA, 23 nt, Human
uugacaguaggugguuuucauug

SEQ ID NO: 131902 - RNA, 22 nt, Human
aaugcacaugucuuggccucac

SEQ ID NO: 131903 - RNA, 22 nt, Human
ucucaggguuuccugggggcug

SEQ ID NO: 131904 - RNA, 22 nt, Human
uguguuauugccacugaagacc

SEQ ID NO: 131905 - RNA, 22 nt, Human
uggcacugagcagccgcggcag

SEQ ID NO: 131906 - RNA, 22 nt, Human
uggaggagggcuggugucugua

SEQ ID NO: 131907 - RNA, 22 nt, Human
uugacuuuauguguauguuuac

SEQ ID NO: 131908 - RNA, 22 nt, Human
uuuagaaguucacacauuuaaa

SEQ ID NO: 131909 - RNA, 22 nt, Human
uggcucagaugcucuuccagug

SEQ ID NO: 131910 - RNA, 17 nt, Human
uccuggcucugccacug

SEQ ID NO: 131911 - RNA, 22 nt, Human
gagaggcugaaaucacaggagc

SEQ ID NO: 131912 - RNA, 22 nt, Human
ugucaguguauacauacaguau

SEQ ID NO: 131913 - RNA, 22 nt, Human
cagggguggcugcagcagaggu

SEQ ID NO: 131914 - RNA, 22 nt, Human
aaugcacagcuaaagugguucc

SEQ ID NO: 131915 - RNA, 22 nt, Human
uguguuugggggagaugcauuu

SEQ ID NO: 131916 - RNA, 22 nt, Human
cugugcuggagaugggccagag

SEQ ID NO: 131917 - RNA, 22 nt, Human
aggcagccagauggcagccugc

SEQ ID NO: 131918 - RNA, 22 nt, Human
auguucuuucagccagugcauc

SEQ ID NO: 131919 - RNA, 22 nt, Human
cacaggcuugucagcaugaggc

SEQ ID NO: 131920 - RNA, 22 nt, Human
cuacaguacuggaugcucagcc

SEQ ID NO: 131921 - RNA, 22 nt, Human
agaaaugugagccccuuaucaa

SEQ ID NO: 131922 - RNA, 20 nt, Human
ugugugaauuagggcauguu

SEQ ID NO: 131923 - RNA, 22 nt, Human
uguccugcaacugaaggagaag

SEQ ID NO: 131924 - RNA, 22 nt, Human
cacagacccagaagggaugaag

SEQ ID NO: 131925 - RNA, 22 nt, Human
acaguguccuuguggucccugu

SEQ ID NO: 131926 - RNA, 20 nt, Human
cugagcgucuaagaggugag

SEQ ID NO: 131927 - RNA, 22 nt, Human
cauuuguuaauuacuauuaucu

SEQ ID NO: 131928 - RNA, 22 nt, Human
agcagggcuucugugccugugc

SEQ ID NO: 131929 - RNA, 22 nt, Human
ugugggcaggcccgggucugag

SEQ ID NO: 131930 - RNA, 22 nt, Human
agauguguuucuaguuccugca

SEQ ID NO: 131931 - RNA, 22 nt, Human
ugaaccagagucuccagugguu

SEQ ID NO: 131932 - RNA, 22 nt, Human
cagcaguguggaagcugagggg

SEQ ID NO: 131933 - RNA, 22 nt, Human
cucucucuucuuuguaggggcc

SEQ ID NO: 131934 - RNA, 22 nt, Human
aaagccuucaaguagauguaag

SEQ ID NO: 131935 - RNA, 17 nt, Human
gaaagguccuagaaauc

SEQ ID NO: 131936 - RNA, 22 nt, Human
cuggcccagucucagaguguca

SEQ ID NO: 131937 - RNA, 22 nt, Human
uguuuauaccuugguauaacca

SEQ ID NO: 131938 - RNA, 22 nt, Human
gaaaucugcggugaggccugag

SEQ ID NO: 131939 - RNA, 22 nt, Human
accuugaugccuuuccaagaug

SEQ ID NO: 131940 - RNA, 20 nt, Human
gagauggcuaagugcugaac

SEQ ID NO: 131941 - RNA, 22 nt, Human
aggcacaggccucagcacccag

SEQ ID NO: 131942 - RNA, 22 nt, Human
auuuaaauuuucugauggagag

SEQ ID NO: 131943 - RNA, 23 nt, Human
gccuucagcucgggaaggcuccc

SEQ ID NO: 131944 - RNA, 22 nt, Human
cuugcacacauguacaugugua

SEQ ID NO: 131945 - RNA, 22 nt, Human
ccuggcagguggagguugcagu

SEQ ID NO: 131946 - RNA, 22 nt, Human
uuccuguauuuugcgaauuuuc

SEQ ID NO: 131947 - RNA, 22 nt, Human
cucagcccagcccaggaccagg

SEQ ID NO: 131948 - RNA, 22 nt, Human
ucucagagaacaguuggugcuu

SEQ ID NO: 131949 - RNA, 22 nt, Human
uauucacaaaaugagguccuca

SEQ ID NO: 131950 - RNA, 22 nt, Human
aacaaaugaccugauuucuucc

SEQ ID NO: 131951 - RNA, 22 nt, Human
auguuacagaaagcaaagauga

SEQ ID NO: 131952 - RNA, 22 nt, Human
ugcuguggcaguuuauguauag

SEQ ID NO: 131953 - RNA, 22 nt, Human
cucaccacagagccuguccagc

SEQ ID NO: 131954 - RNA, 22 nt, Human
ugagaguauuuuggcauuauca

SEQ ID NO: 131955 - RNA, 22 nt, Human
ugcaggcuguaaucugaggcua

SEQ ID NO: 131956 - RNA, 22 nt, Human
ucagaaaugaucguuauucauu

SEQ ID NO: 131957 - RNA, 22 nt, Human
uacauuuauaaggcuucucugu

SEQ ID NO: 131958 - RNA, 22 nt, Human
gcagccugaugaucuggguugu

SEQ ID NO: 131959 - RNA, 22 nt, Human
uccaugaguuugaggaaaagag

SEQ ID NO: 131960 - RNA, 22 nt, Human
ucagggacuuacaaaccagaag

SEQ ID NO: 131961 - RNA, 22 nt, Human
acccagagccagggucaggagc

SEQ ID NO: 131962 - RNA, 22 nt, Human
ugcguugcgcuccugcagcagg

SEQ ID NO: 131963 - RNA, 22 nt, Human
ggcugcagguugguuggcagcu

SEQ ID NO: 131964 - RNA, 22 nt, Human
aagauuauuuaagacaggaacc

SEQ ID NO: 131965 - RNA, 22 nt, Human
ccaggaggcagaaguugcagug

SEQ ID NO: 131966 - RNA, 22 nt, Human
aguuauauuccauagauucaga

SEQ ID NO: 131967 - RNA, 17 nt, Human
uggacccuugggccucc

SEQ ID NO: 131968 - RNA, 22 nt, Human
auggcugugcagagauugggaa

SEQ ID NO: 131969 - RNA, 22 nt, Human
cugugaggcccugggugcugga

SEQ ID NO: 131970 - RNA, 22 nt, Human
agcugugugguuugggcaaauu

SEQ ID NO: 131971 - RNA, 19 nt, Human
caauauauagugaguggau

SEQ ID NO: 131972 - RNA, 22 nt, Human
agggaugguggagguugcaagu

SEQ ID NO: 131973 - RNA, 22 nt, Human
gccuggcacauugcaguggauu

SEQ ID NO: 131974 - RNA, 23 nt, Human
ugcagagggacugaagccagcuu

SEQ ID NO: 131975 - RNA, 20 nt, Human
ggcugcugugggcagagagg

SEQ ID NO: 131976 - RNA, 22 nt, Human
gcucucuuucacagagguagga

SEQ ID NO: 131977 - RNA, 17 nt, Human
agccccucagcgucacc

SEQ ID NO: 131978 - RNA, 22 nt, Human
ggggacugccuuccacagacac

SEQ ID NO: 131979 - RNA, 22 nt, Human
aaggucauggcaaauuacuuuu

SEQ ID NO: 131980 - RNA, 22 nt, Human
gucugagaaucuugcauaucau

SEQ ID NO: 131981 - RNA, 22 nt, Human
ugccugggggacuaaggccaaa

SEQ ID NO: 131982 - RNA, 22 nt, Human
aggccagaaaugucagggagug

SEQ ID NO: 131983 - RNA, 22 nt, Human
accgaaggaaacuggaaccguu

SEQ ID NO: 131984 - RNA, 22 nt, Human
gcugccugcucggcuccuggga

SEQ ID NO: 131985 - RNA, 20 nt, Human
gccuguccugagugucaugg

SEQ ID NO: 131986 - RNA, 22 nt, Human
cuacaguagaguaggccucuga

SEQ ID NO: 131987 - RNA, 22 nt, Human
uugggugcugucauggggcacg

SEQ ID NO: 131988 - RNA, 19 nt, Human
caggagagcaugcacuuug

SEQ ID NO: 131989 - RNA, 22 nt, Human
accaggaggccuggagcacaaa

SEQ ID NO: 131990 - RNA, 22 nt, Human
cccucugccucugaguaggaca

SEQ ID NO: 131991 - RNA, 22 nt, Human
cuucugugaaugaaguguggga

SEQ ID NO: 131992 - RNA, 22 nt, Human
uauuuccaaaagccuauuauga

SEQ ID NO: 131993 - RNA, 17 nt, Human
acucaggaucugggagu

SEQ ID NO: 131994 - RNA, 22 nt, Human
aguguggcaggaaugacuagaa

SEQ ID NO: 131995 - RNA, 22 nt, Human
uuuggcugagaaguugugcuuu

SEQ ID NO: 131996 - RNA, 20 nt, Human
agcuggagaagggcccuucc

SEQ ID NO: 131997 - RNA, 17 nt, Human
gccuggcccagccuggc

SEQ ID NO: 131998 - RNA, 22 nt, Human
ggcuguguccccaccugagcag

SEQ ID NO: 131999 - RNA, 22 nt, Human
gccacagggcagaugcgcagag

SEQ ID NO: 132000 - RNA, 22 nt, Human
aaggagcuuguucgccuuccuc

SEQ ID NO: 132001 - RNA, 22 nt, Human
uccuugaauccuagcauccuau

SEQ ID NO: 132002 - RNA, 22 nt, Human
aggcacugguccauuuucugca

SEQ ID NO: 132003 - RNA, 22 nt, Human
uugaaucauuacaauagauaag

SEQ ID NO: 132004 - RNA, 22 nt, Human
cuuaaagaugucaaggcuguuu

SEQ ID NO: 132005 - RNA, 22 nt, Human
uauuucuugaguggucaguuuc

SEQ ID NO: 132006 - RNA, 22 nt, Human
uauaauuuuucuguggccaguu

SEQ ID NO: 132007 - RNA, 22 nt, Human
ugcuccuuccucauccugugca

SEQ ID NO: 132008 - RNA, 22 nt, Human
ucuguguccugcuagcugucuu

SEQ ID NO: 132009 - RNA, 22 nt, Human
acauuucuaucauccuguaaug

SEQ ID NO: 132010 - RNA, 22 nt, Human
agaagucauuuauguuagauga

SEQ ID NO: 132011 - RNA, 22 nt, Human
gagucacauuaauuuaauuuua

SEQ ID NO: 132012 - RNA, 22 nt, Human
uuuauuauguacaggcacuaua

SEQ ID NO: 132013 - RNA, 22 nt, Human
guggccuggaugagcuucgaca

SEQ ID NO: 132014 - RNA, 22 nt, Human
cuuggcagauccaaaaaugaca

SEQ ID NO: 132015 - RNA, 22 nt, Human
ccccagccagcaggaccucuga

SEQ ID NO: 132016 - RNA, 20 nt, Human
uuccagagaucugcauuuua

SEQ ID NO: 132017 - RNA, 20 nt, Human
cagagcuguuauggaugaug

SEQ ID NO: 132018 - RNA, 22 nt, Human
caaaggagguaaugggugugag

SEQ ID NO: 132019 - RNA, 22 nt, Human
guaacagaaagucaugcucauu

SEQ ID NO: 132020 - RNA, 22 nt, Human
gaggccuguagucauggaugua

SEQ ID NO: 132021 - RNA, 22 nt, Human
cacaggagguuaggaagugguc

SEQ ID NO: 132022 - RNA, 22 nt, Human
gagcugagccuggguggaccgc

SEQ ID NO: 132023 - RNA, 22 nt, Human
uguguccuucugggagucccag

SEQ ID NO: 132024 - RNA, 22 nt, Human
uucuucaauuauuggaaagaaa

SEQ ID NO: 132025 - RNA, 22 nt, Human
ucacuuuugaucccuaugcagu

SEQ ID NO: 132026 - RNA, 21 nt, Human
uggagcugaauuuuuggcauc

SEQ ID NO: 132027 - RNA, 18 nt, Human
ucauuuguuuugcaugaa

SEQ ID NO: 132028 - RNA, 22 nt, Human
ucagggcaaagggcagaguuug

SEQ ID NO: 132029 - RNA, 22 nt, Human
auggccuggggagcaugggaag

SEQ ID NO: 132030 - RNA, 22 nt, Human
uauguguaggaggaggacaggg

SEQ ID NO: 132031 - RNA, 23 nt, Human
uguguguguauucuacgcaaggu

SEQ ID NO: 132032 - RNA, 22 nt, Human
uugaaagaagaagcugcgaugu

SEQ ID NO: 132033 - RNA, 22 nt, Human
ucagggcaucaucaugaauaua

SEQ ID NO: 132034 - RNA, 22 nt, Human
aaaauaucagcaaagggugaca

SEQ ID NO: 132035 - RNA, 20 nt, Human
gcuuuuucuaauagcagucc

SEQ ID NO: 132036 - RNA, 22 nt, Human
caguauuuauggcuugaguauu

SEQ ID NO: 132037 - RNA, 22 nt, Human
uagcagggccaggcugggaacc

SEQ ID NO: 132038 - RNA, 22 nt, Human
accuuaaaacugacacauggag

SEQ ID NO: 132039 - RNA, 22 nt, Human
uucaggauccccaccgcguuua

SEQ ID NO: 132040 - RNA, 22 nt, Human
uucucucuuccaguucccacuu

SEQ ID NO: 132041 - RNA, 22 nt, Human
agggguggagaguguugccagu

SEQ ID NO: 132042 - RNA, 22 nt, Human
agcugagagguggcaagcugua

SEQ ID NO: 132043 - RNA, 22 nt, Human
ucugagggcuugaggggaagua

SEQ ID NO: 132044 - RNA, 22 nt, Human
cucuggagcgcugcuucccgcg

SEQ ID NO: 132045 - RNA, 23 nt, Human
ucuggcucuaugugacagcucuc

SEQ ID NO: 132046 - RNA, 22 nt, Human
uccagggaugguaaugagcagu

SEQ ID NO: 132047 - RNA, 22 nt, Human
ccagucugaggccuggugaggg

SEQ ID NO: 132048 - RNA, 22 nt, Human
ucucagggccccaaaggcuagu

SEQ ID NO: 132049 - RNA, 22 nt, Human
auucagcauaaucaguagcuug

SEQ ID NO: 132050 - RNA, 22 nt, Human
ggcugcugaguuggccaggaga

SEQ ID NO: 132051 - RNA, 22 nt, Human
ugcucugguaacucacuuccau

SEQ ID NO: 132052 - RNA, 22 nt, Human
ugaaagaacuagcaucuucaag

SEQ ID NO: 132053 - RNA, 21 nt, Human
aaaggccauaaucacggagca

SEQ ID NO: 132054 - RNA, 22 nt, Human
auguaaggcugccuaugacacu

SEQ ID NO: 132055 - RNA, 22 nt, Human
caucacuguccaaaguucaguu

SEQ ID NO: 132056 - RNA, 22 nt, Human
gauauauuuuccauggucugca

SEQ ID NO: 132057 - RNA, 22 nt, Human
agcaggaaggucugugugaguc

SEQ ID NO: 132058 - RNA, 22 nt, Human
uugcuucaguagcucuuuaaag

SEQ ID NO: 132059 - RNA, 22 nt, Human
acagcuaucugacuuugacuca

SEQ ID NO: 132060 - RNA, 22 nt, Human
acauucaugucccacuucuagc

SEQ ID NO: 132061 - RNA, 22 nt, Human
ugggcagaaugugggauccaga

SEQ ID NO: 132062 - RNA, 22 nt, Human
uacaacauuguguugcuucaua

SEQ ID NO: 132063 - RNA, 22 nt, Human
gucaugccagcggagcucggga

SEQ ID NO: 132064 - RNA, 22 nt, Human
gccaagagaaugugagagaaau

SEQ ID NO: 132065 - RNA, 22 nt, Human
cagcauuggguuaccuuuguuu

SEQ ID NO: 132066 - RNA, 22 nt, Human
agagcugcaccuaugcagaccu

SEQ ID NO: 132067 - RNA, 22 nt, Human
uccagccuaauguucuucccac

SEQ ID NO: 132068 - RNA, 22 nt, Human
gagggcagaaaauuaugcggug

SEQ ID NO: 132069 - RNA, 22 nt, Human
cuggcucaggaaaguugcugcu

SEQ ID NO: 132070 - RNA, 22 nt, Human
ugaagaugucagcagggguggu

SEQ ID NO: 132071 - RNA, 22 nt, Human
ggcugcugcccaccccugcaug

SEQ ID NO: 132072 - RNA, 22 nt, Human
gaaggaagucauuagugcagac

SEQ ID NO: 132073 - RNA, 22 nt, Human
ugucucagauacgccaucaagg

SEQ ID NO: 132074 - RNA, 22 nt, Human
uggcacugggacagaugcucuc

SEQ ID NO: 132075 - RNA, 22 nt, Human
cagcagcccacgcgugcugucc

SEQ ID NO: 132076 - RNA, 22 nt, Human
cugcagaggccucgccuccucu

SEQ ID NO: 132077 - RNA, 18 nt, Human
ccugccagucuggagcag

SEQ ID NO: 132078 - RNA, 22 nt, Human
guuauacauauguguuaacaaa

SEQ ID NO: 132079 - RNA, 22 nt, Human
uuuucuuacugucugugauccu

SEQ ID NO: 132080 - RNA, 22 nt, Human
uugucucuaagugugaucuuca

SEQ ID NO: 132081 - RNA, 22 nt, Human
ucuuuaagggauguucugcuuu

SEQ ID NO: 132082 - RNA, 22 nt, Human
gucucucucccaagauuggcua

SEQ ID NO: 132083 - RNA, 22 nt, Human
gaaugcacuuccaacaucuauu

SEQ ID NO: 132084 - RNA, 22 nt, Human
aagggcugccagggggugccag

SEQ ID NO: 132085 - RNA, 22 nt, Human
gagcugccuguugcauagcaac

SEQ ID NO: 132086 - RNA, 22 nt, Human
gaagagcuuaguuguccuagaa

SEQ ID NO: 132087 - RNA, 22 nt, Human
acagaaggcggggacaaggcgg

SEQ ID NO: 132088 - RNA, 22 nt, Human
cagcagagguuggaacaguucu

SEQ ID NO: 132089 - RNA, 22 nt, Human
ucagaagaagagacuccacagc

SEQ ID NO: 132090 - RNA, 22 nt, Human
cuggccuucagacucggacuga

SEQ ID NO: 132091 - RNA, 22 nt, Human
aagguacaccaaaguucaaguu

SEQ ID NO: 132092 - RNA, 22 nt, Human
auugcaccuuggguuuugaaag

SEQ ID NO: 132093 - RNA, 22 nt, Human
ggugcagaggagccagcugggg

SEQ ID NO: 132094 - RNA, 22 nt, Human
acagcuugcaauggcuuucaac

SEQ ID NO: 132095 - RNA, 20 nt, Human
gcucugugguuugagucucc

SEQ ID NO: 132096 - RNA, 22 nt, Human
aggggagcuaacaccagagccc

SEQ ID NO: 132097 - RNA, 22 nt, Human
ugagcuucaaaauaugugaauc

SEQ ID NO: 132098 - RNA, 22 nt, Human
cugcaggcucgaagacacggau

SEQ ID NO: 132099 - RNA, 22 nt, Human
auaacagauacucucugugagg

SEQ ID NO: 132100 - RNA, 22 nt, Human
gauggcagguaguggucucauc

SEQ ID NO: 132101 - RNA, 22 nt, Human
aacagaauugcugcugccaaug

SEQ ID NO: 132102 - RNA, 22 nt, Human
aaugaacaucaaaugccuacca

SEQ ID NO: 132103 - RNA, 22 nt, Human
gccaggcugaggcucuggaaga

SEQ ID NO: 132104 - RNA, 22 nt, Human
ccagggugaccagcuggccuag

SEQ ID NO: 132105 - RNA, 21 nt, Human
uuagaaagcucacuacaguua

SEQ ID NO: 132106 - RNA, 18 nt, Human
agggucagugucacuggc

SEQ ID NO: 132107 - RNA, 22 nt, Human
gaggggcugcccuggugucagg

SEQ ID NO: 132108 - RNA, 22 nt, Human
uaaggcacgcauaagagggggc

SEQ ID NO: 132109 - RNA, 22 nt, Human
gaagcccaggcuuccuuggcuu

SEQ ID NO: 132110 - RNA, 22 nt, Human
uucauucauuacgugccaggca

SEQ ID NO: 132111 - RNA, 21 nt, Human
ucagcagcaucugccuagagu

SEQ ID NO: 132112 - RNA, 22 nt, Human
gauuucuguaacacuucagaua

SEQ ID NO: 132113 - RNA, 22 nt, Human
ugagccagaguggagugugccu

SEQ ID NO: 132114 - RNA, 22 nt, Human
aagaauguucuuguagucauga

SEQ ID NO: 132115 - RNA, 22 nt, Human
ucaaggugcugugcugugcuag

SEQ ID NO: 132116 - RNA, 22 nt, Human
cagucccaugagcccagaacau

SEQ ID NO: 132117 - RNA, 22 nt, Human
acauuucucaucuaguagagua

SEQ ID NO: 132118 - RNA, 22 nt, Human
cacagcuucuccuugauaucgc

SEQ ID NO: 132119 - RNA, 22 nt, Human
guauuuucaugauuucagacca

SEQ ID NO: 132120 - RNA, 22 nt, Human
uugcaggggaaggagcagagcu

SEQ ID NO: 132121 - RNA, 22 nt, Human
gcugucacucaccaggccugca

SEQ ID NO: 132122 - RNA, 22 nt, Human
ccagcuggucugugcucauguu

SEQ ID NO: 132123 - RNA, 22 nt, Human
cuucccagacgggguggcagcc

SEQ ID NO: 132124 - RNA, 22 nt, Human
guucaaagcuccugguacagua

SEQ ID NO: 132125 - RNA, 18 nt, Human
cagggcuguggggucacu

SEQ ID NO: 132126 - RNA, 22 nt, Human
ccaggaagcggugagggcugcc

SEQ ID NO: 132127 - RNA, 22 nt, Human
ucacugaagacugggcucuaaa

SEQ ID NO: 132128 - RNA, 22 nt, Human
ucugucacccagagugcagugg

SEQ ID NO: 132129 - RNA, 22 nt, Human
acgcagaagggccuggcgugcc

SEQ ID NO: 132130 - RNA, 22 nt, Human
ugccugcucuuaccacucuccc

SEQ ID NO: 132131 - RNA, 22 nt, Human
aggucacccguuugacuaucca

SEQ ID NO: 132132 - RNA, 22 nt, Human
acauuguauaaugauuaucaca

SEQ ID NO: 132133 - RNA, 22 nt, Human
agccugagagccaagcugugca

SEQ ID NO: 132134 - RNA, 22 nt, Human
ugucucuucugccuccagcugu

SEQ ID NO: 132135 - RNA, 22 nt, Human
uugucuuaaauggauggacaau

SEQ ID NO: 132136 - RNA, 22 nt, Human
ucugaggcauacccaggccccc

SEQ ID NO: 132137 - RNA, 22 nt, Human
guuugaaaaaagcaguauguaa

SEQ ID NO: 132138 - RNA, 22 nt, Human
agagccugcaucaggcuugggg

SEQ ID NO: 132139 - RNA, 21 nt, Human
uccacaaguuagaaggaaauu

SEQ ID NO: 132140 - RNA, 22 nt, Human
uguauacaugucugugugcaca

SEQ ID NO: 132141 - RNA, 22 nt, Human
acuuccugggcaugcagagucc

SEQ ID NO: 132142 - RNA, 22 nt, Human
cugccugugugugccugcagaa

SEQ ID NO: 132143 - RNA, 22 nt, Human
uaguacuuaucucugucauugu

SEQ ID NO: 132144 - RNA, 21 nt, Human
ucuggagcccuaagcugagaa

SEQ ID NO: 132145 - RNA, 22 nt, Human
ucuucaauuagauuuaccaauu

SEQ ID NO: 132146 - RNA, 21 nt, Human
augacagaugcugcagaucgu

SEQ ID NO: 132147 - RNA, 22 nt, Human
guuuuauaauugcuucauaaga

SEQ ID NO: 132148 - RNA, 22 nt, Human
ugcauuguuugauaggugaauu

SEQ ID NO: 132149 - RNA, 22 nt, Human
ucugugauagguggcauaguga

SEQ ID NO: 132150 - RNA, 22 nt, Human
uuucuagucucgaucucuuaau

SEQ ID NO: 132151 - RNA, 22 nt, Human
cacagggcagguacucucagag

SEQ ID NO: 132152 - RNA, 22 nt, Human
ggcuuggaccagucacaguggu

SEQ ID NO: 132153 - RNA, 22 nt, Human
augcugagacuggagcagcugg

SEQ ID NO: 132154 - RNA, 22 nt, Human
uccugcagagccgcccucaggu

SEQ ID NO: 132155 - RNA, 22 nt, Human
ucuacuguagugaugcugcagu

SEQ ID NO: 132156 - RNA, 22 nt, Human
cuauugaaaguguacaauucaa

SEQ ID NO: 132157 - RNA, 22 nt, Human
ucaguauaauugcuggcacuga

SEQ ID NO: 132158 - RNA, 22 nt, Human
gcauuuaaauuugaacuucaga

SEQ ID NO: 132159 - RNA, 22 nt, Human
gguggcagaggugcaucagccc

SEQ ID NO: 132160 - RNA, 19 nt, Human
agaaaucucgagauuuguu

SEQ ID NO: 132161 - RNA, 22 nt, Human
ggcagcucacugauuagcaauu

SEQ ID NO: 132162 - RNA, 22 nt, Human
aguaaaaucuuaagcacagugg

SEQ ID NO: 132163 - RNA, 22 nt, Human
cugggcaggagggcucuaugga

SEQ ID NO: 132164 - RNA, 22 nt, Human
caggccuggcugcagcucgccu

SEQ ID NO: 132165 - RNA, 22 nt, Human
augggcagcagcugccauucau

SEQ ID NO: 132166 - RNA, 22 nt, Human
acagcuguggccacuugcaucc

SEQ ID NO: 132167 - RNA, 20 nt, Human
gagagcuggggaugaggcug

SEQ ID NO: 132168 - RNA, 22 nt, Human
acagaaugcguagugcauguug

SEQ ID NO: 132169 - RNA, 20 nt, Human
ucucuuuuagcuuacagcug

SEQ ID NO: 132170 - RNA, 22 nt, Human
aggugaguugguaggaaguuug

SEQ ID NO: 132171 - RNA, 22 nt, Human
gcucaggagcugacagccucaa

SEQ ID NO: 132172 - RNA, 22 nt, Human
uucaaacaguguagaauauaug

SEQ ID NO: 132173 - RNA, 22 nt, Human
gcuggccugaccugaggcuggg

SEQ ID NO: 132174 - RNA, 22 nt, Human
cugagccagcuggcaugugcua

SEQ ID NO: 132175 - RNA, 21 nt, Human
uagaaaucagcuggugccucu

SEQ ID NO: 132176 - RNA, 22 nt, Human
aggcugugauuccaccacucuc

SEQ ID NO: 132177 - RNA, 17 nt, Human
aggaaacauuuucuuuc

SEQ ID NO: 132178 - RNA, 19 nt, Human
cugagagaugcuucacaca

SEQ ID NO: 132179 - RNA, 22 nt, Human
ucacagggauggaauagaaaua

SEQ ID NO: 132180 - RNA, 22 nt, Human
uggccugggucacaccaggguc

SEQ ID NO: 132181 - RNA, 22 nt, Human
cuauauuucuuggcuuuaaaca

SEQ ID NO: 132182 - RNA, 22 nt, Human
cuguggcuuuuccggggagccu

SEQ ID NO: 132183 - RNA, 20 nt, Human
gauuucaaagcagaguggcc

SEQ ID NO: 132184 - RNA, 20 nt, Human
gcugccuuguccugcuuggu

SEQ ID NO: 132185 - RNA, 22 nt, Human
auacuuucugaccaauuaauug

SEQ ID NO: 132186 - RNA, 22 nt, Human
cacagcagaaaguguaggagga

SEQ ID NO: 132187 - RNA, 19 nt, Human
gcacacccugcaccaccau

SEQ ID NO: 132188 - RNA, 22 nt, Human
ccugggcuugcaucugugcugg

SEQ ID NO: 132189 - RNA, 22 nt, Human
cucccugggcagauguggcucu

SEQ ID NO: 132190 - RNA, 22 nt, Human
cccagcucucucaguucugcuu

SEQ ID NO: 132191 - RNA, 22 nt, Human
gaggggcuggguagggcaaccc

SEQ ID NO: 132192 - RNA, 22 nt, Human
aagaaucauccugcaagagucu

SEQ ID NO: 132193 - RNA, 22 nt, Human
auugacaauuagcccuuaggug

SEQ ID NO: 132194 - RNA, 22 nt, Human
ggaggccaaggaggagcuugcc

SEQ ID NO: 132195 - RNA, 19 nt, Human
cucuggccucuggaugcug

SEQ ID NO: 132196 - RNA, 22 nt, Human
aucuuucaaucaggaaaaaucu

SEQ ID NO: 132197 - RNA, 22 nt, Human
uggaggccagagguacugggac

SEQ ID NO: 132198 - RNA, 22 nt, Human
guccucagagugggcagguccu

SEQ ID NO: 132199 - RNA, 22 nt, Human
uuuacagcuucuauacuaugug

SEQ ID NO: 132200 - RNA, 22 nt, Human
gccagcaguccugcugugugcc

SEQ ID NO: 132201 - RNA, 22 nt, Human
aagugaagaaauacaugagaau

SEQ ID NO: 132202 - RNA, 22 nt, Human
gucagugucuuaacagagauua

SEQ ID NO: 132203 - RNA, 22 nt, Human
gcaggggcugcugggaacucgg

SEQ ID NO: 132204 - RNA, 22 nt, Human
cccaggaggcagaaguugcagu

SEQ ID NO: 132205 - RNA, 22 nt, Human
uauuuucaccuucucuggauau

SEQ ID NO: 132206 - RNA, 22 nt, Human
ggaggaugagcuacgaggagcu

SEQ ID NO: 132207 - RNA, 23 nt, Human
ugauuuccagugagucaguggga

SEQ ID NO: 132208 - RNA, 22 nt, Human
aaaucaguaaauguucauuaac

SEQ ID NO: 132209 - RNA, 22 nt, Human
caggaaagguagucacaaugua

SEQ ID NO: 132210 - RNA, 22 nt, Human
ggcaaaguuuucaucucauaac

SEQ ID NO: 132211 - RNA, 22 nt, Human
uauguucuuagaagaggcagca

SEQ ID NO: 132212 - RNA, 22 nt, Human
gugucaugcacacucaguguug

SEQ ID NO: 132213 - RNA, 22 nt, Human
uaaaugugaccuucauuuuaua

SEQ ID NO: 132214 - RNA, 22 nt, Human
cugagcugguggaagcaugcag

SEQ ID NO: 132215 - RNA, 22 nt, Human
cucaggauagauuguccucuca

SEQ ID NO: 132216 - RNA, 22 nt, Human
auauucacugagcauaaagcca

SEQ ID NO: 132217 - RNA, 22 nt, Human
cugcugugacagcugccguguu

SEQ ID NO: 132218 - RNA, 22 nt, Human
aggaggccgcugaugggcuccc

SEQ ID NO: 132219 - RNA, 22 nt, Human
caguacuuaguucucaugguuu

SEQ ID NO: 132220 - RNA, 22 nt, Human
uguaugcagggcuuguaugcag

SEQ ID NO: 132221 - RNA, 22 nt, Human
uggcccuguggaggucagugag

SEQ ID NO: 132222 - RNA, 22 nt, Human
cccccagccagcagugcucagc

SEQ ID NO: 132223 - RNA, 20 nt, Human
ggggcccaagcccucuugcc

SEQ ID NO: 132224 - RNA, 22 nt, Human
gcugagggcuguaacagcagag

SEQ ID NO: 132225 - RNA, 22 nt, Human
ugacagcauaacacuggucuug

SEQ ID NO: 132226 - RNA, 20 nt, Human
gcucccagccugcagucccc

SEQ ID NO: 132227 - RNA, 22 nt, Human
cuccuucccuucaaguguuccu

SEQ ID NO: 132228 - RNA, 22 nt, Human
cagcagcaaaucuagaagagga

SEQ ID NO: 132229 - RNA, 22 nt, Human
auuucucuuagcaagacauuac

SEQ ID NO: 132230 - RNA, 22 nt, Human
ccuggcuccugccucugcaggg

SEQ ID NO: 132231 - RNA, 17 nt, Human
gagugcugguggagcuc

SEQ ID NO: 132232 - RNA, 22 nt, Human
ccugcagguaaggcuaacugcc

SEQ ID NO: 132233 - RNA, 22 nt, Human
uuggaaagcaagcuggacauac

SEQ ID NO: 132234 - RNA, 22 nt, Human
auuucucugccucagcuucugc

SEQ ID NO: 132235 - RNA, 22 nt, Human
ugucauugaggaaaacuaggug

SEQ ID NO: 132236 - RNA, 22 nt, Human
agaggcaggagguugacuugag

SEQ ID NO: 132237 - RNA, 22 nt, Human
cacagaggaaaggcaguuggua

SEQ ID NO: 132238 - RNA, 22 nt, Human
uauuuaucgagugucuacuaug

SEQ ID NO: 132239 - RNA, 22 nt, Human
gccacccccaaguagguggucu

SEQ ID NO: 132240 - RNA, 22 nt, Human
uguucuugagccuuuagaccua

SEQ ID NO: 132241 - RNA, 22 nt, Human
gucacacucagaaugacuagag

SEQ ID NO: 132242 - RNA, 22 nt, Human
gcaggcuccaggccggccccuu

SEQ ID NO: 132243 - RNA, 22 nt, Human
uagcaguacugggcauguguuu

SEQ ID NO: 132244 - RNA, 22 nt, Human
agcagcauggagaaaccguuca

SEQ ID NO: 132245 - RNA, 22 nt, Human
gagccugggacugggggucaug

SEQ ID NO: 132246 - RNA, 22 nt, Human
uuuacauuucccucugucaguu

SEQ ID NO: 132247 - RNA, 22 nt, Human
ugagugccugaacauagaguag

SEQ ID NO: 132248 - RNA, 19 nt, Human
uggcaucuguaaaauggug

SEQ ID NO: 132249 - RNA, 22 nt, Human
agcuuccugaugcaagagggcu

SEQ ID NO: 132250 - RNA, 22 nt, Human
guguugcucuguuuggggguug

SEQ ID NO: 132251 - RNA, 22 nt, Human
cagagcuguuacuauucaugaa

SEQ ID NO: 132252 - RNA, 22 nt, Human
auggcugugguaucagacgcag

SEQ ID NO: 132253 - RNA, 22 nt, Human
guuauauauaguauuucucuga

SEQ ID NO: 132254 - RNA, 22 nt, Human
uuucuucagagagagcuuuccc

SEQ ID NO: 132255 - RNA, 22 nt, Human
cuggcucagacagcugugcagu

SEQ ID NO: 132256 - RNA, 22 nt, Human
ccaaggagcaaguuuacaccug

SEQ ID NO: 132257 - RNA, 22 nt, Human
cucuccuggggagcacacacac

SEQ ID NO: 132258 - RNA, 22 nt, Human
gcagcuggagccagccagacac

SEQ ID NO: 132259 - RNA, 22 nt, Human
uuauguucagcaucugcuuuau

SEQ ID NO: 132260 - RNA, 22 nt, Human
ugggccugaguuugggaacugg

SEQ ID NO: 132261 - RNA, 22 nt, Human
aucuagaaaguguugaagauca

SEQ ID NO: 132262 - RNA, 22 nt, Human
aucuggcucucucauuuacaaa

SEQ ID NO: 132263 - RNA, 22 nt, Human
aggcccugcccagagcuccucg

SEQ ID NO: 132264 - RNA, 22 nt, Human
uguccucacaggaaugaacuuu

SEQ ID NO: 132265 - RNA, 22 nt, Human
auguagcaugaggcacugugcc

SEQ ID NO: 132266 - RNA, 22 nt, Human
aaacagcugucauuguuuuaaa

SEQ ID NO: 132267 - RNA, 22 nt, Human
ugcaguguuccuguggguuuau

SEQ ID NO: 132268 - RNA, 22 nt, Human
gagagcuggguucaaguagcug

SEQ ID NO: 132269 - RNA, 22 nt, Human
uuuuucuggauaacuguaucuc

SEQ ID NO: 132270 - RNA, 23 nt, Human
uggcucugugucacauacaggau

SEQ ID NO: 132271 - RNA, 22 nt, Human
uugcugaaaucuaugacauccu

SEQ ID NO: 132272 - RNA, 22 nt, Human
ucucccacugcaagcccaggcu

SEQ ID NO: 132273 - RNA, 22 nt, Human
ugagcuggucuugaguguagcu

SEQ ID NO: 132274 - RNA, 22 nt, Human
ugcaugcguuaguuggcguguu

SEQ ID NO: 132275 - RNA, 22 nt, Human
uaguguguaugguaaugaugaa

SEQ ID NO: 132276 - RNA, 22 nt, Human
uguacagucaugcuuucuguuc

SEQ ID NO: 132277 - RNA, 22 nt, Human
cuggagcucuguguguuccuga

SEQ ID NO: 132278 - RNA, 22 nt, Human
acagguggggaggcugagguuc

SEQ ID NO: 132279 - RNA, 17 nt, Human
guccuacccauggucua

SEQ ID NO: 132280 - RNA, 22 nt, Human
cagcugaacauguagagcaucu

SEQ ID NO: 132281 - RNA, 22 nt, Human
ggcagcagggcugucucccuac

SEQ ID NO: 132282 - RNA, 22 nt, Human
ucccaggcuaggccucugcguu

SEQ ID NO: 132283 - RNA, 21 nt, Human
aggugggagaccauguagguc

SEQ ID NO: 132284 - RNA, 22 nt, Human
ugacaguauacuugugauggga

SEQ ID NO: 132285 - RNA, 22 nt, Human
agagcccucuucacugccccuu

SEQ ID NO: 132286 - RNA, 22 nt, Human
gcagugugucuggaguacaugg

SEQ ID NO: 132287 - RNA, 22 nt, Human
uuucuggcagcgggacaggggu

SEQ ID NO: 132288 - RNA, 22 nt, Human
aagggcugaaagaccuugggca

SEQ ID NO: 132289 - RNA, 22 nt, Human
guaacuuuggauuuaggguacc

SEQ ID NO: 132290 - RNA, 22 nt, Human
auagucuuagucuauaguuuug

SEQ ID NO: 132291 - RNA, 22 nt, Human
ugcuggaggggccugaccagga

SEQ ID NO: 132292 - RNA, 22 nt, Human
gcucccacgcaauucuuuucag

SEQ ID NO: 132293 - RNA, 22 nt, Human
uucaggauggaguaccuuuuau

SEQ ID NO: 132294 - RNA, 22 nt, Human
cacagcuuguuuagugacucac

SEQ ID NO: 132295 - RNA, 22 nt, Human
cucuuccuacagucugcuaugc

SEQ ID NO: 132296 - RNA, 22 nt, Human
agggaguguaaauggugcucag

SEQ ID NO: 132297 - RNA, 22 nt, Human
aguggcuggcauaggaacagac

SEQ ID NO: 132298 - RNA, 22 nt, Human
uggcuggcuuguucacugacug

SEQ ID NO: 132299 - RNA, 22 nt, Human
ugggaguguucuuggcuugcuu

SEQ ID NO: 132300 - RNA, 22 nt, Human
uucagaaguagcuaagcaguca

SEQ ID NO: 132301 - RNA, 22 nt, Human
aacuguuucagaaauauuguug

SEQ ID NO: 132302 - RNA, 22 nt, Human
gccuggaguagcauggcaagcc

SEQ ID NO: 132303 - RNA, 22 nt, Human
acugugugaggcugggugaguc

SEQ ID NO: 132304 - RNA, 22 nt, Human
aagauuucucuccuggaaagca

SEQ ID NO: 132305 - RNA, 20 nt, Human
aggcucagagcaguaguaca

SEQ ID NO: 132306 - RNA, 22 nt, Human
uucaggaucaaguugccaguag

SEQ ID NO: 132307 - RNA, 22 nt, Human
aggugcagcaugaguccaacgg

SEQ ID NO: 132308 - RNA, 22 nt, Human
augggaugcauggcuguggcca

SEQ ID NO: 132309 - RNA, 22 nt, Human
gcaggagagucugugccagguu

SEQ ID NO: 132310 - RNA, 22 nt, Human
uacaauaugugaacuuuggugu

SEQ ID NO: 132311 - RNA, 22 nt, Human
uggccuggugucugcgaggccu

SEQ ID NO: 132312 - RNA, 17 nt, Human
uauggcuguguuugugc

SEQ ID NO: 132313 - RNA, 18 nt, Human
ggcugugcguggaggcug

SEQ ID NO: 132314 - RNA, 23 nt, Human
cagggccaggcagcagcugucac

SEQ ID NO: 132315 - RNA, 22 nt, Human
aucuuuucuguuugcuaugucu

SEQ ID NO: 132316 - RNA, 22 nt, Human
cccugcagccggccagcucauu

SEQ ID NO: 132317 - RNA, 22 nt, Human
caggcccugggcaggaucagcc

SEQ ID NO: 132318 - RNA, 22 nt, Human
cuuucucuugagcaagagcugu

SEQ ID NO: 132319 - RNA, 22 nt, Human
ggcucuggaaaguguccuugau

SEQ ID NO: 132320 - RNA, 17 nt, Human
acacagggagagggagc

SEQ ID NO: 132321 - RNA, 22 nt, Human
cugcaucaguggauaugauggu

SEQ ID NO: 132322 - RNA, 22 nt, Human
guccucuguuagaaaugugcuu

SEQ ID NO: 132323 - RNA, 22 nt, Human
agugaaauacugucguuuuuag

SEQ ID NO: 132324 - RNA, 22 nt, Human
gggggcucugacucccucagcu

SEQ ID NO: 132325 - RNA, 23 nt, Human
aggugcagcccuggaccugcccc

SEQ ID NO: 132326 - RNA, 22 nt, Human
augugacaauauuuggucuuau

SEQ ID NO: 132327 - RNA, 22 nt, Human
cccagccugucuuucccaauga

SEQ ID NO: 132328 - RNA, 22 nt, Human
gccucugcugcaagccugguug

SEQ ID NO: 132329 - RNA, 22 nt, Human
ccucagggaggccucuguggcu

SEQ ID NO: 132330 - RNA, 22 nt, Human
aguaaugugccugaaauacuug

SEQ ID NO: 132331 - RNA, 22 nt, Human
gagcuggugaucagcuggagga

SEQ ID NO: 132332 - RNA, 22 nt, Human
agaaugcaagauaaacuuuauu

SEQ ID NO: 132333 - RNA, 22 nt, Human
guguggcugccagccaagaggc

SEQ ID NO: 132334 - RNA, 22 nt, Human
ugagcugggcugggcugagcug

SEQ ID NO: 132335 - RNA, 22 nt, Human
gcccagaaguugaggcugcagu

SEQ ID NO: 132336 - RNA, 22 nt, Human
ucagaagcauguggggagccug

SEQ ID NO: 132337 - RNA, 22 nt, Human
gcagcuguggguuccaagucua

SEQ ID NO: 132338 - RNA, 22 nt, Human
aaggcugaggagggccugcagg

SEQ ID NO: 132339 - RNA, 22 nt, Human
caagaugaaacuacagggagga

SEQ ID NO: 132340 - RNA, 22 nt, Human
aaaacaguuuaggcaucacagu

SEQ ID NO: 132341 - RNA, 22 nt, Human
uccguauuugacuauugcaccg

SEQ ID NO: 132342 - RNA, 22 nt, Human
caggccaggcugcauuugcccc

SEQ ID NO: 132343 - RNA, 22 nt, Human
gggccuccggggugagcugugg

SEQ ID NO: 132344 - RNA, 22 nt, Human
ccugucugcagauaucucaggu

SEQ ID NO: 132345 - RNA, 22 nt, Human
uggcuaugacuucguacugucu

SEQ ID NO: 132346 - RNA, 18 nt, Human
cagucccaaaccuuagga

SEQ ID NO: 132347 - RNA, 22 nt, Human
gagcucagauucuggugucaga

SEQ ID NO: 132348 - RNA, 22 nt, Human
accucccagcucugagcuuggg

SEQ ID NO: 132349 - RNA, 22 nt, Human
caggcacuagcagaaugaggcu

SEQ ID NO: 132350 - RNA, 22 nt, Human
cugcugggaaggucugcucagu

SEQ ID NO: 132351 - RNA, 22 nt, Human
auguggcuaguggacacaguau

SEQ ID NO: 132352 - RNA, 22 nt, Human
ugcagcaggcacaggacggaag

SEQ ID NO: 132353 - RNA, 22 nt, Human
ucuuugugccaugcagugaggc

SEQ ID NO: 132354 - RNA, 22 nt, Human
uuaaaauagccagugccccucu

SEQ ID NO: 132355 - RNA, 22 nt, Human
agucccagugagaugaaccagg

SEQ ID NO: 132356 - RNA, 22 nt, Human
ccucagcugcuucccuggagcc

SEQ ID NO: 132357 - RNA, 22 nt, Human
aacuagaaaacaagaugcugau

SEQ ID NO: 132358 - RNA, 22 nt, Human
uuggcugucacugucaguucag

SEQ ID NO: 132359 - RNA, 22 nt, Human
ggcagauggaagaggcuggguc

SEQ ID NO: 132360 - RNA, 22 nt, Human
cuccucacacccacugcaacca

SEQ ID NO: 132361 - RNA, 22 nt, Human
aaggaguuuggguagucauaca

SEQ ID NO: 132362 - RNA, 22 nt, Human
uaagauaugguaggaaguuugg

SEQ ID NO: 132363 - RNA, 22 nt, Human
caggggcugagaaggaacgucc

SEQ ID NO: 132364 - RNA, 22 nt, Human
ugagcccagucugucugacaug

SEQ ID NO: 132365 - RNA, 22 nt, Human
uacaguauauacuguguguaga

SEQ ID NO: 132366 - RNA, 22 nt, Human
uccuuucccuuuccauccuggc

SEQ ID NO: 132367 - RNA, 21 nt, Human
uccuucaguucugcacuuucu

SEQ ID NO: 132368 - RNA, 22 nt, Human
gggugggguguaucggauccua

SEQ ID NO: 132369 - RNA, 22 nt, Human
auuacaguuaauuuaccuucuu

SEQ ID NO: 132370 - RNA, 22 nt, Human
uaaauguguguagccaucugug

SEQ ID NO: 132371 - RNA, 22 nt, Human
uguggcugggcuaauaggcaaa

SEQ ID NO: 132372 - RNA, 22 nt, Human
ugccaaggguaugggcaagaua

SEQ ID NO: 132373 - RNA, 18 nt, Human
gcugucugaggucugagg

SEQ ID NO: 132374 - RNA, 22 nt, Human
cuggcugcuuguagacucgacu

SEQ ID NO: 132375 - RNA, 22 nt, Human
cuggccucauagccaagcugug

SEQ ID NO: 132376 - RNA, 21 nt, Human
auccuugaucagaagagugcu

SEQ ID NO: 132377 - RNA, 22 nt, Human
cccagcucaucaggagccgccc

SEQ ID NO: 132378 - RNA, 22 nt, Human
gguggguuuggaagagcaggcu

SEQ ID NO: 132379 - RNA, 22 nt, Human
caugugugagugagcagucuuc

SEQ ID NO: 132380 - RNA, 19 nt, Human
ccuggcccugcugcgcggg

SEQ ID NO: 132381 - RNA, 22 nt, Human
ggcuccugggaugggacugagc

SEQ ID NO: 132382 - RNA, 22 nt, Human
aguuucucuuaaucuaguaucu

SEQ ID NO: 132383 - RNA, 22 nt, Human
uguagcucuccagccagcaagg

SEQ ID NO: 132384 - RNA, 22 nt, Human
ggcaugggccgaggugccuccu

SEQ ID NO: 132385 - RNA, 22 nt, Human
uguguguaaggaagcuuuaugg

SEQ ID NO: 132386 - RNA, 22 nt, Human
gcuggccuugugucugaggaag

SEQ ID NO: 132387 - RNA, 22 nt, Human
agagcagugcugaagaguaggg

SEQ ID NO: 132388 - RNA, 22 nt, Human
ggccucggcccacugcugcggu

SEQ ID NO: 132389 - RNA, 22 nt, Human
aaggucauuuuuuccucuguug

SEQ ID NO: 132390 - RNA, 22 nt, Human
guagccauuggcaaugaagccu

SEQ ID NO: 132391 - RNA, 22 nt, Human
ucaggccacuucacaggugauu

SEQ ID NO: 132392 - RNA, 22 nt, Human
ugccucugguuaucugguaccu

SEQ ID NO: 132393 - RNA, 22 nt, Human
gugcugugugauccaugcuggc

SEQ ID NO: 132394 - RNA, 22 nt, Human
guguguacaaauuucauguaaa

SEQ ID NO: 132395 - RNA, 22 nt, Human
ucugggcucuuaguguacccuc

SEQ ID NO: 132396 - RNA, 22 nt, Human
gcauuccugagaaugcagagug

SEQ ID NO: 132397 - RNA, 18 nt, Human
ucugggcuucccgaggcu

SEQ ID NO: 132398 - RNA, 22 nt, Human
uuuugaaagaguccugcuacag

SEQ ID NO: 132399 - RNA, 20 nt, Human
acuuucucgguuucucaccu

SEQ ID NO: 132400 - RNA, 22 nt, Human
ugauuuccccagucuugcugcu

SEQ ID NO: 132401 - RNA, 22 nt, Human
uguuacuuaucucacgugaugc

SEQ ID NO: 132402 - RNA, 22 nt, Human
cugggagagaagcgaagcuggg

SEQ ID NO: 132403 - RNA, 21 nt, Human
agcaggaggcagucacagcuc

SEQ ID NO: 132404 - RNA, 22 nt, Human
uuguuuugcuaaagggucauca

SEQ ID NO: 132405 - RNA, 21 nt, Human
ccugagggugguugugaagau

SEQ ID NO: 132406 - RNA, 22 nt, Human
cucucugguuucagcgaagggg

SEQ ID NO: 132407 - RNA, 22 nt, Human
gggaucagcaagccacugcacc

SEQ ID NO: 132408 - RNA, 22 nt, Human
agcacagaguugcagagagcgu

SEQ ID NO: 132409 - RNA, 22 nt, Human
caagagcuggagaggcagucua

SEQ ID NO: 132410 - RNA, 22 nt, Human
ccagggucuuggagaggagugc

SEQ ID NO: 132411 - RNA, 22 nt, Human
cuguggagcuuguggcaguggg

SEQ ID NO: 132412 - RNA, 17 nt, Human
agaggcagauacuugga

SEQ ID NO: 132413 - RNA, 22 nt, Human
uuacaaagagugccagagugug

SEQ ID NO: 132414 - RNA, 22 nt, Human
ggagcuguaacgagccauugcu

SEQ ID NO: 132415 - RNA, 22 nt, Human
cagcaggcagccauuucacugu

SEQ ID NO: 132416 - RNA, 22 nt, Human
caggggcucugagauugucuaa

SEQ ID NO: 132417 - RNA, 22 nt, Human
aucaauucuuaggaaaauagcu

SEQ ID NO: 132418 - RNA, 22 nt, Human
auggaaagcuaagccauuuacc

SEQ ID NO: 132419 - RNA, 22 nt, Human
ucugaaggugcuagagaaagcu

SEQ ID NO: 132420 - RNA, 22 nt, Human
gccugagcuacuagggagucug

SEQ ID NO: 132421 - RNA, 22 nt, Human
ggcagggaggaggugaaaguga

SEQ ID NO: 132422 - RNA, 22 nt, Human
uguguguuaucuuaguucaucu

SEQ ID NO: 132423 - RNA, 22 nt, Human
caggguggcccuguggucucau

SEQ ID NO: 132424 - RNA, 22 nt, Human
uuuuuauaacucuuuugugaca

SEQ ID NO: 132425 - RNA, 22 nt, Human
gcuuuguguagaaggaggaugg

SEQ ID NO: 132426 - RNA, 22 nt, Human
ccucaggggugcccacagcugc

SEQ ID NO: 132427 - RNA, 22 nt, Human
aaggguggauuucugagcucua

SEQ ID NO: 132428 - RNA, 22 nt, Human
uacaaaguuugagaaugcuuuc

SEQ ID NO: 132429 - RNA, 22 nt, Human
ucagcagggagaggagaaugca

SEQ ID NO: 132430 - RNA, 22 nt, Human
ggguaauuggggccuugcagug

SEQ ID NO: 132431 - RNA, 22 nt, Human
caguaauaagcuggagggugug

SEQ ID NO: 132432 - RNA, 22 nt, Human
acugcuuuucagagucugccug

SEQ ID NO: 132433 - RNA, 22 nt, Human
acucuugucucaacuuuuguau

SEQ ID NO: 132434 - RNA, 22 nt, Human
gugugugccaacuuuaugugca

SEQ ID NO: 132435 - RNA, 22 nt, Human
ggaaagaggauaguggguaggu

SEQ ID NO: 132436 - RNA, 22 nt, Human
gaggaccacagaugagccugca

SEQ ID NO: 132437 - RNA, 22 nt, Human
auuucaaggcuauuaauauaaa

SEQ ID NO: 132438 - RNA, 22 nt, Human
gggcuggggcucaauaauuugu

SEQ ID NO: 132439 - RNA, 22 nt, Human
gccugccugcugucaucugccu

SEQ ID NO: 132440 - RNA, 22 nt, Human
cucccagagagcaggugggccg

SEQ ID NO: 132441 - RNA, 22 nt, Human
gcaggcagagguggaggagaca

SEQ ID NO: 132442 - RNA, 19 nt, Human
ggcugcugguuacagaggc

SEQ ID NO: 132443 - RNA, 19 nt, Human
uggcauugguccagauaaa

SEQ ID NO: 132444 - RNA, 22 nt, Human
accaaggagccacauacaaccu

SEQ ID NO: 132445 - RNA, 22 nt, Human
ucaggggacuuaggagagaagu

SEQ ID NO: 132446 - RNA, 17 nt, Human
cucagaguugcuuuguc

SEQ ID NO: 132447 - RNA, 21 nt, Human
gggaaauuaggauugcucauc

SEQ ID NO: 132448 - RNA, 22 nt, Human
gcagugcuaaguagcuggccca

SEQ ID NO: 132449 - RNA, 22 nt, Human
agcagcugaccagugaguccug

SEQ ID NO: 132450 - RNA, 22 nt, Human
aaaugucuaucuggcauauucc

SEQ ID NO: 132451 - RNA, 22 nt, Human
guggcaggucccauuggagcag

SEQ ID NO: 132452 - RNA, 22 nt, Human
ucuacuuuauaaguauauaagu

SEQ ID NO: 132453 - RNA, 22 nt, Human
ugaaagguuaaaaguaguauug

SEQ ID NO: 132454 - RNA, 22 nt, Human
aagaauguucauuaaacuguug

SEQ ID NO: 132455 - RNA, 22 nt, Human
uggccuggggaagaccaugggc

SEQ ID NO: 132456 - RNA, 22 nt, Human
uggcagcacuagguacugagcu

SEQ ID NO: 132457 - RNA, 22 nt, Human
uaucucuuuauugacaauaaaa

SEQ ID NO: 132458 - RNA, 22 nt, Human
ucugugucguucugugcucugg

SEQ ID NO: 132459 - RNA, 22 nt, Human
gccucugcacuguggcacacca

SEQ ID NO: 132460 - RNA, 22 nt, Human
uuucacagguacaaacacuccu

SEQ ID NO: 132461 - RNA, 22 nt, Human
ugauuucccuguagccucugaa

SEQ ID NO: 132462 - RNA, 22 nt, Human
ugucucugaacagcuuacuaaa

SEQ ID NO: 132463 - RNA, 22 nt, Human
caggccacaaguuggguucaag

SEQ ID NO: 132464 - RNA, 22 nt, Human
gcugggagaggcccugaaguga

SEQ ID NO: 132465 - RNA, 22 nt, Human
ggcagugaaaaaguauguuucc

SEQ ID NO: 132466 - RNA, 22 nt, Human
auugacaagugagcugggcugc

SEQ ID NO: 132467 - RNA, 22 nt, Human
gcucugcucuugacuuaccagg

SEQ ID NO: 132468 - RNA, 22 nt, Human
uuuuuccaccguacuuccugag

SEQ ID NO: 132469 - RNA, 22 nt, Human
uaacagaaauaguaggugaggg

SEQ ID NO: 132470 - RNA, 22 nt, Human
gggcugacucugcacugagcca

SEQ ID NO: 132471 - RNA, 22 nt, Human
ucaggcugagaaaaucuggacc

SEQ ID NO: 132472 - RNA, 22 nt, Human
gaggacaggagacucacuguuu

SEQ ID NO: 132473 - RNA, 22 nt, Human
agagcuuauaucuuggccaucc

SEQ ID NO: 132474 - RNA, 22 nt, Human
caaggagaguaauugaaugaga

SEQ ID NO: 132475 - RNA, 22 nt, Human
ucuggcucucucaucacccaau

SEQ ID NO: 132476 - RNA, 22 nt, Human
gcugucugcaagccaggaaaug

SEQ ID NO: 132477 - RNA, 22 nt, Human
uuacugaaaauucuucaggauu

SEQ ID NO: 132478 - RNA, 22 nt, Human
gugauuucagguuuuucauacu

SEQ ID NO: 132479 - RNA, 22 nt, Human
ugaugguugauuauaaaucagu

SEQ ID NO: 132480 - RNA, 23 nt, Human
uugugggcagauuccauggggag

SEQ ID NO: 132481 - RNA, 22 nt, Human
uggcuggcuagugggcaggauu

SEQ ID NO: 132482 - RNA, 22 nt, Human
uucuaacucaaagcuucuuuca

SEQ ID NO: 132483 - RNA, 18 nt, Human
auguggcuagugcuacug

SEQ ID NO: 132484 - RNA, 20 nt, Human
ucugugugccaucaccuaac

SEQ ID NO: 132485 - RNA, 22 nt, Human
ccugcagacacuuguccagcaa

SEQ ID NO: 132486 - RNA, 22 nt, Human
aguguauucagaauguagcaaa

SEQ ID NO: 132487 - RNA, 20 nt, Human
uuuuccagaaaguaucauug

SEQ ID NO: 132488 - RNA, 23 nt, Human
acagggcauugcuggccucgagg

SEQ ID NO: 132489 - RNA, 22 nt, Human
ggccacuccgcugcuacuggaa

SEQ ID NO: 132490 - RNA, 18 nt, Human
ugaauagggguuugcaga

SEQ ID NO: 132491 - RNA, 22 nt, Human
gucauugcaguggcaaaucaca

SEQ ID NO: 132492 - RNA, 22 nt, Human
gcauaauauacaugcuugaucc

SEQ ID NO: 132493 - RNA, 22 nt, Human
cccuggagggcagacagaugcc

SEQ ID NO: 132494 - RNA, 22 nt, Human
ccagcuccaggacugggagcug

SEQ ID NO: 132495 - RNA, 20 nt, Human
gacauucauaguuauuacca

SEQ ID NO: 132496 - RNA, 22 nt, Human
uucaagauggcugcaaauacuu

SEQ ID NO: 132497 - RNA, 22 nt, Human
ucuuccucucuaauugaucaga

SEQ ID NO: 132498 - RNA, 21 nt, Human
auacauucuauuaagcauuua

SEQ ID NO: 132499 - RNA, 22 nt, Human
auucuucacuguuucagaauga

SEQ ID NO: 132500 - RNA, 22 nt, Human
uuuuacuucauuccugacuuca

SEQ ID NO: 132501 - RNA, 22 nt, Human
ggagacaguauggcuuguagcu

SEQ ID NO: 132502 - RNA, 19 nt, Human
gggcuccuugggccucucu

SEQ ID NO: 132503 - RNA, 22 nt, Human
uccagccaagggagguuacuag

SEQ ID NO: 132504 - RNA, 22 nt, Human
agggaucaaaaaauguacaugc

SEQ ID NO: 132505 - RNA, 22 nt, Human
uggcugcuagccagagcuucag

SEQ ID NO: 132506 - RNA, 22 nt, Human
uauaucuuauaugugcagguac

SEQ ID NO: 132507 - RNA, 20 nt, Human
ugaagcagccuugauucugu

SEQ ID NO: 132508 - RNA, 22 nt, Human
uuacaguaaucgaguguugugg

SEQ ID NO: 132509 - RNA, 22 nt, Human
aaaugguaagacaacacauuau

SEQ ID NO: 132510 - RNA, 22 nt, Human
uuuuccucaggaaugcuaagcu

SEQ ID NO: 132511 - RNA, 22 nt, Human
ccugugcauccgguggucauug

SEQ ID NO: 132512 - RNA, 22 nt, Human
uuugaguugcuuauuuaauagg

SEQ ID NO: 132513 - RNA, 22 nt, Human
cuuauuuuaagucaguuugggu

SEQ ID NO: 132514 - RNA, 22 nt, Human
cagaguacugggagaacagaag

SEQ ID NO: 132515 - RNA, 22 nt, Human
aaaaaugaaacggcugguuggc

SEQ ID NO: 132516 - RNA, 22 nt, Human
uucucuggaacugaaacaagau

SEQ ID NO: 132517 - RNA, 19 nt, Human
caggaugaucccaugacac

SEQ ID NO: 132518 - RNA, 22 nt, Human
acaggugguaaaauggacuguc

SEQ ID NO: 132519 - RNA, 22 nt, Human
gccuaauaugcaaaauugauac

SEQ ID NO: 132520 - RNA, 22 nt, Human
uuuuccucuguauuugaaaugc

SEQ ID NO: 132521 - RNA, 22 nt, Human
ucagagugguagccuauuuucu

SEQ ID NO: 132522 - RNA, 22 nt, Human
gauuuccucacuaacauccauc

SEQ ID NO: 132523 - RNA, 22 nt, Human
aguaaaaauugaggugcaaaau

SEQ ID NO: 132524 - RNA, 22 nt, Human
uuguaacacuuuucuauuaaua

SEQ ID NO: 132525 - RNA, 22 nt, Human
aucaguuuguauaugaaacacu

SEQ ID NO: 132526 - RNA, 22 nt, Human
aaaggucagacuuaggcugggc

SEQ ID NO: 132527 - RNA, 22 nt, Human
ccaggcuggagugcaauggugc

SEQ ID NO: 132528 - RNA, 22 nt, Human
uuuuacaggucauagguauagu

SEQ ID NO: 132529 - RNA, 22 nt, Human
ggcccuguuagagcucccacaa

SEQ ID NO: 132530 - RNA, 22 nt, Human
acuuuuugcuggucucuuccau

SEQ ID NO: 132531 - RNA, 22 nt, Human
ggcugcagcggauuggggauug

SEQ ID NO: 132532 - RNA, 22 nt, Human
uucaagguaugguagcugguca

SEQ ID NO: 132533 - RNA, 22 nt, Human
ucuggcuccacuuucuucauuu

SEQ ID NO: 132534 - RNA, 22 nt, Human
cuguuuauaaauagaggggagu

SEQ ID NO: 132535 - RNA, 22 nt, Human
agagcaggcauaaagcuuugaa

SEQ ID NO: 132536 - RNA, 22 nt, Human
aaaugaacaguugcauucucug

SEQ ID NO: 132537 - RNA, 20 nt, Human
uggcugugggcaucuguuuc

SEQ ID NO: 132538 - RNA, 22 nt, Human
aguguuguaugggaugacugcu

SEQ ID NO: 132539 - RNA, 22 nt, Human
ggcugcugggucaugaugcaga

SEQ ID NO: 132540 - RNA, 22 nt, Human
guugaaaguagaugcuauuugg

SEQ ID NO: 132541 - RNA, 22 nt, Human
uacuuuggauccuuacaauagc

SEQ ID NO: 132542 - RNA, 22 nt, Human
acaguacaggacgaguuuuccu

SEQ ID NO: 132543 - RNA, 22 nt, Human
cuuccugcaggacagccaucug

SEQ ID NO: 132544 - RNA, 22 nt, Human
gcagggcucauucuaguacaau

SEQ ID NO: 132545 - RNA, 20 nt, Human
agcagcauuguucuagagca

SEQ ID NO: 132546 - RNA, 21 nt, Human
auuuucucuggaugaugguca

SEQ ID NO: 132547 - RNA, 22 nt, Human
cagguaagagacggauuggccc

SEQ ID NO: 132548 - RNA, 22 nt, Human
aaagcugcugccaaucaggcuu

SEQ ID NO: 132549 - RNA, 22 nt, Human
uuucuaucuaggguuagaguga

SEQ ID NO: 132550 - RNA, 22 nt, Human
acucuuuaacagacuuugaucu

SEQ ID NO: 132551 - RNA, 22 nt, Human
ccucuuugugccugcaggcugc

SEQ ID NO: 132552 - RNA, 22 nt, Human
ucagaaauguaagcugaugacu

SEQ ID NO: 132553 - RNA, 22 nt, Human
ugguccugagcaccagccugac

SEQ ID NO: 132554 - RNA, 22 nt, Human
caggguuucaccauguuagcag

SEQ ID NO: 132555 - RNA, 22 nt, Human
auguguguacacacgugacucu

SEQ ID NO: 132556 - RNA, 22 nt, Human
cccaggucugugccagcucuga

SEQ ID NO: 132557 - RNA, 21 nt, Human
ggucuuccaaauaaggagaaa

SEQ ID NO: 132558 - RNA, 22 nt, Human
agcugccauccuguucagcacc

SEQ ID NO: 132559 - RNA, 22 nt, Human
cucugugucugaguuauggucu

SEQ ID NO: 132560 - RNA, 22 nt, Human
gucccauaaguagugcaacuug

SEQ ID NO: 132561 - RNA, 20 nt, Human
uacugggcaagcccacagac

SEQ ID NO: 132562 - RNA, 22 nt, Human
auaguuuuauagauauugugua

SEQ ID NO: 132563 - RNA, 22 nt, Human
uugaaaggcacaggcaccuggg

SEQ ID NO: 132564 - RNA, 22 nt, Human
agggcagcacagcugugcuccu

SEQ ID NO: 132565 - RNA, 22 nt, Human
ccagcuucucucugaugcagcu

SEQ ID NO: 132566 - RNA, 22 nt, Human
guuugcauggaagacagugagu

SEQ ID NO: 132567 - RNA, 22 nt, Human
aguuuuucugcuggucucacua

SEQ ID NO: 132568 - RNA, 22 nt, Human
aggcccugaagucggccccuca

SEQ ID NO: 132569 - RNA, 20 nt, Human
acccagcucugugcccuggg

SEQ ID NO: 132570 - RNA, 18 nt, Human
aguaguggguuuagcuuc

SEQ ID NO: 132571 - RNA, 22 nt, Human
guguguggacgucugagcccag

SEQ ID NO: 132572 - RNA, 22 nt, Human
aaaugcagauuuugaugcagca

SEQ ID NO: 132573 - RNA, 22 nt, Human
agagguagagguugcagugagc

SEQ ID NO: 132574 - RNA, 20 nt, Human
cauuuguuagcuuucuacug

SEQ ID NO: 132575 - RNA, 22 nt, Human
aaagauuugaguucugcuuaua

SEQ ID NO: 132576 - RNA, 22 nt, Human
cauguauauuucuguaugugca

SEQ ID NO: 132577 - RNA, 22 nt, Human
cacugggcaauucugagccuaa

SEQ ID NO: 132578 - RNA, 22 nt, Human
ccuggcagacugugagggcagg

SEQ ID NO: 132579 - RNA, 20 nt, Human
ccuggagccuggaaggaguc

SEQ ID NO: 132580 - RNA, 22 nt, Human
gcuggccugcugggcaccaccg

SEQ ID NO: 132581 - RNA, 22 nt, Human
cagguauaacgugcauguugua

SEQ ID NO: 132582 - RNA, 22 nt, Human
augucccaagauacagcuagag

SEQ ID NO: 132583 - RNA, 22 nt, Human
auuuuccuccaugugagcaguu

SEQ ID NO: 132584 - RNA, 22 nt, Human
ggagucccagcaaagccuuccc

SEQ ID NO: 132585 - RNA, 22 nt, Human
agaggagugggaagcagugcaa

SEQ ID NO: 132586 - RNA, 19 nt, Human
agugucaucagcuacucag

SEQ ID NO: 132587 - RNA, 22 nt, Human
ugugccauuucuauucugcagc

SEQ ID NO: 132588 - RNA, 22 nt, Human
gccuggcaggggccugggagug

SEQ ID NO: 132589 - RNA, 22 nt, Human
uggcaccugaacuuagaggugu

SEQ ID NO: 132590 - RNA, 21 nt, Human
cccuguguuccacagcagaca

SEQ ID NO: 132591 - RNA, 22 nt, Human
uggggccugagguggagcugca

SEQ ID NO: 132592 - RNA, 22 nt, Human
aggccagcaagaaagagagucu

SEQ ID NO: 132593 - RNA, 22 nt, Human
aucuggcucauucagggaacgg

SEQ ID NO: 132594 - RNA, 22 nt, Human
agagugaucagauaucaggugu

SEQ ID NO: 132595 - RNA, 22 nt, Human
gagcagaugugugccaggaugc

SEQ ID NO: 132596 - RNA, 22 nt, Human
uggcucagagagggagugugga

SEQ ID NO: 132597 - RNA, 21 nt, Human
uugaaaguaaauucagcagcu

SEQ ID NO: 132598 - RNA, 22 nt, Human
guucuucaguaaaauuaaaugu

SEQ ID NO: 132599 - RNA, 22 nt, Human
ucaggcaguagaauugcuugaa

SEQ ID NO: 132600 - RNA, 22 nt, Human
ggucccaggagaauaggugcaa

SEQ ID NO: 132601 - RNA, 22 nt, Human
cuagaaauauuuuacagucaag

SEQ ID NO: 132602 - RNA, 22 nt, Human
ccagggcauguaacuaauggug

SEQ ID NO: 132603 - RNA, 22 nt, Human
cugagccagagggagucggguc

SEQ ID NO: 132604 - RNA, 22 nt, Human
gcugcuucucugauggagucca

SEQ ID NO: 132605 - RNA, 22 nt, Human
aagggcugaaugaaggguugaa

SEQ ID NO: 132606 - RNA, 22 nt, Human
aaaaguucccugguuagaaaag

SEQ ID NO: 132607 - RNA, 22 nt, Human
gugucccacucuggaggugaag

SEQ ID NO: 132608 - RNA, 22 nt, Human
ucuauuacuuaccacuaauuca

SEQ ID NO: 132609 - RNA, 22 nt, Human
cugugucuuuccuacuuugugg

SEQ ID NO: 132610 - RNA, 22 nt, Human
gaguuauuggguggaaagguag

SEQ ID NO: 132611 - RNA, 22 nt, Human
gagaagcaauuuccaacugugc

SEQ ID NO: 132612 - RNA, 22 nt, Human
cugucugugaccucugcauguc

SEQ ID NO: 132613 - RNA, 22 nt, Human
agccccucuguggcucugccuc

SEQ ID NO: 132614 - RNA, 22 nt, Human
agagcugaaaaagcugacccgg

SEQ ID NO: 132615 - RNA, 19 nt, Human
gcaggcacagcccugggug

SEQ ID NO: 132616 - RNA, 20 nt, Human
ccagucccugagcaccaggg

SEQ ID NO: 132617 - RNA, 22 nt, Human
aggcuguguccucauuuuauau

SEQ ID NO: 132618 - RNA, 22 nt, Human
acagucuugcuguauggucagg

SEQ ID NO: 132619 - RNA, 22 nt, Human
aggguccugggugcaguugcuu

SEQ ID NO: 132620 - RNA, 22 nt, Human
agguggguaucaugagagauua

SEQ ID NO: 132621 - RNA, 22 nt, Human
cuggccuggcaggggaccucua

SEQ ID NO: 132622 - RNA, 17 nt, Human
acagagguuauacagac

SEQ ID NO: 132623 - RNA, 22 nt, Human
gccaugccugugucuccaggcc

SEQ ID NO: 132624 - RNA, 22 nt, Human
cuggagaggccccaagauauuu

SEQ ID NO: 132625 - RNA, 22 nt, Human
auugacaaggaaacuauaccag

SEQ ID NO: 132626 - RNA, 22 nt, Human
ccucaggcuuacgggcaaugga

SEQ ID NO: 132627 - RNA, 22 nt, Human
uaggaaaaauacagaauuauau

SEQ ID NO: 132628 - RNA, 22 nt, Human
guguguccaggcgggagucaag

SEQ ID NO: 132629 - RNA, 22 nt, Human
cuccugggcucaagugauccuc

SEQ ID NO: 132630 - RNA, 22 nt, Human
caggaaugaggucguaaguguc

SEQ ID NO: 132631 - RNA, 22 nt, Human
ccaggcugggcuacaaguugag

SEQ ID NO: 132632 - RNA, 22 nt, Human
aauauaauuuuauuccuagagu

SEQ ID NO: 132633 - RNA, 22 nt, Human
aaguccaucucugccccacaca

SEQ ID NO: 132634 - RNA, 22 nt, Human
guaaaucccauccuuucucugg

SEQ ID NO: 132635 - RNA, 22 nt, Human
cagcaggcguugggagaaagac

SEQ ID NO: 132636 - RNA, 22 nt, Human
acagcuguggggacucuugccc

SEQ ID NO: 132637 - RNA, 22 nt, Human
caaauaguuuuucauguauuau

SEQ ID NO: 132638 - RNA, 22 nt, Human
cucugugcccuacugcucagcu

SEQ ID NO: 132639 - RNA, 22 nt, Human
uaauuuaauuccauggauucua

SEQ ID NO: 132640 - RNA, 22 nt, Human
aauaucagcacuuuugugguau

SEQ ID NO: 132641 - RNA, 22 nt, Human
cugugcuugcggguguggagcc

SEQ ID NO: 132642 - RNA, 22 nt, Human
uguguguggggaggcagcagau

SEQ ID NO: 132643 - RNA, 22 nt, Human
ucccacugugaauccaaggccu

SEQ ID NO: 132644 - RNA, 22 nt, Human
aggcuguggugaugauuggguc

SEQ ID NO: 132645 - RNA, 22 nt, Human
aguguaugucaaguauauacac

SEQ ID NO: 132646 - RNA, 22 nt, Human
acagaauauugguuacuguugc

SEQ ID NO: 132647 - RNA, 22 nt, Human
uuucacauacaguguauaguag

SEQ ID NO: 132648 - RNA, 22 nt, Human
ggacuggacucucaggcucaca

SEQ ID NO: 132649 - RNA, 22 nt, Human
ucaggccacggcucacugagac

SEQ ID NO: 132650 - RNA, 22 nt, Human
cucugcagaauuugagcugcuc

SEQ ID NO: 132651 - RNA, 18 nt, Human
ccagcaugccagaggcug

SEQ ID NO: 132652 - RNA, 22 nt, Human
uggcugugggauaugugacuga

SEQ ID NO: 132653 - RNA, 22 nt, Human
cuuuuucacuguguccucacac

SEQ ID NO: 132654 - RNA, 22 nt, Human
ucugggcugggagcguguggac

SEQ ID NO: 132655 - RNA, 22 nt, Human
ucugaagaacugaguaaacaug

SEQ ID NO: 132656 - RNA, 22 nt, Human
uggcagagucucuccuuuccag

SEQ ID NO: 132657 - RNA, 22 nt, Human
uguguggccuccauaggguacu

SEQ ID NO: 132658 - RNA, 22 nt, Human
cucuccucagaacaggcccucu

SEQ ID NO: 132659 - RNA, 22 nt, Human
ggccugcacagagguggcucua

SEQ ID NO: 132660 - RNA, 22 nt, Human
uggaagggggaagacagcucug

SEQ ID NO: 132661 - RNA, 22 nt, Human
aggcucagcugguggugaucgc

SEQ ID NO: 132662 - RNA, 22 nt, Human
cauuucugucacguucuuuuau

SEQ ID NO: 132663 - RNA, 22 nt, Human
gccaggcagcugggagggugcc

SEQ ID NO: 132664 - RNA, 22 nt, Human
guguauggacacaugucauguu

SEQ ID NO: 132665 - RNA, 22 nt, Human
ggccucugccucaucugggcac

SEQ ID NO: 132666 - RNA, 22 nt, Human
ucacauuuuaucuauuuuaagu

SEQ ID NO: 132667 - RNA, 22 nt, Human
uagauaaauuagaaaguuuacu

SEQ ID NO: 132668 - RNA, 22 nt, Human
ccacacagucaguuuccaagaa

SEQ ID NO: 132669 - RNA, 23 nt, Human
aguguuccaguugguugagagug

SEQ ID NO: 132670 - RNA, 22 nt, Human
uuucauggcuaggacuagagug

SEQ ID NO: 132671 - RNA, 22 nt, Human
uccaugucuucaugugucuaac

SEQ ID NO: 132672 - RNA, 22 nt, Human
gggcucagccccauugaaccag

SEQ ID NO: 132673 - RNA, 22 nt, Human
uguuuuaaucucccauugcucu

SEQ ID NO: 132674 - RNA, 22 nt, Human
aaaggccacuugaaggauuuuu

SEQ ID NO: 132675 - RNA, 22 nt, Human
aucaguuuuguucacuacuaua

SEQ ID NO: 132676 - RNA, 22 nt, Human
aauggccagcugggagaguuga

SEQ ID NO: 132677 - RNA, 23 nt, Human
auguggcuagugagaccaagaaa

SEQ ID NO: 132678 - RNA, 22 nt, Human
aacaaaugauaccaguucucaa

SEQ ID NO: 132679 - RNA, 22 nt, Human
gccuccccugcaauuguccuug

SEQ ID NO: 132680 - RNA, 22 nt, Human
uguguagcucauauuaguguua

SEQ ID NO: 132681 - RNA, 22 nt, Human
ccugccugucccucaguccaca

SEQ ID NO: 132682 - RNA, 22 nt, Human
auggaguucuuuaaauucacag

SEQ ID NO: 132683 - RNA, 22 nt, Human
guucauauuacuuugagugcag

SEQ ID NO: 132684 - RNA, 22 nt, Human
gacagggcgagacucagucuca

SEQ ID NO: 132685 - RNA, 22 nt, Human
aaaggucauugaaaaggaggaa

SEQ ID NO: 132686 - RNA, 22 nt, Human
acaucucaugaaugauaaauca

SEQ ID NO: 132687 - RNA, 22 nt, Human
acuuuugguucuguaacuguga

SEQ ID NO: 132688 - RNA, 22 nt, Human
cugggaggauucauugagguga

SEQ ID NO: 132689 - RNA, 22 nt, Human
ccuggcugccgagugugcagcg

SEQ ID NO: 132690 - RNA, 22 nt, Human
ccacugggcguuucuguccaau

SEQ ID NO: 132691 - RNA, 22 nt, Human
uggcagaguuggagguggaaga

SEQ ID NO: 132692 - RNA, 22 nt, Human
ccagcaggagacuagcaacaua

SEQ ID NO: 132693 - RNA, 22 nt, Human
acagagccuccaggagugcugg

SEQ ID NO: 132694 - RNA, 22 nt, Human
cccuggaggcggauguugcagu

SEQ ID NO: 132695 - RNA, 22 nt, Human
cugccucuggccucaggcccag

SEQ ID NO: 132696 - RNA, 22 nt, Human
aaggcacucagccuugggacag

SEQ ID NO: 132697 - RNA, 22 nt, Human
uagagcuggccgggacagcugg

SEQ ID NO: 132698 - RNA, 22 nt, Human
cacauugaaaugacccaauaau

SEQ ID NO: 132699 - RNA, 22 nt, Human
gaaggcugaugacagauucugc

SEQ ID NO: 132700 - RNA, 22 nt, Human
caggccucaggggcucaggcug

SEQ ID NO: 132701 - RNA, 22 nt, Human
cuuagaaauaaugguuucaguu

SEQ ID NO: 132702 - RNA, 19 nt, Human
aucugccuuagugcugcug

SEQ ID NO: 132703 - RNA, 19 nt, Human
ggcugucucggcccagcca

SEQ ID NO: 132704 - RNA, 22 nt, Human
uuuucucuacaaaauaaccagc

SEQ ID NO: 132705 - RNA, 22 nt, Human
ggcuagaacuuuacacuuugca

SEQ ID NO: 132706 - RNA, 20 nt, Human
aaaguguaagcauauaauua

SEQ ID NO: 132707 - RNA, 22 nt, Human
cagagacauuaagugccaugau

SEQ ID NO: 132708 - RNA, 22 nt, Human
acacauuucuaaauuuuuaccg

SEQ ID NO: 132709 - RNA, 22 nt, Human
uaucucuugucuguuuugcaaa

SEQ ID NO: 132710 - RNA, 18 nt, Human
ugaacuuuggugucucuc

SEQ ID NO: 132711 - RNA, 22 nt, Human
acauauauuacuaguaaagaca

SEQ ID NO: 132712 - RNA, 22 nt, Human
cgcagaagagguugucuagucc

SEQ ID NO: 132713 - RNA, 23 nt, Human
uugcacauuggagcuggucuucu

SEQ ID NO: 132714 - RNA, 22 nt, Human
caaaaugugagucccaccucaa

SEQ ID NO: 132715 - RNA, 22 nt, Human
agcugcugagagucugccgggc

SEQ ID NO: 132716 - RNA, 22 nt, Human
ugggcuguggagcaccuuugca

SEQ ID NO: 132717 - RNA, 22 nt, Human
gagucacaaagccuuucuuauu

SEQ ID NO: 132718 - RNA, 22 nt, Human
cagacagacagccguggccacc

SEQ ID NO: 132719 - RNA, 21 nt, Human
auuauuauuucuguguccagc

SEQ ID NO: 132720 - RNA, 22 nt, Human
gcuggcugaguucugucgucug

SEQ ID NO: 132721 - RNA, 22 nt, Human
ucagagcuuaucucuugcugga

SEQ ID NO: 132722 - RNA, 22 nt, Human
aaaguuuuagaacuaggaagca

SEQ ID NO: 132723 - RNA, 22 nt, Human
ggaucauuaacacauccaucac

SEQ ID NO: 132724 - RNA, 22 nt, Human
uuggaaggcccugccuagcagg

SEQ ID NO: 132725 - RNA, 22 nt, Human
auguguaucuaagguguucuau

SEQ ID NO: 132726 - RNA, 22 nt, Human
agccacgucccugucaggguca

SEQ ID NO: 132727 - RNA, 22 nt, Human
uauuugucaccuauggcugucc

SEQ ID NO: 132728 - RNA, 23 nt, Human
gccugggacucaggaggagcuca

SEQ ID NO: 132729 - RNA, 22 nt, Human
caaaugcauagaaagaugaaac

SEQ ID NO: 132730 - RNA, 22 nt, Human
cuuuuauuuugaauuaagggcu

SEQ ID NO: 132731 - RNA, 22 nt, Human
ucuguguauuugugaccuguau

SEQ ID NO: 132732 - RNA, 18 nt, Human
gggcccuggcguccgccc

SEQ ID NO: 132733 - RNA, 22 nt, Human
auuucucugcaguguucggaau

SEQ ID NO: 132734 - RNA, 22 nt, Human
ucaggggcugugcauuucccag

SEQ ID NO: 132735 - RNA, 22 nt, Human
ugcauuaugcuacccagaagcu

SEQ ID NO: 132736 - RNA, 22 nt, Human
aaguguguauuguuuaugcugc

SEQ ID NO: 132737 - RNA, 22 nt, Human
caucacuguccucagcauucca

SEQ ID NO: 132738 - RNA, 22 nt, Human
ugggcacaggggaauggaugaa

SEQ ID NO: 132739 - RNA, 22 nt, Human
uagcagcuuccagagagggcag

SEQ ID NO: 132740 - RNA, 22 nt, Human
cuggagcccaggccuggugucu

SEQ ID NO: 132741 - RNA, 22 nt, Human
ccuggcagaauauuaaagugca

SEQ ID NO: 132742 - RNA, 21 nt, Human
ugauuuccagaaaauuggccc

SEQ ID NO: 132743 - RNA, 22 nt, Human
agggcugcuccuccuucaggcc

SEQ ID NO: 132744 - RNA, 17 nt, Human
gccucugcuugugucau

SEQ ID NO: 132745 - RNA, 22 nt, Human
cugaggcuuggaggggucuggu

SEQ ID NO: 132746 - RNA, 22 nt, Human
ugcuuuauguuaucagaagggu

SEQ ID NO: 132747 - RNA, 22 nt, Human
cucaggauucucgacacucaca

SEQ ID NO: 132748 - RNA, 22 nt, Human
auucuucauuuacuguuacuug

SEQ ID NO: 132749 - RNA, 22 nt, Human
gauuuucuugggaaacaaugag

SEQ ID NO: 132750 - RNA, 22 nt, Human
agccacagcaacaagugcaauu

SEQ ID NO: 132751 - RNA, 22 nt, Human
aacaaauguguggcaguguggg

SEQ ID NO: 132752 - RNA, 22 nt, Human
aaauugugagcuauagaucuag

SEQ ID NO: 132753 - RNA, 22 nt, Human
aggcucugcagugcuggaggac

SEQ ID NO: 132754 - RNA, 22 nt, Human
cagggccugccugguuccugga

SEQ ID NO: 132755 - RNA, 22 nt, Human
ugggccuggcccuguggaggag

SEQ ID NO: 132756 - RNA, 22 nt, Human
ggcugccacgucgaggguccaa

SEQ ID NO: 132757 - RNA, 17 nt, Human
cuggagccaagagggcc

SEQ ID NO: 132758 - RNA, 22 nt, Human
ugaaggagcucaaugaugaugc

SEQ ID NO: 132759 - RNA, 22 nt, Human
caggccugcaggaaaggcuccc

SEQ ID NO: 132760 - RNA, 22 nt, Human
uuggaauucaaguuguagcuua

SEQ ID NO: 132761 - RNA, 22 nt, Human
agggacuggcucucugagcagg

SEQ ID NO: 132762 - RNA, 22 nt, Human
agcauugccugccuauugcuaa

SEQ ID NO: 132763 - RNA, 18 nt, Human
caugggugacagguggau

SEQ ID NO: 132764 - RNA, 22 nt, Human
ccaggagccacucaggcccaca

SEQ ID NO: 132765 - RNA, 22 nt, Human
aggagcagaacuguuguggagg

SEQ ID NO: 132766 - RNA, 22 nt, Human
cuggcagcuuccuuugcaucug

SEQ ID NO: 132767 - RNA, 22 nt, Human
gggagggauuaguucugccugg

SEQ ID NO: 132768 - RNA, 22 nt, Human
auuauguagguuaggugguugu

SEQ ID NO: 132769 - RNA, 22 nt, Human
aguaauaauuuauauuagggag

SEQ ID NO: 132770 - RNA, 23 nt, Human
gccagccuugcucuccugcagcc

SEQ ID NO: 132771 - RNA, 22 nt, Human
uaguccauuuucacacugcuga

SEQ ID NO: 132772 - RNA, 22 nt, Human
cugcagagcaaguaacauccuc

SEQ ID NO: 132773 - RNA, 22 nt, Human
cccuggagugccggaaucaaga

SEQ ID NO: 132774 - RNA, 22 nt, Human
guaggcagucucucaggugauc

SEQ ID NO: 132775 - RNA, 22 nt, Human
cagugugugacucuggggguac

SEQ ID NO: 132776 - RNA, 22 nt, Human
ccaggcagcaaauuuucugaau

SEQ ID NO: 132777 - RNA, 22 nt, Human
gcuguucucuguaacaugcauu

SEQ ID NO: 132778 - RNA, 22 nt, Human
aagcacagaaaaggagcaugga

SEQ ID NO: 132779 - RNA, 22 nt, Human
gugaaugccgcagucuguugcu

SEQ ID NO: 132780 - RNA, 22 nt, Human
gaauauuuguaauuacuguuga

SEQ ID NO: 132781 - RNA, 22 nt, Human
uucuuauuucccccuucaucau

SEQ ID NO: 132782 - RNA, 22 nt, Human
agaugcugcuccacaggccagg

SEQ ID NO: 132783 - RNA, 17 nt, Human
ucuuuccugccaugcuc

SEQ ID NO: 132784 - RNA, 22 nt, Human
gcuggccaguguggugaccacc

SEQ ID NO: 132785 - RNA, 22 nt, Human
cuuuacagaauaagaauacugg

SEQ ID NO: 132786 - RNA, 22 nt, Human
uauaacacucagaaagaaucau

SEQ ID NO: 132787 - RNA, 22 nt, Human
aaaauggucucagcuggcacca

SEQ ID NO: 132788 - RNA, 22 nt, Human
ugacagggugauuaugagagcu

SEQ ID NO: 132789 - RNA, 22 nt, Human
aagauuuagggccaguuuacau

SEQ ID NO: 132790 - RNA, 22 nt, Human
cugcuucugggaugauggagua

SEQ ID NO: 132791 - RNA, 22 nt, Human
acuucuucuucagcugggggau

SEQ ID NO: 132792 - RNA, 22 nt, Human
acuggcagccacaacuggcagg

SEQ ID NO: 132793 - RNA, 22 nt, Human
uugaagcauuguggcuuguauu

SEQ ID NO: 132794 - RNA, 22 nt, Human
cucuuuaaaguaaaauuugucu

SEQ ID NO: 132795 - RNA, 22 nt, Human
ggcagcucugcuccacaugagu

SEQ ID NO: 132796 - RNA, 22 nt, Human
auaaacacuucuagggcacaca

SEQ ID NO: 132797 - RNA, 22 nt, Human
gagcuuccauggacgccaucug

SEQ ID NO: 132798 - RNA, 22 nt, Human
cacugcagaucagaggcugaga

SEQ ID NO: 132799 - RNA, 22 nt, Human
ucucagaggugcccuggcaucu

SEQ ID NO: 132800 - RNA, 22 nt, Human
aaaggaagauugagcuuuucca

SEQ ID NO: 132801 - RNA, 22 nt, Human
ggcucaggacugcagcguagag

SEQ ID NO: 132802 - RNA, 22 nt, Human
aagcagcacaguaauauuggug

SEQ ID NO: 132803 - RNA, 22 nt, Human
ccagcagccaccuucucgaaau

SEQ ID NO: 132804 - RNA, 22 nt, Human
gugacugugaacuguuucugau

SEQ ID NO: 132805 - RNA, 22 nt, Human
guaguguguaggcacugugcuc

SEQ ID NO: 132806 - RNA, 22 nt, Human
aguguguaaugccaggggcugc

SEQ ID NO: 132807 - RNA, 23 nt, Human
uuuaacuuuccaauaauucauug

SEQ ID NO: 132808 - RNA, 22 nt, Human
ggcuucugccacgagagggaag

SEQ ID NO: 132809 - RNA, 22 nt, Human
aagggaggccagagguuuugca

SEQ ID NO: 132810 - RNA, 22 nt, Human
ugcagaguaaaagcagaugcua

SEQ ID NO: 132811 - RNA, 22 nt, Human
uacaugcaugucacagaaugaa

SEQ ID NO: 132812 - RNA, 22 nt, Human
augagcuguaagguggcuuccu

SEQ ID NO: 132813 - RNA, 22 nt, Human
ggaggagacccugugucaguuu

SEQ ID NO: 132814 - RNA, 22 nt, Human
gggcugugcugaguaggaggug

SEQ ID NO: 132815 - RNA, 22 nt, Human
gggacagacccaugggccaggu

SEQ ID NO: 132816 - RNA, 22 nt, Human
auuauucuugagguguuuauug

SEQ ID NO: 132817 - RNA, 22 nt, Human
augagacuaccuguaauguggc

SEQ ID NO: 132818 - RNA, 22 nt, Human
aggagucauugagagggguccu

SEQ ID NO: 132819 - RNA, 22 nt, Human
aggcacagagaaugcccuccau

SEQ ID NO: 132820 - RNA, 22 nt, Human
cucuguuucucagccuauuucc

SEQ ID NO: 132821 - RNA, 22 nt, Human
uucuggaggccccuuccuucuc

SEQ ID NO: 132822 - RNA, 22 nt, Human
ggccucacccaucggugccuuu

SEQ ID NO: 132823 - RNA, 22 nt, Human
uuugaacuucuaccugucauau

SEQ ID NO: 132824 - RNA, 22 nt, Human
ggguggcugacuguuuugugga

SEQ ID NO: 132825 - RNA, 19 nt, Human
caggaaugagguaauggcu

SEQ ID NO: 132826 - RNA, 22 nt, Human
gaauuguacgcuuuacauaggu

SEQ ID NO: 132827 - RNA, 22 nt, Human
gggagcugagcuggaagagaau

SEQ ID NO: 132828 - RNA, 22 nt, Human
ccacccuuggguucggaggccg

SEQ ID NO: 132829 - RNA, 22 nt, Human
aguuucucuagagucuuugaaa

SEQ ID NO: 132830 - RNA, 22 nt, Human
ucccagagcccaaguuggagag

SEQ ID NO: 132831 - RNA, 22 nt, Human
caccagggacaaugcuaggggu

SEQ ID NO: 132832 - RNA, 22 nt, Human
ugcugugucuuucugugaaaag

SEQ ID NO: 132833 - RNA, 22 nt, Human
uucaagaugccagggacgcggc

SEQ ID NO: 132834 - RNA, 22 nt, Human
uggcucagaguucaucuuuuag

SEQ ID NO: 132835 - RNA, 20 nt, Human
uguguauaaauauauguuuc

SEQ ID NO: 132836 - RNA, 22 nt, Human
uccuucaggguugaggccgacu

SEQ ID NO: 132837 - RNA, 22 nt, Human
gcccugucggaacugcgaccuc

SEQ ID NO: 132838 - RNA, 22 nt, Human
ugggccuguugggguugaguua

SEQ ID NO: 132839 - RNA, 22 nt, Human
aaauuauuacaagcuaguuggc

SEQ ID NO: 132840 - RNA, 22 nt, Human
gcugucuccauagcuguguguc

SEQ ID NO: 132841 - RNA, 22 nt, Human
caagggcuucaaguggccaaga

SEQ ID NO: 132842 - RNA, 22 nt, Human
ucugccuggguguggagcagag

SEQ ID NO: 132843 - RNA, 22 nt, Human
cugccugugcaugcagucagaa

SEQ ID NO: 132844 - RNA, 22 nt, Human
ucaccagucuuucuuaccauug

SEQ ID NO: 132845 - RNA, 22 nt, Human
uucuucaguguagcaacuguau

SEQ ID NO: 132846 - RNA, 22 nt, Human
uaaugucaaggugauagauuug

SEQ ID NO: 132847 - RNA, 22 nt, Human
gggcagagagcuggaacuccuu

SEQ ID NO: 132848 - RNA, 22 nt, Human
uucaauucuaaacuaauauucu

SEQ ID NO: 132849 - RNA, 22 nt, Human
ucugcuguaaagaauuucugcc

SEQ ID NO: 132850 - RNA, 22 nt, Human
gcugucugagaacaugguggaa

SEQ ID NO: 132851 - RNA, 22 nt, Human
acagauauguuggguucuuguu

SEQ ID NO: 132852 - RNA, 22 nt, Human
ucuggagcuggcagggcccugg

SEQ ID NO: 132853 - RNA, 22 nt, Human
acacugcucacuucuucccuug

SEQ ID NO: 132854 - RNA, 22 nt, Human
ugucccaguucccaggguugcu

SEQ ID NO: 132855 - RNA, 22 nt, Human
gcagugugaccgagcuugcuuc

SEQ ID NO: 132856 - RNA, 22 nt, Human
uuauagaaggagcauucacuua

SEQ ID NO: 132857 - RNA, 23 nt, Human
uggcagcuguguaagagaaagca

SEQ ID NO: 132858 - RNA, 22 nt, Human
uuauuuaaaagugguaagauuc

SEQ ID NO: 132859 - RNA, 22 nt, Human
ucagagagccucaggcacugcc

SEQ ID NO: 132860 - RNA, 22 nt, Human
uacagguagcaaaaccuuuccu

SEQ ID NO: 132861 - RNA, 22 nt, Human
cauugacaguucuuuaaguugc

SEQ ID NO: 132862 - RNA, 20 nt, Human
agcugaggcaccugagguua

SEQ ID NO: 132863 - RNA, 22 nt, Human
aagaaauauugggccuuauaaa

SEQ ID NO: 132864 - RNA, 22 nt, Human
ugccaggcccagcuccagagcu

SEQ ID NO: 132865 - RNA, 22 nt, Human
cugaagccacgauagcuuccua

SEQ ID NO: 132866 - RNA, 22 nt, Human
aggucaccauggcaugcuccac

SEQ ID NO: 132867 - RNA, 20 nt, Human
uggcuccugcgguggaacca

SEQ ID NO: 132868 - RNA, 22 nt, Human
agucccagugacuuggccagaa

SEQ ID NO: 132869 - RNA, 22 nt, Human
cuccagggagcuuggaaagacc

SEQ ID NO: 132870 - RNA, 22 nt, Human
cucuuuucaaaauuucacugca

SEQ ID NO: 132871 - RNA, 22 nt, Human
gggaugucacugugccuggcac

SEQ ID NO: 132872 - RNA, 22 nt, Human
cuggcucaugugaugagggcaa

SEQ ID NO: 132873 - RNA, 22 nt, Human
ggcugagcacuuuaggcaggag

SEQ ID NO: 132874 - RNA, 22 nt, Human
aaaaucaguacacuuuauuuug

SEQ ID NO: 132875 - RNA, 22 nt, Human
gcugagaggcacuaucuccgga

SEQ ID NO: 132876 - RNA, 22 nt, Human
gcaggcugaugacuggaguugg

SEQ ID NO: 132877 - RNA, 22 nt, Human
auuucuuccucugucaguaacu

SEQ ID NO: 132878 - RNA, 22 nt, Human
uacuuuucuguguggcagucac

SEQ ID NO: 132879 - RNA, 22 nt, Human
cugcccugucuuuuucugauga

SEQ ID NO: 132880 - RNA, 22 nt, Human
gccaggcugcuggcugcugucc

SEQ ID NO: 132881 - RNA, 22 nt, Human
ucaggcaggcagagggcaaaug

SEQ ID NO: 132882 - RNA, 22 nt, Human
uacaugcuccacuuucuccugu

SEQ ID NO: 132883 - RNA, 23 nt, Human
gacagagugagaccuugucuuac

SEQ ID NO: 132884 - RNA, 19 nt, Human
ucugucacuggggguauuc

SEQ ID NO: 132885 - RNA, 22 nt, Human
ggggcagagucuggacuguugu

SEQ ID NO: 132886 - RNA, 22 nt, Human
ggagugucagaaacaguguccu

SEQ ID NO: 132887 - RNA, 22 nt, Human
gaucauuuugaugcccuuuuag

SEQ ID NO: 132888 - RNA, 21 nt, Human
gauuucacuuaccuucauuua

SEQ ID NO: 132889 - RNA, 22 nt, Human
agugucauuuuguccaucuucu

SEQ ID NO: 132890 - RNA, 22 nt, Human
ugugccagccucuggcuguguc

SEQ ID NO: 132891 - RNA, 22 nt, Human
cuuuuuccagcuucaggguggg

SEQ ID NO: 132892 - RNA, 22 nt, Human
cuuuuuaucucuuaaugauguu

SEQ ID NO: 132893 - RNA, 22 nt, Human
uguguauaaacaagagucugug

SEQ ID NO: 132894 - RNA, 22 nt, Human
ucucuucugaaaccugucuuua

SEQ ID NO: 132895 - RNA, 22 nt, Human
aaaugcagguucuugagccaag

SEQ ID NO: 132896 - RNA, 22 nt, Human
ggcaggcaggagcgugcuuggg

SEQ ID NO: 132897 - RNA, 23 nt, Human
aucaaaguggaaaucaauuaucu

SEQ ID NO: 132898 - RNA, 21 nt, Human
uguauacacacauauauguac

SEQ ID NO: 132899 - RNA, 22 nt, Human
ccugccagcauggcuuaucucc

SEQ ID NO: 132900 - RNA, 22 nt, Human
ucaacacuauccaggcaaucuu

SEQ ID NO: 132901 - RNA, 22 nt, Human
gccugaagaacagcugugagga

SEQ ID NO: 132902 - RNA, 22 nt, Human
ucucucauagagaaaaauauau

SEQ ID NO: 132903 - RNA, 22 nt, Human
aauguacaaaagucagccaacu

SEQ ID NO: 132904 - RNA, 17 nt, Human
agaaagaggauccacag

SEQ ID NO: 132905 - RNA, 22 nt, Human
aagggaggaggauuuauuguac

SEQ ID NO: 132906 - RNA, 22 nt, Human
agccugagccccauccagcuga

SEQ ID NO: 132907 - RNA, 22 nt, Human
ggcuucucucccccagcuccac

SEQ ID NO: 132908 - RNA, 22 nt, Human
uaaggccagccagcaaaucugu

SEQ ID NO: 132909 - RNA, 22 nt, Human
uuuuacaggugugagccaccau

SEQ ID NO: 132910 - RNA, 22 nt, Human
gucccugggaugcccuucuggg

SEQ ID NO: 132911 - RNA, 22 nt, Human
aucaggaugacuauaaggcugc

SEQ ID NO: 132912 - RNA, 22 nt, Human
uugagaagaauguguugaguuu

SEQ ID NO: 132913 - RNA, 22 nt, Human
ugaaagcuguccacuaggcugu

SEQ ID NO: 132914 - RNA, 22 nt, Human
uggaagcaucacuucuugccug

SEQ ID NO: 132915 - RNA, 22 nt, Human
uggcagcagccauggaaggccc

SEQ ID NO: 132916 - RNA, 22 nt, Human
uguguggcguugcguggcuagg

SEQ ID NO: 132917 - RNA, 22 nt, Human
uggcucugaucagauguccagu

SEQ ID NO: 132918 - RNA, 22 nt, Human
gggagggaucugcuaggcaaug

SEQ ID NO: 132919 - RNA, 22 nt, Human
auaguaacuggcauguuuauga

SEQ ID NO: 132920 - RNA, 22 nt, Human
ucuggcugaaaggggcugugcc

SEQ ID NO: 132921 - RNA, 22 nt, Human
agggagacacaugaggaaguca

SEQ ID NO: 132922 - RNA, 20 nt, Human
ucagugauuaucucugagug

SEQ ID NO: 132923 - RNA, 22 nt, Human
gagcugccggcccacaguacua

SEQ ID NO: 132924 - RNA, 22 nt, Human
cuguauuucccacauucucuau

SEQ ID NO: 132925 - RNA, 22 nt, Human
ggcugcucuucuuggcgaccuc

SEQ ID NO: 132926 - RNA, 22 nt, Human
cauaccuuucucaagcacaugu

SEQ ID NO: 132927 - RNA, 22 nt, Human
uuagaaaucugcugccaugcaa

SEQ ID NO: 132928 - RNA, 22 nt, Human
aucaguuugauaauaaggcuug

SEQ ID NO: 132929 - RNA, 22 nt, Human
uagacuuuuaagucccucuuua

SEQ ID NO: 132930 - RNA, 22 nt, Human
ucucucagaggccaggguccug

SEQ ID NO: 132931 - RNA, 22 nt, Human
cucuggagguggagguugcagu

SEQ ID NO: 132932 - RNA, 22 nt, Human
uggcucagcuuacuuuugaggg

SEQ ID NO: 132933 - RNA, 22 nt, Human
gcuggagccauuggcuuggccu

SEQ ID NO: 132934 - RNA, 22 nt, Human
uauguuucuuccuuuucauaca

SEQ ID NO: 132935 - RNA, 22 nt, Human
gacccagcuuaagucacauguu

SEQ ID NO: 132936 - RNA, 21 nt, Human
ucuguacaucauugagucccc

SEQ ID NO: 132937 - RNA, 22 nt, Human
augcaguaaauguucuaguuug

SEQ ID NO: 132938 - RNA, 22 nt, Human
auguacaguggaaacuaacaaa

SEQ ID NO: 132939 - RNA, 23 nt, Human
aguuccagaaaaaugcucaagca

SEQ ID NO: 132940 - RNA, 22 nt, Human
uaccaguaauguaacuuugcaa

SEQ ID NO: 132941 - RNA, 21 nt, Human
gcagccacagccaccaagcua

SEQ ID NO: 132942 - RNA, 17 nt, Human
agugacuuggaaagagc

SEQ ID NO: 132943 - RNA, 22 nt, Human
aauuagagaucaguucuuugac

SEQ ID NO: 132944 - RNA, 22 nt, Human
cuccccagguucaggagguggg

SEQ ID NO: 132945 - RNA, 22 nt, Human
cugagccauaagggaggcuggg

SEQ ID NO: 132946 - RNA, 22 nt, Human
agucauauggcuauuuaguggg

SEQ ID NO: 132947 - RNA, 22 nt, Human
uccuggagaauccugccaccug

SEQ ID NO: 132948 - RNA, 22 nt, Human
agagucugaggcagcugcagcc

SEQ ID NO: 132949 - RNA, 22 nt, Human
uggcuaggcuccaagagcugga

SEQ ID NO: 132950 - RNA, 22 nt, Human
guugaaugaaucauucuaugua

SEQ ID NO: 132951 - RNA, 22 nt, Human
ccagccaggcuggcuguggagg

SEQ ID NO: 132952 - RNA, 19 nt, Human
aggcagaggcuuggcuagc

SEQ ID NO: 132953 - RNA, 22 nt, Human
uucauucccaagaguaaacaua

SEQ ID NO: 132954 - RNA, 22 nt, Human
acacaaugcauauuuuuccaga

SEQ ID NO: 132955 - RNA, 22 nt, Human
agaccaagaaaggaugaggauc

SEQ ID NO: 132956 - RNA, 20 nt, Human
guucucacugaucugcaggg

SEQ ID NO: 132957 - RNA, 22 nt, Human
cuuauuauaaaauccuguuuga

SEQ ID NO: 132958 - RNA, 22 nt, Human
uccagcagcccgaaggcccauc

SEQ ID NO: 132959 - RNA, 22 nt, Human
cugccucucaggucccugagau

SEQ ID NO: 132960 - RNA, 22 nt, Human
auccaugauuaguaggauaaag

SEQ ID NO: 132961 - RNA, 22 nt, Human
uggcugugucaucauagcugug

SEQ ID NO: 132962 - RNA, 22 nt, Human
cagcuccccaugguuccugaag

SEQ ID NO: 132963 - RNA, 22 nt, Human
guccugggaaggaagccaggga

SEQ ID NO: 132964 - RNA, 22 nt, Human
gcucugggugaacuuggagcaa

SEQ ID NO: 132965 - RNA, 22 nt, Human
ugugugcagccucugucuuugg

SEQ ID NO: 132966 - RNA, 22 nt, Human
gauuuucugagccuucaaauuu

SEQ ID NO: 132967 - RNA, 23 nt, Human
uggagcugacagucagagggagg

SEQ ID NO: 132968 - RNA, 22 nt, Human
gggccuggugcuucugacuccu

SEQ ID NO: 132969 - RNA, 22 nt, Human
uuucuagaggcuccaggggagu

SEQ ID NO: 132970 - RNA, 22 nt, Human
ccaaggaggccccaggucagcu

SEQ ID NO: 132971 - RNA, 22 nt, Human
ugcuguguuacugagauccggc

SEQ ID NO: 132972 - RNA, 22 nt, Human
cacguuuuaugacagaagaagc

SEQ ID NO: 132973 - RNA, 22 nt, Human
ucauuuuucacacagggucacc

SEQ ID NO: 132974 - RNA, 21 nt, Human
ccuggcagaagccugauaugc

SEQ ID NO: 132975 - RNA, 22 nt, Human
gcucuggacccuggaguggcug

SEQ ID NO: 132976 - RNA, 22 nt, Human
ccagaggugcugggagaggucu

SEQ ID NO: 132977 - RNA, 22 nt, Human
uucucacuauguauguagauug

SEQ ID NO: 132978 - RNA, 22 nt, Human
uaguuucuaaagcuuccuaggu

SEQ ID NO: 132979 - RNA, 21 nt, Human
gcaggggauagaaauggucug

SEQ ID NO: 132980 - RNA, 22 nt, Human
cucaucugauaaaucacucuua

SEQ ID NO: 132981 - RNA, 22 nt, Human
auuaaauuggaucugcauaguu

SEQ ID NO: 132982 - RNA, 22 nt, Human
cagcuggaugggagaccauguu

SEQ ID NO: 132983 - RNA, 22 nt, Human
gcuggccucuacaggccggcca

SEQ ID NO: 132984 - RNA, 22 nt, Human
ugggcagaaggaagagccaccu

SEQ ID NO: 132985 - RNA, 22 nt, Human
aguggcuguuuauaggugggua

SEQ ID NO: 132986 - RNA, 22 nt, Human
ggugccaggcucccagcucagg

SEQ ID NO: 132987 - RNA, 22 nt, Human
aaaggugacugcagcagcuauu

SEQ ID NO: 132988 - RNA, 22 nt, Human
uggccagcccuucagccaugcc

SEQ ID NO: 132989 - RNA, 22 nt, Human
ucaaaguaaaaguauagaguuu

SEQ ID NO: 132990 - RNA, 22 nt, Human
auuacaguggacagcuaugcac

SEQ ID NO: 132991 - RNA, 22 nt, Human
aagcaaagaguuuaguggguga

SEQ ID NO: 132992 - RNA, 22 nt, Human
gguuauauaauucagugcuuuc

SEQ ID NO: 132993 - RNA, 22 nt, Human
aggggccugguuggccucuguu

SEQ ID NO: 132994 - RNA, 22 nt, Human
aauguuguuuuucugcaugucu

SEQ ID NO: 132995 - RNA, 22 nt, Human
acauuuuuuagagucccacauu

SEQ ID NO: 132996 - RNA, 22 nt, Human
cuaucuuucgauucuagcuuaa

SEQ ID NO: 132997 - RNA, 22 nt, Human
cagccacguagcccuuggccgu

SEQ ID NO: 132998 - RNA, 22 nt, Human
ggaggccaaggcaggcggauca

SEQ ID NO: 132999 - RNA, 18 nt, Human
cguuuuuccgggauugca

SEQ ID NO: 133000 - RNA, 22 nt, Human
aucuacccacugaacacaauau

SEQ ID NO: 133001 - RNA, 22 nt, Human
agccacagucaaccuguccaua

SEQ ID NO: 133002 - RNA, 19 nt, Human
gguguuucuucauuuucca

SEQ ID NO: 133003 - RNA, 22 nt, Human
gcucccugacucaguuccugag

SEQ ID NO: 133004 - RNA, 22 nt, Human
aggcagggucuugcuauguugc

SEQ ID NO: 133005 - RNA, 22 nt, Human
ccagcccuguaaggaugaggca

SEQ ID NO: 133006 - RNA, 22 nt, Human
gcugguuaggugagggugcgcc

SEQ ID NO: 133007 - RNA, 22 nt, Human
acuggcucagaguuccuagaga

SEQ ID NO: 133008 - RNA, 22 nt, Human
ugcuugugacagaacugugucc

SEQ ID NO: 133009 - RNA, 22 nt, Human
uuuccucuucgauuaaguuugg

SEQ ID NO: 133010 - RNA, 22 nt, Human
gcugggagugggcaagaugaga

SEQ ID NO: 133011 - RNA, 23 nt, Human
cuuuuaacuugaucugagaccag

SEQ ID NO: 133012 - RNA, 22 nt, Human
caggcugaggcaguaggguuug

SEQ ID NO: 133013 - RNA, 22 nt, Human
agggacagaugaaugacugagu

SEQ ID NO: 133014 - RNA, 22 nt, Human
agagacagaggcaauauagcuu

SEQ ID NO: 133015 - RNA, 22 nt, Human
uauguacauaacaugaaaugca

SEQ ID NO: 133016 - RNA, 22 nt, Human
ggaagggcaaaagagaugaacu

SEQ ID NO: 133017 - RNA, 22 nt, Human
auauucuuccaaaacaucauuu

SEQ ID NO: 133018 - RNA, 22 nt, Human
agcuggccuguuagagcugagu

SEQ ID NO: 133019 - RNA, 18 nt, Human
guuggcugcuguggcugg

SEQ ID NO: 133020 - RNA, 22 nt, Human
gcagggcuauuggaaggagaug

SEQ ID NO: 133021 - RNA, 22 nt, Human
cacucuccagcacaccccauuu

SEQ ID NO: 133022 - RNA, 22 nt, Human
aaguuguauauaccgcuuuaag

SEQ ID NO: 133023 - RNA, 22 nt, Human
accaaggagacaaagguguauu

SEQ ID NO: 133024 - RNA, 22 nt, Human
ugucucugagaugacucccacc

SEQ ID NO: 133025 - RNA, 22 nt, Human
uguggcuggauugauuuuaccu

SEQ ID NO: 133026 - RNA, 22 nt, Human
cuauuuucccauaugguugaca

SEQ ID NO: 133027 - RNA, 22 nt, Human
uguacauugucacucaucaagu

SEQ ID NO: 133028 - RNA, 19 nt, Human
ucccuggcgccucucgggc

SEQ ID NO: 133029 - RNA, 22 nt, Human
ggccaggaagggaagaucagca

SEQ ID NO: 133030 - RNA, 18 nt, Human
ucuuggaguaaugaucaa

SEQ ID NO: 133031 - RNA, 22 nt, Human
agcugccaucagccuuuggaug

SEQ ID NO: 133032 - RNA, 22 nt, Human
gauuucaccugaucuugucauc

SEQ ID NO: 133033 - RNA, 22 nt, Human
agccucugguccucccucagcu

SEQ ID NO: 133034 - RNA, 22 nt, Human
caguauguacucuuaucaugua

SEQ ID NO: 133035 - RNA, 22 nt, Human
cucuggagcaccgggcuaucca

SEQ ID NO: 133036 - RNA, 22 nt, Human
uuugugugaaaauauuuaaguu

SEQ ID NO: 133037 - RNA, 22 nt, Human
auacaucuuccuuuuaaaaugc

SEQ ID NO: 133038 - RNA, 22 nt, Human
uguagaaagaauauguuucaua

SEQ ID NO: 133039 - RNA, 22 nt, Human
cugcagggcagggccuccuggc

SEQ ID NO: 133040 - RNA, 22 nt, Human
acagaauuaucaggaaauguua

SEQ ID NO: 133041 - RNA, 22 nt, Human
ucugugugauuucagggaaguc

SEQ ID NO: 133042 - RNA, 23 nt, Human
aacaccaaggcucagagagauaa

SEQ ID NO: 133043 - RNA, 22 nt, Human
gcagcauuucucaaaggguggu

SEQ ID NO: 133044 - RNA, 22 nt, Human
ggagcugcuccuucagccaagu

SEQ ID NO: 133045 - RNA, 22 nt, Human
acuccugguuuguguccuggcu

SEQ ID NO: 133046 - RNA, 22 nt, Human
aaaguuuccugcuaagugcuau

SEQ ID NO: 133047 - RNA, 22 nt, Human
gcaaggcugagcacauuugcau

SEQ ID NO: 133048 - RNA, 22 nt, Human
acagggcauuuccucuaugugu

SEQ ID NO: 133049 - RNA, 22 nt, Human
gaggaaaauggaguguaauuaa

SEQ ID NO: 133050 - RNA, 22 nt, Human
gccugccuuugugaggaagcgg

SEQ ID NO: 133051 - RNA, 22 nt, Human
auuuucucacaauccuaugggg

SEQ ID NO: 133052 - RNA, 22 nt, Human
ccaggccugauugggaaucuug

SEQ ID NO: 133053 - RNA, 22 nt, Human
auuuuuccaauuaggauaaaga

SEQ ID NO: 133054 - RNA, 22 nt, Human
ccucugcagcagagagccagag

SEQ ID NO: 133055 - RNA, 17 nt, Human
aggccagaugaggcaag

SEQ ID NO: 133056 - RNA, 22 nt, Human
aggcuccuugcucacaggcuca

SEQ ID NO: 133057 - RNA, 22 nt, Human
cacaagagagugcgcguugcaa

SEQ ID NO: 133058 - RNA, 22 nt, Human
uuuucugcggugugaauggccu

SEQ ID NO: 133059 - RNA, 22 nt, Human
ccucagagguguggcaucucug

SEQ ID NO: 133060 - RNA, 22 nt, Human
agagcagauggccagggggccu

SEQ ID NO: 133061 - RNA, 22 nt, Human
ucaugucaguuucuucuauaaa

SEQ ID NO: 133062 - RNA, 22 nt, Human
auacaaguugugauaauguaaa

SEQ ID NO: 133063 - RNA, 23 nt, Human
ggcucugugcugggccugcagga

SEQ ID NO: 133064 - RNA, 22 nt, Human
agcugcuaugacaacaccagcc

SEQ ID NO: 133065 - RNA, 22 nt, Human
cuggcuucugggccagggcaga

SEQ ID NO: 133066 - RNA, 22 nt, Human
ggagauagacuuggugagccac

SEQ ID NO: 133067 - RNA, 22 nt, Human
augaguaagaccauaauuuuug

SEQ ID NO: 133068 - RNA, 22 nt, Human
cagcaggauagguuucuuugga

SEQ ID NO: 133069 - RNA, 22 nt, Human
ugucccaguuuaucugggacug

SEQ ID NO: 133070 - RNA, 22 nt, Human
cccagcccagcguucgaggggu

SEQ ID NO: 133071 - RNA, 22 nt, Human
gucacaggccuggaugaggggc

SEQ ID NO: 133072 - RNA, 20 nt, Human
ccagcugagccaaggggaga

SEQ ID NO: 133073 - RNA, 22 nt, Human
auggcugugagcaggcagcuuc

SEQ ID NO: 133074 - RNA, 22 nt, Human
aggugauguccacagcuugcag

SEQ ID NO: 133075 - RNA, 22 nt, Human
ucucaucucggaucagaaguga

SEQ ID NO: 133076 - RNA, 20 nt, Human
ugauauuucuggaaguggag

SEQ ID NO: 133077 - RNA, 22 nt, Human
aguggcugauuacaaacugagu

SEQ ID NO: 133078 - RNA, 21 nt, Human
cuugaaagguagagucuacag

SEQ ID NO: 133079 - RNA, 22 nt, Human
ccugccucaucaacuugucgug

SEQ ID NO: 133080 - RNA, 22 nt, Human
aguuuuaugcaguguucugaua

SEQ ID NO: 133081 - RNA, 22 nt, Human
aaaugaccagaauacaggcuuc

SEQ ID NO: 133082 - RNA, 22 nt, Human
gcagcugcagguggucccaugc

SEQ ID NO: 133083 - RNA, 22 nt, Human
uggcuccuucauucuccugcca

SEQ ID NO: 133084 - RNA, 22 nt, Human
uuuggacuuagccugcagaauu

SEQ ID NO: 133085 - RNA, 22 nt, Human
cugggcugagccugggcugugu

SEQ ID NO: 133086 - RNA, 22 nt, Human
uccagccuaggggaacagcugc

SEQ ID NO: 133087 - RNA, 22 nt, Human
cucuuugccuaacuguuuucaa

SEQ ID NO: 133088 - RNA, 22 nt, Human
ggcugccaggagaagcucagug

SEQ ID NO: 133089 - RNA, 23 nt, Human
cucucucuaccaugugaggacac

SEQ ID NO: 133090 - RNA, 22 nt, Human
cuuguccuuuacuugagacuca

SEQ ID NO: 133091 - RNA, 21 nt, Human
uuagcaguuguugauuuccag

SEQ ID NO: 133092 - RNA, 22 nt, Human
cuuuauguccuugaagaguugu

SEQ ID NO: 133093 - RNA, 22 nt, Human
gcaaggaccuuugagcgugcca

SEQ ID NO: 133094 - RNA, 22 nt, Human
ccacacugaaccucagugucuu

SEQ ID NO: 133095 - RNA, 22 nt, Human
gcauccagagguagccacugug

SEQ ID NO: 133096 - RNA, 18 nt, Human
uuaaguuuuacugcuuua

SEQ ID NO: 133097 - RNA, 23 nt, Human
uagggcagcugggagggacaugc

SEQ ID NO: 133098 - RNA, 22 nt, Human
gucccuggaauggacucugcgc

SEQ ID NO: 133099 - RNA, 17 nt, Human
ugaaggaaggaugaugu

SEQ ID NO: 133100 - RNA, 22 nt, Human
uuucacaucagagguagauuag

SEQ ID NO: 133101 - RNA, 21 nt, Human
aagaagcaauuuauuggaagg

SEQ ID NO: 133102 - RNA, 22 nt, Human
ucuaacuuguauguauaguuuu

SEQ ID NO: 133103 - RNA, 19 nt, Human
cacagggcaggucucaugu

SEQ ID NO: 133104 - RNA, 22 nt, Human
cagaguguuucuuugggugggu

SEQ ID NO: 133105 - RNA, 22 nt, Human
ugcuggaauaauuucauguuaa

SEQ ID NO: 133106 - RNA, 19 nt, Human
ggaagagaggaaaggugga

SEQ ID NO: 133107 - RNA, 23 nt, Human
agcuguguggccuugggcaaguu

SEQ ID NO: 133108 - RNA, 22 nt, Human
uccuggaguauuucuguggugu

SEQ ID NO: 133109 - RNA, 19 nt, Human
ugagagugaggaaggcuuc

SEQ ID NO: 133110 - RNA, 22 nt, Human
ucugucugcucauuuaccucag

SEQ ID NO: 133111 - RNA, 22 nt, Human
cucugugucagcugggugugca

SEQ ID NO: 133112 - RNA, 21 nt, Human
ccuggcuucagggugcacugg

SEQ ID NO: 133113 - RNA, 22 nt, Human
gccaggcuccccggaucccugg

SEQ ID NO: 133114 - RNA, 22 nt, Human
ggagcagagcauuucacagccu

SEQ ID NO: 133115 - RNA, 22 nt, Human
uugaaaguuuauggagucugca

SEQ ID NO: 133116 - RNA, 22 nt, Human
ucuggagaacuugcaagaggau

SEQ ID NO: 133117 - RNA, 22 nt, Human
ucagggcagaauccaaagaauu

SEQ ID NO: 133118 - RNA, 22 nt, Human
cacaagacuuauuuguguagaa

SEQ ID NO: 133119 - RNA, 22 nt, Human
ggcagccauacucagaccuggg

SEQ ID NO: 133120 - RNA, 21 nt, Human
gcugcugccccuagugaggcc

SEQ ID NO: 133121 - RNA, 22 nt, Human
agccuggaggaggaguugagca

SEQ ID NO: 133122 - RNA, 20 nt, Human
gugccuggagaagaggcugu

SEQ ID NO: 133123 - RNA, 22 nt, Human
aggcugggcuccgcccaacucc

SEQ ID NO: 133124 - RNA, 22 nt, Human
uacaggaggauuaucaaaggau

SEQ ID NO: 133125 - RNA, 22 nt, Human
gaggcagcaaaauauaucauaa

SEQ ID NO: 133126 - RNA, 22 nt, Human
aguauguugacuuauucuugga

SEQ ID NO: 133127 - RNA, 23 nt, Human
aguguguauugcugagggcagcu

SEQ ID NO: 133128 - RNA, 22 nt, Human
acauuucucuuagaguuggacu

SEQ ID NO: 133129 - RNA, 22 nt, Human
ggagccugcgggagcucccauu

SEQ ID NO: 133130 - RNA, 22 nt, Human
aguucuucauaaccuuacugug

SEQ ID NO: 133131 - RNA, 22 nt, Human
gugugagccaugauguguccag

SEQ ID NO: 133132 - RNA, 23 nt, Human
uggagaugccccacucccugucu

SEQ ID NO: 133133 - RNA, 22 nt, Human
aggucacacuuggaucauagaa

SEQ ID NO: 133134 - RNA, 22 nt, Human
aagaggaacugggggcugaguc

SEQ ID NO: 133135 - RNA, 22 nt, Human
uauuuccuguggauacuuuuag

SEQ ID NO: 133136 - RNA, 22 nt, Human
uuacauguggagucugauugca

SEQ ID NO: 133137 - RNA, 22 nt, Human
ggccuggcucuugcccagccug

SEQ ID NO: 133138 - RNA, 22 nt, Human
ugccugggaaccaauccuggcu

SEQ ID NO: 133139 - RNA, 22 nt, Human
ugucaugcccaggagcaaggua

SEQ ID NO: 133140 - RNA, 19 nt, Human
augucccaccgccccugag

SEQ ID NO: 133141 - RNA, 19 nt, Human
agcuccugggcucugggcc

SEQ ID NO: 133142 - RNA, 22 nt, Human
gaaucacgguauucugcacggg

SEQ ID NO: 133143 - RNA, 22 nt, Human
gccuggagaaaggaagguggga

SEQ ID NO: 133144 - RNA, 22 nt, Human
gucuggggaagucagggcauca

SEQ ID NO: 133145 - RNA, 22 nt, Human
aguguguccagaaaucuguauu

SEQ ID NO: 133146 - RNA, 22 nt, Human
cagggccaagcugcagcaucug

SEQ ID NO: 133147 - RNA, 22 nt, Human
uagcagcucugauucugggccc

SEQ ID NO: 133148 - RNA, 18 nt, Human
agcuggcccuggcugccg

SEQ ID NO: 133149 - RNA, 20 nt, Human
cuaucuccuggcgugccuuc

SEQ ID NO: 133150 - RNA, 22 nt, Human
ucuuuccauggccacacagucu

SEQ ID NO: 133151 - RNA, 22 nt, Human
ggaguucacugugcaggcucug

SEQ ID NO: 133152 - RNA, 22 nt, Human
guuaucaugcuucaucaucacu

SEQ ID NO: 133153 - RNA, 22 nt, Human
acuuggagagcauugcugggga

SEQ ID NO: 133154 - RNA, 22 nt, Human
ggcugccuccucgagacaggau

SEQ ID NO: 133155 - RNA, 22 nt, Human
gugauuccuauuaguacaugca

SEQ ID NO: 133156 - RNA, 17 nt, Human
gggcagggacuccuggg

SEQ ID NO: 133157 - RNA, 22 nt, Human
uaagcauaacuaaaaaugauuu

SEQ ID NO: 133158 - RNA, 22 nt, Human
uuacaguguuacuugaugucca

SEQ ID NO: 133159 - RNA, 22 nt, Human
uuuccagugauugcugcucuca

SEQ ID NO: 133160 - RNA, 22 nt, Human
uuuguaaaggccugaauuucag

SEQ ID NO: 133161 - RNA, 22 nt, Human
gugccuggcaugcgccggugcu

SEQ ID NO: 133162 - RNA, 20 nt, Human
agugugcauuuagagucugc

SEQ ID NO: 133163 - RNA, 22 nt, Human
ugcucccagggacucuggcugg

SEQ ID NO: 133164 - RNA, 22 nt, Human
gcuggccuccugcuagauggaa

SEQ ID NO: 133165 - RNA, 22 nt, Human
auguguauuacccuuucauucc

SEQ ID NO: 133166 - RNA, 22 nt, Human
gcaaaugaguuguaacauaaaa

SEQ ID NO: 133167 - RNA, 22 nt, Human
ucuuuucuggacucugcaugga

SEQ ID NO: 133168 - RNA, 22 nt, Human
uuuacaguauaguaggacucau

SEQ ID NO: 133169 - RNA, 22 nt, Human
uguacuuccccaaugacagcac

SEQ ID NO: 133170 - RNA, 22 nt, Human
agcaugaagacuucagagcuag

SEQ ID NO: 133171 - RNA, 22 nt, Human
ccaggcagagggauccccaucc

SEQ ID NO: 133172 - RNA, 22 nt, Human
cagacagaccugcaagggcaca

SEQ ID NO: 133173 - RNA, 22 nt, Human
uucuccuuccugguuuucaggc

SEQ ID NO: 133174 - RNA, 22 nt, Human
augagcugggccauccagugau

SEQ ID NO: 133175 - RNA, 18 nt, Human
gggcacuggggacuggag

SEQ ID NO: 133176 - RNA, 22 nt, Human
uuucacagcagaauuucugagg

SEQ ID NO: 133177 - RNA, 22 nt, Human
gagggcagugaauuuugaagcu

SEQ ID NO: 133178 - RNA, 22 nt, Human
ggcagcuggguuggccagaaac

SEQ ID NO: 133179 - RNA, 22 nt, Human
uguggcucggccagcugcugaa

SEQ ID NO: 133180 - RNA, 22 nt, Human
uaaggccaauuaacaaccaggg

SEQ ID NO: 133181 - RNA, 22 nt, Human
ucccagaaaaaggaggcuauga

SEQ ID NO: 133182 - RNA, 19 nt, Human
auagucuuuccaauuauac

SEQ ID NO: 133183 - RNA, 22 nt, Human
caagagcuggguggcaagcuag

SEQ ID NO: 133184 - RNA, 22 nt, Human
uggcucuggauuaaucuaggaa

SEQ ID NO: 133185 - RNA, 22 nt, Human
gcacacccucucaccagcacug

SEQ ID NO: 133186 - RNA, 22 nt, Human
gcagacuguaucaaugucagua

SEQ ID NO: 133187 - RNA, 22 nt, Human
caggagccccaggcugacaaua

SEQ ID NO: 133188 - RNA, 22 nt, Human
uaugcauagguaucuauacuca

SEQ ID NO: 133189 - RNA, 22 nt, Human
uguuuauuacaguucuuggaau

SEQ ID NO: 133190 - RNA, 22 nt, Human
caaagcucaugcucuuagccau

SEQ ID NO: 133191 - RNA, 22 nt, Human
cugggaggcaccgcgucgugcu

SEQ ID NO: 133192 - RNA, 22 nt, Human
aaggccagacaggaccacaucu

SEQ ID NO: 133193 - RNA, 22 nt, Human
ugacacagauuagagacauacc

SEQ ID NO: 133194 - RNA, 22 nt, Human
uaauuucuaauucauuuucagu

SEQ ID NO: 133195 - RNA, 22 nt, Human
aggugagugugacugcaagaga

SEQ ID NO: 133196 - RNA, 22 nt, Human
gucugaggaagaugcaggggga

SEQ ID NO: 133197 - RNA, 22 nt, Human
aggacccagaggcagaggacgu

SEQ ID NO: 133198 - RNA, 22 nt, Human
uccugcaggccuguucccagua

SEQ ID NO: 133199 - RNA, 22 nt, Human
gcugagguggagauugcaguga

SEQ ID NO: 133200 - RNA, 22 nt, Human
agucccagcucagaaccacuag

SEQ ID NO: 133201 - RNA, 22 nt, Human
cuguggcuaugguguacauacu

SEQ ID NO: 133202 - RNA, 22 nt, Human
gcuggcuguuggagguaccugc

SEQ ID NO: 133203 - RNA, 22 nt, Human
gagcagugaagacagaaguaca

SEQ ID NO: 133204 - RNA, 22 nt, Human
agauuucagguuggggcagaag

SEQ ID NO: 133205 - RNA, 22 nt, Human
ggagccuguggccgucacgacu

SEQ ID NO: 133206 - RNA, 22 nt, Human
ccugugcccucagccuggcucu

SEQ ID NO: 133207 - RNA, 22 nt, Human
uacauuugcuuugauuuucagc

SEQ ID NO: 133208 - RNA, 19 nt, Human
gggcuuggggcugaagccu

SEQ ID NO: 133209 - RNA, 22 nt, Human
cgaugguucuggcugcuuguau

SEQ ID NO: 133210 - RNA, 22 nt, Human
cucaggauggaagccuacagga

SEQ ID NO: 133211 - RNA, 22 nt, Human
uaguauauuaauucucacgguu

SEQ ID NO: 133212 - RNA, 22 nt, Human
uucaagaucuggguuuucagcu

SEQ ID NO: 133213 - RNA, 22 nt, Human
guguguguguaaaaauccagag

SEQ ID NO: 133214 - RNA, 22 nt, Human
ccagcucuggcuucuugcuggg

SEQ ID NO: 133215 - RNA, 22 nt, Human
caggggcuagcacuuaauguuu

SEQ ID NO: 133216 - RNA, 18 nt, Human
uuccaugauuccuuucac

SEQ ID NO: 133217 - RNA, 22 nt, Human
guuuguguaacaugaugaugau

SEQ ID NO: 133218 - RNA, 22 nt, Human
ggugucccaggccagcugugug

SEQ ID NO: 133219 - RNA, 22 nt, Human
cagcucccgccaucgggaggca

SEQ ID NO: 133220 - RNA, 22 nt, Human
caaggccacugcucagguuucc

SEQ ID NO: 133221 - RNA, 22 nt, Human
auguggcugucacagcauaaug

SEQ ID NO: 133222 - RNA, 22 nt, Human
ccugcugggccugagcaaugag

SEQ ID NO: 133223 - RNA, 22 nt, Human
aguuugaaauguuggcaauauu

SEQ ID NO: 133224 - RNA, 22 nt, Human
aggucauuuuugccuucuauuu

SEQ ID NO: 133225 - RNA, 20 nt, Human
gucagaggacccuagagcga

SEQ ID NO: 133226 - RNA, 23 nt, Human
uccuuccuuugagaggcuccauc

SEQ ID NO: 133227 - RNA, 22 nt, Human
auugaaagauaggcuacugugg

SEQ ID NO: 133228 - RNA, 22 nt, Human
guccagggcuaaaucagguucc

SEQ ID NO: 133229 - RNA, 22 nt, Human
ugccuggguccaggccaagccu

SEQ ID NO: 133230 - RNA, 22 nt, Human
ugccugaggagucagggcaggu

SEQ ID NO: 133231 - RNA, 22 nt, Human
ucauacaucuguccuggagcuc

SEQ ID NO: 133232 - RNA, 22 nt, Human
augucuuucucacagccaguuc

SEQ ID NO: 133233 - RNA, 22 nt, Human
gccuccugagaagccacaggcu

SEQ ID NO: 133234 - RNA, 22 nt, Human
uagucuuuuuaauaaauaaugc

SEQ ID NO: 133235 - RNA, 22 nt, Human
cagugcuccugauguacccuug

SEQ ID NO: 133236 - RNA, 22 nt, Human
ccucccuuggccauagccagcc

SEQ ID NO: 133237 - RNA, 22 nt, Human
cauugcccaguaggaucaccag

SEQ ID NO: 133238 - RNA, 22 nt, Human
gcugugugacugagagccuggc

SEQ ID NO: 133239 - RNA, 22 nt, Human
aucuguguguucaggaaguccu

SEQ ID NO: 133240 - RNA, 22 nt, Human
gcccagcacuaaaagcuuugcu

SEQ ID NO: 133241 - RNA, 22 nt, Human
cccugggcagucugcacuucag

SEQ ID NO: 133242 - RNA, 21 nt, Human
agcuuccugcagugggagguc

SEQ ID NO: 133243 - RNA, 22 nt, Human
cuggcucuaucuccaaggcugg

SEQ ID NO: 133244 - RNA, 22 nt, Human
uggugaagucagcggagcccgg

SEQ ID NO: 133245 - RNA, 22 nt, Human
agguaggguuaauggagauaua

SEQ ID NO: 133246 - RNA, 22 nt, Human
cauuuucucaaugaacccucuu

SEQ ID NO: 133247 - RNA, 22 nt, Human
aguguuccacacaucuggggaa

SEQ ID NO: 133248 - RNA, 22 nt, Human
gccuguccuggaugcucugcaa

SEQ ID NO: 133249 - RNA, 22 nt, Human
gcgugugugauaugccucugca

SEQ ID NO: 133250 - RNA, 22 nt, Human
cugugugcugaaaugcagugag

SEQ ID NO: 133251 - RNA, 22 nt, Human
caccuggcuggaagugcuccgg

SEQ ID NO: 133252 - RNA, 22 nt, Human
aguuuauuguauaugguaguuu

SEQ ID NO: 133253 - RNA, 22 nt, Human
gcugggcuugguuucccugcuu

SEQ ID NO: 133254 - RNA, 22 nt, Human
guguggcugaaaucaaggcagg

SEQ ID NO: 133255 - RNA, 22 nt, Human
ccaggcuggauuuugcaguuca

SEQ ID NO: 133256 - RNA, 22 nt, Human
cagucucucugaaguauuaaga

SEQ ID NO: 133257 - RNA, 19 nt, Human
ugaguucugugguucucaa

SEQ ID NO: 133258 - RNA, 22 nt, Human
guggccuggaguuugauguagg

SEQ ID NO: 133259 - RNA, 22 nt, Human
aguggggaagagcaugggcccu

SEQ ID NO: 133260 - RNA, 22 nt, Human
ucuggccagugaaaugcagaau

SEQ ID NO: 133261 - RNA, 22 nt, Human
cuauauuuggugagggaugucu

SEQ ID NO: 133262 - RNA, 22 nt, Human
agccuggaggccaggagacagu

SEQ ID NO: 133263 - RNA, 22 nt, Human
gagagaagaaagccaugguccu

SEQ ID NO: 133264 - RNA, 22 nt, Human
aggcugcuucagcugcagggag

SEQ ID NO: 133265 - RNA, 22 nt, Human
ggaaagaccugagauaggaaua

SEQ ID NO: 133266 - RNA, 19 nt, Human
ucaucucacagggccuggc

SEQ ID NO: 133267 - RNA, 22 nt, Human
cauaauaucuccgauuacuugc

SEQ ID NO: 133268 - RNA, 21 nt, Human
agcagcagaucuggugagggc

SEQ ID NO: 133269 - RNA, 22 nt, Human
gggcagcucucacagcagccaa

SEQ ID NO: 133270 - RNA, 22 nt, Human
aaggcacugacugugcagggga

SEQ ID NO: 133271 - RNA, 22 nt, Human
cucucugaggaaggagcaucug

SEQ ID NO: 133272 - RNA, 22 nt, Human
cccuccagcucaaagcaaccgg

SEQ ID NO: 133273 - RNA, 22 nt, Human
gaaggcuugcagcucuguggca

SEQ ID NO: 133274 - RNA, 23 nt, Human
uccuucagagccucccuccaagc

SEQ ID NO: 133275 - RNA, 22 nt, Human
gcucaggaucccaggggugugc

SEQ ID NO: 133276 - RNA, 22 nt, Human
cagcugaguuuccaagucugcc

SEQ ID NO: 133277 - RNA, 22 nt, Human
cucuuuccucagccacagucua

SEQ ID NO: 133278 - RNA, 22 nt, Human
aucagcaaguccuguuaauucu

SEQ ID NO: 133279 - RNA, 22 nt, Human
aggccagguggucaugcuugcu

SEQ ID NO: 133280 - RNA, 22 nt, Human
aaggcugaguaaaacagagaac

SEQ ID NO: 133281 - RNA, 22 nt, Human
aaaucuaggcucauccuggucc

SEQ ID NO: 133282 - RNA, 22 nt, Human
cuggagcuaauaauccaucuga

SEQ ID NO: 133283 - RNA, 22 nt, Human
cugcagagcuaggcugagugaa

SEQ ID NO: 133284 - RNA, 22 nt, Human
agggggcaggagagaccugcug

SEQ ID NO: 133285 - RNA, 17 nt, Human
gaacuuuuauuaaauuc

SEQ ID NO: 133286 - RNA, 22 nt, Human
cagugccucuuaagugucaccc

SEQ ID NO: 133287 - RNA, 21 nt, Human
gucagcagauccagcacuugu

SEQ ID NO: 133288 - RNA, 22 nt, Human
gcugccacauuuucaggacuaa

SEQ ID NO: 133289 - RNA, 22 nt, Human
cagacacagauaugcauauggc

SEQ ID NO: 133290 - RNA, 23 nt, Human
uuacagcuaacugcuguuauuag

SEQ ID NO: 133291 - RNA, 18 nt, Human
aaugcacacauuuacucc

SEQ ID NO: 133292 - RNA, 21 nt, Human
ugccagggauuuacagagccu

SEQ ID NO: 133293 - RNA, 22 nt, Human
agccaagcacucaacuccugga

SEQ ID NO: 133294 - RNA, 22 nt, Human
aggcacugagaggcuguguugc

SEQ ID NO: 133295 - RNA, 22 nt, Human
ugguccagacauuucugaggua

SEQ ID NO: 133296 - RNA, 22 nt, Human
gggacuguaaauucauauggcc

SEQ ID NO: 133297 - RNA, 19 nt, Human
ugccuggcaccagcuccac

SEQ ID NO: 133298 - RNA, 22 nt, Human
aaaugcuguaacugauauucug

SEQ ID NO: 133299 - RNA, 22 nt, Human
gccugugcuuaacugacgugag

SEQ ID NO: 133300 - RNA, 22 nt, Human
guuugcauaaaguggaugcagg

SEQ ID NO: 133301 - RNA, 19 nt, Human
uguguguauuucaguucuu

SEQ ID NO: 133302 - RNA, 22 nt, Human
gguuggaggugggaauagcuag

SEQ ID NO: 133303 - RNA, 22 nt, Human
uucuucaugcuguugcugcuug

SEQ ID NO: 133304 - RNA, 22 nt, Human
cagggugggcacccagccucca

SEQ ID NO: 133305 - RNA, 22 nt, Human
cuuuacaggaaaagguggcugu

SEQ ID NO: 133306 - RNA, 22 nt, Human
uauacaguuugaguucuugcau

SEQ ID NO: 133307 - RNA, 22 nt, Human
acagaggccccgugggagagcc

SEQ ID NO: 133308 - RNA, 22 nt, Human
guguccagagaaacucacagcu

SEQ ID NO: 133309 - RNA, 22 nt, Human
gcagggugugucucauacaguu

SEQ ID NO: 133310 - RNA, 22 nt, Human
ucuucagacccuuagcugugau

SEQ ID NO: 133311 - RNA, 22 nt, Human
cugggcacacagugacucugca

SEQ ID NO: 133312 - RNA, 22 nt, Human
gaggaguggaguugcuggguug

SEQ ID NO: 133313 - RNA, 22 nt, Human
gucaggaugcuauuguuauuaa

SEQ ID NO: 133314 - RNA, 21 nt, Human
auuaacuuguuaaccuaaagu

SEQ ID NO: 133315 - RNA, 22 nt, Human
acucucagaggguggcagcaau

SEQ ID NO: 133316 - RNA, 22 nt, Human
agcucccagcagagcuggccac

SEQ ID NO: 133317 - RNA, 22 nt, Human
cacagggcagagaccugggugc

SEQ ID NO: 133318 - RNA, 22 nt, Human
aaguuacuggcaagggcugcag

SEQ ID NO: 133319 - RNA, 19 nt, Human
gcucugagaggggcauggg

SEQ ID NO: 133320 - RNA, 22 nt, Human
uuucuucuguuuguaguuacac

SEQ ID NO: 133321 - RNA, 22 nt, Human
aguuuaugaaacacagauuuga

SEQ ID NO: 133322 - RNA, 22 nt, Human
ggggcuggcucacuaagagacu

SEQ ID NO: 133323 - RNA, 22 nt, Human
cagcagcagccccaggaagguu

SEQ ID NO: 133324 - RNA, 22 nt, Human
uugagggucuggaucugcugcu

SEQ ID NO: 133325 - RNA, 20 nt, Human
ugcuugucaugcacucaggc

SEQ ID NO: 133326 - RNA, 22 nt, Human
aaaucuggccccuugccuauuu

SEQ ID NO: 133327 - RNA, 22 nt, Human
gagugguaggcaguguuaggaa

SEQ ID NO: 133328 - RNA, 22 nt, Human
cucccaagggguaagggagcug

SEQ ID NO: 133329 - RNA, 21 nt, Human
ugcuggccucaagggugacuu

SEQ ID NO: 133330 - RNA, 22 nt, Human
ugaguaauaaacugucuugcuc

SEQ ID NO: 133331 - RNA, 22 nt, Human
guaugugugcaaauguaaauau

SEQ ID NO: 133332 - RNA, 22 nt, Human
ggugggcaacauuuggccugag

SEQ ID NO: 133333 - RNA, 18 nt, Human
guaggucaguaccaagca

SEQ ID NO: 133334 - RNA, 22 nt, Human
acauacuaugaauacauguguc

SEQ ID NO: 133335 - RNA, 22 nt, Human
gggaggugauggcaagcagcgg

SEQ ID NO: 133336 - RNA, 22 nt, Human
ccugggcaucucaugcaccugc

SEQ ID NO: 133337 - RNA, 22 nt, Human
ucucaccauggugcuugcuuau

SEQ ID NO: 133338 - RNA, 22 nt, Human
cagcaggauuugaaaggaagag

SEQ ID NO: 133339 - RNA, 22 nt, Human
ggggcagaaguagugccccuga

SEQ ID NO: 133340 - RNA, 23 nt, Human
agccucuuuucuccugcccugca

SEQ ID NO: 133341 - RNA, 18 nt, Human
uggcagcaggaagccauu

SEQ ID NO: 133342 - RNA, 21 nt, Human
ucauuugugaucugauuucca

SEQ ID NO: 133343 - RNA, 22 nt, Human
cauggcagagaaggggaacugg

SEQ ID NO: 133344 - RNA, 22 nt, Human
uagcugcugcagcacagggagg

SEQ ID NO: 133345 - RNA, 22 nt, Human
uggcuccuaucaaggagugggu

SEQ ID NO: 133346 - RNA, 22 nt, Human
gcucccucugcucaggcacuug

SEQ ID NO: 133347 - RNA, 22 nt, Human
cagucucagaggugggaguggg

SEQ ID NO: 133348 - RNA, 22 nt, Human
aggccugaaguguggagugggg

SEQ ID NO: 133349 - RNA, 22 nt, Human
ucagagccccuccgcuguccca

SEQ ID NO: 133350 - RNA, 18 nt, Human
acugugugaauuagcucc

SEQ ID NO: 133351 - RNA, 21 nt, Human
agagaauugccuuagauguuc

SEQ ID NO: 133352 - RNA, 22 nt, Human
gccugucugcgucacgcuuauu

SEQ ID NO: 133353 - RNA, 22 nt, Human
uggguggaauaaaucaguucug

SEQ ID NO: 133354 - RNA, 22 nt, Human
cucaggauguacuacagaaggc

SEQ ID NO: 133355 - RNA, 22 nt, Human
ugcuggcccuggcucagggaac

SEQ ID NO: 133356 - RNA, 22 nt, Human
gcucucugccauaugaggauac

SEQ ID NO: 133357 - RNA, 22 nt, Human
cucucaggcuugggucguggca

SEQ ID NO: 133358 - RNA, 22 nt, Human
gaggggcucuugggcaugaagg

SEQ ID NO: 133359 - RNA, 22 nt, Human
ugggcagaggcucugaagucca

SEQ ID NO: 133360 - RNA, 22 nt, Human
aaggagaguacaggaguuggua

SEQ ID NO: 133361 - RNA, 22 nt, Human
aggagcugcauggauaccuggu

SEQ ID NO: 133362 - RNA, 22 nt, Human
ugcccuguuccugccuccagcu

SEQ ID NO: 133363 - RNA, 22 nt, Human
aguggcaggcggagauguagga

SEQ ID NO: 133364 - RNA, 22 nt, Human
cagcuugggucaggugccugcu

SEQ ID NO: 133365 - RNA, 22 nt, Human
caguuucuuaucuucaaaauug

SEQ ID NO: 133366 - RNA, 22 nt, Human
gagcugucucuauaugaaugcu

SEQ ID NO: 133367 - RNA, 22 nt, Human
aggggaggagcuuuucuugccu

SEQ ID NO: 133368 - RNA, 22 nt, Human
ccugggugucaugggcagcugg

SEQ ID NO: 133369 - RNA, 22 nt, Human
ucugucugcaccuaagcacagu

SEQ ID NO: 133370 - RNA, 22 nt, Human
cacagggccuugugugacugca

SEQ ID NO: 133371 - RNA, 22 nt, Human
uucuggagaucugccuauggga

SEQ ID NO: 133372 - RNA, 22 nt, Human
uuagcaguucauugauuaucgu

SEQ ID NO: 133373 - RNA, 22 nt, Human
gggcguggauggucagugcagg

SEQ ID NO: 133374 - RNA, 22 nt, Human
caggugggcuugggagaacacu

SEQ ID NO: 133375 - RNA, 22 nt, Human
gccuucagcggccgcucgcugc

SEQ ID NO: 133376 - RNA, 22 nt, Human
cuuccuggccauugccauggca

SEQ ID NO: 133377 - RNA, 22 nt, Human
gcugucagaaggugaaggguaa

SEQ ID NO: 133378 - RNA, 22 nt, Human
caugucuguguacacaugcaca

SEQ ID NO: 133379 - RNA, 20 nt, Human
acuggagccaucucagccua

SEQ ID NO: 133380 - RNA, 22 nt, Human
ucccacucccaggcaggccucu

SEQ ID NO: 133381 - RNA, 16 nt, Human
auuuccagauuaugca

SEQ ID NO: 133382 - RNA, 22 nt, Human
gcugauccuuuuaugucuagcu

SEQ ID NO: 133383 - RNA, 22 nt, Human
uucaagaucuuccaaaggauac

SEQ ID NO: 133384 - RNA, 22 nt, Human
auuauguaacugugguucagca

SEQ ID NO: 133385 - RNA, 22 nt, Human
ggagggcucaauugacuccuga

SEQ ID NO: 133386 - RNA, 22 nt, Human
ccuccagcugccucagucucuu

SEQ ID NO: 133387 - RNA, 22 nt, Human
cuuuacagcuuagugguaugga

SEQ ID NO: 133388 - RNA, 22 nt, Human
ggucucagaucuuuauuaaggc

SEQ ID NO: 133389 - RNA, 22 nt, Human
guguggcugugggagauguuca

SEQ ID NO: 133390 - RNA, 22 nt, Human
ugagcuggucacuccuucugaa

SEQ ID NO: 133391 - RNA, 22 nt, Human
caaggccauauugccuguaugu

SEQ ID NO: 133392 - RNA, 22 nt, Human
aaauaauuauagcgagucuauc

SEQ ID NO: 133393 - RNA, 22 nt, Human
uggcucugcaccucaguguacc

SEQ ID NO: 133394 - RNA, 22 nt, Human
uuguguguagacucagccauug

SEQ ID NO: 133395 - RNA, 22 nt, Human
aguggcugucuuccaaaaucug

SEQ ID NO: 133396 - RNA, 22 nt, Human
cugggcacaaguggcccuggau

SEQ ID NO: 133397 - RNA, 22 nt, Human
aggagccaugagugacaucaca

SEQ ID NO: 133398 - RNA, 22 nt, Human
guguacauagaauugugcuuug

SEQ ID NO: 133399 - RNA, 22 nt, Human
cagcaauaguguguuuguuuca

SEQ ID NO: 133400 - RNA, 23 nt, Human
gccaggcuccggucuguggccac

SEQ ID NO: 133401 - RNA, 22 nt, Human
aaaugcauuuuuaauuagaccc

SEQ ID NO: 133402 - RNA, 22 nt, Human
agucccagaucuccauucgguc

SEQ ID NO: 133403 - RNA, 22 nt, Human
uuuccucuccggggccuccagg

SEQ ID NO: 133404 - RNA, 22 nt, Human
agccuucaguaaauccacugug

SEQ ID NO: 133405 - RNA, 22 nt, Human
aguggcugcuucugguugcucc

SEQ ID NO: 133406 - RNA, 22 nt, Human
ggagcagagcugggcuuggcug

SEQ ID NO: 133407 - RNA, 22 nt, Human
ucagaagagcuggugcugccug

SEQ ID NO: 133408 - RNA, 19 nt, Human
ggcuccuguggcugcagcc

SEQ ID NO: 133409 - RNA, 22 nt, Human
gcugagcugggacaguccuggg

SEQ ID NO: 133410 - RNA, 20 nt, Human
uauuuagauucaaguaugga

SEQ ID NO: 133411 - RNA, 22 nt, Human
uagcuaucuguguccagaucca

SEQ ID NO: 133412 - RNA, 22 nt, Human
gagcugccagacaugggaauga

SEQ ID NO: 133413 - RNA, 22 nt, Human
ugaagcagcaaaugaugggaga

SEQ ID NO: 133414 - RNA, 18 nt, Human
auguuucucuuggcucug

SEQ ID NO: 133415 - RNA, 22 nt, Human
ucccagccauuccuuuaggugu

SEQ ID NO: 133416 - RNA, 22 nt, Human
cugugcugcagacgcaguagcu

SEQ ID NO: 133417 - RNA, 22 nt, Human
ugggaauggaugcuaagugcua

SEQ ID NO: 133418 - RNA, 22 nt, Human
agcuggagaauguggaugaucc

SEQ ID NO: 133419 - RNA, 22 nt, Human
gcagcugguuaaugggagaauu

SEQ ID NO: 133420 - RNA, 22 nt, Human
ggccuuggugcucuguguugca

SEQ ID NO: 133421 - RNA, 22 nt, Human
aguguguacauaauuguacgcc

SEQ ID NO: 133422 - RNA, 22 nt, Human
cccaggcagucuggcucuaaag

SEQ ID NO: 133423 - RNA, 22 nt, Human
uuauccuggauuauauauguga

SEQ ID NO: 133424 - RNA, 22 nt, Human
ugccagugggugugcagagacu

SEQ ID NO: 133425 - RNA, 22 nt, Human
uuuuucaagacaaccugcaugu

SEQ ID NO: 133426 - RNA, 22 nt, Human
ucuuugcagaauuuaacuuugc

SEQ ID NO: 133427 - RNA, 22 nt, Human
uguccucuuccagugcuccuuc

SEQ ID NO: 133428 - RNA, 22 nt, Human
cuggagagaccgaaagaggcug

SEQ ID NO: 133429 - RNA, 22 nt, Human
ccucccaccguaucucaguggc

SEQ ID NO: 133430 - RNA, 22 nt, Human
gaggccugcagcguggucccug

SEQ ID NO: 133431 - RNA, 22 nt, Human
cuuuagcaacgaugaugauauu

SEQ ID NO: 133432 - RNA, 22 nt, Human
ccccaccugugcgucugccgca

SEQ ID NO: 133433 - RNA, 22 nt, Human
uggcucugucgccguuuggaau

SEQ ID NO: 133434 - RNA, 22 nt, Human
ucagcugccucucccuggaaga

SEQ ID NO: 133435 - RNA, 22 nt, Human
gaucuucucuuuaguagaaaca

SEQ ID NO: 133436 - RNA, 22 nt, Human
acuggcaguggcagcagaaaga

SEQ ID NO: 133437 - RNA, 22 nt, Human
uccaagggcagccauagaacuu

SEQ ID NO: 133438 - RNA, 22 nt, Human
ugccagcacaaguuaagagauc

SEQ ID NO: 133439 - RNA, 22 nt, Human
cacugcauggaugauggcugua

SEQ ID NO: 133440 - RNA, 23 nt, Human
gccugccugaccugugcaaaguc

SEQ ID NO: 133441 - RNA, 22 nt, Human
agugaaauuuguuuagauaggu

SEQ ID NO: 133442 - RNA, 22 nt, Human
uuugcagucuggccugcuuugg

SEQ ID NO: 133443 - RNA, 22 nt, Human
cugaggaugguguggucuucuc

SEQ ID NO: 133444 - RNA, 22 nt, Human
ggcagcuggccuccucgcccac

SEQ ID NO: 133445 - RNA, 22 nt, Human
cccagcacaggcaauuccauac

SEQ ID NO: 133446 - RNA, 22 nt, Human
cucucuggcuuggcacggagau

SEQ ID NO: 133447 - RNA, 22 nt, Human
acaguguagaauccuguacuua

SEQ ID NO: 133448 - RNA, 22 nt, Human
uaaugcacaugacugaacuauu

SEQ ID NO: 133449 - RNA, 22 nt, Human
cuguggcuguauuuggccagag

SEQ ID NO: 133450 - RNA, 22 nt, Human
cucucugggggccaugccaaga

SEQ ID NO: 133451 - RNA, 22 nt, Human
cagccccucccucaggcaggug

SEQ ID NO: 133452 - RNA, 22 nt, Human
agacaggacacaagcugcauaa

SEQ ID NO: 133453 - RNA, 22 nt, Human
gucuucaacaauaacuaccacu

SEQ ID NO: 133454 - RNA, 22 nt, Human
guugggaaggcaagaaguagaa

SEQ ID NO: 133455 - RNA, 22 nt, Human
cugcugcauuccucuuuaugag

SEQ ID NO: 133456 - RNA, 22 nt, Human
accuggcaugaagcaugccuua

SEQ ID NO: 133457 - RNA, 22 nt, Human
aguaacaagugccaacguuaga

SEQ ID NO: 133458 - RNA, 22 nt, Human
uaauuuuccacucuguuuaucu

SEQ ID NO: 133459 - RNA, 22 nt, Human
gcuuuacagagaaaguuugccu

SEQ ID NO: 133460 - RNA, 22 nt, Human
cccauuuaucccaagguuacuc

SEQ ID NO: 133461 - RNA, 22 nt, Human
ccaggggcuggugcugagcugg

SEQ ID NO: 133462 - RNA, 22 nt, Human
agccuguccagaggacagggcu

SEQ ID NO: 133463 - RNA, 22 nt, Human
acccaggccugagagacaggag

SEQ ID NO: 133464 - RNA, 22 nt, Human
ucacugcucucuaagcaucgcc

SEQ ID NO: 133465 - RNA, 22 nt, Human
aggcucagcaucugauucauau

SEQ ID NO: 133466 - RNA, 22 nt, Human
gagccagcugagcugcacuguc

SEQ ID NO: 133467 - RNA, 22 nt, Human
ccagccuggacugggucuugug

SEQ ID NO: 133468 - RNA, 22 nt, Human
uucuuucugaauacaguugagu

SEQ ID NO: 133469 - RNA, 22 nt, Human
caggccugacccugagcuucac

SEQ ID NO: 133470 - RNA, 22 nt, Human
cagcaggacccaggaauccugc

SEQ ID NO: 133471 - RNA, 22 nt, Human
cagaaauguucuaaugauucag

SEQ ID NO: 133472 - RNA, 22 nt, Human
ccuucuucuguguggcccaaga

SEQ ID NO: 133473 - RNA, 22 nt, Human
uccauuuucaucucauguauaa

SEQ ID NO: 133474 - RNA, 22 nt, Human
ggcccugggaugcucagcagug

SEQ ID NO: 133475 - RNA, 22 nt, Human
uggcaguggcuuugcuggugga

SEQ ID NO: 133476 - RNA, 22 nt, Human
cacagaauaaauugguaucaga

SEQ ID NO: 133477 - RNA, 22 nt, Human
gagacugauggggcucccagaa

SEQ ID NO: 133478 - RNA, 22 nt, Human
uaauuccaaguugagacaugca

SEQ ID NO: 133479 - RNA, 22 nt, Human
acugucucucuagcaguucagg

SEQ ID NO: 133480 - RNA, 22 nt, Human
uagagcuggaauuugcagcaag

SEQ ID NO: 133481 - RNA, 22 nt, Human
uuuacacugccauucugaauac

SEQ ID NO: 133482 - RNA, 22 nt, Human
aagagcuggcccaaucugagca

SEQ ID NO: 133483 - RNA, 22 nt, Human
ucagacaguuugcagugugccu

SEQ ID NO: 133484 - RNA, 22 nt, Human
uugcaaaagccgaggcacucca

SEQ ID NO: 133485 - RNA, 22 nt, Human
cugggacacccaaggaaagagc

SEQ ID NO: 133486 - RNA, 22 nt, Human
guggagacgggacagaagcuaa

SEQ ID NO: 133487 - RNA, 22 nt, Human
ucucuguacaguacaugccgug

SEQ ID NO: 133488 - RNA, 22 nt, Human
cucuccagaucugcugagccag

SEQ ID NO: 133489 - RNA, 22 nt, Human
acuguuuucuuagcucccugcu

SEQ ID NO: 133490 - RNA, 22 nt, Human
uagagcugauaaugaggccaag

SEQ ID NO: 133491 - RNA, 23 nt, Human
uggcuggcagaaacugaagcaug

SEQ ID NO: 133492 - RNA, 22 nt, Human
auucauuuagguauucacuuac

SEQ ID NO: 133493 - RNA, 22 nt, Human
cacuggcaugugaggcgguggc

SEQ ID NO: 133494 - RNA, 18 nt, Human
uggcucagauggcuuuaa

SEQ ID NO: 133495 - RNA, 22 nt, Human
cagagggcucuuggcugccugc

SEQ ID NO: 133496 - RNA, 22 nt, Human
auucuucaucagagaugcacua

SEQ ID NO: 133497 - RNA, 22 nt, Human
uuuuaaucaugcuucuaugucc

SEQ ID NO: 133498 - RNA, 20 nt, Human
gugugaagcccucaggagga

SEQ ID NO: 133499 - RNA, 22 nt, Human
uucugggagagaaagggccuug

SEQ ID NO: 133500 - RNA, 22 nt, Human
gggagcugagggaccucugugg

SEQ ID NO: 133501 - RNA, 22 nt, Human
cgagaguggacagggcgcagcu

SEQ ID NO: 133502 - RNA, 22 nt, Human
ucucaggacuuugggaagcuca

SEQ ID NO: 133503 - RNA, 21 nt, Human
ucuuguccuugcucucccacu

SEQ ID NO: 133504 - RNA, 22 nt, Human
gggcuggaggugagcaggacag

SEQ ID NO: 133505 - RNA, 22 nt, Human
aaaaucugcuuccuuuuacaga

SEQ ID NO: 133506 - RNA, 21 nt, Human
gggagcuggaaacugggugac

SEQ ID NO: 133507 - RNA, 22 nt, Human
ccuuuacaguagcccuuuugaa

SEQ ID NO: 133508 - RNA, 22 nt, Human
ugaaaucuucacuaagucucuu

SEQ ID NO: 133509 - RNA, 22 nt, Human
acagaaauugggcaaauggaag

SEQ ID NO: 133510 - RNA, 22 nt, Human
ggugcucaagagggcauccucu

SEQ ID NO: 133511 - RNA, 22 nt, Human
gugguuguuuaggucguggauc

SEQ ID NO: 133512 - RNA, 22 nt, Human
ggcugcaguuugucuuuugcuu

SEQ ID NO: 133513 - RNA, 22 nt, Human
agaggcuggauugagcauagac

SEQ ID NO: 133514 - RNA, 22 nt, Human
augcucuggaguacgugaaauu

SEQ ID NO: 133515 - RNA, 20 nt, Human
cccugcagccaugggagugg

SEQ ID NO: 133516 - RNA, 20 nt, Human
cuucuucagccuaugcuuca

SEQ ID NO: 133517 - RNA, 22 nt, Human
uaaauuguuuucuagaaguugu

SEQ ID NO: 133518 - RNA, 22 nt, Human
uagcugccagaccauucuuacu

SEQ ID NO: 133519 - RNA, 22 nt, Human
guuacagugcauguggcuucug

SEQ ID NO: 133520 - RNA, 23 nt, Human
uuuauauuccuaaugucuugagc

SEQ ID NO: 133521 - RNA, 22 nt, Human
gaucuucuagcagaaguaauuu

SEQ ID NO: 133522 - RNA, 22 nt, Human
uguacauagaucuugaaaauua

SEQ ID NO: 133523 - RNA, 22 nt, Human
gggcagccucggugccugcugc

SEQ ID NO: 133524 - RNA, 22 nt, Human
ccagcagacacacaggcguggg

SEQ ID NO: 133525 - RNA, 22 nt, Human
aaagacugguguguuacauaua

SEQ ID NO: 133526 - RNA, 22 nt, Human
ugucccaggccucauguugcca

SEQ ID NO: 133527 - RNA, 22 nt, Human
ugcuggcugggcugcuggagac

SEQ ID NO: 133528 - RNA, 22 nt, Human
caagauggagaagcagcaaggg

SEQ ID NO: 133529 - RNA, 19 nt, Human
ggaaacaggggccagagga

SEQ ID NO: 133530 - RNA, 22 nt, Human
cugcccagaagcuuagagcuua

SEQ ID NO: 133531 - RNA, 22 nt, Human
caaaagauacuugcaucuaacu

SEQ ID NO: 133532 - RNA, 22 nt, Human
cagagggagcccuccaggagca

SEQ ID NO: 133533 - RNA, 22 nt, Human
uuucauguuuucuuaaauggca

SEQ ID NO: 133534 - RNA, 22 nt, Human
cacuuaagcaguuaauuuaucu

SEQ ID NO: 133535 - RNA, 22 nt, Human
ucagucuuugcuuaugacaaua

SEQ ID NO: 133536 - RNA, 22 nt, Human
auaaggcagaaaugauucuagu

SEQ ID NO: 133537 - RNA, 22 nt, Human
ugaggccagucucaucacaggc

SEQ ID NO: 133538 - RNA, 22 nt, Human
uuugcaauuugugcugcaaaug

SEQ ID NO: 133539 - RNA, 22 nt, Human
guuuuguugcugcagagcucaa

SEQ ID NO: 133540 - RNA, 22 nt, Human
uggagcugggaguccugggcug

SEQ ID NO: 133541 - RNA, 22 nt, Human
cccugagagugagugccaccuu

SEQ ID NO: 133542 - RNA, 22 nt, Human
uccagccaugcaugacaaucac

SEQ ID NO: 133543 - RNA, 22 nt, Human
auuguucuguagugacauguag

SEQ ID NO: 133544 - RNA, 22 nt, Human
ugggcagacuaaggucaaagcu

SEQ ID NO: 133545 - RNA, 22 nt, Human
uucucccugguauuuacuuagu

SEQ ID NO: 133546 - RNA, 22 nt, Human
gcuggcuguaucaccuggccag

SEQ ID NO: 133547 - RNA, 22 nt, Human
uggcucagugaagagauaacuu

SEQ ID NO: 133548 - RNA, 22 nt, Human
acaggcugcugagccauuugcu

SEQ ID NO: 133549 - RNA, 22 nt, Human
cugugucuucacauuugugugc

SEQ ID NO: 133550 - RNA, 22 nt, Human
uugaggagucaggggcacggaa

SEQ ID NO: 133551 - RNA, 22 nt, Human
cuucuccucugaguccugggag

SEQ ID NO: 133552 - RNA, 22 nt, Human
agaagcagacucugaggcaagg

SEQ ID NO: 133553 - RNA, 22 nt, Human
aucaguuuaacugucaagagcc

SEQ ID NO: 133554 - RNA, 22 nt, Human
agcugcuacugcucugccagag

SEQ ID NO: 133555 - RNA, 22 nt, Human
agccagaggccagccugccuca

SEQ ID NO: 133556 - RNA, 22 nt, Human
aacaguauggaagccauuagga

SEQ ID NO: 133557 - RNA, 22 nt, Human
auguguauuuauuuggggcuua

SEQ ID NO: 133558 - RNA, 22 nt, Human
aauguauaaaguguuaauaacu

SEQ ID NO: 133559 - RNA, 22 nt, Human
gccuggugaaaggcagagagcg

SEQ ID NO: 133560 - RNA, 22 nt, Human
cggggacacacuggcagcuccu

SEQ ID NO: 133561 - RNA, 20 nt, Human
ccacaggaguccagucgacc

SEQ ID NO: 133562 - RNA, 20 nt, Human
uagauuucauacuucucuuu

SEQ ID NO: 133563 - RNA, 22 nt, Human
cuggagccggcgagccccagcc

SEQ ID NO: 133564 - RNA, 22 nt, Human
uagccucuggaauccuuucucu

SEQ ID NO: 133565 - RNA, 22 nt, Human
agaggccggccgagcccauggg

SEQ ID NO: 133566 - RNA, 22 nt, Human
gcagagcucaagguguucagcu

SEQ ID NO: 133567 - RNA, 22 nt, Human
auucuucauaccuacugagguu

SEQ ID NO: 133568 - RNA, 22 nt, Human
uggcccugacuuggaggccuga

SEQ ID NO: 133569 - RNA, 22 nt, Human
uuuagcagagcauaugauaucc

SEQ ID NO: 133570 - RNA, 22 nt, Human
gcaaugauauugaagugaugaa

SEQ ID NO: 133571 - RNA, 22 nt, Human
ggcugcaggcagaggcugucug

SEQ ID NO: 133572 - RNA, 22 nt, Human
aauuuggcagugucuugaagua

SEQ ID NO: 133573 - RNA, 22 nt, Human
ugucauguguucuuaaauacau

SEQ ID NO: 133574 - RNA, 22 nt, Human
ucaggcagagcuguggagcucu

SEQ ID NO: 133575 - RNA, 21 nt, Human
acucaggagacuaacuauguc

SEQ ID NO: 133576 - RNA, 22 nt, Human
uggcagagagacucuccuugau

SEQ ID NO: 133577 - RNA, 22 nt, Human
cccaggcugaugggaugggcca

SEQ ID NO: 133578 - RNA, 22 nt, Human
gacagaguuguugauguaugcu

SEQ ID NO: 133579 - RNA, 22 nt, Human
aggcacugacucaagggagcca

SEQ ID NO: 133580 - RNA, 22 nt, Human
auccugggaagcugacauugaa

SEQ ID NO: 133581 - RNA, 22 nt, Human
aaugcacacauuugguacugaa

SEQ ID NO: 133582 - RNA, 22 nt, Human
acagcagcauaaacugacuaag

SEQ ID NO: 133583 - RNA, 22 nt, Human
gaaagaggaaggagauguauua

SEQ ID NO: 133584 - RNA, 22 nt, Human
auacuuuuaauuccuucugagu

SEQ ID NO: 133585 - RNA, 22 nt, Human
uuauccaagcagaagcugcaca

SEQ ID NO: 133586 - RNA, 22 nt, Human
aagcagaaaaacugagcuccaa

SEQ ID NO: 133587 - RNA, 22 nt, Human
cacaaaugguuguagacauuaa

SEQ ID NO: 133588 - RNA, 22 nt, Human
gaggguccccaugcagagcuca

SEQ ID NO: 133589 - RNA, 22 nt, Human
guucucucugcuuccaagaugg

SEQ ID NO: 133590 - RNA, 22 nt, Human
gccucugcaauuacauugugcc

SEQ ID NO: 133591 - RNA, 22 nt, Human
agcugguucauucauucauggu

SEQ ID NO: 133592 - RNA, 22 nt, Human
guggccugccagcagauggcgc

SEQ ID NO: 133593 - RNA, 22 nt, Human
ugccuugguucucuacuuggag

SEQ ID NO: 133594 - RNA, 22 nt, Human
cacugaagccacuggaagagga

SEQ ID NO: 133595 - RNA, 22 nt, Human
acaaagucaaauugcagccgcc

SEQ ID NO: 133596 - RNA, 22 nt, Human
auuauuauuguugauguuaggg

SEQ ID NO: 133597 - RNA, 22 nt, Human
cuauugaauagcccaaaucauu

SEQ ID NO: 133598 - RNA, 22 nt, Human
cuggccagaguuggagggugug

SEQ ID NO: 133599 - RNA, 22 nt, Human
guguaauugaaauugagaacca

SEQ ID NO: 133600 - RNA, 22 nt, Human
ucugcagcuucuugccagagag

SEQ ID NO: 133601 - RNA, 18 nt, Human
ucaagacaucaugaaaua

SEQ ID NO: 133602 - RNA, 22 nt, Human
ucucuucuugauuuucacugga

SEQ ID NO: 133603 - RNA, 22 nt, Human
cugcaggcugagcgccugccgg

SEQ ID NO: 133604 - RNA, 22 nt, Human
uaacagaaguuguucauugugg

SEQ ID NO: 133605 - RNA, 22 nt, Human
gccacacuuauucucaugcaca

SEQ ID NO: 133606 - RNA, 21 nt, Human
acaguauauuagauauuugaa

SEQ ID NO: 133607 - RNA, 22 nt, Human
uguguguacucuccaguccuga

SEQ ID NO: 133608 - RNA, 22 nt, Human
gaaggccaagaggcuccaagau

SEQ ID NO: 133609 - RNA, 21 nt, Human
augucaaaugcuuuauuuuau

SEQ ID NO: 133610 - RNA, 22 nt, Human
uuacaauaguuccuucuuuugu

SEQ ID NO: 133611 - RNA, 22 nt, Human
gaggccaaguuggagaccaggu

SEQ ID NO: 133612 - RNA, 22 nt, Human
aucaguuuggugcuuucaguga

SEQ ID NO: 133613 - RNA, 22 nt, Human
uccucaggagagcuccuaugcc

SEQ ID NO: 133614 - RNA, 22 nt, Human
acaguauauauagucuaaaagc

SEQ ID NO: 133615 - RNA, 22 nt, Human
cugugugccuccugugaucagg

SEQ ID NO: 133616 - RNA, 22 nt, Human
uagauuucgcugcaucucaauc

SEQ ID NO: 133617 - RNA, 22 nt, Human
gcagggaggaagagaugcuucc

SEQ ID NO: 133618 - RNA, 22 nt, Human
ucagagaguuacacaaauuguu

SEQ ID NO: 133619 - RNA, 19 nt, Human
uggcuucuguuuucauguu

SEQ ID NO: 133620 - RNA, 19 nt, Human
uccugggcugggccagguc

SEQ ID NO: 133621 - RNA, 22 nt, Human
gccuggucucuuucaugucagu

SEQ ID NO: 133622 - RNA, 22 nt, Human
guguggcuaggauggcuuugcu

SEQ ID NO: 133623 - RNA, 22 nt, Human
cacugugucagaguaugaugau

SEQ ID NO: 133624 - RNA, 22 nt, Human
gcuuuacaaguggugcagauua

SEQ ID NO: 133625 - RNA, 22 nt, Human
uugugaaacauucauggauuug

SEQ ID NO: 133626 - RNA, 22 nt, Human
gccuucugcgcucgugucuccg

SEQ ID NO: 133627 - RNA, 22 nt, Human
auuuuucucucacacuuaccag

SEQ ID NO: 133628 - RNA, 22 nt, Human
gaggcccaguccugcaagcacg

SEQ ID NO: 133629 - RNA, 22 nt, Human
ucugagcauugaauuuucuucc

SEQ ID NO: 133630 - RNA, 22 nt, Human
cacugaagguaggaccaaggcu

SEQ ID NO: 133631 - RNA, 22 nt, Human
cucagaguccauaguuuacagu

SEQ ID NO: 133632 - RNA, 22 nt, Human
uuugcaaauaccaugaaacuug

SEQ ID NO: 133633 - RNA, 22 nt, Human
uguauuagaucugagaacuucu

SEQ ID NO: 133634 - RNA, 22 nt, Human
gucccaggcuuauguggagcuu

SEQ ID NO: 133635 - RNA, 23 nt, Human
cagggcugggcuugguguuaggc

SEQ ID NO: 133636 - RNA, 22 nt, Human
aguuuucuuucaucuaucagca

SEQ ID NO: 133637 - RNA, 22 nt, Human
cuguggcucaauugccuacuga

SEQ ID NO: 133638 - RNA, 22 nt, Human
ggggcagaaagcccacagagug

SEQ ID NO: 133639 - RNA, 23 nt, Human
uggcccugugcaugcugcuuccc

SEQ ID NO: 133640 - RNA, 21 nt, Human
ucuuuccugcccaguugcccu

SEQ ID NO: 133641 - RNA, 22 nt, Human
ccagagucuaugaguccucauu

SEQ ID NO: 133642 - RNA, 21 nt, Human
gcugcaucaaucuacccaggg

SEQ ID NO: 133643 - RNA, 22 nt, Human
acuuccugcagcuucucagccc

SEQ ID NO: 133644 - RNA, 22 nt, Human
cacuggugacuucugagcugga

SEQ ID NO: 133645 - RNA, 22 nt, Human
uacaguauuaugagugauugaa

SEQ ID NO: 133646 - RNA, 23 nt, Human
uggcagugaucaaaagcuuacau

SEQ ID NO: 133647 - RNA, 23 nt, Human
acuuuucaauuagcuaugcuuaa

SEQ ID NO: 133648 - RNA, 22 nt, Human
gcaggaaagguugagacuuugc

SEQ ID NO: 133649 - RNA, 20 nt, Human
uuuaucugugggaguggaga

SEQ ID NO: 133650 - RNA, 22 nt, Human
agaauucucuuccauugaaaca

SEQ ID NO: 133651 - RNA, 20 nt, Human
uuuuuccuucucuacaggca

SEQ ID NO: 133652 - RNA, 17 nt, Human
gcagccagugcagcagg

SEQ ID NO: 133653 - RNA, 22 nt, Human
auguggcuagugcagaugaaua

SEQ ID NO: 133654 - RNA, 22 nt, Human
uaugagcuuccaguguugcaug

SEQ ID NO: 133655 - RNA, 22 nt, Human
uucucucuuacugccaugcugu

SEQ ID NO: 133656 - RNA, 22 nt, Human
guuuuauaggcuguugcuauau

SEQ ID NO: 133657 - RNA, 22 nt, Human
ggcugcuuuaucggcugcugaa

SEQ ID NO: 133658 - RNA, 22 nt, Human
ucuggccaacaaaaacuaaguc

SEQ ID NO: 133659 - RNA, 22 nt, Human
uucacagauguauuggaacucc

SEQ ID NO: 133660 - RNA, 22 nt, Human
cugggagguggagguugcauug

SEQ ID NO: 133661 - RNA, 21 nt, Human
uaaggccaagucuauuucugu

SEQ ID NO: 133662 - RNA, 22 nt, Human
ugucaccaugccagcuucugcc

SEQ ID NO: 133663 - RNA, 22 nt, Human
uuaaguauauccauuugacugg

SEQ ID NO: 133664 - RNA, 22 nt, Human
ugugucugcccuuaguacaucu

SEQ ID NO: 133665 - RNA, 22 nt, Human
cucuggccugcuuccucaggua

SEQ ID NO: 133666 - RNA, 22 nt, Human
ugaaaucuuuaguuucuguccc

SEQ ID NO: 133667 - RNA, 22 nt, Human
cuguaauucacuagggucagcg

SEQ ID NO: 133668 - RNA, 22 nt, Human
ccugaagaugcuguggccuggu

SEQ ID NO: 133669 - RNA, 21 nt, Human
cuguggaagggaacuagaggg

SEQ ID NO: 133670 - RNA, 22 nt, Human
agagggcauuaacucugucuug

SEQ ID NO: 133671 - RNA, 22 nt, Human
ugaccaaagaguugcuuguauu

SEQ ID NO: 133672 - RNA, 19 nt, Human
uuugaaaggauuguuauuu

SEQ ID NO: 133673 - RNA, 22 nt, Human
guccaugauucuguguaguaga

SEQ ID NO: 133674 - RNA, 22 nt, Human
uuauuugugaaucauuuaucua

SEQ ID NO: 133675 - RNA, 22 nt, Human
gugggaugcaguggugaguggc

SEQ ID NO: 133676 - RNA, 22 nt, Human
ucagcuggcaguucagaggcug

SEQ ID NO: 133677 - RNA, 22 nt, Human
ugucugguggguugacaggcag

SEQ ID NO: 133678 - RNA, 22 nt, Human
guacuuccguggacuaauuguu

SEQ ID NO: 133679 - RNA, 22 nt, Human
gcccacagcucguuccucuccu

SEQ ID NO: 133680 - RNA, 22 nt, Human
ggugggcagcucuuggcaggca

SEQ ID NO: 133681 - RNA, 23 nt, Human
ccacuagcaccuguucaacuucu

SEQ ID NO: 133682 - RNA, 22 nt, Human
ggcuucauggaggaggugaguc

SEQ ID NO: 133683 - RNA, 22 nt, Human
accaucagucacauguagagaa

SEQ ID NO: 133684 - RNA, 22 nt, Human
cccagcuccuuacagggccgaa

SEQ ID NO: 133685 - RNA, 22 nt, Human
uuacaaagaguguucuuuucca

SEQ ID NO: 133686 - RNA, 20 nt, Human
ugugaaagcaguagaaugac

SEQ ID NO: 133687 - RNA, 21 nt, Human
agcugagcccagaagacuggu

SEQ ID NO: 133688 - RNA, 22 nt, Human
gcuggagccaagcugcucuugg

SEQ ID NO: 133689 - RNA, 22 nt, Human
ccauuguaguaucuguuuuagu

SEQ ID NO: 133690 - RNA, 22 nt, Human
auugucuucuggucuuaucuuu

SEQ ID NO: 133691 - RNA, 22 nt, Human
acugugcaaugaguaauaaacu

SEQ ID NO: 133692 - RNA, 22 nt, Human
uucugcugguguuuugugaggc

SEQ ID NO: 133693 - RNA, 22 nt, Human
aaaugcaccuugcugugagacu

SEQ ID NO: 133694 - RNA, 22 nt, Human
uauuugcugacagugcuggagc

SEQ ID NO: 133695 - RNA, 22 nt, Human
cucacuguccaacaggcuuuac

SEQ ID NO: 133696 - RNA, 22 nt, Human
acuuccugcaaucguccacucc

SEQ ID NO: 133697 - RNA, 22 nt, Human
acuuuacagaugguuuccugac

SEQ ID NO: 133698 - RNA, 22 nt, Human
gaaaggcaguacagcugagccu

SEQ ID NO: 133699 - RNA, 22 nt, Human
gggguggauuccuacaggucca

SEQ ID NO: 133700 - RNA, 22 nt, Human
ucacuguauuugcugaugcaua

SEQ ID NO: 133701 - RNA, 22 nt, Human
cagaguccuggacacagagaca

SEQ ID NO: 133702 - RNA, 22 nt, Human
auguaguguagagauuagucuc

SEQ ID NO: 133703 - RNA, 22 nt, Human
ucuucagauaaagggagaguau

SEQ ID NO: 133704 - RNA, 22 nt, Human
cauuuagagucuugcaauuuua

SEQ ID NO: 133705 - RNA, 22 nt, Human
guguguguacucuguauauaaa

SEQ ID NO: 133706 - RNA, 20 nt, Human
agauuauuccuaagauuucu

SEQ ID NO: 133707 - RNA, 22 nt, Human
augcauguaacaguguuaugaa

SEQ ID NO: 133708 - RNA, 22 nt, Human
uguuugugguuauaauaaguau

SEQ ID NO: 133709 - RNA, 22 nt, Human
uuuccagguauuaauacuguau

SEQ ID NO: 133710 - RNA, 22 nt, Human
cuggaugcuuccucucugcuag

SEQ ID NO: 133711 - RNA, 22 nt, Human
ucuugccucuuccccuuuccau

SEQ ID NO: 133712 - RNA, 22 nt, Human
ucauugcaguugaguuguguua

SEQ ID NO: 133713 - RNA, 22 nt, Human
ucucucuucaacccuuaacuag

SEQ ID NO: 133714 - RNA, 22 nt, Human
aggcuucccagcugagcucagc

SEQ ID NO: 133715 - RNA, 22 nt, Human
acagccaggaauucuggagaag

SEQ ID NO: 133716 - RNA, 22 nt, Human
cuccuguauguugggcuucaca

SEQ ID NO: 133717 - RNA, 22 nt, Human
uuaugcuaaaugaaucaaguca

SEQ ID NO: 133718 - RNA, 22 nt, Human
uuucucugggcuguuggcagcc

SEQ ID NO: 133719 - RNA, 22 nt, Human
agggccuggcgcguggccgccg

SEQ ID NO: 133720 - RNA, 22 nt, Human
gggagggaaggaccuuaugaau

SEQ ID NO: 133721 - RNA, 18 nt, Human
ggcugccuguuccugaag

SEQ ID NO: 133722 - RNA, 22 nt, Human
ccugcagcuccggauuucuggg

SEQ ID NO: 133723 - RNA, 22 nt, Human
aguggcugccaagagcaaugcu

SEQ ID NO: 133724 - RNA, 22 nt, Human
auaucuuuguuuuugccaagau

SEQ ID NO: 133725 - RNA, 22 nt, Human
guuagaaagugucugcuugggu

SEQ ID NO: 133726 - RNA, 23 nt, Human
ugugcgugaugcuuuguugaagg

SEQ ID NO: 133727 - RNA, 22 nt, Human
uccugggcugcagggaagagca

SEQ ID NO: 133728 - RNA, 22 nt, Human
auguggcuaguggcuaugaucu

SEQ ID NO: 133729 - RNA, 22 nt, Human
aagcuuuucucuguauuaccug

SEQ ID NO: 133730 - RNA, 22 nt, Human
cuguggcuucugcuugggccuc

SEQ ID NO: 133731 - RNA, 22 nt, Human
uggugcaagucucugaggaggg

SEQ ID NO: 133732 - RNA, 22 nt, Human
cucagaauuuagggcucugagg

SEQ ID NO: 133733 - RNA, 22 nt, Human
ggcagcaggcgacuucccuauu

SEQ ID NO: 133734 - RNA, 22 nt, Human
cagcaggaaagacaucugagca

SEQ ID NO: 133735 - RNA, 22 nt, Human
cuuaaauucuuaaugcccucau

SEQ ID NO: 133736 - RNA, 22 nt, Human
cccuguccuuggcugugaggcu

SEQ ID NO: 133737 - RNA, 21 nt, Human
agagagaaggccauauggucc

SEQ ID NO: 133738 - RNA, 22 nt, Human
uguuacagugacuaauguuuua

SEQ ID NO: 133739 - RNA, 22 nt, Human
cugagagccuccuguuggcuag

SEQ ID NO: 133740 - RNA, 22 nt, Human
uugaggaguguuuagggugagg

SEQ ID NO: 133741 - RNA, 22 nt, Human
cucugggcaaguuucuucauga

SEQ ID NO: 133742 - RNA, 21 nt, Human
cagugcucaaucugacagugg

SEQ ID NO: 133743 - RNA, 20 nt, Human
ugaaaggugggaauuguggg

SEQ ID NO: 133744 - RNA, 22 nt, Human
gggcugggauggcuugaagauu

SEQ ID NO: 133745 - RNA, 22 nt, Human
caggcugggaacgccacccgcu

SEQ ID NO: 133746 - RNA, 22 nt, Human
uugaagagugccuuccagacau

SEQ ID NO: 133747 - RNA, 22 nt, Human
gcugugugaaaacugggccugg

SEQ ID NO: 133748 - RNA, 22 nt, Human
gcucucugaggugcuggcagag

SEQ ID NO: 133749 - RNA, 22 nt, Human
uguguuuacuucuaugcaguuu

SEQ ID NO: 133750 - RNA, 22 nt, Human
guucucucagcgauagugaugg

SEQ ID NO: 133751 - RNA, 22 nt, Human
cagcuccugcagcugcugccgu

SEQ ID NO: 133752 - RNA, 22 nt, Human
cagcaguguacaaggugucaga

SEQ ID NO: 133753 - RNA, 22 nt, Human
ucagggcaaugucccucagaag

SEQ ID NO: 133754 - RNA, 21 nt, Human
uuuuuucuugcgugaggccug

SEQ ID NO: 133755 - RNA, 19 nt, Human
guggccugcgcugggugcg

SEQ ID NO: 133756 - RNA, 22 nt, Human
cuggagagauccuccugaaaaa

SEQ ID NO: 133757 - RNA, 21 nt, Human
agcagaggggacauguuugau

SEQ ID NO: 133758 - RNA, 21 nt, Human
cugcucugacagugaggccag

SEQ ID NO: 133759 - RNA, 22 nt, Human
ccaggcugcuguugguguccgc

SEQ ID NO: 133760 - RNA, 18 nt, Human
ugugguggagcugccuuc

SEQ ID NO: 133761 - RNA, 22 nt, Human
ccugggcagguguggcuucccc

SEQ ID NO: 133762 - RNA, 19 nt, Human
ugugacugguugucucgcu

SEQ ID NO: 133763 - RNA, 23 nt, Human
ucagagaaguuguaggcugggga

SEQ ID NO: 133764 - RNA, 22 nt, Human
acagcuggaggccccauugucc

SEQ ID NO: 133765 - RNA, 22 nt, Human
uccagcagaaaagagguaggga

SEQ ID NO: 133766 - RNA, 22 nt, Human
ugcagcuccucuggcugccuga

SEQ ID NO: 133767 - RNA, 22 nt, Human
gguguggcugugaguuuuugau

SEQ ID NO: 133768 - RNA, 22 nt, Human
ccugccugcuuucugcuuugca

SEQ ID NO: 133769 - RNA, 22 nt, Human
uucagcaagaccaccauguacc

SEQ ID NO: 133770 - RNA, 22 nt, Human
uuguuuucacagcuuugcccgg

SEQ ID NO: 133771 - RNA, 22 nt, Human
cugagggccuuggcuccugccc

SEQ ID NO: 133772 - RNA, 22 nt, Human
cauuacaugguccaggauauau

SEQ ID NO: 133773 - RNA, 22 nt, Human
ugagauguaagguaugcuuacu

SEQ ID NO: 133774 - RNA, 22 nt, Human
uauugaaaugaaugacagugau

SEQ ID NO: 133775 - RNA, 22 nt, Human
uucuggaguauuccuggcaccu

SEQ ID NO: 133776 - RNA, 22 nt, Human
ggccccuggcaccaggcugauu

SEQ ID NO: 133777 - RNA, 20 nt, Human
ccugggguacacuggcaugu

SEQ ID NO: 133778 - RNA, 22 nt, Human
acuuucucaaaucagacuuuaa

SEQ ID NO: 133779 - RNA, 22 nt, Human
agagcuggcugguagcccugau

SEQ ID NO: 133780 - RNA, 22 nt, Human
aucaggaucugcaucauaagaa

SEQ ID NO: 133781 - RNA, 22 nt, Human
caccugagugucaguauucuca

SEQ ID NO: 133782 - RNA, 22 nt, Human
ucacaaauauuuuaacaguagg

SEQ ID NO: 133783 - RNA, 22 nt, Human
guaugcuuauuccuuguuguga

SEQ ID NO: 133784 - RNA, 22 nt, Human
cuguggcugccucaccuacagg

SEQ ID NO: 133785 - RNA, 22 nt, Human
uuucccucucaucucuauuauu

SEQ ID NO: 133786 - RNA, 23 nt, Human
ugccucugccucccuagucugca

SEQ ID NO: 133787 - RNA, 22 nt, Human
ugcuuagacgucaaguacagcc

SEQ ID NO: 133788 - RNA, 22 nt, Human
caugaagcauguuuugucauga

SEQ ID NO: 133789 - RNA, 22 nt, Human
aaagaauuuguacacccuacua

SEQ ID NO: 133790 - RNA, 22 nt, Human
ggucauugucagagccuguacu

SEQ ID NO: 133791 - RNA, 22 nt, Human
auuucuucaggucagaaauaga

SEQ ID NO: 133792 - RNA, 22 nt, Human
augccagucaaagaagaugaca

SEQ ID NO: 133793 - RNA, 22 nt, Human
gcagcuguguaaugagcccaca

SEQ ID NO: 133794 - RNA, 22 nt, Human
gagacaaaaguuggagugcaag

SEQ ID NO: 133795 - RNA, 22 nt, Human
uuuguuuucaaugugucauuca

SEQ ID NO: 133796 - RNA, 19 nt, Human
cagcugcaccgugaccauc

SEQ ID NO: 133797 - RNA, 22 nt, Human
cuuuacauccuguuucccguuu

SEQ ID NO: 133798 - RNA, 22 nt, Human
auauuucaugggguuccauacu

SEQ ID NO: 133799 - RNA, 22 nt, Human
aaaugcagauugucauucagga

SEQ ID NO: 133800 - RNA, 22 nt, Human
ucuuucucucuaaucaagcaca

SEQ ID NO: 133801 - RNA, 22 nt, Human
acgaguauguuuguauuuucuu

SEQ ID NO: 133802 - RNA, 22 nt, Human
acuacuuugggccauuuguuua

SEQ ID NO: 133803 - RNA, 22 nt, Human
ucagaggucacacagcaaguuu

SEQ ID NO: 133804 - RNA, 23 nt, Human
ucugauguucucuuaugcuguag

SEQ ID NO: 133805 - RNA, 22 nt, Human
cacagcuuccauuagaaugaga

SEQ ID NO: 133806 - RNA, 22 nt, Human
agucccagacuccaguuuucug

SEQ ID NO: 133807 - RNA, 22 nt, Human
aagaagaugguuaacuuucagu

SEQ ID NO: 133808 - RNA, 22 nt, Human
ugauauuuuucacuggccucug

SEQ ID NO: 133809 - RNA, 22 nt, Human
gagccuggggacccuccugagu

SEQ ID NO: 133810 - RNA, 22 nt, Human
aggaaagcucccaguagggcuc

SEQ ID NO: 133811 - RNA, 21 nt, Human
aaacugaccuugccugagaca

SEQ ID NO: 133812 - RNA, 22 nt, Human
gcucugugaaggguguugcuca

SEQ ID NO: 133813 - RNA, 22 nt, Human
cagaaguaagauuacugugagu

SEQ ID NO: 133814 - RNA, 22 nt, Human
aggcuuccgaguagcugggacu

SEQ ID NO: 133815 - RNA, 22 nt, Human
ucuuucagccacuuaccugucu

SEQ ID NO: 133816 - RNA, 22 nt, Human
caccagcuuugcccacugccca

SEQ ID NO: 133817 - RNA, 23 nt, Human
uggcucugagcuuccugguggcc

SEQ ID NO: 133818 - RNA, 22 nt, Human
uggcccugacagguccugggca

SEQ ID NO: 133819 - RNA, 22 nt, Human
gucuucuuguguugccugucuu

SEQ ID NO: 133820 - RNA, 22 nt, Human
aaccaggacaauuugaauagaa

SEQ ID NO: 133821 - RNA, 22 nt, Human
acauucuuaacaguuaaaaacu

SEQ ID NO: 133822 - RNA, 22 nt, Human
uauguuauuuucauacaacaga

SEQ ID NO: 133823 - RNA, 22 nt, Human
uuucuuuaucauagcaucuuug

SEQ ID NO: 133824 - RNA, 22 nt, Human
ggcagaggagcuggaaacaugg

SEQ ID NO: 133825 - RNA, 22 nt, Human
guuugauucaagaacaaagagu

SEQ ID NO: 133826 - RNA, 22 nt, Human
uuaacuucaacacucucuugua

SEQ ID NO: 133827 - RNA, 22 nt, Human
gaaaagggcaagagagagggca

SEQ ID NO: 133828 - RNA, 22 nt, Human
uguacaguguagucaugagguu

SEQ ID NO: 133829 - RNA, 22 nt, Human
gcucacugcaaccucugcuucc

SEQ ID NO: 133830 - RNA, 22 nt, Human
gagcugcuucugugugccgggu

SEQ ID NO: 133831 - RNA, 22 nt, Human
cagaguguaucuguguaagcau

SEQ ID NO: 133832 - RNA, 22 nt, Human
aaagaugucauacacauuaaga

SEQ ID NO: 133833 - RNA, 22 nt, Human
caguagcacuagauaugugugg

SEQ ID NO: 133834 - RNA, 22 nt, Human
cucagagaagucuuugcuaaac

SEQ ID NO: 133835 - RNA, 22 nt, Human
ucugcaucauuuuucagagccg

SEQ ID NO: 133836 - RNA, 18 nt, Human
gcccagaggucugggccc

SEQ ID NO: 133837 - RNA, 22 nt, Human
ccuucagaccuagacaggaauc

SEQ ID NO: 133838 - RNA, 22 nt, Human
gcucuggagauggagccuugag

SEQ ID NO: 133839 - RNA, 23 nt, Human
cucccuggaguuucuggaagaug

SEQ ID NO: 133840 - RNA, 22 nt, Human
ucugugugguaguuucagugaa

SEQ ID NO: 133841 - RNA, 22 nt, Human
aggaggugacagccugcaucug

SEQ ID NO: 133842 - RNA, 20 nt, Human
cagagaccugucuucacaga

SEQ ID NO: 133843 - RNA, 22 nt, Human
gagagcccugcuccuaucccag

SEQ ID NO: 133844 - RNA, 22 nt, Human
cacagccugcugcacucaagaa

SEQ ID NO: 133845 - RNA, 23 nt, Human
uuugcaaauuggacacaaccaca

SEQ ID NO: 133846 - RNA, 22 nt, Human
acuuuuuacaggguguauacca

SEQ ID NO: 133847 - RNA, 22 nt, Human
caguggccugagccaggcuucc

SEQ ID NO: 133848 - RNA, 22 nt, Human
uuauuuucagcuaggaaagcca

SEQ ID NO: 133849 - RNA, 18 nt, Human
cagaagcaggcagugcag

SEQ ID NO: 133850 - RNA, 22 nt, Human
gcuuggaaguaggauugggaga

SEQ ID NO: 133851 - RNA, 22 nt, Human
uuuuaucuucauuccuaucuac

SEQ ID NO: 133852 - RNA, 22 nt, Human
auuuccauacacccauuucuga

SEQ ID NO: 133853 - RNA, 22 nt, Human
gcugugauugucagucuucaau

SEQ ID NO: 133854 - RNA, 22 nt, Human
cagggccuuauccugccauuga

SEQ ID NO: 133855 - RNA, 22 nt, Human
auggaaagggaagcaaggaaca

SEQ ID NO: 133856 - RNA, 22 nt, Human
cagcccuguccagcagagggug

SEQ ID NO: 133857 - RNA, 22 nt, Human
uccucucagugugguuguggga

SEQ ID NO: 133858 - RNA, 22 nt, Human
gcugucaccaaagcaggcacug

SEQ ID NO: 133859 - RNA, 22 nt, Human
cacugcaggucugagauggggg

SEQ ID NO: 133860 - RNA, 22 nt, Human
ggccagagagccgcuguuagga

SEQ ID NO: 133861 - RNA, 22 nt, Human
agcaucuggucaugagugagaa

SEQ ID NO: 133862 - RNA, 20 nt, Human
uuucagugguuugugccuag

SEQ ID NO: 133863 - RNA, 22 nt, Human
ccucugaggucauggacuuggc

SEQ ID NO: 133864 - RNA, 21 nt, Human
gcagacugcccugcugucccc

SEQ ID NO: 133865 - RNA, 22 nt, Human
uuagucaauagugaauauagag

SEQ ID NO: 133866 - RNA, 23 nt, Human
cugugugugccgaggguggccac

SEQ ID NO: 133867 - RNA, 22 nt, Human
aaguuugagaagcuuauagaua

SEQ ID NO: 133868 - RNA, 22 nt, Human
ugcugucugauucagggugauu

SEQ ID NO: 133869 - RNA, 22 nt, Human
gcagcauugcacuuuuguucuu

SEQ ID NO: 133870 - RNA, 22 nt, Human
uacacauguuuggcaaguaugu

SEQ ID NO: 133871 - RNA, 22 nt, Human
agaguguuauuugcucuguauu

SEQ ID NO: 133872 - RNA, 19 nt, Human
agguggucuaggcuggaga

SEQ ID NO: 133873 - RNA, 20 nt, Human
guugaaaguaauaugaugcu

SEQ ID NO: 133874 - RNA, 22 nt, Human
uagagcuguaucaaagagccuu

SEQ ID NO: 133875 - RNA, 22 nt, Human
gcucaagggaugggagugggug

SEQ ID NO: 133876 - RNA, 22 nt, Human
uuugcauuucuaaugagcuccg

SEQ ID NO: 133877 - RNA, 22 nt, Human
gcuggccugucuagagccuuac

SEQ ID NO: 133878 - RNA, 22 nt, Human
gggcuggcaucaguugccgaga

SEQ ID NO: 133879 - RNA, 22 nt, Human
uggcugaaggaagauucuucua

SEQ ID NO: 133880 - RNA, 22 nt, Human
guggugcaggccagcaggggcg

SEQ ID NO: 133881 - RNA, 22 nt, Human
aggcacugaaagguggccagag

SEQ ID NO: 133882 - RNA, 22 nt, Human
cccucuacagggaagcgcuuuc

SEQ ID NO: 133883 - RNA, 21 nt, Human
uagagaaaagaagcuguuccu

SEQ ID NO: 133884 - RNA, 22 nt, Human
gagugugggcacgggggccuug

SEQ ID NO: 133885 - RNA, 22 nt, Human
cacagggccacuuucccaguaa

SEQ ID NO: 133886 - RNA, 22 nt, Human
ucuuuccuacuuuauugugaac

SEQ ID NO: 133887 - RNA, 19 nt, Human
acccucucagugccugagg

SEQ ID NO: 133888 - RNA, 19 nt, Human
aucuuacagagcagaguac

SEQ ID NO: 133889 - RNA, 22 nt, Human
uucacagugguagugcauuuag

SEQ ID NO: 133890 - RNA, 22 nt, Human
gccagggaggcuguaggguccu

SEQ ID NO: 133891 - RNA, 22 nt, Human
cuggagccuagguugaccuggg

SEQ ID NO: 133892 - RNA, 22 nt, Human
cuugaaagcacuuaguaaauua

SEQ ID NO: 133893 - RNA, 22 nt, Human
ugucuguacaaauuuucugugu

SEQ ID NO: 133894 - RNA, 22 nt, Human
ccagggcauccucacaucgcag

SEQ ID NO: 133895 - RNA, 22 nt, Human
ucugucugagggagugacauuu

SEQ ID NO: 133896 - RNA, 22 nt, Human
gaggcucagagggagcaugguc

SEQ ID NO: 133897 - RNA, 22 nt, Human
ggucccagaauugguuagcaca

SEQ ID NO: 133898 - RNA, 22 nt, Human
gcucugagccgggggccugucc

SEQ ID NO: 133899 - RNA, 22 nt, Human
ucaguuuuaagguuugagaauu

SEQ ID NO: 133900 - RNA, 22 nt, Human
auuuucaucauggguuuaacau

SEQ ID NO: 133901 - RNA, 22 nt, Human
ugguaaagaaggcuagaucuga

SEQ ID NO: 133902 - RNA, 22 nt, Human
agcagcuguggaaaaguaacua

SEQ ID NO: 133903 - RNA, 22 nt, Human
cuggcuggccggagcgaggcgg

SEQ ID NO: 133904 - RNA, 22 nt, Human
cugaggaagacagcagcugugu

SEQ ID NO: 133905 - RNA, 22 nt, Human
agcugcaggcccaugcucaguc

SEQ ID NO: 133906 - RNA, 22 nt, Human
uugcagcuucgagucuaucugu

SEQ ID NO: 133907 - RNA, 22 nt, Human
uuuugaaagccagguuuguaug

SEQ ID NO: 133908 - RNA, 22 nt, Human
uccagggcugacuugggagagg

SEQ ID NO: 133909 - RNA, 22 nt, Human
uauguguauaucuguaugugca

SEQ ID NO: 133910 - RNA, 22 nt, Human
cuuuggcaugguccucacuaua

SEQ ID NO: 133911 - RNA, 22 nt, Human
ggaagaagggucauuggcagcc

SEQ ID NO: 133912 - RNA, 22 nt, Human
caucacugacgcugagauucca

SEQ ID NO: 133913 - RNA, 22 nt, Human
gagugcagaugaacagaagauu

SEQ ID NO: 133914 - RNA, 22 nt, Human
cagcugccagcuucucuccauc

SEQ ID NO: 133915 - RNA, 20 nt, Human
uaaggcuguuuuguauuccu

SEQ ID NO: 133916 - RNA, 22 nt, Human
aaguggacuaauacaaggacua

SEQ ID NO: 133917 - RNA, 22 nt, Human
gaggccuggagccgccuaggcg

SEQ ID NO: 133918 - RNA, 22 nt, Human
acauuucucauaggagagccac

SEQ ID NO: 133919 - RNA, 21 nt, Human
aggcacuguuugugguuuggg

SEQ ID NO: 133920 - RNA, 22 nt, Human
uccagccuuucuacucacugag

SEQ ID NO: 133921 - RNA, 22 nt, Human
agacaaagacagcaucucaggu

SEQ ID NO: 133922 - RNA, 22 nt, Human
cacagaagaaucaugcuguguu

SEQ ID NO: 133923 - RNA, 22 nt, Human
caugggaggucugcaaggugcu

SEQ ID NO: 133924 - RNA, 22 nt, Human
gacuguguccaugugcuggauu

SEQ ID NO: 133925 - RNA, 22 nt, Human
agcaccuguggcucaugcucgu

SEQ ID NO: 133926 - RNA, 22 nt, Human
gggccucucccuucucacgcau

SEQ ID NO: 133927 - RNA, 21 nt, Human
ucuguggcagcaugaugaggu

SEQ ID NO: 133928 - RNA, 23 nt, Human
ggagccuggcauaugagacgcau

SEQ ID NO: 133929 - RNA, 22 nt, Human
acaaugcaccagcaucuucacc

SEQ ID NO: 133930 - RNA, 21 nt, Human
cugccuugaaugguacuggga

SEQ ID NO: 133931 - RNA, 22 nt, Human
agcugcuguggggcucggccug

SEQ ID NO: 133932 - RNA, 22 nt, Human
agaauucuguucuucgggugug

SEQ ID NO: 133933 - RNA, 22 nt, Human
cacaggcuuccaguccccagcu

SEQ ID NO: 133934 - RNA, 22 nt, Human
ucauuucuccgaccugcugucc

SEQ ID NO: 133935 - RNA, 22 nt, Human
uugcauugggagugaggagacc

SEQ ID NO: 133936 - RNA, 22 nt, Human
ccagggugaggaggcucccacg

SEQ ID NO: 133937 - RNA, 22 nt, Human
aggauccuuuuucugcuguuug

SEQ ID NO: 133938 - RNA, 22 nt, Human
ccaggcucugucuggucagaag

SEQ ID NO: 133939 - RNA, 22 nt, Human
agcugcucuugggugacuucaa

SEQ ID NO: 133940 - RNA, 22 nt, Human
gcugggagcccuggucugcucc

SEQ ID NO: 133941 - RNA, 22 nt, Human
ggcuggaaguccaagaucaaga

SEQ ID NO: 133942 - RNA, 23 nt, Human
uggggcugauggagacggaccag

SEQ ID NO: 133943 - RNA, 22 nt, Human
uuggcuucuggcagucuggacg

SEQ ID NO: 133944 - RNA, 22 nt, Human
uuuuuauaccaccucucacuua

SEQ ID NO: 133945 - RNA, 22 nt, Human
uacuuuaaaaacugauaauuca

SEQ ID NO: 133946 - RNA, 22 nt, Human
aaaagcucuuucugcuguagau

SEQ ID NO: 133947 - RNA, 22 nt, Human
ucaggggagguugaaucgucuc

SEQ ID NO: 133948 - RNA, 22 nt, Human
gccugcagaacugugaggcaau

SEQ ID NO: 133949 - RNA, 22 nt, Human
agagccuguuuugugggagaug

SEQ ID NO: 133950 - RNA, 22 nt, Human
cucuggacagcaggugcugugg

SEQ ID NO: 133951 - RNA, 22 nt, Human
cuacaguagagaggauguagaa

SEQ ID NO: 133952 - RNA, 22 nt, Human
aacaguauaugaaauguuagga

SEQ ID NO: 133953 - RNA, 22 nt, Human
ucucagagggaaacaugaguga

SEQ ID NO: 133954 - RNA, 22 nt, Human
uccauguguuuuccuguccaca

SEQ ID NO: 133955 - RNA, 22 nt, Human
acuuuacaggcacuucaaguau

SEQ ID NO: 133956 - RNA, 22 nt, Human
aggugccagaugcacagcugaa

SEQ ID NO: 133957 - RNA, 22 nt, Human
ccugccugguguaagucuaagg

SEQ ID NO: 133958 - RNA, 22 nt, Human
uacaguaagaugaaauagcaau

SEQ ID NO: 133959 - RNA, 22 nt, Human
aagacagaccacgugacagggc

SEQ ID NO: 133960 - RNA, 20 nt, Human
ugucauuguuucuaggaccu

SEQ ID NO: 133961 - RNA, 22 nt, Human
gguggcagucuuaagagaucuu

SEQ ID NO: 133962 - RNA, 22 nt, Human
agucuauuuuugguucuucggg

SEQ ID NO: 133963 - RNA, 22 nt, Human
cugagagucagcuucuccuccu

SEQ ID NO: 133964 - RNA, 22 nt, Human
acagaaauauucguggugcuug

SEQ ID NO: 133965 - RNA, 22 nt, Human
gaauacauuggaaaucagaaua

SEQ ID NO: 133966 - RNA, 22 nt, Human
ccaggcaggcgauggugcagug

SEQ ID NO: 133967 - RNA, 22 nt, Human
aggcacuguucccaguuauccu

SEQ ID NO: 133968 - RNA, 22 nt, Human
ucuggcuguguaauauguguag

SEQ ID NO: 133969 - RNA, 21 nt, Human
uaaagaagaugaaugugauca

SEQ ID NO: 133970 - RNA, 22 nt, Human
auguggcuuucaugauuaagca

SEQ ID NO: 133971 - RNA, 22 nt, Human
gcucccaggaugaggagccagg

SEQ ID NO: 133972 - RNA, 19 nt, Human
ucucacaucagcuccuagc

SEQ ID NO: 133973 - RNA, 22 nt, Human
caguugaugggacucauguggg

SEQ ID NO: 133974 - RNA, 22 nt, Human
guguaauuauauaaagaucuac

SEQ ID NO: 133975 - RNA, 22 nt, Human
cgcugccaggauccccugccgg

SEQ ID NO: 133976 - RNA, 22 nt, Human
uugggcugaacccugcagcuga

SEQ ID NO: 133977 - RNA, 22 nt, Human
cagaagcacuaggaggaaacgu

SEQ ID NO: 133978 - RNA, 22 nt, Human
ccugagggaaggaugcuaccca

SEQ ID NO: 133979 - RNA, 22 nt, Human
aguggcugauguaggcaguggg

SEQ ID NO: 133980 - RNA, 22 nt, Human
gagcagcucugggugacccagu

SEQ ID NO: 133981 - RNA, 22 nt, Human
uccuugaaugaauguucucucc

SEQ ID NO: 133982 - RNA, 22 nt, Human
cagagcugauuggauccagaga

SEQ ID NO: 133983 - RNA, 22 nt, Human
uccuuggcagcagggagcauga

SEQ ID NO: 133984 - RNA, 22 nt, Human
cagcuccagcccaggcagcucc

SEQ ID NO: 133985 - RNA, 22 nt, Human
auuuuaucugcuuacuuucagg

SEQ ID NO: 133986 - RNA, 22 nt, Human
uggcucagcauucacuggucuu

SEQ ID NO: 133987 - RNA, 22 nt, Human
cucagagucugcauuucuguca

SEQ ID NO: 133988 - RNA, 22 nt, Human
ccacugaggcaggcaguaucua

SEQ ID NO: 133989 - RNA, 22 nt, Human
aauuaguauugcgauucauuag

SEQ ID NO: 133990 - RNA, 22 nt, Human
ucugcugcugagcacacuccua

SEQ ID NO: 133991 - RNA, 21 nt, Human
ucaaagcacauauuugcacau

SEQ ID NO: 133992 - RNA, 22 nt, Human
ugcagcaggagccaggccuggu

SEQ ID NO: 133993 - RNA, 22 nt, Human
acauacauaugacaacuuuccu

SEQ ID NO: 133994 - RNA, 22 nt, Human
ggcucagaccucccagcuccag

SEQ ID NO: 133995 - RNA, 22 nt, Human
aggcccuggcacugccugggag

SEQ ID NO: 133996 - RNA, 23 nt, Human
acauacauggagauaaagugaug

SEQ ID NO: 133997 - RNA, 22 nt, Human
uccagcucuaacaugcugggcc

SEQ ID NO: 133998 - RNA, 21 nt, Human
ccagaggccucucuuggccac

SEQ ID NO: 133999 - RNA, 22 nt, Human
cucucuggaagggggagcugau

SEQ ID NO: 134000 - RNA, 22 nt, Human
agucucagggccacccggggaa

SEQ ID NO: 134001 - RNA, 22 nt, Human
ugccugucuucaggagugucac

SEQ ID NO: 134002 - RNA, 22 nt, Human
gggcagggguagcauuccaagu

SEQ ID NO: 134003 - RNA, 22 nt, Human
gcagggcucugcuguaguccua

SEQ ID NO: 134004 - RNA, 20 nt, Human
ucugaggcugagcucuacuu

SEQ ID NO: 134005 - RNA, 23 nt, Human
gcagagcugcccuauugccuugg

SEQ ID NO: 134006 - RNA, 22 nt, Human
auugaaagauuuugggcucaug

SEQ ID NO: 134007 - RNA, 17 nt, Human
agauggcaggaggcaga

SEQ ID NO: 134008 - RNA, 22 nt, Human
gcuggcugggucccugagaggc

SEQ ID NO: 134009 - RNA, 22 nt, Human
accugccucagugcagcuggau

SEQ ID NO: 134010 - RNA, 22 nt, Human
agcagggcagugcuucagcucu

SEQ ID NO: 134011 - RNA, 22 nt, Human
gcagggccagguacaagaagca

SEQ ID NO: 134012 - RNA, 22 nt, Human
gugugggugggacaucaucuuu

SEQ ID NO: 134013 - RNA, 22 nt, Human
cagacagcugcuuucuugcugu

SEQ ID NO: 134014 - RNA, 22 nt, Human
guuucucuguaccucuguccca

SEQ ID NO: 134015 - RNA, 22 nt, Human
ugaggcagcaauuguauuguau

SEQ ID NO: 134016 - RNA, 22 nt, Human
guggcuucuggcugggccucag

SEQ ID NO: 134017 - RNA, 22 nt, Human
gcugucuuccuugcuccaaggg

SEQ ID NO: 134018 - RNA, 22 nt, Human
gcugccugccuugccuggagga

SEQ ID NO: 134019 - RNA, 22 nt, Human
cccucugccugcgcccuggugu

SEQ ID NO: 134020 - RNA, 22 nt, Human
gcugcucuugaggggcucacug

SEQ ID NO: 134021 - RNA, 17 nt, Human
gcugccaccuuuggagc

SEQ ID NO: 134022 - RNA, 22 nt, Human
uaaggccaggcuguggucggca

SEQ ID NO: 134023 - RNA, 22 nt, Human
aagccagcauuuucccauuccu

SEQ ID NO: 134024 - RNA, 22 nt, Human
cucuggaggccuaaggaagugg

SEQ ID NO: 134025 - RNA, 22 nt, Human
uagaaaugcaguguacuguguc

SEQ ID NO: 134026 - RNA, 22 nt, Human
gggagcaggagccugccugcca

SEQ ID NO: 134027 - RNA, 21 nt, Human
gcagagccggggcgagaaggc

SEQ ID NO: 134028 - RNA, 22 nt, Human
accugagccuagggagguugag

SEQ ID NO: 134029 - RNA, 22 nt, Human
agcuggggcugcagagaacagg

SEQ ID NO: 134030 - RNA, 22 nt, Human
uggccuguggcuuaaggucugu

SEQ ID NO: 134031 - RNA, 22 nt, Human
uuugacagauccuuaacucagc

SEQ ID NO: 134032 - RNA, 22 nt, Human
gccagcucagaugcaggaagga

SEQ ID NO: 134033 - RNA, 22 nt, Human
uggaaauguauuugggcaugcc

SEQ ID NO: 134034 - RNA, 22 nt, Human
gaagcccauuuguacagcacau

SEQ ID NO: 134035 - RNA, 22 nt, Human
ucuggcucaucucuccagguaa

SEQ ID NO: 134036 - RNA, 22 nt, Human
ucuugggauugcccugcaguuc

SEQ ID NO: 134037 - RNA, 19 nt, Human
gccugggaugggcagaacu

SEQ ID NO: 134038 - RNA, 22 nt, Human
gggagccuugggagugccagcc

SEQ ID NO: 134039 - RNA, 22 nt, Human
auuguauuuccagcuugaaugu

SEQ ID NO: 134040 - RNA, 22 nt, Human
gacagccaugcacuucugcugu

SEQ ID NO: 134041 - RNA, 22 nt, Human
ugucucaggggcauugaaauaa

SEQ ID NO: 134042 - RNA, 22 nt, Human
uuggaggcaaugggaaggaggc

SEQ ID NO: 134043 - RNA, 22 nt, Human
ggccuggcauggggacuaaggg

SEQ ID NO: 134044 - RNA, 22 nt, Human
uuugacagugaugauauauaca

SEQ ID NO: 134045 - RNA, 20 nt, Human
uccugggguaagccaugguc

SEQ ID NO: 134046 - RNA, 22 nt, Human
caguaauagaggcuuugagucu

SEQ ID NO: 134047 - RNA, 22 nt, Human
uaucuauuccaaauaucagcgu

SEQ ID NO: 134048 - RNA, 22 nt, Human
cuggugccuccucccugugcuu

SEQ ID NO: 134049 - RNA, 22 nt, Human
ggagaguggauuccagcuguau

SEQ ID NO: 134050 - RNA, 22 nt, Human
cugccagcucaaagcgcagcua

SEQ ID NO: 134051 - RNA, 17 nt, Human
ucaugcccaacuauuac

SEQ ID NO: 134052 - RNA, 22 nt, Human
ucuggagauaagacagacagau

SEQ ID NO: 134053 - RNA, 22 nt, Human
guccucagggaauguggcgggu

SEQ ID NO: 134054 - RNA, 22 nt, Human
gucugugugcacagcgagugcc

SEQ ID NO: 134055 - RNA, 22 nt, Human
ggccugcugcuaugacuuccug

SEQ ID NO: 134056 - RNA, 22 nt, Human
uuucaauguaugucuuucugag

SEQ ID NO: 134057 - RNA, 22 nt, Human
ccaaaguccauaguuuacauua

SEQ ID NO: 134058 - RNA, 22 nt, Human
cuccucacuuuccagacugggc

SEQ ID NO: 134059 - RNA, 22 nt, Human
cugccuuugcccuugacacugu

SEQ ID NO: 134060 - RNA, 22 nt, Human
agcagccagagaaugaugcagu

SEQ ID NO: 134061 - RNA, 21 nt, Human
ccagagccugcugagcccccu

SEQ ID NO: 134062 - RNA, 22 nt, Human
cuggccagggugcgaucguggu

SEQ ID NO: 134063 - RNA, 22 nt, Human
agggcagagagaugaaugggau

SEQ ID NO: 134064 - RNA, 22 nt, Human
ggcuuggaaaugguaaugagcu

SEQ ID NO: 134065 - RNA, 22 nt, Human
guacaguuuucaguguucacug

SEQ ID NO: 134066 - RNA, 22 nt, Human
ucuggcugcugcgugagugcuu

SEQ ID NO: 134067 - RNA, 22 nt, Human
ccuggccacucagguguggggc

SEQ ID NO: 134068 - RNA, 21 nt, Human
ugcaggaaagugcugcgaccc

SEQ ID NO: 134069 - RNA, 22 nt, Human
agauggguaacuggagucugcu

SEQ ID NO: 134070 - RNA, 22 nt, Human
agcagccaaaugaagauuuuac

SEQ ID NO: 134071 - RNA, 19 nt, Human
uuacaucugcaacacuggu

SEQ ID NO: 134072 - RNA, 22 nt, Human
guuacaguggguuuggggccca

SEQ ID NO: 134073 - RNA, 22 nt, Human
cagcuuggaggaggaucuaaga

SEQ ID NO: 134074 - RNA, 22 nt, Human
aaaaaucacuuuuauaggcagc

SEQ ID NO: 134075 - RNA, 22 nt, Human
cugugucucauccgccucuggc

SEQ ID NO: 134076 - RNA, 22 nt, Human
uauguguguaugacagacagag

SEQ ID NO: 134077 - RNA, 22 nt, Human
cagcuggcagcccuggcccugc

SEQ ID NO: 134078 - RNA, 22 nt, Human
uaugaagacaaugauagcauga

SEQ ID NO: 134079 - RNA, 22 nt, Human
ucuuugcaggccaaauuguuaa

SEQ ID NO: 134080 - RNA, 22 nt, Human
aauauaaugcuguuuuaugcca

SEQ ID NO: 134081 - RNA, 21 nt, Human
auuucagagcacacaaguaaa

SEQ ID NO: 134082 - RNA, 22 nt, Human
cuggccugaggucggcuguagg

SEQ ID NO: 134083 - RNA, 22 nt, Human
uuugacuucugggcauuuuggu

SEQ ID NO: 134084 - RNA, 22 nt, Human
uugaaaguccuucuugaguuac

SEQ ID NO: 134085 - RNA, 22 nt, Human
ccagcugcugugaggaccacag

SEQ ID NO: 134086 - RNA, 22 nt, Human
uugggcuggcagagguggucuu

SEQ ID NO: 134087 - RNA, 22 nt, Human
caggcagcaucagucugcugua

SEQ ID NO: 134088 - RNA, 22 nt, Human
gucuguguuuucaggccuuugu

SEQ ID NO: 134089 - RNA, 22 nt, Human
ggagccagaggcugcugcugug

SEQ ID NO: 134090 - RNA, 22 nt, Human
agggugggcuagacucuucccc

SEQ ID NO: 134091 - RNA, 22 nt, Human
aagcagcagaccugauuuugaa

SEQ ID NO: 134092 - RNA, 22 nt, Human
gugcaugugucuuuauaguagc

SEQ ID NO: 134093 - RNA, 22 nt, Human
gagcagcuccagccgcaugacu

SEQ ID NO: 134094 - RNA, 22 nt, Human
aguccaugguucugacucaucu

SEQ ID NO: 134095 - RNA, 21 nt, Human
ugcuuuaugggaaaaauguca

SEQ ID NO: 134096 - RNA, 22 nt, Human
cugggagggguagccaauccua

SEQ ID NO: 134097 - RNA, 22 nt, Human
uguggcugcaggcgauggagga

SEQ ID NO: 134098 - RNA, 18 nt, Human
cugaggcuggcaggagcc

SEQ ID NO: 134099 - RNA, 22 nt, Human
guuauuuuaucucugagagguu

SEQ ID NO: 134100 - RNA, 22 nt, Human
ugugccuucucaguccugcuca

SEQ ID NO: 134101 - RNA, 21 nt, Human
ucagaguggaagacaguuuga

SEQ ID NO: 134102 - RNA, 22 nt, Human
uagcagagcagggaucagagcc

SEQ ID NO: 134103 - RNA, 20 nt, Human
ugccagggccagcagaggcu

SEQ ID NO: 134104 - RNA, 22 nt, Human
uggccuccccuaacagccucuu

SEQ ID NO: 134105 - RNA, 22 nt, Human
ggucccagcugcucaagaggcu

SEQ ID NO: 134106 - RNA, 22 nt, Human
ggcaggagaauggcgugaacuc

SEQ ID NO: 134107 - RNA, 22 nt, Human
ucugagaggcagaccuuccuaa

SEQ ID NO: 134108 - RNA, 22 nt, Human
uucauucccuuauauuagcauu

SEQ ID NO: 134109 - RNA, 22 nt, Human
gcagugaaacaauaggaucaaa

SEQ ID NO: 134110 - RNA, 22 nt, Human
cggcugugucuucacaggagcc

SEQ ID NO: 134111 - RNA, 22 nt, Human
ucucagggugaggaaagaauuu

SEQ ID NO: 134112 - RNA, 22 nt, Human
agagccugucugccuuucuacc

SEQ ID NO: 134113 - RNA, 18 nt, Human
cccagcccaccauuucuc

SEQ ID NO: 134114 - RNA, 22 nt, Human
augcuuuacaguuuuccaaaca

SEQ ID NO: 134115 - RNA, 21 nt, Human
aucacauuggcuguuauuauu

SEQ ID NO: 134116 - RNA, 20 nt, Human
auccaugagagucuggauuc

SEQ ID NO: 134117 - RNA, 22 nt, Human
ccagcagagcauggggaggaag

SEQ ID NO: 134118 - RNA, 22 nt, Human
gucucuuuuauggugaguugau

SEQ ID NO: 134119 - RNA, 22 nt, Human
ccucagaguaggucucagcugu

SEQ ID NO: 134120 - RNA, 17 nt, Human
ucugccgacugccagcu

SEQ ID NO: 134121 - RNA, 22 nt, Human
ggcaggagggcggacaaugacc

SEQ ID NO: 134122 - RNA, 22 nt, Human
aucaaaguucguaacugauaac

SEQ ID NO: 134123 - RNA, 22 nt, Human
cugggugguucuaacuguugau

SEQ ID NO: 134124 - RNA, 22 nt, Human
uacaguguauguauuuguaggu

SEQ ID NO: 134125 - RNA, 22 nt, Human
uuucuucuugauuuaaacaggg

SEQ ID NO: 134126 - RNA, 22 nt, Human
cucugugugguaugauugucau

SEQ ID NO: 134127 - RNA, 22 nt, Human
uugcagcagggugaauucacuc

SEQ ID NO: 134128 - RNA, 22 nt, Human
gccuggguuccaugaucuccag

SEQ ID NO: 134129 - RNA, 17 nt, Human
uugggagagaaagguau

SEQ ID NO: 134130 - RNA, 22 nt, Human
gugggacucuucuuuggcagug

SEQ ID NO: 134131 - RNA, 22 nt, Human
uuucucugugccauuuccauaa

SEQ ID NO: 134132 - RNA, 22 nt, Human
gaggagggagcuggaagcucuu

SEQ ID NO: 134133 - RNA, 22 nt, Human
uucuuuguggcagugagcuggg

SEQ ID NO: 134134 - RNA, 22 nt, Human
uuaucauugucgcagucuaauu

SEQ ID NO: 134135 - RNA, 22 nt, Human
uuuucuaacaucuaguaauuug

SEQ ID NO: 134136 - RNA, 22 nt, Human
gagcagcuggacaggccucccu

SEQ ID NO: 134137 - RNA, 22 nt, Human
ggccugagcuugggcagcguau

SEQ ID NO: 134138 - RNA, 22 nt, Human
uuucucauggcccuuggcuuuu

SEQ ID NO: 134139 - RNA, 22 nt, Human
cagaaggcuuuguggaguagac

SEQ ID NO: 134140 - RNA, 22 nt, Human
auaauuaauuucaguaaucucc

SEQ ID NO: 134141 - RNA, 22 nt, Human
cccuggcaaaacacucucuuga

SEQ ID NO: 134142 - RNA, 22 nt, Human
uuugcauuccugccugcauuca

SEQ ID NO: 134143 - RNA, 22 nt, Human
gggcagaggcucuggcccaucc

SEQ ID NO: 134144 - RNA, 22 nt, Human
ggcucugcccagaugaagagga

SEQ ID NO: 134145 - RNA, 22 nt, Human
ugaugguuuuauuaauaggacc

SEQ ID NO: 134146 - RNA, 22 nt, Human
cuuuauguccaccagacugcaa

SEQ ID NO: 134147 - RNA, 22 nt, Human
uggccugcagaggcuguggggc

SEQ ID NO: 134148 - RNA, 22 nt, Human
gccuccuggauuuuagugccau

SEQ ID NO: 134149 - RNA, 21 nt, Human
cgcagagcgaacuugcggcgc

SEQ ID NO: 134150 - RNA, 22 nt, Human
uagaaagugaagguuaauuaau

SEQ ID NO: 134151 - RNA, 22 nt, Human
caggcacagaguuauucauuua

SEQ ID NO: 134152 - RNA, 22 nt, Human
ggggcagauggaacagagcaca

SEQ ID NO: 134153 - RNA, 22 nt, Human
ucugccuggaugauggcagggc

SEQ ID NO: 134154 - RNA, 22 nt, Human
ugucaugccauuuaaaauguuu

SEQ ID NO: 134155 - RNA, 22 nt, Human
uuucuaggucuuccauacugcc

SEQ ID NO: 134156 - RNA, 22 nt, Human
acaaagucugaaaccugaggca

SEQ ID NO: 134157 - RNA, 22 nt, Human
cucuuuacucuguguuauuguu

SEQ ID NO: 134158 - RNA, 22 nt, Human
ugucuguggcaauuguggguaa

SEQ ID NO: 134159 - RNA, 20 nt, Human
uaacuuucuaugcuuucagc

SEQ ID NO: 134160 - RNA, 22 nt, Human
cuagaaaaauacuuuauuguga

SEQ ID NO: 134161 - RNA, 22 nt, Human
ggcaggaggaagaguuagcacc

SEQ ID NO: 134162 - RNA, 22 nt, Human
cuggcucccucgcugaggugcu

SEQ ID NO: 134163 - RNA, 22 nt, Human
ugcagggccuucuagaccaugg

SEQ ID NO: 134164 - RNA, 22 nt, Human
ucucaagagggaggcaaucaug

SEQ ID NO: 134165 - RNA, 22 nt, Human
aaaaugugaucuacaaaugcaa

SEQ ID NO: 134166 - RNA, 22 nt, Human
gcagcagagaacacaaugaugg

SEQ ID NO: 134167 - RNA, 17 nt, Human
auccccagcaucuagaa

SEQ ID NO: 134168 - RNA, 22 nt, Human
uucugggacaucuggacaguuu

SEQ ID NO: 134169 - RNA, 22 nt, Human
guuuuccuucucagccauugcc

SEQ ID NO: 134170 - RNA, 22 nt, Human
acacaugcugauaagaauauaa

SEQ ID NO: 134171 - RNA, 22 nt, Human
caaagguaguauauauauuguu

SEQ ID NO: 134172 - RNA, 21 nt, Human
ugcaguauguauuuguaucca

SEQ ID NO: 134173 - RNA, 22 nt, Human
aucauuccacauguaccacuag

SEQ ID NO: 134174 - RNA, 22 nt, Human
cucccuggaggcccagaccugg

SEQ ID NO: 134175 - RNA, 22 nt, Human
augauauuugcaaugugcuugc

SEQ ID NO: 134176 - RNA, 22 nt, Human
agaaaacauuacauaggugugu

SEQ ID NO: 134177 - RNA, 22 nt, Human
cagaauuugaaguaauauucca

SEQ ID NO: 134178 - RNA, 22 nt, Human
ucucugugacagcuggguaugu

SEQ ID NO: 134179 - RNA, 22 nt, Human
auguuacauaguccuuauuugu

SEQ ID NO: 134180 - RNA, 22 nt, Human
ggggcagagcauagcuccaauu

SEQ ID NO: 134181 - RNA, 22 nt, Human
cugggaggugaacagaaaaacu

SEQ ID NO: 134182 - RNA, 20 nt, Human
cagaccugcacccacuucga

SEQ ID NO: 134183 - RNA, 22 nt, Human
ccagcuccaaguuugggcauca

SEQ ID NO: 134184 - RNA, 20 nt, Human
aguaggggaaugcaagagca

SEQ ID NO: 134185 - RNA, 22 nt, Human
acuuguuugaaucucucuagag

SEQ ID NO: 134186 - RNA, 22 nt, Human
gcugugugcugggcauggcacu

SEQ ID NO: 134187 - RNA, 22 nt, Human
agcagccagaaagggcagucga

SEQ ID NO: 134188 - RNA, 19 nt, Human
ucccgcccacugagcgugc

SEQ ID NO: 134189 - RNA, 22 nt, Human
cagucacacaaguggacuuggg

SEQ ID NO: 134190 - RNA, 22 nt, Human
ccugccugacagagaagguuca

SEQ ID NO: 134191 - RNA, 22 nt, Human
uuuucugugauucugagguugg

SEQ ID NO: 134192 - RNA, 22 nt, Human
aguuuguaucaauuugcuuuau

SEQ ID NO: 134193 - RNA, 18 nt, Human
ugucauugccagggaagc

SEQ ID NO: 134194 - RNA, 22 nt, Human
uuacagauuaaaaugcugaggu

SEQ ID NO: 134195 - RNA, 22 nt, Human
ggacagagcccugguggccuaa

SEQ ID NO: 134196 - RNA, 21 nt, Human
ugggaugggucugggaccagc

SEQ ID NO: 134197 - RNA, 22 nt, Human
auguggcuagugcaacugagaa

SEQ ID NO: 134198 - RNA, 22 nt, Human
gaagagcugcucagaacaugau

SEQ ID NO: 134199 - RNA, 22 nt, Human
agggcagagggugccucaccug

SEQ ID NO: 134200 - RNA, 22 nt, Human
acaggggaauuuacugucauua

SEQ ID NO: 134201 - RNA, 19 nt, Human
uacaaguaggcguuuucuc

SEQ ID NO: 134202 - RNA, 22 nt, Human
cuuauguacacacauauauugu

SEQ ID NO: 134203 - RNA, 22 nt, Human
uaacuuuuacuuaccaucugag

SEQ ID NO: 134204 - RNA, 20 nt, Human
caaugcacacagcugcuucu

SEQ ID NO: 134205 - RNA, 22 nt, Human
ugaaggccagcagagugaaggc

SEQ ID NO: 134206 - RNA, 18 nt, Human
gaggccugagaaccaggu

SEQ ID NO: 134207 - RNA, 22 nt, Human
ccugugucuuccccacuggugu

SEQ ID NO: 134208 - RNA, 18 nt, Human
agcugcagaccaggaggu

SEQ ID NO: 134209 - RNA, 22 nt, Human
gcucagggaacuuuuugcaggc

SEQ ID NO: 134210 - RNA, 22 nt, Human
guauuuucaagagcaguaguau

SEQ ID NO: 134211 - RNA, 22 nt, Human
uguaguguggccuaucuuugcc

SEQ ID NO: 134212 - RNA, 22 nt, Human
ggcaaggccuugcccagcauuc

SEQ ID NO: 134213 - RNA, 21 nt, Human
ucacaucuauguuaagcaaac

SEQ ID NO: 134214 - RNA, 22 nt, Human
agcaguggcugaagauguuccu

SEQ ID NO: 134215 - RNA, 22 nt, Human
uucaaugaggauagaacuggau

SEQ ID NO: 134216 - RNA, 22 nt, Human
ccagcuuguuugaagcucguca

SEQ ID NO: 134217 - RNA, 22 nt, Human
cccugccuuguuggagccuaug

SEQ ID NO: 134218 - RNA, 22 nt, Human
ugugugugacucauacuagaac

SEQ ID NO: 134219 - RNA, 22 nt, Human
cagggugccucccgcucgccgg

SEQ ID NO: 134220 - RNA, 22 nt, Human
ucuuugcaaauguuauuaucuu

SEQ ID NO: 134221 - RNA, 22 nt, Human
gccuggcaggccucaugagggg

SEQ ID NO: 134222 - RNA, 22 nt, Human
gcccugucccuuggcuucuagg

SEQ ID NO: 134223 - RNA, 22 nt, Human
cugugugcaacuugcaguuuug

SEQ ID NO: 134224 - RNA, 22 nt, Human
ugcuagaauaccuaccuggagg

SEQ ID NO: 134225 - RNA, 22 nt, Human
cucaggggaccuggcuccgagu

SEQ ID NO: 134226 - RNA, 22 nt, Human
ucugcguggcugcugugagcgu

SEQ ID NO: 134227 - RNA, 22 nt, Human
gccugggugucgaucacuagug

SEQ ID NO: 134228 - RNA, 22 nt, Human
gaaaugugaccuacuuccuugu

SEQ ID NO: 134229 - RNA, 22 nt, Human
ccggggacuuaaagugaaggaa

SEQ ID NO: 134230 - RNA, 22 nt, Human
cuggcugucuucugggagcugu

SEQ ID NO: 134231 - RNA, 22 nt, Human
cuuugaaagcucccaggacuua

SEQ ID NO: 134232 - RNA, 22 nt, Human
gucuuguuugggauguggaugg

SEQ ID NO: 134233 - RNA, 22 nt, Human
ucugcuuuagaauccaguagcu

SEQ ID NO: 134234 - RNA, 22 nt, Human
ucagcugaaguggagaagcaga

SEQ ID NO: 134235 - RNA, 22 nt, Human
uggaggaugccauccaggauac

SEQ ID NO: 134236 - RNA, 23 nt, Human
ugcagccacucaggagcucagug

SEQ ID NO: 134237 - RNA, 22 nt, Human
agacagggucuugaucagagcu

SEQ ID NO: 134238 - RNA, 22 nt, Human
uuggaugaagucuagcuuuagu

SEQ ID NO: 134239 - RNA, 22 nt, Human
acuguguccucauguggcagaa

SEQ ID NO: 134240 - RNA, 22 nt, Human
gauuucuucauucauuagaugg

SEQ ID NO: 134241 - RNA, 23 nt, Human
uggaccugaaccagugccucugu

SEQ ID NO: 134242 - RNA, 22 nt, Human
agauuuagacugccuuaaucau

SEQ ID NO: 134243 - RNA, 22 nt, Human
uuguguauuuuuugauacuaac

SEQ ID NO: 134244 - RNA, 22 nt, Human
agcaguggccuggggcucugug

SEQ ID NO: 134245 - RNA, 22 nt, Human
acagugauugggguaucugcag

SEQ ID NO: 134246 - RNA, 22 nt, Human
auggauaagaacaaauaucuga

SEQ ID NO: 134247 - RNA, 22 nt, Human
ccugguguugugaaguagccgu

SEQ ID NO: 134248 - RNA, 19 nt, Human
aggguccagggagcggcuc

SEQ ID NO: 134249 - RNA, 22 nt, Human
ucccagagcugauaagccuuua

SEQ ID NO: 134250 - RNA, 22 nt, Human
cauguaaaacacucagaacagu

SEQ ID NO: 134251 - RNA, 22 nt, Human
ugaaaguuacaggaaaacagau

SEQ ID NO: 134252 - RNA, 22 nt, Human
gagcuguccgccccugggccga

SEQ ID NO: 134253 - RNA, 22 nt, Human
agcauggggcuccgcaaugaac

SEQ ID NO: 134254 - RNA, 22 nt, Human
gacauucacaguuuccgauggu

SEQ ID NO: 134255 - RNA, 22 nt, Human
uuuuuggguccaggcuguaucu

SEQ ID NO: 134256 - RNA, 22 nt, Human
ucuggagccuuggaugggaaag

SEQ ID NO: 134257 - RNA, 22 nt, Human
gagaggucaucucccaucagca

SEQ ID NO: 134258 - RNA, 22 nt, Human
uuugaaagucaaccuuccaguu

SEQ ID NO: 134259 - RNA, 22 nt, Human
uucuaacuuaacacuccuguga

SEQ ID NO: 134260 - RNA, 22 nt, Human
uaauuucuucaucucugcagcu

SEQ ID NO: 134261 - RNA, 22 nt, Human
uuccaugacaccgagggaaguc

SEQ ID NO: 134262 - RNA, 22 nt, Human
gggccagagcuuggcagcuggg

SEQ ID NO: 134263 - RNA, 22 nt, Human
caaugauguuuagauaaaaucc

SEQ ID NO: 134264 - RNA, 18 nt, Human
ccugagcccugcuuacuu

SEQ ID NO: 134265 - RNA, 22 nt, Human
ucugucaggagauuggcagcug

SEQ ID NO: 134266 - RNA, 22 nt, Human
ggcuucccagcagagggcgcac

SEQ ID NO: 134267 - RNA, 22 nt, Human
uucuuucccaguagaugugaaa

SEQ ID NO: 134268 - RNA, 21 nt, Human
augaagucuaugcuucugugu

SEQ ID NO: 134269 - RNA, 22 nt, Human
ugcccaggguggagugcagcgg

SEQ ID NO: 134270 - RNA, 22 nt, Human
gcuccagguauuugcccuuuua

SEQ ID NO: 134271 - RNA, 22 nt, Human
aguggcugacaacuggguuaac

SEQ ID NO: 134272 - RNA, 22 nt, Human
gcuggcagguccaagauagagc

SEQ ID NO: 134273 - RNA, 22 nt, Human
agagccuugaagaucuggaaaa

SEQ ID NO: 134274 - RNA, 22 nt, Human
acucuuuuauaaagcaucuuga

SEQ ID NO: 134275 - RNA, 22 nt, Human
ggagugggcagcacugcccugu

SEQ ID NO: 134276 - RNA, 22 nt, Human
gcauugucaaaagugguaugac

SEQ ID NO: 134277 - RNA, 22 nt, Human
uagaaaucagcaggcauaugua

SEQ ID NO: 134278 - RNA, 22 nt, Human
guuuuuaucuaauagcaguuau

SEQ ID NO: 134279 - RNA, 22 nt, Human
ggcucagggaaugaggaagaau

SEQ ID NO: 134280 - RNA, 22 nt, Human
agguacaguagacagacaguua

SEQ ID NO: 134281 - RNA, 22 nt, Human
cagcccugcacgcugccuccgc

SEQ ID NO: 134282 - RNA, 22 nt, Human
cgugucaucugagccuugggcg

SEQ ID NO: 134283 - RNA, 22 nt, Human
gcauuuauuucuuuacugcauc

SEQ ID NO: 134284 - RNA, 22 nt, Human
ucccaaagcuacucuucugacu

SEQ ID NO: 134285 - RNA, 22 nt, Human
ugcugcacgauaaauaauuucu

SEQ ID NO: 134286 - RNA, 22 nt, Human
cucaagacugaucgcaguggaa

SEQ ID NO: 134287 - RNA, 22 nt, Human
ucccagaggcuccagucucuau

SEQ ID NO: 134288 - RNA, 22 nt, Human
guuugugucaaugacuucugca

SEQ ID NO: 134289 - RNA, 22 nt, Human
ccaaggcuggagugcaguggcg

SEQ ID NO: 134290 - RNA, 22 nt, Human
uuucacagauauaagauuucac

SEQ ID NO: 134291 - RNA, 22 nt, Human
ucugggaaguccucugucaugc

SEQ ID NO: 134292 - RNA, 22 nt, Human
uguuuaagcugaugagguaucg

SEQ ID NO: 134293 - RNA, 22 nt, Human
gggcugagggguaucucauggg

SEQ ID NO: 134294 - RNA, 22 nt, Human
ugcugcuccugccuggcuccca

SEQ ID NO: 134295 - RNA, 22 nt, Human
gguucacacuuucaugauuuca

SEQ ID NO: 134296 - RNA, 22 nt, Human
ugccugaugcaggaguaucaga

SEQ ID NO: 134297 - RNA, 22 nt, Human
agccaggaaugcaugcucugcu

SEQ ID NO: 134298 - RNA, 21 nt, Human
agugaaaugaaguguaugcuc

SEQ ID NO: 134299 - RNA, 22 nt, Human
ugccacacagucugguagaaua

SEQ ID NO: 134300 - RNA, 22 nt, Human
caaacugagcaucagaaaguuu

SEQ ID NO: 134301 - RNA, 22 nt, Human
aaaaaugcuuggacuuaauaaa

SEQ ID NO: 134302 - RNA, 22 nt, Human
ugcagcugcuugauucaucuug

SEQ ID NO: 134303 - RNA, 22 nt, Human
gugcaugugcauccauguguac

SEQ ID NO: 134304 - RNA, 22 nt, Human
caagcagacaguaggccuagaa

SEQ ID NO: 134305 - RNA, 22 nt, Human
aguguguaagggaucaaagagu

SEQ ID NO: 134306 - RNA, 22 nt, Human
uccucuuucucaacauuaguua

SEQ ID NO: 134307 - RNA, 22 nt, Human
uuucacauaaauauuaugccua

SEQ ID NO: 134308 - RNA, 22 nt, Human
ucucuacagauccuauauagaa

SEQ ID NO: 134309 - RNA, 22 nt, Human
gcugggcugagcuagacuuggc

SEQ ID NO: 134310 - RNA, 22 nt, Human
ucuggcuccaccuccuuuacua

SEQ ID NO: 134311 - RNA, 22 nt, Human
ugcucuggguccugggccuccu

SEQ ID NO: 134312 - RNA, 21 nt, Human
ccagcuccaggaccuuggauc

SEQ ID NO: 134313 - RNA, 22 nt, Human
ugucaccucuuuggcugcagcu

SEQ ID NO: 134314 - RNA, 22 nt, Human
aggcacugugcugaugucuuau

SEQ ID NO: 134315 - RNA, 22 nt, Human
cccccaggcucugacacaggag

SEQ ID NO: 134316 - RNA, 22 nt, Human
uucuacagacuauaacugugau

SEQ ID NO: 134317 - RNA, 22 nt, Human
accucugcuucccggguucaag

SEQ ID NO: 134318 - RNA, 22 nt, Human
cagcauugaucccaggcugugg

SEQ ID NO: 134319 - RNA, 22 nt, Human
agggcagcagcccauggcucug

SEQ ID NO: 134320 - RNA, 22 nt, Human
cugccagccaggccagguaggc

SEQ ID NO: 134321 - RNA, 22 nt, Human
agcucagcuuccucuccaugcu

SEQ ID NO: 134322 - RNA, 22 nt, Human
agcagccauccuuagagaaaga

SEQ ID NO: 134323 - RNA, 17 nt, Human
uucaaugauuaaugcau

SEQ ID NO: 134324 - RNA, 22 nt, Human
cugugugugaacacagcccagc

SEQ ID NO: 134325 - RNA, 22 nt, Human
auaguggugagcugcauuuaug

SEQ ID NO: 134326 - RNA, 22 nt, Human
cagcccugagaaggaggaucuc

SEQ ID NO: 134327 - RNA, 22 nt, Human
aagaauucacugguagagucaa

SEQ ID NO: 134328 - RNA, 22 nt, Human
ccagcccugccagagagagcug

SEQ ID NO: 134329 - RNA, 22 nt, Human
acagagaugcaaguguguauuu

SEQ ID NO: 134330 - RNA, 22 nt, Human
uccucaggcugccuggaagacu

SEQ ID NO: 134331 - RNA, 22 nt, Human
agcagcaucuucuguucuccgc

SEQ ID NO: 134332 - RNA, 22 nt, Human
aguggcugaauauauuuuacua

SEQ ID NO: 134333 - RNA, 22 nt, Human
uauucacaguugauuuacaguu

SEQ ID NO: 134334 - RNA, 22 nt, Human
ggucccugcugaagccuuggug

SEQ ID NO: 134335 - RNA, 22 nt, Human
ucuaaagaagaggguucugcgg

SEQ ID NO: 134336 - RNA, 22 nt, Human
uuacaguuagaaucugaugaaa

SEQ ID NO: 134337 - RNA, 22 nt, Human
ccugagagagaagcgaccuggu

SEQ ID NO: 134338 - RNA, 22 nt, Human
agagcagagggcucugggacaa

SEQ ID NO: 134339 - RNA, 22 nt, Human
ccacacagggggaugaguuauu

SEQ ID NO: 134340 - RNA, 22 nt, Human
gccuggcccagggcucuuguug

SEQ ID NO: 134341 - RNA, 22 nt, Human
uauaucaccaaaaacaguucug

SEQ ID NO: 134342 - RNA, 22 nt, Human
auguagcagaagauguuuuccu

SEQ ID NO: 134343 - RNA, 22 nt, Human
aucucucugcccaggggcugug

SEQ ID NO: 134344 - RNA, 22 nt, Human
aggcugugacagggucauggag

SEQ ID NO: 134345 - RNA, 22 nt, Human
aaacucuggagauguuuaugca

SEQ ID NO: 134346 - RNA, 20 nt, Human
uuagcaguagagugugcuuc

SEQ ID NO: 134347 - RNA, 16 nt, Human
uggaaggggucuccgg

SEQ ID NO: 134348 - RNA, 22 nt, Human
caguguguggauccucccagga

SEQ ID NO: 134349 - RNA, 22 nt, Human
ucacaaaugaggaaaucgagca

SEQ ID NO: 134350 - RNA, 22 nt, Human
caguucuuauuuggccaguguc

SEQ ID NO: 134351 - RNA, 22 nt, Human
uucagaauauuuguuuuacaug

SEQ ID NO: 134352 - RNA, 22 nt, Human
aggccagaugucgggcuagaag

SEQ ID NO: 134353 - RNA, 19 nt, Human
ugucucagugucccuuccu

SEQ ID NO: 134354 - RNA, 22 nt, Human
cugucuccagggcaggugcagg

SEQ ID NO: 134355 - RNA, 22 nt, Human
auguauuucuauguagugaaga

SEQ ID NO: 134356 - RNA, 22 nt, Human
ucauguguguuucauguaugga

SEQ ID NO: 134357 - RNA, 22 nt, Human
gcuguccugggaacaggcacua

SEQ ID NO: 134358 - RNA, 22 nt, Human
gcugccaguguggcaugaugca

SEQ ID NO: 134359 - RNA, 22 nt, Human
cucuucuuuaguccagaccauc

SEQ ID NO: 134360 - RNA, 22 nt, Human
uccagucaucucccuucacauu

SEQ ID NO: 134361 - RNA, 22 nt, Human
aagugggaauagaaaugaaggu

SEQ ID NO: 134362 - RNA, 22 nt, Human
ccagggugggguccaggaacca

SEQ ID NO: 134363 - RNA, 22 nt, Human
cugggccugguagggcuugaaa

SEQ ID NO: 134364 - RNA, 22 nt, Human
cagauggaacacagaaaggaga

SEQ ID NO: 134365 - RNA, 22 nt, Human
uguuuuaaagccauugccuuuc

SEQ ID NO: 134366 - RNA, 22 nt, Human
ccuuuuauacucuguccucugg

SEQ ID NO: 134367 - RNA, 21 nt, Human
ugcauaaagaaauacaaauac

SEQ ID NO: 134368 - RNA, 22 nt, Human
aaaucuguaagcaauugcucag

SEQ ID NO: 134369 - RNA, 22 nt, Human
ucagugugaggucuuccacccg

SEQ ID NO: 134370 - RNA, 22 nt, Human
gaggccugggagccuguccucc

SEQ ID NO: 134371 - RNA, 22 nt, Human
gccucugggcucugccccuggc

SEQ ID NO: 134372 - RNA, 22 nt, Human
cuuuucucuuacauuccacugg

SEQ ID NO: 134373 - RNA, 22 nt, Human
uaauuauuugaagacauuagag

SEQ ID NO: 134374 - RNA, 22 nt, Human
caagagcauuuaguuagcuggu

SEQ ID NO: 134375 - RNA, 19 nt, Human
cucagcuguagcucaugug

SEQ ID NO: 134376 - RNA, 22 nt, Human
cugcugcaggaugggcacucug

SEQ ID NO: 134377 - RNA, 19 nt, Human
gcacugaagaguuggucac

SEQ ID NO: 134378 - RNA, 22 nt, Human
guucucucucuugccugggugg

SEQ ID NO: 134379 - RNA, 22 nt, Human
caagggcucacggucugcuggg

SEQ ID NO: 134380 - RNA, 22 nt, Human
gagagcuguguucauucuacca

SEQ ID NO: 134381 - RNA, 22 nt, Human
ccuggcuuccuggagcucacaa

SEQ ID NO: 134382 - RNA, 22 nt, Human
agacacaggauucugcauuucu

SEQ ID NO: 134383 - RNA, 22 nt, Human
aaaaguuaccucuguaauauaa

SEQ ID NO: 134384 - RNA, 22 nt, Human
gaaggccucacucugcagcaua

SEQ ID NO: 134385 - RNA, 22 nt, Human
acccaggagcaggcugggcagu

SEQ ID NO: 134386 - RNA, 22 nt, Human
ucacaccuguaaucccaggccu

SEQ ID NO: 134387 - RNA, 22 nt, Human
cugcccagaaucacucacucga

SEQ ID NO: 134388 - RNA, 22 nt, Human
ggcagggaaacagcugauccca

SEQ ID NO: 134389 - RNA, 22 nt, Human
auucaguuaaaaacuguacuuc

SEQ ID NO: 134390 - RNA, 17 nt, Human
ugaggccugcaucagug

SEQ ID NO: 134391 - RNA, 22 nt, Human
ccucuggcaacuucacagccca

SEQ ID NO: 134392 - RNA, 22 nt, Human
aguggcuguacuauuuuuucau

SEQ ID NO: 134393 - RNA, 23 nt, Human
uuguacagcccagauuccucuuc

SEQ ID NO: 134394 - RNA, 22 nt, Human
cagcauggggaucacuguaggc

SEQ ID NO: 134395 - RNA, 22 nt, Human
agcagcauguucauuacauuau

SEQ ID NO: 134396 - RNA, 22 nt, Human
acaguagugcucaaucaguguu

SEQ ID NO: 134397 - RNA, 23 nt, Human
uuuggacuugugacucuucuccu

SEQ ID NO: 134398 - RNA, 22 nt, Human
ugagccuggccugcagagacca

SEQ ID NO: 134399 - RNA, 22 nt, Human
cugagcauggccgguccauggu

SEQ ID NO: 134400 - RNA, 22 nt, Human
gcagguguggaguggggugagc

SEQ ID NO: 134401 - RNA, 22 nt, Human
aagauucuacaguagguacauu

SEQ ID NO: 134402 - RNA, 22 nt, Human
auuuggcaacauuaauugaauc

SEQ ID NO: 134403 - RNA, 22 nt, Human
guuguauagagggcaugaaucu

SEQ ID NO: 134404 - RNA, 22 nt, Human
ccaggcagcucugauuuauguc

SEQ ID NO: 134405 - RNA, 22 nt, Human
cucacugugaccucagcagaca

SEQ ID NO: 134406 - RNA, 22 nt, Human
agcagccacagucugggacagg

SEQ ID NO: 134407 - RNA, 22 nt, Human
gaugagcauuguuucauguguu

SEQ ID NO: 134408 - RNA, 22 nt, Human
ucccaggguccucuucuggaau

SEQ ID NO: 134409 - RNA, 22 nt, Human
uuugcaguagacaucuuauuuu

SEQ ID NO: 134410 - RNA, 22 nt, Human
agggcagaggcggacacggaag

SEQ ID NO: 134411 - RNA, 22 nt, Human
uggcagaggaggcucagauuga

SEQ ID NO: 134412 - RNA, 22 nt, Human
ucacaugcuacugagccagacc

SEQ ID NO: 134413 - RNA, 22 nt, Human
agaaagcacucugucuuuuacc

SEQ ID NO: 134414 - RNA, 22 nt, Human
uaguccagccuuggguguagcc

SEQ ID NO: 134415 - RNA, 22 nt, Human
auauuauucuagcucuugugug

SEQ ID NO: 134416 - RNA, 22 nt, Human
uggcugugggaugagagccuca

SEQ ID NO: 134417 - RNA, 22 nt, Human
uaugcacacaggcuuaauucau

SEQ ID NO: 134418 - RNA, 22 nt, Human
guacaguagagccagguucagu

SEQ ID NO: 134419 - RNA, 22 nt, Human
ggguccagcgacagcaggcuca

SEQ ID NO: 134420 - RNA, 18 nt, Human
ucuuccaacacugacacc

SEQ ID NO: 134421 - RNA, 22 nt, Human
gcuccugucuuggggcacuggc

SEQ ID NO: 134422 - RNA, 22 nt, Human
ggaugcugacuuuggagcaugg

SEQ ID NO: 134423 - RNA, 22 nt, Human
cccagccucuguuugcuccucu

SEQ ID NO: 134424 - RNA, 22 nt, Human
ugcagaaggccugacauugcac

SEQ ID NO: 134425 - RNA, 20 nt, Human
ccucaggaugagggugagca

SEQ ID NO: 134426 - RNA, 22 nt, Human
aguuauaaucugcuacugauau

SEQ ID NO: 134427 - RNA, 22 nt, Human
gacauucacagguaaacauucc

SEQ ID NO: 134428 - RNA, 22 nt, Human
acagaguauuggaaaggcagug

SEQ ID NO: 134429 - RNA, 22 nt, Human
caggaggcuccuagggcucugu

SEQ ID NO: 134430 - RNA, 22 nt, Human
aaugucugccagaacugaucau

SEQ ID NO: 134431 - RNA, 18 nt, Human
gagcugccauauuuaguu

SEQ ID NO: 134432 - RNA, 22 nt, Human
gggcuaggcuuggccagcacug

SEQ ID NO: 134433 - RNA, 22 nt, Human
acauuuguaugcguuuuuacug

SEQ ID NO: 134434 - RNA, 22 nt, Human
ggacucuguuuuccugaucacu

SEQ ID NO: 134435 - RNA, 15 nt, Human
cuguggcuaaccuaa

SEQ ID NO: 134436 - RNA, 22 nt, Human
ucagugaucuaaggguauggcc

SEQ ID NO: 134437 - RNA, 22 nt, Human
aauauccacacugugucccugc

SEQ ID NO: 134438 - RNA, 22 nt, Human
cucagcagcagggaagagguca

SEQ ID NO: 134439 - RNA, 22 nt, Human
augccugucucagggucuguuu

SEQ ID NO: 134440 - RNA, 22 nt, Human
gggcugcugcugccagcgacac

SEQ ID NO: 134441 - RNA, 22 nt, Human
uaacagaagaaaacauauugga

SEQ ID NO: 134442 - RNA, 22 nt, Human
gaguuauucuagguccuuugua

SEQ ID NO: 134443 - RNA, 22 nt, Human
cuacugaguccuucagcugcca

SEQ ID NO: 134444 - RNA, 22 nt, Human
uacccaggagaaacagcagggc

SEQ ID NO: 134445 - RNA, 21 nt, Human
uuucacaaaaguaugugacaa

SEQ ID NO: 134446 - RNA, 22 nt, Human
agacaucagcuugugugcaggg

SEQ ID NO: 134447 - RNA, 22 nt, Human
ccaggagcaaagaucacuggga

SEQ ID NO: 134448 - RNA, 22 nt, Human
ucucaggaguagugggauccau

SEQ ID NO: 134449 - RNA, 19 nt, Human
aauacaguguuauagaauu

SEQ ID NO: 134450 - RNA, 22 nt, Human
uucuccaacacaagcaugaugu

SEQ ID NO: 134451 - RNA, 22 nt, Human
agucagugaaaacuagaauguu

SEQ ID NO: 134452 - RNA, 22 nt, Human
uuaacauuguccuuagcagauu

SEQ ID NO: 134453 - RNA, 22 nt, Human
cagcagcugcgugcccaggccg

SEQ ID NO: 134454 - RNA, 22 nt, Human
cugcuccacaccuccauuuccu

SEQ ID NO: 134455 - RNA, 22 nt, Human
ccugggagcuguggaaaggcug

SEQ ID NO: 134456 - RNA, 22 nt, Human
accucugcaaugcaaugucaug

SEQ ID NO: 134457 - RNA, 22 nt, Human
cagcagcaugaauucgagccac

SEQ ID NO: 134458 - RNA, 22 nt, Human
ugaugcugagccugggacugac

SEQ ID NO: 134459 - RNA, 22 nt, Human
cucugcauuuuaacagaugauu

SEQ ID NO: 134460 - RNA, 17 nt, Human
gugcagggaugaaggau

SEQ ID NO: 134461 - RNA, 22 nt, Human
ugcuauaagaauuauauuacuc

SEQ ID NO: 134462 - RNA, 22 nt, Human
ucacaacucuuuccauuuaaua

SEQ ID NO: 134463 - RNA, 21 nt, Human
aaggagccuaggaggcucagg

SEQ ID NO: 134464 - RNA, 22 nt, Human
uccagagggcgauggcuggggg

SEQ ID NO: 134465 - RNA, 22 nt, Human
gcugaagagagaugcguccagc

SEQ ID NO: 134466 - RNA, 22 nt, Human
agugucauaugccacugcaucc

SEQ ID NO: 134467 - RNA, 22 nt, Human
uucauugugauucuuggcuagc

SEQ ID NO: 134468 - RNA, 19 nt, Human
uggcagggagaguuugaag

SEQ ID NO: 134469 - RNA, 21 nt, Human
ccugagccuguuuauccagaa

SEQ ID NO: 134470 - RNA, 22 nt, Human
cugaaaauguuacacaggaaga

SEQ ID NO: 134471 - RNA, 22 nt, Human
ugcauuguaggauguuuagcag

SEQ ID NO: 134472 - RNA, 22 nt, Human
uuugaaaggaaguuaauacuuu

SEQ ID NO: 134473 - RNA, 20 nt, Human
gggguuggcuggcacaggga

SEQ ID NO: 134474 - RNA, 22 nt, Human
cagucucucagcuuucagcugu

SEQ ID NO: 134475 - RNA, 22 nt, Human
uuugacuuugggcucuaacuca

SEQ ID NO: 134476 - RNA, 22 nt, Human
cagcuggcuggucagugcacaa

SEQ ID NO: 134477 - RNA, 20 nt, Human
ucacaggggaccaggagcag

SEQ ID NO: 134478 - RNA, 21 nt, Human
ggcagcugaccgcgcggugca

SEQ ID NO: 134479 - RNA, 22 nt, Human
aguuuucugccucuggaugcgu

SEQ ID NO: 134480 - RNA, 22 nt, Human
aggccuggccugggcggcauug

SEQ ID NO: 134481 - RNA, 22 nt, Human
ucugucacuuuuauuuacugaa

SEQ ID NO: 134482 - RNA, 22 nt, Human
agagccagcaagugaauaguga

SEQ ID NO: 134483 - RNA, 22 nt, Human
uuugaaagacagaauauuuuug

SEQ ID NO: 134484 - RNA, 20 nt, Human
ugugugcuaggacuacagug

SEQ ID NO: 134485 - RNA, 22 nt, Human
ucuuuccuagaggcugaugagu

SEQ ID NO: 134486 - RNA, 22 nt, Human
uuugaacugauaaucuucuguu

SEQ ID NO: 134487 - RNA, 22 nt, Human
uggagaagucaaagugaacagg

SEQ ID NO: 134488 - RNA, 20 nt, Human
agccagaagaaggcuggaga

SEQ ID NO: 134489 - RNA, 22 nt, Human
gggccuggcaugcagccccguu

SEQ ID NO: 134490 - RNA, 22 nt, Human
aguacauuuuucaguggggagu

SEQ ID NO: 134491 - RNA, 22 nt, Human
cagacuugacggcagcugcuuu

SEQ ID NO: 134492 - RNA, 22 nt, Human
uuguauuagcuguaaauuuucu

SEQ ID NO: 134493 - RNA, 21 nt, Human
aggcucagagaucaaacagua

SEQ ID NO: 134494 - RNA, 22 nt, Human
ucagagaaaugaaguagggauu

SEQ ID NO: 134495 - RNA, 22 nt, Human
acaguaauaaguguuggugagg

SEQ ID NO: 134496 - RNA, 22 nt, Human
gcucagagaaucagcagacacc

SEQ ID NO: 134497 - RNA, 22 nt, Human
caggguggaagcuguagagugg

SEQ ID NO: 134498 - RNA, 22 nt, Human
ucgagcucuggagccaaggaug

SEQ ID NO: 134499 - RNA, 22 nt, Human
ucuaaaaaagucuguucacuug

SEQ ID NO: 134500 - RNA, 22 nt, Human
uucuguguugugacauucuaga

SEQ ID NO: 134501 - RNA, 22 nt, Human
gcaggccugacuguagggggca

SEQ ID NO: 134502 - RNA, 22 nt, Human
ucuucagacuccaaauguuuua

SEQ ID NO: 134503 - RNA, 22 nt, Human
caggcaccccaggugagcacug

SEQ ID NO: 134504 - RNA, 22 nt, Human
cuguccugauggugccacuggu

SEQ ID NO: 134505 - RNA, 22 nt, Human
ccagcagcccucuuccaagacu

SEQ ID NO: 134506 - RNA, 22 nt, Human
aaguauauuuagcugagcuugu

SEQ ID NO: 134507 - RNA, 17 nt, Human
acaagcaguggccaugg

SEQ ID NO: 134508 - RNA, 22 nt, Human
uuuaaauuuagaagaaacacug

SEQ ID NO: 134509 - RNA, 22 nt, Human
ugagccuguggggugacaacca

SEQ ID NO: 134510 - RNA, 22 nt, Human
gcucuguguccacagcuggaaa

SEQ ID NO: 134511 - RNA, 19 nt, Human
aggcugugaggggaaggaa

SEQ ID NO: 134512 - RNA, 22 nt, Human
acacagggauauuucagguggu

SEQ ID NO: 134513 - RNA, 22 nt, Human
uggaaugacagagagucugaau

SEQ ID NO: 134514 - RNA, 18 nt, Human
uggacaggguggagaaaa

SEQ ID NO: 134515 - RNA, 22 nt, Human
agcugugugaccuagggcaagc

SEQ ID NO: 134516 - RNA, 22 nt, Human
aauguuaaaaccuucagugcuu

SEQ ID NO: 134517 - RNA, 20 nt, Human
aucagcaacugccacucagu

SEQ ID NO: 134518 - RNA, 23 nt, Human
uaucauuucagcucucugccugg

SEQ ID NO: 134519 - RNA, 22 nt, Human
gccugguggacacugggcauca

SEQ ID NO: 134520 - RNA, 22 nt, Human
uuagaaaucaccucugaagauc

SEQ ID NO: 134521 - RNA, 22 nt, Human
guacauguugguuguuuccagu

SEQ ID NO: 134522 - RNA, 20 nt, Human
gcugccuguuucuguaagua

SEQ ID NO: 134523 - RNA, 22 nt, Human
ccagucagccaagcugcagcgg

SEQ ID NO: 134524 - RNA, 22 nt, Human
acagugaucaguuacugucugu

SEQ ID NO: 134525 - RNA, 22 nt, Human
cugagcuggucuauggacuugg

SEQ ID NO: 134526 - RNA, 20 nt, Human
ccagaagagaugaucaucca

SEQ ID NO: 134527 - RNA, 22 nt, Human
uugucuguccaggcaccccaag

SEQ ID NO: 134528 - RNA, 22 nt, Human
cucucuuucauuggucgccuug

SEQ ID NO: 134529 - RNA, 22 nt, Human
gcugagugaaaguuugcugugu

SEQ ID NO: 134530 - RNA, 22 nt, Human
ugggaccaagucauuucuuuag

SEQ ID NO: 134531 - RNA, 21 nt, Human
acaggcucuggggaugcuggg

SEQ ID NO: 134532 - RNA, 22 nt, Human
uuaguuuucccaucuuuauggu

SEQ ID NO: 134533 - RNA, 23 nt, Human
cccagagcacagccuccagaugc

SEQ ID NO: 134534 - RNA, 22 nt, Human
agggacuuguguccuauguaug

SEQ ID NO: 134535 - RNA, 22 nt, Human
aaagguaguacuucuagaaggg

SEQ ID NO: 134536 - RNA, 22 nt, Human
gugauauuucaagaguggggca

SEQ ID NO: 134537 - RNA, 22 nt, Human
gggcaugguggugcacaccugu

SEQ ID NO: 134538 - RNA, 22 nt, Human
gcuguauuuaacaacuggcuca

SEQ ID NO: 134539 - RNA, 22 nt, Human
aaggcagagggcuggaucagag

SEQ ID NO: 134540 - RNA, 22 nt, Human
aacaguauugguugaacucaag

SEQ ID NO: 134541 - RNA, 22 nt, Human
uuucccagagguaugaauaagu

SEQ ID NO: 134542 - RNA, 23 nt, Human
uccuccuuuugcuugugcuuccc

SEQ ID NO: 134543 - RNA, 22 nt, Human
augcccgauaccuaguuaacuc

SEQ ID NO: 134544 - RNA, 22 nt, Human
cucacuggcaagacuacaggug

SEQ ID NO: 134545 - RNA, 22 nt, Human
agcuggagcuucaagcagguaa

SEQ ID NO: 134546 - RNA, 22 nt, Human
ucuugacaacuauacuacuuac

SEQ ID NO: 134547 - RNA, 22 nt, Human
cagacaugauguaagcagaggc

SEQ ID NO: 134548 - RNA, 22 nt, Human
cucagggggaaucaggucacag

SEQ ID NO: 134549 - RNA, 22 nt, Human
ggcugcugugaccucaggugau

SEQ ID NO: 134550 - RNA, 22 nt, Human
auucucucuucugcugcccgug

SEQ ID NO: 134551 - RNA, 22 nt, Human
ucuuguccuaagagcuggauuc

SEQ ID NO: 134552 - RNA, 22 nt, Human
auugaaagcauggauuuggauu

SEQ ID NO: 134553 - RNA, 22 nt, Human
acagcagccugcagcccugugu

SEQ ID NO: 134554 - RNA, 22 nt, Human
uggcagccacaucucguggauu

SEQ ID NO: 134555 - RNA, 22 nt, Human
gccuggaggggccaggguggua

SEQ ID NO: 134556 - RNA, 22 nt, Human
ugagcccagagcccuuguaggg

SEQ ID NO: 134557 - RNA, 17 nt, Human
aggcugcugggccaggg

SEQ ID NO: 134558 - RNA, 22 nt, Human
agcccaugcaacaggccuagcg

SEQ ID NO: 134559 - RNA, 22 nt, Human
uccuccaggucuaggguggcuu

SEQ ID NO: 134560 - RNA, 22 nt, Human
cagggccaagccccuuuggcug

SEQ ID NO: 134561 - RNA, 22 nt, Human
uccuggagauaauugcagugaa

SEQ ID NO: 134562 - RNA, 22 nt, Human
accccagcucugagccacacca

SEQ ID NO: 134563 - RNA, 22 nt, Human
auuguacuuuuauuacauguag

SEQ ID NO: 134564 - RNA, 22 nt, Human
cugcucugugguccaugagaca

SEQ ID NO: 134565 - RNA, 22 nt, Human
agagcuguggauaguccuggau

SEQ ID NO: 134566 - RNA, 22 nt, Human
agccagggauggcagugcccag

SEQ ID NO: 134567 - RNA, 22 nt, Human
cagcugcccaggccaccuggag

SEQ ID NO: 134568 - RNA, 22 nt, Human
uuugcagugauucuugcaguga

SEQ ID NO: 134569 - RNA, 22 nt, Human
guacaguaguaaaagugaauga

SEQ ID NO: 134570 - RNA, 22 nt, Human
uugcuuuguggugguucuucca

SEQ ID NO: 134571 - RNA, 22 nt, Human
cugccucaugcugccugcagcc

SEQ ID NO: 134572 - RNA, 22 nt, Human
caguauauuuuagagaaguccc

SEQ ID NO: 134573 - RNA, 22 nt, Human
ggcuggcuuucucuccgcaccu

SEQ ID NO: 134574 - RNA, 22 nt, Human
augaggcaaucaugguccaguu

SEQ ID NO: 134575 - RNA, 22 nt, Human
ucacaugaguauuauuuuccaa

SEQ ID NO: 134576 - RNA, 22 nt, Human
ccucugcucugguccaugugcu

SEQ ID NO: 134577 - RNA, 23 nt, Human
aggcccaacucugugagggcugc

SEQ ID NO: 134578 - RNA, 22 nt, Human
uggcuggggccacaguuuuccu

SEQ ID NO: 134579 - RNA, 22 nt, Human
aggugagguuugggagguguca

SEQ ID NO: 134580 - RNA, 22 nt, Human
ugugugacccccagugaagccu

SEQ ID NO: 134581 - RNA, 22 nt, Human
ucuggcucuccagugcucuuag

SEQ ID NO: 134582 - RNA, 22 nt, Human
gugggggcaggcagugcuagga

SEQ ID NO: 134583 - RNA, 21 nt, Human
ccugggagaucagcugccuuc

SEQ ID NO: 134584 - RNA, 22 nt, Human
aucuaggauuugaaugcacagu

SEQ ID NO: 134585 - RNA, 22 nt, Human
aggucccaggcauagcuggucu

SEQ ID NO: 134586 - RNA, 23 nt, Human
ucagaaugcacugaauuuacccu

SEQ ID NO: 134587 - RNA, 20 nt, Human
ugccaugguaacagagugug

SEQ ID NO: 134588 - RNA, 22 nt, Human
aaaugcacaaaguaaguguaau

SEQ ID NO: 134589 - RNA, 22 nt, Human
uccagggaucuuuagagucuuu

SEQ ID NO: 134590 - RNA, 22 nt, Human
agagccagcaacucuagcccug

SEQ ID NO: 134591 - RNA, 19 nt, Human
ugugaaagcuaguguucuu

SEQ ID NO: 134592 - RNA, 22 nt, Human
cuggugagacgguugacaggag

SEQ ID NO: 134593 - RNA, 22 nt, Human
cguggcugguggaccugagggc

SEQ ID NO: 134594 - RNA, 22 nt, Human
acagagcugggugcccccugga

SEQ ID NO: 134595 - RNA, 22 nt, Human
cuggcagcgugagcagcaucca

SEQ ID NO: 134596 - RNA, 22 nt, Human
ugcagcauugcaaagcagucuu

SEQ ID NO: 134597 - RNA, 22 nt, Human
caguguggagggagagagccug

SEQ ID NO: 134598 - RNA, 22 nt, Human
cugagagcagggacuugagcca

SEQ ID NO: 134599 - RNA, 22 nt, Human
uaacagaauagcagaaacagaa

SEQ ID NO: 134600 - RNA, 22 nt, Human
acugugugggccgcucacuggg

SEQ ID NO: 134601 - RNA, 22 nt, Human
ugccuggguucccaccccaaag

SEQ ID NO: 134602 - RNA, 22 nt, Human
aagccagauagaagaacucauu

SEQ ID NO: 134603 - RNA, 22 nt, Human
gcugccugcacagagcugcuuu

SEQ ID NO: 134604 - RNA, 22 nt, Human
gcaggaguguggugggacaucc

SEQ ID NO: 134605 - RNA, 22 nt, Human
auucuucacaccuguuccuguu

SEQ ID NO: 134606 - RNA, 23 nt, Human
agccuucaggcaaugucaguaga

SEQ ID NO: 134607 - RNA, 22 nt, Human
uugggcucaggaguuugagacc

SEQ ID NO: 134608 - RNA, 22 nt, Human
gcagagcuaucuucuggauuug

SEQ ID NO: 134609 - RNA, 20 nt, Human
aggcacuguugucuguaucc

SEQ ID NO: 134610 - RNA, 22 nt, Human
cccugccuucuuggccuuuaaa

SEQ ID NO: 134611 - RNA, 22 nt, Human
ugggccugggcuccuguccucu

SEQ ID NO: 134612 - RNA, 22 nt, Human
aggcugugugcuccuuaugaga

SEQ ID NO: 134613 - RNA, 22 nt, Human
auguguauugagcaccuacugc

SEQ ID NO: 134614 - RNA, 22 nt, Human
cugcucugcaaggcacagugau

SEQ ID NO: 134615 - RNA, 22 nt, Human
ucccagagacagagccuccucc

SEQ ID NO: 134616 - RNA, 22 nt, Human
ucaaaugcacguagagaaaaua

SEQ ID NO: 134617 - RNA, 22 nt, Human
uuuacagugucuuguugacugu

SEQ ID NO: 134618 - RNA, 22 nt, Human
ucuuucaaugagcauucuuucc

SEQ ID NO: 134619 - RNA, 20 nt, Human
ugcuggggacauacagggug

SEQ ID NO: 134620 - RNA, 21 nt, Human
gacaggggaagaagcaaggag

SEQ ID NO: 134621 - RNA, 22 nt, Human
gugcauguuaaugguguacaaa

SEQ ID NO: 134622 - RNA, 22 nt, Human
uagcugucagcaaucaaguggu

SEQ ID NO: 134623 - RNA, 22 nt, Human
cagcugagaccagaaugcaggu

SEQ ID NO: 134624 - RNA, 22 nt, Human
uagucccauuuugagguauuug

SEQ ID NO: 134625 - RNA, 22 nt, Human
uguauuuuuagaccuuuagacc

SEQ ID NO: 134626 - RNA, 22 nt, Human
gaaggaaaggucucaugccuuu

SEQ ID NO: 134627 - RNA, 22 nt, Human
ggcaggugcaccugagccaucu

SEQ ID NO: 134628 - RNA, 22 nt, Human
uucaggauucuuucagacuggg

SEQ ID NO: 134629 - RNA, 21 nt, Human
gaugaagcaaucuuucuguug

SEQ ID NO: 134630 - RNA, 22 nt, Human
gaagcucucaaacucuccccuu

SEQ ID NO: 134631 - RNA, 22 nt, Human
uuuccucuuauacaguguuuau

SEQ ID NO: 134632 - RNA, 22 nt, Human
guuuggcucugggugccugugc

SEQ ID NO: 134633 - RNA, 22 nt, Human
aucacauuguuagcauagacug

SEQ ID NO: 134634 - RNA, 22 nt, Human
ugccaggggaccuagggauguc

SEQ ID NO: 134635 - RNA, 22 nt, Human
accugagcaugccaggagagug

SEQ ID NO: 134636 - RNA, 22 nt, Human
ggccucgcggcuucugguggcu

SEQ ID NO: 134637 - RNA, 22 nt, Human
auucugucuuuuuaaaauaaua

SEQ ID NO: 134638 - RNA, 22 nt, Human
cuucagaacuauaaaaaguacu

SEQ ID NO: 134639 - RNA, 22 nt, Human
uggcucagccuggcccuuucau

SEQ ID NO: 134640 - RNA, 22 nt, Human
ccugggcaacauagugagaccc

SEQ ID NO: 134641 - RNA, 22 nt, Human
agaaaucugacugcugugcaca

SEQ ID NO: 134642 - RNA, 22 nt, Human
aagucauugguagcuugauagg

SEQ ID NO: 134643 - RNA, 22 nt, Human
ugccucugugugcaggugagca

SEQ ID NO: 134644 - RNA, 22 nt, Human
uuucaaugacacaaaagagaaa

SEQ ID NO: 134645 - RNA, 22 nt, Human
augaugugugcugaucaagcuu

SEQ ID NO: 134646 - RNA, 22 nt, Human
uagaaauguugguauuaacauu

SEQ ID NO: 134647 - RNA, 22 nt, Human
aggcucugguuggcaaguaaag

SEQ ID NO: 134648 - RNA, 22 nt, Human
gcuguguaucagaugccacggg

SEQ ID NO: 134649 - RNA, 20 nt, Human
gaggccucagccucagcucc

SEQ ID NO: 134650 - RNA, 22 nt, Human
augaagcuaaacccugcagcca

SEQ ID NO: 134651 - RNA, 22 nt, Human
gccucugcgccucagccgaccu

SEQ ID NO: 134652 - RNA, 19 nt, Human
ucaaugcaugaaaucagcc

SEQ ID NO: 134653 - RNA, 22 nt, Human
uguaugcuuuccaaaaaugcug

SEQ ID NO: 134654 - RNA, 22 nt, Human
aaagacuuggcuuaugauuugc

SEQ ID NO: 134655 - RNA, 22 nt, Human
aucacaggugguaggaaaagaa

SEQ ID NO: 134656 - RNA, 22 nt, Human
ccagccugaaaugccucauccu

SEQ ID NO: 134657 - RNA, 22 nt, Human
augcucugggcaggagcccugg

SEQ ID NO: 134658 - RNA, 19 nt, Human
uuuacaaguucuuuguaug

SEQ ID NO: 134659 - RNA, 23 nt, Human
ccucagcauggcaggagcccagc

SEQ ID NO: 134660 - RNA, 20 nt, Human
uucacagaggacucagguca

SEQ ID NO: 134661 - RNA, 22 nt, Human
cugcccugcuugaugacagcga

SEQ ID NO: 134662 - RNA, 22 nt, Human
aggcucagaggugagcaucugc

SEQ ID NO: 134663 - RNA, 23 nt, Human
aaggucacagaacuuagcaagcc

SEQ ID NO: 134664 - RNA, 22 nt, Human
cagcuucugcuaucgaacaucu

SEQ ID NO: 134665 - RNA, 22 nt, Human
uggcucaggccacuucuuuuau

SEQ ID NO: 134666 - RNA, 22 nt, Human
cucuguguuccggguugcugcu

SEQ ID NO: 134667 - RNA, 22 nt, Human
gagauauguuagaaagcuauug

SEQ ID NO: 134668 - RNA, 22 nt, Human
gcagccacccucaaggcugaau

SEQ ID NO: 134669 - RNA, 22 nt, Human
aagaugauaggacuugcuuaag

SEQ ID NO: 134670 - RNA, 22 nt, Human
accccagcccugcuucugggag

SEQ ID NO: 134671 - RNA, 22 nt, Human
uccagccaugacucggacagug

SEQ ID NO: 134672 - RNA, 22 nt, Human
ggaggccagggacccagucagc

SEQ ID NO: 134673 - RNA, 22 nt, Human
gccugggagggcagcagugugg

SEQ ID NO: 134674 - RNA, 22 nt, Human
ggaguuggugagcaccaggcuu

SEQ ID NO: 134675 - RNA, 21 nt, Human
uguggcaucauugaucuguga

SEQ ID NO: 134676 - RNA, 22 nt, Human
cuaacuuugucaucuucccuuu

SEQ ID NO: 134677 - RNA, 22 nt, Human
cuccucugucuaccacgagggu

SEQ ID NO: 134678 - RNA, 18 nt, Human
uuaagagcugaaagggga

SEQ ID NO: 134679 - RNA, 22 nt, Human
aggggugauuugggacaggaca

SEQ ID NO: 134680 - RNA, 22 nt, Human
uaacagaaacagauaaguguaa

SEQ ID NO: 134681 - RNA, 22 nt, Human
uccuuuccagccucaccucagc

SEQ ID NO: 134682 - RNA, 22 nt, Human
aucuggcugagcgaggcccaca

SEQ ID NO: 134683 - RNA, 22 nt, Human
cuggcugucuuggaggaaggag

SEQ ID NO: 134684 - RNA, 22 nt, Human
caggugcuguccugcacauguc

SEQ ID NO: 134685 - RNA, 22 nt, Human
ugcaguguuuggaugcugaguc

SEQ ID NO: 134686 - RNA, 22 nt, Human
agagcuguucaacguagcaaug

SEQ ID NO: 134687 - RNA, 22 nt, Human
uaaccauauuuuccauuaaguu

SEQ ID NO: 134688 - RNA, 22 nt, Human
ucuuagaaauuccccaguggcu

SEQ ID NO: 134689 - RNA, 22 nt, Human
ugugggugguaaaauacaauga

SEQ ID NO: 134690 - RNA, 20 nt, Human
ugggccuguggcagaagucu

SEQ ID NO: 134691 - RNA, 22 nt, Human
uugcauuguugcaaugaaguau

SEQ ID NO: 134692 - RNA, 22 nt, Human
uaacagaaauagaaaugagagu

SEQ ID NO: 134693 - RNA, 22 nt, Human
cauugcacuccaucuugggcaa

SEQ ID NO: 134694 - RNA, 22 nt, Human
ucagagaaguaagguggggugc

SEQ ID NO: 134695 - RNA, 22 nt, Human
ggccagaggccacagcuguguc

SEQ ID NO: 134696 - RNA, 23 nt, Human
ugcuguccaacagacuggccaug

SEQ ID NO: 134697 - RNA, 17 nt, Human
gcuggcugacccaugcc

SEQ ID NO: 134698 - RNA, 22 nt, Human
cugaggucaauuaaucaacaac

SEQ ID NO: 134699 - RNA, 22 nt, Human
ucacugcucuccaauguggagu

SEQ ID NO: 134700 - RNA, 19 nt, Human
caucuggaugauucuccug

SEQ ID NO: 134701 - RNA, 22 nt, Human
gccuucaggaggguuccagaca

SEQ ID NO: 134702 - RNA, 22 nt, Human
uuuaucugcuaucugcugugcu

SEQ ID NO: 134703 - RNA, 22 nt, Human
ugcagaagaccuuccagggcug

SEQ ID NO: 134704 - RNA, 22 nt, Human
cugugcugagugaugugacuua

SEQ ID NO: 134705 - RNA, 19 nt, Human
uggggccuccugucccugg

SEQ ID NO: 134706 - RNA, 22 nt, Human
auugaaagguuuugagcagaua

SEQ ID NO: 134707 - RNA, 22 nt, Human
aggcacugaaggaagcuugcgc

SEQ ID NO: 134708 - RNA, 22 nt, Human
aaauuauuaugccccucuauaa

SEQ ID NO: 134709 - RNA, 22 nt, Human
acugggccuggauuggcguguc

SEQ ID NO: 134710 - RNA, 22 nt, Human
gccugcuggcuguccauugcag

SEQ ID NO: 134711 - RNA, 22 nt, Human
auuuccucaugaucauaaugca

SEQ ID NO: 134712 - RNA, 22 nt, Human
cuucaagauauuucuagaauca

SEQ ID NO: 134713 - RNA, 20 nt, Human
aaacauucauguacaaguga

SEQ ID NO: 134714 - RNA, 22 nt, Human
ugugugccagccuacgaggagc

SEQ ID NO: 134715 - RNA, 22 nt, Human
aaagagcuaacauugccgagau

SEQ ID NO: 134716 - RNA, 22 nt, Human
ucuccuucgaggcccagcuccc

SEQ ID NO: 134717 - RNA, 17 nt, Human
aagauuucauuagcuga

SEQ ID NO: 134718 - RNA, 22 nt, Human
cuuacagagaagaaaauguagu

SEQ ID NO: 134719 - RNA, 22 nt, Human
uggcccugcuguaucaucugcu

SEQ ID NO: 134720 - RNA, 22 nt, Human
uacaguuacugcauuucuaaua

SEQ ID NO: 134721 - RNA, 17 nt, Human
cucugcagugcauggcu

SEQ ID NO: 134722 - RNA, 22 nt, Human
ccuggcugguggcagcgacaag

SEQ ID NO: 134723 - RNA, 22 nt, Human
ugagccugcaauaagcacagcc

SEQ ID NO: 134724 - RNA, 22 nt, Human
acaguacugcuguucuuguccu

SEQ ID NO: 134725 - RNA, 22 nt, Human
uauuacaguucgaguuucuagg

SEQ ID NO: 134726 - RNA, 22 nt, Human
caggagacuauggcccaaggcc

SEQ ID NO: 134727 - RNA, 22 nt, Human
gugaggugggcuggccagagac

SEQ ID NO: 134728 - RNA, 22 nt, Human
cagagccucagaauccugugga

SEQ ID NO: 134729 - RNA, 22 nt, Human
ggggcacacuuuugguagauau

SEQ ID NO: 134730 - RNA, 22 nt, Human
agcccagguugaggcugcagug

SEQ ID NO: 134731 - RNA, 22 nt, Human
augucuuuggcuuugacauggc

SEQ ID NO: 134732 - RNA, 22 nt, Human
cucaggauuuacuaauuucaag

SEQ ID NO: 134733 - RNA, 22 nt, Human
gugggagcuuuggcaucaggcu

SEQ ID NO: 134734 - RNA, 22 nt, Human
cuucuucaauagcaagcgcaua

SEQ ID NO: 134735 - RNA, 22 nt, Human
gaggggcuugaggcccugaugg

SEQ ID NO: 134736 - RNA, 22 nt, Human
cugaggaguuuggguuguucaa

SEQ ID NO: 134737 - RNA, 22 nt, Human
caugggcucuucuggacugcac

SEQ ID NO: 134738 - RNA, 22 nt, Human
aagggcagaauagagaagaugg

SEQ ID NO: 134739 - RNA, 22 nt, Human
aauucauccaugaacaauucca

SEQ ID NO: 134740 - RNA, 21 nt, Human
uccucugcucucauaccacaa

SEQ ID NO: 134741 - RNA, 22 nt, Human
gcuggccugcaaagcccggcug

SEQ ID NO: 134742 - RNA, 22 nt, Human
cacagaaucugugacuccaaga

SEQ ID NO: 134743 - RNA, 22 nt, Human
uugcucagcacuggagccagcu

SEQ ID NO: 134744 - RNA, 22 nt, Human
uuuccauauucugcgucugcca

SEQ ID NO: 134745 - RNA, 22 nt, Human
cgcuggccauagccuccugugu

SEQ ID NO: 134746 - RNA, 22 nt, Human
caucaucaaaacaaauggaguc

SEQ ID NO: 134747 - RNA, 22 nt, Human
uccaugugccaaggggcagagg

SEQ ID NO: 134748 - RNA, 22 nt, Human
uuucacauuuaggcgugaauug

SEQ ID NO: 134749 - RNA, 22 nt, Human
uggagccuguguuucugcccag

SEQ ID NO: 134750 - RNA, 20 nt, Human
gcccacucuaauccacuguc

SEQ ID NO: 134751 - RNA, 22 nt, Human
uggaaagaaaaacaggccauga

SEQ ID NO: 134752 - RNA, 23 nt, Human
ugucacauuuaguuggcauuguu

SEQ ID NO: 134753 - RNA, 19 nt, Human
augauggucccauucaccu

SEQ ID NO: 134754 - RNA, 22 nt, Human
aaaagguaguugccaaauaagg

SEQ ID NO: 134755 - RNA, 22 nt, Human
agcagccacagcagaucugagu

SEQ ID NO: 134756 - RNA, 23 nt, Human
uuacagaaaguaugcuuuuguuu

SEQ ID NO: 134757 - RNA, 22 nt, Human
ggucagagggugggcugccugu

SEQ ID NO: 134758 - RNA, 17 nt, Human
uuuucucucuuggauuc

SEQ ID NO: 134759 - RNA, 22 nt, Human
uuuuuuaguuaggucagaaugu

SEQ ID NO: 134760 - RNA, 22 nt, Human
auacaguaauugcccugcaaug

SEQ ID NO: 134761 - RNA, 22 nt, Human
cuguccccgcgaguccagagcu

SEQ ID NO: 134762 - RNA, 22 nt, Human
ugggcugcuguuacaggggcug

SEQ ID NO: 134763 - RNA, 22 nt, Human
uaauuuaauuucaugccagccu

SEQ ID NO: 134764 - RNA, 22 nt, Human
uuggcuguuuuauaggucaguu

SEQ ID NO: 134765 - RNA, 22 nt, Human
cuuacaguacuucuaauaugau

SEQ ID NO: 134766 - RNA, 22 nt, Human
cccugccugugggcaucaacau

SEQ ID NO: 134767 - RNA, 22 nt, Human
ugacagcugagccccaggcaag

SEQ ID NO: 134768 - RNA, 19 nt, Human
auggcuguguuccaguaaa

SEQ ID NO: 134769 - RNA, 22 nt, Human
agcucacagaaauccugcagga

SEQ ID NO: 134770 - RNA, 22 nt, Human
ugccagaagugcuuuauaagug

SEQ ID NO: 134771 - RNA, 22 nt, Human
aagggcuggcccugggaagagu

SEQ ID NO: 134772 - RNA, 22 nt, Human
cccugccuacaggguuuucuuu

SEQ ID NO: 134773 - RNA, 22 nt, Human
cuggccugugggcugucuccgg

SEQ ID NO: 134774 - RNA, 22 nt, Human
ggaggaccccagcagcucccca

SEQ ID NO: 134775 - RNA, 21 nt, Human
aagagcuggaucaaggauaag

SEQ ID NO: 134776 - RNA, 22 nt, Human
cccagggauuauaaaggugaaa

SEQ ID NO: 134777 - RNA, 22 nt, Human
uggcacuggaaucguagccuug

SEQ ID NO: 134778 - RNA, 22 nt, Human
gcaggaugaaggcagaggcuga

SEQ ID NO: 134779 - RNA, 22 nt, Human
ggagaggugaauggcugcucua

SEQ ID NO: 134780 - RNA, 22 nt, Human
aggagcugcagauucugccuug

SEQ ID NO: 134781 - RNA, 22 nt, Human
guuauguaucuugauugggugg

SEQ ID NO: 134782 - RNA, 22 nt, Human
gggccacacagaaccuccuggu

SEQ ID NO: 134783 - RNA, 22 nt, Human
aagcugccacacggugaguacu

SEQ ID NO: 134784 - RNA, 22 nt, Human
cuggcuguuucuccuuugucua

SEQ ID NO: 134785 - RNA, 22 nt, Human
cuggcucaguucuugguuuuca

SEQ ID NO: 134786 - RNA, 22 nt, Human
uuccucuuucucugugcuaugu

SEQ ID NO: 134787 - RNA, 22 nt, Human
ucaguggauauuucuguggcug

SEQ ID NO: 134788 - RNA, 22 nt, Human
guggccucaugucuauaaagag

SEQ ID NO: 134789 - RNA, 22 nt, Human
gcucccaccuccagccugaguu

SEQ ID NO: 134790 - RNA, 22 nt, Human
ucuggcucggauuugucuagca

SEQ ID NO: 134791 - RNA, 22 nt, Human
aaaauaacuucuacuauuugca

SEQ ID NO: 134792 - RNA, 22 nt, Human
auccaugaagguacuucucagg

SEQ ID NO: 134793 - RNA, 22 nt, Human
cugagcugggacucaguagcaa

SEQ ID NO: 134794 - RNA, 22 nt, Human
aaaugugugcacaaagacagcu

SEQ ID NO: 134795 - RNA, 22 nt, Human
aggccugagcagaggaguggac

SEQ ID NO: 134796 - RNA, 22 nt, Human
aagaacaacugcuuuaaaagca

SEQ ID NO: 134797 - RNA, 22 nt, Human
ggcaggugugagaucgaggcca

SEQ ID NO: 134798 - RNA, 22 nt, Human
aagcccagaugggagcauuuca

SEQ ID NO: 134799 - RNA, 22 nt, Human
uuuucuguggucagagcuugag

SEQ ID NO: 134800 - RNA, 22 nt, Human
agcaauaugacauugcuacauc

SEQ ID NO: 134801 - RNA, 22 nt, Human
guguguguauauauacacacac

SEQ ID NO: 134802 - RNA, 22 nt, Human
gaagagcuaaaggcacaggcuu

SEQ ID NO: 134803 - RNA, 22 nt, Human
gcugccucuguagcuuuggacc

SEQ ID NO: 134804 - RNA, 22 nt, Human
gcuguuccugcuuagaggucgg

SEQ ID NO: 134805 - RNA, 22 nt, Human
ucccagccuuccuuguggugaa

SEQ ID NO: 134806 - RNA, 22 nt, Human
uagggcagagcuuguacacgau

SEQ ID NO: 134807 - RNA, 22 nt, Human
gggcuggugaggcugcccugca

SEQ ID NO: 134808 - RNA, 22 nt, Human
caggagugaguuggggucuaca

SEQ ID NO: 134809 - RNA, 22 nt, Human
aguguggccaaugaggaugggc

SEQ ID NO: 134810 - RNA, 22 nt, Human
ggcugucucugugacugccacc

SEQ ID NO: 134811 - RNA, 22 nt, Human
cugugccaggcccagcugacuu

SEQ ID NO: 134812 - RNA, 22 nt, Human
ugggugagugggaaaagcccag

SEQ ID NO: 134813 - RNA, 22 nt, Human
cagagccaaaccucagggcccg

SEQ ID NO: 134814 - RNA, 22 nt, Human
cacaggcuccggccuugcagcc

SEQ ID NO: 134815 - RNA, 22 nt, Human
gauuucaaccuaacaguaugac

SEQ ID NO: 134816 - RNA, 22 nt, Human
aggggcugggacagagccaagc

SEQ ID NO: 134817 - RNA, 22 nt, Human
ugcuguuauacuuagcugguua

SEQ ID NO: 134818 - RNA, 22 nt, Human
uggaggagaauuuauggucgaa

SEQ ID NO: 134819 - RNA, 22 nt, Human
cuuuuuuaagguagcuccuccu

SEQ ID NO: 134820 - RNA, 22 nt, Human
ccagggugcucuguggcgucgc

SEQ ID NO: 134821 - RNA, 22 nt, Human
uggcucagaagaaaagguaaac

SEQ ID NO: 134822 - RNA, 22 nt, Human
ccuggugccacuagagaauguc

SEQ ID NO: 134823 - RNA, 22 nt, Human
aguggggagguccaggccaccc

SEQ ID NO: 134824 - RNA, 22 nt, Human
uggucaguugcaucagagaagu

SEQ ID NO: 134825 - RNA, 22 nt, Human
uuagcuuuugagaaugauuucu

SEQ ID NO: 134826 - RNA, 22 nt, Human
uuugacagaaaguuauuauuuu

SEQ ID NO: 134827 - RNA, 22 nt, Human
ccugggcucuauccugacccag

SEQ ID NO: 134828 - RNA, 22 nt, Human
ccccuuccgucucuugaguguc

SEQ ID NO: 134829 - RNA, 22 nt, Human
uggagcaggccggaaguggcuu

SEQ ID NO: 134830 - RNA, 22 nt, Human
uuccucuccucccaccagguga

SEQ ID NO: 134831 - RNA, 22 nt, Human
aaugauggucauggcaacuuuu

SEQ ID NO: 134832 - RNA, 22 nt, Human
aacaugaagguaggaugguuuu

SEQ ID NO: 134833 - RNA, 22 nt, Human
gcugcuguuaugauguuacuuu

SEQ ID NO: 134834 - RNA, 22 nt, Human
ucagguguuagaagaaauuuca

SEQ ID NO: 134835 - RNA, 22 nt, Human
cacagcugccauggcugcacuu

SEQ ID NO: 134836 - RNA, 22 nt, Human
acauuugagaugccuuuuaggu

SEQ ID NO: 134837 - RNA, 22 nt, Human
cuggcagcgguuugcagccugg

SEQ ID NO: 134838 - RNA, 22 nt, Human
ggccuugggcuggcugcaguau

SEQ ID NO: 134839 - RNA, 22 nt, Human
cugggcugcagcgggagcgacg

SEQ ID NO: 134840 - RNA, 22 nt, Human
cagaauuuagcacaauguaugg

SEQ ID NO: 134841 - RNA, 22 nt, Human
ccaugagccaggcugaggaagc

SEQ ID NO: 134842 - RNA, 22 nt, Human
cucaggaugaaagucaugguga

SEQ ID NO: 134843 - RNA, 22 nt, Human
agaguguuucagucuuccuaga

SEQ ID NO: 134844 - RNA, 21 nt, Human
uugcaccaugauaaauucaga

SEQ ID NO: 134845 - RNA, 21 nt, Human
ucaggggcuguguuuuccauc

SEQ ID NO: 134846 - RNA, 22 nt, Human
aggucaaaccacagcucuaggc

SEQ ID NO: 134847 - RNA, 22 nt, Human
gucuccugagccuugacugcaa

SEQ ID NO: 134848 - RNA, 22 nt, Human
uucacauuaucaggauuguuuc

SEQ ID NO: 134849 - RNA, 22 nt, Human
ugucugugaccucuuuggagcc

SEQ ID NO: 134850 - RNA, 22 nt, Human
ugcagggccagacuggguugga

SEQ ID NO: 134851 - RNA, 20 nt, Human
acaggagaucugaggaaagg

SEQ ID NO: 134852 - RNA, 22 nt, Human
acuguuuaaaggcuuccuuucu

SEQ ID NO: 134853 - RNA, 22 nt, Human
cauugaaauauggaaacugaug

SEQ ID NO: 134854 - RNA, 22 nt, Human
ccucacugaagaggugacauuu

SEQ ID NO: 134855 - RNA, 17 nt, Human
uggcucugaggcugaau

SEQ ID NO: 134856 - RNA, 22 nt, Human
uccuucaggccucauucucaua

SEQ ID NO: 134857 - RNA, 22 nt, Human
ggcaggcugcuugggucauguc

SEQ ID NO: 134858 - RNA, 22 nt, Human
agauacaucuugaacuucuaga

SEQ ID NO: 134859 - RNA, 22 nt, Human
agugaaauaaagcugccuaugg

SEQ ID NO: 134860 - RNA, 22 nt, Human
cugcuggccuagcccauccucu

SEQ ID NO: 134861 - RNA, 22 nt, Human
gugcccugaguggguaggagag

SEQ ID NO: 134862 - RNA, 22 nt, Human
acaaagugcacaagaugagaac

SEQ ID NO: 134863 - RNA, 22 nt, Human
gagcucauucauucauugccug

SEQ ID NO: 134864 - RNA, 22 nt, Human
cuccagggcagcauggcagugg

SEQ ID NO: 134865 - RNA, 22 nt, Human
ccugggagugucagacuugcuu

SEQ ID NO: 134866 - RNA, 22 nt, Human
uaaagguaguuuuaaaggugcu

SEQ ID NO: 134867 - RNA, 22 nt, Human
uguuuguggaauauucuuuaag

SEQ ID NO: 134868 - RNA, 22 nt, Human
caguaugucuacuggacaaagu

SEQ ID NO: 134869 - RNA, 22 nt, Human
uaggacaggugaggggcugugg

SEQ ID NO: 134870 - RNA, 22 nt, Human
agggguggccugccuuacuccc

SEQ ID NO: 134871 - RNA, 22 nt, Human
agccuggacagcuacggagaac

SEQ ID NO: 134872 - RNA, 22 nt, Human
acagaaauaacuuuuuauguuu

SEQ ID NO: 134873 - RNA, 22 nt, Human
cugauuccugauucaugcucuu

SEQ ID NO: 134874 - RNA, 22 nt, Human
ucuuaacauauuauuuuagcac

SEQ ID NO: 134875 - RNA, 23 nt, Human
ugcugggcagagcuggugcugag

SEQ ID NO: 134876 - RNA, 22 nt, Human
uugcaucuagggcaacccagag

SEQ ID NO: 134877 - RNA, 22 nt, Human
aggccagaaauuuggaguaugu

SEQ ID NO: 134878 - RNA, 22 nt, Human
ugggccuggagcccuggagagu

SEQ ID NO: 134879 - RNA, 22 nt, Human
ccuuggaggacugcugcuucuu

SEQ ID NO: 134880 - RNA, 22 nt, Human
cccagcccccgagugucuggaa

SEQ ID NO: 134881 - RNA, 22 nt, Human
uggcacugggaugcuacuguua

SEQ ID NO: 134882 - RNA, 22 nt, Human
cuguggcuccagugaaccaaug

SEQ ID NO: 134883 - RNA, 22 nt, Human
uccucaggucaaagcaggagaa

SEQ ID NO: 134884 - RNA, 22 nt, Human
uuucacagcgucuuucucuugc

SEQ ID NO: 134885 - RNA, 22 nt, Human
gugccagggggcacugaacaga

SEQ ID NO: 134886 - RNA, 22 nt, Human
acuuccuguuaugugugccucu

SEQ ID NO: 134887 - RNA, 19 nt, Human
cuugguuaugguaugaugc

SEQ ID NO: 134888 - RNA, 22 nt, Human
uauuucaugugcaccauaauuc

SEQ ID NO: 134889 - RNA, 22 nt, Human
cauugcuguuaauugucucuag

SEQ ID NO: 134890 - RNA, 22 nt, Human
aggagaaggaagugcaucacua

SEQ ID NO: 134891 - RNA, 22 nt, Human
gguuugcaugugauguugggca

SEQ ID NO: 134892 - RNA, 22 nt, Human
aggcuggcuuggcucuccugug

SEQ ID NO: 134893 - RNA, 22 nt, Human
ucccagcagagccagcaagccg

SEQ ID NO: 134894 - RNA, 22 nt, Human
ccagggccucguguucugagug

SEQ ID NO: 134895 - RNA, 23 nt, Human
uuucacagcuuuuauucugcauc

SEQ ID NO: 134896 - RNA, 22 nt, Human
ccacugggggcugcaggcacuc

SEQ ID NO: 134897 - RNA, 17 nt, Human
auuucacuuagcaugag

SEQ ID NO: 134898 - RNA, 22 nt, Human
uucacauuagugguucuauaua

SEQ ID NO: 134899 - RNA, 22 nt, Human
agaggccuaaccaagauguccu

SEQ ID NO: 134900 - RNA, 22 nt, Human
gagggcagagucuaaugaugca

SEQ ID NO: 134901 - RNA, 22 nt, Human
agaauucugacaauagaauugg

SEQ ID NO: 134902 - RNA, 22 nt, Human
ccugucaggguuugccucagaa

SEQ ID NO: 134903 - RNA, 22 nt, Human
ucaguauagcuaaaaguuuguc

SEQ ID NO: 134904 - RNA, 21 nt, Human
ucccagagugcuugggacugc

SEQ ID NO: 134905 - RNA, 22 nt, Human
cagcagcaaggugaggguggag

SEQ ID NO: 134906 - RNA, 22 nt, Human
cucugagcccgcugcagcccca

SEQ ID NO: 134907 - RNA, 22 nt, Human
uagcuuuacaaagugcugcacc

SEQ ID NO: 134908 - RNA, 22 nt, Human
uaaggccaauuacauauguuca

SEQ ID NO: 134909 - RNA, 22 nt, Human
ggucucagacuggcaggcagug

SEQ ID NO: 134910 - RNA, 22 nt, Human
uuugacagcuuguuacaaaguu

SEQ ID NO: 134911 - RNA, 22 nt, Human
cuggguggcagagccugcagug

SEQ ID NO: 134912 - RNA, 22 nt, Human
gauuucaaguaucuugggcgag

SEQ ID NO: 134913 - RNA, 22 nt, Human
cccagcagggucucugugucua

SEQ ID NO: 134914 - RNA, 22 nt, Human
uggaaauggaucugaugagucu

SEQ ID NO: 134915 - RNA, 23 nt, Human
ucagugauguugaaccuagcagu

SEQ ID NO: 134916 - RNA, 20 nt, Human
auguaugcaaaugucuucca

SEQ ID NO: 134917 - RNA, 21 nt, Human
ccaccaggucuucugcucggg

SEQ ID NO: 134918 - RNA, 22 nt, Human
gggcacuguacacugugcaugg

SEQ ID NO: 134919 - RNA, 22 nt, Human
ccaaggcuucccagagaugcuc

SEQ ID NO: 134920 - RNA, 18 nt, Human
cucugcuaaugggcagcu

SEQ ID NO: 134921 - RNA, 22 nt, Human
ugcucugucaagaaaagaugcc

SEQ ID NO: 134922 - RNA, 22 nt, Human
uguuccauaaguggugcuuugu

SEQ ID NO: 134923 - RNA, 22 nt, Human
acugugugcccugacgccaggg

SEQ ID NO: 134924 - RNA, 22 nt, Human
aggcacugugcuucuuauaugu

SEQ ID NO: 134925 - RNA, 22 nt, Human
uccucaggcggugaggaggggc

SEQ ID NO: 134926 - RNA, 22 nt, Human
uucucuuuauguauuuaguggg

SEQ ID NO: 134927 - RNA, 21 nt, Human
ggagauggguaucgccugggc

SEQ ID NO: 134928 - RNA, 17 nt, Human
gccaaaggguuccaauc

SEQ ID NO: 134929 - RNA, 22 nt, Human
gcaggcagucaucuuucauauu

SEQ ID NO: 134930 - RNA, 17 nt, Human
ugaaggccaugaccacg

SEQ ID NO: 134931 - RNA, 22 nt, Human
uggccgggccgggcgccuccac

SEQ ID NO: 134932 - RNA, 22 nt, Human
cuguauuuaguuaaaaugcuaa

SEQ ID NO: 134933 - RNA, 22 nt, Human
aggucauuacaauuaucauuuu

SEQ ID NO: 134934 - RNA, 18 nt, Human
gcccugguggagcuggug

SEQ ID NO: 134935 - RNA, 22 nt, Human
ucauugcaccccagucccagcu

SEQ ID NO: 134936 - RNA, 22 nt, Human
uugugucccccuuugagagcca

SEQ ID NO: 134937 - RNA, 22 nt, Human
gccaggcuggugcaaggauauu

SEQ ID NO: 134938 - RNA, 22 nt, Human
gcaggggcuaaggacacagaga

SEQ ID NO: 134939 - RNA, 22 nt, Human
uagcagggaagaugaucagaau

SEQ ID NO: 134940 - RNA, 22 nt, Human
ccaggccuuucuucuuggucug

SEQ ID NO: 134941 - RNA, 22 nt, Human
uugauacaggccuucuagauga

SEQ ID NO: 134942 - RNA, 22 nt, Human
uccuucagggcugaccacaggc

SEQ ID NO: 134943 - RNA, 22 nt, Human
acaguguauauuguuuaucugg

SEQ ID NO: 134944 - RNA, 22 nt, Human
gucccuaguggaaagacaugau

SEQ ID NO: 134945 - RNA, 22 nt, Human
cuuggcagcuuuuggaggagcc

SEQ ID NO: 134946 - RNA, 22 nt, Human
ugcacagcgggugucugucagg

SEQ ID NO: 134947 - RNA, 22 nt, Human
gagcagcucgagaaggaagcag

SEQ ID NO: 134948 - RNA, 17 nt, Human
aggagucucagaugagc

SEQ ID NO: 134949 - RNA, 22 nt, Human
ucaggaauccagacagggcaca

SEQ ID NO: 134950 - RNA, 22 nt, Human
aguucuuuugugaacauaugcu

SEQ ID NO: 134951 - RNA, 20 nt, Human
cccucugcacauggcugugg

SEQ ID NO: 134952 - RNA, 22 nt, Human
cagggaguuuuuguuccucuag

SEQ ID NO: 134953 - RNA, 22 nt, Human
aacuuuuguccgaucuccugga

SEQ ID NO: 134954 - RNA, 22 nt, Human
uuuucaguuacuguuuauguga

SEQ ID NO: 134955 - RNA, 21 nt, Human
cucaggauggcggccuggugg

SEQ ID NO: 134956 - RNA, 22 nt, Human
ccuggccucagccuagggcuga

SEQ ID NO: 134957 - RNA, 22 nt, Human
aggcugugaagguuaaagacga

SEQ ID NO: 134958 - RNA, 22 nt, Human
cugugucccccucagccaggug

SEQ ID NO: 134959 - RNA, 22 nt, Human
uuaacauacaucaugaacaaug

SEQ ID NO: 134960 - RNA, 22 nt, Human
cacugcuucuggaggaauuugg

SEQ ID NO: 134961 - RNA, 22 nt, Human
aacagaaugcaggggaugcugc

SEQ ID NO: 134962 - RNA, 22 nt, Human
agcccagccggauucccaguuc

SEQ ID NO: 134963 - RNA, 22 nt, Human
uauuaucauugguaauaugguc

SEQ ID NO: 134964 - RNA, 18 nt, Human
agggaucaucacugcagc

SEQ ID NO: 134965 - RNA, 22 nt, Human
aauaaauguuaagauugucuca

SEQ ID NO: 134966 - RNA, 22 nt, Human
aauuuucugaugaugaagcacg

SEQ ID NO: 134967 - RNA, 18 nt, Human
gguggcaggucagaugcc

SEQ ID NO: 134968 - RNA, 21 nt, Human
aagcaggacauaugaugcccu

SEQ ID NO: 134969 - RNA, 22 nt, Human
gcauguguugguuuaugcaugu

SEQ ID NO: 134970 - RNA, 22 nt, Human
uaucuuuauuaugucuaucugc

SEQ ID NO: 134971 - RNA, 22 nt, Human
ugcuggggauccguaccaaccc

SEQ ID NO: 134972 - RNA, 22 nt, Human
cugcaguguucuggaaugcauu

SEQ ID NO: 134973 - RNA, 22 nt, Human
ucccugggccacagcugugagc

SEQ ID NO: 134974 - RNA, 23 nt, Human
ccugggcauuggcugcagcuucu

SEQ ID NO: 134975 - RNA, 22 nt, Human
gccugagacagugugguccaau

SEQ ID NO: 134976 - RNA, 22 nt, Human
cugggcucagaugagaggaagg

SEQ ID NO: 134977 - RNA, 22 nt, Human
agcccugggaggccagcuugua

SEQ ID NO: 134978 - RNA, 22 nt, Human
uaaaaguuuuaguuguacauaa

SEQ ID NO: 134979 - RNA, 22 nt, Human
aggugcagcugacaccaugugg

SEQ ID NO: 134980 - RNA, 17 nt, Human
uccaugagacaugaaga

SEQ ID NO: 134981 - RNA, 22 nt, Human
uggcagcaguggagguagaaag

SEQ ID NO: 134982 - RNA, 22 nt, Human
cuguggcuaggauuauuccuga

SEQ ID NO: 134983 - RNA, 22 nt, Human
cugagauggaguuuugcucuug

SEQ ID NO: 134984 - RNA, 22 nt, Human
ucccagcccagauuugugugac

SEQ ID NO: 134985 - RNA, 22 nt, Human
ccucagcucuucccugugcaca

SEQ ID NO: 134986 - RNA, 22 nt, Human
uggcagggccugaaucuuauac

SEQ ID NO: 134987 - RNA, 22 nt, Human
ccagggcaaaugagaucauagc

SEQ ID NO: 134988 - RNA, 17 nt, Human
accagccucuccugggg

SEQ ID NO: 134989 - RNA, 22 nt, Human
ugacuuuuggaccucacugucc

SEQ ID NO: 134990 - RNA, 22 nt, Human
uaaagguaugucuuaaucaaac

SEQ ID NO: 134991 - RNA, 22 nt, Human
agcagggguaacagaaggaaag

SEQ ID NO: 134992 - RNA, 22 nt, Human
ugcagaggagucagccugggca

SEQ ID NO: 134993 - RNA, 22 nt, Human
uagcagcugugaguaaaagcca

SEQ ID NO: 134994 - RNA, 22 nt, Human
cagggcugguuugucgaagaaa

SEQ ID NO: 134995 - RNA, 22 nt, Human
agguggcuccucccauggcugg

SEQ ID NO: 134996 - RNA, 22 nt, Human
gauuuuauauggcauacugugg

SEQ ID NO: 134997 - RNA, 22 nt, Human
uugacuuuacaguuuucuuagg

SEQ ID NO: 134998 - RNA, 22 nt, Human
uccucaggaugugggguagaau

SEQ ID NO: 134999 - RNA, 22 nt, Human
ugaaggaaugagggaguggguc

SEQ ID NO: 135000 - RNA, 22 nt, Human
ugggggacugcacuggcgucag

SEQ ID NO: 135001 - RNA, 21 nt, Human
accaggcuugugggagggagc

SEQ ID NO: 135002 - RNA, 22 nt, Human
agaaaucacaggaggcagaagg

SEQ ID NO: 135003 - RNA, 22 nt, Human
agaguguaauaagggcaagggc

SEQ ID NO: 135004 - RNA, 22 nt, Human
uguggccuugcagccuggaggu

SEQ ID NO: 135005 - RNA, 20 nt, Human
ccugucuccucuuaccuggc

SEQ ID NO: 135006 - RNA, 22 nt, Human
gcuggccagggcugcucgcgga

SEQ ID NO: 135007 - RNA, 22 nt, Human
auaugccauuagcuagaaauaa

SEQ ID NO: 135008 - RNA, 22 nt, Human
guugaaagagcauggacuugaa

SEQ ID NO: 135009 - RNA, 22 nt, Human
uccuugaagaaugauucuugga

SEQ ID NO: 135010 - RNA, 22 nt, Human
gagcugcugguugcuggugccu

SEQ ID NO: 135011 - RNA, 21 nt, Human
uccugccuuaguccagagcag

SEQ ID NO: 135012 - RNA, 22 nt, Human
aguacuuuacuucuuacaguuu

SEQ ID NO: 135013 - RNA, 22 nt, Human
uauugucuucaacucuacuuuu

SEQ ID NO: 135014 - RNA, 22 nt, Human
uauguuucauucuuuucuggua

SEQ ID NO: 135015 - RNA, 22 nt, Human
cauguguguccaugugacuaag

SEQ ID NO: 135016 - RNA, 22 nt, Human
aaaaauagcuucucuugucccu

SEQ ID NO: 135017 - RNA, 22 nt, Human
aaguuugacagaaguuucuaau

SEQ ID NO: 135018 - RNA, 22 nt, Human
ggaagagagggcugggccucaa

SEQ ID NO: 135019 - RNA, 22 nt, Human
ucaggaugguccuuuaugagaa

SEQ ID NO: 135020 - RNA, 22 nt, Human
ucuuugcaggagcccuuugaac

SEQ ID NO: 135021 - RNA, 22 nt, Human
auuugucuagugguauucacgu

SEQ ID NO: 135022 - RNA, 23 nt, Human
gcagauggccccagagugcugcc

SEQ ID NO: 135023 - RNA, 22 nt, Human
uuuuuaucuacagauucucagc

SEQ ID NO: 135024 - RNA, 22 nt, Human
ccuuuacaucugacuucuuuca

SEQ ID NO: 135025 - RNA, 22 nt, Human
ugcacacaaaugugaacgugcc

SEQ ID NO: 135026 - RNA, 19 nt, Human
cugaggcccauguaccaug

SEQ ID NO: 135027 - RNA, 22 nt, Human
aagcugccagauucagucugcu

SEQ ID NO: 135028 - RNA, 22 nt, Human
cugccugcugccuguggagggu

SEQ ID NO: 135029 - RNA, 22 nt, Human
uucugaaagccaauucauugaa

SEQ ID NO: 135030 - RNA, 22 nt, Human
uucacaguauagguuuccagcg

SEQ ID NO: 135031 - RNA, 22 nt, Human
uucccaguauuaccuucaggaa

SEQ ID NO: 135032 - RNA, 22 nt, Human
ugucucugggugauucaguccu

SEQ ID NO: 135033 - RNA, 22 nt, Human
agucauaauuauaaacaucagu

SEQ ID NO: 135034 - RNA, 22 nt, Human
augauggugggagaugacccag

SEQ ID NO: 135035 - RNA, 22 nt, Human
uuccaugaaauguguuaugcuu

SEQ ID NO: 135036 - RNA, 22 nt, Human
uuauguaccugaauuaguaaag

SEQ ID NO: 135037 - RNA, 22 nt, Human
aauguauuccucaugcaagagu

SEQ ID NO: 135038 - RNA, 22 nt, Human
aaugcacaaaaauuguauguaa

SEQ ID NO: 135039 - RNA, 22 nt, Human
agucccuguacuuuccacugcc

SEQ ID NO: 135040 - RNA, 22 nt, Human
ggagcugucuguagggcacagg

SEQ ID NO: 135041 - RNA, 22 nt, Human
aaugaacaaaauaugcuuugca

SEQ ID NO: 135042 - RNA, 23 nt, Human
acaaaugcccauacaucuaguuc

SEQ ID NO: 135043 - RNA, 22 nt, Human
ggcucaggccagaccacgacuc

SEQ ID NO: 135044 - RNA, 22 nt, Human
uggcugcguuuuccgauguauu

SEQ ID NO: 135045 - RNA, 22 nt, Human
gccagccugugcuuggccaggc

SEQ ID NO: 135046 - RNA, 22 nt, Human
aggcugcagaacagucaggugc

SEQ ID NO: 135047 - RNA, 22 nt, Human
auaugcacacucugcccacaga

SEQ ID NO: 135048 - RNA, 21 nt, Human
cagggcacacagaggauggua

SEQ ID NO: 135049 - RNA, 22 nt, Human
gucuuucuuaauucaagugcuu

SEQ ID NO: 135050 - RNA, 22 nt, Human
cauggcagaaaccugagcugcu

SEQ ID NO: 135051 - RNA, 22 nt, Human
gguguggcaguggaccugugaa

SEQ ID NO: 135052 - RNA, 22 nt, Human
augccuguaaucccagugcuuu

SEQ ID NO: 135053 - RNA, 22 nt, Human
cuacacaguucugccuaauggc

SEQ ID NO: 135054 - RNA, 22 nt, Human
acauuuaaauaccuauguuucu

SEQ ID NO: 135055 - RNA, 17 nt, Human
gcacugaacaauccugu

SEQ ID NO: 135056 - RNA, 22 nt, Human
aguggcugcuaugaucaggaca

SEQ ID NO: 135057 - RNA, 20 nt, Human
cuuagaaauuuuuacccugg

SEQ ID NO: 135058 - RNA, 22 nt, Human
agcaggaaagaaaaaucugugu

SEQ ID NO: 135059 - RNA, 22 nt, Human
ugcucuccggcuuccguggccu

SEQ ID NO: 135060 - RNA, 22 nt, Human
ucaggagggugacaggcccugg

SEQ ID NO: 135061 - RNA, 22 nt, Human
cccagcucaagcagagagcuaa

SEQ ID NO: 135062 - RNA, 22 nt, Human
ugacuucaaaggcucuacuccu

SEQ ID NO: 135063 - RNA, 22 nt, Human
aggcugcaggucugggucaugu

SEQ ID NO: 135064 - RNA, 22 nt, Human
gaaaugcagauucugauucugu

SEQ ID NO: 135065 - RNA, 18 nt, Human
aaagaaggauuggagagc

SEQ ID NO: 135066 - RNA, 22 nt, Human
auugucucugaauuuccagcug

SEQ ID NO: 135067 - RNA, 22 nt, Human
ccagcagcccacaggcgucccu

SEQ ID NO: 135068 - RNA, 22 nt, Human
agcugguucagaaauuagaugg

SEQ ID NO: 135069 - RNA, 20 nt, Human
aguggcugauggaaagaagc

SEQ ID NO: 135070 - RNA, 22 nt, Human
aucucagggcuggagcccugga

SEQ ID NO: 135071 - RNA, 22 nt, Human
uugacaauguccuuugaauuuc

SEQ ID NO: 135072 - RNA, 22 nt, Human
gcagugcugaucccauggcaga

SEQ ID NO: 135073 - RNA, 22 nt, Human
agaaguuaccacauacuucucu

SEQ ID NO: 135074 - RNA, 22 nt, Human
gagauuggauuuaauggccaaa

SEQ ID NO: 135075 - RNA, 22 nt, Human
ccugagcuggaagagcuugugc

SEQ ID NO: 135076 - RNA, 22 nt, Human
cuucccagaccuuagagugcag

SEQ ID NO: 135077 - RNA, 22 nt, Human
ggagcuguugcgcaugcgcucg

SEQ ID NO: 135078 - RNA, 22 nt, Human
uuucaaagaguuguaaauuacu

SEQ ID NO: 135079 - RNA, 22 nt, Human
ucacuguugaccuggaaguggg

SEQ ID NO: 135080 - RNA, 22 nt, Human
auaaaaguaggaccaacuuaca

SEQ ID NO: 135081 - RNA, 19 nt, Human
ugacaggcuguugccuuga

SEQ ID NO: 135082 - RNA, 19 nt, Human
ccugucugucuucagcuag

SEQ ID NO: 135083 - RNA, 22 nt, Human
ccagucacagguguguuuauau

SEQ ID NO: 135084 - RNA, 19 nt, Human
gggcagaauggcaucucag

SEQ ID NO: 135085 - RNA, 22 nt, Human
uuguuuuaucuuucuacagacu

SEQ ID NO: 135086 - RNA, 22 nt, Human
cagagcuggagaaguggauuua

SEQ ID NO: 135087 - RNA, 22 nt, Human
ugguugugcugaguuuagugca

SEQ ID NO: 135088 - RNA, 17 nt, Human
aggcagcucagaacauc

SEQ ID NO: 135089 - RNA, 22 nt, Human
gaccauuuuuacagagcauuca

SEQ ID NO: 135090 - RNA, 22 nt, Human
cacugugucaguuugguuagac

SEQ ID NO: 135091 - RNA, 22 nt, Human
aaggaggaauuucagggugaau

SEQ ID NO: 135092 - RNA, 22 nt, Human
uucaaagugcauguuccucaga

SEQ ID NO: 135093 - RNA, 22 nt, Human
cugagccaaggggacagugaca

SEQ ID NO: 135094 - RNA, 22 nt, Human
cuguggcugcguaggucuggca

SEQ ID NO: 135095 - RNA, 22 nt, Human
ucucagagaagugaugagcaau

SEQ ID NO: 135096 - RNA, 22 nt, Human
uuuaccaagcuuuaauuacaua

SEQ ID NO: 135097 - RNA, 22 nt, Human
aaaugugucaguuucauucucu

SEQ ID NO: 135098 - RNA, 19 nt, Human
ugcucaggccaaggagccc

SEQ ID NO: 135099 - RNA, 22 nt, Human
gagcuuaggccagggacaggga

SEQ ID NO: 135100 - RNA, 22 nt, Human
auucuggauuaucaguccacca

SEQ ID NO: 135101 - RNA, 22 nt, Human
cccagguggcagaagcugcagu

SEQ ID NO: 135102 - RNA, 16 nt, Human
ccuuucucugccuucc

SEQ ID NO: 135103 - RNA, 22 nt, Human
gcaguaaaaaaggauaugugca

SEQ ID NO: 135104 - RNA, 22 nt, Human
aucucccagccacagcauucuu

SEQ ID NO: 135105 - RNA, 20 nt, Human
ccuggcugcauucaggacgg

SEQ ID NO: 135106 - RNA, 22 nt, Human
uugggcaaaguguuucuggagc

SEQ ID NO: 135107 - RNA, 20 nt, Human
gugggcagaugugugcaugg

SEQ ID NO: 135108 - RNA, 22 nt, Human
ucuggcucccagccugcucuca

SEQ ID NO: 135109 - RNA, 22 nt, Human
gagcugugccaaucugucuggg

SEQ ID NO: 135110 - RNA, 22 nt, Human
uuugaaagaaaccagugaguga

SEQ ID NO: 135111 - RNA, 23 nt, Human
gaagcagaugucugaguaggcag

SEQ ID NO: 135112 - RNA, 17 nt, Human
caaggccagcaucuuca

SEQ ID NO: 135113 - RNA, 22 nt, Human
ucucgacagccuggcacagugg

SEQ ID NO: 135114 - RNA, 22 nt, Human
ucagcaauaugauaggcuuugu

SEQ ID NO: 135115 - RNA, 19 nt, Human
agucauauuguucaucuug

SEQ ID NO: 135116 - RNA, 22 nt, Human
gggcucuguccauuccuucaua

SEQ ID NO: 135117 - RNA, 22 nt, Human
gaagcagcaaaucugcaguauc

SEQ ID NO: 135118 - RNA, 22 nt, Human
cacauuucugugagucaauauu

SEQ ID NO: 135119 - RNA, 22 nt, Human
cagcaaaagccagcauaagcuc

SEQ ID NO: 135120 - RNA, 22 nt, Human
auguaugcauagugaguaaaug

SEQ ID NO: 135121 - RNA, 22 nt, Human
cuggcuuucucugugguguuca

SEQ ID NO: 135122 - RNA, 22 nt, Human
uccagucaggcugaauucaagg

SEQ ID NO: 135123 - RNA, 22 nt, Human
ugugccuggcccagugguguca

SEQ ID NO: 135124 - RNA, 22 nt, Human
ugaagccagcuuuggaagacac

SEQ ID NO: 135125 - RNA, 22 nt, Human
gcagagugaggaagagcuucca

SEQ ID NO: 135126 - RNA, 22 nt, Human
ugauuucauaguauauacauga

SEQ ID NO: 135127 - RNA, 22 nt, Human
uucuuacagaguuuacagagcc

SEQ ID NO: 135128 - RNA, 22 nt, Human
gggcagauggggcacaggcuga

SEQ ID NO: 135129 - RNA, 18 nt, Human
cauuaugugguuauagaa

SEQ ID NO: 135130 - RNA, 22 nt, Human
auguggcuauuuuaauguuaau

SEQ ID NO: 135131 - RNA, 23 nt, Human
augcaguauaugucaguaguuua

SEQ ID NO: 135132 - RNA, 22 nt, Human
gggaggucagggugccugcugg

SEQ ID NO: 135133 - RNA, 22 nt, Human
cacagcuggugcacuagcucug

SEQ ID NO: 135134 - RNA, 22 nt, Human
caaaggcaguuacugaaugaag

SEQ ID NO: 135135 - RNA, 22 nt, Human
gucaggaugacaagugcuuuca

SEQ ID NO: 135136 - RNA, 22 nt, Human
acuguguccuauuuccuugaca

SEQ ID NO: 135137 - RNA, 22 nt, Human
gcacugaaugcuuuuacuguaa

SEQ ID NO: 135138 - RNA, 22 nt, Human
cugaggcucaagggcagguggg

SEQ ID NO: 135139 - RNA, 22 nt, Human
agucuucccugugccagagugu

SEQ ID NO: 135140 - RNA, 18 nt, Human
cucucuggucuggauccc

SEQ ID NO: 135141 - RNA, 22 nt, Human
acaaagugaauugcaucgaguu

SEQ ID NO: 135142 - RNA, 22 nt, Human
uccugaggaaaguucaugaaug

SEQ ID NO: 135143 - RNA, 22 nt, Human
cagugucuccagaugcuccaau

SEQ ID NO: 135144 - RNA, 22 nt, Human
uuacaugguuguuggaaaugcu

SEQ ID NO: 135145 - RNA, 20 nt, Human
ucagaugggagugagccauc

SEQ ID NO: 135146 - RNA, 22 nt, Human
cggcagagcuuccugcucagcg

SEQ ID NO: 135147 - RNA, 22 nt, Human
ucuccuccuuuuuucaacauag

SEQ ID NO: 135148 - RNA, 22 nt, Human
cagcccugagagaaccaucuau

SEQ ID NO: 135149 - RNA, 22 nt, Human
ggcagccaugucccagggcuuc

SEQ ID NO: 135150 - RNA, 22 nt, Human
agauacauauagaaaacaucaa

SEQ ID NO: 135151 - RNA, 22 nt, Human
cugcagagcauaaaucugaaua

SEQ ID NO: 135152 - RNA, 22 nt, Human
acagggccauuaucuguucuag

SEQ ID NO: 135153 - RNA, 22 nt, Human
uauguucuaaccuugucuuucc

SEQ ID NO: 135154 - RNA, 22 nt, Human
uuuauaguagcaugauuuauag

SEQ ID NO: 135155 - RNA, 19 nt, Human
accucugcagagauguuua

SEQ ID NO: 135156 - RNA, 18 nt, Human
gguguguaacguguuuuc

SEQ ID NO: 135157 - RNA, 22 nt, Human
agagggaucacccuguuucugg

SEQ ID NO: 135158 - RNA, 22 nt, Human
aguacuuugcacuuugcucaga

SEQ ID NO: 135159 - RNA, 22 nt, Human
gccuggagcucuccacuugggg

SEQ ID NO: 135160 - RNA, 22 nt, Human
ucccagaggaaauggcagcuga

SEQ ID NO: 135161 - RNA, 22 nt, Human
ggcacugagcugccuuggggca

SEQ ID NO: 135162 - RNA, 20 nt, Human
ucagccagcuaacaugggga

SEQ ID NO: 135163 - RNA, 22 nt, Human
ugcucccaggcauucucuguug

SEQ ID NO: 135164 - RNA, 22 nt, Human
uugcugugucauuuguuuaauc

SEQ ID NO: 135165 - RNA, 22 nt, Human
uguguguagaaagggcccuggu

SEQ ID NO: 135166 - RNA, 18 nt, Human
aaauguacuguccauggc

SEQ ID NO: 135167 - RNA, 22 nt, Human
gccaggugcauggcugagucuc

SEQ ID NO: 135168 - RNA, 22 nt, Human
cuucucuucccagggacacagg

SEQ ID NO: 135169 - RNA, 22 nt, Human
agguauaugcuauuacuucugc

SEQ ID NO: 135170 - RNA, 22 nt, Human
aagcagggugucuugacccaug

SEQ ID NO: 135171 - RNA, 22 nt, Human
ucaaauguucccuguacuggcc

SEQ ID NO: 135172 - RNA, 22 nt, Human
gggcuucucuuaugcuaacugg

SEQ ID NO: 135173 - RNA, 22 nt, Human
agcuguccuggcucaggcugug

SEQ ID NO: 135174 - RNA, 22 nt, Human
agagccugcagcugugaagaaa

SEQ ID NO: 135175 - RNA, 22 nt, Human
gagcaggcauucuaguggcuga

SEQ ID NO: 135176 - RNA, 22 nt, Human
uuuguuuagaugguaaaucagu

SEQ ID NO: 135177 - RNA, 22 nt, Human
uugacaguauagcuuuaccuau

SEQ ID NO: 135178 - RNA, 22 nt, Human
uguauauucacugagcaagggg

SEQ ID NO: 135179 - RNA, 22 nt, Human
auaguuugugaaacacagcagu

SEQ ID NO: 135180 - RNA, 22 nt, Human
uacuuuuagccuauuugauucu

SEQ ID NO: 135181 - RNA, 22 nt, Human
uggcagcuccuggggccagcac

SEQ ID NO: 135182 - RNA, 22 nt, Human
ucugaggccccugggcaggaug

SEQ ID NO: 135183 - RNA, 22 nt, Human
ucagugucuugaccugggugug

SEQ ID NO: 135184 - RNA, 22 nt, Human
gcccaugcucucaggcgggccu

SEQ ID NO: 135185 - RNA, 22 nt, Human
gagggacagcuaaagagaaauu

SEQ ID NO: 135186 - RNA, 22 nt, Human
ggaggcaggaaagacagguuca

SEQ ID NO: 135187 - RNA, 22 nt, Human
uuugugaagggaacagaagugu

SEQ ID NO: 135188 - RNA, 22 nt, Human
cacagggcuaaaugaaggguug

SEQ ID NO: 135189 - RNA, 22 nt, Human
uuacaaaguucugaguucaaac

SEQ ID NO: 135190 - RNA, 22 nt, Human
gcauuauuaauagcugcaugag

SEQ ID NO: 135191 - RNA, 22 nt, Human
ccugccagggccuuggaagaaa

SEQ ID NO: 135192 - RNA, 22 nt, Human
gcucacuggccugaagaggacg

SEQ ID NO: 135193 - RNA, 23 nt, Human
ggacagggcccugcccuauggcc

SEQ ID NO: 135194 - RNA, 22 nt, Human
agagaauuuuaaaagccuugaa

SEQ ID NO: 135195 - RNA, 19 nt, Human
uggcuuccaucucucucau

SEQ ID NO: 135196 - RNA, 22 nt, Human
uuaaacagagucugaaauguaa

SEQ ID NO: 135197 - RNA, 22 nt, Human
ccauccuaucugaccuacuugu

SEQ ID NO: 135198 - RNA, 21 nt, Human
ccuccaggugauuccgugcuc

SEQ ID NO: 135199 - RNA, 22 nt, Human
cacauguaguaagcaggcaaug

SEQ ID NO: 135200 - RNA, 22 nt, Human
aaggcagauauaaagacuagag

SEQ ID NO: 135201 - RNA, 22 nt, Human
cacugaaggaaggacuacugca

SEQ ID NO: 135202 - RNA, 22 nt, Human
cugggaaauggcuucgagcuca

SEQ ID NO: 135203 - RNA, 21 nt, Human
cugugucgcucucgcugggag

SEQ ID NO: 135204 - RNA, 22 nt, Human
guucacauccuugugaggauuu

SEQ ID NO: 135205 - RNA, 22 nt, Human
aaaagagguuaaccaggugugu

SEQ ID NO: 135206 - RNA, 22 nt, Human
gcauucuuuuuaggagguuccu

SEQ ID NO: 135207 - RNA, 22 nt, Human
cuggcagcucuacucagagccu

SEQ ID NO: 135208 - RNA, 22 nt, Human
uucccucuccuacucaggaaag

SEQ ID NO: 135209 - RNA, 22 nt, Human
ucagaacaauugggaaccauua

SEQ ID NO: 135210 - RNA, 22 nt, Human
ccugagaccaaguugcagccau

SEQ ID NO: 135211 - RNA, 22 nt, Human
uggcagcacuugaacuugagcc

SEQ ID NO: 135212 - RNA, 22 nt, Human
aucuuuaccaccaaagaaugcu

SEQ ID NO: 135213 - RNA, 22 nt, Human
cagggcagaacauauagauagu

SEQ ID NO: 135214 - RNA, 22 nt, Human
agaaagaacguugguuaucuua

SEQ ID NO: 135215 - RNA, 20 nt, Human
ugaguggccacugggucgca

SEQ ID NO: 135216 - RNA, 23 nt, Human
acuuuagauaaauuaugugcaca

SEQ ID NO: 135217 - RNA, 22 nt, Human
uugcugaaguuaaugcuugcaa

SEQ ID NO: 135218 - RNA, 22 nt, Human
cugcugcucgaccagucccagg

SEQ ID NO: 135219 - RNA, 22 nt, Human
cagggcuccccgcaccgcagcc

SEQ ID NO: 135220 - RNA, 22 nt, Human
agaggcagcagucauacuacag

SEQ ID NO: 135221 - RNA, 22 nt, Human
uuugaaagagcugauacaugaa

SEQ ID NO: 135222 - RNA, 21 nt, Human
gcaaggcuuuuguguuuccca

SEQ ID NO: 135223 - RNA, 20 nt, Human
uguacacaguacuuuacaau

SEQ ID NO: 135224 - RNA, 21 nt, Human
cgggcuggccgggcccucacc

SEQ ID NO: 135225 - RNA, 22 nt, Human
aaagauuucacaucccaagccu

SEQ ID NO: 135226 - RNA, 22 nt, Human
aggaggccccuccuggguugcu

SEQ ID NO: 135227 - RNA, 23 nt, Human
agucucagcuggaaacauguguc

SEQ ID NO: 135228 - RNA, 22 nt, Human
cagagccagcaguggggacagg

SEQ ID NO: 135229 - RNA, 22 nt, Human
uuuucaguaaugucuacauaau

SEQ ID NO: 135230 - RNA, 22 nt, Human
cugguccuccuugccuucagau

SEQ ID NO: 135231 - RNA, 22 nt, Human
cccuggaggaaaaucugaggcu

SEQ ID NO: 135232 - RNA, 22 nt, Human
ugaaaucugucccacuuuagcu

SEQ ID NO: 135233 - RNA, 22 nt, Human
aggauccuuuggccacuucuua

SEQ ID NO: 135234 - RNA, 22 nt, Human
caggaggaacaagagguucugg

SEQ ID NO: 135235 - RNA, 22 nt, Human
ccagcucuuggugcacuuacau

SEQ ID NO: 135236 - RNA, 19 nt, Human
uaugugugcauuugugcau

SEQ ID NO: 135237 - RNA, 22 nt, Human
ucccuggcagcuaagggugguc

SEQ ID NO: 135238 - RNA, 22 nt, Human
auguacaaaaugccacugaauu

SEQ ID NO: 135239 - RNA, 22 nt, Human
ugcuggggucauggggcgcccg

SEQ ID NO: 135240 - RNA, 22 nt, Human
ugcugcauuuaucuucucaaac

SEQ ID NO: 135241 - RNA, 22 nt, Human
ccaggcugugguuuagauagag

SEQ ID NO: 135242 - RNA, 22 nt, Human
ucagagaacacagaggugaugu

SEQ ID NO: 135243 - RNA, 22 nt, Human
ggcugggccagggccuguggac

SEQ ID NO: 135244 - RNA, 20 nt, Human
uauauuuucucuuuggccuu

SEQ ID NO: 135245 - RNA, 22 nt, Human
ucccuggacagccuugccuggg

SEQ ID NO: 135246 - RNA, 22 nt, Human
agcagagccaggucucucugua

SEQ ID NO: 135247 - RNA, 22 nt, Human
uuucaugugcaauuagcaauau

SEQ ID NO: 135248 - RNA, 22 nt, Human
ggcagugguuagaaacaugagc

SEQ ID NO: 135249 - RNA, 22 nt, Human
uucccucucacuuaaagcuugg

SEQ ID NO: 135250 - RNA, 22 nt, Human
cugggcugcaucaaagaggcau

SEQ ID NO: 135251 - RNA, 22 nt, Human
uauuucugaauccaaaagguca

SEQ ID NO: 135252 - RNA, 22 nt, Human
cccauucauccucgcuuccuuc

SEQ ID NO: 135253 - RNA, 22 nt, Human
acuuuguuuccauauuuguagc

SEQ ID NO: 135254 - RNA, 22 nt, Human
cugugcugaggaugcaguuucu

SEQ ID NO: 135255 - RNA, 22 nt, Human
uccuuacaacuuguuauuuuuc

SEQ ID NO: 135256 - RNA, 19 nt, Human
agugaaauggaguauucaa

SEQ ID NO: 135257 - RNA, 22 nt, Human
guuaauaaagguauagaaucag

SEQ ID NO: 135258 - RNA, 22 nt, Human
uucaaugauuuuuagggaucau

SEQ ID NO: 135259 - RNA, 22 nt, Human
ggcugagcucaggggcagcagg

SEQ ID NO: 135260 - RNA, 22 nt, Human
cucaggcccacagcagacccac

SEQ ID NO: 135261 - RNA, 22 nt, Human
auaacagaguugggaagugaaa

SEQ ID NO: 135262 - RNA, 22 nt, Human
cugggagcccgcguccuggugg

SEQ ID NO: 135263 - RNA, 22 nt, Human
aaagauuuaagaauaauuugug

SEQ ID NO: 135264 - RNA, 22 nt, Human
cugggcugcaggaguggggcaa

SEQ ID NO: 135265 - RNA, 22 nt, Human
auguaagguucagaguauguga

SEQ ID NO: 135266 - RNA, 23 nt, Human
auugaugacuugauuacacuuuu

SEQ ID NO: 135267 - RNA, 22 nt, Human
acaguaauauugaugcucguca

SEQ ID NO: 135268 - RNA, 22 nt, Human
ugggacacccucacgccugcac

SEQ ID NO: 135269 - RNA, 22 nt, Human
aacagacaacuccuguggcuca

SEQ ID NO: 135270 - RNA, 23 nt, Human
uggacgccgacuuuggaggcgcu

SEQ ID NO: 135271 - RNA, 22 nt, Human
agagaagagcaaugauaaauuu

SEQ ID NO: 135272 - RNA, 22 nt, Human
ucuggcucccuggagcuccaca

SEQ ID NO: 135273 - RNA, 22 nt, Human
caaugugguggcagaugucagu

SEQ ID NO: 135274 - RNA, 22 nt, Human
acuuuugaacaaacuccucugu

SEQ ID NO: 135275 - RNA, 21 nt, Human
uguguguaugcacacacaugc

SEQ ID NO: 135276 - RNA, 22 nt, Human
uuuaguaaguucacugcaaagc

SEQ ID NO: 135277 - RNA, 22 nt, Human
agaaaucagaacccugaaguuc

SEQ ID NO: 135278 - RNA, 22 nt, Human
ccccuuccacagugcuuccuaa

SEQ ID NO: 135279 - RNA, 22 nt, Human
uucugucuggaaaaggacauag

SEQ ID NO: 135280 - RNA, 22 nt, Human
gcuguguccaggugggggugac

SEQ ID NO: 135281 - RNA, 22 nt, Human
uguaagauauucagcuuauuga

SEQ ID NO: 135282 - RNA, 22 nt, Human
ucucaggggauucacuggcacc

SEQ ID NO: 135283 - RNA, 22 nt, Human
ucagaagcugguguccuuugaa

SEQ ID NO: 135284 - RNA, 22 nt, Human
aaacugaauucccaagggcaug

SEQ ID NO: 135285 - RNA, 22 nt, Human
aggagcagcccacuccuguccu

SEQ ID NO: 135286 - RNA, 22 nt, Human
guaaaauagaauaacguggcua

SEQ ID NO: 135287 - RNA, 22 nt, Human
aggauccuccuuagaaaagacc

SEQ ID NO: 135288 - RNA, 22 nt, Human
agguauagaauugaaaggguuu

SEQ ID NO: 135289 - RNA, 22 nt, Human
cuguggcucauucuugguggca

SEQ ID NO: 135290 - RNA, 22 nt, Human
acaguuuaugguguuuuauaua

SEQ ID NO: 135291 - RNA, 22 nt, Human
augaguucaauuguuucaguca

SEQ ID NO: 135292 - RNA, 22 nt, Human
cuggcuccuccaaggccuggag

SEQ ID NO: 135293 - RNA, 22 nt, Human
agagccagcauuugggcccugc

SEQ ID NO: 135294 - RNA, 22 nt, Human
cagaaccaggaacugauggaga

SEQ ID NO: 135295 - RNA, 22 nt, Human
agcaguauucuccuguggugga

SEQ ID NO: 135296 - RNA, 22 nt, Human
ggccagcagucacagggucaga

SEQ ID NO: 135297 - RNA, 22 nt, Human
ggccucucuccagucagugcag

SEQ ID NO: 135298 - RNA, 22 nt, Human
gagcacagcuggagguagcauu

SEQ ID NO: 135299 - RNA, 22 nt, Human
gccuuugcaccaucagugcaau

SEQ ID NO: 135300 - RNA, 19 nt, Human
ccagcagcuuugauucucu

SEQ ID NO: 135301 - RNA, 20 nt, Human
uaugaguauuacuuucagga

SEQ ID NO: 135302 - RNA, 22 nt, Human
acaguggagaaggcaugaggcu

SEQ ID NO: 135303 - RNA, 17 nt, Human
uuccuggaagucauucc

SEQ ID NO: 135304 - RNA, 20 nt, Human
acugagcugcauggagagga

SEQ ID NO: 135305 - RNA, 22 nt, Human
agcagcugagccccagcuguga

SEQ ID NO: 135306 - RNA, 22 nt, Human
uccuugaacagagggccugggu

SEQ ID NO: 135307 - RNA, 22 nt, Human
augauugaccaucugcugggcu

SEQ ID NO: 135308 - RNA, 22 nt, Human
uggugguuaugcgcuuuguggg

SEQ ID NO: 135309 - RNA, 18 nt, Human
auuguucugugacauguc

SEQ ID NO: 135310 - RNA, 22 nt, Human
uuucuuugagucucaguuugcu

SEQ ID NO: 135311 - RNA, 22 nt, Human
gcuguucccauguggggcucag

SEQ ID NO: 135312 - RNA, 22 nt, Human
cuccugagcucugaggaagcuu

SEQ ID NO: 135313 - RNA, 22 nt, Human
ucuacugugguccuuguaacca

SEQ ID NO: 135314 - RNA, 22 nt, Human
uacuguaugauuucauguauau

SEQ ID NO: 135315 - RNA, 22 nt, Human
gggcugugccucaggugggguc

SEQ ID NO: 135316 - RNA, 22 nt, Human
gugggcuucuguuagggaggcu

SEQ ID NO: 135317 - RNA, 22 nt, Human
ggcucagguuuccuucccagcu

SEQ ID NO: 135318 - RNA, 22 nt, Human
augccaggccccacgcugggca

SEQ ID NO: 135319 - RNA, 22 nt, Human
auuugucucugcacuuuacuca

SEQ ID NO: 135320 - RNA, 22 nt, Human
acacaguauuacaauaggugcu

SEQ ID NO: 135321 - RNA, 22 nt, Human
agccagcuggugggucagcugg

SEQ ID NO: 135322 - RNA, 22 nt, Human
agugugugaccuuuuaauuuaa

SEQ ID NO: 135323 - RNA, 22 nt, Human
ccuggagcaggagcugcagagg

SEQ ID NO: 135324 - RNA, 22 nt, Human
aaagaacaaaugauauaugguu

SEQ ID NO: 135325 - RNA, 22 nt, Human
ggagagcagggaggcugcucug

SEQ ID NO: 135326 - RNA, 22 nt, Human
ucucaggcuaccuugcacaagg

SEQ ID NO: 135327 - RNA, 22 nt, Human
gagggagagugauggaccauug

SEQ ID NO: 135328 - RNA, 22 nt, Human
uuugaaaggagcuuuauccaga

SEQ ID NO: 135329 - RNA, 22 nt, Human
agccucugacugucagcaaggu

SEQ ID NO: 135330 - RNA, 22 nt, Human
uccauuuuagaagaaaauccac

SEQ ID NO: 135331 - RNA, 22 nt, Human
ugggugcuucgucagcucugag

SEQ ID NO: 135332 - RNA, 21 nt, Human
uuacuuuugcaccaaccuaau

SEQ ID NO: 135333 - RNA, 22 nt, Human
agcucccagaaggcccugcgcc

SEQ ID NO: 135334 - RNA, 22 nt, Human
caagagagaugcagcucacuca

SEQ ID NO: 135335 - RNA, 22 nt, Human
ccuggcagcuguuuggcuuggc

SEQ ID NO: 135336 - RNA, 22 nt, Human
agucucagccacacagaccuau

SEQ ID NO: 135337 - RNA, 22 nt, Human
gcugagugauugauauuuuagu

SEQ ID NO: 135338 - RNA, 22 nt, Human
auucucuguggugaugcuggug

SEQ ID NO: 135339 - RNA, 21 nt, Human
gagcauggcuuacaucagcag

SEQ ID NO: 135340 - RNA, 22 nt, Human
guguguguucaauaaauuuaag

SEQ ID NO: 135341 - RNA, 22 nt, Human
augcuuuuaugucacaugguca

SEQ ID NO: 135342 - RNA, 22 nt, Human
ccagaggaggggggucuuucug

SEQ ID NO: 135343 - RNA, 22 nt, Human
uaaggccaaacuauuauaguuc

SEQ ID NO: 135344 - RNA, 22 nt, Human
gcugcucugugacagccuccgg

SEQ ID NO: 135345 - RNA, 22 nt, Human
aaguccaugaucaagauguggc

SEQ ID NO: 135346 - RNA, 22 nt, Human
uggacucaaguccaaguucacg

SEQ ID NO: 135347 - RNA, 22 nt, Human
aaagaacaauguggaaucuccu

SEQ ID NO: 135348 - RNA, 22 nt, Human
ccaggagcaggagcuggacaga

SEQ ID NO: 135349 - RNA, 22 nt, Human
gcugugcuauaucucugagugu

SEQ ID NO: 135350 - RNA, 22 nt, Human
ccugaggcccuggcugugcuga

SEQ ID NO: 135351 - RNA, 22 nt, Human
ccuggggagaagagcuuccccc

SEQ ID NO: 135352 - RNA, 22 nt, Human
uucaggauaguggugaguggca

SEQ ID NO: 135353 - RNA, 22 nt, Human
ugacaugcuuguuuuccuugaa

SEQ ID NO: 135354 - RNA, 22 nt, Human
aucucucuaugcacugaggacu

SEQ ID NO: 135355 - RNA, 22 nt, Human
uacauuauccugucuuuguccu

SEQ ID NO: 135356 - RNA, 17 nt, Human
uauguaguacuuauaaa

SEQ ID NO: 135357 - RNA, 22 nt, Human
caccaggcugaaccagagggga

SEQ ID NO: 135358 - RNA, 22 nt, Human
gaggccagaaugagcugaaugc

SEQ ID NO: 135359 - RNA, 23 nt, Human
aggcuuccuaucuuagagcuggg

SEQ ID NO: 135360 - RNA, 22 nt, Human
cauuuguaguaucuguuuauau

SEQ ID NO: 135361 - RNA, 22 nt, Human
ucucauucauacccuacaugcu

SEQ ID NO: 135362 - RNA, 22 nt, Human
aaaggagacuucagaucuccuu

SEQ ID NO: 135363 - RNA, 22 nt, Human
ccuggauucaagucuuucuuuc

SEQ ID NO: 135364 - RNA, 22 nt, Human
agcucccaauugacuugaacua

SEQ ID NO: 135365 - RNA, 22 nt, Human
aaaugcacacaccaggaaacua

SEQ ID NO: 135366 - RNA, 22 nt, Human
gcaccaggcuuagagccccagg

SEQ ID NO: 135367 - RNA, 22 nt, Human
agccagagcugaugucauucuc

SEQ ID NO: 135368 - RNA, 22 nt, Human
aguggcugcuggaguggagaug

SEQ ID NO: 135369 - RNA, 22 nt, Human
ggaggccaucagggagggcauu

SEQ ID NO: 135370 - RNA, 22 nt, Human
cagaguguugaccauaagccca

SEQ ID NO: 135371 - RNA, 22 nt, Human
gccuggccugaacuaggaggug

SEQ ID NO: 135372 - RNA, 22 nt, Human
ggccugcuauuggugggcagac

SEQ ID NO: 135373 - RNA, 22 nt, Human
gcugccuccugaaagcgcucug

SEQ ID NO: 135374 - RNA, 22 nt, Human
aaggcagccgugugacugcaug

SEQ ID NO: 135375 - RNA, 22 nt, Human
uggcagcaaaaccagaaucaga

SEQ ID NO: 135376 - RNA, 22 nt, Human
aguguguagcauuuggcaggca

SEQ ID NO: 135377 - RNA, 22 nt, Human
ugcaugcauaaauguacacaca

SEQ ID NO: 135378 - RNA, 22 nt, Human
uucuucaaaacaacacuggccu

SEQ ID NO: 135379 - RNA, 22 nt, Human
aucacuguguauguauaugcag

SEQ ID NO: 135380 - RNA, 22 nt, Human
ucacagacaauuguuuuggugu

SEQ ID NO: 135381 - RNA, 22 nt, Human
ccaggugguucaggucaccaua

SEQ ID NO: 135382 - RNA, 22 nt, Human
auguguuggauauuagugggga

SEQ ID NO: 135383 - RNA, 22 nt, Human
cccugagaugccucacccuagu

SEQ ID NO: 135384 - RNA, 21 nt, Human
gccacguuucagucuucucag

SEQ ID NO: 135385 - RNA, 23 nt, Human
ccuccugggcacaggccugaugg

SEQ ID NO: 135386 - RNA, 22 nt, Human
cucaggauuuaaaggggcacuc

SEQ ID NO: 135387 - RNA, 19 nt, Human
uggcagaggcaguuuguac

SEQ ID NO: 135388 - RNA, 22 nt, Human
ugucucugauaaguaguucagu

SEQ ID NO: 135389 - RNA, 22 nt, Human
gcucucuuuccauguggaggau

SEQ ID NO: 135390 - RNA, 22 nt, Human
ucuuuaagaguucauuugcaug

SEQ ID NO: 135391 - RNA, 22 nt, Human
cugguccuugacgcgugggagg

SEQ ID NO: 135392 - RNA, 22 nt, Human
cuugcaggcagggccuccugga

SEQ ID NO: 135393 - RNA, 21 nt, Human
uuagcaaagcaaacacaugcu

SEQ ID NO: 135394 - RNA, 22 nt, Human
uuguaacaaucugucauaaaug

SEQ ID NO: 135395 - RNA, 22 nt, Human
aagguacaaaguauuauuuaaa

SEQ ID NO: 135396 - RNA, 22 nt, Human
gauacauuuuaucuccuaacag

SEQ ID NO: 135397 - RNA, 22 nt, Human
caggggcucugggugaugugag

SEQ ID NO: 135398 - RNA, 22 nt, Human
gacccaggguuucugcacaggg

SEQ ID NO: 135399 - RNA, 22 nt, Human
auccuugagaaaauaaaugacc

SEQ ID NO: 135400 - RNA, 22 nt, Human
guacauuggcaacucucuuaga

SEQ ID NO: 135401 - RNA, 22 nt, Human
ggagcagacauaaccuuacaga

SEQ ID NO: 135402 - RNA, 22 nt, Human
agucaguguucuccggagaggc

SEQ ID NO: 135403 - RNA, 22 nt, Human
cagugucuuauuuguagcucag

SEQ ID NO: 135404 - RNA, 22 nt, Human
ccugugugcacacgaggccaug

SEQ ID NO: 135405 - RNA, 22 nt, Human
uucuauuucuuaaucuuggcug

SEQ ID NO: 135406 - RNA, 19 nt, Human
uccucaggggcucacagac

SEQ ID NO: 135407 - RNA, 22 nt, Human
gggagggaaggaggcgccgugu

SEQ ID NO: 135408 - RNA, 23 nt, Human
uggggccaagugaggaagggucu

SEQ ID NO: 135409 - RNA, 22 nt, Human
gcucccaccuuugcuaucagua

SEQ ID NO: 135410 - RNA, 22 nt, Human
uccucacaagcaagcacaggua

SEQ ID NO: 135411 - RNA, 22 nt, Human
uuuaguuugauguucuacuccu

SEQ ID NO: 135412 - RNA, 22 nt, Human
guggccugucagaagccguggg

SEQ ID NO: 135413 - RNA, 22 nt, Human
cugcucuguuaauuaaacuuug

SEQ ID NO: 135414 - RNA, 22 nt, Human
ccagagcugcauccagcagguu

SEQ ID NO: 135415 - RNA, 22 nt, Human
gggaggcuggcucuggccacag

SEQ ID NO: 135416 - RNA, 22 nt, Human
auaaguucagguaaagaaauca

SEQ ID NO: 135417 - RNA, 22 nt, Human
agaaaucauucccaaacccaua

SEQ ID NO: 135418 - RNA, 22 nt, Human
auaagcauguuagaauauuuga

SEQ ID NO: 135419 - RNA, 22 nt, Human
ugccagaagauucucuaucaga

SEQ ID NO: 135420 - RNA, 22 nt, Human
gccaggcaaauuaaggaaugca

SEQ ID NO: 135421 - RNA, 22 nt, Human
uuaacuguaucauacuguuuca

SEQ ID NO: 135422 - RNA, 23 nt, Human
gccuggagaaaagcugcaguuca

SEQ ID NO: 135423 - RNA, 22 nt, Human
ugugcaguuucuauguugucca

SEQ ID NO: 135424 - RNA, 22 nt, Human
ugcugccaaaugcgagcucugu

SEQ ID NO: 135425 - RNA, 22 nt, Human
cagggcugaaaucaagguguag

SEQ ID NO: 135426 - RNA, 17 nt, Human
cagggcugucugccuag

SEQ ID NO: 135427 - RNA, 22 nt, Human
uacugcaugguggaguggagcu

SEQ ID NO: 135428 - RNA, 22 nt, Human
cgggcagauugggaagguucau

SEQ ID NO: 135429 - RNA, 18 nt, Human
acauacauucugucugca

SEQ ID NO: 135430 - RNA, 22 nt, Human
caugugguucaaguacuccaca

SEQ ID NO: 135431 - RNA, 22 nt, Human
uccuugaagcaacgugcagaca

SEQ ID NO: 135432 - RNA, 22 nt, Human
acagggcaaccucugggagacu

SEQ ID NO: 135433 - RNA, 22 nt, Human
uugaagaggacuuugcagcugu

SEQ ID NO: 135434 - RNA, 22 nt, Human
caguuucuacgaaggucaaccc

SEQ ID NO: 135435 - RNA, 22 nt, Human
uccugggcuguggccccgggca

SEQ ID NO: 135436 - RNA, 22 nt, Human
cugaagcaaaugaaacagcucu

SEQ ID NO: 135437 - RNA, 22 nt, Human
uggcucugucacugugagcuau

SEQ ID NO: 135438 - RNA, 22 nt, Human
ugcucugugguccaagauggcu

SEQ ID NO: 135439 - RNA, 22 nt, Human
agcugggagcagagccacagcc

SEQ ID NO: 135440 - RNA, 22 nt, Human
agggcuggcaucucuaaugcug

SEQ ID NO: 135441 - RNA, 22 nt, Human
cuugaaagucagcagaguggau

SEQ ID NO: 135442 - RNA, 22 nt, Human
uagggcagccuuauagcuccca

SEQ ID NO: 135443 - RNA, 22 nt, Human
uguauauucugccuaaaagcuu

SEQ ID NO: 135444 - RNA, 22 nt, Human
caaagguaaagaucugcugugg

SEQ ID NO: 135445 - RNA, 22 nt, Human
agcuuuauucaugauuucaggg

SEQ ID NO: 135446 - RNA, 22 nt, Human
ugauuuccucuacuagcaauua

SEQ ID NO: 135447 - RNA, 22 nt, Human
agcuuuaugggagcuuagauaa

SEQ ID NO: 135448 - RNA, 21 nt, Human
gcuccuggugcugcguggcgc

SEQ ID NO: 135449 - RNA, 22 nt, Human
gaggccaggagugcuguaaguu

SEQ ID NO: 135450 - RNA, 22 nt, Human
uuauaguaugugcauaugugug

SEQ ID NO: 135451 - RNA, 22 nt, Human
gccagcuggagugagagugggc

SEQ ID NO: 135452 - RNA, 22 nt, Human
ggugcagcugcagccugggagc

SEQ ID NO: 135453 - RNA, 22 nt, Human
ccagggcagggaccacgugucu

SEQ ID NO: 135454 - RNA, 22 nt, Human
aauccagguggcggagguugug

SEQ ID NO: 135455 - RNA, 22 nt, Human
cugggccaucagaggggcugga

SEQ ID NO: 135456 - RNA, 22 nt, Human
agaggcuccuagccacuggcuu

SEQ ID NO: 135457 - RNA, 22 nt, Human
acagucucuccacacugcaggg

SEQ ID NO: 135458 - RNA, 20 nt, Human
ucugucucugagcuagacuu

SEQ ID NO: 135459 - RNA, 22 nt, Human
ccagucugugugccagccugcg

SEQ ID NO: 135460 - RNA, 19 nt, Human
ucacaggcaucuccccaga

SEQ ID NO: 135461 - RNA, 22 nt, Human
auugaaaguccuaucuaaggga

SEQ ID NO: 135462 - RNA, 22 nt, Human
ccuuuacacguaaggcuguuga

SEQ ID NO: 135463 - RNA, 22 nt, Human
gagcccuccauggagccaggca

SEQ ID NO: 135464 - RNA, 22 nt, Human
cucuggcuucuaccuugcaguu

SEQ ID NO: 135465 - RNA, 22 nt, Human
uuaugaaagacauuucuguugg

SEQ ID NO: 135466 - RNA, 22 nt, Human
aucccugcccucauggagcuua

SEQ ID NO: 135467 - RNA, 22 nt, Human
cagguggguacaucacagagac

SEQ ID NO: 135468 - RNA, 22 nt, Human
gaggaugugucuggucugggca

SEQ ID NO: 135469 - RNA, 18 nt, Human
gugcaugcaugcucugcc

SEQ ID NO: 135470 - RNA, 22 nt, Human
uaaagguagcaugaaacugcaa

SEQ ID NO: 135471 - RNA, 22 nt, Human
agggcagaaaucgauuacaccu

SEQ ID NO: 135472 - RNA, 22 nt, Human
uuaucucucacuuuuaaggaca

SEQ ID NO: 135473 - RNA, 22 nt, Human
cugagggcccugaagcuuggca

SEQ ID NO: 135474 - RNA, 22 nt, Human
aggcuuccuggaggaagaggua

SEQ ID NO: 135475 - RNA, 22 nt, Human
agagugaaaagcuagagcagua

SEQ ID NO: 135476 - RNA, 22 nt, Human
gaucauuuacuuguucuggacu

SEQ ID NO: 135477 - RNA, 22 nt, Human
ggagccaguuuagaccucaguu

SEQ ID NO: 135478 - RNA, 22 nt, Human
cucuguccacagguuugucccu

SEQ ID NO: 135479 - RNA, 22 nt, Human
agcugcucccuauccuuuccuu

SEQ ID NO: 135480 - RNA, 22 nt, Human
aggcuucuacguggucccaggg

SEQ ID NO: 135481 - RNA, 22 nt, Human
ucucuggagggcuccaggcggg

SEQ ID NO: 135482 - RNA, 19 nt, Human
caaggccaccauuucuccg

SEQ ID NO: 135483 - RNA, 23 nt, Human
uacauuguggauggaguccuggg

SEQ ID NO: 135484 - RNA, 19 nt, Human
acagcagggauuuuuggag

SEQ ID NO: 135485 - RNA, 22 nt, Human
uggccucuuaggacauccucua

SEQ ID NO: 135486 - RNA, 22 nt, Human
cuuuuuacaaagccugucuucu

SEQ ID NO: 135487 - RNA, 22 nt, Human
ucccagagucagagguggggcc

SEQ ID NO: 135488 - RNA, 22 nt, Human
aggaaaaagaguugcugccuuc

SEQ ID NO: 135489 - RNA, 22 nt, Human
gcccugagacugagcauggguu

SEQ ID NO: 135490 - RNA, 18 nt, Human
ugacucacccugucagug

SEQ ID NO: 135491 - RNA, 22 nt, Human
uugcacagaugagggugaugcu

SEQ ID NO: 135492 - RNA, 22 nt, Human
auguguaaaaagugcuuaauau

SEQ ID NO: 135493 - RNA, 22 nt, Human
aggcuguguuuccccuggagcu

SEQ ID NO: 135494 - RNA, 22 nt, Human
ucucucuuuuuaaucauguaau

SEQ ID NO: 135495 - RNA, 22 nt, Human
auauucucugcugcuuuugugu

SEQ ID NO: 135496 - RNA, 22 nt, Human
ccuucauugcaucuuuaagaga

SEQ ID NO: 135497 - RNA, 22 nt, Human
uuucuaggcacagugucuuccc

SEQ ID NO: 135498 - RNA, 22 nt, Human
gcuggccuucugcagaguucug

SEQ ID NO: 135499 - RNA, 21 nt, Human
ugauccuuucccccauguugc

SEQ ID NO: 135500 - RNA, 22 nt, Human
agagcagauggagcuggaagag

SEQ ID NO: 135501 - RNA, 19 nt, Human
ccaggccuccugggagguc

SEQ ID NO: 135502 - RNA, 22 nt, Human
ugaagcaggcauugacugauga

SEQ ID NO: 135503 - RNA, 22 nt, Human
uuccugaugcacacagucauuu

SEQ ID NO: 135504 - RNA, 22 nt, Human
aagccagguuccauggaggagc

SEQ ID NO: 135505 - RNA, 22 nt, Human
agcagcauggcugacuaaagac

SEQ ID NO: 135506 - RNA, 22 nt, Human
aucaggauucaccccagagcug

SEQ ID NO: 135507 - RNA, 22 nt, Human
acauuucuccuacuuguuauuu

SEQ ID NO: 135508 - RNA, 22 nt, Human
uucuuuccucccagccuuugga

SEQ ID NO: 135509 - RNA, 22 nt, Human
ugaugcuucacgcugaauaugc

SEQ ID NO: 135510 - RNA, 22 nt, Human
ucauugcagcuucagguguuca

SEQ ID NO: 135511 - RNA, 20 nt, Human
ucacuaguaaccaucugcuu

SEQ ID NO: 135512 - RNA, 21 nt, Human
ugugucacuaacuagaggcua

SEQ ID NO: 135513 - RNA, 22 nt, Human
gcugugaguggaguucugugcu

SEQ ID NO: 135514 - RNA, 22 nt, Human
cagggcccaagacacaaugagg

SEQ ID NO: 135515 - RNA, 22 nt, Human
agagaacacgugcaucugcaau

SEQ ID NO: 135516 - RNA, 22 nt, Human
gcucccugcagcugagaguucc

SEQ ID NO: 135517 - RNA, 22 nt, Human
agaagccauugaagcagaccuc

SEQ ID NO: 135518 - RNA, 22 nt, Human
uagaacagaguuccagugauca

SEQ ID NO: 135519 - RNA, 22 nt, Human
acagccuguuugaucuggugcu

SEQ ID NO: 135520 - RNA, 22 nt, Human
cccuccagagcuugaccugcug

SEQ ID NO: 135521 - RNA, 19 nt, Human
ucugugcugggaggcagca

SEQ ID NO: 135522 - RNA, 22 nt, Human
aggcuccuuguucaucauccau

SEQ ID NO: 135523 - RNA, 22 nt, Human
cagguggggcgcccucaggcag

SEQ ID NO: 135524 - RNA, 22 nt, Human
uucuugcaggucacucacugag

SEQ ID NO: 135525 - RNA, 20 nt, Human
ccucaguguccuggacuggg

SEQ ID NO: 135526 - RNA, 22 nt, Human
ucuccaagcagggcugcaaggc

SEQ ID NO: 135527 - RNA, 22 nt, Human
uggagcuggaauuucugggccu

SEQ ID NO: 135528 - RNA, 22 nt, Human
cagccagcugaauguaccauga

SEQ ID NO: 135529 - RNA, 22 nt, Human
uucuucugacacugaugcugua

SEQ ID NO: 135530 - RNA, 22 nt, Human
uuucuucuuucccagugauggg

SEQ ID NO: 135531 - RNA, 22 nt, Human
ccagcaggaaagugacguuuga

SEQ ID NO: 135532 - RNA, 22 nt, Human
cugaggcaugaaugugggcuuu

SEQ ID NO: 135533 - RNA, 22 nt, Human
ugaugaaauguugaggcaguga

SEQ ID NO: 135534 - RNA, 22 nt, Human
uucucuucccacuuucuguauu

SEQ ID NO: 135535 - RNA, 22 nt, Human
uuacacguguguguaucuguau

SEQ ID NO: 135536 - RNA, 22 nt, Human
acagauauaaacuauaguagug

SEQ ID NO: 135537 - RNA, 22 nt, Human
ccuuucucuaucgacccaucgc

SEQ ID NO: 135538 - RNA, 18 nt, Human
auuuugaacaaugcugua

SEQ ID NO: 135539 - RNA, 21 nt, Human
ggcccugguuacgccuccucu

SEQ ID NO: 135540 - RNA, 22 nt, Human
acacauauucauauguacuuac

SEQ ID NO: 135541 - RNA, 22 nt, Human
uggggcugugagacuacaggau

SEQ ID NO: 135542 - RNA, 22 nt, Human
ggcacugagcgggcucugagcg

SEQ ID NO: 135543 - RNA, 22 nt, Human
gccugagauucugcauuucuaa

SEQ ID NO: 135544 - RNA, 22 nt, Human
auaugaagucagacaaacuggg

SEQ ID NO: 135545 - RNA, 22 nt, Human
auucuucaguauguguggauug

SEQ ID NO: 135546 - RNA, 22 nt, Human
agcauuuaugacuaauguaaaa

SEQ ID NO: 135547 - RNA, 22 nt, Human
ccuggagguggagguugcagug

SEQ ID NO: 135548 - RNA, 22 nt, Human
uggccuggcucacagugagauu

SEQ ID NO: 135549 - RNA, 22 nt, Human
aguauaucugcuucuggguccc

SEQ ID NO: 135550 - RNA, 22 nt, Human
gcugaguguaaugauggcagag

SEQ ID NO: 135551 - RNA, 22 nt, Human
uggcucuguuuguuaacuagac

SEQ ID NO: 135552 - RNA, 22 nt, Human
ccaggccuguguuguguggagg

SEQ ID NO: 135553 - RNA, 22 nt, Human
caguagcaggcacucagcacgu

SEQ ID NO: 135554 - RNA, 22 nt, Human
auaaggcagaaauagggaaagu

SEQ ID NO: 135555 - RNA, 22 nt, Human
cuguggcugcgcccugggggag

SEQ ID NO: 135556 - RNA, 22 nt, Human
cucagagcaaugaacaugcaaa

SEQ ID NO: 135557 - RNA, 22 nt, Human
ccugccaggacauugcuugaag

SEQ ID NO: 135558 - RNA, 22 nt, Human
ggcucuggcguccaauggagcg

SEQ ID NO: 135559 - RNA, 22 nt, Human
uuuaagcuguggcauuaauucu

SEQ ID NO: 135560 - RNA, 22 nt, Human
cccaaggccucuccuuggcuug

SEQ ID NO: 135561 - RNA, 22 nt, Human
ugugcuauuugacuguuugcua

SEQ ID NO: 135562 - RNA, 22 nt, Human
ugaaaguugcacauaagagaau

SEQ ID NO: 135563 - RNA, 22 nt, Human
cagacuggccacaucugcacug

SEQ ID NO: 135564 - RNA, 22 nt, Human
caggaacauuuaaccacagggu

SEQ ID NO: 135565 - RNA, 22 nt, Human
cuccuggacauggagcggagga

SEQ ID NO: 135566 - RNA, 22 nt, Human
uaggggugaggccaggcaucag

SEQ ID NO: 135567 - RNA, 23 nt, Human
auggagcugguacuagcuaccuc

SEQ ID NO: 135568 - RNA, 22 nt, Human
acagggccagccugggaccugg

SEQ ID NO: 135569 - RNA, 22 nt, Human
uggagcugagaaguggagcucu

SEQ ID NO: 135570 - RNA, 22 nt, Human
cuggugugauugagcccaggug

SEQ ID NO: 135571 - RNA, 22 nt, Human
aaaugcacagaaaggaugugga

SEQ ID NO: 135572 - RNA, 22 nt, Human
aggggcugcuggguccgccccu

SEQ ID NO: 135573 - RNA, 22 nt, Human
ccuuggagcggucagcacuggu

SEQ ID NO: 135574 - RNA, 18 nt, Human
gccugccuagagcuugcc

SEQ ID NO: 135575 - RNA, 22 nt, Human
ucucucugugacagcuuugcug

SEQ ID NO: 135576 - RNA, 22 nt, Human
ugcagcagguuccaaaggguua

SEQ ID NO: 135577 - RNA, 22 nt, Human
acuuugcacuaaguuacucauu

SEQ ID NO: 135578 - RNA, 22 nt, Human
aaccaggacaauuuugaaagua

SEQ ID NO: 135579 - RNA, 22 nt, Human
agagcagaggcauggccguggg

SEQ ID NO: 135580 - RNA, 22 nt, Human
agcagcauguugggaugugaaa

SEQ ID NO: 135581 - RNA, 22 nt, Human
cagggacaugacuggucucugu

SEQ ID NO: 135582 - RNA, 22 nt, Human
aaggagcucccggcagaccagg

SEQ ID NO: 135583 - RNA, 22 nt, Human
aggcucugugacaaucaagcug

SEQ ID NO: 135584 - RNA, 22 nt, Human
ucuggagcuuguuucagauggu

SEQ ID NO: 135585 - RNA, 22 nt, Human
ugcaagaggaauucuagaagca

SEQ ID NO: 135586 - RNA, 22 nt, Human
ucaggagagaaagaauacaauu

SEQ ID NO: 135587 - RNA, 22 nt, Human
aaugagcuagaccugcuuccuc

SEQ ID NO: 135588 - RNA, 22 nt, Human
ugacaguuaagguauacauuca

SEQ ID NO: 135589 - RNA, 22 nt, Human
aagcuuuucucaguguccuugg

SEQ ID NO: 135590 - RNA, 22 nt, Human
ugcauauuuguaugauguuuag

SEQ ID NO: 135591 - RNA, 22 nt, Human
auacaacuuuaucuguaaugag

SEQ ID NO: 135592 - RNA, 22 nt, Human
aggcugugaguaguucuuguug

SEQ ID NO: 135593 - RNA, 22 nt, Human
ccugggcagggcuggacucuca

SEQ ID NO: 135594 - RNA, 22 nt, Human
uuuaaccucuaauuuaguucuc

SEQ ID NO: 135595 - RNA, 22 nt, Human
ugaagacagaccaaggagaaug

SEQ ID NO: 135596 - RNA, 22 nt, Human
gaggcagcagggcugguuccuu

SEQ ID NO: 135597 - RNA, 22 nt, Human
aagccucaccuuuuagaagcua

SEQ ID NO: 135598 - RNA, 22 nt, Human
uuaaauuuuagaaacagacucu

SEQ ID NO: 135599 - RNA, 22 nt, Human
uaaugcacauagaaguacuuag

SEQ ID NO: 135600 - RNA, 22 nt, Human
ggcugaaguguaguggcucacu

SEQ ID NO: 135601 - RNA, 22 nt, Human
agcagcuccugccaugagugcu

SEQ ID NO: 135602 - RNA, 22 nt, Human
cuguauguuccguuuugucacu

SEQ ID NO: 135603 - RNA, 22 nt, Human
uguauauuguucugucucuuca

SEQ ID NO: 135604 - RNA, 19 nt, Human
aggcucugagcuccuggag

SEQ ID NO: 135605 - RNA, 22 nt, Human
cuggcugugcugacugagaggg

SEQ ID NO: 135606 - RNA, 22 nt, Human
ggagcugggacccugucaucug

SEQ ID NO: 135607 - RNA, 22 nt, Human
ugcccaagcagaggagugauuc

SEQ ID NO: 135608 - RNA, 22 nt, Human
ucucaggguuuguacaagugua

SEQ ID NO: 135609 - RNA, 22 nt, Human
uggcugugaacaaagagaauaa

SEQ ID NO: 135610 - RNA, 22 nt, Human
gcucugugccacaugcaguguu

SEQ ID NO: 135611 - RNA, 22 nt, Human
gggauggggagcuggaaagggg

SEQ ID NO: 135612 - RNA, 22 nt, Human
cagcaggacauggaggaguaaa

SEQ ID NO: 135613 - RNA, 22 nt, Human
auggccugggcccgcuucagau

SEQ ID NO: 135614 - RNA, 22 nt, Human
uuccuuguuuguagcucuggga

SEQ ID NO: 135615 - RNA, 22 nt, Human
ugcucauuggcgaucugaggga

SEQ ID NO: 135616 - RNA, 22 nt, Human
auucucugccauugcgguggau

SEQ ID NO: 135617 - RNA, 22 nt, Human
uggcucaguuccaucaucugga

SEQ ID NO: 135618 - RNA, 22 nt, Human
cagggccuuuuagcaucuucuc

SEQ ID NO: 135619 - RNA, 22 nt, Human
acagucuaaucuuguguucugu

SEQ ID NO: 135620 - RNA, 22 nt, Human
cacagcugaaguagccaugugg

SEQ ID NO: 135621 - RNA, 22 nt, Human
aggccagcuguuacuagagcca

SEQ ID NO: 135622 - RNA, 22 nt, Human
gccagggggucagcaggcacuu

SEQ ID NO: 135623 - RNA, 22 nt, Human
ugggcagaggcagcagaaaccu

SEQ ID NO: 135624 - RNA, 22 nt, Human
acauuucuaguuguucaucucc

SEQ ID NO: 135625 - RNA, 22 nt, Human
ugggagcccaagggagcugccg

SEQ ID NO: 135626 - RNA, 22 nt, Human
ugggcucauggcccagcacugg

SEQ ID NO: 135627 - RNA, 22 nt, Human
ggguuggggcccagcagucugc

SEQ ID NO: 135628 - RNA, 22 nt, Human
agagacaccgcgcaucauggcu

SEQ ID NO: 135629 - RNA, 22 nt, Human
agcucccagagcucgagaguaa

SEQ ID NO: 135630 - RNA, 21 nt, Human
uccucagggccccagagcacu

SEQ ID NO: 135631 - RNA, 22 nt, Human
gggcacuguggggcccaugcug

SEQ ID NO: 135632 - RNA, 22 nt, Human
cuuuccuagauggccaucuuuc

SEQ ID NO: 135633 - RNA, 22 nt, Human
agcugccacauggugucacugu

SEQ ID NO: 135634 - RNA, 22 nt, Human
uggggaggacgggcgccuuccu

SEQ ID NO: 135635 - RNA, 22 nt, Human
ccuuggcccuagccucaggcaa

SEQ ID NO: 135636 - RNA, 22 nt, Human
uguggcucucaugcacucccag

SEQ ID NO: 135637 - RNA, 20 nt, Human
ucagggcaugggacagcccc

SEQ ID NO: 135638 - RNA, 22 nt, Human
caaagucccagcugcuuagaga

SEQ ID NO: 135639 - RNA, 22 nt, Human
gugcucuccuggcugcccugac

SEQ ID NO: 135640 - RNA, 22 nt, Human
cccaaggcugcagugagcauga

SEQ ID NO: 135641 - RNA, 22 nt, Human
ccuggcagcagcacaugccuuc

SEQ ID NO: 135642 - RNA, 22 nt, Human
gagccugagugcugccuccccu

SEQ ID NO: 135643 - RNA, 22 nt, Human
cuccagggaaaggggcguccgc

SEQ ID NO: 135644 - RNA, 20 nt, Human
ugcagaagaacguucugguu

SEQ ID NO: 135645 - RNA, 22 nt, Human
aggugcagaaaaaaguccuuua

SEQ ID NO: 135646 - RNA, 22 nt, Human
acauuauagcuuugaguuugga

SEQ ID NO: 135647 - RNA, 22 nt, Human
aagccaggcugcacuugcuggg

SEQ ID NO: 135648 - RNA, 22 nt, Human
caaggcaggaagccugucuuau

SEQ ID NO: 135649 - RNA, 22 nt, Human
acauuuaaccaaacuguuuaau

SEQ ID NO: 135650 - RNA, 22 nt, Human
cccaggagauggagguugcagu

SEQ ID NO: 135651 - RNA, 22 nt, Human
gguacaaggagugaagguuugg

SEQ ID NO: 135652 - RNA, 22 nt, Human
caggccuggggcuggcuuccag

SEQ ID NO: 135653 - RNA, 22 nt, Human
ccuggccuggcacucccucugc

SEQ ID NO: 135654 - RNA, 17 nt, Human
ugcaugcgucugugaua

SEQ ID NO: 135655 - RNA, 22 nt, Human
ugagcccagagaucugagcuau

SEQ ID NO: 135656 - RNA, 22 nt, Human
ugaaggccagggauuugcagcc

SEQ ID NO: 135657 - RNA, 22 nt, Human
gccggggcuggggagagacaug

SEQ ID NO: 135658 - RNA, 22 nt, Human
caugccaguuuugagaugcacc

SEQ ID NO: 135659 - RNA, 22 nt, Human
uguccucaaggagcuucagucu

SEQ ID NO: 135660 - RNA, 22 nt, Human
acauuucucagguaagucauuu

SEQ ID NO: 135661 - RNA, 22 nt, Human
aucaaaguggaaguuuacuagg

SEQ ID NO: 135662 - RNA, 22 nt, Human
uggcagugccccuugaccagug

SEQ ID NO: 135663 - RNA, 22 nt, Human
ggccugcuucucagugagcuug

SEQ ID NO: 135664 - RNA, 22 nt, Human
aggccugaaggaagaugagcug

SEQ ID NO: 135665 - RNA, 22 nt, Human
agaaaaggcuugaagagguuuu

SEQ ID NO: 135666 - RNA, 22 nt, Human
acagggccucagccagggcaga

SEQ ID NO: 135667 - RNA, 22 nt, Human
gucccuggucuaccguggcuuc

SEQ ID NO: 135668 - RNA, 22 nt, Human
cagggcaguuuuacuucucucu

SEQ ID NO: 135669 - RNA, 22 nt, Human
aguguauugauuggaacagccu

SEQ ID NO: 135670 - RNA, 22 nt, Human
aguaccaugcuuccugacuggu

SEQ ID NO: 135671 - RNA, 17 nt, Human
gccuuccuuccuccaca

SEQ ID NO: 135672 - RNA, 22 nt, Human
caaauaguaugagcaaugauuc

SEQ ID NO: 135673 - RNA, 22 nt, Human
gcugcucucagagcucaugcug

SEQ ID NO: 135674 - RNA, 22 nt, Human
cucuuuaacucccauucugucc

SEQ ID NO: 135675 - RNA, 22 nt, Human
ugcagugccucggcagugcagc

SEQ ID NO: 135676 - RNA, 22 nt, Human
cugugcccuggccaggccucuc

SEQ ID NO: 135677 - RNA, 22 nt, Human
ucacucuuuaucuuuuaugucu

SEQ ID NO: 135678 - RNA, 22 nt, Human
ccccuuccuuccucagacagcc

SEQ ID NO: 135679 - RNA, 19 nt, Human
ugccugucaguagaucuca

SEQ ID NO: 135680 - RNA, 21 nt, Human
acaugcauagagagauuucug

SEQ ID NO: 135681 - RNA, 22 nt, Human
ccucuggguaucuguggaagua

SEQ ID NO: 135682 - RNA, 22 nt, Human
gugaguguuaacccacugcuuc

SEQ ID NO: 135683 - RNA, 22 nt, Human
ggugaaggcacaagagggcaag

SEQ ID NO: 135684 - RNA, 22 nt, Human
uugccuugauucuucucaugug

SEQ ID NO: 135685 - RNA, 22 nt, Human
auucucuggucauugaguauaa

SEQ ID NO: 135686 - RNA, 22 nt, Human
gcagcugaaagggaucucuaca

SEQ ID NO: 135687 - RNA, 22 nt, Human
uuuuacagucagucaaacucag

SEQ ID NO: 135688 - RNA, 22 nt, Human
ucauugucuugauaugauuguc

SEQ ID NO: 135689 - RNA, 22 nt, Human
gccucucucuacccaguaugau

SEQ ID NO: 135690 - RNA, 22 nt, Human
gugugugcaagagguuuauuga

SEQ ID NO: 135691 - RNA, 22 nt, Human
agcugagcuaguaguuccagug

SEQ ID NO: 135692 - RNA, 22 nt, Human
aauuuagauugauaaacaugga

SEQ ID NO: 135693 - RNA, 22 nt, Human
ugggagcaagcuggugcuggag

SEQ ID NO: 135694 - RNA, 22 nt, Human
ugcagcugcuggcccaggugcu

SEQ ID NO: 135695 - RNA, 22 nt, Human
cauugcacuuuggguccaggac

SEQ ID NO: 135696 - RNA, 22 nt, Human
ccuggaaggcaggcauggauug

SEQ ID NO: 135697 - RNA, 22 nt, Human
cugugcugggugugcuuaugau

SEQ ID NO: 135698 - RNA, 22 nt, Human
uacuuuuuagcacagugugugc

SEQ ID NO: 135699 - RNA, 22 nt, Human
gcagccacuaguuuuccuguuu

SEQ ID NO: 135700 - RNA, 22 nt, Human
accaucagucauugucaguggg

SEQ ID NO: 135701 - RNA, 22 nt, Human
ugggccugggagggcagacgcu

SEQ ID NO: 135702 - RNA, 22 nt, Human
ggagcugaugacgucaccaugg

SEQ ID NO: 135703 - RNA, 23 nt, Human
ugcucugggaggcccuggagagc

SEQ ID NO: 135704 - RNA, 21 nt, Human
uuucucaccaugguauggaaa

SEQ ID NO: 135705 - RNA, 22 nt, Human
agagccaggugcugcuguuuga

SEQ ID NO: 135706 - RNA, 22 nt, Human
cuguguccucccgcugcaccca

SEQ ID NO: 135707 - RNA, 22 nt, Human
acucugggccccagguggagcu

SEQ ID NO: 135708 - RNA, 22 nt, Human
aggugccagugcuguggucccc

SEQ ID NO: 135709 - RNA, 22 nt, Human
agaggaugauuuuaaggacacu

SEQ ID NO: 135710 - RNA, 22 nt, Human
auaguacacauccuacaauguu

SEQ ID NO: 135711 - RNA, 22 nt, Human
ucucaucuccauuauagcauca

SEQ ID NO: 135712 - RNA, 22 nt, Human
aaggcugccucugccagaggag

SEQ ID NO: 135713 - RNA, 22 nt, Human
uuuccucuucuggcaggcaggg

SEQ ID NO: 135714 - RNA, 22 nt, Human
cacugccuccccaggcuccaca

SEQ ID NO: 135715 - RNA, 22 nt, Human
aaaguucugggggagaagaacg

SEQ ID NO: 135716 - RNA, 22 nt, Human
cauuuagaaacuguuuuuaaca

SEQ ID NO: 135717 - RNA, 22 nt, Human
cauuuguagcuauuuacuguau

SEQ ID NO: 135718 - RNA, 22 nt, Human
ccuggcucucugcagauccugg

SEQ ID NO: 135719 - RNA, 22 nt, Human
aggcucugaucagguggcugug

SEQ ID NO: 135720 - RNA, 22 nt, Human
cugagcugggaguagagacucu

SEQ ID NO: 135721 - RNA, 22 nt, Human
aguucacauuccgagguacugg

SEQ ID NO: 135722 - RNA, 19 nt, Human
uguguggguuuagaguagu

SEQ ID NO: 135723 - RNA, 22 nt, Human
gagcugugauuggugucucacu

SEQ ID NO: 135724 - RNA, 22 nt, Human
uguauagaguuggaagaugacu

SEQ ID NO: 135725 - RNA, 22 nt, Human
cuaacuuuuacagucauguugc

SEQ ID NO: 135726 - RNA, 22 nt, Human
aacuuauugaacauucucgaau

SEQ ID NO: 135727 - RNA, 22 nt, Human
agaauucuggaguugggaggaa

SEQ ID NO: 135728 - RNA, 22 nt, Human
guugggaagcagauggaugagc

SEQ ID NO: 135729 - RNA, 22 nt, Human
cucagaauuacaucccauuuua

SEQ ID NO: 135730 - RNA, 22 nt, Human
uuugaacaagagcuucacauua

SEQ ID NO: 135731 - RNA, 22 nt, Human
cuuccaaacccaggguaugggc

SEQ ID NO: 135732 - RNA, 22 nt, Human
auuauauugaguauaaccagag

SEQ ID NO: 135733 - RNA, 22 nt, Human
caggguagacaguaggugucug

SEQ ID NO: 135734 - RNA, 22 nt, Human
acagauguacacucauauauaa

SEQ ID NO: 135735 - RNA, 22 nt, Human
cagaggcuaagaugagugggug

SEQ ID NO: 135736 - RNA, 22 nt, Human
uccugggcccaggcugccaggg

SEQ ID NO: 135737 - RNA, 22 nt, Human
acucaggaaaaauguagugaua

SEQ ID NO: 135738 - RNA, 22 nt, Human
uggaguucucaggugagggcuu

SEQ ID NO: 135739 - RNA, 22 nt, Human
ugcaggugaaaauuaugaggau

SEQ ID NO: 135740 - RNA, 22 nt, Human
aggcacaguggcucacaccugu

SEQ ID NO: 135741 - RNA, 22 nt, Human
gagcagcuagauaaagcccuuc

SEQ ID NO: 135742 - RNA, 22 nt, Human
aaguauuucguucugaaaaagu

SEQ ID NO: 135743 - RNA, 22 nt, Human
ugcauugcaguuaacucaguau

SEQ ID NO: 135744 - RNA, 22 nt, Human
agaagccacuggagguugagau

SEQ ID NO: 135745 - RNA, 22 nt, Human
caaaguuuggcucucaugacau

SEQ ID NO: 135746 - RNA, 22 nt, Human
agcugcugcgccucacccuggc

SEQ ID NO: 135747 - RNA, 22 nt, Human
ugaguguauaugaagguuguaa

SEQ ID NO: 135748 - RNA, 22 nt, Human
uguauguauguauguauuuggg

SEQ ID NO: 135749 - RNA, 22 nt, Human
ccagcuccgggaguugcugcug

SEQ ID NO: 135750 - RNA, 22 nt, Human
ugcauauugugaaaauguagau

SEQ ID NO: 135751 - RNA, 22 nt, Human
gacacauagaucuaucucacuc

SEQ ID NO: 135752 - RNA, 22 nt, Human
cacugaguucccugacauuuca

SEQ ID NO: 135753 - RNA, 22 nt, Human
agggcugguauguccaugaaag

SEQ ID NO: 135754 - RNA, 19 nt, Human
ggccccucucacaggaguu

SEQ ID NO: 135755 - RNA, 22 nt, Human
ucauuuguucaucugcucuucu

SEQ ID NO: 135756 - RNA, 22 nt, Human
caggguacagaguuuucuaaac

SEQ ID NO: 135757 - RNA, 22 nt, Human
aggcuguguggauaauauuggg

SEQ ID NO: 135758 - RNA, 22 nt, Human
caggaaccuaaagagacauuac

SEQ ID NO: 135759 - RNA, 22 nt, Human
uucucuuauucuggauaugcag

SEQ ID NO: 135760 - RNA, 22 nt, Human
auauuucuggggguguguuucu

SEQ ID NO: 135761 - RNA, 21 nt, Human
agugugugauaggcaggaaga

SEQ ID NO: 135762 - RNA, 22 nt, Human
acugucugcaaaacucauacuc

SEQ ID NO: 135763 - RNA, 21 nt, Human
ccuucucuugcuucagcuuca

SEQ ID NO: 135764 - RNA, 22 nt, Human
uugagaagaaauaguuugcaau

SEQ ID NO: 135765 - RNA, 22 nt, Human
uggaaggagcuaaggaccuggg

SEQ ID NO: 135766 - RNA, 22 nt, Human
cuggaggcacccuuagagaggc

SEQ ID NO: 135767 - RNA, 21 nt, Human
ggagucauuagucauuuccuu

SEQ ID NO: 135768 - RNA, 22 nt, Human
gcagagcuucuguccuucagga

SEQ ID NO: 135769 - RNA, 20 nt, Human
accaauguuagcuuaguacu

SEQ ID NO: 135770 - RNA, 22 nt, Human
uacugugucuuaggauguggaa

SEQ ID NO: 135771 - RNA, 22 nt, Human
gcagagugagccgaggcugcuc

SEQ ID NO: 135772 - RNA, 22 nt, Human
gcuggccuuugaggaagcugcg

SEQ ID NO: 135773 - RNA, 22 nt, Human
gggagagagagcucauguugaa

SEQ ID NO: 135774 - RNA, 22 nt, Human
cauuguuaccaucuuuuaccua

SEQ ID NO: 135775 - RNA, 22 nt, Human
ccugcucugguuuagucagucu

SEQ ID NO: 135776 - RNA, 22 nt, Human
gaaaucugaaucuucuguuggu

SEQ ID NO: 135777 - RNA, 22 nt, Human
uguauaugagucugaguguaca

SEQ ID NO: 135778 - RNA, 22 nt, Human
ucacaggaaccaucagagaaau

SEQ ID NO: 135779 - RNA, 22 nt, Human
uuuuuaagagauucuccagucu

SEQ ID NO: 135780 - RNA, 22 nt, Human
cuccucccucuuugccacacau

SEQ ID NO: 135781 - RNA, 22 nt, Human
ugugugaaucuauugaauauau

SEQ ID NO: 135782 - RNA, 22 nt, Human
cugugcuggauucugaggcuac

SEQ ID NO: 135783 - RNA, 22 nt, Human
aucauucuauuguugagcugcc

SEQ ID NO: 135784 - RNA, 22 nt, Human
gcucaggacuggaggagcgggg

SEQ ID NO: 135785 - RNA, 22 nt, Human
cagaacauuccaugugcccugc

SEQ ID NO: 135786 - RNA, 22 nt, Human
ugugugugaguccuggcuuucc

SEQ ID NO: 135787 - RNA, 18 nt, Human
uggagcugagugcugugc

SEQ ID NO: 135788 - RNA, 22 nt, Human
ccagugcaggugagcaccaggu

SEQ ID NO: 135789 - RNA, 22 nt, Human
aaugucugcucuacucaggagg

SEQ ID NO: 135790 - RNA, 22 nt, Human
ggcagcugugaagugccucaca

SEQ ID NO: 135791 - RNA, 22 nt, Human
agcagggcagcugaugcgcacg

SEQ ID NO: 135792 - RNA, 22 nt, Human
augucccagcugagagacaacu

SEQ ID NO: 135793 - RNA, 18 nt, Human
gaggauggaaggagaugc

SEQ ID NO: 135794 - RNA, 22 nt, Human
gcccaucaucacuguggaggcu

SEQ ID NO: 135795 - RNA, 22 nt, Human
uuacaaagagaaguuguagaau

SEQ ID NO: 135796 - RNA, 22 nt, Human
gcugucccaugguugcaagaug

SEQ ID NO: 135797 - RNA, 22 nt, Human
ggcucugcgcgguaaagugacu

SEQ ID NO: 135798 - RNA, 22 nt, Human
aagugacacauggcacuucuau

SEQ ID NO: 135799 - RNA, 22 nt, Human
cugucaguucuuccagauagag

SEQ ID NO: 135800 - RNA, 22 nt, Human
ccaggagcagggcuggcugcac

SEQ ID NO: 135801 - RNA, 22 nt, Human
caaauguaaauucuuuugaagc

SEQ ID NO: 135802 - RNA, 21 nt, Human
uuucaauguguucuuuguagu

SEQ ID NO: 135803 - RNA, 22 nt, Human
uuucaguuguccuguuaauagc

SEQ ID NO: 135804 - RNA, 21 nt, Human
uccaggaguggcugggcaggg

SEQ ID NO: 135805 - RNA, 22 nt, Human
ccugggagugugccaucucugu

SEQ ID NO: 135806 - RNA, 22 nt, Human
aaguugaaugcguacgugacau

SEQ ID NO: 135807 - RNA, 22 nt, Human
cugcccugggauggucugugcg

SEQ ID NO: 135808 - RNA, 21 nt, Human
ugaaaucugaugggacaaaug

SEQ ID NO: 135809 - RNA, 22 nt, Human
uacagauacagaucuagauaca

SEQ ID NO: 135810 - RNA, 22 nt, Human
uggggacacagagguucguugg

SEQ ID NO: 135811 - RNA, 22 nt, Human
gccaggcuguuuuuauuacugu

SEQ ID NO: 135812 - RNA, 22 nt, Human
aguguaugcagguuuucaaugu

SEQ ID NO: 135813 - RNA, 22 nt, Human
ucauugcaggcauuccccugcc

SEQ ID NO: 135814 - RNA, 22 nt, Human
ggaugcacgaaggcgccucgga

SEQ ID NO: 135815 - RNA, 22 nt, Human
auuucucucauuguuagcuagg

SEQ ID NO: 135816 - RNA, 22 nt, Human
uaagacaauucuucagucacaa

SEQ ID NO: 135817 - RNA, 23 nt, Human
agcagggccagaauacuugcugu

SEQ ID NO: 135818 - RNA, 22 nt, Human
caaaugugguuucucagcauuc

SEQ ID NO: 135819 - RNA, 22 nt, Human
agcugccacugagggugcacag

SEQ ID NO: 135820 - RNA, 16 nt, Human
guucucucacuguacc

SEQ ID NO: 135821 - RNA, 22 nt, Human
gccacugcacuccagcccaggc

SEQ ID NO: 135822 - RNA, 22 nt, Human
uagaaaucagguuuuuagaaag

SEQ ID NO: 135823 - RNA, 22 nt, Human
aaauguagaccuauagggaccu

SEQ ID NO: 135824 - RNA, 22 nt, Human
ggcugcuggggacgugggagag

SEQ ID NO: 135825 - RNA, 22 nt, Human
aauauuuuaggcuuuccaggcu

SEQ ID NO: 135826 - RNA, 22 nt, Human
uuccucugaaauggcuuggaaa

SEQ ID NO: 135827 - RNA, 22 nt, Human
agacaacaccaaaugcuagugu

SEQ ID NO: 135828 - RNA, 22 nt, Human
ggccucugaggacagccuuggc

SEQ ID NO: 135829 - RNA, 22 nt, Human
cugguucauccccuuccaggaa

SEQ ID NO: 135830 - RNA, 22 nt, Human
ugugccuggucccugagucgag

SEQ ID NO: 135831 - RNA, 22 nt, Human
ccauuugucaccucugcacucc

SEQ ID NO: 135832 - RNA, 22 nt, Human
agggcccaggacagcaucaggg

SEQ ID NO: 135833 - RNA, 22 nt, Human
aguggcagagugcacucaggca

SEQ ID NO: 135834 - RNA, 22 nt, Human
ucaggagucugugcaguuccac

SEQ ID NO: 135835 - RNA, 23 nt, Human
ggccuguguuuugucugaaguac

SEQ ID NO: 135836 - RNA, 22 nt, Human
ggaaaguggugguggaaagagg

SEQ ID NO: 135837 - RNA, 22 nt, Human
ucuuuaagaguaauuauuuugg

SEQ ID NO: 135838 - RNA, 22 nt, Human
gaggcugcccaacuggagugga

SEQ ID NO: 135839 - RNA, 22 nt, Human
agucucugcacaguaagaagca

SEQ ID NO: 135840 - RNA, 20 nt, Human
ccugccugccucggcucauu

SEQ ID NO: 135841 - RNA, 20 nt, Human
aacagggggcugcagagggc

SEQ ID NO: 135842 - RNA, 22 nt, Human
cugagcuuccaguuccuccagg

SEQ ID NO: 135843 - RNA, 22 nt, Human
gcagggcaaugaucccgagagg

SEQ ID NO: 135844 - RNA, 22 nt, Human
uuauuuauggcacuguuggugg

SEQ ID NO: 135845 - RNA, 22 nt, Human
aguauguugaguuuugcuuuag

SEQ ID NO: 135846 - RNA, 22 nt, Human
cugagcugcggcaggcaccugg

SEQ ID NO: 135847 - RNA, 22 nt, Human
uggcugcugcuuggucuucuuc

SEQ ID NO: 135848 - RNA, 22 nt, Human
aucuggcucuuccuggaguucc

SEQ ID NO: 135849 - RNA, 22 nt, Human
aguauauuuugauuguaugugu

SEQ ID NO: 135850 - RNA, 22 nt, Human
cauacauuuugcauauuuacca

SEQ ID NO: 135851 - RNA, 22 nt, Human
agcugugugugaauuuggccua

SEQ ID NO: 135852 - RNA, 22 nt, Human
agccacaggaaacagagacagc

SEQ ID NO: 135853 - RNA, 22 nt, Human
cagcaggaaacuuaaagguaau

SEQ ID NO: 135854 - RNA, 22 nt, Human
ccugaggcuuaaucugucccaa

SEQ ID NO: 135855 - RNA, 22 nt, Human
aggcaagggggcgccaccuucc

SEQ ID NO: 135856 - RNA, 22 nt, Human
cuguguuuuuggucugaucuau

SEQ ID NO: 135857 - RNA, 22 nt, Human
uuuucauuguuccucgagcauu

SEQ ID NO: 135858 - RNA, 19 nt, Human
cucugcuugguccauaugc

SEQ ID NO: 135859 - RNA, 22 nt, Human
gcuggcucccauugguccuucc

SEQ ID NO: 135860 - RNA, 22 nt, Human
auggcuguugugaggaucaaau

SEQ ID NO: 135861 - RNA, 22 nt, Human
ugggacagugugccuugcuccu

SEQ ID NO: 135862 - RNA, 22 nt, Human
ccaggccagcaggcacaccugc

SEQ ID NO: 135863 - RNA, 22 nt, Human
gcagugaaucuggcaagaauuu

SEQ ID NO: 135864 - RNA, 22 nt, Human
cugggcuggagugcaauggcgc

SEQ ID NO: 135865 - RNA, 22 nt, Human
aggggagaguuaaugugaaugu

SEQ ID NO: 135866 - RNA, 22 nt, Human
gccugagauucccggagccgug

SEQ ID NO: 135867 - RNA, 22 nt, Human
gcccuggccuucaucucagaca

SEQ ID NO: 135868 - RNA, 22 nt, Human
ucuggccugggccugccggugc

SEQ ID NO: 135869 - RNA, 22 nt, Human
gccugggagagggauagugcag

SEQ ID NO: 135870 - RNA, 22 nt, Human
agauuucccaaauacuuguuau

SEQ ID NO: 135871 - RNA, 22 nt, Human
aagauacauaaagguagagucu

SEQ ID NO: 135872 - RNA, 22 nt, Human
ugggcugcggauaggccucgga

SEQ ID NO: 135873 - RNA, 22 nt, Human
ugugugaguaaggcugagagag

SEQ ID NO: 135874 - RNA, 22 nt, Human
ggcuuucuagaucuagcucugu

SEQ ID NO: 135875 - RNA, 22 nt, Human
cagaguguggcaucuuccaacu

SEQ ID NO: 135876 - RNA, 22 nt, Human
acuuccugcuaugagcuucugu

SEQ ID NO: 135877 - RNA, 23 nt, Human
uauguauguauguuuguauggaa

SEQ ID NO: 135878 - RNA, 19 nt, Human
uauguguauauguaucugu

SEQ ID NO: 135879 - RNA, 22 nt, Human
ucaaaugcuguauuguaguaau

SEQ ID NO: 135880 - RNA, 22 nt, Human
cucuucuugcuagacugagugc

SEQ ID NO: 135881 - RNA, 22 nt, Human
uccuucagcuacucaguuucca

SEQ ID NO: 135882 - RNA, 22 nt, Human
cuuuacagugcugcuaauggcu

SEQ ID NO: 135883 - RNA, 22 nt, Human
ucacugcaaccucugccuuccg

SEQ ID NO: 135884 - RNA, 17 nt, Human
uuaaaggaugcucucuc

SEQ ID NO: 135885 - RNA, 22 nt, Human
uggccugggccggcagauauac

SEQ ID NO: 135886 - RNA, 22 nt, Human
guuuaugcacuugguuuguguc

SEQ ID NO: 135887 - RNA, 22 nt, Human
acagggccucagcugauucugg

SEQ ID NO: 135888 - RNA, 22 nt, Human
gucaaacaaauuaacauaucca

SEQ ID NO: 135889 - RNA, 22 nt, Human
cugugcaagacuuacuuuaaua

SEQ ID NO: 135890 - RNA, 22 nt, Human
gggcaguggcucacgccuguaa

SEQ ID NO: 135891 - RNA, 22 nt, Human
uuguuuguaugcugagaagaau

SEQ ID NO: 135892 - RNA, 22 nt, Human
uuccauaauaggcuuaagugaa

SEQ ID NO: 135893 - RNA, 22 nt, Human
gcagagacuccacugucuugug

SEQ ID NO: 135894 - RNA, 22 nt, Human
agggcacaucugcugggaaugg

SEQ ID NO: 135895 - RNA, 21 nt, Human
uggcucugaaagagugcugca

SEQ ID NO: 135896 - RNA, 22 nt, Human
cagccugcuagggcaaugccuu

SEQ ID NO: 135897 - RNA, 22 nt, Human
uucacagggcagcagcugagcc

SEQ ID NO: 135898 - RNA, 22 nt, Human
ugugugauuccacuuauauggg

SEQ ID NO: 135899 - RNA, 22 nt, Human
uaaaauguguuucuguaugguu

SEQ ID NO: 135900 - RNA, 22 nt, Human
acagccauagaugcuuauguaa

SEQ ID NO: 135901 - RNA, 22 nt, Human
gugucauuaaccaccaugcaaa

SEQ ID NO: 135902 - RNA, 22 nt, Human
aaauauaauuucugccucaaua

SEQ ID NO: 135903 - RNA, 22 nt, Human
gagggcugauaacaggaauaca

SEQ ID NO: 135904 - RNA, 22 nt, Human
ugcagcuguaacagaggccuca

SEQ ID NO: 135905 - RNA, 22 nt, Human
gugugccaccagucaaggugaa

SEQ ID NO: 135906 - RNA, 22 nt, Human
ccugagaggcccucucacuguc

SEQ ID NO: 135907 - RNA, 22 nt, Human
acuggcaguuugagaaugcauu

SEQ ID NO: 135908 - RNA, 22 nt, Human
aagaagagaaaugugcugcugg

SEQ ID NO: 135909 - RNA, 22 nt, Human
uuucacaggaguccuuucuaua

SEQ ID NO: 135910 - RNA, 22 nt, Human
ccaggguggaggcuggauggag

SEQ ID NO: 135911 - RNA, 22 nt, Human
ggcugcuggauuguguaucugu

SEQ ID NO: 135912 - RNA, 22 nt, Human
auguuuauguugggcuauauuu

SEQ ID NO: 135913 - RNA, 22 nt, Human
uaauauuucuacccugcugccu

SEQ ID NO: 135914 - RNA, 22 nt, Human
ugugugucagucuuguuuaggg

SEQ ID NO: 135915 - RNA, 22 nt, Human
aggcagcaaagaaaugaugcug

SEQ ID NO: 135916 - RNA, 22 nt, Human
guggauggauuuugaggaaugg

SEQ ID NO: 135917 - RNA, 22 nt, Human
aagcagugcgcucaucuaaggg

SEQ ID NO: 135918 - RNA, 22 nt, Human
acaauauuguacccagaaguuu

SEQ ID NO: 135919 - RNA, 22 nt, Human
caccaggcuggagugcagaggu

SEQ ID NO: 135920 - RNA, 22 nt, Human
gggggcuggaauauccaucaac

SEQ ID NO: 135921 - RNA, 22 nt, Human
ccugucuguccucucaugagcc

SEQ ID NO: 135922 - RNA, 22 nt, Human
gccuucugauugcuggacugac

SEQ ID NO: 135923 - RNA, 22 nt, Human
cuuccuguugucacagucugcg

SEQ ID NO: 135924 - RNA, 22 nt, Human
uauguucuuuacaucugugcaa

SEQ ID NO: 135925 - RNA, 22 nt, Human
caaaugauacuguuuuuagucu

SEQ ID NO: 135926 - RNA, 22 nt, Human
uuagagaaauucugguaaugua

SEQ ID NO: 135927 - RNA, 22 nt, Human
auaagaaacauuauucuuucca

SEQ ID NO: 135928 - RNA, 22 nt, Human
ggcagccagagggcagcuggau

SEQ ID NO: 135929 - RNA, 22 nt, Human
caggugccgggaaugcagcaau

SEQ ID NO: 135930 - RNA, 22 nt, Human
aaguucaagucugcaucuuuuu

SEQ ID NO: 135931 - RNA, 22 nt, Human
uccagggaaggugugaggcugg

SEQ ID NO: 135932 - RNA, 22 nt, Human
aaagccuugagauccuauaguu

SEQ ID NO: 135933 - RNA, 22 nt, Human
uuuccuguucuaguuguugcca

SEQ ID NO: 135934 - RNA, 22 nt, Human
auucuucauacagacaaguccu

SEQ ID NO: 135935 - RNA, 22 nt, Human
uggagccugagucagcggaggc

SEQ ID NO: 135936 - RNA, 22 nt, Human
aguauuucuaguugguucuacu

SEQ ID NO: 135937 - RNA, 22 nt, Human
agaaaaggauugauggaucaga

SEQ ID NO: 135938 - RNA, 22 nt, Human
ucaaugaugcugaagguagcgu

SEQ ID NO: 135939 - RNA, 22 nt, Human
ugaagacacauacaagggaaug

SEQ ID NO: 135940 - RNA, 22 nt, Human
cugaagcaaaggaucgagcuaa

SEQ ID NO: 135941 - RNA, 22 nt, Human
uggccuuguguuuuagagaaag

SEQ ID NO: 135942 - RNA, 22 nt, Human
cagcagcucccauccgcugagc

SEQ ID NO: 135943 - RNA, 22 nt, Human
ucugagagguuaagcaauuuga

SEQ ID NO: 135944 - RNA, 22 nt, Human
cccacagguccccaugaacucg

SEQ ID NO: 135945 - RNA, 22 nt, Human
ugcauuucagaagaaaauucgg

SEQ ID NO: 135946 - RNA, 22 nt, Human
ugccugcuaggcccugcugggu

SEQ ID NO: 135947 - RNA, 22 nt, Human
gcagggugaaggucacauagaa

SEQ ID NO: 135948 - RNA, 22 nt, Human
uggcagaguuauggguauuuau

SEQ ID NO: 135949 - RNA, 22 nt, Human
ggcacugggcaccggcugaggg

SEQ ID NO: 135950 - RNA, 22 nt, Human
uggguggcacuucuggggucca

SEQ ID NO: 135951 - RNA, 22 nt, Human
uggcaggggaggugcuugcuua

SEQ ID NO: 135952 - RNA, 22 nt, Human
uuaauuuuaaccuguuuguguc

SEQ ID NO: 135953 - RNA, 22 nt, Human
ucauuauccuaguaucuugaau

SEQ ID NO: 135954 - RNA, 22 nt, Human
ugcccaggaucuggcgaugcuc

SEQ ID NO: 135955 - RNA, 22 nt, Human
gaggcugccccuuccucagcug

SEQ ID NO: 135956 - RNA, 19 nt, Human
gaucuuugccaauuuaagc

SEQ ID NO: 135957 - RNA, 22 nt, Human
agccucucuuuauucccagcua

SEQ ID NO: 135958 - RNA, 22 nt, Human
cagggccagccgcagcauccac

SEQ ID NO: 135959 - RNA, 22 nt, Human
ucuccucuauuucuguauguau

SEQ ID NO: 135960 - RNA, 22 nt, Human
uccuucuuugacaaguggcaga

SEQ ID NO: 135961 - RNA, 22 nt, Human
gaggagagggcugcgggcccac

SEQ ID NO: 135962 - RNA, 22 nt, Human
uuguggcuucuacgcccacagg

SEQ ID NO: 135963 - RNA, 22 nt, Human
uuguuacagcagugauuucaga

SEQ ID NO: 135964 - RNA, 22 nt, Human
caaaguuaugaaugauaagauu

SEQ ID NO: 135965 - RNA, 22 nt, Human
ugaugaaaauaugauucugagg

SEQ ID NO: 135966 - RNA, 22 nt, Human
ucaaaugcggucauggcuuuua

SEQ ID NO: 135967 - RNA, 22 nt, Human
ugcacacaaguuggagaaugaa

SEQ ID NO: 135968 - RNA, 22 nt, Human
caaagccucugauuucacuugu

SEQ ID NO: 135969 - RNA, 22 nt, Human
auaauuuaaauuaguaugugau

SEQ ID NO: 135970 - RNA, 18 nt, Human
uuucacaaccuccagagg

SEQ ID NO: 135971 - RNA, 22 nt, Human
uacccagcuucaagucaggacu

SEQ ID NO: 135972 - RNA, 22 nt, Human
gccaggugggagacagacagca

SEQ ID NO: 135973 - RNA, 22 nt, Human
acaggccugacacacagagggc

SEQ ID NO: 135974 - RNA, 22 nt, Human
ucucccaggugggugccuggag

SEQ ID NO: 135975 - RNA, 22 nt, Human
cuggccuggcagggagggcaug

SEQ ID NO: 135976 - RNA, 22 nt, Human
agggaagaagcugguaguaggu

SEQ ID NO: 135977 - RNA, 22 nt, Human
uguguguguaaaagcauuuaua

SEQ ID NO: 135978 - RNA, 22 nt, Human
cuggccaggcuugggacagaca

SEQ ID NO: 135979 - RNA, 22 nt, Human
aggcugucugaccccagagccc

SEQ ID NO: 135980 - RNA, 19 nt, Human
uagcugccuguuaccucca

SEQ ID NO: 135981 - RNA, 22 nt, Human
uuuaucuuuaggacuuugcaga

SEQ ID NO: 135982 - RNA, 22 nt, Human
caggauggugugagugugagga

SEQ ID NO: 135983 - RNA, 22 nt, Human
uuugaaaggaauuaggaugaca

SEQ ID NO: 135984 - RNA, 22 nt, Human
auccuugacacacuccaguacu

SEQ ID NO: 135985 - RNA, 22 nt, Human
uggccucugcaauggauucacc

SEQ ID NO: 135986 - RNA, 22 nt, Human
aagaaugucguugguauuuuaa

SEQ ID NO: 135987 - RNA, 22 nt, Human
acaaggcugaacagugaagccg

SEQ ID NO: 135988 - RNA, 22 nt, Human
gaggggcuggcuguggucccau

SEQ ID NO: 135989 - RNA, 22 nt, Human
cuggcaggaagaggaaagguca

SEQ ID NO: 135990 - RNA, 22 nt, Human
aagcagccagccaucaugcccg

SEQ ID NO: 135991 - RNA, 22 nt, Human
aggucacacaacugucagaggc

SEQ ID NO: 135992 - RNA, 18 nt, Human
uguaaugcagcggguggc

SEQ ID NO: 135993 - RNA, 22 nt, Human
aggaccuguaccucagcaucua

SEQ ID NO: 135994 - RNA, 22 nt, Human
uauuuugcaaaccugaguuuga

SEQ ID NO: 135995 - RNA, 22 nt, Human
aguguaugugaaacuuuccaaa

SEQ ID NO: 135996 - RNA, 22 nt, Human
ucucuccugcacugaauuaugu

SEQ ID NO: 135997 - RNA, 22 nt, Human
gggcuggcaggaccugggcuga

SEQ ID NO: 135998 - RNA, 22 nt, Human
guaucuuucccaccaaucacaa

SEQ ID NO: 135999 - RNA, 22 nt, Human
gggaaggagguggcuugaagug

SEQ ID NO: 136000 - RNA, 22 nt, Human
ucccugggccuccugcuaugca

SEQ ID NO: 136001 - RNA, 22 nt, Human
ccugcagguccccggaugcgca

SEQ ID NO: 136002 - RNA, 22 nt, Human
ucucagaguuuacggggcugaa

SEQ ID NO: 136003 - RNA, 15 nt, Human
uaacuuuuuugggcu

SEQ ID NO: 136004 - RNA, 22 nt, Human
guggccucugugcuccugccua

SEQ ID NO: 136005 - RNA, 22 nt, Human
ucugccuuggcaaccacagcuu

SEQ ID NO: 136006 - RNA, 22 nt, Human
ucucuuucuuuguaugucuauu

SEQ ID NO: 136007 - RNA, 22 nt, Human
cuucuggggauggagcccagaa

SEQ ID NO: 136008 - RNA, 22 nt, Human
uggcagagagagugcagucgac

SEQ ID NO: 136009 - RNA, 22 nt, Human
accaaggaguuugguauuuuag

SEQ ID NO: 136010 - RNA, 22 nt, Human
uggcagaguucgcugugccuuu

SEQ ID NO: 136011 - RNA, 22 nt, Human
ggggagugacgcagggccauag

SEQ ID NO: 136012 - RNA, 22 nt, Human
ggccugugagcccuugcaugua

SEQ ID NO: 136013 - RNA, 16 nt, Human
uuguggcuuuugcaca

SEQ ID NO: 136014 - RNA, 22 nt, Human
agaguucugcucuucucaguga

SEQ ID NO: 136015 - RNA, 22 nt, Human
ccugaagcaaggguaggcaggu

SEQ ID NO: 136016 - RNA, 22 nt, Human
gccuuugccugcgacguggcug

SEQ ID NO: 136017 - RNA, 22 nt, Human
cacagaggcaaccuucuggggu

SEQ ID NO: 136018 - RNA, 22 nt, Human
agcaguggaccucagugcuauu

SEQ ID NO: 136019 - RNA, 22 nt, Human
acaugauuuuaguaucauaaua

SEQ ID NO: 136020 - RNA, 22 nt, Human
uggagggaacccaggcugcucu

SEQ ID NO: 136021 - RNA, 22 nt, Human
agcagcucuuaacaaagcaugg

SEQ ID NO: 136022 - RNA, 23 nt, Human
ucuccuccuagauacagucaugg

SEQ ID NO: 136023 - RNA, 22 nt, Human
uuugcauuuauaaguuggugga

SEQ ID NO: 136024 - RNA, 22 nt, Human
ucugcguggcgugguucugugc

SEQ ID NO: 136025 - RNA, 22 nt, Human
gcuggggcugggcugaggaaga

SEQ ID NO: 136026 - RNA, 22 nt, Human
cuuuaacaaaugacucuugucu

SEQ ID NO: 136027 - RNA, 22 nt, Human
guggcugguuuccugcaugcaa

SEQ ID NO: 136028 - RNA, 17 nt, Human
agcagcuggguugaucu

SEQ ID NO: 136029 - RNA, 22 nt, Human
uuguguggauaauauuacuuga

SEQ ID NO: 136030 - RNA, 22 nt, Human
ucucccacgguacaggauaaac

SEQ ID NO: 136031 - RNA, 20 nt, Human
accccagccccucuaucuga

SEQ ID NO: 136032 - RNA, 22 nt, Human
agagaacaaauuaaaggugguu

SEQ ID NO: 136033 - RNA, 22 nt, Human
aaucuucuuucuuaacaguaca

SEQ ID NO: 136034 - RNA, 19 nt, Human
ucuggagcugaugcaggug

SEQ ID NO: 136035 - RNA, 22 nt, Human
cuuccucacggugcaacaggaa

SEQ ID NO: 136036 - RNA, 22 nt, Human
cugcagaggguuugagcauccu

SEQ ID NO: 136037 - RNA, 22 nt, Human
ucaccgccuugcccggccgggc

SEQ ID NO: 136038 - RNA, 22 nt, Human
aguuacuugagacguuuaugaa

SEQ ID NO: 136039 - RNA, 22 nt, Human
ugcaggugcguuuucaagccuc

SEQ ID NO: 136040 - RNA, 22 nt, Human
aagggaaaucauauggugcagu

SEQ ID NO: 136041 - RNA, 22 nt, Human
uacagaaaucacaucgcuuuga

SEQ ID NO: 136042 - RNA, 22 nt, Human
uuacauuuggcuauguccucua

SEQ ID NO: 136043 - RNA, 22 nt, Human
augggguggaguccgggcagcg

SEQ ID NO: 136044 - RNA, 22 nt, Human
ucacuuauugcucaucucaugc

SEQ ID NO: 136045 - RNA, 22 nt, Human
cugaaggauguguggugggagu

SEQ ID NO: 136046 - RNA, 22 nt, Human
ggcagaagauaggacagggaau

SEQ ID NO: 136047 - RNA, 22 nt, Human
uggcagcugauuagauggugcc

SEQ ID NO: 136048 - RNA, 23 nt, Human
ccagccucugggucuucauccag

SEQ ID NO: 136049 - RNA, 22 nt, Human
uacagauauauagugugugccu

SEQ ID NO: 136050 - RNA, 22 nt, Human
auacagauguugaauguuauau

SEQ ID NO: 136051 - RNA, 22 nt, Human
gcaggagcuggaaagugauguu

SEQ ID NO: 136052 - RNA, 22 nt, Human
gcucccacugcagcccugagcc

SEQ ID NO: 136053 - RNA, 22 nt, Human
ucacgagaggcacagaauagag

SEQ ID NO: 136054 - RNA, 22 nt, Human
ccacagggauaggaauggggcu

SEQ ID NO: 136055 - RNA, 22 nt, Human
agggcuggcuccguuaccuuga

SEQ ID NO: 136056 - RNA, 22 nt, Human
caacuuuucugugaauuuaagu

SEQ ID NO: 136057 - RNA, 22 nt, Human
gcccagcuccucugcagacccu

SEQ ID NO: 136058 - RNA, 22 nt, Human
caggguccggcugccuggcugu

SEQ ID NO: 136059 - RNA, 20 nt, Human
cagagccaagagcagcaucu

SEQ ID NO: 136060 - RNA, 22 nt, Human
uggggugccgacagggagggca

SEQ ID NO: 136061 - RNA, 22 nt, Human
auuuucagagacaucuggacuu

SEQ ID NO: 136062 - RNA, 22 nt, Human
uacaagagguauauagaaacag

SEQ ID NO: 136063 - RNA, 22 nt, Human
gcuggcagaauuucuucuugcu

SEQ ID NO: 136064 - RNA, 22 nt, Human
cauucauuagaauagauaugua

SEQ ID NO: 136065 - RNA, 22 nt, Human
uggcucagcugucacagccugg

SEQ ID NO: 136066 - RNA, 22 nt, Human
cagugguggaaugaggaauugu

SEQ ID NO: 136067 - RNA, 22 nt, Human
cccagcaguuguuggugcacau

SEQ ID NO: 136068 - RNA, 22 nt, Human
gucaggauuuacaaacuucagu

SEQ ID NO: 136069 - RNA, 22 nt, Human
ucuccucucuuaccugguacaa

SEQ ID NO: 136070 - RNA, 22 nt, Human
aaggcaguacuuuauguccaua

SEQ ID NO: 136071 - RNA, 22 nt, Human
aaggcugcuuuuaacaugcaua

SEQ ID NO: 136072 - RNA, 22 nt, Human
ucugaggcuaagagacagaggc

SEQ ID NO: 136073 - RNA, 22 nt, Human
uaaguuuaaauguacaugaagc

SEQ ID NO: 136074 - RNA, 21 nt, Human
caguuauucuugaugugugug

SEQ ID NO: 136075 - RNA, 22 nt, Human
gggcaggaugcaguuucagaga

SEQ ID NO: 136076 - RNA, 22 nt, Human
uuagauaauguuauuguaauuu

SEQ ID NO: 136077 - RNA, 22 nt, Human
aaguucaagcucugccuaaaau

SEQ ID NO: 136078 - RNA, 22 nt, Human
cuggcucaauaaauauuagcug

SEQ ID NO: 136079 - RNA, 22 nt, Human
uacuguguggugagcugucucc

SEQ ID NO: 136080 - RNA, 23 nt, Human
cuuguuauaagaagacugucugg

SEQ ID NO: 136081 - RNA, 22 nt, Human
uuuuuaagcuccuuugauguca

SEQ ID NO: 136082 - RNA, 22 nt, Human
cagagguagccgagugcaaucg

SEQ ID NO: 136083 - RNA, 22 nt, Human
gugcucaggaagcuguuccugc

SEQ ID NO: 136084 - RNA, 21 nt, Human
uacagaaugcgcuucagucug

SEQ ID NO: 136085 - RNA, 22 nt, Human
ucucaggggccuggaguccugg

SEQ ID NO: 136086 - RNA, 22 nt, Human
uaaacauggauucugaucacag

SEQ ID NO: 136087 - RNA, 22 nt, Human
accaguaugugccuucaguguc

SEQ ID NO: 136088 - RNA, 22 nt, Human
auguguguguauauacacacau

SEQ ID NO: 136089 - RNA, 22 nt, Human
gccuucagcccugacuggccag

SEQ ID NO: 136090 - RNA, 22 nt, Human
uaguaaaaguuuaguugaaagu

SEQ ID NO: 136091 - RNA, 22 nt, Human
agggggugcuacuuccagaguu

SEQ ID NO: 136092 - RNA, 22 nt, Human
ggcaugggagugagcaaccuua

SEQ ID NO: 136093 - RNA, 22 nt, Human
ucucaggaauagaguggcagca

SEQ ID NO: 136094 - RNA, 22 nt, Human
gaggcaggcacuguuaucagca

SEQ ID NO: 136095 - RNA, 22 nt, Human
uuauucucaucucccuacuuag

SEQ ID NO: 136096 - RNA, 22 nt, Human
ugggcuggcccaccacaccucg

SEQ ID NO: 136097 - RNA, 20 nt, Human
gugggcagcaggcauacugg

SEQ ID NO: 136098 - RNA, 22 nt, Human
ugcauuaugcuugugcuguaua

SEQ ID NO: 136099 - RNA, 17 nt, Human
gcuuccugugcugggga

SEQ ID NO: 136100 - RNA, 22 nt, Human
uuaaaguucauuaaaugagcca

SEQ ID NO: 136101 - RNA, 22 nt, Human
gcuuccucgcugggcagaggca

SEQ ID NO: 136102 - RNA, 22 nt, Human
ggcggggguccaggagccugca

SEQ ID NO: 136103 - RNA, 22 nt, Human
uagcugugagcacccaggcugu

SEQ ID NO: 136104 - RNA, 22 nt, Human
acucugaggcaggucagggcag

SEQ ID NO: 136105 - RNA, 22 nt, Human
caggacaguuugcuuugcccug

SEQ ID NO: 136106 - RNA, 22 nt, Human
uggcucagagcagggacucugg

SEQ ID NO: 136107 - RNA, 20 nt, Human
auuccauaguuggcacuuuu

SEQ ID NO: 136108 - RNA, 22 nt, Human
agauuucaauggauauugcaag

SEQ ID NO: 136109 - RNA, 22 nt, Human
uccuugaagcuuguaucuaaua

SEQ ID NO: 136110 - RNA, 22 nt, Human
gggcugugugcccacuucccau

SEQ ID NO: 136111 - RNA, 17 nt, Human
agguggguggaucaccu

SEQ ID NO: 136112 - RNA, 22 nt, Human
agaacagaagggaggaaggccu

SEQ ID NO: 136113 - RNA, 22 nt, Human
uaugagaaaauaaauaucuguu

SEQ ID NO: 136114 - RNA, 22 nt, Human
ucucagagugacaaugagaauu

SEQ ID NO: 136115 - RNA, 22 nt, Human
ucugcuguuuacugugugauau

SEQ ID NO: 136116 - RNA, 22 nt, Human
cuucugugcuucacaguugcca

SEQ ID NO: 136117 - RNA, 22 nt, Human
cagggugcgccacucagaugua

SEQ ID NO: 136118 - RNA, 22 nt, Human
uguggcauacacaugagguggu

SEQ ID NO: 136119 - RNA, 19 nt, Human
auagaaaggguuaaagaca

SEQ ID NO: 136120 - RNA, 22 nt, Human
uuucucuccuccaaaccaaaga

SEQ ID NO: 136121 - RNA, 22 nt, Human
gggcagugguccaggcuacagc

SEQ ID NO: 136122 - RNA, 22 nt, Human
cccagcaggucggugcugccug

SEQ ID NO: 136123 - RNA, 22 nt, Human
ugcuguguuaaauacaagcaug

SEQ ID NO: 136124 - RNA, 22 nt, Human
ccugagagcagcuuccugcuua

SEQ ID NO: 136125 - RNA, 22 nt, Human
caaauguauaaauguacuuucu

SEQ ID NO: 136126 - RNA, 22 nt, Human
ugcuguguggaugugaagaauc

SEQ ID NO: 136127 - RNA, 22 nt, Human
agagccaggcggcugggcaccu

SEQ ID NO: 136128 - RNA, 22 nt, Human
gucccugcaucaccacgggacu

SEQ ID NO: 136129 - RNA, 22 nt, Human
cccuggcaugcaugucccuggc

SEQ ID NO: 136130 - RNA, 22 nt, Human
uguggaaaauuggaacguuccu

SEQ ID NO: 136131 - RNA, 22 nt, Human
guggagaccuccuaggaugugu

SEQ ID NO: 136132 - RNA, 22 nt, Human
ggggugggguuacucauugugc

SEQ ID NO: 136133 - RNA, 22 nt, Human
uucugcuguaguugcaucuguu

SEQ ID NO: 136134 - RNA, 22 nt, Human
ugggcagaaaucaguaucagau

SEQ ID NO: 136135 - RNA, 22 nt, Human
ucuuuacaucacaauuguaugg

SEQ ID NO: 136136 - RNA, 22 nt, Human
cugucucugucuuaacucccag

SEQ ID NO: 136137 - RNA, 22 nt, Human
ccacaaguuucagcacccagag

SEQ ID NO: 136138 - RNA, 20 nt, Human
aggagccauugacugcagca

SEQ ID NO: 136139 - RNA, 22 nt, Human
uccuucagucuucugagccaua

SEQ ID NO: 136140 - RNA, 22 nt, Human
ugggggucaggaugaggccuug

SEQ ID NO: 136141 - RNA, 22 nt, Human
augcuauacucaaagaaauuca

SEQ ID NO: 136142 - RNA, 22 nt, Human
uagaaacacagaucugguguca

SEQ ID NO: 136143 - RNA, 22 nt, Human
gcaggagugacauggaugugga

SEQ ID NO: 136144 - RNA, 22 nt, Human
uaagaagcuucugcuaaugccu

SEQ ID NO: 136145 - RNA, 22 nt, Human
cuguggcuucagcauucagagc

SEQ ID NO: 136146 - RNA, 22 nt, Human
uucucuuuugugaugugagaug

SEQ ID NO: 136147 - RNA, 20 nt, Human
uaugaagauaugugaacagc

SEQ ID NO: 136148 - RNA, 22 nt, Human
uguaugcaccauuguauuaccu

SEQ ID NO: 136149 - RNA, 22 nt, Human
ugcagaggaccauuguccugga

SEQ ID NO: 136150 - RNA, 22 nt, Human
ucugugaacaucacauugacag

SEQ ID NO: 136151 - RNA, 22 nt, Human
cagagcuggagcuugaauggag

SEQ ID NO: 136152 - RNA, 22 nt, Human
ucuguguguugucaggaggauu

SEQ ID NO: 136153 - RNA, 22 nt, Human
aucagcaaaaaugccuucagaa

SEQ ID NO: 136154 - RNA, 22 nt, Human
gcaggagcugcucuccugacga

SEQ ID NO: 136155 - RNA, 22 nt, Human
ccuuuccuuuuuagugugggag

SEQ ID NO: 136156 - RNA, 22 nt, Human
ccagggcuggguuugucggugu

SEQ ID NO: 136157 - RNA, 22 nt, Human
caggggaagaugccaagggaga

SEQ ID NO: 136158 - RNA, 22 nt, Human
ccugcagaccacacucaguccu

SEQ ID NO: 136159 - RNA, 22 nt, Human
ucugucccugagagcucaggag

SEQ ID NO: 136160 - RNA, 22 nt, Human
cuuacauugugugcaugagggg

SEQ ID NO: 136161 - RNA, 22 nt, Human
uccuggagcuuccuucauggua

SEQ ID NO: 136162 - RNA, 22 nt, Human
ugcuugggaauguggagucaga

SEQ ID NO: 136163 - RNA, 22 nt, Human
acccacgaagaugagcggcaug

SEQ ID NO: 136164 - RNA, 22 nt, Human
cuguuuucaaagagagagaaug

SEQ ID NO: 136165 - RNA, 22 nt, Human
ugauuuccaugaagcugaaggc

SEQ ID NO: 136166 - RNA, 22 nt, Human
auccaaaccuggacaugagugg

SEQ ID NO: 136167 - RNA, 22 nt, Human
ccugagagcauuccacacugaa

SEQ ID NO: 136168 - RNA, 22 nt, Human
aucaggauccaccuugagccug

SEQ ID NO: 136169 - RNA, 22 nt, Human
ugcucucucaggccuggcccac

SEQ ID NO: 136170 - RNA, 22 nt, Human
aggaccagccuccaggucucuu

SEQ ID NO: 136171 - RNA, 22 nt, Human
uauugaaauccauuacguucuu

SEQ ID NO: 136172 - RNA, 22 nt, Human
uuugcacuagcauuuguccaug

SEQ ID NO: 136173 - RNA, 20 nt, Human
uugauaggcagcuugucagg

SEQ ID NO: 136174 - RNA, 22 nt, Human
ucacugcaaggaggcuucucaa

SEQ ID NO: 136175 - RNA, 20 nt, Human
agaggcuuccuugggaggag

SEQ ID NO: 136176 - RNA, 22 nt, Human
ggagacagugacuuagagacug

SEQ ID NO: 136177 - RNA, 20 nt, Human
uccagcugggaacagcugau

SEQ ID NO: 136178 - RNA, 22 nt, Human
uucuguguggguagcuccuguu

SEQ ID NO: 136179 - RNA, 22 nt, Human
uuguuuucuccacugcaucuua

SEQ ID NO: 136180 - RNA, 22 nt, Human
guccucagucaguuuggugggg

SEQ ID NO: 136181 - RNA, 22 nt, Human
caggcacucauucagagaggug

SEQ ID NO: 136182 - RNA, 22 nt, Human
cagcugccugucuggaggcaau

SEQ ID NO: 136183 - RNA, 22 nt, Human
uggcugaguaaguugugauaug

SEQ ID NO: 136184 - RNA, 22 nt, Human
ugcugguggagaaaguggaggu

SEQ ID NO: 136185 - RNA, 22 nt, Human
aguuuuuccguggcuacgauaa

SEQ ID NO: 136186 - RNA, 22 nt, Human
auuaaauuggacgcugggggaa

SEQ ID NO: 136187 - RNA, 22 nt, Human
ggccugugucugugccuguccu

SEQ ID NO: 136188 - RNA, 22 nt, Human
aagaguuaagcaacagauacca

SEQ ID NO: 136189 - RNA, 22 nt, Human
cugggcagaauuuuaggauggc

SEQ ID NO: 136190 - RNA, 22 nt, Human
ccagcgcuucccaucagggagg

SEQ ID NO: 136191 - RNA, 22 nt, Human
uuuuauagcugaauaguauucc

SEQ ID NO: 136192 - RNA, 22 nt, Human
gcucccagcauugcugcugaau

SEQ ID NO: 136193 - RNA, 22 nt, Human
gcucucuguuauuaagaucuuu

SEQ ID NO: 136194 - RNA, 22 nt, Human
aagccaggggcugcuuaggaga

SEQ ID NO: 136195 - RNA, 22 nt, Human
agccugucugucuccaaagcug

SEQ ID NO: 136196 - RNA, 22 nt, Human
agguacagcaauauaagagguc

SEQ ID NO: 136197 - RNA, 22 nt, Human
ucacagacauggugagguaaca

SEQ ID NO: 136198 - RNA, 22 nt, Human
ugggcuggcugaggcauucacu

SEQ ID NO: 136199 - RNA, 22 nt, Human
agguacagaugaaagucuaguu

SEQ ID NO: 136200 - RNA, 22 nt, Human
augcagcuucaggauuaugaug

SEQ ID NO: 136201 - RNA, 22 nt, Human
guggccagcaagugcugccucu

SEQ ID NO: 136202 - RNA, 22 nt, Human
cagaaagaccugggcucaagag

SEQ ID NO: 136203 - RNA, 22 nt, Human
uagcagggaaggugugcugagc

SEQ ID NO: 136204 - RNA, 22 nt, Human
augugugugcauuucucucccu

SEQ ID NO: 136205 - RNA, 21 nt, Human
cucaaagaccaaaaguguaga

SEQ ID NO: 136206 - RNA, 19 nt, Human
augagcuggcauuucaggu

SEQ ID NO: 136207 - RNA, 22 nt, Human
uuuccucugagugagcugggag

SEQ ID NO: 136208 - RNA, 18 nt, Human
uccagagcuacuguggug

SEQ ID NO: 136209 - RNA, 22 nt, Human
uggugcugauaauggcaggauu

SEQ ID NO: 136210 - RNA, 22 nt, Human
uacaaagugagcaaccucuuuu

SEQ ID NO: 136211 - RNA, 22 nt, Human
ugugucagaaggcaauggggau

SEQ ID NO: 136212 - RNA, 23 nt, Human
aagcugccagucugaagccuggg

SEQ ID NO: 136213 - RNA, 22 nt, Human
gguggccaggccagcucuggcc

SEQ ID NO: 136214 - RNA, 22 nt, Human
caggauggagggagggcuguua

SEQ ID NO: 136215 - RNA, 22 nt, Human
uguaggauuuucaccagaccuu

SEQ ID NO: 136216 - RNA, 22 nt, Human
uggccuuggacagagcgcuccu

SEQ ID NO: 136217 - RNA, 22 nt, Human
guuuucucaucuccucaauggu

SEQ ID NO: 136218 - RNA, 22 nt, Human
ucacaguaaaagcauggaagag

SEQ ID NO: 136219 - RNA, 22 nt, Human
gugccugugccaggggugugcu

SEQ ID NO: 136220 - RNA, 22 nt, Human
ugagccuggcggaagcagcgug

SEQ ID NO: 136221 - RNA, 22 nt, Human
gcaggagccacuucagggaugc

SEQ ID NO: 136222 - RNA, 22 nt, Human
acuucuggugucauacugcauu

SEQ ID NO: 136223 - RNA, 19 nt, Human
agaggcugucaccuguagc

SEQ ID NO: 136224 - RNA, 22 nt, Human
acaagcaugggcuuugacauca

SEQ ID NO: 136225 - RNA, 22 nt, Human
agacagcaugauacaugaugcu

SEQ ID NO: 136226 - RNA, 22 nt, Human
ccuggagcuuuuccauccugga

SEQ ID NO: 136227 - RNA, 22 nt, Human
ccagcccugccucucagggccc

SEQ ID NO: 136228 - RNA, 22 nt, Human
caguggagagacuuuuacucuu

SEQ ID NO: 136229 - RNA, 22 nt, Human
guggcugcagcggcuguggaga

SEQ ID NO: 136230 - RNA, 22 nt, Human
aacagcagggggaccugcuggu

SEQ ID NO: 136231 - RNA, 22 nt, Human
ucuguccucuuugaagcugcuc

SEQ ID NO: 136232 - RNA, 22 nt, Human
cagggcaggaugcugugauuau

SEQ ID NO: 136233 - RNA, 22 nt, Human
uuccucaugggguuccuucaga

SEQ ID NO: 136234 - RNA, 19 nt, Human
aagggcugggcaccucacu

SEQ ID NO: 136235 - RNA, 22 nt, Human
uuggccuuaaccucucugugcc

SEQ ID NO: 136236 - RNA, 23 nt, Human
auucuucauuaucuucuagaaaa

SEQ ID NO: 136237 - RNA, 22 nt, Human
cuccaggccauggcugcggagg

SEQ ID NO: 136238 - RNA, 22 nt, Human
cacucugagaaguacaagcucc

SEQ ID NO: 136239 - RNA, 22 nt, Human
ccaaggcuccucagcuggucuu

SEQ ID NO: 136240 - RNA, 22 nt, Human
ucccagaggcaguugguaacuu

SEQ ID NO: 136241 - RNA, 22 nt, Human
gacacagagauaggccuguguu

SEQ ID NO: 136242 - RNA, 22 nt, Human
uggccuggggaccugugagacc

SEQ ID NO: 136243 - RNA, 22 nt, Human
uccauuuuguagguaugcuaca

SEQ ID NO: 136244 - RNA, 19 nt, Human
cagcaauaaugccagaugg

SEQ ID NO: 136245 - RNA, 22 nt, Human
gcaagcuggcuguuagaggaug

SEQ ID NO: 136246 - RNA, 22 nt, Human
cagaggaggccaccgcauaggc

SEQ ID NO: 136247 - RNA, 22 nt, Human
auuucuuuucaagagggugcuu

SEQ ID NO: 136248 - RNA, 22 nt, Human
aggcacugcagauuacaggcgc

SEQ ID NO: 136249 - RNA, 22 nt, Human
gcucuccaaacccuguggcuuu

SEQ ID NO: 136250 - RNA, 22 nt, Human
gcugccuuuuaaagccucgcuu

SEQ ID NO: 136251 - RNA, 22 nt, Human
augaagucuagcaagcauugaa

SEQ ID NO: 136252 - RNA, 22 nt, Human
ugagccugcugucgcuggaccc

SEQ ID NO: 136253 - RNA, 21 nt, Human
acagacagggccagugucccc

SEQ ID NO: 136254 - RNA, 23 nt, Human
ccacagagcugccaauuccugug

SEQ ID NO: 136255 - RNA, 22 nt, Human
cucaggaugcaauuccaucaag

SEQ ID NO: 136256 - RNA, 19 nt, Human
uccuccuuacuuccucuug

SEQ ID NO: 136257 - RNA, 19 nt, Human
auuccucaaggacagaaau

SEQ ID NO: 136258 - RNA, 22 nt, Human
agagccugcuguguaagucaca

SEQ ID NO: 136259 - RNA, 21 nt, Human
agcagaacagucgagcacugc

SEQ ID NO: 136260 - RNA, 22 nt, Human
ucuucuacuauaauaauuuucu

SEQ ID NO: 136261 - RNA, 22 nt, Human
gaggccugguagccgagcccca

SEQ ID NO: 136262 - RNA, 22 nt, Human
uauaauccauucauugauuucu

SEQ ID NO: 136263 - RNA, 22 nt, Human
agccuggccacucagggccuga

SEQ ID NO: 136264 - RNA, 22 nt, Human
cugagguggaacagaggugaag

SEQ ID NO: 136265 - RNA, 22 nt, Human
uucaggaugacaccauguccag

SEQ ID NO: 136266 - RNA, 20 nt, Human
ugggcagcacugcuggcugg

SEQ ID NO: 136267 - RNA, 22 nt, Human
agccuggaagaaccugaagucu

SEQ ID NO: 136268 - RNA, 22 nt, Human
ucucagggcagcaaggaagcau

SEQ ID NO: 136269 - RNA, 22 nt, Human
ucucuggccgagagucccuggg

SEQ ID NO: 136270 - RNA, 21 nt, Human
auggagccuaagaguggaggu

SEQ ID NO: 136271 - RNA, 22 nt, Human
cacuggggaaaacaggcuucuu

SEQ ID NO: 136272 - RNA, 19 nt, Human
ugucucugaaagaugagcu

SEQ ID NO: 136273 - RNA, 20 nt, Human
agcccuguuuccuggagaga

SEQ ID NO: 136274 - RNA, 22 nt, Human
ccagcugguguuccuuaggacc

SEQ ID NO: 136275 - RNA, 22 nt, Human
aauaugcauguauacaugugua

SEQ ID NO: 136276 - RNA, 22 nt, Human
ucccaagugucuuggaccaggg

SEQ ID NO: 136277 - RNA, 22 nt, Human
ugugugcuuauagucuaguagu

SEQ ID NO: 136278 - RNA, 22 nt, Human
uagccgcuuaauuauuugguga

SEQ ID NO: 136279 - RNA, 20 nt, Human
ugcucugucuaaaacuuccc

SEQ ID NO: 136280 - RNA, 18 nt, Human
aaaugcuaggcuacauga

SEQ ID NO: 136281 - RNA, 22 nt, Human
cagaggcuguguaggcagacug

SEQ ID NO: 136282 - RNA, 22 nt, Human
ucaaagucauggcaggcucaga

SEQ ID NO: 136283 - RNA, 22 nt, Human
ucuucuuuggaugaaagaauau

SEQ ID NO: 136284 - RNA, 22 nt, Human
uuccuguccgcaauggccuggg

SEQ ID NO: 136285 - RNA, 22 nt, Human
auaaagauuucuuuuucucuac

SEQ ID NO: 136286 - RNA, 23 nt, Human
cugcagucgccggccugggugcc

SEQ ID NO: 136287 - RNA, 22 nt, Human
acccugggcuuggccugcucag

SEQ ID NO: 136288 - RNA, 22 nt, Human
ccagcaugagacgaugaugaag

SEQ ID NO: 136289 - RNA, 19 nt, Human
ccugugugggguagagauc

SEQ ID NO: 136290 - RNA, 22 nt, Human
caggauauaucucuaguguugg

SEQ ID NO: 136291 - RNA, 22 nt, Human
agauggggcucaguguggaggc

SEQ ID NO: 136292 - RNA, 22 nt, Human
acuucaugcagaagagagcugu

SEQ ID NO: 136293 - RNA, 22 nt, Human
ucaggaugagcucauaacuaug

SEQ ID NO: 136294 - RNA, 21 nt, Human
ucugucucuccacugcccugc

SEQ ID NO: 136295 - RNA, 21 nt, Human
agggagcuauuuauaguaagc

SEQ ID NO: 136296 - RNA, 22 nt, Human
uucaagauaauaggaaugaaaa

SEQ ID NO: 136297 - RNA, 23 nt, Human
aguggcuggacagacuuuccugg

SEQ ID NO: 136298 - RNA, 22 nt, Human
auuuguaauuucuuaucugugu

SEQ ID NO: 136299 - RNA, 22 nt, Human
caguaaaugugauuuuucuugu

SEQ ID NO: 136300 - RNA, 23 nt, Human
gagugcagaauagacaugcagug

SEQ ID NO: 136301 - RNA, 22 nt, Human
uuucacauuuuauacuuaagcc

SEQ ID NO: 136302 - RNA, 22 nt, Human
agaaugcuccagagcugaaaga

SEQ ID NO: 136303 - RNA, 22 nt, Human
gccucugcaacuccgccuuggu

SEQ ID NO: 136304 - RNA, 22 nt, Human
agcucugggccaggaacccuaa

SEQ ID NO: 136305 - RNA, 19 nt, Human
auuuacugccuaaaaucuc

SEQ ID NO: 136306 - RNA, 22 nt, Human
ccuggcugcauuuugcuggaug

SEQ ID NO: 136307 - RNA, 22 nt, Human
agaagccauguuuaguaggaug

SEQ ID NO: 136308 - RNA, 22 nt, Human
ccacugucuuuuccaggcugaa

SEQ ID NO: 136309 - RNA, 22 nt, Human
aucagugcuaaagcaaaugccc

SEQ ID NO: 136310 - RNA, 22 nt, Human
uucuuuccccauggaguucgga

SEQ ID NO: 136311 - RNA, 22 nt, Human
uccagggaugccagccauguug

SEQ ID NO: 136312 - RNA, 22 nt, Human
ggucaggggcugcucuacagag

SEQ ID NO: 136313 - RNA, 22 nt, Human
uugaaaggugaacaugaugcac

SEQ ID NO: 136314 - RNA, 22 nt, Human
auucuagaugcuguaaguagca

SEQ ID NO: 136315 - RNA, 22 nt, Human
aacauacagugagcaguggacu

SEQ ID NO: 136316 - RNA, 22 nt, Human
agauguuccagccaaugggaau

SEQ ID NO: 136317 - RNA, 22 nt, Human
agagacaggguuuugucguguu

SEQ ID NO: 136318 - RNA, 22 nt, Human
ucuuuaucaagucuguucuuug

SEQ ID NO: 136319 - RNA, 22 nt, Human
auaagagcuagucuuuuccuug

SEQ ID NO: 136320 - RNA, 22 nt, Human
gggccacauugaagggugggua

SEQ ID NO: 136321 - RNA, 22 nt, Human
ucuuugcaacucccauuuccau

SEQ ID NO: 136322 - RNA, 22 nt, Human
aagauuucuuacuuauugaugc

SEQ ID NO: 136323 - RNA, 22 nt, Human
uaugcauaugaccccaagcuug

SEQ ID NO: 136324 - RNA, 22 nt, Human
gacaucauagggugggaggaaa

SEQ ID NO: 136325 - RNA, 22 nt, Human
auacacauauguguguauaugu

SEQ ID NO: 136326 - RNA, 22 nt, Human
uaccugagcccagugcagcaua

SEQ ID NO: 136327 - RNA, 22 nt, Human
gagggauggugugagaggcuca

SEQ ID NO: 136328 - RNA, 22 nt, Human
uuuucuguaagaggacuuuaau

SEQ ID NO: 136329 - RNA, 20 nt, Human
ggcagagcuaugucuguugc

SEQ ID NO: 136330 - RNA, 22 nt, Human
gccuggagcccaguguggggcu

SEQ ID NO: 136331 - RNA, 22 nt, Human
auacauacauguaugcacauac

SEQ ID NO: 136332 - RNA, 22 nt, Human
aaggagucucagcugggccuga

SEQ ID NO: 136333 - RNA, 22 nt, Human
uucuuauuaugugcucugugaa

SEQ ID NO: 136334 - RNA, 22 nt, Human
caagagcuuuagaaaugcucau

SEQ ID NO: 136335 - RNA, 22 nt, Human
gcagcuggcccugacacgcaga

SEQ ID NO: 136336 - RNA, 22 nt, Human
aggcuccaugcaaaggcuguuu

SEQ ID NO: 136337 - RNA, 22 nt, Human
uucucuuucugcugggcuggaa

SEQ ID NO: 136338 - RNA, 22 nt, Human
uagagcuggaaaacugcaggua

SEQ ID NO: 136339 - RNA, 22 nt, Human
gagccugaauuugaccugcuua

SEQ ID NO: 136340 - RNA, 22 nt, Human
ugcauuaucuuuaauguucuca

SEQ ID NO: 136341 - RNA, 22 nt, Human
ggccuugggaggagggucagaa

SEQ ID NO: 136342 - RNA, 22 nt, Human
ucacugcugcugccaugaugga

SEQ ID NO: 136343 - RNA, 22 nt, Human
cuuaacagagagaaguguugcu

SEQ ID NO: 136344 - RNA, 18 nt, Human
cggcagagugcuucuagc

SEQ ID NO: 136345 - RNA, 22 nt, Human
uacacacaugcauuugccuuau

SEQ ID NO: 136346 - RNA, 22 nt, Human
guaucuuuugguggaaaaauaa

SEQ ID NO: 136347 - RNA, 18 nt, Human
aggcacagagcauacaua

SEQ ID NO: 136348 - RNA, 22 nt, Human
uuacacuuggguguggauuuua

SEQ ID NO: 136349 - RNA, 22 nt, Human
agggauggaagcucgucugcaa

SEQ ID NO: 136350 - RNA, 23 nt, Human
ucaugcccaggcuccagauguca

SEQ ID NO: 136351 - RNA, 22 nt, Human
cacccagccuucacacaggagu

SEQ ID NO: 136352 - RNA, 22 nt, Human
ugaaggaagaauaggcaguguu

SEQ ID NO: 136353 - RNA, 22 nt, Human
gaauacaugauacaugaacugc

SEQ ID NO: 136354 - RNA, 22 nt, Human
auuuuuaugacaaaccauccuc

SEQ ID NO: 136355 - RNA, 22 nt, Human
ucagcugagcuccagcucauag

SEQ ID NO: 136356 - RNA, 22 nt, Human
caaggccacuccagagacuggu

SEQ ID NO: 136357 - RNA, 22 nt, Human
aggcugggaagguaaaguugua

SEQ ID NO: 136358 - RNA, 22 nt, Human
cugucuguacaaauguggggcc

SEQ ID NO: 136359 - RNA, 22 nt, Human
gugugccucccauuagggugua

SEQ ID NO: 136360 - RNA, 22 nt, Human
auucuguauggaaaagcacuau

SEQ ID NO: 136361 - RNA, 22 nt, Human
aaggcagcagugcacgacugau

SEQ ID NO: 136362 - RNA, 22 nt, Human
aggaagccaugguggacgucua

SEQ ID NO: 136363 - RNA, 22 nt, Human
uguggcuuaagaaugccuuuaa

SEQ ID NO: 136364 - RNA, 22 nt, Human
cacagguguaugaauaugucca

SEQ ID NO: 136365 - RNA, 22 nt, Human
ggauguugauugaauggccauu

SEQ ID NO: 136366 - RNA, 22 nt, Human
gcaggguccauggaggcagccc

SEQ ID NO: 136367 - RNA, 23 nt, Human
gucagggcuggggucagagugac

SEQ ID NO: 136368 - RNA, 22 nt, Human
gugauugcccagcaccauuguu

SEQ ID NO: 136369 - RNA, 22 nt, Human
gggaucagaaacauagcccuga

SEQ ID NO: 136370 - RNA, 22 nt, Human
ggcccagcacagugcuuggggg

SEQ ID NO: 136371 - RNA, 22 nt, Human
gaacagaagaggcuggugccac

SEQ ID NO: 136372 - RNA, 22 nt, Human
aauguacaauaagacaaagagg

SEQ ID NO: 136373 - RNA, 22 nt, Human
uggguagagacacagucugggg

SEQ ID NO: 136374 - RNA, 22 nt, Human
uguuugaacugaauaacauagu

SEQ ID NO: 136375 - RNA, 22 nt, Human
gccucccuggcccacagcagcg

SEQ ID NO: 136376 - RNA, 22 nt, Human
gcaaaaaaugcuuguugcuuag

SEQ ID NO: 136377 - RNA, 18 nt, Human
uguguaugucucagggaa

SEQ ID NO: 136378 - RNA, 20 nt, Human
caguagcaauaauuagaagc

SEQ ID NO: 136379 - RNA, 22 nt, Human
gagccuggccuccugccucagc

SEQ ID NO: 136380 - RNA, 22 nt, Human
cuguggcucuccaauggaggga

SEQ ID NO: 136381 - RNA, 22 nt, Human
ucugucuccucugaggugccag

SEQ ID NO: 136382 - RNA, 18 nt, Human
aaggcuucaaagaguaga

SEQ ID NO: 136383 - RNA, 22 nt, Human
cucccucugucuuguccagaaa

SEQ ID NO: 136384 - RNA, 22 nt, Human
uucaggaucacuaaacccucca

SEQ ID NO: 136385 - RNA, 22 nt, Human
ccaggguggcguagaugcuggg

SEQ ID NO: 136386 - RNA, 22 nt, Human
uuguuauaaagacuaaauaugu

SEQ ID NO: 136387 - RNA, 22 nt, Human
ccacccugagccgcaagagcag

SEQ ID NO: 136388 - RNA, 22 nt, Human
ucugggugccacugucuguaca

SEQ ID NO: 136389 - RNA, 22 nt, Human
agggcagagauuaauuaagaca

SEQ ID NO: 136390 - RNA, 22 nt, Human
uauuugaaaguguacaaaaacu

SEQ ID NO: 136391 - RNA, 22 nt, Human
gcugucugggaugucacugcug

SEQ ID NO: 136392 - RNA, 22 nt, Human
gaaggagagagacaucgucccu

SEQ ID NO: 136393 - RNA, 22 nt, Human
uaguauaugucuaugguuguag

SEQ ID NO: 136394 - RNA, 22 nt, Human
aaugcauauguaggcaagcagu

SEQ ID NO: 136395 - RNA, 22 nt, Human
aggacaggauugagcugaacug

SEQ ID NO: 136396 - RNA, 22 nt, Human
ccaggaguuggagguugcagug

SEQ ID NO: 136397 - RNA, 21 nt, Human
accagcaggagaucagaagga

SEQ ID NO: 136398 - RNA, 22 nt, Human
gcugcccucccagggcaagcuu

SEQ ID NO: 136399 - RNA, 22 nt, Human
ggggaugguagaccggugacgu

SEQ ID NO: 136400 - RNA, 22 nt, Human
ucaucacuguaucauugauaga

SEQ ID NO: 136401 - RNA, 22 nt, Human
uucaagaugcacaguggcauuc

SEQ ID NO: 136402 - RNA, 22 nt, Human
uuccaggaauucagcucucagu

SEQ ID NO: 136403 - RNA, 22 nt, Human
cagaggccccagaacuagcucu

SEQ ID NO: 136404 - RNA, 22 nt, Human
ucugugcucuucucaguaucac

SEQ ID NO: 136405 - RNA, 22 nt, Human
aguuuucugaccccugcucuau

SEQ ID NO: 136406 - RNA, 22 nt, Human
ugucccagcacuuugggagucu

SEQ ID NO: 136407 - RNA, 22 nt, Human
ccacuguuuuucaguuaacuuu

SEQ ID NO: 136408 - RNA, 22 nt, Human
gccugucugcagggcugucauu

SEQ ID NO: 136409 - RNA, 21 nt, Human
agcagcugggcaacauggagg

SEQ ID NO: 136410 - RNA, 18 nt, Human
auggucucauacugggag

SEQ ID NO: 136411 - RNA, 22 nt, Human
ugucucugcuuuccuugcaggg

SEQ ID NO: 136412 - RNA, 22 nt, Human
gugucccaggagaggagacaau

SEQ ID NO: 136413 - RNA, 20 nt, Human
gucugaggagcagugggaaa

SEQ ID NO: 136414 - RNA, 22 nt, Human
cagcaggauuggauacaucuca

SEQ ID NO: 136415 - RNA, 22 nt, Human
ugaacagauggcccagcagagg

SEQ ID NO: 136416 - RNA, 22 nt, Human
aaaguuugcaauuuauguuaau

SEQ ID NO: 136417 - RNA, 22 nt, Human
ggccaugguuggggaagacaug

SEQ ID NO: 136418 - RNA, 22 nt, Human
ugggccuggguuccuccugggc

SEQ ID NO: 136419 - RNA, 22 nt, Human
gaagccaacauuccaaguagaa

SEQ ID NO: 136420 - RNA, 22 nt, Human
gcccauggcagaacugugagca

SEQ ID NO: 136421 - RNA, 22 nt, Human
auggcuguguuguuccucugaa

SEQ ID NO: 136422 - RNA, 22 nt, Human
cauuucugcagaauugcucuuc

SEQ ID NO: 136423 - RNA, 22 nt, Human
ucuugacauucaaucauguaua

SEQ ID NO: 136424 - RNA, 22 nt, Human
aauuuccagaucagaugacuca

SEQ ID NO: 136425 - RNA, 21 nt, Human
ccaggcagagcugugaguucu

SEQ ID NO: 136426 - RNA, 22 nt, Human
ucuggcucauaggaaggccauu

SEQ ID NO: 136427 - RNA, 21 nt, Human
ggcagaaguagcauggacggg

SEQ ID NO: 136428 - RNA, 22 nt, Human
uacuuuuuaugauaagaacuga

SEQ ID NO: 136429 - RNA, 22 nt, Human
caguacuuguccucagguguua

SEQ ID NO: 136430 - RNA, 22 nt, Human
guguuguggagcuugucagggg

SEQ ID NO: 136431 - RNA, 22 nt, Human
ucucagagauucagggagaagu

SEQ ID NO: 136432 - RNA, 22 nt, Human
guccacauaggaacccagcuuc

SEQ ID NO: 136433 - RNA, 22 nt, Human
uggccugggcaugaagcaucgu

SEQ ID NO: 136434 - RNA, 22 nt, Human
cugccagcaaugugaccaugcu

SEQ ID NO: 136435 - RNA, 22 nt, Human
gccagccugugggggcucugug

SEQ ID NO: 136436 - RNA, 22 nt, Human
gaggcagaaguugcagugagca

SEQ ID NO: 136437 - RNA, 22 nt, Human
uucaggauaugugauaucugaa

SEQ ID NO: 136438 - RNA, 22 nt, Human
aauuucucaauuguuacaggug

SEQ ID NO: 136439 - RNA, 20 nt, Human
agucccagaucaaauuucug

SEQ ID NO: 136440 - RNA, 22 nt, Human
cccauuuagauaacaguucaaa

SEQ ID NO: 136441 - RNA, 22 nt, Human
uuucaaagaccauuaacuauca

SEQ ID NO: 136442 - RNA, 22 nt, Human
aauaucaguauauuguaucagu

SEQ ID NO: 136443 - RNA, 22 nt, Human
uacaaaugaguuguaugaacca

SEQ ID NO: 136444 - RNA, 22 nt, Human
augcaguacugauacaugccac

SEQ ID NO: 136445 - RNA, 22 nt, Human
uggcugggagcuggaacugggc

SEQ ID NO: 136446 - RNA, 21 nt, Human
uucuucaguuuaauauaaaau

SEQ ID NO: 136447 - RNA, 22 nt, Human
gcacagggcugccaggcggcuu

SEQ ID NO: 136448 - RNA, 22 nt, Human
ugcuggcuggccuggccuggac

SEQ ID NO: 136449 - RNA, 22 nt, Human
ugcuuccuugagcucuccaauc

SEQ ID NO: 136450 - RNA, 22 nt, Human
uucuuacagcccuauuacuaaa

SEQ ID NO: 136451 - RNA, 22 nt, Human
ggcuccuguggcaagacagcuu

SEQ ID NO: 136452 - RNA, 22 nt, Human
ugccuucaaucaggauggucuc

SEQ ID NO: 136453 - RNA, 22 nt, Human
agaugaaaagauaagcagcaau

SEQ ID NO: 136454 - RNA, 22 nt, Human
uucauguauuuaucauguaaau

SEQ ID NO: 136455 - RNA, 22 nt, Human
uuagccauuaauguccugugca

SEQ ID NO: 136456 - RNA, 22 nt, Human
cuggugcuggagccuagucccu

SEQ ID NO: 136457 - RNA, 19 nt, Human
ggugaccaccuggucagug

SEQ ID NO: 136458 - RNA, 22 nt, Human
cuccuuccugguuagcaccuua

SEQ ID NO: 136459 - RNA, 22 nt, Human
auucuaggcuugaaacaugaag

SEQ ID NO: 136460 - RNA, 22 nt, Human
aucaaaguaggcauauguuuuu

SEQ ID NO: 136461 - RNA, 22 nt, Human
cuuccuucugaagcauagaagc

SEQ ID NO: 136462 - RNA, 21 nt, Human
uggccucccacacuuccaugg

SEQ ID NO: 136463 - RNA, 22 nt, Human
cacauuuaaagguugaagcuga

SEQ ID NO: 136464 - RNA, 22 nt, Human
caaugguggugucagaagagau

SEQ ID NO: 136465 - RNA, 22 nt, Human
uucagaaagugaaucuuguuau

SEQ ID NO: 136466 - RNA, 22 nt, Human
acauguguauagccuguauaga

SEQ ID NO: 136467 - RNA, 22 nt, Human
gaggcccuccagcugucagcug

SEQ ID NO: 136468 - RNA, 22 nt, Human
aaugauguauuaguacaacaca

SEQ ID NO: 136469 - RNA, 22 nt, Human
cugugcuuaccugcccagguga

SEQ ID NO: 136470 - RNA, 22 nt, Human
aagaugauagaucugucaaugu

SEQ ID NO: 136471 - RNA, 22 nt, Human
uguuacagaaauauugcuucuu

SEQ ID NO: 136472 - RNA, 22 nt, Human
uucaaugagcccggggccauag

SEQ ID NO: 136473 - RNA, 21 nt, Human
ggagcugcaggagccgaaggc

SEQ ID NO: 136474 - RNA, 22 nt, Human
ucuuuacacaagacaagaauaa

SEQ ID NO: 136475 - RNA, 22 nt, Human
ccaggccucuggcugcuuaguc

SEQ ID NO: 136476 - RNA, 22 nt, Human
ucaguguguaauucuuuguuuc

SEQ ID NO: 136477 - RNA, 17 nt, Human
agcagaagucagaggga

SEQ ID NO: 136478 - RNA, 18 nt, Human
cccagcuccacuucccuc

SEQ ID NO: 136479 - RNA, 22 nt, Human
uuuacaauagggucugaaugaa

SEQ ID NO: 136480 - RNA, 22 nt, Human
ccacagggucagccacucugca

SEQ ID NO: 136481 - RNA, 22 nt, Human
ugcaggccucacaccuggcacc

SEQ ID NO: 136482 - RNA, 22 nt, Human
caggagugagaugcgaucacuu

SEQ ID NO: 136483 - RNA, 20 nt, Human
caggaggcaaggucaagguc

SEQ ID NO: 136484 - RNA, 21 nt, Human
gcagcuggucucagagcuugc

SEQ ID NO: 136485 - RNA, 22 nt, Human
cuauuucugccuaaugaccugu

SEQ ID NO: 136486 - RNA, 22 nt, Human
cacacaggagagugcuggaggu

SEQ ID NO: 136487 - RNA, 22 nt, Human
auguagcagauauuugugcaca

SEQ ID NO: 136488 - RNA, 22 nt, Human
agcugggucuugggccaggaga

SEQ ID NO: 136489 - RNA, 22 nt, Human
uguacauacauagauauacaca

SEQ ID NO: 136490 - RNA, 19 nt, Human
acuguguggaagugugauu

SEQ ID NO: 136491 - RNA, 22 nt, Human
uuacauuagacccacuuucaug

SEQ ID NO: 136492 - RNA, 22 nt, Human
acuuaaaaagaaucuuuucacg

SEQ ID NO: 136493 - RNA, 22 nt, Human
acugaaggguaaugugggagcc

SEQ ID NO: 136494 - RNA, 22 nt, Human
ggugcagaaggaagggagcugg

SEQ ID NO: 136495 - RNA, 22 nt, Human
ucaugcaaggcugaaacauggu

SEQ ID NO: 136496 - RNA, 22 nt, Human
aacauuuaugguagucauugca

SEQ ID NO: 136497 - RNA, 22 nt, Human
uuuauauugggagucguuuuga

SEQ ID NO: 136498 - RNA, 22 nt, Human
uuaacagagaacauagaaguag

SEQ ID NO: 136499 - RNA, 22 nt, Human
accauccugaaaccuucaugcu

SEQ ID NO: 136500 - RNA, 22 nt, Human
uugugucugggggagugacauc

SEQ ID NO: 136501 - RNA, 22 nt, Human
cuguccauuuucgugccuccuu

SEQ ID NO: 136502 - RNA, 22 nt, Human
ggcuccagggaguggagagaag

SEQ ID NO: 136503 - RNA, 22 nt, Human
gugcccugguccccagcauaua

SEQ ID NO: 136504 - RNA, 22 nt, Human
uggagcagagaugggagcccaa

SEQ ID NO: 136505 - RNA, 22 nt, Human
ugagccaguggaagauggcagu

SEQ ID NO: 136506 - RNA, 22 nt, Human
gccaguuccuguggagucagag

SEQ ID NO: 136507 - RNA, 22 nt, Human
uucucugcucucacauacagaa

SEQ ID NO: 136508 - RNA, 22 nt, Human
cagggccuucguaaguguccgg

SEQ ID NO: 136509 - RNA, 20 nt, Human
ggcagcucacuacuuucugu

SEQ ID NO: 136510 - RNA, 22 nt, Human
aaaaguaauugaugcaaucgua

SEQ ID NO: 136511 - RNA, 22 nt, Human
ucuuucuucuuucauaguguga

SEQ ID NO: 136512 - RNA, 22 nt, Human
uuuuaguuuggauuucuaaagc

SEQ ID NO: 136513 - RNA, 19 nt, Human
agucccaggcccgaaagag

SEQ ID NO: 136514 - RNA, 22 nt, Human
cuaacuuuauuugcuaaguaga

SEQ ID NO: 136515 - RNA, 22 nt, Human
gccaccucggcuuucucugcuc

SEQ ID NO: 136516 - RNA, 22 nt, Human
caggaugggugucggccagcac

SEQ ID NO: 136517 - RNA, 22 nt, Human
acuuuggaucugauguaaucag

SEQ ID NO: 136518 - RNA, 22 nt, Human
gguggggcccuggcacugguau

SEQ ID NO: 136519 - RNA, 22 nt, Human
ugagggcugcuuccagagcuag

SEQ ID NO: 136520 - RNA, 23 nt, Human
uccucccaaauuucagccucauu

SEQ ID NO: 136521 - RNA, 22 nt, Human
uucauugugaacacauucugcc

SEQ ID NO: 136522 - RNA, 22 nt, Human
ccucucaucauuaucgcuuugu

SEQ ID NO: 136523 - RNA, 22 nt, Human
ugcuguguucuccugacucacc

SEQ ID NO: 136524 - RNA, 22 nt, Human
gccacaugcaauugcagcacgu

SEQ ID NO: 136525 - RNA, 22 nt, Human
ggcucaggccuguaauccuagc

SEQ ID NO: 136526 - RNA, 22 nt, Human
cagagcugagaauguugaugcu

SEQ ID NO: 136527 - RNA, 22 nt, Human
ccuggccucuccgaguaaccug

SEQ ID NO: 136528 - RNA, 22 nt, Human
uucaaaacagcuagauauugga

SEQ ID NO: 136529 - RNA, 22 nt, Human
ggucaggguauaaucaagugag

SEQ ID NO: 136530 - RNA, 22 nt, Human
ccuuucucuuggauaccgauug

SEQ ID NO: 136531 - RNA, 22 nt, Human
cuggcuguuucaggcagugucc

SEQ ID NO: 136532 - RNA, 22 nt, Human
agaggcuguuacacucccagau

SEQ ID NO: 136533 - RNA, 21 nt, Human
gggccacaccuucugcagacc

SEQ ID NO: 136534 - RNA, 22 nt, Human
agacaaauggaguaugagcaac

SEQ ID NO: 136535 - RNA, 22 nt, Human
gagccagccuucuucugagguc

SEQ ID NO: 136536 - RNA, 22 nt, Human
auaauaacaccugaauaggaaa

SEQ ID NO: 136537 - RNA, 21 nt, Human
uucaaaaugguguguuugucu

SEQ ID NO: 136538 - RNA, 22 nt, Human
uccuucaguucaauuaguccgu

SEQ ID NO: 136539 - RNA, 22 nt, Human
uuacagauacauuucuuuuguu

SEQ ID NO: 136540 - RNA, 20 nt, Human
cucaguguggccugaguguu

SEQ ID NO: 136541 - RNA, 22 nt, Human
uguguauagguugugcuaauag

SEQ ID NO: 136542 - RNA, 22 nt, Human
gaccauuugcuaguaaauugca

SEQ ID NO: 136543 - RNA, 21 nt, Human
ccucugcucgggcaugcguuu

SEQ ID NO: 136544 - RNA, 22 nt, Human
gccagagcaugcacugccugca

SEQ ID NO: 136545 - RNA, 22 nt, Human
ccagcugcgggcaucgagaguu

SEQ ID NO: 136546 - RNA, 22 nt, Human
acagaccaaguuuccagcaggu

SEQ ID NO: 136547 - RNA, 22 nt, Human
ggcugggcuccgggagcaugcg

SEQ ID NO: 136548 - RNA, 22 nt, Human
gucccacaccuugaggggucuu

SEQ ID NO: 136549 - RNA, 22 nt, Human
ucauuguuauguuuugcugucu

SEQ ID NO: 136550 - RNA, 22 nt, Human
gcucagagauguucaguagcuu

SEQ ID NO: 136551 - RNA, 22 nt, Human
uggcagagguauauugggagga

SEQ ID NO: 136552 - RNA, 22 nt, Human
auuuauguaucuguguagauca

SEQ ID NO: 136553 - RNA, 19 nt, Human
guaagggcuaauggacuau

SEQ ID NO: 136554 - RNA, 22 nt, Human
uauguuaaauguuugauguuua

SEQ ID NO: 136555 - RNA, 22 nt, Human
ccugccugucaucgccugcgcc

SEQ ID NO: 136556 - RNA, 22 nt, Human
gaugcagaaaguagacaccauc

SEQ ID NO: 136557 - RNA, 22 nt, Human
guuugcauaucugugaaaugga

SEQ ID NO: 136558 - RNA, 22 nt, Human
acagucuacuugagcuuguaua

SEQ ID NO: 136559 - RNA, 22 nt, Human
ccuggggcucaagauggcgccg

SEQ ID NO: 136560 - RNA, 22 nt, Human
ccagcuggcacuguggcugccc

SEQ ID NO: 136561 - RNA, 22 nt, Human
aggugcuggagucugggcagga

SEQ ID NO: 136562 - RNA, 22 nt, Human
ugucaugccaccguuucccaga

SEQ ID NO: 136563 - RNA, 22 nt, Human
auacagaaaaugaugcagaguu

SEQ ID NO: 136564 - RNA, 22 nt, Human
uggcagcauguuauguaaggaa

SEQ ID NO: 136565 - RNA, 22 nt, Human
gagucaguaauggauaugucau

SEQ ID NO: 136566 - RNA, 22 nt, Human
cuucagaauccagaaucagaau

SEQ ID NO: 136567 - RNA, 22 nt, Human
agaccagcugccucccagggcc

SEQ ID NO: 136568 - RNA, 22 nt, Human
ggguccagacacuccagaggaa

SEQ ID NO: 136569 - RNA, 23 nt, Human
augugugggaggucagagagcca

SEQ ID NO: 136570 - RNA, 20 nt, Human
aggcugggguguuuugccca

SEQ ID NO: 136571 - RNA, 22 nt, Human
acuguacacgugucauuuacag

SEQ ID NO: 136572 - RNA, 18 nt, Human
cucucugggugaggacaa

SEQ ID NO: 136573 - RNA, 20 nt, Human
uacagaaacaggacuuuugg

SEQ ID NO: 136574 - RNA, 22 nt, Human
uccaagaucuacagcaguuuag

SEQ ID NO: 136575 - RNA, 22 nt, Human
ucagggacuaggugcugccuga

SEQ ID NO: 136576 - RNA, 19 nt, Human
cagagcugcuggccucguc

SEQ ID NO: 136577 - RNA, 22 nt, Human
auacaguaagugucccugaaac

SEQ ID NO: 136578 - RNA, 22 nt, Human
ugcuggcccaugaagacgcagu

SEQ ID NO: 136579 - RNA, 22 nt, Human
uuuuuccuaagcaguggagcug

SEQ ID NO: 136580 - RNA, 22 nt, Human
auuugucuucaguagguucuuc

SEQ ID NO: 136581 - RNA, 22 nt, Human
ugcugggcuugaaagcugcuaa

SEQ ID NO: 136582 - RNA, 22 nt, Human
ucuuuaagccaagauauauuua

SEQ ID NO: 136583 - RNA, 21 nt, Human
ucagaacaauuccaugccucc

SEQ ID NO: 136584 - RNA, 22 nt, Human
agauacauugaguuuccuccug

SEQ ID NO: 136585 - RNA, 22 nt, Human
auaccuuuuagacauguaguug

SEQ ID NO: 136586 - RNA, 20 nt, Human
gaaaugugaccucuucugug

SEQ ID NO: 136587 - RNA, 22 nt, Human
gcugggagcaaagccaugcaua

SEQ ID NO: 136588 - RNA, 22 nt, Human
cagcagcuacuuggagcagcag

SEQ ID NO: 136589 - RNA, 22 nt, Human
uuccuauuuccaugaaacacaa

SEQ ID NO: 136590 - RNA, 22 nt, Human
caaagguauucucauuuuggaa

SEQ ID NO: 136591 - RNA, 22 nt, Human
ucuggcucucauacucgccagu

SEQ ID NO: 136592 - RNA, 22 nt, Human
aaaaugaggucaauauccuuuu

SEQ ID NO: 136593 - RNA, 17 nt, Human
ugagacagggcaggccc

SEQ ID NO: 136594 - RNA, 22 nt, Human
uggagcugagagccaggcuggc

SEQ ID NO: 136595 - RNA, 20 nt, Human
aacuuguuuuguuuucuaau

SEQ ID NO: 136596 - RNA, 22 nt, Human
agcuuccuacaaccaucucaga

SEQ ID NO: 136597 - RNA, 22 nt, Human
ggcaaaaaguucccaucagugu

SEQ ID NO: 136598 - RNA, 22 nt, Human
aagaacaguugggaggugagcc

SEQ ID NO: 136599 - RNA, 22 nt, Human
ugagcuuacgugggaacagacu

SEQ ID NO: 136600 - RNA, 22 nt, Human
agguaacacuacuuaguauacu

SEQ ID NO: 136601 - RNA, 22 nt, Human
uuuuuccuagcgauuugucagc

SEQ ID NO: 136602 - RNA, 18 nt, Human
gcagagugcgucucugug

SEQ ID NO: 136603 - RNA, 22 nt, Human
cugaggugcuauggaggauacg

SEQ ID NO: 136604 - RNA, 22 nt, Human
gcacaugagcugcugggauggg

SEQ ID NO: 136605 - RNA, 22 nt, Human
ggagaccagaaggaagcuucga

SEQ ID NO: 136606 - RNA, 22 nt, Human
aguauuuccuggcuuaucugcu

SEQ ID NO: 136607 - RNA, 22 nt, Human
uuugaaaggugucgagaugugu

SEQ ID NO: 136608 - RNA, 21 nt, Human
uucaaaguuugccuaaagauu

SEQ ID NO: 136609 - RNA, 22 nt, Human
cagguggcuucucccuaggcca

SEQ ID NO: 136610 - RNA, 22 nt, Human
uucaacuagauuuauacaauuc

SEQ ID NO: 136611 - RNA, 22 nt, Human
auuuccaggagaaaggauuuua

SEQ ID NO: 136612 - RNA, 22 nt, Human
ucaguucuuuauuucacaguga

SEQ ID NO: 136613 - RNA, 22 nt, Human
cucuuccucucaugcggucaua

SEQ ID NO: 136614 - RNA, 22 nt, Human
ccacagaaaguugucuagagua

SEQ ID NO: 136615 - RNA, 22 nt, Human
cccagcagauggcuaugugcua

SEQ ID NO: 136616 - RNA, 22 nt, Human
ccuggcugaaccaaugaagugg

SEQ ID NO: 136617 - RNA, 23 nt, Human
ucucaagaggaagcagggcucau

SEQ ID NO: 136618 - RNA, 22 nt, Human
acauuucucauucuccccuaac

SEQ ID NO: 136619 - RNA, 22 nt, Human
uuuuauugggaguccucuacug

SEQ ID NO: 136620 - RNA, 22 nt, Human
ccugugugccuggccgcgggag

SEQ ID NO: 136621 - RNA, 22 nt, Human
uacuuccagcaaucugcauauu

SEQ ID NO: 136622 - RNA, 22 nt, Human
auaucuuuguaugguucagcag

SEQ ID NO: 136623 - RNA, 22 nt, Human
ugcagccuugccuccucccagc

SEQ ID NO: 136624 - RNA, 22 nt, Human
uccuucagggggccgccugcac

SEQ ID NO: 136625 - RNA, 22 nt, Human
uggggcucaccuaggcuggaag

SEQ ID NO: 136626 - RNA, 20 nt, Human
uguucacaguaguugcugcu

SEQ ID NO: 136627 - RNA, 17 nt, Human
acagagcacaucaagau

SEQ ID NO: 136628 - RNA, 18 nt, Human
uccugccugugccccagg

SEQ ID NO: 136629 - RNA, 22 nt, Human
agcugccugcuuaugagcucca

SEQ ID NO: 136630 - RNA, 22 nt, Human
uguggcugcaaaggaaggcugc

SEQ ID NO: 136631 - RNA, 22 nt, Human
gugugcaguagagaaagagcag

SEQ ID NO: 136632 - RNA, 22 nt, Human
gacagggcgcccagccuguuuc

SEQ ID NO: 136633 - RNA, 22 nt, Human
guuggccugaauggucaagagg

SEQ ID NO: 136634 - RNA, 22 nt, Human
agcuaggaaauugaggcugaga

SEQ ID NO: 136635 - RNA, 22 nt, Human
cccagagcuccgguccugccca

SEQ ID NO: 136636 - RNA, 22 nt, Human
cugagauggccacugggucuca

SEQ ID NO: 136637 - RNA, 22 nt, Human
gaugcugaagugaagugaucuu

SEQ ID NO: 136638 - RNA, 22 nt, Human
ggccugagcucuggggaggcaa

SEQ ID NO: 136639 - RNA, 22 nt, Human
acagaauaagguuuaucucucc

SEQ ID NO: 136640 - RNA, 22 nt, Human
gaggccuggcucugcccuccug

SEQ ID NO: 136641 - RNA, 22 nt, Human
acuuccuggcugggugaccugg

SEQ ID NO: 136642 - RNA, 22 nt, Human
cugccuuccaaccccagacucc

SEQ ID NO: 136643 - RNA, 22 nt, Human
gcacugcagccucagauggugg

SEQ ID NO: 136644 - RNA, 22 nt, Human
gucuauauauugcuugaauaau

SEQ ID NO: 136645 - RNA, 22 nt, Human
cuggcugugucuuggaggagcu

SEQ ID NO: 136646 - RNA, 22 nt, Human
ucaguuuuuaaaugauauaauu

SEQ ID NO: 136647 - RNA, 22 nt, Human
aucuuucagagcuccaucaggg

SEQ ID NO: 136648 - RNA, 22 nt, Human
gggagcuguaguccagauaccg

SEQ ID NO: 136649 - RNA, 20 nt, Human
uguugauuggugucaucuca

SEQ ID NO: 136650 - RNA, 22 nt, Human
uuucugcuaaucuuuuacugag

SEQ ID NO: 136651 - RNA, 22 nt, Human
ggucccagguugacagggagac

SEQ ID NO: 136652 - RNA, 21 nt, Human
gacaaagugaagcaggcagga

SEQ ID NO: 136653 - RNA, 22 nt, Human
uuuucagugggcaaugauguga

SEQ ID NO: 136654 - RNA, 22 nt, Human
uuuguguauguaugcuuguaca

SEQ ID NO: 136655 - RNA, 22 nt, Human
guggcugcagagccagcaagcu

SEQ ID NO: 136656 - RNA, 22 nt, Human
aaauguguuucgaaaacuggug

SEQ ID NO: 136657 - RNA, 22 nt, Human
uccugccuguuuaccuguacuu

SEQ ID NO: 136658 - RNA, 22 nt, Human
ggcuuccuaauacucccuacac

SEQ ID NO: 136659 - RNA, 22 nt, Human
ugcaggggcuugucugggccug

SEQ ID NO: 136660 - RNA, 22 nt, Human
cagagccugccaccuuucuccc

SEQ ID NO: 136661 - RNA, 22 nt, Human
guguggcuugggugaggcgccu

SEQ ID NO: 136662 - RNA, 22 nt, Human
acugccuuauaugcugugugug

SEQ ID NO: 136663 - RNA, 22 nt, Human
ugaaagggguugaguuacagcu

SEQ ID NO: 136664 - RNA, 22 nt, Human
ugagccaggcucaagugauccu

SEQ ID NO: 136665 - RNA, 22 nt, Human
uuucuuuccauacauauugcua

SEQ ID NO: 136666 - RNA, 22 nt, Human
cauugcacucuggcuggaacgg

SEQ ID NO: 136667 - RNA, 22 nt, Human
uucaaucauuuuuacauagucc

SEQ ID NO: 136668 - RNA, 22 nt, Human
ucucucagcuuugagaccugcu

SEQ ID NO: 136669 - RNA, 22 nt, Human
ucagugucuugggcuugaaugc

SEQ ID NO: 136670 - RNA, 22 nt, Human
accucugcucaagaccccuccg

SEQ ID NO: 136671 - RNA, 22 nt, Human
uaucaucuuguugucaugcagc

SEQ ID NO: 136672 - RNA, 20 nt, Human
auguggcuuuuugaccugcu

SEQ ID NO: 136673 - RNA, 22 nt, Human
ucucccacuggccuuguaugau

SEQ ID NO: 136674 - RNA, 21 nt, Human
aaauuuucuuggcuguagugu

SEQ ID NO: 136675 - RNA, 22 nt, Human
ucaacacucuuuggcacaguua

SEQ ID NO: 136676 - RNA, 22 nt, Human
aaguucaagucuccugaguaua

SEQ ID NO: 136677 - RNA, 22 nt, Human
gcaguggcaugaugugggcuca

SEQ ID NO: 136678 - RNA, 19 nt, Human
cgcaggagccgaggugacc

SEQ ID NO: 136679 - RNA, 22 nt, Human
caggauccuggcugcauggacg

SEQ ID NO: 136680 - RNA, 22 nt, Human
agcagccauagauagcaugcaa

SEQ ID NO: 136681 - RNA, 22 nt, Human
uacauguauguguuaauaucug

SEQ ID NO: 136682 - RNA, 22 nt, Human
gcugccuugaacuuggccuggg

SEQ ID NO: 136683 - RNA, 22 nt, Human
uggggcuguccuuagucugaga

SEQ ID NO: 136684 - RNA, 22 nt, Human
caacagaagguguacuacugaa

SEQ ID NO: 136685 - RNA, 22 nt, Human
agcagagcccuuccauggccuu

SEQ ID NO: 136686 - RNA, 22 nt, Human
cugggcacaggggagcagaguc

SEQ ID NO: 136687 - RNA, 22 nt, Human
cacugaagaugcgacuagugcu

SEQ ID NO: 136688 - RNA, 21 nt, Human
ucacagacuggucagugaggc

SEQ ID NO: 136689 - RNA, 22 nt, Human
uaaggcaccuguccaggcuggg

SEQ ID NO: 136690 - RNA, 22 nt, Human
cagcagagcuuauguuggguca

SEQ ID NO: 136691 - RNA, 22 nt, Human
cucagaguggggcucccugagg

SEQ ID NO: 136692 - RNA, 22 nt, Human
uagagcugcuggacuguaacag

SEQ ID NO: 136693 - RNA, 22 nt, Human
ucacaguaucacacaaggauua

SEQ ID NO: 136694 - RNA, 22 nt, Human
ccugucugaggaggugcucuuu

SEQ ID NO: 136695 - RNA, 22 nt, Human
guggcugcaguaguguaggguc

SEQ ID NO: 136696 - RNA, 22 nt, Human
uagagcauuuagaggggcagga

SEQ ID NO: 136697 - RNA, 22 nt, Human
uugcuauuuugagagucauagu

SEQ ID NO: 136698 - RNA, 22 nt, Human
aagauuuccauuucuagcucau

SEQ ID NO: 136699 - RNA, 19 nt, Human
acuuugcaugugugucuaa

SEQ ID NO: 136700 - RNA, 22 nt, Human
ugugugugggcggaacggcccc

SEQ ID NO: 136701 - RNA, 22 nt, Human
ugucccagguccuagaugacca

SEQ ID NO: 136702 - RNA, 22 nt, Human
auucuuaauugccaugcuguau

SEQ ID NO: 136703 - RNA, 22 nt, Human
acauuguuugagaauacagaug

SEQ ID NO: 136704 - RNA, 22 nt, Human
uggcucagugcauucacaguaa

SEQ ID NO: 136705 - RNA, 22 nt, Human
uuugggaacucuaucauggaaa

SEQ ID NO: 136706 - RNA, 22 nt, Human
gcccucagcuccuggacacaug

SEQ ID NO: 136707 - RNA, 22 nt, Human
uuucucugaguuguuacaaaac

SEQ ID NO: 136708 - RNA, 22 nt, Human
auuuccuagccucucuugcagu

SEQ ID NO: 136709 - RNA, 22 nt, Human
uccauuuucuaaguaucacuua

SEQ ID NO: 136710 - RNA, 22 nt, Human
cuuggcugucuauaggaaagag

SEQ ID NO: 136711 - RNA, 22 nt, Human
uaacucuuccaacacuccuucc

SEQ ID NO: 136712 - RNA, 22 nt, Human
gaaggaaaacagaucugccuga

SEQ ID NO: 136713 - RNA, 22 nt, Human
uuugcuauuuuucugugcagcu

SEQ ID NO: 136714 - RNA, 22 nt, Human
gagagaagggggauaugagccu

SEQ ID NO: 136715 - RNA, 22 nt, Human
gcuguguggcugugccgucacg

SEQ ID NO: 136716 - RNA, 22 nt, Human
cuauuacaaucugcuacuauga

SEQ ID NO: 136717 - RNA, 22 nt, Human
cauugacaucaggcuuggccaa

SEQ ID NO: 136718 - RNA, 22 nt, Human
agcuugccucuuaaucaccuca

SEQ ID NO: 136719 - RNA, 22 nt, Human
gcaggcaggcuuccuugaacug

SEQ ID NO: 136720 - RNA, 22 nt, Human
cuguuaaucugcuugcaugaug

SEQ ID NO: 136721 - RNA, 22 nt, Human
aggccaggcaacauucugaagu

SEQ ID NO: 136722 - RNA, 23 nt, Human
uggcugagguccagguaguuuca

SEQ ID NO: 136723 - RNA, 17 nt, Human
gcugcagcgguaggcag

SEQ ID NO: 136724 - RNA, 22 nt, Human
gagagcugggaaagccguggag

SEQ ID NO: 136725 - RNA, 22 nt, Human
uagaggugacacugagaccaua

SEQ ID NO: 136726 - RNA, 22 nt, Human
agccuccaucccaugcacaaag

SEQ ID NO: 136727 - RNA, 22 nt, Human
augaagucugcacaugcaugug

SEQ ID NO: 136728 - RNA, 22 nt, Human
acuugauuuugaaccuuucuac

SEQ ID NO: 136729 - RNA, 22 nt, Human
cggcuggguagaggugccgggu

SEQ ID NO: 136730 - RNA, 22 nt, Human
uccuggccugucuggaguagcu

SEQ ID NO: 136731 - RNA, 22 nt, Human
uaucugugaaauguguuuguau

SEQ ID NO: 136732 - RNA, 22 nt, Human
cagaggcucuuccucacugccc

SEQ ID NO: 136733 - RNA, 22 nt, Human
gugucgugcuugccauggguac

SEQ ID NO: 136734 - RNA, 22 nt, Human
auugacaagcaguaugucuuag

SEQ ID NO: 136735 - RNA, 23 nt, Human
gccugggacugguagugugaccu

SEQ ID NO: 136736 - RNA, 22 nt, Human
cucccaggggaacuaucaagua

SEQ ID NO: 136737 - RNA, 21 nt, Human
uggcaggcagcuggaagcuug

SEQ ID NO: 136738 - RNA, 22 nt, Human
gcagcaggcuuuucauaccuug

SEQ ID NO: 136739 - RNA, 22 nt, Human
ggaaagagcccagcagugcuug

SEQ ID NO: 136740 - RNA, 22 nt, Human
uagaggugucacuuugggaagu

SEQ ID NO: 136741 - RNA, 22 nt, Human
gccagggcaggggagcaucugc

SEQ ID NO: 136742 - RNA, 22 nt, Human
guggcagcggcccaggccgucu

SEQ ID NO: 136743 - RNA, 21 nt, Human
ucucugggaggacuugugaga

SEQ ID NO: 136744 - RNA, 21 nt, Human
aggcagaaagagcccaggcug

SEQ ID NO: 136745 - RNA, 20 nt, Human
ucauuguguugccaauuccc

SEQ ID NO: 136746 - RNA, 22 nt, Human
uuagauaaauuaagacuuuaca

SEQ ID NO: 136747 - RNA, 22 nt, Human
auguguauuuuguacuauuggg

SEQ ID NO: 136748 - RNA, 22 nt, Human
uacuguauaugcuuguaucuga

SEQ ID NO: 136749 - RNA, 22 nt, Human
uagccaggcgaggucagugucg

SEQ ID NO: 136750 - RNA, 22 nt, Human
ccugcuucagggaugauggcac

SEQ ID NO: 136751 - RNA, 22 nt, Human
ucauugcacuccagccugggca

SEQ ID NO: 136752 - RNA, 22 nt, Human
cucucuguuaugcuuucaugaa

SEQ ID NO: 136753 - RNA, 22 nt, Human
uucauucugcaguucucagcuc

SEQ ID NO: 136754 - RNA, 23 nt, Human
ugagcccaggaggucaaggcugc

SEQ ID NO: 136755 - RNA, 22 nt, Human
cuuguuaucuccguguccuugu

SEQ ID NO: 136756 - RNA, 22 nt, Human
gcucucuggaggccauggacag

SEQ ID NO: 136757 - RNA, 22 nt, Human
gaccugccugagcugccucugc

SEQ ID NO: 136758 - RNA, 22 nt, Human
uaguuacagcaggcaggauaua

SEQ ID NO: 136759 - RNA, 19 nt, Human
gggaaauucacuugcuucc

SEQ ID NO: 136760 - RNA, 22 nt, Human
ucuggcuccacucugugcaugc

SEQ ID NO: 136761 - RNA, 22 nt, Human
guuugcauguguacuuaauugg

SEQ ID NO: 136762 - RNA, 22 nt, Human
guccucuggccuuucccaggac

SEQ ID NO: 136763 - RNA, 22 nt, Human
auacaguagacaaucucaugaa

SEQ ID NO: 136764 - RNA, 22 nt, Human
acccaggagguggaggcugcag

SEQ ID NO: 136765 - RNA, 22 nt, Human
uuguaaauaguaguaagaugcc

SEQ ID NO: 136766 - RNA, 22 nt, Human
cugaaggaagcagguggccugu

SEQ ID NO: 136767 - RNA, 23 nt, Human
aggaacugaggccuagggaggua

SEQ ID NO: 136768 - RNA, 22 nt, Human
agagccugugauugucaucacc

SEQ ID NO: 136769 - RNA, 22 nt, Human
gcuggucacucugggagcugcu

SEQ ID NO: 136770 - RNA, 22 nt, Human
uuugcagcaaggagagagcauu

SEQ ID NO: 136771 - RNA, 22 nt, Human
auuguguaauuuucagcucaua

SEQ ID NO: 136772 - RNA, 22 nt, Human
aaaguggucaccuucucauuuc

SEQ ID NO: 136773 - RNA, 22 nt, Human
auuuacagugugccuacuauau

SEQ ID NO: 136774 - RNA, 22 nt, Human
acuugcauuauauuuaucacaa

SEQ ID NO: 136775 - RNA, 22 nt, Human
auccaugaucaauuuauuacua

SEQ ID NO: 136776 - RNA, 22 nt, Human
uaacauuuaaauuuuucacaua

SEQ ID NO: 136777 - RNA, 22 nt, Human
cugggguggugcaggccucaug

SEQ ID NO: 136778 - RNA, 22 nt, Human
caggcagcagaggaguguggga

SEQ ID NO: 136779 - RNA, 22 nt, Human
gggcauggugaugugcaccugu

SEQ ID NO: 136780 - RNA, 22 nt, Human
agggaggaucugcuccuugucu

SEQ ID NO: 136781 - RNA, 22 nt, Human
cuuuccaggcugaguuugcuug

SEQ ID NO: 136782 - RNA, 22 nt, Human
uaacuguugugcgggucucugg

SEQ ID NO: 136783 - RNA, 22 nt, Human
gagcccagguucugcuuccagc

SEQ ID NO: 136784 - RNA, 22 nt, Human
cacaagucuguggucuccaaca

SEQ ID NO: 136785 - RNA, 22 nt, Human
gugggcaaggucccugccagcu

SEQ ID NO: 136786 - RNA, 22 nt, Human
ccagaagggcuauugcagugac

SEQ ID NO: 136787 - RNA, 22 nt, Human
gcagcccagagcgcaggacccc

SEQ ID NO: 136788 - RNA, 22 nt, Human
augugugugaugggcgccgcca

SEQ ID NO: 136789 - RNA, 22 nt, Human
uugaaauacugcauuguucagu

SEQ ID NO: 136790 - RNA, 22 nt, Human
gccugagcaggcguggaccaug

SEQ ID NO: 136791 - RNA, 22 nt, Human
uugaaaguuaucuagauucuga

SEQ ID NO: 136792 - RNA, 22 nt, Human
aucuuucagggccauuuguauu

SEQ ID NO: 136793 - RNA, 22 nt, Human
gcucugucuucagcacacagua

SEQ ID NO: 136794 - RNA, 22 nt, Human
uaggcagggauuaggguugauu

SEQ ID NO: 136795 - RNA, 22 nt, Human
uacaucauaauaauacuuagaa

SEQ ID NO: 136796 - RNA, 22 nt, Human
cuuacauuaaguaagagauuga

SEQ ID NO: 136797 - RNA, 22 nt, Human
ugccaggcuaaguggaggacuu

SEQ ID NO: 136798 - RNA, 22 nt, Human
uuccaggggcagcagugauggu

SEQ ID NO: 136799 - RNA, 22 nt, Human
agcugagcauuugauccaccuc

SEQ ID NO: 136800 - RNA, 22 nt, Human
cuuccugcauugugccagaguu

SEQ ID NO: 136801 - RNA, 20 nt, Human
aggagcugaauuagaggguu

SEQ ID NO: 136802 - RNA, 22 nt, Human
aaggccaacuaggaugagcuag

SEQ ID NO: 136803 - RNA, 18 nt, Human
ucagcuggggcugcagcc

SEQ ID NO: 136804 - RNA, 22 nt, Human
auuguauuagcacaauacaauu

SEQ ID NO: 136805 - RNA, 22 nt, Human
gcugucugcugggucgcucagg

SEQ ID NO: 136806 - RNA, 22 nt, Human
agccucucugaugugacagcua

SEQ ID NO: 136807 - RNA, 22 nt, Human
ucagcaguuuuauaugcagcuu

SEQ ID NO: 136808 - RNA, 22 nt, Human
cauuucugugacacuuccaucu

SEQ ID NO: 136809 - RNA, 22 nt, Human
cuguuuaucccuuuggucagca

SEQ ID NO: 136810 - RNA, 22 nt, Human
uuucucuggccucaguuuaaca

SEQ ID NO: 136811 - RNA, 22 nt, Human
cagggcagagggaaacuccuuu

SEQ ID NO: 136812 - RNA, 22 nt, Human
auucaguucuaaggucagugcc

SEQ ID NO: 136813 - RNA, 22 nt, Human
uggccugguccuugucaaggca

SEQ ID NO: 136814 - RNA, 22 nt, Human
gcugucaggccaugugggccuu

SEQ ID NO: 136815 - RNA, 22 nt, Human
gcucugagcacugugcggcugg

SEQ ID NO: 136816 - RNA, 22 nt, Human
cuggggugagcagaaacagggg

SEQ ID NO: 136817 - RNA, 20 nt, Human
ccugaggguuuguguucuuu

SEQ ID NO: 136818 - RNA, 22 nt, Human
agggggaggcugugcugcgucu

SEQ ID NO: 136819 - RNA, 22 nt, Human
ucauugcagugauguuguaugu

SEQ ID NO: 136820 - RNA, 22 nt, Human
ggagugaaucacuagaugcaga

SEQ ID NO: 136821 - RNA, 22 nt, Human
cuccagaagacccauccucaug

SEQ ID NO: 136822 - RNA, 22 nt, Human
acuuuuuaguuuccucaaacau

SEQ ID NO: 136823 - RNA, 18 nt, Human
gaacuuuuggcuuugugu

SEQ ID NO: 136824 - RNA, 22 nt, Human
ucaggaguccugccugcagccu

SEQ ID NO: 136825 - RNA, 22 nt, Human
uaaauuaugucacaugacucug

SEQ ID NO: 136826 - RNA, 22 nt, Human
uggcuucaucugcagcacugcc

SEQ ID NO: 136827 - RNA, 22 nt, Human
cuguggcuuucucugccuccuu

SEQ ID NO: 136828 - RNA, 22 nt, Human
cucagcuggcaauucuggcucc

SEQ ID NO: 136829 - RNA, 22 nt, Human
accaucaguacuggaugcugac

SEQ ID NO: 136830 - RNA, 18 nt, Human
guccugagcucugcugua

SEQ ID NO: 136831 - RNA, 22 nt, Human
cccuggugguacggcacuggca

SEQ ID NO: 136832 - RNA, 22 nt, Human
aagggcaggcagagaucauaua

SEQ ID NO: 136833 - RNA, 20 nt, Human
ucucugcuguccacauuugc

SEQ ID NO: 136834 - RNA, 22 nt, Human
auucauucugaccucaagagaa

SEQ ID NO: 136835 - RNA, 21 nt, Human
aaaaugugagcgugaugcuua

SEQ ID NO: 136836 - RNA, 22 nt, Human
aaaaaugcugugguagcugugu

SEQ ID NO: 136837 - RNA, 22 nt, Human
ggccuugggauguggcugcagc

SEQ ID NO: 136838 - RNA, 22 nt, Human
gcugcuuccuuuccugcugacc

SEQ ID NO: 136839 - RNA, 22 nt, Human
uacuuucuuucugauccuuaug

SEQ ID NO: 136840 - RNA, 21 nt, Human
ucacuagugccuucugucauu

SEQ ID NO: 136841 - RNA, 22 nt, Human
cagcugccaugacauguccugc

SEQ ID NO: 136842 - RNA, 22 nt, Human
ucauguaaguauagaaagcagu

SEQ ID NO: 136843 - RNA, 22 nt, Human
cccagcuccuuggaugggcagg

SEQ ID NO: 136844 - RNA, 22 nt, Human
auguggcugguaguugacaacu

SEQ ID NO: 136845 - RNA, 22 nt, Human
ucccagagccaagcuauggaug

SEQ ID NO: 136846 - RNA, 22 nt, Human
ggggcggggcucugagaagcau

SEQ ID NO: 136847 - RNA, 21 nt, Human
uguuuucuaaagggcggauca

SEQ ID NO: 136848 - RNA, 22 nt, Human
aaugaacaggugaaugucagau

SEQ ID NO: 136849 - RNA, 22 nt, Human
gcucccagcaauugaggcagcc

SEQ ID NO: 136850 - RNA, 22 nt, Human
ccaaagucuggagcagcagagc

SEQ ID NO: 136851 - RNA, 22 nt, Human
uguacacugcaggaugcauugc

SEQ ID NO: 136852 - RNA, 22 nt, Human
agucaguguagaaagcccaggc

SEQ ID NO: 136853 - RNA, 22 nt, Human
ugaaagcacucacuucugcucu

SEQ ID NO: 136854 - RNA, 18 nt, Human
gggcauggaugcagcauc

SEQ ID NO: 136855 - RNA, 22 nt, Human
acauuuaggauguuuugagaga

SEQ ID NO: 136856 - RNA, 22 nt, Human
gccuggcaggccugggccagca

SEQ ID NO: 136857 - RNA, 22 nt, Human
agcuggagaugcccagcaccgg

SEQ ID NO: 136858 - RNA, 22 nt, Human
uggcuaugguauugauggguuu

SEQ ID NO: 136859 - RNA, 22 nt, Human
cuggcuuccucaggagcagugg

SEQ ID NO: 136860 - RNA, 22 nt, Human
ugaugggacugccagcugcuga

SEQ ID NO: 136861 - RNA, 22 nt, Human
uccugccugagcguggaggagg

SEQ ID NO: 136862 - RNA, 22 nt, Human
ugcauaaagugccauaguauua

SEQ ID NO: 136863 - RNA, 22 nt, Human
uugaagcauuugcuauagcauu

SEQ ID NO: 136864 - RNA, 22 nt, Human
aucuguguaugugaccuuaucu

SEQ ID NO: 136865 - RNA, 22 nt, Human
cugggcugucaauggcccucug

SEQ ID NO: 136866 - RNA, 23 nt, Human
acagagaucuugacuuguaugga

SEQ ID NO: 136867 - RNA, 22 nt, Human
caguuucugggcguucacaggu

SEQ ID NO: 136868 - RNA, 22 nt, Human
cauuguauugaggauacuuaag

SEQ ID NO: 136869 - RNA, 22 nt, Human
cccagggacagaugggcagcua

SEQ ID NO: 136870 - RNA, 22 nt, Human
guucagggagggacagaugaag

SEQ ID NO: 136871 - RNA, 22 nt, Human
gcaguggcaccgcuggcucugg

SEQ ID NO: 136872 - RNA, 19 nt, Human
uccuuugaauaucaguuga

SEQ ID NO: 136873 - RNA, 22 nt, Human
guuaaauucgaugauggauaaa

SEQ ID NO: 136874 - RNA, 22 nt, Human
uuucuucaauugcuaacaagga

SEQ ID NO: 136875 - RNA, 22 nt, Human
gagagucacugucugcauuucc

SEQ ID NO: 136876 - RNA, 22 nt, Human
ucugucacucccugaugaugaa

SEQ ID NO: 136877 - RNA, 22 nt, Human
cuuuguaucuaaauaucuugaa

SEQ ID NO: 136878 - RNA, 22 nt, Human
ggccugccucacagucagcacc

SEQ ID NO: 136879 - RNA, 22 nt, Human
gcaggcagagaaggaacauuua

SEQ ID NO: 136880 - RNA, 22 nt, Human
agugaccaaucaugguuagauu

SEQ ID NO: 136881 - RNA, 22 nt, Human
ucuguacaaaggcuauuuggag

SEQ ID NO: 136882 - RNA, 22 nt, Human
ccagcagcgauagggugagugc

SEQ ID NO: 136883 - RNA, 21 nt, Human
uggcagggguaguaguacagc

SEQ ID NO: 136884 - RNA, 22 nt, Human
gauuuuauuagcccaaacuuug

SEQ ID NO: 136885 - RNA, 22 nt, Human
ccagcccugucaccaacuggag

SEQ ID NO: 136886 - RNA, 22 nt, Human
auauuuguaaaauucugugucu

SEQ ID NO: 136887 - RNA, 22 nt, Human
uuagaaaugauuucaccucuuu

SEQ ID NO: 136888 - RNA, 22 nt, Human
uagggcaggugaagaaaagcua

SEQ ID NO: 136889 - RNA, 21 nt, Human
uucaguaugcgucaugcuguu

SEQ ID NO: 136890 - RNA, 22 nt, Human
aagcaauaagccagauuuggau

SEQ ID NO: 136891 - RNA, 21 nt, Human
ccccugggagcccugucagua

SEQ ID NO: 136892 - RNA, 22 nt, Human
uuagcugcauuaucaaaguuau

SEQ ID NO: 136893 - RNA, 22 nt, Human
gauuucaaagguucugcaugcc

SEQ ID NO: 136894 - RNA, 22 nt, Human
ugcaguggcgccaucucagcuc

SEQ ID NO: 136895 - RNA, 22 nt, Human
cccagcagaaucugaugagggc

SEQ ID NO: 136896 - RNA, 22 nt, Human
aggaaaaucgagucuggaggca

SEQ ID NO: 136897 - RNA, 22 nt, Human
gcagugccuugcuucucugucu

SEQ ID NO: 136898 - RNA, 20 nt, Human
gccugagcuccgccuccugu

SEQ ID NO: 136899 - RNA, 22 nt, Human
aggcagagagcaguggccgucu

SEQ ID NO: 136900 - RNA, 22 nt, Human
auguuucagauacagaucaaau

SEQ ID NO: 136901 - RNA, 22 nt, Human
uuuacagucuauguugaauuaa

SEQ ID NO: 136902 - RNA, 22 nt, Human
agccacagagguugaugugguu

SEQ ID NO: 136903 - RNA, 22 nt, Human
cccuggaguagcacugggucgc

SEQ ID NO: 136904 - RNA, 22 nt, Human
gaguggagcaaaagagguagau

SEQ ID NO: 136905 - RNA, 20 nt, Human
ggguggaguugcggucugug

SEQ ID NO: 136906 - RNA, 22 nt, Human
ucuucaaguuccaaagugcagg

SEQ ID NO: 136907 - RNA, 22 nt, Human
cugcucuguucccccaucaucu

SEQ ID NO: 136908 - RNA, 22 nt, Human
cccaccccuggacaggugagug

SEQ ID NO: 136909 - RNA, 22 nt, Human
cauuuccagcuccugcaucaug

SEQ ID NO: 136910 - RNA, 22 nt, Human
gcugucuguggugucagcugac

SEQ ID NO: 136911 - RNA, 22 nt, Human
ccugacucuggccaggccagcu

SEQ ID NO: 136912 - RNA, 22 nt, Human
ugugaaagucaaauuaauugaa

SEQ ID NO: 136913 - RNA, 22 nt, Human
ccugggaguggcacucacagca

SEQ ID NO: 136914 - RNA, 22 nt, Human
gccagagcagaauagaguggcc

SEQ ID NO: 136915 - RNA, 22 nt, Human
acuuguuuggucucauguuuaa

SEQ ID NO: 136916 - RNA, 22 nt, Human
ucuuuacauaguguggacuacu

SEQ ID NO: 136917 - RNA, 22 nt, Human
aaaagucugcucucauuucaga

SEQ ID NO: 136918 - RNA, 19 nt, Human
acagaagcauagaaaagga

SEQ ID NO: 136919 - RNA, 22 nt, Human
ucugccuugagguccucagcuc

SEQ ID NO: 136920 - RNA, 22 nt, Human
cucacaggagaaagucaugguc

SEQ ID NO: 136921 - RNA, 22 nt, Human
aguuauuuacuccuuugucucu

SEQ ID NO: 136922 - RNA, 22 nt, Human
gauuauauaauggaagcucuug

SEQ ID NO: 136923 - RNA, 22 nt, Human
ccagagccuaagaucugauccu

SEQ ID NO: 136924 - RNA, 22 nt, Human
cccuuucccuucuggcucaggg

SEQ ID NO: 136925 - RNA, 22 nt, Human
ugaaagcacaaguucuaacagg

SEQ ID NO: 136926 - RNA, 20 nt, Human
ucuguacacucaucuucugc

SEQ ID NO: 136927 - RNA, 22 nt, Human
uccaguggugguuugaagggca

SEQ ID NO: 136928 - RNA, 22 nt, Human
aaucuguucuacucuauucaga

SEQ ID NO: 136929 - RNA, 22 nt, Human
agccuggaguucccaggagaag

SEQ ID NO: 136930 - RNA, 22 nt, Human
cugcccugggaguaccuguccu

SEQ ID NO: 136931 - RNA, 22 nt, Human
cccagcuccaagggacagcgaa

SEQ ID NO: 136932 - RNA, 18 nt, Human
ugaacagaugaguugaag

SEQ ID NO: 136933 - RNA, 22 nt, Human
cagggagaucuuggcuccuggu

SEQ ID NO: 136934 - RNA, 22 nt, Human
uggaggaugagugugggcucug

SEQ ID NO: 136935 - RNA, 22 nt, Human
accugccuauggagccacaugg

SEQ ID NO: 136936 - RNA, 22 nt, Human
aagagcuggauggaaucuggga

SEQ ID NO: 136937 - RNA, 22 nt, Human
uaaaugcaagugcuccugggag

SEQ ID NO: 136938 - RNA, 23 nt, Human
gccucuggagccccagugcucag

SEQ ID NO: 136939 - RNA, 22 nt, Human
uacauuaucuuguuaucuuuca

SEQ ID NO: 136940 - RNA, 22 nt, Human
cugugccuuuguagcugugccu

SEQ ID NO: 136941 - RNA, 22 nt, Human
cugaggucuagacaccccaggg

SEQ ID NO: 136942 - RNA, 22 nt, Human
ucugccuucgcugcucccugaa

SEQ ID NO: 136943 - RNA, 22 nt, Human
agccaacuaggagauuaaggua

SEQ ID NO: 136944 - RNA, 22 nt, Human
uggggcuggggaucuugagccu

SEQ ID NO: 136945 - RNA, 22 nt, Human
uuguggcucuugaggcucucgu

SEQ ID NO: 136946 - RNA, 22 nt, Human
acucucuugggggagagcagag

SEQ ID NO: 136947 - RNA, 22 nt, Human
cuucccacuaguaucacagagc

SEQ ID NO: 136948 - RNA, 22 nt, Human
caguuucucucaauaagcaucg

SEQ ID NO: 136949 - RNA, 22 nt, Human
uuuacacggcauuaucuucaug

SEQ ID NO: 136950 - RNA, 22 nt, Human
gcugccaugguccaggcuccag

SEQ ID NO: 136951 - RNA, 22 nt, Human
aagauggagcacgagcagaagc

SEQ ID NO: 136952 - RNA, 20 nt, Human
aaguauauguccguguacuu

SEQ ID NO: 136953 - RNA, 22 nt, Human
uggagcagcuaagccucugaga

SEQ ID NO: 136954 - RNA, 22 nt, Human
acagagcuguacaugugccaug

SEQ ID NO: 136955 - RNA, 22 nt, Human
cugggcaguuuauucaguucug

SEQ ID NO: 136956 - RNA, 22 nt, Human
ucucagagaaaugugucaccau

SEQ ID NO: 136957 - RNA, 22 nt, Human
ccuggcugcuuucacuauggag

SEQ ID NO: 136958 - RNA, 18 nt, Human
ccuguguguguugcaggc

SEQ ID NO: 136959 - RNA, 22 nt, Human
cacuacuugaaagaauuacaga

SEQ ID NO: 136960 - RNA, 22 nt, Human
uuuuccuauaugcaaagaaugc

SEQ ID NO: 136961 - RNA, 22 nt, Human
ggcagagcuugcagugagccga

SEQ ID NO: 136962 - RNA, 22 nt, Human
uuugacagacauuuacuacauu

SEQ ID NO: 136963 - RNA, 22 nt, Human
uguggcccagaugagugugcua

SEQ ID NO: 136964 - RNA, 22 nt, Human
gugagcagaacagguggcuucu

SEQ ID NO: 136965 - RNA, 22 nt, Human
guccucuguagggcugggccac

SEQ ID NO: 136966 - RNA, 21 nt, Human
gggcuggacaugguggcucau

SEQ ID NO: 136967 - RNA, 22 nt, Human
uaugaguacaaggacucugucu

SEQ ID NO: 136968 - RNA, 20 nt, Human
uuugagaccagucugcccaa

SEQ ID NO: 136969 - RNA, 22 nt, Human
acaaaaauuagcugggcauggu

SEQ ID NO: 136970 - RNA, 22 nt, Human
uucuuucccuuccagcagcucc

SEQ ID NO: 136971 - RNA, 22 nt, Human
cauuuacauuuaagguuaauau

SEQ ID NO: 136972 - RNA, 23 nt, Human
agccagggcacugguggagauug

SEQ ID NO: 136973 - RNA, 22 nt, Human
ugcugccuugaccuccugggcu

SEQ ID NO: 136974 - RNA, 17 nt, Human
aaggccauuuccaccca

SEQ ID NO: 136975 - RNA, 22 nt, Human
cuguggcuggccugucugacau

SEQ ID NO: 136976 - RNA, 22 nt, Human
uauuucagcaagaagaaugugg

SEQ ID NO: 136977 - RNA, 22 nt, Human
gccaggcagcagcgaggauggu

SEQ ID NO: 136978 - RNA, 21 nt, Human
cagaggcugagagggcaaucu

SEQ ID NO: 136979 - RNA, 22 nt, Human
uggcuucugggacuugugagca

SEQ ID NO: 136980 - RNA, 21 nt, Human
aggcccagcuuuccucuugcu

SEQ ID NO: 136981 - RNA, 22 nt, Human
ucucuguggagcaguguguuca

SEQ ID NO: 136982 - RNA, 22 nt, Human
uucacagaugccugaugugugg

SEQ ID NO: 136983 - RNA, 22 nt, Human
accacugggcgggcagccugcu

SEQ ID NO: 136984 - RNA, 22 nt, Human
aaggcacuuuucuaaagaccuu

SEQ ID NO: 136985 - RNA, 22 nt, Human
gagagucuaggaaccucauaua

SEQ ID NO: 136986 - RNA, 22 nt, Human
ucucaggaaauaggauuugagu

SEQ ID NO: 136987 - RNA, 22 nt, Human
cuggcaggagcauucacagagg

SEQ ID NO: 136988 - RNA, 22 nt, Human
ccagagccggauugugaagugc

SEQ ID NO: 136989 - RNA, 22 nt, Human
aaugcuguaaagaugcuaucug

SEQ ID NO: 136990 - RNA, 22 nt, Human
gucuucuuguuuugaaggaaau

SEQ ID NO: 136991 - RNA, 22 nt, Human
aaucuuucccuauuaaaugugg

SEQ ID NO: 136992 - RNA, 22 nt, Human
uuauuauuuuguguacagcaaa

SEQ ID NO: 136993 - RNA, 19 nt, Human
ccugcagggaugagagguu

SEQ ID NO: 136994 - RNA, 17 nt, Human
cguggcugagccauaga

SEQ ID NO: 136995 - RNA, 22 nt, Human
uguggcugugguuuucauaaau

SEQ ID NO: 136996 - RNA, 22 nt, Human
acuuuacauuugaucucucuaa

SEQ ID NO: 136997 - RNA, 22 nt, Human
ccagccuggagggcaguggugg

SEQ ID NO: 136998 - RNA, 22 nt, Human
uuaguaaauaaagucuacuuuc

SEQ ID NO: 136999 - RNA, 22 nt, Human
aguggcuguaucagucaacccu

SEQ ID NO: 137000 - RNA, 22 nt, Human
caaauguguaaggaaguguuag

SEQ ID NO: 137001 - RNA, 22 nt, Human
aggcugccaaagcuucugucuc

SEQ ID NO: 137002 - RNA, 22 nt, Human
cauuccuuaacguggggagucu

SEQ ID NO: 137003 - RNA, 22 nt, Human
ugaaugaguuuggcugcuguuc

SEQ ID NO: 137004 - RNA, 22 nt, Human
ugccucugcugcuguggcauca

SEQ ID NO: 137005 - RNA, 22 nt, Human
gcugugcagucuuuggugugcc

SEQ ID NO: 137006 - RNA, 22 nt, Human
cugcagaggucuugcugauggu

SEQ ID NO: 137007 - RNA, 22 nt, Human
acagaggucauggagaguucuc

SEQ ID NO: 137008 - RNA, 22 nt, Human
aguguauguccugaggggagaa

SEQ ID NO: 137009 - RNA, 22 nt, Human
cugggccagucucggccgcucu

SEQ ID NO: 137010 - RNA, 22 nt, Human
cagagugaaauaggggaucaag

SEQ ID NO: 137011 - RNA, 22 nt, Human
cagcuggggcagccacgugcgg

SEQ ID NO: 137012 - RNA, 22 nt, Human
ucucagagugguggucccucug

SEQ ID NO: 137013 - RNA, 22 nt, Human
guuauguaaucuaacacucagu

SEQ ID NO: 137014 - RNA, 22 nt, Human
ugccaggccucaggagucucca

SEQ ID NO: 137015 - RNA, 22 nt, Human
caguauguuugggagacaugac

SEQ ID NO: 137016 - RNA, 22 nt, Human
cuuucucuguggugaggagggu

SEQ ID NO: 137017 - RNA, 22 nt, Human
uuauuugcugauuucaguuuca

SEQ ID NO: 137018 - RNA, 22 nt, Human
gcugucacacauggccccagcu

SEQ ID NO: 137019 - RNA, 22 nt, Human
uuccugugaagaucugggugcu

SEQ ID NO: 137020 - RNA, 22 nt, Human
cagggccaccguguuugcugcu

SEQ ID NO: 137021 - RNA, 22 nt, Human
uugguuuaggaacuggcuugga

SEQ ID NO: 137022 - RNA, 22 nt, Human
ucugggagcacacgcagugauc

SEQ ID NO: 137023 - RNA, 21 nt, Human
aagcuucccugcucuccaggg

SEQ ID NO: 137024 - RNA, 22 nt, Human
caagccucagaaucuucuccau

SEQ ID NO: 137025 - RNA, 22 nt, Human
caagaaaugggauuugacugcc

SEQ ID NO: 137026 - RNA, 22 nt, Human
cucuggaguuagugaucugggc

SEQ ID NO: 137027 - RNA, 22 nt, Human
uagaaacauauaggauggcagg

SEQ ID NO: 137028 - RNA, 21 nt, Human
cucuggagucaagagcuucca

SEQ ID NO: 137029 - RNA, 22 nt, Human
cugggggcaauggucagagugu

SEQ ID NO: 137030 - RNA, 22 nt, Human
cuucaagauccauagauauugc

SEQ ID NO: 137031 - RNA, 22 nt, Human
ggccugagaaccauggggccaa

SEQ ID NO: 137032 - RNA, 17 nt, Human
agucauauugugcaguu

SEQ ID NO: 137033 - RNA, 22 nt, Human
cucugggcuuguugaccugcac

SEQ ID NO: 137034 - RNA, 22 nt, Human
uuuauuauucuguucucucuac

SEQ ID NO: 137035 - RNA, 22 nt, Human
uggcuguggguggaaggaaacc

SEQ ID NO: 137036 - RNA, 22 nt, Human
uuuuccucugcagagcaguuag

SEQ ID NO: 137037 - RNA, 22 nt, Human
uucucuauguguguuguaguuu

SEQ ID NO: 137038 - RNA, 20 nt, Human
gucaggauuaguaaacucug

SEQ ID NO: 137039 - RNA, 22 nt, Human
ucuggccaggauggcaagacca

SEQ ID NO: 137040 - RNA, 22 nt, Human
gguuggggcgagcuggaggccc

SEQ ID NO: 137041 - RNA, 22 nt, Human
ugccucugugggccuuccuggc

SEQ ID NO: 137042 - RNA, 22 nt, Human
gugggugucaguaucuuuaacg

SEQ ID NO: 137043 - RNA, 22 nt, Human
agccagagagccccagguucua

SEQ ID NO: 137044 - RNA, 21 nt, Human
gggugggaggacacagcaggc

SEQ ID NO: 137045 - RNA, 22 nt, Human
gugaaggacuagcauggagggc

SEQ ID NO: 137046 - RNA, 22 nt, Human
gcacagccacugagugagaacc

SEQ ID NO: 137047 - RNA, 22 nt, Human
uagaguauagcuaacuguauua

SEQ ID NO: 137048 - RNA, 22 nt, Human
ucuccuuugaaaguuaggacug

SEQ ID NO: 137049 - RNA, 22 nt, Human
acugaaggcuuucccaagguca

SEQ ID NO: 137050 - RNA, 22 nt, Human
uggcccugacacgugguacugg

SEQ ID NO: 137051 - RNA, 22 nt, Human
ugucacauaauuuaucuguagg

SEQ ID NO: 137052 - RNA, 20 nt, Human
ucauccaggacaggaguggc

SEQ ID NO: 137053 - RNA, 22 nt, Human
ggcucugcuggauugaggccag

SEQ ID NO: 137054 - RNA, 17 nt, Human
ugagaaguaggcaucau

SEQ ID NO: 137055 - RNA, 22 nt, Human
aaggccugcucagcugucugug

SEQ ID NO: 137056 - RNA, 22 nt, Human
aaaaaugaauucuucaguggca

SEQ ID NO: 137057 - RNA, 22 nt, Human
uggcuuccuggacagaugcggu

SEQ ID NO: 137058 - RNA, 22 nt, Human
uucuuuucuuuaggcauugugu

SEQ ID NO: 137059 - RNA, 22 nt, Human
uuguauuugauugucauaucgu

SEQ ID NO: 137060 - RNA, 22 nt, Human
ucauucuugaucacuaguuagu

SEQ ID NO: 137061 - RNA, 22 nt, Human
cagggccauaucuugugcacca

SEQ ID NO: 137062 - RNA, 22 nt, Human
auaaggcagucccuuaacaagg

SEQ ID NO: 137063 - RNA, 22 nt, Human
ucugggaagcugcgugccuguu

SEQ ID NO: 137064 - RNA, 22 nt, Human
aguaucuucaaguuucuucuag

SEQ ID NO: 137065 - RNA, 22 nt, Human
guggugcauccuugaguaagcu

SEQ ID NO: 137066 - RNA, 22 nt, Human
acauuucuuuucaucucuauau

SEQ ID NO: 137067 - RNA, 22 nt, Human
caagagcucaccggagagcauu

SEQ ID NO: 137068 - RNA, 22 nt, Human
acagaagagcacauuuaguaug

SEQ ID NO: 137069 - RNA, 22 nt, Human
gcccagcacagcuggaagaguc

SEQ ID NO: 137070 - RNA, 22 nt, Human
gugucccagccccacaggccug

SEQ ID NO: 137071 - RNA, 22 nt, Human
guggccugaugccagcccugug

SEQ ID NO: 137072 - RNA, 22 nt, Human
aucaggauguuuggcugucaua

SEQ ID NO: 137073 - RNA, 22 nt, Human
uguauguguauguacauaugca

SEQ ID NO: 137074 - RNA, 22 nt, Human
agagcugaauuuggguggugga

SEQ ID NO: 137075 - RNA, 23 nt, Human
cugcugugaaacaugguuuuggu

SEQ ID NO: 137076 - RNA, 22 nt, Human
ccacucugcugugcuccaugau

SEQ ID NO: 137077 - RNA, 22 nt, Human
uauguagaagcugcucaaagaa

SEQ ID NO: 137078 - RNA, 20 nt, Human
uaacagaaguagaagugggu

SEQ ID NO: 137079 - RNA, 22 nt, Human
aagaaauuaaggaaugcaacga

SEQ ID NO: 137080 - RNA, 21 nt, Human
agagcugggacuugccugaga

SEQ ID NO: 137081 - RNA, 22 nt, Human
gggcuugcugauuugggcagga

SEQ ID NO: 137082 - RNA, 22 nt, Human
cuuucaguuaguaccuaguggc

SEQ ID NO: 137083 - RNA, 20 nt, Human
agcccaggccugugugaguc

SEQ ID NO: 137084 - RNA, 22 nt, Human
aagcugccaccagcccagggca

SEQ ID NO: 137085 - RNA, 22 nt, Human
ugccuguccugaggaugagggu

SEQ ID NO: 137086 - RNA, 22 nt, Human
uacauguauugauuucucuucu

SEQ ID NO: 137087 - RNA, 22 nt, Human
aaaggcuaugagauagaagaua

SEQ ID NO: 137088 - RNA, 22 nt, Human
ccugggaagagcugacaggagg

SEQ ID NO: 137089 - RNA, 22 nt, Human
ggcugguguugagugccuguag

SEQ ID NO: 137090 - RNA, 22 nt, Human
ucaguuuuguauguuguaaguc

SEQ ID NO: 137091 - RNA, 22 nt, Human
aggcugugagaaguccuucagu

SEQ ID NO: 137092 - RNA, 22 nt, Human
ggccucucucccuggcuugcag

SEQ ID NO: 137093 - RNA, 22 nt, Human
aggccuggccuuuauguucaag

SEQ ID NO: 137094 - RNA, 22 nt, Human
ccagaggucuccugcacgggau

SEQ ID NO: 137095 - RNA, 22 nt, Human
agcccuucaaccugccuacucc

SEQ ID NO: 137096 - RNA, 22 nt, Human
ucugagccguauggcuuggcua

SEQ ID NO: 137097 - RNA, 22 nt, Human
cuuccugguuugaagcucgccg

SEQ ID NO: 137098 - RNA, 22 nt, Human
aggcaggcucaggcccaugcuu

SEQ ID NO: 137099 - RNA, 22 nt, Human
gaguuguucaacgugugugaaa

SEQ ID NO: 137100 - RNA, 22 nt, Human
ucagggcaggacaguguaggcc

SEQ ID NO: 137101 - RNA, 22 nt, Human
ucaggaggccaccaggaccugu

SEQ ID NO: 137102 - RNA, 22 nt, Human
aaauuaguacauugcaaagucc

SEQ ID NO: 137103 - RNA, 22 nt, Human
cugcagcuccccugagaucaag

SEQ ID NO: 137104 - RNA, 22 nt, Human
cccccuggcaggcuggccucuc

SEQ ID NO: 137105 - RNA, 22 nt, Human
uauguucuagacuuuugcugug

SEQ ID NO: 137106 - RNA, 22 nt, Human
ccuggagcacagcccaguccca

SEQ ID NO: 137107 - RNA, 22 nt, Human
aguggcagagcugugucuugaa

SEQ ID NO: 137108 - RNA, 22 nt, Human
uacagugaaugaauggcugugc

SEQ ID NO: 137109 - RNA, 22 nt, Human
agaguauaauuagugucuucua

SEQ ID NO: 137110 - RNA, 22 nt, Human
aacucaguguguuucuuaguau

SEQ ID NO: 137111 - RNA, 22 nt, Human
ccaggaggcagagguuacagug

SEQ ID NO: 137112 - RNA, 22 nt, Human
ucacuggggccuuuggucagga

SEQ ID NO: 137113 - RNA, 22 nt, Human
aaaucugggagcagcucggcca

SEQ ID NO: 137114 - RNA, 22 nt, Human
ugucccagacauaaguggacau

SEQ ID NO: 137115 - RNA, 22 nt, Human
acaauguaggauauguacuugu

SEQ ID NO: 137116 - RNA, 21 nt, Human
auguggcucccuuccucagga

SEQ ID NO: 137117 - RNA, 22 nt, Human
ggcaggugcucugugggccugg

SEQ ID NO: 137118 - RNA, 22 nt, Human
cucugagaaagcugugagcuaa

SEQ ID NO: 137119 - RNA, 22 nt, Human
cagccugacaccagcuuugggc

SEQ ID NO: 137120 - RNA, 22 nt, Human
cauugucacccaaagcucauag

SEQ ID NO: 137121 - RNA, 22 nt, Human
aggcucagauucacauuugguu

SEQ ID NO: 137122 - RNA, 22 nt, Human
acacugaaugcuguuuagaaau

SEQ ID NO: 137123 - RNA, 22 nt, Human
ccagggcaucacauccaguguu

SEQ ID NO: 137124 - RNA, 22 nt, Human
uuuuccucugcaauaaaagcag

SEQ ID NO: 137125 - RNA, 22 nt, Human
agggcagcauugccuuucucca

SEQ ID NO: 137126 - RNA, 19 nt, Human
auaaggcaauuggauuugg

SEQ ID NO: 137127 - RNA, 22 nt, Human
agaauguagucuuggagauuua

SEQ ID NO: 137128 - RNA, 22 nt, Human
agccuggauccuaggcucagcu

SEQ ID NO: 137129 - RNA, 22 nt, Human
agcuggaggauaacucacuucu

SEQ ID NO: 137130 - RNA, 22 nt, Human
agcugagcacauucaaacaggu

SEQ ID NO: 137131 - RNA, 22 nt, Human
cccuggagcaucucugcugucu

SEQ ID NO: 137132 - RNA, 22 nt, Human
gauggguggucucagacuugcc

SEQ ID NO: 137133 - RNA, 22 nt, Human
gugcuuccccaagccacagccu

SEQ ID NO: 137134 - RNA, 22 nt, Human
auacauacguacauacguaugu

SEQ ID NO: 137135 - RNA, 22 nt, Human
ggcagcuggggcagugcccugu

SEQ ID NO: 137136 - RNA, 22 nt, Human
ugcagaggagcuggaaggcugg

SEQ ID NO: 137137 - RNA, 22 nt, Human
cuggccugaggccgccuucaga

SEQ ID NO: 137138 - RNA, 17 nt, Human
cagacagauauccuggg

SEQ ID NO: 137139 - RNA, 22 nt, Human
uuucucucuggcccugauuguc

SEQ ID NO: 137140 - RNA, 22 nt, Human
ccagggugggaggcugaaggcg

SEQ ID NO: 137141 - RNA, 19 nt, Human
aggugaugugacucuagaa

SEQ ID NO: 137142 - RNA, 22 nt, Human
acuucuuucacaauguuucuag

SEQ ID NO: 137143 - RNA, 22 nt, Human
guucauuuuacuguaaauagca

SEQ ID NO: 137144 - RNA, 22 nt, Human
cuggguggcuguccagccagcc

SEQ ID NO: 137145 - RNA, 22 nt, Human
auucuccaucaccacuggcacu

SEQ ID NO: 137146 - RNA, 22 nt, Human
cgccucagccguggucaucuuc

SEQ ID NO: 137147 - RNA, 22 nt, Human
cuguaugaggaucagacuggac

SEQ ID NO: 137148 - RNA, 22 nt, Human
gcugcucuccauggccgugagu

SEQ ID NO: 137149 - RNA, 22 nt, Human
acauuucuuagccuaguuccag

SEQ ID NO: 137150 - RNA, 22 nt, Human
ggacaggguaaguacuagugug

SEQ ID NO: 137151 - RNA, 22 nt, Human
gucccucugugucccugcaguc

SEQ ID NO: 137152 - RNA, 22 nt, Human
cagcagaggaaagcaaaucuaa

SEQ ID NO: 137153 - RNA, 22 nt, Human
agaauccugaugaaaaggagag

SEQ ID NO: 137154 - RNA, 22 nt, Human
gcuccagaugaaaggccagagg

SEQ ID NO: 137155 - RNA, 22 nt, Human
cagcugggagcuccauuagaua

SEQ ID NO: 137156 - RNA, 21 nt, Human
acagccugucaucucaugguc

SEQ ID NO: 137157 - RNA, 22 nt, Human
ucugcaggaggcuggcugcagg

SEQ ID NO: 137158 - RNA, 22 nt, Human
cuggggcccaucgagggcugag

SEQ ID NO: 137159 - RNA, 22 nt, Human
augauuuccaguuguugcuaag

SEQ ID NO: 137160 - RNA, 21 nt, Human
ggcugguguuuagcugugaua

SEQ ID NO: 137161 - RNA, 21 nt, Human
cugcucuggggaccggcugug

SEQ ID NO: 137162 - RNA, 22 nt, Human
cagcucugugcaggccugggga

SEQ ID NO: 137163 - RNA, 22 nt, Human
gccaggcauucuagaaguagug

SEQ ID NO: 137164 - RNA, 22 nt, Human
uguacaaugccagggaacacca

SEQ ID NO: 137165 - RNA, 22 nt, Human
cuguguauugaaaaaggguuaa

SEQ ID NO: 137166 - RNA, 22 nt, Human
cacugaaggcuaggauuagaug

SEQ ID NO: 137167 - RNA, 22 nt, Human
aacacaaagaagcugcaggauc

SEQ ID NO: 137168 - RNA, 22 nt, Human
ugagagggcccagagcacacca

SEQ ID NO: 137169 - RNA, 22 nt, Human
augcaucuauucccaagggcag

SEQ ID NO: 137170 - RNA, 22 nt, Human
cagagcuguugcggggcuuggc

SEQ ID NO: 137171 - RNA, 22 nt, Human
gugugugucuccgcggccguag

SEQ ID NO: 137172 - RNA, 22 nt, Human
agcuuccuguugagagagggag

SEQ ID NO: 137173 - RNA, 18 nt, Human
acauuucuccuucugacc

SEQ ID NO: 137174 - RNA, 22 nt, Human
acauguuagaaaugcagaaucu

SEQ ID NO: 137175 - RNA, 22 nt, Human
agaauuuuugauuaucuacucg

SEQ ID NO: 137176 - RNA, 22 nt, Human
uacaguaaccagucuacuuaga

SEQ ID NO: 137177 - RNA, 22 nt, Human
uguuuuaugagccauauaaccu

SEQ ID NO: 137178 - RNA, 22 nt, Human
cugggcagugguggcaucuuug

SEQ ID NO: 137179 - RNA, 22 nt, Human
ugccacagaggugaagcccacu

SEQ ID NO: 137180 - RNA, 22 nt, Human
auaaggaaugauguaucaguuu

SEQ ID NO: 137181 - RNA, 22 nt, Human
aaguaugacauuuaagacaauu

SEQ ID NO: 137182 - RNA, 22 nt, Human
ggaaggaggaugcucuggccuu

SEQ ID NO: 137183 - RNA, 22 nt, Human
ugggcagauguggcucuccuug

SEQ ID NO: 137184 - RNA, 19 nt, Human
ggcagaagguguaggggga

SEQ ID NO: 137185 - RNA, 22 nt, Human
caggggcuguggcacauggugu

SEQ ID NO: 137186 - RNA, 22 nt, Human
ggcagcagcaagguuggagcug

SEQ ID NO: 137187 - RNA, 22 nt, Human
uaccauuucauucuuuccucau

SEQ ID NO: 137188 - RNA, 22 nt, Human
ggcaguggugggaggcucgcuc

SEQ ID NO: 137189 - RNA, 22 nt, Human
ucccuggggauguuggccugcc

SEQ ID NO: 137190 - RNA, 22 nt, Human
gugcuuucugcugcauuccucu

SEQ ID NO: 137191 - RNA, 22 nt, Human
ccaagggcucugacuugccugc

SEQ ID NO: 137192 - RNA, 22 nt, Human
ucauuuguugcuguuaccugag

SEQ ID NO: 137193 - RNA, 22 nt, Human
aaucacaauuacuuuugcacca

SEQ ID NO: 137194 - RNA, 22 nt, Human
aagcacuuagaagagugccugc

SEQ ID NO: 137195 - RNA, 22 nt, Human
acaguagagcauuuguuuugau

SEQ ID NO: 137196 - RNA, 22 nt, Human
ucaggauggcuucugcaucaaa

SEQ ID NO: 137197 - RNA, 22 nt, Human
uggugcugacaguucugagugc

SEQ ID NO: 137198 - RNA, 22 nt, Human
ggaggcucugcuccguguguuc

SEQ ID NO: 137199 - RNA, 22 nt, Human
ggucucaggagacuggagagca

SEQ ID NO: 137200 - RNA, 22 nt, Human
agguggggugagcugcagacua

SEQ ID NO: 137201 - RNA, 22 nt, Human
gaagcagcaaguauaggacagg

SEQ ID NO: 137202 - RNA, 22 nt, Human
uggguagagcaggcuggggcuu

SEQ ID NO: 137203 - RNA, 22 nt, Human
augauacaucuucaugucagug

SEQ ID NO: 137204 - RNA, 22 nt, Human
uguguauuaccauuuuacagcu

SEQ ID NO: 137205 - RNA, 22 nt, Human
cugggagauugcuagagaugca

SEQ ID NO: 137206 - RNA, 22 nt, Human
agaguggggaagguguugagaa

SEQ ID NO: 137207 - RNA, 22 nt, Human
ugucuucagcaaaugccuuucu

SEQ ID NO: 137208 - RNA, 22 nt, Human
ggaggagacaguaaaaagcacg

SEQ ID NO: 137209 - RNA, 22 nt, Human
cuuaaauuuucaucuacaagaa

SEQ ID NO: 137210 - RNA, 22 nt, Human
ugggggagauuagagcuucuua

SEQ ID NO: 137211 - RNA, 22 nt, Human
uccuucaaagcuccuagugagc

SEQ ID NO: 137212 - RNA, 22 nt, Human
uacagauagaauuagugaguua

SEQ ID NO: 137213 - RNA, 22 nt, Human
agagcugcccacacagcagauu

SEQ ID NO: 137214 - RNA, 22 nt, Human
agagcagccugugaugaugcac

SEQ ID NO: 137215 - RNA, 22 nt, Human
ccagccagccuugaucugagua

SEQ ID NO: 137216 - RNA, 23 nt, Human
uaguuauuuucucuguaauuugc

SEQ ID NO: 137217 - RNA, 19 nt, Human
gccagcagaaugaugaggc

SEQ ID NO: 137218 - RNA, 22 nt, Human
agcaggcagccauuuggaaggc

SEQ ID NO: 137219 - RNA, 22 nt, Human
aaacuguauauuuauggcaugu

SEQ ID NO: 137220 - RNA, 22 nt, Human
aaugcuguauaucuuagcuaau

SEQ ID NO: 137221 - RNA, 22 nt, Human
ugaaggccagcucuuuaucagc

SEQ ID NO: 137222 - RNA, 18 nt, Human
cacaggcucccagugagg

SEQ ID NO: 137223 - RNA, 22 nt, Human
caggaggccaacugugggacuu

SEQ ID NO: 137224 - RNA, 22 nt, Human
ccuccaaguuugacucaggaca

SEQ ID NO: 137225 - RNA, 20 nt, Human
uuauguguaccugugcuccc

SEQ ID NO: 137226 - RNA, 22 nt, Human
cagcagggaagcugugcuguuu

SEQ ID NO: 137227 - RNA, 22 nt, Human
ccuggguggcagagguugcagu

SEQ ID NO: 137228 - RNA, 22 nt, Human
uggagcaggugccaggugugug

SEQ ID NO: 137229 - RNA, 22 nt, Human
uggcucuguuuuaugaguacca

SEQ ID NO: 137230 - RNA, 22 nt, Human
ucccugggcaucacguugcuuc

SEQ ID NO: 137231 - RNA, 22 nt, Human
uagggcuauaagagaauaagac

SEQ ID NO: 137232 - RNA, 22 nt, Human
gcagguggauuaucagaagugc

SEQ ID NO: 137233 - RNA, 22 nt, Human
uaugcacaguuacaagaauauc

SEQ ID NO: 137234 - RNA, 22 nt, Human
cuccucugucuggcccugagcc

SEQ ID NO: 137235 - RNA, 22 nt, Human
ggcaucuguccaucucuccagc

SEQ ID NO: 137236 - RNA, 22 nt, Human
gugacugugagucgcugugaca

SEQ ID NO: 137237 - RNA, 21 nt, Human
guggcccugguguggcugcac

SEQ ID NO: 137238 - RNA, 19 nt, Human
uugaaauuguuugauaugg

SEQ ID NO: 137239 - RNA, 22 nt, Human
agaugagggguagaaaggacuu

SEQ ID NO: 137240 - RNA, 22 nt, Human
gcugagcugcuguucauccugc

SEQ ID NO: 137241 - RNA, 22 nt, Human
ugucuucaguaaaauacacuau

SEQ ID NO: 137242 - RNA, 22 nt, Human
ccagcugagaaguguaaaguga

SEQ ID NO: 137243 - RNA, 22 nt, Human
ucuuuccuuagaauaauucuuu

SEQ ID NO: 137244 - RNA, 22 nt, Human
aagcugccauagaacgagaggu

SEQ ID NO: 137245 - RNA, 22 nt, Human
auacaguauuaccuguucagga

SEQ ID NO: 137246 - RNA, 22 nt, Human
ucuuuccuaggugauaugcaau

SEQ ID NO: 137247 - RNA, 22 nt, Human
accguauauguuugcugugccc

SEQ ID NO: 137248 - RNA, 22 nt, Human
aacauacauauuucagugucca

SEQ ID NO: 137249 - RNA, 22 nt, Human
ucuggccugaaaguccaugcuu

SEQ ID NO: 137250 - RNA, 22 nt, Human
agcuuccucaccucagaggucu

SEQ ID NO: 137251 - RNA, 22 nt, Human
ggggcuguuuuuggaauggcug

SEQ ID NO: 137252 - RNA, 22 nt, Human
aagcagccaccucaucuccacu

SEQ ID NO: 137253 - RNA, 22 nt, Human
aucuacagcugucugcacagua

SEQ ID NO: 137254 - RNA, 22 nt, Human
guggagccaggggcuguaggua

SEQ ID NO: 137255 - RNA, 22 nt, Human
cagaauggcuuuuauggcucag

SEQ ID NO: 137256 - RNA, 22 nt, Human
ucccagaguauuagcaauugcu

SEQ ID NO: 137257 - RNA, 18 nt, Human
cucaccauucugcccaau

SEQ ID NO: 137258 - RNA, 22 nt, Human
uugcuuccucgaggccagcgug

SEQ ID NO: 137259 - RNA, 22 nt, Human
ccacaggggucucuguagcuga

SEQ ID NO: 137260 - RNA, 22 nt, Human
aagcaggcauuccagagacaau

SEQ ID NO: 137261 - RNA, 22 nt, Human
ccagcaggcagucauauccuuu

SEQ ID NO: 137262 - RNA, 22 nt, Human
aagcugcccucauucccagugc

SEQ ID NO: 137263 - RNA, 22 nt, Human
guguguggcaaacugggccugc

SEQ ID NO: 137264 - RNA, 20 nt, Human
augugucuguaaacaacucu

SEQ ID NO: 137265 - RNA, 22 nt, Human
gauggcagcagcagccagggau

SEQ ID NO: 137266 - RNA, 22 nt, Human
ggcugccucugaugugcagacg

SEQ ID NO: 137267 - RNA, 22 nt, Human
cuugggagacacaagaagacau

SEQ ID NO: 137268 - RNA, 22 nt, Human
uugacaauugggagauauaaag

SEQ ID NO: 137269 - RNA, 22 nt, Human
uacaggauaucacuucauuucu

SEQ ID NO: 137270 - RNA, 22 nt, Human
ugguuugcccacucgagugauu

SEQ ID NO: 137271 - RNA, 22 nt, Human
caggagcagaggguggucagca

SEQ ID NO: 137272 - RNA, 22 nt, Human
aaauaauugaguuggucaauau

SEQ ID NO: 137273 - RNA, 22 nt, Human
cagccucucuguaucucaggau

SEQ ID NO: 137274 - RNA, 22 nt, Human
agccucugauggcucccaagga

SEQ ID NO: 137275 - RNA, 22 nt, Human
gaggacagugugaucugccagc

SEQ ID NO: 137276 - RNA, 22 nt, Human
uuccauuuauucuuguccagau

SEQ ID NO: 137277 - RNA, 22 nt, Human
ucugaaagaagggcagucuuuu

SEQ ID NO: 137278 - RNA, 22 nt, Human
aggcuucuuagauuggcuggag

SEQ ID NO: 137279 - RNA, 22 nt, Human
gaggagcacaugaggcugaggg

SEQ ID NO: 137280 - RNA, 21 nt, Human
acaguacuugagaucuuuuga

SEQ ID NO: 137281 - RNA, 22 nt, Human
ucugagaggauuccugucccga

SEQ ID NO: 137282 - RNA, 22 nt, Human
ccagucacuggaaaaugggaau

SEQ ID NO: 137283 - RNA, 22 nt, Human
ccacugucagaggggcugugcc

SEQ ID NO: 137284 - RNA, 22 nt, Human
ugcaauaacuacuuuaauguug

SEQ ID NO: 137285 - RNA, 22 nt, Human
uggaccugcuggaugggcaggu

SEQ ID NO: 137286 - RNA, 22 nt, Human
uccagagguauguagagaguau

SEQ ID NO: 137287 - RNA, 22 nt, Human
uugacaagaaucguugccuugg

SEQ ID NO: 137288 - RNA, 22 nt, Human
gaaagaagcuuuagauggcuau

SEQ ID NO: 137289 - RNA, 22 nt, Human
auaaggcagucacuggaauguu

SEQ ID NO: 137290 - RNA, 22 nt, Human
agggccucugacgcccccagcc

SEQ ID NO: 137291 - RNA, 22 nt, Human
gcagagguggcaucugggcucu

SEQ ID NO: 137292 - RNA, 21 nt, Human
acuuuacaauuuacauaguga

SEQ ID NO: 137293 - RNA, 22 nt, Human
auuugcagagcucugaauuuug

SEQ ID NO: 137294 - RNA, 22 nt, Human
auguguauuuccaucgaucagc

SEQ ID NO: 137295 - RNA, 22 nt, Human
uguguacaggccuugcuagacu

SEQ ID NO: 137296 - RNA, 22 nt, Human
aggcugugcucagccaauggga

SEQ ID NO: 137297 - RNA, 22 nt, Human
acaggcagcacuaaucucuggu

SEQ ID NO: 137298 - RNA, 22 nt, Human
acagugauugguuuggggguga

SEQ ID NO: 137299 - RNA, 22 nt, Human
uuagggcuuuucugaauaggcc

SEQ ID NO: 137300 - RNA, 22 nt, Human
cagagacagaaaauggaucuag

SEQ ID NO: 137301 - RNA, 22 nt, Human
gccagggaacccaagggccuca

SEQ ID NO: 137302 - RNA, 22 nt, Human
agucucugccagcuuguccucu

SEQ ID NO: 137303 - RNA, 22 nt, Human
auguuuuauauuuugcagcagu

SEQ ID NO: 137304 - RNA, 22 nt, Human
cuucuuuaccaagagauagagu

SEQ ID NO: 137305 - RNA, 22 nt, Human
acagcaagccagcuugucacug

SEQ ID NO: 137306 - RNA, 22 nt, Human
ucucuguggugggaggcugagu

SEQ ID NO: 137307 - RNA, 22 nt, Human
ugggugaggaugaugaggcagc

SEQ ID NO: 137308 - RNA, 22 nt, Human
ucuggauggucagcucuuccug

SEQ ID NO: 137309 - RNA, 22 nt, Human
gugggugucucaagaauggggg

SEQ ID NO: 137310 - RNA, 22 nt, Human
augucacagucugacucaguga

SEQ ID NO: 137311 - RNA, 22 nt, Human
gugugucagguacugugcuagg

SEQ ID NO: 137312 - RNA, 20 nt, Human
uggagcuguaaucuugucug

SEQ ID NO: 137313 - RNA, 22 nt, Human
ggugugugguuuugauacaguc

SEQ ID NO: 137314 - RNA, 22 nt, Human
ugugccugaguuggcugaguac

SEQ ID NO: 137315 - RNA, 20 nt, Human
agcaggaaugaugcuuucau

SEQ ID NO: 137316 - RNA, 22 nt, Human
ucuuuccuguaacugcuguuca

SEQ ID NO: 137317 - RNA, 22 nt, Human
cccaccaguacagaugguagau

SEQ ID NO: 137318 - RNA, 22 nt, Human
uggccugccugggagcagcagg

SEQ ID NO: 137319 - RNA, 22 nt, Human
aagaguuuucuauaaucuuggc

SEQ ID NO: 137320 - RNA, 22 nt, Human
uuccaaaggaauggggagcuau

SEQ ID NO: 137321 - RNA, 22 nt, Human
uugucugucccagcuugugcau

SEQ ID NO: 137322 - RNA, 22 nt, Human
gcagcuggacccacacggcuua

SEQ ID NO: 137323 - RNA, 22 nt, Human
ucacaugcccuguauuuaccag

SEQ ID NO: 137324 - RNA, 22 nt, Human
ggcagcucugugucugggaagc

SEQ ID NO: 137325 - RNA, 22 nt, Human
cuguccucuguccucagcagga

SEQ ID NO: 137326 - RNA, 19 nt, Human
aggucauugauagugcagg

SEQ ID NO: 137327 - RNA, 22 nt, Human
ugggccacuugaaaguggaugu

SEQ ID NO: 137328 - RNA, 22 nt, Human
aaggagaaaugguagaugugca

SEQ ID NO: 137329 - RNA, 19 nt, Human
cuauacagccucugaggaa

SEQ ID NO: 137330 - RNA, 22 nt, Human
cucucugagugagggacaagcu

SEQ ID NO: 137331 - RNA, 22 nt, Human
gggcucugggaugcucuuagag

SEQ ID NO: 137332 - RNA, 21 nt, Human
ugggcagauggcaguguggcu

SEQ ID NO: 137333 - RNA, 22 nt, Human
ucuggcuggcagugauggugug

SEQ ID NO: 137334 - RNA, 22 nt, Human
gcacagaacagagaaauagcca

SEQ ID NO: 137335 - RNA, 22 nt, Human
uccugcagagacagaggccuca

SEQ ID NO: 137336 - RNA, 21 nt, Human
agcagaggcagaauguaugca

SEQ ID NO: 137337 - RNA, 22 nt, Human
caggaggaaaugugacccugcu

SEQ ID NO: 137338 - RNA, 22 nt, Human
agucacuguucugucaugucaa

SEQ ID NO: 137339 - RNA, 22 nt, Human
ccaggagucaauaaaggaagcu

SEQ ID NO: 137340 - RNA, 20 nt, Human
agcuggccuguccuaggccu

SEQ ID NO: 137341 - RNA, 22 nt, Human
gggacuggaacuacuggugcag

SEQ ID NO: 137342 - RNA, 22 nt, Human
cccagccuggugcacugugggg

SEQ ID NO: 137343 - RNA, 22 nt, Human
uacaguuucuguccuuguggag

SEQ ID NO: 137344 - RNA, 22 nt, Human
uuuccugucuuuugugaaggau

SEQ ID NO: 137345 - RNA, 22 nt, Human
aagacuuucucccaaauccuca

SEQ ID NO: 137346 - RNA, 22 nt, Human
gugccugguuuggggaauguuc

SEQ ID NO: 137347 - RNA, 22 nt, Human
uccugagauucugcauuucuaa

SEQ ID NO: 137348 - RNA, 22 nt, Human
gccugagagucugcauuucuaa

SEQ ID NO: 137349 - RNA, 22 nt, Human
uggcauguggcaauguugggau

SEQ ID NO: 137350 - RNA, 22 nt, Human
cuccauugaacauccucucaga

SEQ ID NO: 137351 - RNA, 22 nt, Human
gcaggguauaauacuuagguga

SEQ ID NO: 137352 - RNA, 22 nt, Human
aguuuauguaaaauuaguaaug

SEQ ID NO: 137353 - RNA, 22 nt, Human
uucaguaugcugaaugauuuuu

SEQ ID NO: 137354 - RNA, 22 nt, Human
gcacacagauuaggaaacagaa

SEQ ID NO: 137355 - RNA, 22 nt, Human
uccaggagagguguggggacug

SEQ ID NO: 137356 - RNA, 22 nt, Human
acugucuuccaggucuggaggu

SEQ ID NO: 137357 - RNA, 22 nt, Human
ucaagcaggguagcaagcuggu

SEQ ID NO: 137358 - RNA, 22 nt, Human
ugccugaguuuaacccucagag

SEQ ID NO: 137359 - RNA, 22 nt, Human
gcugagcuagaaaaggaccaca

SEQ ID NO: 137360 - RNA, 18 nt, Human
agaguguucucagugaaa

SEQ ID NO: 137361 - RNA, 22 nt, Human
uugugaaauguuucaaaauagu

SEQ ID NO: 137362 - RNA, 22 nt, Human
ggcucccugccuguccucaguc

SEQ ID NO: 137363 - RNA, 22 nt, Human
uggagaugaauauguguaccug

SEQ ID NO: 137364 - RNA, 22 nt, Human
aaagucauguaaugauaugauu

SEQ ID NO: 137365 - RNA, 22 nt, Human
ucuuugcauggacauguguuuu

SEQ ID NO: 137366 - RNA, 22 nt, Human
aauaauguugacgauagucuua

SEQ ID NO: 137367 - RNA, 22 nt, Human
cacauaaguggguuccauugca

SEQ ID NO: 137368 - RNA, 22 nt, Human
gaggggcuggcacgauggcugc

SEQ ID NO: 137369 - RNA, 22 nt, Human
ucacaacuugaagcugauuuaa

SEQ ID NO: 137370 - RNA, 22 nt, Human
uagcuuuuauccacugcuuuug

SEQ ID NO: 137371 - RNA, 22 nt, Human
uguguccauucaggcacugacc

SEQ ID NO: 137372 - RNA, 22 nt, Human
uuacagaaucuacucgugguga

SEQ ID NO: 137373 - RNA, 22 nt, Human
ucuucagagugaaagucuguga

SEQ ID NO: 137374 - RNA, 22 nt, Human
uggccuugggcagguggccugc

SEQ ID NO: 137375 - RNA, 22 nt, Human
gccugcagggugaugggcugcc

SEQ ID NO: 137376 - RNA, 22 nt, Human
ugaaaaggagccuuagguaggu

SEQ ID NO: 137377 - RNA, 22 nt, Human
aggaagccuggggcugcccucg

SEQ ID NO: 137378 - RNA, 22 nt, Human
gugcaugcacacaugugugagg

SEQ ID NO: 137379 - RNA, 22 nt, Human
uuguuaaaaugcauauucuggu

SEQ ID NO: 137380 - RNA, 22 nt, Human
uauuucugauugcucaugaggc

SEQ ID NO: 137381 - RNA, 22 nt, Human
ucagcugcucuguugagcugaa

SEQ ID NO: 137382 - RNA, 22 nt, Human
aggugaguuacaggaggagguc

SEQ ID NO: 137383 - RNA, 22 nt, Human
uucuucuucaagugcugcauuc

SEQ ID NO: 137384 - RNA, 22 nt, Human
uaaauucuacaacuucaaagau

SEQ ID NO: 137385 - RNA, 22 nt, Human
cucuuuacugcuacuacaaaga

SEQ ID NO: 137386 - RNA, 22 nt, Human
uaauuuaauccaaguguuacau

SEQ ID NO: 137387 - RNA, 22 nt, Human
acauguauacaauguguaauga

SEQ ID NO: 137388 - RNA, 22 nt, Human
guucuccauucagcuuccugug

SEQ ID NO: 137389 - RNA, 22 nt, Human
augauucagcaauuuuauaucu

SEQ ID NO: 137390 - RNA, 22 nt, Human
cuucuuuagggaucucuugcug

SEQ ID NO: 137391 - RNA, 22 nt, Human
gcaaaugcuaaaguguagagac

SEQ ID NO: 137392 - RNA, 22 nt, Human
ccagaaaaugcagaacauagaa

SEQ ID NO: 137393 - RNA, 22 nt, Human
accucaggauguggacacagaa

SEQ ID NO: 137394 - RNA, 20 nt, Human
uauuucugggcaaccauuua

SEQ ID NO: 137395 - RNA, 22 nt, Human
gaggccacagcuaucagggaca

SEQ ID NO: 137396 - RNA, 22 nt, Human
cccagcucucgcacuuacuagc

SEQ ID NO: 137397 - RNA, 22 nt, Human
uuucuucauagaccuugucuug

SEQ ID NO: 137398 - RNA, 22 nt, Human
uucuguguucugugcaaugagc

SEQ ID NO: 137399 - RNA, 22 nt, Human
uccuugaaaagaaugucuccau

SEQ ID NO: 137400 - RNA, 22 nt, Human
ccucacuggccagccaggggug

SEQ ID NO: 137401 - RNA, 22 nt, Human
gggacuggaguagaggccggug

SEQ ID NO: 137402 - RNA, 22 nt, Human
ggcgugggaaguggggcuucug

SEQ ID NO: 137403 - RNA, 22 nt, Human
ccagagcaauucucacagaacu

SEQ ID NO: 137404 - RNA, 21 nt, Human
uucaaugaaaacaaagugagg

SEQ ID NO: 137405 - RNA, 22 nt, Human
gcuucccacagcuggacugggg

SEQ ID NO: 137406 - RNA, 22 nt, Human
ggcacucagagauucaggcugu

SEQ ID NO: 137407 - RNA, 22 nt, Human
guuuacaguggcuucauuggau

SEQ ID NO: 137408 - RNA, 22 nt, Human
cagaauuuuucgaauguacugu

SEQ ID NO: 137409 - RNA, 22 nt, Human
gagcugugagggacacauugcu

SEQ ID NO: 137410 - RNA, 22 nt, Human
uuguuacacauaauaacauuuu

SEQ ID NO: 137411 - RNA, 22 nt, Human
gauggggaugagaagugagcag

SEQ ID NO: 137412 - RNA, 22 nt, Human
ggcaugggguguauguggcacg

SEQ ID NO: 137413 - RNA, 20 nt, Human
acaggggcagcacaauaaug

SEQ ID NO: 137414 - RNA, 22 nt, Human
agagagcccgggccagggcaca

SEQ ID NO: 137415 - RNA, 22 nt, Human
aaggcugagagucacaguccua

SEQ ID NO: 137416 - RNA, 21 nt, Human
cagagguggccugaccucuga

SEQ ID NO: 137417 - RNA, 22 nt, Human
uggaaggcaugggaacuguucu

SEQ ID NO: 137418 - RNA, 22 nt, Human
agccuccacagaugcaaagggc

SEQ ID NO: 137419 - RNA, 22 nt, Human
ucagagugcagcgggaggcugg

SEQ ID NO: 137420 - RNA, 22 nt, Human
acuccuggggauccauuccuuu

SEQ ID NO: 137421 - RNA, 22 nt, Human
uagggcagccacccaggcugcu

SEQ ID NO: 137422 - RNA, 20 nt, Human
gcuguguagcagugugcagu

SEQ ID NO: 137423 - RNA, 23 nt, Human
guguguggaaagugcaugggccu

SEQ ID NO: 137424 - RNA, 22 nt, Human
aggccugggacgggagccguga

SEQ ID NO: 137425 - RNA, 20 nt, Human
cucugcagcaaggccugggu

SEQ ID NO: 137426 - RNA, 22 nt, Human
ggcagcuuuuaucccugacaga

SEQ ID NO: 137427 - RNA, 22 nt, Human
gccaggcagauaugugagcuua

SEQ ID NO: 137428 - RNA, 22 nt, Human
caaggaaaaagcgagcucgggg

SEQ ID NO: 137429 - RNA, 22 nt, Human
uaguaucuuucuauauuuccca

SEQ ID NO: 137430 - RNA, 22 nt, Human
aguguuccugcucucaggaagc

SEQ ID NO: 137431 - RNA, 19 nt, Human
cugugcaggccgggcugag

SEQ ID NO: 137432 - RNA, 22 nt, Human
uugacagcuauuuugcuuugau

SEQ ID NO: 137433 - RNA, 23 nt, Human
ucccagggaaggugagcgaggcu

SEQ ID NO: 137434 - RNA, 22 nt, Human
ggucucagcaguugcuuugacu

SEQ ID NO: 137435 - RNA, 22 nt, Human
augugcaugcacuuacaugugu

SEQ ID NO: 137436 - RNA, 22 nt, Human
ccagagccucuuaugaagaucg

SEQ ID NO: 137437 - RNA, 22 nt, Human
cugggacagcugagacaggaga

SEQ ID NO: 137438 - RNA, 22 nt, Human
aaucaguuaggguguuaaugag

SEQ ID NO: 137439 - RNA, 22 nt, Human
agggcugcaggcaagauauggc

SEQ ID NO: 137440 - RNA, 22 nt, Human
uucuuucccagaagauauguuu

SEQ ID NO: 137441 - RNA, 22 nt, Human
uccugccucuuuucuuauucca

SEQ ID NO: 137442 - RNA, 22 nt, Human
ucugaggcauaaccuguucugc

SEQ ID NO: 137443 - RNA, 22 nt, Human
uggcucaggagggaucuuugcu

SEQ ID NO: 137444 - RNA, 22 nt, Human
agcagccaaccuuacauucauc

SEQ ID NO: 137445 - RNA, 22 nt, Human
uccucagggcggccuccgucuu

SEQ ID NO: 137446 - RNA, 22 nt, Human
acaguauaaacuccuaaaagcc

SEQ ID NO: 137447 - RNA, 22 nt, Human
uggagccaggagccugggaguc

SEQ ID NO: 137448 - RNA, 22 nt, Human
gucaggauuaaugggaguaugc

SEQ ID NO: 137449 - RNA, 22 nt, Human
gaaggagagggucaaggauaau

SEQ ID NO: 137450 - RNA, 20 nt, Human
augccucuaauuuugcaaac

SEQ ID NO: 137451 - RNA, 22 nt, Human
caagggaguuacugagggcggg

SEQ ID NO: 137452 - RNA, 20 nt, Human
uccaagggcagcagaaucag

SEQ ID NO: 137453 - RNA, 22 nt, Human
agucauauguggcauuuucuaa

SEQ ID NO: 137454 - RNA, 22 nt, Human
uccauaagcagguucuuccuga

SEQ ID NO: 137455 - RNA, 22 nt, Human
cauguguggucuguggcuaucu

SEQ ID NO: 137456 - RNA, 22 nt, Human
gggcuacagacaugcucuaagc

SEQ ID NO: 137457 - RNA, 22 nt, Human
cacagaggacuguagcggggag

SEQ ID NO: 137458 - RNA, 22 nt, Human
aggcagcaugcucugcuucuac

SEQ ID NO: 137459 - RNA, 22 nt, Human
gcucagagauggggaaugaaaa

SEQ ID NO: 137460 - RNA, 23 nt, Human
ucacacagcuggucagguacaga

SEQ ID NO: 137461 - RNA, 22 nt, Human
aauguguguauuucuaggcgag

SEQ ID NO: 137462 - RNA, 22 nt, Human
uugggcugaaguagagggcaga

SEQ ID NO: 137463 - RNA, 22 nt, Human
ugugggcucccccucacucugu

SEQ ID NO: 137464 - RNA, 22 nt, Human
ucagucuucccuccagugcaac

SEQ ID NO: 137465 - RNA, 22 nt, Human
uuguguguuuguagaaaaucca

SEQ ID NO: 137466 - RNA, 22 nt, Human
cucccaggguagggagagacua

SEQ ID NO: 137467 - RNA, 22 nt, Human
uuuccucuuuguaccuugacua

SEQ ID NO: 137468 - RNA, 18 nt, Human
acauuucuaggugaaagc

SEQ ID NO: 137469 - RNA, 22 nt, Human
gcugcuguacuuggggggugcu

SEQ ID NO: 137470 - RNA, 22 nt, Human
caggugccucaggaugagacaa

SEQ ID NO: 137471 - RNA, 22 nt, Human
uucaggauucucucccauuuac

SEQ ID NO: 137472 - RNA, 22 nt, Human
auggcugucacgccacugugag

SEQ ID NO: 137473 - RNA, 22 nt, Human
aaguucaagaucaagguuccag

SEQ ID NO: 137474 - RNA, 22 nt, Human
cuuaacagcaagaucuguguca

SEQ ID NO: 137475 - RNA, 22 nt, Human
cucugagagagcuggugagcac

SEQ ID NO: 137476 - RNA, 22 nt, Human
ucucugguggcuccaucaguag

SEQ ID NO: 137477 - RNA, 22 nt, Human
ugaaguccuagaacuccuggua

SEQ ID NO: 137478 - RNA, 22 nt, Human
gguggcugcaauggcuaacuuc

SEQ ID NO: 137479 - RNA, 22 nt, Human
agagaaaagaguucaggcuuug

SEQ ID NO: 137480 - RNA, 22 nt, Human
gcugcugguccucagagcucau

SEQ ID NO: 137481 - RNA, 22 nt, Human
gauaugaaguggcauugugaag

SEQ ID NO: 137482 - RNA, 20 nt, Human
ugcucaggauggagaggugu

SEQ ID NO: 137483 - RNA, 22 nt, Human
uaucuaaauggaauauuccaga

SEQ ID NO: 137484 - RNA, 22 nt, Human
ugcauggaggaagaugaaugca

SEQ ID NO: 137485 - RNA, 22 nt, Human
uggcuucagacuucugcuacgu

SEQ ID NO: 137486 - RNA, 22 nt, Human
uagggcuauucugaguaauaau

SEQ ID NO: 137487 - RNA, 22 nt, Human
acaguacugaguacugaguugg

SEQ ID NO: 137488 - RNA, 22 nt, Human
gcagagcuguuaauggagcuga

SEQ ID NO: 137489 - RNA, 22 nt, Human
aaacuuuuccugcucuuguccu

SEQ ID NO: 137490 - RNA, 22 nt, Human
cuguggcucaggccuguaagcc

SEQ ID NO: 137491 - RNA, 22 nt, Human
cagcccuggugccaagguuccc

SEQ ID NO: 137492 - RNA, 22 nt, Human
caugugucaaaugauguagcug

SEQ ID NO: 137493 - RNA, 22 nt, Human
cccagaggugcuucagaggugc

SEQ ID NO: 137494 - RNA, 22 nt, Human
gcugccaccguggagaugagug

SEQ ID NO: 137495 - RNA, 22 nt, Human
ggugacugguuuaucuggcagu

SEQ ID NO: 137496 - RNA, 22 nt, Human
uggcugugauuugcacgagaug

SEQ ID NO: 137497 - RNA, 22 nt, Human
ucaaaugcugccuuugugugcc

SEQ ID NO: 137498 - RNA, 19 nt, Human
aggcagcacccaguccuug

SEQ ID NO: 137499 - RNA, 22 nt, Human
cacagggcuucucauggggugc

SEQ ID NO: 137500 - RNA, 22 nt, Human
cugcuuugauuagaagaguaca

SEQ ID NO: 137501 - RNA, 22 nt, Human
cagugcaguuucccagaugcug

SEQ ID NO: 137502 - RNA, 22 nt, Human
augucacagcucccauuccucc

SEQ ID NO: 137503 - RNA, 22 nt, Human
gagccaggcccguacuugcugu

SEQ ID NO: 137504 - RNA, 22 nt, Human
aggcugugaguuuugucucaga

SEQ ID NO: 137505 - RNA, 22 nt, Human
ccuccaggauaagucagggccu

SEQ ID NO: 137506 - RNA, 22 nt, Human
cagcuggcauaccugggcccgg

SEQ ID NO: 137507 - RNA, 22 nt, Human
agucccagaugacccagcuacu

SEQ ID NO: 137508 - RNA, 22 nt, Human
uuuacagaaugucaauuucuau

SEQ ID NO: 137509 - RNA, 22 nt, Human
uuuucaguugugcucucuaguu

SEQ ID NO: 137510 - RNA, 22 nt, Human
gaguauaugacuuucuuuugca

SEQ ID NO: 137511 - RNA, 22 nt, Human
gaggcugcugagagcccuguuu

SEQ ID NO: 137512 - RNA, 22 nt, Human
cuguggcucaaaaucccaugau

SEQ ID NO: 137513 - RNA, 22 nt, Human
uggcagggccuaccccaauauc

SEQ ID NO: 137514 - RNA, 22 nt, Human
ccugggagggcaagugcugaug

SEQ ID NO: 137515 - RNA, 22 nt, Human
gcaggaguuaggcgucguggau

SEQ ID NO: 137516 - RNA, 22 nt, Human
acuaguauucuuggucuuguau

SEQ ID NO: 137517 - RNA, 22 nt, Human
ccagccagucccgcaugaccgc

SEQ ID NO: 137518 - RNA, 22 nt, Human
agguggggaaaccagcgauccc

SEQ ID NO: 137519 - RNA, 22 nt, Human
uuuagaguugaguauucauugg

SEQ ID NO: 137520 - RNA, 22 nt, Human
aaaaccaggcguuuccuauuau

SEQ ID NO: 137521 - RNA, 22 nt, Human
gcaggagagccagcaggcuucc

SEQ ID NO: 137522 - RNA, 17 nt, Human
aggcuggcucacaggga

SEQ ID NO: 137523 - RNA, 22 nt, Human
uaggccagcccuuaguccuguc

SEQ ID NO: 137524 - RNA, 17 nt, Human
ccugggaggaguuauga

SEQ ID NO: 137525 - RNA, 22 nt, Human
augugaaacugaagcauccaua

SEQ ID NO: 137526 - RNA, 22 nt, Human
uaagaaauuuaguuauagaaug

SEQ ID NO: 137527 - RNA, 22 nt, Human
guggcucuaggugagcauggag

SEQ ID NO: 137528 - RNA, 22 nt, Human
cugugugugucugcagcauacu

SEQ ID NO: 137529 - RNA, 22 nt, Human
gcaggcucuucuuucugcccag

SEQ ID NO: 137530 - RNA, 22 nt, Human
uuagucuucuuccuuauauguu

SEQ ID NO: 137531 - RNA, 22 nt, Human
cccaguccuaaagcagacgcca

SEQ ID NO: 137532 - RNA, 22 nt, Human
aauacaguagguaauaguucau

SEQ ID NO: 137533 - RNA, 22 nt, Human
uuauuuugagagaaugugugcu

SEQ ID NO: 137534 - RNA, 22 nt, Human
aaggaagacacagaugaaguga

SEQ ID NO: 137535 - RNA, 22 nt, Human
guccucaguaagagggccucug

SEQ ID NO: 137536 - RNA, 22 nt, Human
cagagccugcucacgucucugu

SEQ ID NO: 137537 - RNA, 22 nt, Human
aauacauauggaauuccauguu

SEQ ID NO: 137538 - RNA, 22 nt, Human
cuguggcuuugugucuauugua

SEQ ID NO: 137539 - RNA, 18 nt, Human
gagguccugcucuagccc

SEQ ID NO: 137540 - RNA, 22 nt, Human
ucauucuuuaccaaguugucac

SEQ ID NO: 137541 - RNA, 22 nt, Human
cagacuuucaaggagugaaggc

SEQ ID NO: 137542 - RNA, 22 nt, Human
gcugcccaguucugcugcugcc

SEQ ID NO: 137543 - RNA, 22 nt, Human
ucugugugggauaguuugagga

SEQ ID NO: 137544 - RNA, 22 nt, Human
cagcuggccugaucccuguggc

SEQ ID NO: 137545 - RNA, 22 nt, Human
gaggccagcgcgcagcacuuuu

SEQ ID NO: 137546 - RNA, 22 nt, Human
uuguaacaggcacucugugcca

SEQ ID NO: 137547 - RNA, 22 nt, Human
uuuucuccagggaacaagguga

SEQ ID NO: 137548 - RNA, 22 nt, Human
guuugucuuaauuaggcaucga

SEQ ID NO: 137549 - RNA, 18 nt, Human
aggcccuggccucgaaca

SEQ ID NO: 137550 - RNA, 22 nt, Human
uucuuauagaagcaaccauugu

SEQ ID NO: 137551 - RNA, 22 nt, Human
ggcuggaaaagacaaagcuauu

SEQ ID NO: 137552 - RNA, 22 nt, Human
aguggcugaagcaucaaaggca

SEQ ID NO: 137553 - RNA, 22 nt, Human
ucacaaauagcuauauuaagga

SEQ ID NO: 137554 - RNA, 20 nt, Human
uccuucaggcagggccuagu

SEQ ID NO: 137555 - RNA, 22 nt, Human
ugugugucauuuaggguggagc

SEQ ID NO: 137556 - RNA, 22 nt, Human
aaaugcauguagaauaauagag

SEQ ID NO: 137557 - RNA, 22 nt, Human
cugggccauggaagucucugcc

SEQ ID NO: 137558 - RNA, 22 nt, Human
cucucugcuguauccuuaggcu

SEQ ID NO: 137559 - RNA, 22 nt, Human
cagugggugaugaguccugggg

SEQ ID NO: 137560 - RNA, 22 nt, Human
ugugugugcaggagagcaggug

SEQ ID NO: 137561 - RNA, 22 nt, Human
uuucaguuuccagcuuugucau

SEQ ID NO: 137562 - RNA, 22 nt, Human
ggaagggccucgggcgugggac

SEQ ID NO: 137563 - RNA, 22 nt, Human
uuauuguuuacuaguuugcaga

SEQ ID NO: 137564 - RNA, 22 nt, Human
cauuacauuucaaaauguuucc

SEQ ID NO: 137565 - RNA, 22 nt, Human
cuggcagguggauggggacucc

SEQ ID NO: 137566 - RNA, 22 nt, Human
agaaaguucacugguauauuuu

SEQ ID NO: 137567 - RNA, 22 nt, Human
aagaaaugcagaaaugugcugg

SEQ ID NO: 137568 - RNA, 22 nt, Human
ccacagagacaggguccuugcu

SEQ ID NO: 137569 - RNA, 22 nt, Human
uuugcauuguuucaaaagugaa

SEQ ID NO: 137570 - RNA, 22 nt, Human
uagaaaucuacuuagacuuucu

SEQ ID NO: 137571 - RNA, 22 nt, Human
ucccagggacaccaagcuguuu

SEQ ID NO: 137572 - RNA, 22 nt, Human
aggaccaguaugagagcaucug

SEQ ID NO: 137573 - RNA, 22 nt, Human
ugcccuuggguaacuugcugau

SEQ ID NO: 137574 - RNA, 22 nt, Human
gaggccacgguuuuccuugggg

SEQ ID NO: 137575 - RNA, 22 nt, Human
gguggagcuguggacaggaagg

SEQ ID NO: 137576 - RNA, 22 nt, Human
cugcaucacagcaggaggcaca

SEQ ID NO: 137577 - RNA, 23 nt, Human
ucugucacuuucugcuguggagu

SEQ ID NO: 137578 - RNA, 22 nt, Human
gucuggaggaggaagaaggcac

SEQ ID NO: 137579 - RNA, 22 nt, Human
aggcugugcaauuaggguaaga

SEQ ID NO: 137580 - RNA, 22 nt, Human
ggcucagguugggucacaugac

SEQ ID NO: 137581 - RNA, 22 nt, Human
gcuggccauggccugcgccauc

SEQ ID NO: 137582 - RNA, 22 nt, Human
cagcaggguagguuguaucagu

SEQ ID NO: 137583 - RNA, 22 nt, Human
caugcacagugauaucugaaga

SEQ ID NO: 137584 - RNA, 18 nt, Human
gggaucaggcugccuagg

SEQ ID NO: 137585 - RNA, 22 nt, Human
uuacaguaugaucaacuuuuca

SEQ ID NO: 137586 - RNA, 22 nt, Human
ccagagcccagcacacggugcu

SEQ ID NO: 137587 - RNA, 20 nt, Human
agucccuuuggucagguauu

SEQ ID NO: 137588 - RNA, 22 nt, Human
gggcacugcuuugcucugucac

SEQ ID NO: 137589 - RNA, 22 nt, Human
uuucuacuaagaaaguugauua

SEQ ID NO: 137590 - RNA, 22 nt, Human
ucuggcuccaggaccgggcaca

SEQ ID NO: 137591 - RNA, 22 nt, Human
cagcagcuucuguugaucagaa

SEQ ID NO: 137592 - RNA, 22 nt, Human
uuuucacacaaggugauaaguu

SEQ ID NO: 137593 - RNA, 22 nt, Human
auucuucacauggauaggaucu

SEQ ID NO: 137594 - RNA, 22 nt, Human
uaugcuguauucuguauguuag

SEQ ID NO: 137595 - RNA, 22 nt, Human
uuucacaacugcuuauuugaga

SEQ ID NO: 137596 - RNA, 16 nt, Human
agcagccagcacugga

SEQ ID NO: 137597 - RNA, 22 nt, Human
agcccagcaaagggagguucag

SEQ ID NO: 137598 - RNA, 22 nt, Human
agaaacagcauuagcaucaauu

SEQ ID NO: 137599 - RNA, 22 nt, Human
uuuucuguauuauugugcuuca

SEQ ID NO: 137600 - RNA, 22 nt, Human
ccucaggguggcaucagaucuu

SEQ ID NO: 137601 - RNA, 22 nt, Human
gcugggcuucucaaugcugccu

SEQ ID NO: 137602 - RNA, 22 nt, Human
uauugucuguccgggucaaagc

SEQ ID NO: 137603 - RNA, 22 nt, Human
ucuggccuacuggaguccauga

SEQ ID NO: 137604 - RNA, 22 nt, Human
aagcaauauacugauaugauua

SEQ ID NO: 137605 - RNA, 22 nt, Human
ugauuuuuagcuauucugaaga

SEQ ID NO: 137606 - RNA, 22 nt, Human
uccuggagccacggagcuuuca

SEQ ID NO: 137607 - RNA, 22 nt, Human
cagcugcccaagccccagaugu

SEQ ID NO: 137608 - RNA, 22 nt, Human
caggaacacaaguucagggaug

SEQ ID NO: 137609 - RNA, 22 nt, Human
cccaggagguggagguugcagu

SEQ ID NO: 137610 - RNA, 22 nt, Human
cagcaggguauacagggaauuu

SEQ ID NO: 137611 - RNA, 22 nt, Human
gaaaugugugacaaguuucaau

SEQ ID NO: 137612 - RNA, 22 nt, Human
ccucacucugcacccugcagca

SEQ ID NO: 137613 - RNA, 23 nt, Human
gcagugugaauccaguguuucag

SEQ ID NO: 137614 - RNA, 22 nt, Human
gcugagagcaguguggccuuaa

SEQ ID NO: 137615 - RNA, 23 nt, Human
agaugaaagcuucccaucacagu

SEQ ID NO: 137616 - RNA, 22 nt, Human
cuguggcuucugggucaguuca

SEQ ID NO: 137617 - RNA, 22 nt, Human
uugauaaaaugauaucuucuuu

SEQ ID NO: 137618 - RNA, 21 nt, Human
ggcacugagccagauggacuc

SEQ ID NO: 137619 - RNA, 22 nt, Human
gccauuuagggaggcaagguga

SEQ ID NO: 137620 - RNA, 22 nt, Human
auaauguagguauguguauuua

SEQ ID NO: 137621 - RNA, 22 nt, Human
ggcucaggaccugggauugcca

SEQ ID NO: 137622 - RNA, 22 nt, Human
ucccagggcagcuguccagaag

SEQ ID NO: 137623 - RNA, 17 nt, Human
uuagcaaaauagcacuu

SEQ ID NO: 137624 - RNA, 22 nt, Human
aagcagcauaauugcuauuuua

SEQ ID NO: 137625 - RNA, 22 nt, Human
auggcugugaaaugguaggugg

SEQ ID NO: 137626 - RNA, 22 nt, Human
gccucugcggagcuguacauca

SEQ ID NO: 137627 - RNA, 22 nt, Human
augggaggaagagaagaugucu

SEQ ID NO: 137628 - RNA, 21 nt, Human
uucacaguggauaacuuucug

SEQ ID NO: 137629 - RNA, 22 nt, Human
gcaguguggccccaguaucacg

SEQ ID NO: 137630 - RNA, 22 nt, Human
ucagcagauggguuguguuggc

SEQ ID NO: 137631 - RNA, 22 nt, Human
auaauuuaauuuucacaguggu

SEQ ID NO: 137632 - RNA, 23 nt, Human
uucugucuugcugucagcuuucu

SEQ ID NO: 137633 - RNA, 22 nt, Human
aacuguuuuucacgugucucau

SEQ ID NO: 137634 - RNA, 22 nt, Human
ccugccagucacuaugucaccu

SEQ ID NO: 137635 - RNA, 22 nt, Human
aggagccccucuucaguccugg

SEQ ID NO: 137636 - RNA, 22 nt, Human
uggagcaggugggaugucguga

SEQ ID NO: 137637 - RNA, 22 nt, Human
uacaguaacuggaauucuucuu

SEQ ID NO: 137638 - RNA, 22 nt, Human
cuguggcuggaauaauaaaugu

SEQ ID NO: 137639 - RNA, 22 nt, Human
agaggugacauaggagaggcuc

SEQ ID NO: 137640 - RNA, 20 nt, Human
aagagcauaguacaggaaga

SEQ ID NO: 137641 - RNA, 22 nt, Human
ggcucugcugguaagaugccuc

SEQ ID NO: 137642 - RNA, 22 nt, Human
ccagcagcagcguccaaggaga

SEQ ID NO: 137643 - RNA, 22 nt, Human
ucugucaccauucagcuugaau

SEQ ID NO: 137644 - RNA, 22 nt, Human
ugcugugcuggcggcagaggcc

SEQ ID NO: 137645 - RNA, 20 nt, Human
ucauugcacauaauggaagc

SEQ ID NO: 137646 - RNA, 22 nt, Human
aggcaugugacccuggacucag

SEQ ID NO: 137647 - RNA, 22 nt, Human
gguggcugcacccuggcuaacu

SEQ ID NO: 137648 - RNA, 22 nt, Human
augaugguaaauucaguauccg

SEQ ID NO: 137649 - RNA, 22 nt, Human
ggcuuggaaauugcaggacaca

SEQ ID NO: 137650 - RNA, 22 nt, Human
auguucaaacuuuuuacacacc

SEQ ID NO: 137651 - RNA, 22 nt, Human
caguccaggccuggaggagcca

SEQ ID NO: 137652 - RNA, 22 nt, Human
aguggcaguagaugagcugguu

SEQ ID NO: 137653 - RNA, 22 nt, Human
ggggagaguccuuuccaguucc

SEQ ID NO: 137654 - RNA, 22 nt, Human
uggcuggacagugggcagugga

SEQ ID NO: 137655 - RNA, 22 nt, Human
gccuggagggauagaaugcaag

SEQ ID NO: 137656 - RNA, 22 nt, Human
guuauguauugggaaauccaag

SEQ ID NO: 137657 - RNA, 22 nt, Human
auguggcuuuuccuggguuccu

SEQ ID NO: 137658 - RNA, 22 nt, Human
aagacauuacuggaaucugacu

SEQ ID NO: 137659 - RNA, 22 nt, Human
aaaugcagcagcuaauugaaaa

SEQ ID NO: 137660 - RNA, 17 nt, Human
ugcauuguuggaaauuu

SEQ ID NO: 137661 - RNA, 22 nt, Human
gcagggagguuugcugaccugg

SEQ ID NO: 137662 - RNA, 22 nt, Human
ucuguggauuuuaguguucaug

SEQ ID NO: 137663 - RNA, 17 nt, Human
cccagcuggcagugccg

SEQ ID NO: 137664 - RNA, 22 nt, Human
ugugugaauagcaguggcuggu

SEQ ID NO: 137665 - RNA, 22 nt, Human
aacagcaugcuggguaacauug

SEQ ID NO: 137666 - RNA, 22 nt, Human
caggggacaguaugguggauga

SEQ ID NO: 137667 - RNA, 22 nt, Human
ugggugggagcgcccugucugg

SEQ ID NO: 137668 - RNA, 22 nt, Human
caggguggaauggaaugcuggc

SEQ ID NO: 137669 - RNA, 22 nt, Human
uggagcagcaucacuuugagcu

SEQ ID NO: 137670 - RNA, 22 nt, Human
ucagggcaaaagggaaaccauu

SEQ ID NO: 137671 - RNA, 22 nt, Human
cugcagaguggagccucggcug

SEQ ID NO: 137672 - RNA, 22 nt, Human
ccugcccagcuucaccucaggc

SEQ ID NO: 137673 - RNA, 19 nt, Human
gcucugugaugcugagggg

SEQ ID NO: 137674 - RNA, 22 nt, Human
caggaucccuggccuccgccca

SEQ ID NO: 137675 - RNA, 22 nt, Human
cagcuuggcuuccgcuuuacug

SEQ ID NO: 137676 - RNA, 22 nt, Human
aaguugagaugucauaggagac

SEQ ID NO: 137677 - RNA, 22 nt, Human
aguuauaugugaaaacacguau

SEQ ID NO: 137678 - RNA, 20 nt, Human
gacaucauguacacauugcc

SEQ ID NO: 137679 - RNA, 23 nt, Human
gagguacagcaccagugaauagg

SEQ ID NO: 137680 - RNA, 22 nt, Human
aagggccuccuggggagccugg

SEQ ID NO: 137681 - RNA, 22 nt, Human
uggggccuggucagagcugcac

SEQ ID NO: 137682 - RNA, 22 nt, Human
augggaggcagcagagcccagc

SEQ ID NO: 137683 - RNA, 22 nt, Human
auguauguuaguguauuaucua

SEQ ID NO: 137684 - RNA, 22 nt, Human
uaaugcaguacugauauaaaca

SEQ ID NO: 137685 - RNA, 22 nt, Human
cuggagccgcauggagcaggga

SEQ ID NO: 137686 - RNA, 22 nt, Human
gucccagaaacauauugcuggu

SEQ ID NO: 137687 - RNA, 22 nt, Human
aggccuggcuuugguuugcuga

SEQ ID NO: 137688 - RNA, 22 nt, Human
gagagcugcagccgagaggggg

SEQ ID NO: 137689 - RNA, 23 nt, Human
uguaggcuguaguuuguaggucc

SEQ ID NO: 137690 - RNA, 22 nt, Human
aaagaacaaauuagcuguuuua

SEQ ID NO: 137691 - RNA, 22 nt, Human
aaagguuaguucuuagaagugc

SEQ ID NO: 137692 - RNA, 22 nt, Human
cuagugugucuaugucuguucc

SEQ ID NO: 137693 - RNA, 22 nt, Human
guuccauaucacagcagacgaa

SEQ ID NO: 137694 - RNA, 22 nt, Human
ggcacagggaggcccuggugug

SEQ ID NO: 137695 - RNA, 22 nt, Human
ugugaaaggggucacagggaaa

SEQ ID NO: 137696 - RNA, 22 nt, Human
uuccauaaugagauucccagcc

SEQ ID NO: 137697 - RNA, 22 nt, Human
auauauuuacucuccuguugca

SEQ ID NO: 137698 - RNA, 22 nt, Human
agguaaagacagugaaagaggg

SEQ ID NO: 137699 - RNA, 22 nt, Human
agcugcuguccuaggcacugua

SEQ ID NO: 137700 - RNA, 22 nt, Human
agaauucuuggugguuagaaua

SEQ ID NO: 137701 - RNA, 22 nt, Human
ugggccugccccaggcuucagc

SEQ ID NO: 137702 - RNA, 20 nt, Human
ucagagucaucaaagauggu

SEQ ID NO: 137703 - RNA, 22 nt, Human
ucaguauccacaaaugcucaaa

SEQ ID NO: 137704 - RNA, 22 nt, Human
uucauuccugagcccauauuua

SEQ ID NO: 137705 - RNA, 22 nt, Human
ggaggcugagaaguccaagauc

SEQ ID NO: 137706 - RNA, 22 nt, Human
aucugccucuucuucauugcga

SEQ ID NO: 137707 - RNA, 22 nt, Human
ccacagagagugucagccuuug

SEQ ID NO: 137708 - RNA, 22 nt, Human
cugcuuugaggggcucuguaua

SEQ ID NO: 137709 - RNA, 22 nt, Human
uggagcaggaagucuauggcug

SEQ ID NO: 137710 - RNA, 22 nt, Human
uuuuauguuccucuuuaugcga

SEQ ID NO: 137711 - RNA, 22 nt, Human
uaguccaguaaaacagcuaacg

SEQ ID NO: 137712 - RNA, 22 nt, Human
agagccagagaccuggguucac

SEQ ID NO: 137713 - RNA, 22 nt, Human
ucugucuccugccagugccucu

SEQ ID NO: 137714 - RNA, 23 nt, Human
gcaggugguucgaacagaaguuu

SEQ ID NO: 137715 - RNA, 22 nt, Human
ucccagagugugggcaucaagg

SEQ ID NO: 137716 - RNA, 22 nt, Human
ggccucugcccucacuccuguc

SEQ ID NO: 137717 - RNA, 22 nt, Human
agcccaagcuaugaggugaccu

SEQ ID NO: 137718 - RNA, 22 nt, Human
gagcugaguuaccuccagauca

SEQ ID NO: 137719 - RNA, 22 nt, Human
gaaggccacggaauggagcugg

SEQ ID NO: 137720 - RNA, 22 nt, Human
aagagguugucugugaugaguu

SEQ ID NO: 137721 - RNA, 22 nt, Human
gcuggcagagacaagaagacua

SEQ ID NO: 137722 - RNA, 22 nt, Human
ucagggcauucaagaggccugg

SEQ ID NO: 137723 - RNA, 22 nt, Human
cucaguuucugacauuaaaauc

SEQ ID NO: 137724 - RNA, 22 nt, Human
cuugaaagauuuggccucugug

SEQ ID NO: 137725 - RNA, 18 nt, Human
cagggccccagaauuauc

SEQ ID NO: 137726 - RNA, 22 nt, Human
cacccaggcuggagugcagggg

SEQ ID NO: 137727 - RNA, 19 nt, Human
agggagaauuccaagagga

SEQ ID NO: 137728 - RNA, 22 nt, Human
gcugcaggggggucuggacuug

SEQ ID NO: 137729 - RNA, 22 nt, Human
agggcugcugcuccgggcccag

SEQ ID NO: 137730 - RNA, 22 nt, Human
ccaggcugccgaggaaagaaag

SEQ ID NO: 137731 - RNA, 22 nt, Human
agcagcauuuaaggauccaagu

SEQ ID NO: 137732 - RNA, 23 nt, Human
uggcagagacccagaaucuacau

SEQ ID NO: 137733 - RNA, 22 nt, Human
auggaaaggcuguggaaacuua

SEQ ID NO: 137734 - RNA, 22 nt, Human
aagccuuccugagugcaaggcc

SEQ ID NO: 137735 - RNA, 22 nt, Human
uaccaguaauugcuugugcugu

SEQ ID NO: 137736 - RNA, 22 nt, Human
acagagccaaaaggacauagua

SEQ ID NO: 137737 - RNA, 22 nt, Human
gcuggccacauugugccguccu

SEQ ID NO: 137738 - RNA, 22 nt, Human
gccagcugguaggcaccuagcc

SEQ ID NO: 137739 - RNA, 22 nt, Human
aggcugugggaguugagagucu

SEQ ID NO: 137740 - RNA, 22 nt, Human
uaaaauguagcuucuaggcugg

SEQ ID NO: 137741 - RNA, 22 nt, Human
agagccugggaauuugcauguu

SEQ ID NO: 137742 - RNA, 22 nt, Human
guacaguaaucccguucuucug

SEQ ID NO: 137743 - RNA, 22 nt, Human
ugcugccagccaggccauggag

SEQ ID NO: 137744 - RNA, 22 nt, Human
gaagaacaagcagugcuuuccu

SEQ ID NO: 137745 - RNA, 22 nt, Human
gucagagagggcacgugcacac

SEQ ID NO: 137746 - RNA, 22 nt, Human
caggccugggcuucggggcuga

SEQ ID NO: 137747 - RNA, 19 nt, Human
uaucuuuaugcaguggugg

SEQ ID NO: 137748 - RNA, 22 nt, Human
aauuuccagaccccauccacag

SEQ ID NO: 137749 - RNA, 22 nt, Human
gggagccaaggagagaggccuu

SEQ ID NO: 137750 - RNA, 22 nt, Human
uuccucucgcucuccggggccc

SEQ ID NO: 137751 - RNA, 18 nt, Human
ggcaugugagugcugagg

SEQ ID NO: 137752 - RNA, 22 nt, Human
uacauucuacuuuuucacuccc

SEQ ID NO: 137753 - RNA, 22 nt, Human
accagagcuuacaugcuagaaa

SEQ ID NO: 137754 - RNA, 22 nt, Human
gcagccagaagacucagaacaa

SEQ ID NO: 137755 - RNA, 22 nt, Human
uccaguaucaaaguccuagucc

SEQ ID NO: 137756 - RNA, 22 nt, Human
gcagggcuguggacacuuuggu

SEQ ID NO: 137757 - RNA, 22 nt, Human
aggcacugcuucuaaguaggaa

SEQ ID NO: 137758 - RNA, 22 nt, Human
caaaugauaccuauuacuaggc

SEQ ID NO: 137759 - RNA, 23 nt, Human
gcugagguacauuuacaggaaga

SEQ ID NO: 137760 - RNA, 22 nt, Human
acacagaaccucauagccucuc

SEQ ID NO: 137761 - RNA, 22 nt, Human
cacccaggcuagagugcagugg

SEQ ID NO: 137762 - RNA, 22 nt, Human
gcagagcuccccaagacaccaa

SEQ ID NO: 137763 - RNA, 22 nt, Human
aguguguaauucagugcccagc

SEQ ID NO: 137764 - RNA, 22 nt, Human
acacagggcaaugcuuugaccu

SEQ ID NO: 137765 - RNA, 22 nt, Human
agggaagagcuugcaagaaacc

SEQ ID NO: 137766 - RNA, 20 nt, Human
uuccuguauacaaagaguuc

SEQ ID NO: 137767 - RNA, 22 nt, Human
guuuuauuuccaugagagaccg

SEQ ID NO: 137768 - RNA, 22 nt, Human
agguggggccaaaugcuacagu

SEQ ID NO: 137769 - RNA, 22 nt, Human
uuccauauguauauagcuguua

SEQ ID NO: 137770 - RNA, 22 nt, Human
gugcauauaugcacauaugugu

SEQ ID NO: 137771 - RNA, 22 nt, Human
uuugcaguguucaucaguauuu

SEQ ID NO: 137772 - RNA, 22 nt, Human
gagagcugggggacuguggaug

SEQ ID NO: 137773 - RNA, 20 nt, Human
aaaaacaguaaugcugaaga

SEQ ID NO: 137774 - RNA, 22 nt, Human
cuggggugugcucagagcaggg

SEQ ID NO: 137775 - RNA, 22 nt, Human
acagcagcgucaacuuaaaauu

SEQ ID NO: 137776 - RNA, 22 nt, Human
cagcuggguuuaguggggugug

SEQ ID NO: 137777 - RNA, 22 nt, Human
ucugcgcugccuugauccuugg

SEQ ID NO: 137778 - RNA, 22 nt, Human
gcagggacagggcagggccuuu

SEQ ID NO: 137779 - RNA, 22 nt, Human
augacagaaggccucccugaca

SEQ ID NO: 137780 - RNA, 22 nt, Human
gaacagaauuaccgaagaucug

SEQ ID NO: 137781 - RNA, 22 nt, Human
ucccagccacagguguagcccu

SEQ ID NO: 137782 - RNA, 22 nt, Human
cccagcucugcagaccugcccu

SEQ ID NO: 137783 - RNA, 20 nt, Human
agugcaagaaagcacagcug

SEQ ID NO: 137784 - RNA, 22 nt, Human
caguaauagauuugagaguggu

SEQ ID NO: 137785 - RNA, 22 nt, Human
aagaauguggguggauaugaug

SEQ ID NO: 137786 - RNA, 22 nt, Human
cagcaauaaugucuacaaaucu

SEQ ID NO: 137787 - RNA, 19 nt, Human
gcuuuuuguugucaaaggu

SEQ ID NO: 137788 - RNA, 22 nt, Human
caguagcauguaauaaagacag

SEQ ID NO: 137789 - RNA, 22 nt, Human
agaggcugcacuugcucaugau

SEQ ID NO: 137790 - RNA, 22 nt, Human
gcagggcugcagagggcacugu

SEQ ID NO: 137791 - RNA, 22 nt, Human
ggagugaguacuggaguagcug

SEQ ID NO: 137792 - RNA, 22 nt, Human
uauauguaagcuauguaagagu

SEQ ID NO: 137793 - RNA, 22 nt, Human
gcuguguguucaauaaugugau

SEQ ID NO: 137794 - RNA, 22 nt, Human
augaaacaguguguauagcaaa

SEQ ID NO: 137795 - RNA, 22 nt, Human
ugcagugguugagagcccagac

SEQ ID NO: 137796 - RNA, 22 nt, Human
uuuguaaauagcaguacucaug

SEQ ID NO: 137797 - RNA, 22 nt, Human
gccuggaggggacagucucugg

SEQ ID NO: 137798 - RNA, 22 nt, Human
caagagcuagacuuugucagga

SEQ ID NO: 137799 - RNA, 22 nt, Human
uauuuguauuucaugcaguaaa

SEQ ID NO: 137800 - RNA, 22 nt, Human
ucucucagggggaaggcugaag

SEQ ID NO: 137801 - RNA, 18 nt, Human
cagcugccagcucaugga

SEQ ID NO: 137802 - RNA, 22 nt, Human
uggugcuguggaggggcagaag

SEQ ID NO: 137803 - RNA, 22 nt, Human
cacauguuuggcaugucaccaa

SEQ ID NO: 137804 - RNA, 22 nt, Human
cuucacagaauaaacucauuau

SEQ ID NO: 137805 - RNA, 22 nt, Human
uaggccagaggagcagcuuugg

SEQ ID NO: 137806 - RNA, 20 nt, Human
aguaugauccacucugcucu

SEQ ID NO: 137807 - RNA, 22 nt, Human
uuucaagcauaacugggaagag

SEQ ID NO: 137808 - RNA, 22 nt, Human
agggaaauuaaugugagcaaug

SEQ ID NO: 137809 - RNA, 22 nt, Human
uucauauauaugcacuacguac

SEQ ID NO: 137810 - RNA, 22 nt, Human
ggaaagagcuaaaagggugaga

SEQ ID NO: 137811 - RNA, 22 nt, Human
aggagggugauccgggcugguc

SEQ ID NO: 137812 - RNA, 22 nt, Human
cauuucugggagacaugcuaga

SEQ ID NO: 137813 - RNA, 22 nt, Human
gggugggguucaggaaucuuca

SEQ ID NO: 137814 - RNA, 22 nt, Human
uuccaugaagggcagccucuca

SEQ ID NO: 137815 - RNA, 20 nt, Human
acagaaagagagaaugucag

SEQ ID NO: 137816 - RNA, 22 nt, Human
cuugaaagaagggucuuuuaau

SEQ ID NO: 137817 - RNA, 22 nt, Human
uagggcagauucgguggaguuu

SEQ ID NO: 137818 - RNA, 22 nt, Human
gcagcuuuuuggaugucaguua

SEQ ID NO: 137819 - RNA, 22 nt, Human
uauauuuaauuaguugcuggau

SEQ ID NO: 137820 - RNA, 22 nt, Human
aaguucaaggcagguccugagg

SEQ ID NO: 137821 - RNA, 22 nt, Human
gcugcccugugguccagcaggu

SEQ ID NO: 137822 - RNA, 22 nt, Human
cugcucuggggaagccagaugu

SEQ ID NO: 137823 - RNA, 23 nt, Human
aguguguaagguacuuugcugcu

SEQ ID NO: 137824 - RNA, 19 nt, Human
ccugggagucagcugaagg

SEQ ID NO: 137825 - RNA, 22 nt, Human
caggaugaagggcaaaggcaag

SEQ ID NO: 137826 - RNA, 22 nt, Human
cugggagaugacucagagcagg

SEQ ID NO: 137827 - RNA, 22 nt, Human
guauacauagaugaugaacaag

SEQ ID NO: 137828 - RNA, 22 nt, Human
caugugugacaaacugccugca

SEQ ID NO: 137829 - RNA, 22 nt, Human
ggugcccaccugucuuccugga

SEQ ID NO: 137830 - RNA, 23 nt, Human
ggccucuguguucugcccacaug

SEQ ID NO: 137831 - RNA, 22 nt, Human
agaauuagucacaauuauagga

SEQ ID NO: 137832 - RNA, 22 nt, Human
ugggaggacuugugggcuucau

SEQ ID NO: 137833 - RNA, 22 nt, Human
cagaccucaguccucaguagga

SEQ ID NO: 137834 - RNA, 22 nt, Human
guuacagugagaagauagccua

SEQ ID NO: 137835 - RNA, 22 nt, Human
ugcuaucucuauauccauuuau

SEQ ID NO: 137836 - RNA, 22 nt, Human
agcuguguaagucauguaggug

SEQ ID NO: 137837 - RNA, 22 nt, Human
aagcugaggcccauggcaaggu

SEQ ID NO: 137838 - RNA, 22 nt, Human
uagccuucucaagacaaaguug

SEQ ID NO: 137839 - RNA, 22 nt, Human
uggcuggcccugggagugcaga

SEQ ID NO: 137840 - RNA, 22 nt, Human
aagcaucucuauguggagagug

SEQ ID NO: 137841 - RNA, 22 nt, Human
cucuggagguugagcccagcaa

SEQ ID NO: 137842 - RNA, 22 nt, Human
acuuuucuaagcaauggucuug

SEQ ID NO: 137843 - RNA, 22 nt, Human
cagcaucuuucucuucuggagu

SEQ ID NO: 137844 - RNA, 22 nt, Human
acugccaggauggcacuagagg

SEQ ID NO: 137845 - RNA, 22 nt, Human
uuucuucauucaccuucacccc

SEQ ID NO: 137846 - RNA, 22 nt, Human
aaguuuaagguggaaguggugg

SEQ ID NO: 137847 - RNA, 22 nt, Human
ucuuugaccaaauuauccuguu

SEQ ID NO: 137848 - RNA, 22 nt, Human
ggcuggccucaggguccucgcu

SEQ ID NO: 137849 - RNA, 22 nt, Human
cguggcuggggcgacuccacgg

SEQ ID NO: 137850 - RNA, 19 nt, Human
gcugucugaugcugagguc

SEQ ID NO: 137851 - RNA, 22 nt, Human
cccaggcugaguuagagguguc

SEQ ID NO: 137852 - RNA, 22 nt, Human
aggcuucccaagcagcugcaaa

SEQ ID NO: 137853 - RNA, 22 nt, Human
cacugggcguguccugggugag

SEQ ID NO: 137854 - RNA, 22 nt, Human
ugagggaggcccuuugagcaga

SEQ ID NO: 137855 - RNA, 22 nt, Human
gcccagcagaucucagugucuc

SEQ ID NO: 137856 - RNA, 22 nt, Human
uuugacaguaauaaagcacaag

SEQ ID NO: 137857 - RNA, 22 nt, Human
ucugccugaaauucacauguaa

SEQ ID NO: 137858 - RNA, 22 nt, Human
ugcauugcauuugucaugaaga

SEQ ID NO: 137859 - RNA, 22 nt, Human
caggguggaaaagcuaguugga

SEQ ID NO: 137860 - RNA, 22 nt, Human
ggcagugaaugaaacagaggcu

SEQ ID NO: 137861 - RNA, 18 nt, Human
aucuuuccauagcauguu

SEQ ID NO: 137862 - RNA, 19 nt, Human
ugggugugaccaucucugc

SEQ ID NO: 137863 - RNA, 22 nt, Human
agcuccugaaaagcgcuugcuu

SEQ ID NO: 137864 - RNA, 22 nt, Human
agaggccaggcugcagagggau

SEQ ID NO: 137865 - RNA, 22 nt, Human
ccugccugcaaaaugggacaag

SEQ ID NO: 137866 - RNA, 22 nt, Human
gcaggggcugagcaccagcggg

SEQ ID NO: 137867 - RNA, 22 nt, Human
uccaguaugacugauguccuuc

SEQ ID NO: 137868 - RNA, 22 nt, Human
uccuggaguugugcagugcaca

SEQ ID NO: 137869 - RNA, 22 nt, Human
ggggacccucaggacugcgucu

SEQ ID NO: 137870 - RNA, 22 nt, Human
gccuucaggaaaucaguccuug

SEQ ID NO: 137871 - RNA, 22 nt, Human
auagaacagaaacagaugcaca

SEQ ID NO: 137872 - RNA, 22 nt, Human
ggggaggcugaugugggcaaag

SEQ ID NO: 137873 - RNA, 22 nt, Human
uugagucaguaauuccauuucu

SEQ ID NO: 137874 - RNA, 22 nt, Human
gaaccaaguaggauacaaggag

SEQ ID NO: 137875 - RNA, 22 nt, Human
uuuacaaggcagaacugauuaa

SEQ ID NO: 137876 - RNA, 22 nt, Human
uguguguauccauuagaggcca

SEQ ID NO: 137877 - RNA, 22 nt, Human
gugucccaaagauuagaaauca

SEQ ID NO: 137878 - RNA, 22 nt, Human
cugcucuggcguacucggcauc

SEQ ID NO: 137879 - RNA, 22 nt, Human
aagugaaacauguaucucuuua

SEQ ID NO: 137880 - RNA, 22 nt, Human
cugggaggugcagcaaaaauca

SEQ ID NO: 137881 - RNA, 22 nt, Human
aggcacaggaaugucauccagu

SEQ ID NO: 137882 - RNA, 22 nt, Human
aggcacuggguaauuaguagcu

SEQ ID NO: 137883 - RNA, 22 nt, Human
uaucaauacauguuaucagugu

SEQ ID NO: 137884 - RNA, 22 nt, Human
uucagagcaucucuaaagccag

SEQ ID NO: 137885 - RNA, 22 nt, Human
cagucacauggaugauggauag

SEQ ID NO: 137886 - RNA, 22 nt, Human
gccaccagccccaugcgcugug

SEQ ID NO: 137887 - RNA, 22 nt, Human
uucuaguguccuuggacuugcu

SEQ ID NO: 137888 - RNA, 22 nt, Human
ggagccagagucugcaguguaa

SEQ ID NO: 137889 - RNA, 22 nt, Human
ccagucccaucucugucgcuua

SEQ ID NO: 137890 - RNA, 19 nt, Human
acagaaauuaguuauuuuc

SEQ ID NO: 137891 - RNA, 22 nt, Human
auguaacaggugaagcucugag

SEQ ID NO: 137892 - RNA, 22 nt, Human
gcuucucucucagacugcaagc

SEQ ID NO: 137893 - RNA, 22 nt, Human
ggugacuggagggacccaggcc

SEQ ID NO: 137894 - RNA, 22 nt, Human
ccuucucuacuccugaugcaug

SEQ ID NO: 137895 - RNA, 22 nt, Human
ggcuucucucuucacauggcuu

SEQ ID NO: 137896 - RNA, 22 nt, Human
uaaauguaccuucugccuuacu

SEQ ID NO: 137897 - RNA, 22 nt, Human
aggugcugccccgagaaggaug

SEQ ID NO: 137898 - RNA, 22 nt, Human
cuucucucggugcaucccucac

SEQ ID NO: 137899 - RNA, 22 nt, Human
aggaugaauaacugaaauggug

SEQ ID NO: 137900 - RNA, 22 nt, Human
ggccucugccccagccacaccu

SEQ ID NO: 137901 - RNA, 21 nt, Human
acccuggguucuccauacccu

SEQ ID NO: 137902 - RNA, 22 nt, Human
acugccuugucucuugccuguu

SEQ ID NO: 137903 - RNA, 21 nt, Human
gugugucuaauguaguggaaa

SEQ ID NO: 137904 - RNA, 22 nt, Human
uacaaguauggaaugauucuca

SEQ ID NO: 137905 - RNA, 22 nt, Human
gggcuggaggagauccagaggc

SEQ ID NO: 137906 - RNA, 22 nt, Human
aagcugccugggaggaagggcu

SEQ ID NO: 137907 - RNA, 22 nt, Human
ccugucuggccaccagggcgau

SEQ ID NO: 137908 - RNA, 22 nt, Human
aauguguagauguugcauuccu

SEQ ID NO: 137909 - RNA, 22 nt, Human
ccagcaccuugaucuuggaguu

SEQ ID NO: 137910 - RNA, 22 nt, Human
acaggcugacuuccugccaugu

SEQ ID NO: 137911 - RNA, 22 nt, Human
aggccugagccccagguuuguu

SEQ ID NO: 137912 - RNA, 22 nt, Human
ucuuuccaaggacucuguagca

SEQ ID NO: 137913 - RNA, 22 nt, Human
cccuccccacaaagcuucacac

SEQ ID NO: 137914 - RNA, 22 nt, Human
ucaguuuuucuauacuuuguag

SEQ ID NO: 137915 - RNA, 22 nt, Human
cagucccaguuugagacucugg

SEQ ID NO: 137916 - RNA, 22 nt, Human
gcuggcugccuuacuuugugga

SEQ ID NO: 137917 - RNA, 22 nt, Human
gcugucagcgcccaaggagcuc

SEQ ID NO: 137918 - RNA, 22 nt, Human
auggcuguuuagcuucucugcu

SEQ ID NO: 137919 - RNA, 22 nt, Human
cucaggguaaugaaagacgaau

SEQ ID NO: 137920 - RNA, 22 nt, Human
agggagaaaauuggaugcacaa

SEQ ID NO: 137921 - RNA, 22 nt, Human
gcucucuugacagcuugcuguu

SEQ ID NO: 137922 - RNA, 22 nt, Human
ggggcagagaauaaaaaccuaa

SEQ ID NO: 137923 - RNA, 22 nt, Human
gugugccaacaaaagacagugc

SEQ ID NO: 137924 - RNA, 22 nt, Human
uccagagcagguggucagaagg

SEQ ID NO: 137925 - RNA, 22 nt, Human
cugcaggcaucuaacugugggc

SEQ ID NO: 137926 - RNA, 22 nt, Human
ucucucuucuuuguuaagaaug

SEQ ID NO: 137927 - RNA, 22 nt, Human
ucugcugugucccuggucuccu

SEQ ID NO: 137928 - RNA, 22 nt, Human
ucauuuguugaacuuuagugcg

SEQ ID NO: 137929 - RNA, 22 nt, Human
cugagcugaaacuugagaggcu

SEQ ID NO: 137930 - RNA, 22 nt, Human
agcucagggcgaucugucucgg

SEQ ID NO: 137931 - RNA, 22 nt, Human
ugaagcagcaccauuuuagagc

SEQ ID NO: 137932 - RNA, 23 nt, Human
uccaugagaugugggcuucuagu

SEQ ID NO: 137933 - RNA, 22 nt, Human
gcucucugucguuaugcuucau

SEQ ID NO: 137934 - RNA, 22 nt, Human
cuggcccuucucuugcuuccug

SEQ ID NO: 137935 - RNA, 19 nt, Human
cugcugggugcugagggag

SEQ ID NO: 137936 - RNA, 22 nt, Human
cccagcauccucagggagcggg

SEQ ID NO: 137937 - RNA, 22 nt, Human
uuuccucuucuucccaugucau

SEQ ID NO: 137938 - RNA, 22 nt, Human
ugcugccaggucuugcugucca

SEQ ID NO: 137939 - RNA, 17 nt, Human
cuggagccuccaacucc

SEQ ID NO: 137940 - RNA, 22 nt, Human
cugaaggacuuggugauaguug

SEQ ID NO: 137941 - RNA, 22 nt, Human
auccuugaaugacucugcccuc

SEQ ID NO: 137942 - RNA, 22 nt, Human
uucagagaugacaccugguguu

SEQ ID NO: 137943 - RNA, 22 nt, Human
cauuuacagugagaguuuuuac

SEQ ID NO: 137944 - RNA, 22 nt, Human
gcucucuugguggcuguccugg

SEQ ID NO: 137945 - RNA, 22 nt, Human
auggcuguaaauucagagaugg

SEQ ID NO: 137946 - RNA, 17 nt, Human
ugcugccaagucccaac

SEQ ID NO: 137947 - RNA, 22 nt, Human
cugucuguaucccuguugguaa

SEQ ID NO: 137948 - RNA, 22 nt, Human
uaaaucacuccuaauaaucagu

SEQ ID NO: 137949 - RNA, 22 nt, Human
aggcagcuggcagcacccaggg

SEQ ID NO: 137950 - RNA, 22 nt, Human
cugggcagagcuaacaccugag

SEQ ID NO: 137951 - RNA, 20 nt, Human
cacagcuugccuuuuaugac

SEQ ID NO: 137952 - RNA, 22 nt, Human
gugcagugagcagugcagcacc

SEQ ID NO: 137953 - RNA, 22 nt, Human
gggcugugugcaguacgggucc

SEQ ID NO: 137954 - RNA, 22 nt, Human
aaucuggcauguaagcuuagag

SEQ ID NO: 137955 - RNA, 22 nt, Human
gaccuggaggauccucuucuug

SEQ ID NO: 137956 - RNA, 22 nt, Human
ccugccuguaagauggguacaa

SEQ ID NO: 137957 - RNA, 22 nt, Human
ucagagcuaaggggagagcaaa

SEQ ID NO: 137958 - RNA, 22 nt, Human
caugcuccaaaaacaagagaau

SEQ ID NO: 137959 - RNA, 22 nt, Human
uucucucuuuuggguaggaggu

SEQ ID NO: 137960 - RNA, 22 nt, Human
uucaggauggcggauguugggg

SEQ ID NO: 137961 - RNA, 22 nt, Human
ccagggcuggugggagaugcug

SEQ ID NO: 137962 - RNA, 22 nt, Human
aggccugaggaccuucuggagg

SEQ ID NO: 137963 - RNA, 22 nt, Human
cucaggccauucuuccagcugc

SEQ ID NO: 137964 - RNA, 22 nt, Human
ccuggcucuguccucgcgcaaa

SEQ ID NO: 137965 - RNA, 22 nt, Human
cagagacagggcagggagugug

SEQ ID NO: 137966 - RNA, 22 nt, Human
acugggaggcaaagagcaagga

SEQ ID NO: 137967 - RNA, 22 nt, Human
uaacuuuaugacaugucuugcu

SEQ ID NO: 137968 - RNA, 22 nt, Human
acagagauguggaugagggauu

SEQ ID NO: 137969 - RNA, 22 nt, Human
uaagaacaguguuucaucucua

SEQ ID NO: 137970 - RNA, 22 nt, Human
auggcuguagucaucugaaggc

SEQ ID NO: 137971 - RNA, 21 nt, Human
uggcucugagccucauggcug

SEQ ID NO: 137972 - RNA, 22 nt, Human
agacccugucaguguuaggaaa

SEQ ID NO: 137973 - RNA, 22 nt, Human
ccagcucuagccccauguggcu

SEQ ID NO: 137974 - RNA, 22 nt, Human
uggcuuccugcacagugucugc

SEQ ID NO: 137975 - RNA, 22 nt, Human
ggaggaccugcuggcccugcaa

SEQ ID NO: 137976 - RNA, 22 nt, Human
ggugaaggucuacugugugcca

SEQ ID NO: 137977 - RNA, 22 nt, Human
cacaguaugaucuaaaguaagu

SEQ ID NO: 137978 - RNA, 22 nt, Human
ggccugagucccaccuggcugu

SEQ ID NO: 137979 - RNA, 22 nt, Human
agagugucugguagcugcucug

SEQ ID NO: 137980 - RNA, 22 nt, Human
ugugcuauuuuugcauaugugu

SEQ ID NO: 137981 - RNA, 22 nt, Human
gugugugugccugcacacacac

SEQ ID NO: 137982 - RNA, 22 nt, Human
gccagagcugagugagguucuu

SEQ ID NO: 137983 - RNA, 22 nt, Human
gcauguguuauuuuauguauga

SEQ ID NO: 137984 - RNA, 19 nt, Human
aauauuuuagccucuuccu

SEQ ID NO: 137985 - RNA, 22 nt, Human
uauauucuuaccaguguaugua

SEQ ID NO: 137986 - RNA, 22 nt, Human
uggcugcugagaaggcagcugu

SEQ ID NO: 137987 - RNA, 22 nt, Human
ucuggcuuucauuuguuuaaag

SEQ ID NO: 137988 - RNA, 22 nt, Human
gggaguggagagcaauggauga

SEQ ID NO: 137989 - RNA, 22 nt, Human
uguguggaugcagcgugggucu

SEQ ID NO: 137990 - RNA, 22 nt, Human
cuggggugucucgucugccauu

SEQ ID NO: 137991 - RNA, 22 nt, Human
aaguuuuaacaaguacuuacua

SEQ ID NO: 137992 - RNA, 22 nt, Human
uuuuaucugcuucauuaguuga

SEQ ID NO: 137993 - RNA, 22 nt, Human
uucacauuauaaucaguucugc

SEQ ID NO: 137994 - RNA, 22 nt, Human
uuauucuuuucuccagaauccc

SEQ ID NO: 137995 - RNA, 21 nt, Human
ugcuccuuagcugccccugcc

SEQ ID NO: 137996 - RNA, 22 nt, Human
ugguaauuuacgcauuucugua

SEQ ID NO: 137997 - RNA, 23 nt, Human
ugcagcugccucuggcgggccgg

SEQ ID NO: 137998 - RNA, 22 nt, Human
ccaggcugggcggggaaccugg

SEQ ID NO: 137999 - RNA, 22 nt, Human
uccuuccucggggacccagauc

SEQ ID NO: 138000 - RNA, 22 nt, Human
ugggcagagucauacaggagac

SEQ ID NO: 138001 - RNA, 22 nt, Human
auuucucuuccuccuaggguug

SEQ ID NO: 138002 - RNA, 22 nt, Human
uggcagcugaggggaggcuuug

SEQ ID NO: 138003 - RNA, 22 nt, Human
ugaacauauucaccucuaaaua

SEQ ID NO: 138004 - RNA, 22 nt, Human
guggcugcuacagagcuggagg

SEQ ID NO: 138005 - RNA, 20 nt, Human
uccaagcccuccuuccauuc

SEQ ID NO: 138006 - RNA, 22 nt, Human
agaugcugugaggaagcuagga

SEQ ID NO: 138007 - RNA, 22 nt, Human
cagcuucccuuggcugagcaga

SEQ ID NO: 138008 - RNA, 22 nt, Human
uguaugcuugaguguguauacu

SEQ ID NO: 138009 - RNA, 22 nt, Human
uuacagugacaguugcuaugau

SEQ ID NO: 138010 - RNA, 22 nt, Human
gagagugaaggcuucccagcaa

SEQ ID NO: 138011 - RNA, 22 nt, Human
cucuggcuuugcucaugcaucc

SEQ ID NO: 138012 - RNA, 22 nt, Human
uucaacuaauguuuauuuuaug

SEQ ID NO: 138013 - RNA, 22 nt, Human
acccaggguagagugcaguggc

SEQ ID NO: 138014 - RNA, 22 nt, Human
uaugaagaaguucugugaaaug

SEQ ID NO: 138015 - RNA, 22 nt, Human
agaaauguuuauggcugccuau

SEQ ID NO: 138016 - RNA, 23 nt, Human
aguggcugagaguguuucauaug

SEQ ID NO: 138017 - RNA, 22 nt, Human
agccacagcuccuugguggaga

SEQ ID NO: 138018 - RNA, 22 nt, Human
uucuucuuaauguccugggaac

SEQ ID NO: 138019 - RNA, 22 nt, Human
aauaauuuugagagccuggaaa

SEQ ID NO: 138020 - RNA, 22 nt, Human
aguggcugccaagauauaauuc

SEQ ID NO: 138021 - RNA, 22 nt, Human
gcccugugccagucacgcugug

SEQ ID NO: 138022 - RNA, 22 nt, Human
uuauuuaaugugaucugaagag

SEQ ID NO: 138023 - RNA, 22 nt, Human
ggcagugacuguucagacgucc

SEQ ID NO: 138024 - RNA, 22 nt, Human
ucacaguuauagucuguagaau

SEQ ID NO: 138025 - RNA, 22 nt, Human
ucaggcagaccaccgugggcag

SEQ ID NO: 138026 - RNA, 22 nt, Human
uggcagagaugaagaguuguuu

SEQ ID NO: 138027 - RNA, 22 nt, Human
aaaugcacaauaaaguaaaggc

SEQ ID NO: 138028 - RNA, 22 nt, Human
gcuguggcuguacagagaccau

SEQ ID NO: 138029 - RNA, 22 nt, Human
agaaacauuuagauuauauguc

SEQ ID NO: 138030 - RNA, 22 nt, Human
agagccagguguagucucggag

SEQ ID NO: 138031 - RNA, 22 nt, Human
gugccuuccccgguggucuguu

SEQ ID NO: 138032 - RNA, 22 nt, Human
uugaaagaggcaaaguuugauc

SEQ ID NO: 138033 - RNA, 22 nt, Human
cacagcagaaauaugaaggcag

SEQ ID NO: 138034 - RNA, 22 nt, Human
ugcugggggugucucaccaggc

SEQ ID NO: 138035 - RNA, 22 nt, Human
uauuacugagguuuuauggagu

SEQ ID NO: 138036 - RNA, 22 nt, Human
cagggacugagauccagacugu

SEQ ID NO: 138037 - RNA, 22 nt, Human
cucaguuucuucauauuguagg

SEQ ID NO: 138038 - RNA, 22 nt, Human
ugcauauuuuauaaagauggaa

SEQ ID NO: 138039 - RNA, 22 nt, Human
caaggccagagccagcgauaag

SEQ ID NO: 138040 - RNA, 22 nt, Human
ugucacauguguggcauuuuuc

SEQ ID NO: 138041 - RNA, 22 nt, Human
ucuauuuuguuuccagcucuac

SEQ ID NO: 138042 - RNA, 22 nt, Human
uucucucauucaaauuaaagug

SEQ ID NO: 138043 - RNA, 22 nt, Human
gagaggccaaaaucccugcccc

SEQ ID NO: 138044 - RNA, 22 nt, Human
agcugccagaugacagugcuau

SEQ ID NO: 138045 - RNA, 22 nt, Human
aagggcuggaucucucugagca

SEQ ID NO: 138046 - RNA, 20 nt, Human
uugagcuuuuaguacagaca

SEQ ID NO: 138047 - RNA, 15 nt, Human
ugauuuccuacuaac

SEQ ID NO: 138048 - RNA, 22 nt, Human
aaagaaauagauggcauuuaaa

SEQ ID NO: 138049 - RNA, 22 nt, Human
aauuugcaugaugagaacaaua

SEQ ID NO: 138050 - RNA, 22 nt, Human
ccuguguggaaggcaggaggcc

SEQ ID NO: 138051 - RNA, 22 nt, Human
aggcacugggaauaugcugagg

SEQ ID NO: 138052 - RNA, 22 nt, Human
cauguauagcaaauauuuguuc

SEQ ID NO: 138053 - RNA, 22 nt, Human
aaggaaccauuugugugcaugg

SEQ ID NO: 138054 - RNA, 22 nt, Human
aauguacaaggguuccaguuuu

SEQ ID NO: 138055 - RNA, 22 nt, Human
gugcuucucuucacacccaacu

SEQ ID NO: 138056 - RNA, 22 nt, Human
ccuuccuggagcccaugcagau

SEQ ID NO: 138057 - RNA, 22 nt, Human
ccagagccagagaggugccugc

SEQ ID NO: 138058 - RNA, 22 nt, Human
cagugggaagggcagaggcuuu

SEQ ID NO: 138059 - RNA, 22 nt, Human
agcugaaggcuagaacagcugg

SEQ ID NO: 138060 - RNA, 22 nt, Human
caaggccaagguuuugugaacu

SEQ ID NO: 138061 - RNA, 22 nt, Human
uguguuugaggcauguugcaga

SEQ ID NO: 138062 - RNA, 18 nt, Human
ugcuuggagcauuuacca

SEQ ID NO: 138063 - RNA, 22 nt, Human
uggcugugcggccucgggcaga

SEQ ID NO: 138064 - RNA, 22 nt, Human
cuugucugugucggauaaaacu

SEQ ID NO: 138065 - RNA, 22 nt, Human
uucaggauccccuugaugggcu

SEQ ID NO: 138066 - RNA, 22 nt, Human
uacauucaacaugucacuaugu

SEQ ID NO: 138067 - RNA, 22 nt, Human
cauuuguuggucagauuguagu

SEQ ID NO: 138068 - RNA, 22 nt, Human
agcagcugguaggaguggccac

SEQ ID NO: 138069 - RNA, 21 nt, Human
ucucugugucuuuaagcugga

SEQ ID NO: 138070 - RNA, 22 nt, Human
auguggcuccuuacucaucagc

SEQ ID NO: 138071 - RNA, 22 nt, Human
gcaaagucugcaucuggaucag

SEQ ID NO: 138072 - RNA, 22 nt, Human
ugcuguguuccucaguuucaug

SEQ ID NO: 138073 - RNA, 22 nt, Human
uuuuuauaugaaggauagugcg

SEQ ID NO: 138074 - RNA, 22 nt, Human
ggcacugagaggcucuuccuaa

SEQ ID NO: 138075 - RNA, 22 nt, Human
cacacauugaauucauucuugu

SEQ ID NO: 138076 - RNA, 20 nt, Human
uccagcugucuuucagagac

SEQ ID NO: 138077 - RNA, 22 nt, Human
gcccucucggcauagcaggggc

SEQ ID NO: 138078 - RNA, 22 nt, Human
uaauguguccugaaagcuucug

SEQ ID NO: 138079 - RNA, 22 nt, Human
aaaucaaaagacauguguuuua

SEQ ID NO: 138080 - RNA, 22 nt, Human
ggcugcagagcugggugggccu

SEQ ID NO: 138081 - RNA, 22 nt, Human
ccagagccggcucccucagcuu

SEQ ID NO: 138082 - RNA, 22 nt, Human
gccugccuuuuggaggcacauu

SEQ ID NO: 138083 - RNA, 22 nt, Human
ucauucagguugggcaaguguc

SEQ ID NO: 138084 - RNA, 22 nt, Human
caguuuuugccauuaagaguaa

SEQ ID NO: 138085 - RNA, 22 nt, Human
acauuucugagcagggagcugu

SEQ ID NO: 138086 - RNA, 22 nt, Human
ccucugcugcuguugagcaccg

SEQ ID NO: 138087 - RNA, 22 nt, Human
cugggagcccugacuagccugg

SEQ ID NO: 138088 - RNA, 22 nt, Human
uguaugugcuugagaagguggg

SEQ ID NO: 138089 - RNA, 22 nt, Human
gccugccuuuguaugacccuga

SEQ ID NO: 138090 - RNA, 22 nt, Human
agggacagucuacuguucacug

SEQ ID NO: 138091 - RNA, 22 nt, Human
gucacuguuuccuauuauauuu

SEQ ID NO: 138092 - RNA, 22 nt, Human
acaacauucuuaaauacacuga

SEQ ID NO: 138093 - RNA, 22 nt, Human
caggaggcccaaagggcgcaga

SEQ ID NO: 138094 - RNA, 20 nt, Human
gccuggcacccggggcuggc

SEQ ID NO: 138095 - RNA, 17 nt, Human
ucugggcuucagugguc

SEQ ID NO: 138096 - RNA, 22 nt, Human
gucuggaguggggccugagaau

SEQ ID NO: 138097 - RNA, 22 nt, Human
aucacauucuuucaaagcaguc

SEQ ID NO: 138098 - RNA, 22 nt, Human
gagccuggagcuggaacgaagc

SEQ ID NO: 138099 - RNA, 22 nt, Human
uugccaggagcucaucugaggg

SEQ ID NO: 138100 - RNA, 22 nt, Human
acuuagaacaggcagaauucca

SEQ ID NO: 138101 - RNA, 22 nt, Human
agcugauuccacuuuuucccca

SEQ ID NO: 138102 - RNA, 22 nt, Human
cuuucauucuuagauauuagug

SEQ ID NO: 138103 - RNA, 22 nt, Human
ccugggagagucuguggucucc

SEQ ID NO: 138104 - RNA, 22 nt, Human
cagcaguggaacuacccaggga

SEQ ID NO: 138105 - RNA, 22 nt, Human
cggggcuguagcacagcugagc

SEQ ID NO: 138106 - RNA, 22 nt, Human
uccuucagugucccgcucaggu

SEQ ID NO: 138107 - RNA, 22 nt, Human
ggcugcugguagggguaggaag

SEQ ID NO: 138108 - RNA, 22 nt, Human
cgcugugugcagacugaaaaug

SEQ ID NO: 138109 - RNA, 22 nt, Human
ccacugaaggucaacauagagc

SEQ ID NO: 138110 - RNA, 22 nt, Human
cucagcagagaccagggaggaa

SEQ ID NO: 138111 - RNA, 22 nt, Human
aaagccuugggauuugugauca

SEQ ID NO: 138112 - RNA, 22 nt, Human
gugccugguuuggggaguguuc

SEQ ID NO: 138113 - RNA, 22 nt, Human
uaguuucuaaacugaacuguca

SEQ ID NO: 138114 - RNA, 22 nt, Human
ggagccuggcaaugcugcgucc

SEQ ID NO: 138115 - RNA, 22 nt, Human
gcagaagggaauaaggagcuuu

SEQ ID NO: 138116 - RNA, 22 nt, Human
ugcauggacucaucagacaaga

SEQ ID NO: 138117 - RNA, 20 nt, Human
cuguccccgaggucaccagg

SEQ ID NO: 138118 - RNA, 22 nt, Human
aaguguuaaaagauuaaaugcu

SEQ ID NO: 138119 - RNA, 22 nt, Human
uucagaaugugaccuuauuugg

SEQ ID NO: 138120 - RNA, 22 nt, Human
cauugcacugcagcccgggcaa

SEQ ID NO: 138121 - RNA, 22 nt, Human
aaggcccuggccccagcuucuu

SEQ ID NO: 138122 - RNA, 22 nt, Human
auacaucuugucagauucaugu

SEQ ID NO: 138123 - RNA, 22 nt, Human
caguguccucagccagcagcua

SEQ ID NO: 138124 - RNA, 22 nt, Human
caguggaggcucaagugugcuu

SEQ ID NO: 138125 - RNA, 22 nt, Human
ccuggcugggccugauuucuca

SEQ ID NO: 138126 - RNA, 22 nt, Human
acuguguggaccacucugaggc

SEQ ID NO: 138127 - RNA, 22 nt, Human
aaaguguacuaugucaugaaca

SEQ ID NO: 138128 - RNA, 22 nt, Human
uaaugugugucaucaguagagu

SEQ ID NO: 138129 - RNA, 22 nt, Human
acugagcucuugacugggaguu

SEQ ID NO: 138130 - RNA, 18 nt, Human
uacaugcauaaaugaagc

SEQ ID NO: 138131 - RNA, 22 nt, Human
uucccaggcugugcuaccagag

SEQ ID NO: 138132 - RNA, 22 nt, Human
cacagaauuaagggagaaauau

SEQ ID NO: 138133 - RNA, 22 nt, Human
uacaguaacauguuguacaagc

SEQ ID NO: 138134 - RNA, 22 nt, Human
cacaguaucuuuugaguaagca

SEQ ID NO: 138135 - RNA, 22 nt, Human
gaagagcuguagccugcucuuu

SEQ ID NO: 138136 - RNA, 22 nt, Human
cagcagcaggcgcacggccguc

SEQ ID NO: 138137 - RNA, 22 nt, Human
auuuugaugcuaucuaaugaau

SEQ ID NO: 138138 - RNA, 22 nt, Human
cucacagaugcugugggucagg

SEQ ID NO: 138139 - RNA, 22 nt, Human
caagaugaucccugaaggcagc

SEQ ID NO: 138140 - RNA, 22 nt, Human
aggguauaaagagcaagcagaa

SEQ ID NO: 138141 - RNA, 22 nt, Human
uuggaaggagucaaccagcuga

SEQ ID NO: 138142 - RNA, 22 nt, Human
ccaggcaucacgggcauguggc

SEQ ID NO: 138143 - RNA, 22 nt, Human
gggagggaagguaccuguguga

SEQ ID NO: 138144 - RNA, 22 nt, Human
agccagcaggugagugcagccu

SEQ ID NO: 138145 - RNA, 22 nt, Human
uuugugugcaacgcauggaguc

SEQ ID NO: 138146 - RNA, 19 nt, Human
gggcuucugggaucaagag

SEQ ID NO: 138147 - RNA, 22 nt, Human
uuuccucugacugcuccccugc

SEQ ID NO: 138148 - RNA, 22 nt, Human
cuggggggagcugcguccagca

SEQ ID NO: 138149 - RNA, 22 nt, Human
ugucucaguacacuccgauguu

SEQ ID NO: 138150 - RNA, 22 nt, Human
uauguguggcagcugggagugu

SEQ ID NO: 138151 - RNA, 22 nt, Human
cagaggugcauacaggucauua

SEQ ID NO: 138152 - RNA, 22 nt, Human
ucauugcaguagggagagaccc

SEQ ID NO: 138153 - RNA, 22 nt, Human
aaaagagucuuaggcagucaua

SEQ ID NO: 138154 - RNA, 22 nt, Human
ggagccugacagugcccagcau

SEQ ID NO: 138155 - RNA, 22 nt, Human
aacaugauggggaagaacaaga

SEQ ID NO: 138156 - RNA, 22 nt, Human
uguucucuucucauugaacaug

SEQ ID NO: 138157 - RNA, 22 nt, Human
acccagagcugggcuuggcaaa

SEQ ID NO: 138158 - RNA, 22 nt, Human
ucugcagcuuuuugguggggug

SEQ ID NO: 138159 - RNA, 22 nt, Human
ccugggaggcggagguugcagu

SEQ ID NO: 138160 - RNA, 22 nt, Human
ugcuuaauauugugauguaaua

SEQ ID NO: 138161 - RNA, 22 nt, Human
cauguacacucauguaacuaua

SEQ ID NO: 138162 - RNA, 22 nt, Human
gcaucuaaauaaacgugggagu

SEQ ID NO: 138163 - RNA, 23 nt, Human
ccugaagggucaggguccucagc

SEQ ID NO: 138164 - RNA, 22 nt, Human
uugaaggacauccuauuucuag

SEQ ID NO: 138165 - RNA, 22 nt, Human
ucuucacaugaccuucaugucu

SEQ ID NO: 138166 - RNA, 21 nt, Human
aggagcuguguuagcuggucg

SEQ ID NO: 138167 - RNA, 22 nt, Human
ccaccagcagugugcaaggauu

SEQ ID NO: 138168 - RNA, 22 nt, Human
auaugugugccauuucagcagu

SEQ ID NO: 138169 - RNA, 22 nt, Human
ugauuuccaauaaggagaaugu

SEQ ID NO: 138170 - RNA, 22 nt, Human
uaaaugugggggccacgggcuu

SEQ ID NO: 138171 - RNA, 22 nt, Human
cuggccuuuaaaaugaccuuau

SEQ ID NO: 138172 - RNA, 22 nt, Human
ugcaguggaaagacucagacuu

SEQ ID NO: 138173 - RNA, 21 nt, Human
cauuucuauugaugagaaaag

SEQ ID NO: 138174 - RNA, 22 nt, Human
cagggccuccccggcagucuuu

SEQ ID NO: 138175 - RNA, 22 nt, Human
cguggccuuugagugagcuccc

SEQ ID NO: 138176 - RNA, 22 nt, Human
ugcuucaggagaugucaccaug

SEQ ID NO: 138177 - RNA, 22 nt, Human
cuuggccucuucucaggguggg

SEQ ID NO: 138178 - RNA, 22 nt, Human
ugagcuuccucccugcauccau

SEQ ID NO: 138179 - RNA, 22 nt, Human
aggagucauaaaugugaacaaa

SEQ ID NO: 138180 - RNA, 22 nt, Human
ucucaggaagauuagggcuaag

SEQ ID NO: 138181 - RNA, 22 nt, Human
ucucuggagcugcagauccagg

SEQ ID NO: 138182 - RNA, 22 nt, Human
caggagcaaggagcagugggau

SEQ ID NO: 138183 - RNA, 22 nt, Human
ugcagcagcagggaggaggcuc

SEQ ID NO: 138184 - RNA, 22 nt, Human
ucagaggagccaaaguucugag

SEQ ID NO: 138185 - RNA, 22 nt, Human
ugcuggccgugagcucucggga

SEQ ID NO: 138186 - RNA, 22 nt, Human
cuuuccagaccuccuuguagcu

SEQ ID NO: 138187 - RNA, 22 nt, Human
acugucugcccugagaugccag

SEQ ID NO: 138188 - RNA, 22 nt, Human
agagccugugggagaugcagcu

SEQ ID NO: 138189 - RNA, 22 nt, Human
gcaaggcugugcacuuugcauu

SEQ ID NO: 138190 - RNA, 22 nt, Human
gcucagagcuugaaguuccacu

SEQ ID NO: 138191 - RNA, 22 nt, Human
auucagcaguuccugcuucagu

SEQ ID NO: 138192 - RNA, 22 nt, Human
acuuaguauuuuucagcuuuga

SEQ ID NO: 138193 - RNA, 22 nt, Human
uggcucaguuuagcagcucagu

SEQ ID NO: 138194 - RNA, 23 nt, Human
cugcuguguuggucucgauggga

SEQ ID NO: 138195 - RNA, 23 nt, Human
ggagugcaauggcgccaucucgg

SEQ ID NO: 138196 - RNA, 22 nt, Human
uuucuacucauccuuuggagaa

SEQ ID NO: 138197 - RNA, 22 nt, Human
gcugucacacaugggaucucag

SEQ ID NO: 138198 - RNA, 22 nt, Human
uaaauuauguuccauguccuuu

SEQ ID NO: 138199 - RNA, 22 nt, Human
aucaggaucagggcuagcagag

SEQ ID NO: 138200 - RNA, 22 nt, Human
aaugagacacgugaagcagaug

SEQ ID NO: 138201 - RNA, 22 nt, Human
ugccuguggaaaggcuggugcu

SEQ ID NO: 138202 - RNA, 22 nt, Human
aagaaauuaaugugccauuacu

SEQ ID NO: 138203 - RNA, 22 nt, Human
gaagccaguacugugcucugca

SEQ ID NO: 138204 - RNA, 22 nt, Human
caggagacaaguuagcagcuga

SEQ ID NO: 138205 - RNA, 22 nt, Human
aaaauuauucauggcuuuugga

SEQ ID NO: 138206 - RNA, 22 nt, Human
agccaaggagugcagguggcuu

SEQ ID NO: 138207 - RNA, 22 nt, Human
gaggccugaggcugccuggagc

SEQ ID NO: 138208 - RNA, 22 nt, Human
ucucuggggauggaccugggag

SEQ ID NO: 138209 - RNA, 22 nt, Human
uagcugccuuugggcuccugcu

SEQ ID NO: 138210 - RNA, 22 nt, Human
ucucucuccuaguuuuuagugg

SEQ ID NO: 138211 - RNA, 22 nt, Human
gcagccacucucauuccacgug

SEQ ID NO: 138212 - RNA, 22 nt, Human
auuguucuggauauuuacauug

SEQ ID NO: 138213 - RNA, 22 nt, Human
uguguagugauuuucuuccaac

SEQ ID NO: 138214 - RNA, 22 nt, Human
gggucucucucggcuccacgcg

SEQ ID NO: 138215 - RNA, 22 nt, Human
cagucccaaggaggaagcaguc

SEQ ID NO: 138216 - RNA, 20 nt, Human
ggccuuggguuucgccuguu

SEQ ID NO: 138217 - RNA, 22 nt, Human
gcccacacaccagcucaggagg

SEQ ID NO: 138218 - RNA, 22 nt, Human
ugccugggguuggcaaacugcu

SEQ ID NO: 138219 - RNA, 22 nt, Human
uuaacuauuauuagcaucuuug

SEQ ID NO: 138220 - RNA, 22 nt, Human
ggcugccugaggcagugagaga

SEQ ID NO: 138221 - RNA, 22 nt, Human
gaggcugggaaguccaagacca

SEQ ID NO: 138222 - RNA, 22 nt, Human
uacaguuaaaaaguucaauggu

SEQ ID NO: 138223 - RNA, 22 nt, Human
uaaaguauccaguuauucuucu

SEQ ID NO: 138224 - RNA, 22 nt, Human
ccugccugcggcccgcggggag

SEQ ID NO: 138225 - RNA, 22 nt, Human
uggcuguggacucagauggcuc

SEQ ID NO: 138226 - RNA, 22 nt, Human
uacaaagucaccagcuucuugc

SEQ ID NO: 138227 - RNA, 22 nt, Human
guccugggccugcugaggcuga

SEQ ID NO: 138228 - RNA, 22 nt, Human
ggauggagaugaccauggugac

SEQ ID NO: 138229 - RNA, 22 nt, Human
uugaauaguuuuggauagcaua

SEQ ID NO: 138230 - RNA, 22 nt, Human
ucugccugcggcugcagguggc

SEQ ID NO: 138231 - RNA, 22 nt, Human
uuucaguuuaugucuugaauua

SEQ ID NO: 138232 - RNA, 22 nt, Human
acaguauauaugguuaucugau

SEQ ID NO: 138233 - RNA, 22 nt, Human
gagauucuguagucaggcaucu

SEQ ID NO: 138234 - RNA, 22 nt, Human
auacauguuguaccauauguuu

SEQ ID NO: 138235 - RNA, 22 nt, Human
cagcucccuauggugaggcgac

SEQ ID NO: 138236 - RNA, 22 nt, Human
gccugcagugagugcagaaggu

SEQ ID NO: 138237 - RNA, 22 nt, Human
uccucugcuguucugguucuuu

SEQ ID NO: 138238 - RNA, 22 nt, Human
aagcagcauucagugaaaugug

SEQ ID NO: 138239 - RNA, 22 nt, Human
gacagaagaggaacuuggacag

SEQ ID NO: 138240 - RNA, 22 nt, Human
gcugugugacccuagccaguag

SEQ ID NO: 138241 - RNA, 23 nt, Human
aggagccaggugcagcccuugug

SEQ ID NO: 138242 - RNA, 20 nt, Human
ccaagagcaugcaugaggaa

SEQ ID NO: 138243 - RNA, 22 nt, Human
ggggcagcucccgagggcagga

SEQ ID NO: 138244 - RNA, 22 nt, Human
cgcugggggaacagcgagggug

SEQ ID NO: 138245 - RNA, 22 nt, Human
uugacaguugcaauggugaucu

SEQ ID NO: 138246 - RNA, 22 nt, Human
gguggcugaaucaaaucaggcc

SEQ ID NO: 138247 - RNA, 20 nt, Human
caggaugauuggacacgaug

SEQ ID NO: 138248 - RNA, 23 nt, Human
ucuugaaaagccuacagcaguuc

SEQ ID NO: 138249 - RNA, 22 nt, Human
agugacugggcagggcagggcc

SEQ ID NO: 138250 - RNA, 22 nt, Human
cagaggccucacuuccagccag

SEQ ID NO: 138251 - RNA, 22 nt, Human
uuagaaaacauaagugguaaag

SEQ ID NO: 138252 - RNA, 22 nt, Human
uuccuguauucuaaagggaaag

SEQ ID NO: 138253 - RNA, 22 nt, Human
cagagcugcacauucuaugaug

SEQ ID NO: 138254 - RNA, 22 nt, Human
agaggcuccaccuucucugucc

SEQ ID NO: 138255 - RNA, 22 nt, Human
uccugagagcagaguccaggug

SEQ ID NO: 138256 - RNA, 22 nt, Human
acaaaugcuuaguucaccaaaa

SEQ ID NO: 138257 - RNA, 22 nt, Human
augcacagacccaaaggccauc

SEQ ID NO: 138258 - RNA, 21 nt, Human
gccuggcagguggaagggcuc

SEQ ID NO: 138259 - RNA, 22 nt, Human
cugugagucuucagcaaguguu

SEQ ID NO: 138260 - RNA, 22 nt, Human
auucuucugccuacuuucaucc

SEQ ID NO: 138261 - RNA, 22 nt, Human
gcaggcaggagcccaacugccu

SEQ ID NO: 138262 - RNA, 20 nt, Human
uuuaacuggccuucuggcuc

SEQ ID NO: 138263 - RNA, 22 nt, Human
gcuggggucugugaggagggcu

SEQ ID NO: 138264 - RNA, 22 nt, Human
uggccucucuaccaggcagccu

SEQ ID NO: 138265 - RNA, 22 nt, Human
cagcagugucuccagcaucaca

SEQ ID NO: 138266 - RNA, 22 nt, Human
ccaucuccacugucccugucaa

SEQ ID NO: 138267 - RNA, 22 nt, Human
cuggcucauagagcagcuccaa

SEQ ID NO: 138268 - RNA, 22 nt, Human
gaacaauagugguaacaaagcc

SEQ ID NO: 138269 - RNA, 22 nt, Human
ugugugggcgaagacagccuuu

SEQ ID NO: 138270 - RNA, 22 nt, Human
gcuuuacaugauuucucacccu

SEQ ID NO: 138271 - RNA, 22 nt, Human
ugcccugcagugagugcgucug

SEQ ID NO: 138272 - RNA, 22 nt, Human
cuugacagaagguuuuauccua

SEQ ID NO: 138273 - RNA, 22 nt, Human
uggcagggaguugcaggauuuc

SEQ ID NO: 138274 - RNA, 22 nt, Human
uuaaauauuauguugucugcaa

SEQ ID NO: 138275 - RNA, 22 nt, Human
gucaugccuggcuucuuagaca

SEQ ID NO: 138276 - RNA, 22 nt, Human
acucugccuuucagcagaugaa

SEQ ID NO: 138277 - RNA, 22 nt, Human
cagagagagugggguguggauu

SEQ ID NO: 138278 - RNA, 22 nt, Human
caggcagcauuuacucugauga

SEQ ID NO: 138279 - RNA, 19 nt, Human
ugcaggaggacugagcaga

SEQ ID NO: 138280 - RNA, 22 nt, Human
acagcuguauccccagagcuca

SEQ ID NO: 138281 - RNA, 22 nt, Human
auugucugaauccaaagcucug

SEQ ID NO: 138282 - RNA, 22 nt, Human
aggcuggaguacaguggcuauu

SEQ ID NO: 138283 - RNA, 22 nt, Human
ccaggcugcuuagccuuaucuu

SEQ ID NO: 138284 - RNA, 22 nt, Human
agcugcaggccucuccugggga

SEQ ID NO: 138285 - RNA, 22 nt, Human
gaugguuuggaaugaaguagcu

SEQ ID NO: 138286 - RNA, 22 nt, Human
ugcugccaagcccgugcuccug

SEQ ID NO: 138287 - RNA, 22 nt, Human
uuuuggucagguuggucucgaa

SEQ ID NO: 138288 - RNA, 17 nt, Human
gauuuccugaaguucuu

SEQ ID NO: 138289 - RNA, 18 nt, Human
uacaguauuuucucgccu

SEQ ID NO: 138290 - RNA, 21 nt, Human
aggugcagagccagggaccag

SEQ ID NO: 138291 - RNA, 22 nt, Human
cacaggaggaggugcccgggcc

SEQ ID NO: 138292 - RNA, 22 nt, Human
auguguacaaccaagcacuaaa

SEQ ID NO: 138293 - RNA, 22 nt, Human
uuuauuccaugugucuaugacc

SEQ ID NO: 138294 - RNA, 21 nt, Human
aucauucuggaaaauucaagc

SEQ ID NO: 138295 - RNA, 22 nt, Human
aucuccaggcauuucaagagac

SEQ ID NO: 138296 - RNA, 22 nt, Human
augccuggacugacaugcacug

SEQ ID NO: 138297 - RNA, 22 nt, Human
gagcucugggaaacaaagugua

SEQ ID NO: 138298 - RNA, 22 nt, Human
gccuggugugcgccgcgcagcu

SEQ ID NO: 138299 - RNA, 22 nt, Human
ccaggacuuuaaguccagcacu

SEQ ID NO: 138300 - RNA, 22 nt, Human
auacuuuggggguuaguguaga

SEQ ID NO: 138301 - RNA, 22 nt, Human
agagcuggauggucaagauggc

SEQ ID NO: 138302 - RNA, 22 nt, Human
ggucaugcugugaaucagugcu

SEQ ID NO: 138303 - RNA, 22 nt, Human
ucaggacagccagggugcagac

SEQ ID NO: 138304 - RNA, 20 nt, Human
agccugccagcuggcccaga

SEQ ID NO: 138305 - RNA, 23 nt, Human
caguggagacucaugcuuccuua

SEQ ID NO: 138306 - RNA, 22 nt, Human
gaggaacccagcugggguugcc

SEQ ID NO: 138307 - RNA, 22 nt, Human
acaguuaucuuugaaauagaga

SEQ ID NO: 138308 - RNA, 23 nt, Human
ucuuuacagcagcaggauuugga

SEQ ID NO: 138309 - RNA, 21 nt, Human
uguguauguccaaugcccuac

SEQ ID NO: 138310 - RNA, 23 nt, Human
uugaaggagaaagcuuucuuggu

SEQ ID NO: 138311 - RNA, 22 nt, Human
cugagcccaggcgggagcugag

SEQ ID NO: 138312 - RNA, 16 nt, Human
gccuggaguggcaggg

SEQ ID NO: 138313 - RNA, 22 nt, Human
gccuggcaggccuguuggggcu

SEQ ID NO: 138314 - RNA, 22 nt, Human
agaugaagauaucugcaggggc

SEQ ID NO: 138315 - RNA, 22 nt, Human
ucagaggaaaggucagauggcu

SEQ ID NO: 138316 - RNA, 22 nt, Human
uguguauguaagcaugugcaua

SEQ ID NO: 138317 - RNA, 22 nt, Human
uacaaguauauucuagugauau

SEQ ID NO: 138318 - RNA, 22 nt, Human
cucucugguacauagaguuugg

SEQ ID NO: 138319 - RNA, 21 nt, Human
ccuccaggagcagagcccuga

SEQ ID NO: 138320 - RNA, 23 nt, Human
acacaauagaguacuauucagcc

SEQ ID NO: 138321 - RNA, 22 nt, Human
uuacagcuuacauuuuaccuug

SEQ ID NO: 138322 - RNA, 22 nt, Human
cucucucuuuagaagcgucugg

SEQ ID NO: 138323 - RNA, 18 nt, Human
uggagccauugccaccau

SEQ ID NO: 138324 - RNA, 22 nt, Human
cuggcaggcggcagagcccagg

SEQ ID NO: 138325 - RNA, 22 nt, Human
uagacacaucaaguauaguuaa

SEQ ID NO: 138326 - RNA, 22 nt, Human
gcugauuauuacaugucugugg

SEQ ID NO: 138327 - RNA, 22 nt, Human
cuggccaacuugcuuguuggca

SEQ ID NO: 138328 - RNA, 22 nt, Human
agccucucuccagcuuggcaga

SEQ ID NO: 138329 - RNA, 22 nt, Human
agaaugcauuuuguguagcuau

SEQ ID NO: 138330 - RNA, 22 nt, Human
ccugggagguggagguugcagc

SEQ ID NO: 138331 - RNA, 22 nt, Human
uaggccaggacagagcuuccag

SEQ ID NO: 138332 - RNA, 22 nt, Human
gaggccuggcugggaggaggug

SEQ ID NO: 138333 - RNA, 22 nt, Human
gggcccuggacguggcggcaga

SEQ ID NO: 138334 - RNA, 22 nt, Human
cugccuggagcauucugaaggu

SEQ ID NO: 138335 - RNA, 22 nt, Human
aggcugcuuucauggccgcccc

SEQ ID NO: 138336 - RNA, 20 nt, Human
gggugagauguaggagaggg

SEQ ID NO: 138337 - RNA, 23 nt, Human
ugaaggccuggaggacgcguugu

SEQ ID NO: 138338 - RNA, 22 nt, Human
agcuguguuaggauguuaauaa

SEQ ID NO: 138339 - RNA, 18 nt, Human
cagaaguccuucaaggcc

SEQ ID NO: 138340 - RNA, 22 nt, Human
uaacagaagaugaaacuucuuu

SEQ ID NO: 138341 - RNA, 22 nt, Human
aacauauaaacucuuaaguuca

SEQ ID NO: 138342 - RNA, 22 nt, Human
ccauaaggagccagacauucca

SEQ ID NO: 138343 - RNA, 22 nt, Human
agcagagucugugugcacuuua

SEQ ID NO: 138344 - RNA, 22 nt, Human
ucuggccuuaucuguccaagcc

SEQ ID NO: 138345 - RNA, 22 nt, Human
ccaaaugcuccacugacuuugg

SEQ ID NO: 138346 - RNA, 22 nt, Human
caguuucuuggaugccaauuuc

SEQ ID NO: 138347 - RNA, 21 nt, Human
uuugaaagcuacaucuauagc

SEQ ID NO: 138348 - RNA, 22 nt, Human
ucaauucaacacaugcacauug

SEQ ID NO: 138349 - RNA, 22 nt, Human
ugagccuggagucguggagggg

SEQ ID NO: 138350 - RNA, 22 nt, Human
cugcugagguccuugcucagac

SEQ ID NO: 138351 - RNA, 22 nt, Human
acacugcagaugaaagcauaag

SEQ ID NO: 138352 - RNA, 22 nt, Human
gagcucccaggccccagcaagg

SEQ ID NO: 138353 - RNA, 22 nt, Human
gcacugaacuuuaaucauuucu

SEQ ID NO: 138354 - RNA, 22 nt, Human
acauuugucuucuuucagauua

SEQ ID NO: 138355 - RNA, 22 nt, Human
ugagcuguagcagaugcuguug

SEQ ID NO: 138356 - RNA, 19 nt, Human
uccaaaggacccaccucca

SEQ ID NO: 138357 - RNA, 22 nt, Human
agaaaugacacacaugagacau

SEQ ID NO: 138358 - RNA, 22 nt, Human
aaagaucagucugaagcaacau

SEQ ID NO: 138359 - RNA, 22 nt, Human
gacuuucucuccucccaggugu

SEQ ID NO: 138360 - RNA, 22 nt, Human
ucagggcacauucugcaguggc

SEQ ID NO: 138361 - RNA, 22 nt, Human
agcuccugcacccagccuugag

SEQ ID NO: 138362 - RNA, 22 nt, Human
gugugggcuaugugcgugggca

SEQ ID NO: 138363 - RNA, 22 nt, Human
cauggccuugagugacugcacu

SEQ ID NO: 138364 - RNA, 22 nt, Human
caggcugagcucuggccugggc

SEQ ID NO: 138365 - RNA, 22 nt, Human
ccaggagcuggagggugcagug

SEQ ID NO: 138366 - RNA, 22 nt, Human
ccacaggggcccacgagccgcu

SEQ ID NO: 138367 - RNA, 22 nt, Human
uggcccugugugcaggcugcac

SEQ ID NO: 138368 - RNA, 22 nt, Human
gcuggcaucacuggcuucggug

SEQ ID NO: 138369 - RNA, 22 nt, Human
cagcagcuggugagacacagcc

SEQ ID NO: 138370 - RNA, 23 nt, Human
ugggccuggccucccaguccagc

SEQ ID NO: 138371 - RNA, 22 nt, Human
aaaaguuuaagacucauucuag

SEQ ID NO: 138372 - RNA, 21 nt, Human
ugcaggagucugugagucagg

SEQ ID NO: 138373 - RNA, 22 nt, Human
ucuguggcuuucuuauguugua

SEQ ID NO: 138374 - RNA, 22 nt, Human
aaccauuugccauuaucuuaag

SEQ ID NO: 138375 - RNA, 22 nt, Human
auggauaauggugauaguugca

SEQ ID NO: 138376 - RNA, 22 nt, Human
cugggccuagcaacagaggagu

SEQ ID NO: 138377 - RNA, 22 nt, Human
ggggaugguggcauuuguaaaa

SEQ ID NO: 138378 - RNA, 22 nt, Human
aggccugucuggggcucagcca

SEQ ID NO: 138379 - RNA, 22 nt, Human
uuauuugcccauguuuagcaga

SEQ ID NO: 138380 - RNA, 22 nt, Human
ucauacaucuuguauaucuauc

SEQ ID NO: 138381 - RNA, 22 nt, Human
ucauugcaagcucauuuaucug

SEQ ID NO: 138382 - RNA, 22 nt, Human
ucucuguguguuggcuguauau

SEQ ID NO: 138383 - RNA, 22 nt, Human
ggcuucaccgcgggguugcagg

SEQ ID NO: 138384 - RNA, 22 nt, Human
aagcuuccugaaugcucauuua

SEQ ID NO: 138385 - RNA, 22 nt, Human
ccacagggcacaagggagguug

SEQ ID NO: 138386 - RNA, 22 nt, Human
aacagcaauagcacuauucauu

SEQ ID NO: 138387 - RNA, 22 nt, Human
ggcagcucaccucugguccagg

SEQ ID NO: 138388 - RNA, 22 nt, Human
gggagggacacaaagaguuccc

SEQ ID NO: 138389 - RNA, 22 nt, Human
ccagcccugaacccugcugcau

SEQ ID NO: 138390 - RNA, 22 nt, Human
uggccucuggcugaggacuaac

SEQ ID NO: 138391 - RNA, 22 nt, Human
ggagcuggucagccuugagcau

SEQ ID NO: 138392 - RNA, 22 nt, Human
aaauguaguauguugcauguau

SEQ ID NO: 138393 - RNA, 22 nt, Human
cagcagcugauggggaagugau

SEQ ID NO: 138394 - RNA, 22 nt, Human
agccagcagggcuuagaggaca

SEQ ID NO: 138395 - RNA, 22 nt, Human
augcaguggcagcuccuggugu

SEQ ID NO: 138396 - RNA, 22 nt, Human
caggugggagcggagacugauu

SEQ ID NO: 138397 - RNA, 19 nt, Human
gcucagagggcccugugcu

SEQ ID NO: 138398 - RNA, 22 nt, Human
cagggccacccucugcugggug

SEQ ID NO: 138399 - RNA, 22 nt, Human
gagaggcuaugagguucugugu

SEQ ID NO: 138400 - RNA, 19 nt, Human
cucugccucuggcuguggc

SEQ ID NO: 138401 - RNA, 22 nt, Human
aaguuauugcagcaauccaagu

SEQ ID NO: 138402 - RNA, 22 nt, Human
gcucccaccaggcagaccuacc

SEQ ID NO: 138403 - RNA, 22 nt, Human
gcaagcaagcagguagagcuga

SEQ ID NO: 138404 - RNA, 22 nt, Human
uaaaugcagauuccugagccua

SEQ ID NO: 138405 - RNA, 22 nt, Human
caguggcugugaccagggaccu

SEQ ID NO: 138406 - RNA, 22 nt, Human
guguuuccucacuucucugacu

SEQ ID NO: 138407 - RNA, 22 nt, Human
cugugucccuugucccagagcc

SEQ ID NO: 138408 - RNA, 22 nt, Human
cccaggagagaggccaguuggc

SEQ ID NO: 138409 - RNA, 22 nt, Human
aguauacauauauuagccuucg

SEQ ID NO: 138410 - RNA, 22 nt, Human
uccagcagguuggucaggugca

SEQ ID NO: 138411 - RNA, 22 nt, Human
ucauugcauuuauucacuggca

SEQ ID NO: 138412 - RNA, 22 nt, Human
aagaggucauaccagauaaggg

SEQ ID NO: 138413 - RNA, 22 nt, Human
uuugggcaguagauguaucacu

SEQ ID NO: 138414 - RNA, 22 nt, Human
uuucucugcuguguuggcagcu

SEQ ID NO: 138415 - RNA, 21 nt, Human
uugaagcaaggguggcucuga

SEQ ID NO: 138416 - RNA, 22 nt, Human
agcugcagagguuugugcaaca

SEQ ID NO: 138417 - RNA, 22 nt, Human
ucuuacauauagcaugaguaca

SEQ ID NO: 138418 - RNA, 22 nt, Human
ccaggcagagugcuccagaaag

SEQ ID NO: 138419 - RNA, 22 nt, Human
acaaagucucuaauaaucuucu

SEQ ID NO: 138420 - RNA, 22 nt, Human
acagauugaucuugagaauuau

SEQ ID NO: 138421 - RNA, 22 nt, Human
ccugccaggcuuugggcuucug

SEQ ID NO: 138422 - RNA, 22 nt, Human
auguuacacauaggcauaaaug

SEQ ID NO: 138423 - RNA, 19 nt, Human
gcugugugaccuugggcaa

SEQ ID NO: 138424 - RNA, 22 nt, Human
uugcauguuauuuaaucuguau

SEQ ID NO: 138425 - RNA, 20 nt, Human
aguuauaguaucuagccaug

SEQ ID NO: 138426 - RNA, 22 nt, Human
ugugaaagcaagucuaguucuc

SEQ ID NO: 138427 - RNA, 22 nt, Human
aacuuuauuguuaggggcuaaa

SEQ ID NO: 138428 - RNA, 22 nt, Human
gcacaauuauuuaugcaguaug

SEQ ID NO: 138429 - RNA, 22 nt, Human
uuggaaggugagucccuggguu

SEQ ID NO: 138430 - RNA, 22 nt, Human
auguggcuuuucuaacccuucc

SEQ ID NO: 138431 - RNA, 22 nt, Human
gaggaaccaaaucagcuugcac

SEQ ID NO: 138432 - RNA, 22 nt, Human
gaguuauuucagaaggaaagau

SEQ ID NO: 138433 - RNA, 22 nt, Human
aguuuauguagaauuggcaaua

SEQ ID NO: 138434 - RNA, 22 nt, Human
guguccagggccguguugucuu

SEQ ID NO: 138435 - RNA, 22 nt, Human
auuuguagugaagugaaaauaa

SEQ ID NO: 138436 - RNA, 22 nt, Human
ggaggcccagagaggugaagug

SEQ ID NO: 138437 - RNA, 22 nt, Human
ucuugacauugcaaucuucaga

SEQ ID NO: 138438 - RNA, 22 nt, Human
cagagcagggugcaccuugggc

SEQ ID NO: 138439 - RNA, 22 nt, Human
uaaaugugagugaugcggugaa

SEQ ID NO: 138440 - RNA, 22 nt, Human
ugcauuugucuugucucaugaa

SEQ ID NO: 138441 - RNA, 21 nt, Human
gcucucugcaugguggcucag

SEQ ID NO: 138442 - RNA, 22 nt, Human
caguucuuuguggggaguucuc

SEQ ID NO: 138443 - RNA, 22 nt, Human
ugcagccaccaccucugcugaa

SEQ ID NO: 138444 - RNA, 22 nt, Human
ggaccuggcaauuugcaucucu

SEQ ID NO: 138445 - RNA, 22 nt, Human
cuacauuucccagcugccuucc

SEQ ID NO: 138446 - RNA, 22 nt, Human
ugcacacacgcggcacaucugu

SEQ ID NO: 138447 - RNA, 22 nt, Human
uguuuuaagagcgcacuuuaua

SEQ ID NO: 138448 - RNA, 22 nt, Human
cccuggaggcaaagguugcagu

SEQ ID NO: 138449 - RNA, 22 nt, Human
ugcacuggggucccagcgcacg

SEQ ID NO: 138450 - RNA, 22 nt, Human
cugauguguuuuaguuugguaa

SEQ ID NO: 138451 - RNA, 22 nt, Human
gaaggccacaagagaaguuaag

SEQ ID NO: 138452 - RNA, 22 nt, Human
ccaccaggacagcccugagggg

SEQ ID NO: 138453 - RNA, 22 nt, Human
ugccucagcugaggccgcucca

SEQ ID NO: 138454 - RNA, 22 nt, Human
agcaggaaguagucuguaagca

SEQ ID NO: 138455 - RNA, 22 nt, Human
uuucuuguaagauguuuauuaa

SEQ ID NO: 138456 - RNA, 20 nt, Human
gcaggcagggaaugggggug

SEQ ID NO: 138457 - RNA, 22 nt, Human
gcacagggaggcuggccuggcc

SEQ ID NO: 138458 - RNA, 22 nt, Human
gaaacuguauguaguuuuuggg

SEQ ID NO: 138459 - RNA, 22 nt, Human
aaaucaguucucccuuucuuca

SEQ ID NO: 138460 - RNA, 22 nt, Human
uuuuugaaggcugaugugauua

SEQ ID NO: 138461 - RNA, 22 nt, Human
gucaggaugggcagccaaacua

SEQ ID NO: 138462 - RNA, 22 nt, Human
cucugaacucuugggcagcaug

SEQ ID NO: 138463 - RNA, 22 nt, Human
ccaguugguuucaaugggacag

SEQ ID NO: 138464 - RNA, 22 nt, Human
ccagggcuccauugcucauccu

SEQ ID NO: 138465 - RNA, 22 nt, Human
cuuauuuugcugaugacccagg

SEQ ID NO: 138466 - RNA, 22 nt, Human
gaagaacacuucaugauucauu

SEQ ID NO: 138467 - RNA, 22 nt, Human
ugcuggccaacaaggcuccaag

SEQ ID NO: 138468 - RNA, 22 nt, Human
cugcaggggccucgagcacagg

SEQ ID NO: 138469 - RNA, 22 nt, Human
aucaaaaugcuccagugauggu

SEQ ID NO: 138470 - RNA, 22 nt, Human
aaaugucugagacuucugaacu

SEQ ID NO: 138471 - RNA, 22 nt, Human
caguaugagaguugaaucaagg

SEQ ID NO: 138472 - RNA, 22 nt, Human
auccccagaaaauaggugccua

SEQ ID NO: 138473 - RNA, 22 nt, Human
ugccugccaugcagaaagcuga

SEQ ID NO: 138474 - RNA, 22 nt, Human
ugcugccucagcuuccugggcu

SEQ ID NO: 138475 - RNA, 22 nt, Human
gugugugugcauauaacauaua

SEQ ID NO: 138476 - RNA, 22 nt, Human
gcugcucuuuucagagaugaga

SEQ ID NO: 138477 - RNA, 22 nt, Human
acugcagccuagggaccacagu

SEQ ID NO: 138478 - RNA, 22 nt, Human
ucccuguccugggcaaucccag

SEQ ID NO: 138479 - RNA, 22 nt, Human
ggcuccugaaagacuaugggaa

SEQ ID NO: 138480 - RNA, 22 nt, Human
ucacaggcuccagggccuggau

SEQ ID NO: 138481 - RNA, 21 nt, Human
ccagccucagaucagggagcu

SEQ ID NO: 138482 - RNA, 22 nt, Human
uacauuccacuagugacuggcg

SEQ ID NO: 138483 - RNA, 22 nt, Human
agucccaguucgguucuuccuc

SEQ ID NO: 138484 - RNA, 22 nt, Human
acagagcuuaggaugacuccca

SEQ ID NO: 138485 - RNA, 22 nt, Human
ucaggaucggccuuuuuuuaag

SEQ ID NO: 138486 - RNA, 22 nt, Human
ggcuccuguccuccuggagcuc

SEQ ID NO: 138487 - RNA, 22 nt, Human
ucccagccuuccagucugguuu

SEQ ID NO: 138488 - RNA, 22 nt, Human
gccaggcuggugucacaacucu

SEQ ID NO: 138489 - RNA, 22 nt, Human
ugcagggccgcuggaggucaug

SEQ ID NO: 138490 - RNA, 22 nt, Human
ugggacagagugagcuuuggcc

SEQ ID NO: 138491 - RNA, 22 nt, Human
aggcugaggcagguggaucacc

SEQ ID NO: 138492 - RNA, 22 nt, Human
augcccaaugucacaauuuuug

SEQ ID NO: 138493 - RNA, 22 nt, Human
uagauuucucauucauagauug

SEQ ID NO: 138494 - RNA, 22 nt, Human
gcagggccagggcucaggcugu

SEQ ID NO: 138495 - RNA, 22 nt, Human
gucccagaggacagggucacau

SEQ ID NO: 138496 - RNA, 22 nt, Human
cagcaggggaacugugggccag

SEQ ID NO: 138497 - RNA, 22 nt, Human
aaaguuugaaugauauauuagu

SEQ ID NO: 138498 - RNA, 22 nt, Human
agggacugagcuaggaucuagu

SEQ ID NO: 138499 - RNA, 22 nt, Human
agcaagcuaccuagauagucua

SEQ ID NO: 138500 - RNA, 22 nt, Human
augcuguggggagugaggguag

SEQ ID NO: 138501 - RNA, 22 nt, Human
ugaugauguuuaucuugguauu

SEQ ID NO: 138502 - RNA, 22 nt, Human
uuguaugcuguaggcaugcauu

SEQ ID NO: 138503 - RNA, 22 nt, Human
gggcugccuuucuucugggagc

SEQ ID NO: 138504 - RNA, 22 nt, Human
caugggagguuggcuuggcaug

SEQ ID NO: 138505 - RNA, 22 nt, Human
aguguccccuacagaggcauuc

SEQ ID NO: 138506 - RNA, 22 nt, Human
cauggcugcgagaagagugggu

SEQ ID NO: 138507 - RNA, 18 nt, Human
uucacaggaaaugucuuu

SEQ ID NO: 138508 - RNA, 22 nt, Human
ggcacugggagaggugagacgg

SEQ ID NO: 138509 - RNA, 22 nt, Human
uuuaaucuucaaaauagucuua

SEQ ID NO: 138510 - RNA, 22 nt, Human
cuccagggagcuguggagguuu

SEQ ID NO: 138511 - RNA, 22 nt, Human
uaacauuagguagacauaagcc

SEQ ID NO: 138512 - RNA, 22 nt, Human
uccuucagccaugggcucucca

SEQ ID NO: 138513 - RNA, 22 nt, Human
gcacagggagcaggucucuggu

SEQ ID NO: 138514 - RNA, 22 nt, Human
ucaggcugcccguucagggcuc

SEQ ID NO: 138515 - RNA, 22 nt, Human
ggcuggagugggcuccagaguu

SEQ ID NO: 138516 - RNA, 22 nt, Human
uuaaucuucagggacucuugcu

SEQ ID NO: 138517 - RNA, 22 nt, Human
uuugaaaguguuuacuugggaa

SEQ ID NO: 138518 - RNA, 22 nt, Human
guuaacuuccccaugucugcau

SEQ ID NO: 138519 - RNA, 23 nt, Human
uuucaacuccugccauuauuucu

SEQ ID NO: 138520 - RNA, 22 nt, Human
aggcugggaaauguagucuucc

SEQ ID NO: 138521 - RNA, 22 nt, Human
gaacagcuucuugggagcuggg

SEQ ID NO: 138522 - RNA, 22 nt, Human
ugggagagugcucaaugugcaa

SEQ ID NO: 138523 - RNA, 22 nt, Human
gcagccacagaggagggaugca

SEQ ID NO: 138524 - RNA, 18 nt, Human
augggaggggccaagaga

SEQ ID NO: 138525 - RNA, 22 nt, Human
cauugcacagcccuguggugau

SEQ ID NO: 138526 - RNA, 22 nt, Human
cagcugccuucugcgggaaguc

SEQ ID NO: 138527 - RNA, 22 nt, Human
gcucagaaaagugaggcucagu

SEQ ID NO: 138528 - RNA, 22 nt, Human
ucagugugacugauggcuuuau

SEQ ID NO: 138529 - RNA, 22 nt, Human
ugaaagcucugucaucauuccu

SEQ ID NO: 138530 - RNA, 22 nt, Human
uucagcaaacacgaugcuuguu

SEQ ID NO: 138531 - RNA, 22 nt, Human
gaggggcugggguugacuccaa

SEQ ID NO: 138532 - RNA, 22 nt, Human
ggcuccuggcaucuggugggua

SEQ ID NO: 138533 - RNA, 22 nt, Human
gggagagagaaaacguggcgca

SEQ ID NO: 138534 - RNA, 22 nt, Human
uucuucaauuuuccauauacug

SEQ ID NO: 138535 - RNA, 22 nt, Human
ugggcucucuggcaggaaggcu

SEQ ID NO: 138536 - RNA, 22 nt, Human
ugggccaggauuucaagacccu

SEQ ID NO: 138537 - RNA, 22 nt, Human
uggcuccuaggauggugccugg

SEQ ID NO: 138538 - RNA, 22 nt, Human
ugcauuauuugcaugugccugu

SEQ ID NO: 138539 - RNA, 22 nt, Human
ugcaggugugguuccucagcca

SEQ ID NO: 138540 - RNA, 22 nt, Human
uagaaacaucagcuaaccaaaa

SEQ ID NO: 138541 - RNA, 22 nt, Human
ucagggcaagucucagaagguu

SEQ ID NO: 138542 - RNA, 22 nt, Human
caggccugugaguugaggcccc

SEQ ID NO: 138543 - RNA, 22 nt, Human
gaugugugcugcauaguauauu

SEQ ID NO: 138544 - RNA, 20 nt, Human
ggccugagcauggcuggcag

SEQ ID NO: 138545 - RNA, 22 nt, Human
cauguguguggacgagcguggc

SEQ ID NO: 138546 - RNA, 22 nt, Human
cugugugcaggugcuggguacc

SEQ ID NO: 138547 - RNA, 22 nt, Human
caggucagagucccccuguccu

SEQ ID NO: 138548 - RNA, 22 nt, Human
caagcccaggauuccccaguua

SEQ ID NO: 138549 - RNA, 22 nt, Human
ugaagcugugggcaguggagcc

SEQ ID NO: 138550 - RNA, 21 nt, Human
gcacagggacagaucaucaca

SEQ ID NO: 138551 - RNA, 22 nt, Human
agagcuggguggacuuguaguu

SEQ ID NO: 138552 - RNA, 22 nt, Human
cugucagguuggucucagagcu

SEQ ID NO: 138553 - RNA, 22 nt, Human
gagccagcgccuugccucuggg

SEQ ID NO: 138554 - RNA, 22 nt, Human
aauguguagcauuuaaugcagu

SEQ ID NO: 138555 - RNA, 22 nt, Human
gaaggagggugcggaucugagc

SEQ ID NO: 138556 - RNA, 22 nt, Human
gaaaggccagcucacagaugag

SEQ ID NO: 138557 - RNA, 21 nt, Human
ccacaggggcuccccugucag

SEQ ID NO: 138558 - RNA, 22 nt, Human
ucuuccagcaaugugaaaucac

SEQ ID NO: 138559 - RNA, 22 nt, Human
uaacuuuucuaggugugauaau

SEQ ID NO: 138560 - RNA, 22 nt, Human
ccaggccaaauucagucagcag

SEQ ID NO: 138561 - RNA, 22 nt, Human
aaggacuccaauucuuucaucu

SEQ ID NO: 138562 - RNA, 22 nt, Human
gggcaugguggcaggcaccugu

SEQ ID NO: 138563 - RNA, 22 nt, Human
ucuagaaauuuugccuuguauu

SEQ ID NO: 138564 - RNA, 22 nt, Human
ccaguccagugccaugcauggc

SEQ ID NO: 138565 - RNA, 22 nt, Human
auguguaugauaccuuugcuga

SEQ ID NO: 138566 - RNA, 22 nt, Human
uauuuccaccuauuauuuucug

SEQ ID NO: 138567 - RNA, 22 nt, Human
agccucugcuuaugcaaaggua

SEQ ID NO: 138568 - RNA, 22 nt, Human
agaagaaacugucggggauauu

SEQ ID NO: 138569 - RNA, 22 nt, Human
cugcuucuccaaaguaggacuu

SEQ ID NO: 138570 - RNA, 22 nt, Human
ugaaagguagcuggccucauag

SEQ ID NO: 138571 - RNA, 22 nt, Human
auuguggugucaguuauaggca

SEQ ID NO: 138572 - RNA, 22 nt, Human
cuguguguccucggacgaguuu

SEQ ID NO: 138573 - RNA, 22 nt, Human
uuugcauuaguuuagauuucaa

SEQ ID NO: 138574 - RNA, 22 nt, Human
cagaaauucccauuucagauuc

SEQ ID NO: 138575 - RNA, 22 nt, Human
agcaccaucagaugcaauaucu

SEQ ID NO: 138576 - RNA, 22 nt, Human
aguggcugguaguuacugagca

SEQ ID NO: 138577 - RNA, 22 nt, Human
caauguguguguuuuucucaac

SEQ ID NO: 138578 - RNA, 22 nt, Human
ugccugucuuuccucccucgua

SEQ ID NO: 138579 - RNA, 22 nt, Human
cagcccaaagccccaggcuaga

SEQ ID NO: 138580 - RNA, 22 nt, Human
uggcagaaguacacaagcaugc

SEQ ID NO: 138581 - RNA, 22 nt, Human
caggggcuuuuccucuauaagg

SEQ ID NO: 138582 - RNA, 22 nt, Human
agcauuuaggagaauuugagaa

SEQ ID NO: 138583 - RNA, 22 nt, Human
caagugucuauaucagugcuug

SEQ ID NO: 138584 - RNA, 22 nt, Human
aggcugggaaauguauuccagc

SEQ ID NO: 138585 - RNA, 22 nt, Human
agugccuggaccccaugacaua

SEQ ID NO: 138586 - RNA, 22 nt, Human
cuggccugagcacagcggcugc

SEQ ID NO: 138587 - RNA, 22 nt, Human
cagcucugaagaaaggugucua

SEQ ID NO: 138588 - RNA, 22 nt, Human
uuagccaugugggaaaaacagc

SEQ ID NO: 138589 - RNA, 22 nt, Human
ugcacacacaugaaguagcaug

SEQ ID NO: 138590 - RNA, 22 nt, Human
uguggcugcagacacuggagcc

SEQ ID NO: 138591 - RNA, 22 nt, Human
uacauguaauuuucauaguaag

SEQ ID NO: 138592 - RNA, 22 nt, Human
gcagggccagugcagagaggaa

SEQ ID NO: 138593 - RNA, 21 nt, Human
gcacagcaugaguguuggcau

SEQ ID NO: 138594 - RNA, 20 nt, Human
agcauuugaaauaugacuau

SEQ ID NO: 138595 - RNA, 22 nt, Human
cugugugcauaguugugcucaa

SEQ ID NO: 138596 - RNA, 22 nt, Human
ucucucagaggaagaggcagug

SEQ ID NO: 138597 - RNA, 22 nt, Human
uccugccuugccugggacauca

SEQ ID NO: 138598 - RNA, 22 nt, Human
guaauugacucagcucuguuca

SEQ ID NO: 138599 - RNA, 22 nt, Human
caggugggagccacagcguaca

SEQ ID NO: 138600 - RNA, 22 nt, Human
ccagaagucaggaaugagucuu

SEQ ID NO: 138601 - RNA, 22 nt, Human
ugcaggugguuuggacacugcu

SEQ ID NO: 138602 - RNA, 19 nt, Human
cuggugcuugagugaguca

SEQ ID NO: 138603 - RNA, 22 nt, Human
ggugcugguucaggguggcugu

SEQ ID NO: 138604 - RNA, 22 nt, Human
ucugggcuuuacacugugcuua

SEQ ID NO: 138605 - RNA, 22 nt, Human
acauuucuuccuaauuaucccu

SEQ ID NO: 138606 - RNA, 22 nt, Human
cugcuuuguguggucccuccag

SEQ ID NO: 138607 - RNA, 22 nt, Human
cuggcugccacuucagggucuu

SEQ ID NO: 138608 - RNA, 22 nt, Human
ccucccagugccuccagagcag

SEQ ID NO: 138609 - RNA, 22 nt, Human
uuaugacauaugaguacaagua

SEQ ID NO: 138610 - RNA, 22 nt, Human
ccugucuguauugguuugcuau

SEQ ID NO: 138611 - RNA, 22 nt, Human
ccuaagaauuaaugaauacacc

SEQ ID NO: 138612 - RNA, 22 nt, Human
ucucuggaagcgcagaucuguu

SEQ ID NO: 138613 - RNA, 22 nt, Human
uggagcaggugcucaggguaau

SEQ ID NO: 138614 - RNA, 22 nt, Human
ucuggagcgaggucccugucug

SEQ ID NO: 138615 - RNA, 22 nt, Human
ucagggcaggcgagcagcugcu

SEQ ID NO: 138616 - RNA, 22 nt, Human
cccaggcuggagugcaauggug

SEQ ID NO: 138617 - RNA, 22 nt, Human
gcaggcugauagaggauuccau

SEQ ID NO: 138618 - RNA, 22 nt, Human
augaaaacggaccagagcuauu

SEQ ID NO: 138619 - RNA, 22 nt, Human
acucacuuuccauucaagcacc

SEQ ID NO: 138620 - RNA, 21 nt, Human
aguguccuugaucuugccuug

SEQ ID NO: 138621 - RNA, 21 nt, Human
uuugaaagcccuauguuuuca

SEQ ID NO: 138622 - RNA, 22 nt, Human
cacaugggcguaauguccaugg

SEQ ID NO: 138623 - RNA, 22 nt, Human
agugcauugcaucucugcuuca

SEQ ID NO: 138624 - RNA, 22 nt, Human
gccaggcuccaggcccuccuga

SEQ ID NO: 138625 - RNA, 22 nt, Human
cagcccuuuccuucucagcuuu

SEQ ID NO: 138626 - RNA, 22 nt, Human
aaaugguauuuacucuguauua

SEQ ID NO: 138627 - RNA, 22 nt, Human
cgcaugugcguugauugcagug

SEQ ID NO: 138628 - RNA, 22 nt, Human
gcuccuggucuggagcuucaag

SEQ ID NO: 138629 - RNA, 19 nt, Human
uggcucugucgaaggcaca

SEQ ID NO: 138630 - RNA, 22 nt, Human
cacagggcaggccccaggccuc

SEQ ID NO: 138631 - RNA, 19 nt, Human
ucagaggauuuggcuauga

SEQ ID NO: 138632 - RNA, 22 nt, Human
caagauggguguugugaugguu

SEQ ID NO: 138633 - RNA, 22 nt, Human
cuggagcaggcuugucccagcu

SEQ ID NO: 138634 - RNA, 22 nt, Human
aaaugcuugcucuugauuauuu

SEQ ID NO: 138635 - RNA, 22 nt, Human
ugucucuuggagggucuaguga

SEQ ID NO: 138636 - RNA, 22 nt, Human
aggacugggugcagagggcauc

SEQ ID NO: 138637 - RNA, 22 nt, Human
guggccuggaaaggcuggucug

SEQ ID NO: 138638 - RNA, 22 nt, Human
aggccuggguguucaccagaag

SEQ ID NO: 138639 - RNA, 22 nt, Human
uguucuucuagauugccuuuua

SEQ ID NO: 138640 - RNA, 22 nt, Human
ccuggccugugaaucugagagc

SEQ ID NO: 138641 - RNA, 19 nt, Human
ccucccacggauuccuucc

SEQ ID NO: 138642 - RNA, 20 nt, Human
ugcagcugcaggaggguggg

SEQ ID NO: 138643 - RNA, 22 nt, Human
caggaugagaggcccagggaag

SEQ ID NO: 138644 - RNA, 22 nt, Human
aguguggguuuuauggagcccu

SEQ ID NO: 138645 - RNA, 22 nt, Human
ugcagaaggaggaggaaaucca

SEQ ID NO: 138646 - RNA, 22 nt, Human
agcaggugaauuccuggaugug

SEQ ID NO: 138647 - RNA, 22 nt, Human
gcugagcugaggcagggcuggg

SEQ ID NO: 138648 - RNA, 22 nt, Human
aggcugugcauuuuggagggcc

SEQ ID NO: 138649 - RNA, 22 nt, Human
uguagcacagagcuuugacacu

SEQ ID NO: 138650 - RNA, 22 nt, Human
ucacaugcucaccuaagccaca

SEQ ID NO: 138651 - RNA, 22 nt, Human
gagcagagacaguacaacuggc

SEQ ID NO: 138652 - RNA, 20 nt, Human
cagagacccaggcuucagcu

SEQ ID NO: 138653 - RNA, 22 nt, Human
uaaaugcaguacaaauuguucu

SEQ ID NO: 138654 - RNA, 22 nt, Human
agcccuccucacaucagcgucc

SEQ ID NO: 138655 - RNA, 22 nt, Human
ccuggagcacauggcaggaggc

SEQ ID NO: 138656 - RNA, 22 nt, Human
agccagccgggggaccacagug

SEQ ID NO: 138657 - RNA, 18 nt, Human
aggaagcaggaggaaggc

SEQ ID NO: 138658 - RNA, 22 nt, Human
uuucugcucauccuaguggagc

SEQ ID NO: 138659 - RNA, 22 nt, Human
ucagggacugcagagggaagcu

SEQ ID NO: 138660 - RNA, 22 nt, Human
uggagggcaucuguggucaggc

SEQ ID NO: 138661 - RNA, 22 nt, Human
uuuacagaucuguugauuuguu

SEQ ID NO: 138662 - RNA, 22 nt, Human
agcaccuggucuccuggcgcug

SEQ ID NO: 138663 - RNA, 22 nt, Human
gccccagcucugccacaacuag

SEQ ID NO: 138664 - RNA, 21 nt, Human
aaggccugcuuacugcuaguu

SEQ ID NO: 138665 - RNA, 22 nt, Human
ggagauuuauagcacacuucag

SEQ ID NO: 138666 - RNA, 22 nt, Human
uucaagaugucuucacaauagu

SEQ ID NO: 138667 - RNA, 22 nt, Human
uuacaucuaaacugugaacaau

SEQ ID NO: 138668 - RNA, 22 nt, Human
cagagaccccgcugcccuucug

SEQ ID NO: 138669 - RNA, 22 nt, Human
ccugccuggaucagccauccug

SEQ ID NO: 138670 - RNA, 19 nt, Human
acucaagucuaaugaaauc

SEQ ID NO: 138671 - RNA, 22 nt, Human
gauaccagacagggagggagaa

SEQ ID NO: 138672 - RNA, 22 nt, Human
aggcugugggguucugcuuuca

SEQ ID NO: 138673 - RNA, 22 nt, Human
ggucacugcucuaaacaaaagu

SEQ ID NO: 138674 - RNA, 22 nt, Human
ggcuccucucuggccgcucccg

SEQ ID NO: 138675 - RNA, 22 nt, Human
gagcugccuacauugccaagag

SEQ ID NO: 138676 - RNA, 22 nt, Human
aauuccugucuuaacaguucug

SEQ ID NO: 138677 - RNA, 22 nt, Human
gggcuacauugugagagaaguu

SEQ ID NO: 138678 - RNA, 22 nt, Human
acaguaaugauucugagucucu

SEQ ID NO: 138679 - RNA, 22 nt, Human
aggcuggcgacaucuggcgggc

SEQ ID NO: 138680 - RNA, 22 nt, Human
auuguggcuagacagucacaau

SEQ ID NO: 138681 - RNA, 22 nt, Human
agccaugcaccuuacucuugcu

SEQ ID NO: 138682 - RNA, 22 nt, Human
uauuuauaaucugccaaagaga

SEQ ID NO: 138683 - RNA, 22 nt, Human
auuuaucaccaguuagcugacu

SEQ ID NO: 138684 - RNA, 22 nt, Human
ugaguucuaguggcugcagauu

SEQ ID NO: 138685 - RNA, 20 nt, Human
gagccuuccccucaccacug

SEQ ID NO: 138686 - RNA, 22 nt, Human
acagucauuagauacaaugucu

SEQ ID NO: 138687 - RNA, 22 nt, Human
agaggccuaauugcuacccuuu

SEQ ID NO: 138688 - RNA, 22 nt, Human
uguuccaucaguuuuugguuga

SEQ ID NO: 138689 - RNA, 22 nt, Human
cugaggccuaagacaugaauga

SEQ ID NO: 138690 - RNA, 22 nt, Human
gccagagguucaacaacugucu

SEQ ID NO: 138691 - RNA, 22 nt, Human
gcugccugauuuacauagugaa

SEQ ID NO: 138692 - RNA, 22 nt, Human
ucacagugaugacgugggagca

SEQ ID NO: 138693 - RNA, 22 nt, Human
caggggcaggugugagaucauc

SEQ ID NO: 138694 - RNA, 22 nt, Human
aagagcuggaguuugcagcccu

SEQ ID NO: 138695 - RNA, 22 nt, Human
gugugcagaagacacaagacau

SEQ ID NO: 138696 - RNA, 22 nt, Human
gcaugugucuccccaguggagg

SEQ ID NO: 138697 - RNA, 22 nt, Human
aggcugugaucucaugauuugu

SEQ ID NO: 138698 - RNA, 22 nt, Human
gcagacagacugcagugauuuu

SEQ ID NO: 138699 - RNA, 22 nt, Human
uggcagugaagcugucuuuagg

SEQ ID NO: 138700 - RNA, 22 nt, Human
gucaggauuggggucaugaguc

SEQ ID NO: 138701 - RNA, 22 nt, Human
gccugagcccaggugugcagag

SEQ ID NO: 138702 - RNA, 22 nt, Human
cucuucuugaaagaggaauuca

SEQ ID NO: 138703 - RNA, 22 nt, Human
aaacaaguguaaacuagucugu

SEQ ID NO: 138704 - RNA, 22 nt, Human
uguagcauguaaauugguuauu

SEQ ID NO: 138705 - RNA, 22 nt, Human
ucccuggcugggggcugccuug

SEQ ID NO: 138706 - RNA, 22 nt, Human
gacugucauucuagugcccaug

SEQ ID NO: 138707 - RNA, 22 nt, Human
acagaauuaaaguguuugugga

SEQ ID NO: 138708 - RNA, 22 nt, Human
ccagccuccauguagauagcug

SEQ ID NO: 138709 - RNA, 22 nt, Human
ccacccuggacaggccucugag

SEQ ID NO: 138710 - RNA, 22 nt, Human
gaguauauauagacaugucaca

SEQ ID NO: 138711 - RNA, 22 nt, Human
gugacucacacaggccugggcu

SEQ ID NO: 138712 - RNA, 21 nt, Human
guggcucugccaggacugaaa

SEQ ID NO: 138713 - RNA, 22 nt, Human
ugggaaauguguuucuggacca

SEQ ID NO: 138714 - RNA, 22 nt, Human
guuuccauggcucuguuaaugg

SEQ ID NO: 138715 - RNA, 22 nt, Human
gaacuuuugggaagccguguga

SEQ ID NO: 138716 - RNA, 22 nt, Human
cugcugcucagugucaucaugu

SEQ ID NO: 138717 - RNA, 22 nt, Human
gucuggcuguuccugccuguga

SEQ ID NO: 138718 - RNA, 22 nt, Human
acuuucuuggucccauguuuga

SEQ ID NO: 138719 - RNA, 22 nt, Human
gaaaagagaacaucugaggauc

SEQ ID NO: 138720 - RNA, 22 nt, Human
uguguacuugaaagggcagguc

SEQ ID NO: 138721 - RNA, 22 nt, Human
uauuauguagaguaaggguuaa

SEQ ID NO: 138722 - RNA, 22 nt, Human
ucucucuucagagauaccuugc

SEQ ID NO: 138723 - RNA, 22 nt, Human
uuguaacagcugcuuaauagag

SEQ ID NO: 138724 - RNA, 22 nt, Human
cucccacuccuggcucaccaca

SEQ ID NO: 138725 - RNA, 22 nt, Human
uccuguguucuagguauggucu

SEQ ID NO: 138726 - RNA, 22 nt, Human
ccugucucuuucaaucugagag

SEQ ID NO: 138727 - RNA, 22 nt, Human
cugccagguuggcgcucgcucu

SEQ ID NO: 138728 - RNA, 22 nt, Human
cuggacagaaaaggccacugga

SEQ ID NO: 138729 - RNA, 22 nt, Human
aucaguuugagugcugugucaa

SEQ ID NO: 138730 - RNA, 22 nt, Human
gcaguauaaguggauuaugucc

SEQ ID NO: 138731 - RNA, 22 nt, Human
ggcagcuccucucagcaaaaga

SEQ ID NO: 138732 - RNA, 22 nt, Human
gugcaugucggggugcauguca

SEQ ID NO: 138733 - RNA, 22 nt, Human
ggguggcacaggugcagagggu

SEQ ID NO: 138734 - RNA, 22 nt, Human
ugucuguauaucacuuuugucc

SEQ ID NO: 138735 - RNA, 22 nt, Human
aaaugucuuuaucucauguaac

SEQ ID NO: 138736 - RNA, 22 nt, Human
ggggauggauuccgggucccug

SEQ ID NO: 138737 - RNA, 22 nt, Human
uuuccuuccuugcuagccugag

SEQ ID NO: 138738 - RNA, 22 nt, Human
uuugcauuguaauauuuaguuc

SEQ ID NO: 138739 - RNA, 22 nt, Human
agauuguagaaacuguagcauu

SEQ ID NO: 138740 - RNA, 22 nt, Human
gcucugcuggagggaaagagaa

SEQ ID NO: 138741 - RNA, 22 nt, Human
uggagcagggcaucacugugcg

SEQ ID NO: 138742 - RNA, 22 nt, Human
gggcccuggauuuaagcaugga

SEQ ID NO: 138743 - RNA, 22 nt, Human
guuauguaugagggaaugauua

SEQ ID NO: 138744 - RNA, 22 nt, Human
ggaggugggagacauaggcggc

SEQ ID NO: 138745 - RNA, 23 nt, Human
cccauuuucauguuaacuccugg

SEQ ID NO: 138746 - RNA, 21 nt, Human
uuuuacagaugaggggaaggg

SEQ ID NO: 138747 - RNA, 22 nt, Human
ucccagggucaguggugaggcc

SEQ ID NO: 138748 - RNA, 19 nt, Human
gaagaagcuugagaaguag

SEQ ID NO: 138749 - RNA, 22 nt, Human
uguauuuugaguccaaucuccu

SEQ ID NO: 138750 - RNA, 23 nt, Human
ccguguguauacucuguaauaga

SEQ ID NO: 138751 - RNA, 22 nt, Human
cagugggcugugauggauucac

SEQ ID NO: 138752 - RNA, 22 nt, Human
gaaaugcauaaucuuaguagau

SEQ ID NO: 138753 - RNA, 21 nt, Human
aagccucaagcagaagacaga

SEQ ID NO: 138754 - RNA, 22 nt, Human
uucucuuuuagaggcuccauga

SEQ ID NO: 138755 - RNA, 22 nt, Human
cuggagccauguauagccuaug

SEQ ID NO: 138756 - RNA, 22 nt, Human
uuccucucucuugccagaaugu

SEQ ID NO: 138757 - RNA, 22 nt, Human
uuucaaagguggaagagugaau

SEQ ID NO: 138758 - RNA, 22 nt, Human
caggguggcacaucacagcauu

SEQ ID NO: 138759 - RNA, 22 nt, Human
agccuguggaucccugcacugg

SEQ ID NO: 138760 - RNA, 22 nt, Human
gcaugugucccucagucugugc

SEQ ID NO: 138761 - RNA, 21 nt, Human
ugcagccauucagcccuaugc

SEQ ID NO: 138762 - RNA, 20 nt, Human
agugacagagacuguguggc

SEQ ID NO: 138763 - RNA, 19 nt, Human
uugguggugguuuugguuc

SEQ ID NO: 138764 - RNA, 22 nt, Human
gugccagcucuccccacaucug

SEQ ID NO: 138765 - RNA, 20 nt, Human
gccuggaggcagagauaaag

SEQ ID NO: 138766 - RNA, 22 nt, Human
gcuaggagauugagcucugaag

SEQ ID NO: 138767 - RNA, 23 nt, Human
ccugucugugcuggguggacaca

SEQ ID NO: 138768 - RNA, 22 nt, Human
accuuuuuguucuguucucagc

SEQ ID NO: 138769 - RNA, 22 nt, Human
uccagggagagccgcugcucca

SEQ ID NO: 138770 - RNA, 22 nt, Human
ucacacagauugguagagcuga

SEQ ID NO: 138771 - RNA, 22 nt, Human
uucugucucccugauguagagc

SEQ ID NO: 138772 - RNA, 22 nt, Human
gugaggugguacaauauuaacu

SEQ ID NO: 138773 - RNA, 22 nt, Human
caggauggucagaugcauuguc

SEQ ID NO: 138774 - RNA, 22 nt, Human
acuuguguaacacagaaagaac

SEQ ID NO: 138775 - RNA, 22 nt, Human
acccagaggugucuagcaagcu

SEQ ID NO: 138776 - RNA, 22 nt, Human
ccuggagccccucuggccagcc

SEQ ID NO: 138777 - RNA, 22 nt, Human
uaccuuuugcuuauuaugacac

SEQ ID NO: 138778 - RNA, 22 nt, Human
aagaacuuccuaauauauuuuc

SEQ ID NO: 138779 - RNA, 22 nt, Human
auuaucucaagggauagcagau

SEQ ID NO: 138780 - RNA, 22 nt, Human
cuccugaguaguagcauuguca

SEQ ID NO: 138781 - RNA, 22 nt, Human
ucaggcagaugcagggauggau

SEQ ID NO: 138782 - RNA, 22 nt, Human
uuaauaaaguaugaauuggaaa

SEQ ID NO: 138783 - RNA, 21 nt, Human
gugcucugggcagcagagggc

SEQ ID NO: 138784 - RNA, 22 nt, Human
ccauggcaauggucagucuauu

SEQ ID NO: 138785 - RNA, 21 nt, Human
gccugccugcgugacccucuu

SEQ ID NO: 138786 - RNA, 22 nt, Human
aguggcugcugacuuuaauaca

SEQ ID NO: 138787 - RNA, 22 nt, Human
ggggauggaggcgugugguccu

SEQ ID NO: 138788 - RNA, 22 nt, Human
gcagggcuaauggggcaaguag

SEQ ID NO: 138789 - RNA, 22 nt, Human
gcagugguccaguucacaccca

SEQ ID NO: 138790 - RNA, 22 nt, Human
acaaaugcaaguuuuaugucaa

SEQ ID NO: 138791 - RNA, 18 nt, Human
acugugguuuauguguag

SEQ ID NO: 138792 - RNA, 22 nt, Human
uuuuccuguuaaaucugggcac

SEQ ID NO: 138793 - RNA, 22 nt, Human
agauuucacaugcugcucuauu

SEQ ID NO: 138794 - RNA, 22 nt, Human
aucuuucuccauauacaucuuu

SEQ ID NO: 138795 - RNA, 22 nt, Human
ugucccagacacaguaugcgcu

SEQ ID NO: 138796 - RNA, 22 nt, Human
aagcgccacgagaagcuggacc

SEQ ID NO: 138797 - RNA, 22 nt, Human
gcagugggaagguuggcacaug

SEQ ID NO: 138798 - RNA, 20 nt, Human
cugagcugagcuccaugggu

SEQ ID NO: 138799 - RNA, 22 nt, Human
ucucuacagaaucuuauuauug

SEQ ID NO: 138800 - RNA, 22 nt, Human
cuguagcagugugcucuuuuuc

SEQ ID NO: 138801 - RNA, 22 nt, Human
acugucuccucaucaugccugg

SEQ ID NO: 138802 - RNA, 22 nt, Human
cugccuguuagucuagcaguua

SEQ ID NO: 138803 - RNA, 18 nt, Human
gcagcugcaguuguagcu

SEQ ID NO: 138804 - RNA, 22 nt, Human
aggggccauuguucugcccgcu

SEQ ID NO: 138805 - RNA, 22 nt, Human
uguauacauacauaugugugug

SEQ ID NO: 138806 - RNA, 20 nt, Human
cuggguggcaagcaaggggg

SEQ ID NO: 138807 - RNA, 22 nt, Human
aaaucaguuguuauauuaaaga

SEQ ID NO: 138808 - RNA, 22 nt, Human
ucagccugcgucauggugacac

SEQ ID NO: 138809 - RNA, 22 nt, Human
aagggagguaaagcuauuuaaa

SEQ ID NO: 138810 - RNA, 22 nt, Human
cauuucugauuacagaauacua

SEQ ID NO: 138811 - RNA, 22 nt, Human
ucuguuccaguagaaaggugca

SEQ ID NO: 138812 - RNA, 22 nt, Human
agaaauaugcugauuagaugaa

SEQ ID NO: 138813 - RNA, 22 nt, Human
ccucacugcuauguguuugcuc

SEQ ID NO: 138814 - RNA, 22 nt, Human
uggauuaaagauuaaaaugaca

SEQ ID NO: 138815 - RNA, 22 nt, Human
agcagugaugcaugacagccua

SEQ ID NO: 138816 - RNA, 22 nt, Human
accugaggcuguuagucuaggu

SEQ ID NO: 138817 - RNA, 22 nt, Human
gugugcgcgcucauaggugugu

SEQ ID NO: 138818 - RNA, 22 nt, Human
gucagcagugucagcucugggg

SEQ ID NO: 138819 - RNA, 22 nt, Human
agaaauuccuaagguacacaag

SEQ ID NO: 138820 - RNA, 22 nt, Human
ucauuuucaaguuugaacagga

SEQ ID NO: 138821 - RNA, 22 nt, Human
uggccugcuuucauuugaugcu

SEQ ID NO: 138822 - RNA, 22 nt, Human
auucuuggcaaggagauuuaaa

SEQ ID NO: 138823 - RNA, 22 nt, Human
cagagcagagugauuguucugg

SEQ ID NO: 138824 - RNA, 19 nt, Human
ccucuccgcccaccagccc

SEQ ID NO: 138825 - RNA, 22 nt, Human
ugggcucugcaucagugcccau

SEQ ID NO: 138826 - RNA, 22 nt, Human
agcagcauagaugcuauccgag

SEQ ID NO: 138827 - RNA, 22 nt, Human
acagggucaagggugcuacaag

SEQ ID NO: 138828 - RNA, 22 nt, Human
cauugcacuccacccuaggcaa

SEQ ID NO: 138829 - RNA, 22 nt, Human
auacaguauguaggcuuuucag

SEQ ID NO: 138830 - RNA, 22 nt, Human
ggcagcaugagccuggugaauu

SEQ ID NO: 138831 - RNA, 22 nt, Human
ucugugcuagaggaguuggcca

SEQ ID NO: 138832 - RNA, 22 nt, Human
uauguguuugacacccugcaag

SEQ ID NO: 138833 - RNA, 22 nt, Human
cuccugggaauuuaguugugag

SEQ ID NO: 138834 - RNA, 22 nt, Human
cugcuuccauaaauaaugugcu

SEQ ID NO: 138835 - RNA, 22 nt, Human
agcagggggccacagucacagc

SEQ ID NO: 138836 - RNA, 22 nt, Human
cucuugaagcaggggccaguuc

SEQ ID NO: 138837 - RNA, 22 nt, Human
agccuggagaggcgccauacac

SEQ ID NO: 138838 - RNA, 21 nt, Human
ccuggcugcacaguugcuggu

SEQ ID NO: 138839 - RNA, 18 nt, Human
gggcucugauccuucacc

SEQ ID NO: 138840 - RNA, 22 nt, Human
aucugacaaccuauugacuuga

SEQ ID NO: 138841 - RNA, 22 nt, Human
aaggcaguuugggccaccaucu

SEQ ID NO: 138842 - RNA, 22 nt, Human
auguggcugccaccugccugaa

SEQ ID NO: 138843 - RNA, 22 nt, Human
cuauugaauuaacuauuaaagu

SEQ ID NO: 138844 - RNA, 22 nt, Human
uucuucuugucugcccucacau

SEQ ID NO: 138845 - RNA, 22 nt, Human
ucagagugggagaaugugccaa

SEQ ID NO: 138846 - RNA, 22 nt, Human
ccuugcaggggaacaggcagug

SEQ ID NO: 138847 - RNA, 23 nt, Human
aucaagauaauccagaugaccua

SEQ ID NO: 138848 - RNA, 22 nt, Human
ucagguggcuuggagggggacg

SEQ ID NO: 138849 - RNA, 22 nt, Human
ucuuggagacucuuguauauuu

SEQ ID NO: 138850 - RNA, 22 nt, Human
agacaaaggauuaaugaugaug

SEQ ID NO: 138851 - RNA, 22 nt, Human
aggcuuccucgugccuuagaua

SEQ ID NO: 138852 - RNA, 21 nt, Human
ucugggcccaugcugccucac

SEQ ID NO: 138853 - RNA, 22 nt, Human
ugaaaucugcaugcaaaguccu

SEQ ID NO: 138854 - RNA, 21 nt, Human
cucuggaggcaagggagagug

SEQ ID NO: 138855 - RNA, 22 nt, Human
agggagcucaguuggaagcggu

SEQ ID NO: 138856 - RNA, 22 nt, Human
gcacagccagcaucugagggau

SEQ ID NO: 138857 - RNA, 22 nt, Human
gcaggugguccccguggagugg

SEQ ID NO: 138858 - RNA, 22 nt, Human
agagauaugaguaguugugaca

SEQ ID NO: 138859 - RNA, 22 nt, Human
cuuagaaauuguuacucauuca

SEQ ID NO: 138860 - RNA, 22 nt, Human
uggcagcaaguucuugggaggu

SEQ ID NO: 138861 - RNA, 22 nt, Human
cuacuuuaauuuucugcagaga

SEQ ID NO: 138862 - RNA, 22 nt, Human
gcaucuaauccaguccagcauc

SEQ ID NO: 138863 - RNA, 19 nt, Human
auacaguaagguguuugcc

SEQ ID NO: 138864 - RNA, 21 nt, Human
aaugcauuaacauaaagcuga

SEQ ID NO: 138865 - RNA, 21 nt, Human
gcagcagaggcuugacagaca

SEQ ID NO: 138866 - RNA, 22 nt, Human
aaacaugaauagauauuaaaca

SEQ ID NO: 138867 - RNA, 22 nt, Human
caagaaauguuuacugagcauc

SEQ ID NO: 138868 - RNA, 22 nt, Human
ugucuguaauagucacuaugug

SEQ ID NO: 138869 - RNA, 22 nt, Human
uugggaaggcguggaagcagaa

SEQ ID NO: 138870 - RNA, 22 nt, Human
uuagauaaauugcaacuugauu

SEQ ID NO: 138871 - RNA, 22 nt, Human
auuauuauauagggaaaguccc

SEQ ID NO: 138872 - RNA, 22 nt, Human
guuauugcaguauagaggucua

SEQ ID NO: 138873 - RNA, 22 nt, Human
ugucacauaggcaaaauguuuu

SEQ ID NO: 138874 - RNA, 22 nt, Human
cucuggacacuggcaugggguc

SEQ ID NO: 138875 - RNA, 22 nt, Human
uccaucagauucccuccugaga

SEQ ID NO: 138876 - RNA, 22 nt, Human
aggacuccauguguccuggaga

SEQ ID NO: 138877 - RNA, 21 nt, Human
accucaagcaacaaccaaggu

SEQ ID NO: 138878 - RNA, 22 nt, Human
auuaaaauuccaagguaugcca

SEQ ID NO: 138879 - RNA, 22 nt, Human
uaaagucaucuuuacaucuuug

SEQ ID NO: 138880 - RNA, 22 nt, Human
auuuaguguguauugcuauuau

SEQ ID NO: 138881 - RNA, 22 nt, Human
acugugcaugaaccgaaacaaa

SEQ ID NO: 138882 - RNA, 22 nt, Human
cagcuucugucugauuagcaag

SEQ ID NO: 138883 - RNA, 20 nt, Human
aggcugccaggucucacauc

SEQ ID NO: 138884 - RNA, 23 nt, Human
caggcaggaugaggacuacacuc

SEQ ID NO: 138885 - RNA, 20 nt, Human
agggcagcuugaggagccgg

SEQ ID NO: 138886 - RNA, 22 nt, Human
uggcagagaaccugggcuuugu

SEQ ID NO: 138887 - RNA, 22 nt, Human
gucucuggguuaagcagugcau

SEQ ID NO: 138888 - RNA, 22 nt, Human
cagcucccagagugaccagcag

SEQ ID NO: 138889 - RNA, 19 nt, Human
ucuggcuccgccucuuagu

SEQ ID NO: 138890 - RNA, 22 nt, Human
acuucucuucauagguggcaau

SEQ ID NO: 138891 - RNA, 22 nt, Human
ucucugggugauggcagggcac

SEQ ID NO: 138892 - RNA, 22 nt, Human
guucuucaggccauccucccag

SEQ ID NO: 138893 - RNA, 22 nt, Human
cagucccaccaggaucgcucuu

SEQ ID NO: 138894 - RNA, 22 nt, Human
agcuggagaucaugcugauacu

SEQ ID NO: 138895 - RNA, 23 nt, Human
ugggccuggaaagccuuagagag

SEQ ID NO: 138896 - RNA, 23 nt, Human
ucugggcaccuuguugacaugau

SEQ ID NO: 138897 - RNA, 22 nt, Human
gagcugggcacacgccacuuga

SEQ ID NO: 138898 - RNA, 22 nt, Human
agcagcugucccuuaacaucag

SEQ ID NO: 138899 - RNA, 22 nt, Human
aucuuucuauuucuaaaaacua

SEQ ID NO: 138900 - RNA, 22 nt, Human
ggagggagucagcugauuagaa

SEQ ID NO: 138901 - RNA, 22 nt, Human
ugucucaguauacgaaacacuu

SEQ ID NO: 138902 - RNA, 22 nt, Human
ucaguuuuuacggucacaggga

SEQ ID NO: 138903 - RNA, 22 nt, Human
cccagcuugcccaggacugagg

SEQ ID NO: 138904 - RNA, 22 nt, Human
caucugugccggguguuuguca

SEQ ID NO: 138905 - RNA, 16 nt, Human
gagccaggugccuuga

SEQ ID NO: 138906 - RNA, 22 nt, Human
aaguuuuucacauugcuguugu

SEQ ID NO: 138907 - RNA, 22 nt, Human
gcaagcaguuguggcuucugag

SEQ ID NO: 138908 - RNA, 20 nt, Human
uaugcaguauguguguauaa

SEQ ID NO: 138909 - RNA, 18 nt, Human
ugggauggagaguaacug

SEQ ID NO: 138910 - RNA, 22 nt, Human
ugccagcaguagcaguaggcca

SEQ ID NO: 138911 - RNA, 23 nt, Human
guaaaauacgcagugcaguguga

SEQ ID NO: 138912 - RNA, 22 nt, Human
cucagagaaaaggagcaagggu

SEQ ID NO: 138913 - RNA, 22 nt, Human
gaugcacugcaguauauacugu

SEQ ID NO: 138914 - RNA, 22 nt, Human
cagagcuggguuugggaaaccu

SEQ ID NO: 138915 - RNA, 22 nt, Human
ugaagcagaggggucuugagcu

SEQ ID NO: 138916 - RNA, 22 nt, Human
aucugccuggcuccaggugagc

SEQ ID NO: 138917 - RNA, 22 nt, Human
ucaaaugcaggucuggucuugg

SEQ ID NO: 138918 - RNA, 22 nt, Human
acacauuuacauguuuacguau

SEQ ID NO: 138919 - RNA, 19 nt, Human
ggcucucuuaaagcuguuu

SEQ ID NO: 138920 - RNA, 22 nt, Human
ucaagauaccaccauuauaugu

SEQ ID NO: 138921 - RNA, 22 nt, Human
gcugugcuugcaugagugucug

SEQ ID NO: 138922 - RNA, 20 nt, Human
ugucaugcauuagaugaaga

SEQ ID NO: 138923 - RNA, 22 nt, Human
gagccaggguuugaaacuagac

SEQ ID NO: 138924 - RNA, 22 nt, Human
ggcagcucugaugaugcucugg

SEQ ID NO: 138925 - RNA, 22 nt, Human
gccugggaagacuaagugggag

SEQ ID NO: 138926 - RNA, 22 nt, Human
uuuaacagauaguuucuucugu

SEQ ID NO: 138927 - RNA, 22 nt, Human
agggcacaagacucugagcccc

SEQ ID NO: 138928 - RNA, 22 nt, Human
gcauccagucuuggcuccugga

SEQ ID NO: 138929 - RNA, 22 nt, Human
acacauauauacauauuugugc

SEQ ID NO: 138930 - RNA, 21 nt, Human
acagagccgggcacaaagcug

SEQ ID NO: 138931 - RNA, 22 nt, Human
uggagcucaaaggccuguggga

SEQ ID NO: 138932 - RNA, 22 nt, Human
aguucucagcuuaguaugcugu

SEQ ID NO: 138933 - RNA, 22 nt, Human
uaucuacuccucuuucagaugc

SEQ ID NO: 138934 - RNA, 22 nt, Human
agguauauguucauguaugugu

SEQ ID NO: 138935 - RNA, 22 nt, Human
acaggugaccugcucauaugaa

SEQ ID NO: 138936 - RNA, 22 nt, Human
ggcacugaauuucuuggcaucu

SEQ ID NO: 138937 - RNA, 22 nt, Human
ucuaaccuuugaaacugcuuuc

SEQ ID NO: 138938 - RNA, 22 nt, Human
aaugcacaugccacauguggua

SEQ ID NO: 138939 - RNA, 23 nt, Human
cagagcuggcucagagcugccug

SEQ ID NO: 138940 - RNA, 22 nt, Human
auaaauuuauaauuguuuccug

SEQ ID NO: 138941 - RNA, 22 nt, Human
cugccugugccaaugcuccuuu

SEQ ID NO: 138942 - RNA, 21 nt, Human
cccuugccugcacuccucggc

SEQ ID NO: 138943 - RNA, 22 nt, Human
augcauaauguauguauugacu

SEQ ID NO: 138944 - RNA, 22 nt, Human
ugggagcugggguuggacgucu

SEQ ID NO: 138945 - RNA, 22 nt, Human
ucacauuuguuccucugcacuu

SEQ ID NO: 138946 - RNA, 22 nt, Human
ccauuuguucgcccagcuccaa

SEQ ID NO: 138947 - RNA, 22 nt, Human
uaugcacauugguuuccucauu

SEQ ID NO: 138948 - RNA, 22 nt, Human
augaugguggguaauguguaaa

SEQ ID NO: 138949 - RNA, 22 nt, Human
ucucagagggaggauuacugcc

SEQ ID NO: 138950 - RNA, 22 nt, Human
gugcaguggcagauccuagcuc

SEQ ID NO: 138951 - RNA, 22 nt, Human
gccaggcuggcaaaaggaaacc

SEQ ID NO: 138952 - RNA, 22 nt, Human
ccugugugucugucacugcaca

SEQ ID NO: 138953 - RNA, 22 nt, Human
cagggcccaggccacuggguug

SEQ ID NO: 138954 - RNA, 22 nt, Human
cugaaugucgaucagcuugggu

SEQ ID NO: 138955 - RNA, 22 nt, Human
agcagcauauugugucuucaua

SEQ ID NO: 138956 - RNA, 23 nt, Human
auaauaacgucugucuugucucu

SEQ ID NO: 138957 - RNA, 22 nt, Human
ccuggcaguggugaagaagagg

SEQ ID NO: 138958 - RNA, 22 nt, Human
auccaaaucaugucagaagaac

SEQ ID NO: 138959 - RNA, 22 nt, Human
gcauuguccugcuucugagugu

SEQ ID NO: 138960 - RNA, 22 nt, Human
ugugacuggcagaggugucugg

SEQ ID NO: 138961 - RNA, 23 nt, Human
cagaccuggcagucauccucaac

SEQ ID NO: 138962 - RNA, 22 nt, Human
agauggagaccuuggaugaacu

SEQ ID NO: 138963 - RNA, 22 nt, Human
ugaagcaggaaccagcagcauu

SEQ ID NO: 138964 - RNA, 22 nt, Human
ugagccagaggaggcugugugg

SEQ ID NO: 138965 - RNA, 22 nt, Human
agauggggcagaauggagccau

SEQ ID NO: 138966 - RNA, 22 nt, Human
gcugccuguguggccacucacu

SEQ ID NO: 138967 - RNA, 22 nt, Human
gcugccaugccacagcacucac

SEQ ID NO: 138968 - RNA, 22 nt, Human
caggcagccaggggaccugucc

SEQ ID NO: 138969 - RNA, 22 nt, Human
gccuucugaucgcuggacugac

SEQ ID NO: 138970 - RNA, 23 nt, Human
aguuuuucugcaugguucuguau

SEQ ID NO: 138971 - RNA, 22 nt, Human
aaguucaaggcucuagaguucc

SEQ ID NO: 138972 - RNA, 17 nt, Human
ucaggauccaggguucu

SEQ ID NO: 138973 - RNA, 22 nt, Human
cuccuuccccuacucagcaucc

SEQ ID NO: 138974 - RNA, 22 nt, Human
uugacacagaucaauauucaac

SEQ ID NO: 138975 - RNA, 22 nt, Human
auuaaauuuucacuaggcuccc

SEQ ID NO: 138976 - RNA, 22 nt, Human
cugggccagcaacugcaaugga

SEQ ID NO: 138977 - RNA, 22 nt, Human
acagaguagcucaagaagauug

SEQ ID NO: 138978 - RNA, 22 nt, Human
cacauuuaauccuuuauaagua

SEQ ID NO: 138979 - RNA, 18 nt, Human
gugagcagagagcaucac

SEQ ID NO: 138980 - RNA, 22 nt, Human
uucuucuuuccuauaauuaauu

SEQ ID NO: 138981 - RNA, 22 nt, Human
uacaaaguaauguauaauaucg

SEQ ID NO: 138982 - RNA, 22 nt, Human
ccagcccuucccaacuggccag

SEQ ID NO: 138983 - RNA, 22 nt, Human
aggggcuggcuuaucugagagu

SEQ ID NO: 138984 - RNA, 22 nt, Human
cccuggagugugacgaggcauu

SEQ ID NO: 138985 - RNA, 19 nt, Human
ugaaauggcaguugcuaaa

SEQ ID NO: 138986 - RNA, 22 nt, Human
gcugccugggcaggaggcgcug

SEQ ID NO: 138987 - RNA, 22 nt, Human
auguuucuguccuacgagauaa

SEQ ID NO: 138988 - RNA, 22 nt, Human
cccagacucaucccugggagcu

SEQ ID NO: 138989 - RNA, 22 nt, Human
aaaguguaaggaauuuaaguaa

SEQ ID NO: 138990 - RNA, 22 nt, Human
aaagccuugcccgucacuggga

SEQ ID NO: 138991 - RNA, 22 nt, Human
caucaguguggcaguucacugu

SEQ ID NO: 138992 - RNA, 23 nt, Human
ugcucugugaauaguuggugacu

SEQ ID NO: 138993 - RNA, 22 nt, Human
gaggcagcaucuauggugggaa

SEQ ID NO: 138994 - RNA, 22 nt, Human
auauucguggucaaguaaggcc

SEQ ID NO: 138995 - RNA, 22 nt, Human
aagcugccaaugguaagcugcu

SEQ ID NO: 138996 - RNA, 17 nt, Human
ugguggcuggagucagg

SEQ ID NO: 138997 - RNA, 22 nt, Human
gcugccacgaucucugcuguag

SEQ ID NO: 138998 - RNA, 22 nt, Human
acagguggagugguuagcaggc

SEQ ID NO: 138999 - RNA, 23 nt, Human
agggaaaguaguaauggccuuug

SEQ ID NO: 139000 - RNA, 22 nt, Human
uuaccaguuuugccauuugcua

SEQ ID NO: 139001 - RNA, 22 nt, Human
uaaugucagcauaguuuauuuu

SEQ ID NO: 139002 - RNA, 22 nt, Human
cagggccaguucucgcagcagu

SEQ ID NO: 139003 - RNA, 22 nt, Human
cuggaagggucuacuuagcaga

SEQ ID NO: 139004 - RNA, 22 nt, Human
cagcaucaccgccauuucugau

SEQ ID NO: 139005 - RNA, 22 nt, Human
uuugcauuaucucacuuauaua

SEQ ID NO: 139006 - RNA, 22 nt, Human
uaaagcaggccacauaugugau

SEQ ID NO: 139007 - RNA, 22 nt, Human
gucucccaaccccugugcccag

SEQ ID NO: 139008 - RNA, 22 nt, Human
acagcagggggagcuguuggac

SEQ ID NO: 139009 - RNA, 22 nt, Human
ccucaggggucacugugaggag

SEQ ID NO: 139010 - RNA, 22 nt, Human
uucuucaaaauccagcaugauu

SEQ ID NO: 139011 - RNA, 22 nt, Human
gagcuuggugaugccuccuggu

SEQ ID NO: 139012 - RNA, 22 nt, Human
uuccauaaucaccuuauucuuu

SEQ ID NO: 139013 - RNA, 22 nt, Human
gguggccuuucaguggaucagg

SEQ ID NO: 139014 - RNA, 22 nt, Human
cugggugaguugaugaaggaga

SEQ ID NO: 139015 - RNA, 22 nt, Human
gaaggccauugcguccugggau

SEQ ID NO: 139016 - RNA, 22 nt, Human
aagugagugguaaggagcaugg

SEQ ID NO: 139017 - RNA, 22 nt, Human
cuguccuugcuggccagguaug

SEQ ID NO: 139018 - RNA, 20 nt, Human
uggagccaaggugugucugg

SEQ ID NO: 139019 - RNA, 22 nt, Human
caguuucuucaucaguuaagca

SEQ ID NO: 139020 - RNA, 22 nt, Human
agugaguggguuacagauggga

SEQ ID NO: 139021 - RNA, 22 nt, Human
cauugcucaggcccagcaggaa

SEQ ID NO: 139022 - RNA, 22 nt, Human
agaaaaaucuuggcgcuugucu

SEQ ID NO: 139023 - RNA, 22 nt, Human
acaggugggcuuaagagucggc

SEQ ID NO: 139024 - RNA, 22 nt, Human
acagucauagcagccuuuguua

SEQ ID NO: 139025 - RNA, 22 nt, Human
gauggcacacagacauccccgc

SEQ ID NO: 139026 - RNA, 22 nt, Human
uuuuucucuucuguaaaguggu

SEQ ID NO: 139027 - RNA, 22 nt, Human
cagucucuaaaucaaucugaau

SEQ ID NO: 139028 - RNA, 20 nt, Human
augugagggguugaaguggg

SEQ ID NO: 139029 - RNA, 22 nt, Human
ugccugucucugacugccauua

SEQ ID NO: 139030 - RNA, 22 nt, Human
ugacccauggucugaucauagg

SEQ ID NO: 139031 - RNA, 22 nt, Human
gcaguauauggauuuuaaacau

SEQ ID NO: 139032 - RNA, 22 nt, Human
ccucucuguguggccucuccau

SEQ ID NO: 139033 - RNA, 22 nt, Human
cucugggcaccaaagagcagcu

SEQ ID NO: 139034 - RNA, 20 nt, Human
ggaccagguggggcgguggc

SEQ ID NO: 139035 - RNA, 22 nt, Human
uggcccgaccucugcucaugca

SEQ ID NO: 139036 - RNA, 22 nt, Human
gcugccucaggcaccuccuggc

SEQ ID NO: 139037 - RNA, 22 nt, Human
uuaagaauggaaugaggaauuu

SEQ ID NO: 139038 - RNA, 23 nt, Human
aguacauucgaaaaauucuguga

SEQ ID NO: 139039 - RNA, 22 nt, Human
acucaggaaauugagauaaugg

SEQ ID NO: 139040 - RNA, 22 nt, Human
uggaaagagguagaggaucugg

SEQ ID NO: 139041 - RNA, 22 nt, Human
agcaggguauguuagagcugua

SEQ ID NO: 139042 - RNA, 22 nt, Human
cucuggccagagccugcgggaa

SEQ ID NO: 139043 - RNA, 22 nt, Human
aaugugguuaacccauuuaaga

SEQ ID NO: 139044 - RNA, 22 nt, Human
acccuggguucccgcagcacca

SEQ ID NO: 139045 - RNA, 22 nt, Human
uaaaguuuggcagacaauaaca

SEQ ID NO: 139046 - RNA, 19 nt, Human
gaaggagagcugaguuagg

SEQ ID NO: 139047 - RNA, 21 nt, Human
cucuguguugaggguguugag

SEQ ID NO: 139048 - RNA, 22 nt, Human
ucuuaacaagcuccucagugcu

SEQ ID NO: 139049 - RNA, 22 nt, Human
cagggagggacaauugucaccu

SEQ ID NO: 139050 - RNA, 22 nt, Human
acugaaggucucagcaaggaug

SEQ ID NO: 139051 - RNA, 22 nt, Human
uuacagguacuugcugcugaaa

SEQ ID NO: 139052 - RNA, 22 nt, Human
uauauauucuuaaguaguguag

SEQ ID NO: 139053 - RNA, 17 nt, Human
cugagcauccgugcucu

SEQ ID NO: 139054 - RNA, 22 nt, Human
ucagcuggagaugagaaccgaa

SEQ ID NO: 139055 - RNA, 21 nt, Human
gcucccugcucagcuccuggg

SEQ ID NO: 139056 - RNA, 22 nt, Human
aucagcaagauugugucuugua

SEQ ID NO: 139057 - RNA, 22 nt, Human
cuguguccugcgucaagccaau

SEQ ID NO: 139058 - RNA, 22 nt, Human
uuuagaaauugcagagugggug

SEQ ID NO: 139059 - RNA, 22 nt, Human
uacaugcucaguaacuuucagu

SEQ ID NO: 139060 - RNA, 21 nt, Human
acaggcuuuagaaaaugacuc

SEQ ID NO: 139061 - RNA, 22 nt, Human
guacauuucauuuaaaugaugu

SEQ ID NO: 139062 - RNA, 22 nt, Human
gaguauauuucucucucuuaag

SEQ ID NO: 139063 - RNA, 22 nt, Human
aggucauuaaaguuaaaugagg

SEQ ID NO: 139064 - RNA, 18 nt, Human
accugccuguucuucucu

SEQ ID NO: 139065 - RNA, 22 nt, Human
acaguaauuaaaauggaucugc

SEQ ID NO: 139066 - RNA, 22 nt, Human
gcaccugggacccagaggcacc

SEQ ID NO: 139067 - RNA, 19 nt, Human
caugagcugcucacuuccc

SEQ ID NO: 139068 - RNA, 22 nt, Human
ugggaggcuuccagaccuugcu

SEQ ID NO: 139069 - RNA, 22 nt, Human
uguggcugcucaggugcagacc

SEQ ID NO: 139070 - RNA, 22 nt, Human
gccaggcacaguucuaggugcu

SEQ ID NO: 139071 - RNA, 22 nt, Human
ucugcagaaguggcugggccac

SEQ ID NO: 139072 - RNA, 22 nt, Human
cuggcucauuuuagcaucaggu

SEQ ID NO: 139073 - RNA, 22 nt, Human
aacucagucauaaagcgaaugc

SEQ ID NO: 139074 - RNA, 22 nt, Human
cuuccucccggcccaugcucug

SEQ ID NO: 139075 - RNA, 22 nt, Human
ccucucuuuccuacaccuugga

SEQ ID NO: 139076 - RNA, 22 nt, Human
gaaggaaaaauacucuguaagg

SEQ ID NO: 139077 - RNA, 22 nt, Human
gcuggccucgcaggcaggaugu

SEQ ID NO: 139078 - RNA, 22 nt, Human
uggagcugggguuugaaucugg

SEQ ID NO: 139079 - RNA, 22 nt, Human
gaggcuggugguuaguuccauu

SEQ ID NO: 139080 - RNA, 22 nt, Human
gcccagcacauugcugaggacc

SEQ ID NO: 139081 - RNA, 22 nt, Human
agagcugcaauuucauguggug

SEQ ID NO: 139082 - RNA, 22 nt, Human
ugugugauugcaggagaugugg

SEQ ID NO: 139083 - RNA, 22 nt, Human
cucugugugcuggugggguccu

SEQ ID NO: 139084 - RNA, 22 nt, Human
auggcuguuuugugacuucuca

SEQ ID NO: 139085 - RNA, 22 nt, Human
uaugcacgucuauuuaugaaga

SEQ ID NO: 139086 - RNA, 22 nt, Human
cuuccucccccacacacucacu

SEQ ID NO: 139087 - RNA, 22 nt, Human
aaaggccaagcaugagguggac

SEQ ID NO: 139088 - RNA, 22 nt, Human
uccugugugggcaggaugagaa

SEQ ID NO: 139089 - RNA, 22 nt, Human
ccaaggagcugcaggcacuugu

SEQ ID NO: 139090 - RNA, 18 nt, Human
acaggccucaguccugca

SEQ ID NO: 139091 - RNA, 22 nt, Human
acaccauacucauguugguucc

SEQ ID NO: 139092 - RNA, 22 nt, Human
uuuucucagcugcacuguauua

SEQ ID NO: 139093 - RNA, 22 nt, Human
ucucuggaauuggcugaggcaa

SEQ ID NO: 139094 - RNA, 22 nt, Human
augggaggcaggcucagaaccg

SEQ ID NO: 139095 - RNA, 22 nt, Human
auagucuuagaucagauaaagu

SEQ ID NO: 139096 - RNA, 22 nt, Human
guuucucuuaacacauaaagua

SEQ ID NO: 139097 - RNA, 22 nt, Human
gcccagcaggggauggcagcuc

SEQ ID NO: 139098 - RNA, 18 nt, Human
uaaaugcauguuaauaac

SEQ ID NO: 139099 - RNA, 22 nt, Human
agcagcucacaggauuccugaa

SEQ ID NO: 139100 - RNA, 22 nt, Human
uaaaguucagugcaugaaugug

SEQ ID NO: 139101 - RNA, 22 nt, Human
cagagguagaaggcaugcagug

SEQ ID NO: 139102 - RNA, 20 nt, Human
cuuucucuaauuuauaagua

SEQ ID NO: 139103 - RNA, 20 nt, Human
uaucaaucagaaagaagacu

SEQ ID NO: 139104 - RNA, 22 nt, Human
gguggccuccagggcauaggug

SEQ ID NO: 139105 - RNA, 22 nt, Human
caugagauaauuuuucuccagu

SEQ ID NO: 139106 - RNA, 19 nt, Human
ucucugugucucuguuuau

SEQ ID NO: 139107 - RNA, 22 nt, Human
aggcagcagccacaaggccuga

SEQ ID NO: 139108 - RNA, 22 nt, Human
cugccugugccaccgccucauu

SEQ ID NO: 139109 - RNA, 22 nt, Human
gguuugcacgauauuuccaugg

SEQ ID NO: 139110 - RNA, 22 nt, Human
ugugugaacucucugauguaca

SEQ ID NO: 139111 - RNA, 22 nt, Human
agggaguuagaaauccaggaua

SEQ ID NO: 139112 - RNA, 18 nt, Human
cagagcagagguggagcg

SEQ ID NO: 139113 - RNA, 22 nt, Human
uuuaaauuauaguuaaugucug

SEQ ID NO: 139114 - RNA, 22 nt, Human
cauggggagacaccuagggaaa

SEQ ID NO: 139115 - RNA, 22 nt, Human
auugagaauccauuugagauga

SEQ ID NO: 139116 - RNA, 22 nt, Human
cuggggcuggugaggcaggcuc

SEQ ID NO: 139117 - RNA, 21 nt, Human
ccugccaggaaacugaguguc

SEQ ID NO: 139118 - RNA, 21 nt, Human
cagagcuguccaaacccugac

SEQ ID NO: 139119 - RNA, 22 nt, Human
uggcucuguugagguauggauu

SEQ ID NO: 139120 - RNA, 20 nt, Human
ucagaggcugccagcugggg

SEQ ID NO: 139121 - RNA, 22 nt, Human
ucugggaacagccuggcugugu

SEQ ID NO: 139122 - RNA, 22 nt, Human
gucaggauuugaacucaggucu

SEQ ID NO: 139123 - RNA, 22 nt, Human
ugccugucuuggaguccuggcc

SEQ ID NO: 139124 - RNA, 22 nt, Human
gggcaagcucuucagaagcucu

SEQ ID NO: 139125 - RNA, 22 nt, Human
uguguacacaaugauugcagag

SEQ ID NO: 139126 - RNA, 22 nt, Human
uguauuuucuucuggaagcuua

SEQ ID NO: 139127 - RNA, 22 nt, Human
uggcccugccacucacugcuga

SEQ ID NO: 139128 - RNA, 22 nt, Human
gagcacaggcuuugguggacac

SEQ ID NO: 139129 - RNA, 20 nt, Human
guggccuguccuguuguggg

SEQ ID NO: 139130 - RNA, 22 nt, Human
cuguacaucucugaggacagua

SEQ ID NO: 139131 - RNA, 20 nt, Human
uucuggaggcuacaagucug

SEQ ID NO: 139132 - RNA, 22 nt, Human
uacauuccauguguguguauuc

SEQ ID NO: 139133 - RNA, 22 nt, Human
agagccuggggauuggcaaggg

SEQ ID NO: 139134 - RNA, 22 nt, Human
gacagccucaugaggagcaaaa

SEQ ID NO: 139135 - RNA, 22 nt, Human
uuuuccuggggcuucuggacuc

SEQ ID NO: 139136 - RNA, 22 nt, Human
gaagagcugacagugucauccu

SEQ ID NO: 139137 - RNA, 22 nt, Human
gcugccugucccaggaugagga

SEQ ID NO: 139138 - RNA, 22 nt, Human
acaguauagggcuuauauugua

SEQ ID NO: 139139 - RNA, 22 nt, Human
uuucugcuuaggacucugugga

SEQ ID NO: 139140 - RNA, 22 nt, Human
agggagcuguggucagcucagu

SEQ ID NO: 139141 - RNA, 22 nt, Human
uggcagaguucgcuccuauuca

SEQ ID NO: 139142 - RNA, 22 nt, Human
gagcacagaaucuucccaugca

SEQ ID NO: 139143 - RNA, 22 nt, Human
gcaguggauccaaugguaucuu

SEQ ID NO: 139144 - RNA, 22 nt, Human
aggcuguguuucuugcguuuuc

SEQ ID NO: 139145 - RNA, 22 nt, Human
aguuugaauugaaaugcagaug

SEQ ID NO: 139146 - RNA, 22 nt, Human
cauguguauuauucuuguggaa

SEQ ID NO: 139147 - RNA, 22 nt, Human
gaccaaggaagaggggagccag

SEQ ID NO: 139148 - RNA, 22 nt, Human
uggcagcagggccccuggagga

SEQ ID NO: 139149 - RNA, 22 nt, Human
uccugagauaaaucucauguga

SEQ ID NO: 139150 - RNA, 22 nt, Human
guuauguaugggggccuuauga

SEQ ID NO: 139151 - RNA, 22 nt, Human
ucugucacuuauuaagauggau

SEQ ID NO: 139152 - RNA, 22 nt, Human
auaucaguaucuauguauuugu

SEQ ID NO: 139153 - RNA, 22 nt, Human
cuuguacaggaauccaugguau

SEQ ID NO: 139154 - RNA, 23 nt, Human
auauuuccagguuagugagguaa

SEQ ID NO: 139155 - RNA, 22 nt, Human
uuugacauggaauaacucauuu

SEQ ID NO: 139156 - RNA, 22 nt, Human
gcuguggcuuucuguuucuguu

SEQ ID NO: 139157 - RNA, 22 nt, Human
gucugucucucuccagagugca

SEQ ID NO: 139158 - RNA, 22 nt, Human
ucaguguguacacugagcauuu

SEQ ID NO: 139159 - RNA, 19 nt, Human
cuggcagccugucuguguc

SEQ ID NO: 139160 - RNA, 22 nt, Human
ccacagcugaccgcaggugagc

SEQ ID NO: 139161 - RNA, 22 nt, Human
aaguucaauggaaaagcuuuag

SEQ ID NO: 139162 - RNA, 22 nt, Human
gacauuucaaucucauuauggg

SEQ ID NO: 139163 - RNA, 22 nt, Human
uuaaauuccagccucauaauag

SEQ ID NO: 139164 - RNA, 22 nt, Human
gagagcugauagaugagcuacu

SEQ ID NO: 139165 - RNA, 22 nt, Human
aauuuucuaaggugaugaucug

SEQ ID NO: 139166 - RNA, 17 nt, Human
ucaggcugggugcagug

SEQ ID NO: 139167 - RNA, 22 nt, Human
cagggccacuguagaugaggag

SEQ ID NO: 139168 - RNA, 22 nt, Human
uugcauaaaagaguauaucuua

SEQ ID NO: 139169 - RNA, 22 nt, Human
augcagguugggcaaguguggg

SEQ ID NO: 139170 - RNA, 22 nt, Human
cuguggcugcgccaucgaaaac

SEQ ID NO: 139171 - RNA, 22 nt, Human
ggcuucugagugcucugcuguu

SEQ ID NO: 139172 - RNA, 22 nt, Human
cuguguagccucaugugggcuu

SEQ ID NO: 139173 - RNA, 22 nt, Human
acagggcagagugaaaugcuau

SEQ ID NO: 139174 - RNA, 22 nt, Human
uugaacauuaacuucagucuau

SEQ ID NO: 139175 - RNA, 22 nt, Human
auguggcugaucgcagagcucu

SEQ ID NO: 139176 - RNA, 22 nt, Human
aaggcagcaccgccuccugaaa

SEQ ID NO: 139177 - RNA, 23 nt, Human
agcaauaagaagggauacaugug

SEQ ID NO: 139178 - RNA, 23 nt, Human
ucaggauauugugugccaaggug

SEQ ID NO: 139179 - RNA, 23 nt, Human
ccagcuccgugagccucgggcuc

SEQ ID NO: 139180 - RNA, 22 nt, Human
guggcugcagcccagcggcacg

SEQ ID NO: 139181 - RNA, 22 nt, Human
auucuucuaauaugaucguguu

SEQ ID NO: 139182 - RNA, 22 nt, Human
cagauauaguggcuugccuggg

SEQ ID NO: 139183 - RNA, 23 nt, Human
agcugugugcgcguccggguucu

SEQ ID NO: 139184 - RNA, 20 nt, Human
auugucagccuucagaggag

SEQ ID NO: 139185 - RNA, 19 nt, Human
uggaggagaggaaaaguca

SEQ ID NO: 139186 - RNA, 22 nt, Human
gcaccuggcugcccagguggag

SEQ ID NO: 139187 - RNA, 22 nt, Human
gggcugucaugugucagugacc

SEQ ID NO: 139188 - RNA, 22 nt, Human
cugccuggguucaaguccuguu

SEQ ID NO: 139189 - RNA, 22 nt, Human
agugaaauccuggucaacaggu

SEQ ID NO: 139190 - RNA, 22 nt, Human
uuucacagcaacacugucugca

SEQ ID NO: 139191 - RNA, 21 nt, Human
gggugcuguggucaugcagga

SEQ ID NO: 139192 - RNA, 19 nt, Human
ugaggggcucacagucuca

SEQ ID NO: 139193 - RNA, 22 nt, Human
uugaagcaugguacuuguucaa

SEQ ID NO: 139194 - RNA, 22 nt, Human
caggcuugggagcagagccacu

SEQ ID NO: 139195 - RNA, 22 nt, Human
cccagcaucccagugggcagca

SEQ ID NO: 139196 - RNA, 22 nt, Human
ccuuaaaagaacuaucucuucu

SEQ ID NO: 139197 - RNA, 22 nt, Human
gcugucugucucugucccacca

SEQ ID NO: 139198 - RNA, 22 nt, Human
cuguauuuucaugccuacguac

SEQ ID NO: 139199 - RNA, 22 nt, Human
auggcagccuguggacagucaa

SEQ ID NO: 139200 - RNA, 22 nt, Human
ccagcuggagccaagguggacu

SEQ ID NO: 139201 - RNA, 22 nt, Human
uguuuucugauucucguguggu

SEQ ID NO: 139202 - RNA, 22 nt, Human
gcaggguaggugacagguaguc

SEQ ID NO: 139203 - RNA, 22 nt, Human
ugauuuccaaaaggcuucuaag

SEQ ID NO: 139204 - RNA, 22 nt, Human
gcugucccgaaccccugguaau

SEQ ID NO: 139205 - RNA, 23 nt, Human
ucugagugauuagccucuggggu

SEQ ID NO: 139206 - RNA, 22 nt, Human
aggcugugcacagggcaccugc

SEQ ID NO: 139207 - RNA, 19 nt, Human
ggaccagguccugggcagc

SEQ ID NO: 139208 - RNA, 22 nt, Human
ucugugcugagcucugagaugu

SEQ ID NO: 139209 - RNA, 22 nt, Human
caggcacuggggaugcugggau

SEQ ID NO: 139210 - RNA, 22 nt, Human
cucuggccgcagcucagcucug

SEQ ID NO: 139211 - RNA, 18 nt, Human
agcagaauucuaggguuc

SEQ ID NO: 139212 - RNA, 22 nt, Human
agcauauuguaugucuauaugu

SEQ ID NO: 139213 - RNA, 22 nt, Human
uuugcauuauauuuauagaaga

SEQ ID NO: 139214 - RNA, 22 nt, Human
gccucccuguucuuccacaaua

SEQ ID NO: 139215 - RNA, 22 nt, Human
caaaugauagagccgauuauca

SEQ ID NO: 139216 - RNA, 22 nt, Human
accuggagucauuugaggagua

SEQ ID NO: 139217 - RNA, 19 nt, Human
uucuguguuaauuccuuua

SEQ ID NO: 139218 - RNA, 22 nt, Human
acaugcauaggagaagucuuua

SEQ ID NO: 139219 - RNA, 22 nt, Human
ggcagugugcaucuguguggcc

SEQ ID NO: 139220 - RNA, 22 nt, Human
uccauggguagcccugguugag

SEQ ID NO: 139221 - RNA, 22 nt, Human
gucauucuuaacaacucaguag

SEQ ID NO: 139222 - RNA, 19 nt, Human
agcauuuggaauucuacac

SEQ ID NO: 139223 - RNA, 22 nt, Human
gaaaugcaggcuuggauucagc

SEQ ID NO: 139224 - RNA, 22 nt, Human
gggcuggucuggcuuagucagg

SEQ ID NO: 139225 - RNA, 19 nt, Human
ucaggacugacuugaaguc

SEQ ID NO: 139226 - RNA, 22 nt, Human
agcugucugucuccugaggaga

SEQ ID NO: 139227 - RNA, 22 nt, Human
ucugccuggauuccauucucca

SEQ ID NO: 139228 - RNA, 22 nt, Human
aagggcagcuuaaauugguagc

SEQ ID NO: 139229 - RNA, 22 nt, Human
ucacagaauagcacuguaagcg

SEQ ID NO: 139230 - RNA, 22 nt, Human
aaagcccauguggaaguacagg

SEQ ID NO: 139231 - RNA, 20 nt, Human
uccugcaguuccuaggaggg

SEQ ID NO: 139232 - RNA, 22 nt, Human
gccaggcauuuguuaggugcug

SEQ ID NO: 139233 - RNA, 22 nt, Human
cccugggacccgcugcagaggc

SEQ ID NO: 139234 - RNA, 22 nt, Human
gcagcguggggcugagucagcu

SEQ ID NO: 139235 - RNA, 22 nt, Human
aacaucagaauauccauguugg

SEQ ID NO: 139236 - RNA, 22 nt, Human
ccagcuggaagagugcagaacu

SEQ ID NO: 139237 - RNA, 22 nt, Human
ggagcugaaggggugggcucag

SEQ ID NO: 139238 - RNA, 22 nt, Human
cucucccccacagcagccuucu

SEQ ID NO: 139239 - RNA, 22 nt, Human
agcuguguucugguugauucac

SEQ ID NO: 139240 - RNA, 22 nt, Human
ccccaggacacauggaccaagu

SEQ ID NO: 139241 - RNA, 19 nt, Human
cagagccucagagcuagaa

SEQ ID NO: 139242 - RNA, 22 nt, Human
aucuuucucugcacuauacaau

SEQ ID NO: 139243 - RNA, 22 nt, Human
uggcauguauacuugaguagga

SEQ ID NO: 139244 - RNA, 22 nt, Human
gagccuggauagccuuguucca

SEQ ID NO: 139245 - RNA, 22 nt, Human
gaggccaaucaauagggcaaua

SEQ ID NO: 139246 - RNA, 22 nt, Human
ggucucuguugccuccaucaag

SEQ ID NO: 139247 - RNA, 22 nt, Human
uacauauagacaguuacucuag

SEQ ID NO: 139248 - RNA, 22 nt, Human
cucagaguccccacaucugggu

SEQ ID NO: 139249 - RNA, 22 nt, Human
uagagugguuaacaguuuagaa

SEQ ID NO: 139250 - RNA, 22 nt, Human
caacuuuugacacgugugcuaa

SEQ ID NO: 139251 - RNA, 22 nt, Human
ugcagggcuaagucagagccug

SEQ ID NO: 139252 - RNA, 22 nt, Human
cuguggcucauaucuguaaucu

SEQ ID NO: 139253 - RNA, 22 nt, Human
cuggccugcugggugagguccu

SEQ ID NO: 139254 - RNA, 22 nt, Human
uuuauuaugauggacaccuucg

SEQ ID NO: 139255 - RNA, 22 nt, Human
ccuuucucuggcagcaggacag

SEQ ID NO: 139256 - RNA, 22 nt, Human
ggcucuggcaaggggaggcuac

SEQ ID NO: 139257 - RNA, 22 nt, Human
ugcagaagcagagaguugccaa

SEQ ID NO: 139258 - RNA, 22 nt, Human
cagagcugugauaaauagauau

SEQ ID NO: 139259 - RNA, 22 nt, Human
gagcucugacugcugggugaca

SEQ ID NO: 139260 - RNA, 22 nt, Human
uaucuucuugccaggcuggugu

SEQ ID NO: 139261 - RNA, 22 nt, Human
cuucucuugguaguucuuguug

SEQ ID NO: 139262 - RNA, 20 nt, Human
gcaaauggaucccacaagcc

SEQ ID NO: 139263 - RNA, 19 nt, Human
ugagugggccccugcagac

SEQ ID NO: 139264 - RNA, 22 nt, Human
gucaggggccaugggccaagga

SEQ ID NO: 139265 - RNA, 22 nt, Human
aaggucauuuaacaauuuauga

SEQ ID NO: 139266 - RNA, 22 nt, Human
gcugccuguccugaggaguccg

SEQ ID NO: 139267 - RNA, 22 nt, Human
cugagccaaaaagcagagcuug

SEQ ID NO: 139268 - RNA, 17 nt, Human
agcuccugcccauggcu

SEQ ID NO: 139269 - RNA, 22 nt, Human
ucuggagcuggagggcaaggca

SEQ ID NO: 139270 - RNA, 22 nt, Human
aucacaaaggcugcuucaugau

SEQ ID NO: 139271 - RNA, 20 nt, Human
cagcccuccaguggaggcag

SEQ ID NO: 139272 - RNA, 22 nt, Human
agcaugaaaggcgugccaacuu

SEQ ID NO: 139273 - RNA, 22 nt, Human
caaggccauaagagauacaaaa

SEQ ID NO: 139274 - RNA, 22 nt, Human
ggaggaugccaagcugugcaca

SEQ ID NO: 139275 - RNA, 22 nt, Human
ccaggcaggcagcguucucagg

SEQ ID NO: 139276 - RNA, 17 nt, Human
ggccuguguggcugcag

SEQ ID NO: 139277 - RNA, 22 nt, Human
ucuacagacagagcagguggga

SEQ ID NO: 139278 - RNA, 22 nt, Human
aaaggccaugguuggaguguuu

SEQ ID NO: 139279 - RNA, 22 nt, Human
ucaagaaagggcuucaccagga

SEQ ID NO: 139280 - RNA, 19 nt, Human
agagaggcugugugaggga

SEQ ID NO: 139281 - RNA, 22 nt, Human
ggcaaaaacagcaaugacuuuu

SEQ ID NO: 139282 - RNA, 22 nt, Human
uugugugucuucuucacugccc

SEQ ID NO: 139283 - RNA, 22 nt, Human
cagagacaguuucacagggucu

SEQ ID NO: 139284 - RNA, 22 nt, Human
ggcagggucuggacugaaagcu

SEQ ID NO: 139285 - RNA, 22 nt, Human
cccagcacuuugaauaugucac

SEQ ID NO: 139286 - RNA, 22 nt, Human
uucauucuugucuuuguauagu

SEQ ID NO: 139287 - RNA, 22 nt, Human
gaugaagccugacuucucggug

SEQ ID NO: 139288 - RNA, 22 nt, Human
ugcuucugggcaaaugugugug

SEQ ID NO: 139289 - RNA, 22 nt, Human
ucuaggagcaugaagggaaggc

SEQ ID NO: 139290 - RNA, 20 nt, Human
cacaguauucuuccuuaaaa

SEQ ID NO: 139291 - RNA, 21 nt, Human
ugcugccauagaccugaggga

SEQ ID NO: 139292 - RNA, 22 nt, Human
auagaaaacagauguccuuaaa

SEQ ID NO: 139293 - RNA, 22 nt, Human
gcagauggcugagccugcagau

SEQ ID NO: 139294 - RNA, 22 nt, Human
acccagcucuuugauggucuug

SEQ ID NO: 139295 - RNA, 22 nt, Human
gugggugauguacuggaggcca

SEQ ID NO: 139296 - RNA, 21 nt, Human
ggccugagcaccuguccaccu

SEQ ID NO: 139297 - RNA, 23 nt, Human
gugcucugcggucugcuagucug

SEQ ID NO: 139298 - RNA, 22 nt, Human
uuccaugaaagugaaauggagc

SEQ ID NO: 139299 - RNA, 22 nt, Human
uacauaguauucacauuguuuu

SEQ ID NO: 139300 - RNA, 22 nt, Human
ucagcagggaggcucugugccc

SEQ ID NO: 139301 - RNA, 21 nt, Human
ugaggcuguuguaccagggag

SEQ ID NO: 139302 - RNA, 22 nt, Human
cuuccagagauagggccucaag

SEQ ID NO: 139303 - RNA, 22 nt, Human
uaaguaaauuuauaaugugauu

SEQ ID NO: 139304 - RNA, 22 nt, Human
cagcuccccucuguggggcagu

SEQ ID NO: 139305 - RNA, 22 nt, Human
ucaggcugccuaucagacugug

SEQ ID NO: 139306 - RNA, 23 nt, Human
aaagacugcugagaauuuuagga

SEQ ID NO: 139307 - RNA, 21 nt, Human
cagaggcagguccugggacgg

SEQ ID NO: 139308 - RNA, 22 nt, Human
auaaaaguuuccaaucaugccu

SEQ ID NO: 139309 - RNA, 22 nt, Human
aggcugugaacucuaugcugaa

SEQ ID NO: 139310 - RNA, 22 nt, Human
gcuggccugggcucaagaccag

SEQ ID NO: 139311 - RNA, 22 nt, Human
uggcagcuacagacagagguga

SEQ ID NO: 139312 - RNA, 19 nt, Human
gagcccucuccauggccac

SEQ ID NO: 139313 - RNA, 22 nt, Human
uuugcauugcagugguuuacag

SEQ ID NO: 139314 - RNA, 20 nt, Human
ucacauccucucccaacaug

SEQ ID NO: 139315 - RNA, 22 nt, Human
aguguauggaauuagcucccuu

SEQ ID NO: 139316 - RNA, 22 nt, Human
uugucccaggacuugcauagau

SEQ ID NO: 139317 - RNA, 22 nt, Human
ccucaggauacaggagccacag

SEQ ID NO: 139318 - RNA, 22 nt, Human
ucccagagucuucuccuguaau

SEQ ID NO: 139319 - RNA, 22 nt, Human
uuagaguagagccauuucuguu

SEQ ID NO: 139320 - RNA, 22 nt, Human
gcucugcugucuucuugcaggc

SEQ ID NO: 139321 - RNA, 22 nt, Human
gaggcugcuguuagcccugggc

SEQ ID NO: 139322 - RNA, 22 nt, Human
ggcagaagaaaggcuaagucuc

SEQ ID NO: 139323 - RNA, 21 nt, Human
agcugccacccuagcuucuga

SEQ ID NO: 139324 - RNA, 22 nt, Human
agugucauuccagggacccucg

SEQ ID NO: 139325 - RNA, 22 nt, Human
cugugugucauuugucaauccu

SEQ ID NO: 139326 - RNA, 22 nt, Human
gcugagaguguaggauguuuac

SEQ ID NO: 139327 - RNA, 19 nt, Human
accaggcuuauggucagug

SEQ ID NO: 139328 - RNA, 22 nt, Human
uaaacauuuguuauucuuguuu

SEQ ID NO: 139329 - RNA, 22 nt, Human
aaaucugggucaagguggagug

SEQ ID NO: 139330 - RNA, 22 nt, Human
cugaggugagcuucccugggcu

SEQ ID NO: 139331 - RNA, 20 nt, Human
agguggcuccugcugggggu

SEQ ID NO: 139332 - RNA, 22 nt, Human
ugacaguagaagaugcuguuac

SEQ ID NO: 139333 - RNA, 22 nt, Human
uaaacaugugagugugcauaua

SEQ ID NO: 139334 - RNA, 22 nt, Human
ugcaguggugguaaagaugcuc

SEQ ID NO: 139335 - RNA, 22 nt, Human
ugaguagcggcuauguguaacu

SEQ ID NO: 139336 - RNA, 22 nt, Human
ggaccugccagaacucaggcua

SEQ ID NO: 139337 - RNA, 22 nt, Human
ucuuccucuagaucugaggccc

SEQ ID NO: 139338 - RNA, 22 nt, Human
caguggcagagaacagagaccu

SEQ ID NO: 139339 - RNA, 18 nt, Human
ccauuucaugauuauuac

SEQ ID NO: 139340 - RNA, 22 nt, Human
uucacagucacccuucuccaug

SEQ ID NO: 139341 - RNA, 22 nt, Human
ugguccagaugccuuggcuuua

SEQ ID NO: 139342 - RNA, 22 nt, Human
cauguuuucuaggcuuucacaa

SEQ ID NO: 139343 - RNA, 22 nt, Human
uguguuuguuagacuaauguua

SEQ ID NO: 139344 - RNA, 23 nt, Human
caugugugacaguaucacuguuu

SEQ ID NO: 139345 - RNA, 22 nt, Human
ggcucuggugcccuggcuccca

SEQ ID NO: 139346 - RNA, 22 nt, Human
uauuuucauucugugugacugu

SEQ ID NO: 139347 - RNA, 21 nt, Human
gcaggcuggucaaaccucagu

SEQ ID NO: 139348 - RNA, 22 nt, Human
auugucuguacuuuaaaaaugu

SEQ ID NO: 139349 - RNA, 22 nt, Human
auguguaugucuuauucaaaga

SEQ ID NO: 139350 - RNA, 22 nt, Human
aggcacugauucuguuuuccau

SEQ ID NO: 139351 - RNA, 22 nt, Human
ucagggacauuuagacacugau

SEQ ID NO: 139352 - RNA, 22 nt, Human
gggcugagucugcugccuguca

SEQ ID NO: 139353 - RNA, 22 nt, Human
gguggcugaagcagucuucggg

SEQ ID NO: 139354 - RNA, 22 nt, Human
uggccugggugcugcugacauc

SEQ ID NO: 139355 - RNA, 22 nt, Human
gaggcuggcagaaaagcacagg

SEQ ID NO: 139356 - RNA, 21 nt, Human
uggaaagauucaaagaccagg

SEQ ID NO: 139357 - RNA, 22 nt, Human
cugccacuuucacccagugcuc

SEQ ID NO: 139358 - RNA, 22 nt, Human
gggcuggcgggaaaggcaauuc

SEQ ID NO: 139359 - RNA, 22 nt, Human
acagaccaaaaaaggauauugg

SEQ ID NO: 139360 - RNA, 22 nt, Human
guguauguucuacuuaauauua

SEQ ID NO: 139361 - RNA, 22 nt, Human
ugguaucagagccaucuguauu

SEQ ID NO: 139362 - RNA, 22 nt, Human
auuauaaagaacaugugugugg

SEQ ID NO: 139363 - RNA, 22 nt, Human
ggugaggcuaagugacacaggg

SEQ ID NO: 139364 - RNA, 22 nt, Human
gcagcauuaccaagacauggca

SEQ ID NO: 139365 - RNA, 22 nt, Human
aggccucacauugggcuucaag

SEQ ID NO: 139366 - RNA, 22 nt, Human
gccuucugugcuccuggccuuu

SEQ ID NO: 139367 - RNA, 22 nt, Human
agacagcaggggagucugguuu

SEQ ID NO: 139368 - RNA, 23 nt, Human
agggguggucaguacccgcagug

SEQ ID NO: 139369 - RNA, 22 nt, Human
gggucuggacggcugcaggaag

SEQ ID NO: 139370 - RNA, 22 nt, Human
cccagcccaucucaaaggucua

SEQ ID NO: 139371 - RNA, 22 nt, Human
ccagggcaugggaagaacugaa

SEQ ID NO: 139372 - RNA, 22 nt, Human
gaagagcuauguccagggagca

SEQ ID NO: 139373 - RNA, 22 nt, Human
gcaggaugggagcuucacucug

SEQ ID NO: 139374 - RNA, 22 nt, Human
cuggcuguaugcuggccucaga

SEQ ID NO: 139375 - RNA, 22 nt, Human
uuuuuuauagcaaugaacccac

SEQ ID NO: 139376 - RNA, 22 nt, Human
agcccuggcccggcugugcuuu

SEQ ID NO: 139377 - RNA, 22 nt, Human
caggugggccaugaaaaaugac

SEQ ID NO: 139378 - RNA, 22 nt, Human
ccaaggagcaaggcucaacaag

SEQ ID NO: 139379 - RNA, 22 nt, Human
cagagccagaacuagaccuugu

SEQ ID NO: 139380 - RNA, 22 nt, Human
ccucccacauugaggacaugcu

SEQ ID NO: 139381 - RNA, 22 nt, Human
ugggacugcucuugcugggguc

SEQ ID NO: 139382 - RNA, 22 nt, Human
uaaaucccuacaucuguguuuu

SEQ ID NO: 139383 - RNA, 22 nt, Human
guugaaagcuuuucauuuaguu

SEQ ID NO: 139384 - RNA, 22 nt, Human
cugcugagcaucagggcugccc

SEQ ID NO: 139385 - RNA, 22 nt, Human
uggcagcuuccugcucauagga

SEQ ID NO: 139386 - RNA, 22 nt, Human
uuguguguguaacuuuaugaga

SEQ ID NO: 139387 - RNA, 22 nt, Human
auucaaauuaaguuaauucagc

SEQ ID NO: 139388 - RNA, 22 nt, Human
ugcaccauuaauuuaugugaga

SEQ ID NO: 139389 - RNA, 22 nt, Human
ccucucauagucuguauccuuu

SEQ ID NO: 139390 - RNA, 22 nt, Human
uacuuucuuguuccuuucauaa

SEQ ID NO: 139391 - RNA, 23 nt, Human
uggcagcagaucuuaaagugacc

SEQ ID NO: 139392 - RNA, 22 nt, Human
cagcaauaagccagguuagaca

SEQ ID NO: 139393 - RNA, 22 nt, Human
ucucaggaucuaauacauggua

SEQ ID NO: 139394 - RNA, 22 nt, Human
gagaaagacguaggcugggagg

SEQ ID NO: 139395 - RNA, 22 nt, Human
uuuucucuuguuaauguacuga

SEQ ID NO: 139396 - RNA, 22 nt, Human
cucuggaauuaaggaagccugu

SEQ ID NO: 139397 - RNA, 22 nt, Human
uggcauguuuaauguacuguau

SEQ ID NO: 139398 - RNA, 22 nt, Human
uuuucuuauggugaagcacaaa

SEQ ID NO: 139399 - RNA, 22 nt, Human
cucuguguucagccuagcagaa

SEQ ID NO: 139400 - RNA, 22 nt, Human
gcccagcuggcuuccagcacau

SEQ ID NO: 139401 - RNA, 22 nt, Human
ccagcugauucgguggugguug

SEQ ID NO: 139402 - RNA, 22 nt, Human
ucugggaacacacgucacuuca

SEQ ID NO: 139403 - RNA, 22 nt, Human
aaggcacugaaaaauugugugu

SEQ ID NO: 139404 - RNA, 22 nt, Human
cuccucccugcgauugcucugc

SEQ ID NO: 139405 - RNA, 19 nt, Human
uggcagcauugguaccuug

SEQ ID NO: 139406 - RNA, 22 nt, Human
cucugaagggagggccaagccc

SEQ ID NO: 139407 - RNA, 22 nt, Human
cugaaggagaaggccacuguuc

SEQ ID NO: 139408 - RNA, 22 nt, Human
ucuguggcgcauaguugucucu

SEQ ID NO: 139409 - RNA, 22 nt, Human
uuucauuacguguuugacuugu

SEQ ID NO: 139410 - RNA, 22 nt, Human
acacaguaugaaaagucuaguu

SEQ ID NO: 139411 - RNA, 18 nt, Human
cagaaaucacaccagcac

SEQ ID NO: 139412 - RNA, 22 nt, Human
cauggcaggugcagauucugug

SEQ ID NO: 139413 - RNA, 22 nt, Human
auuucagauucagaaauguagg

SEQ ID NO: 139414 - RNA, 22 nt, Human
gcauguguuagagugugcaugc

SEQ ID NO: 139415 - RNA, 22 nt, Human
aggagcagaccguaguccugca

SEQ ID NO: 139416 - RNA, 22 nt, Human
ggcugugccucaaggcuacuca

SEQ ID NO: 139417 - RNA, 22 nt, Human
aucuggcuuaccuagggugccu

SEQ ID NO: 139418 - RNA, 22 nt, Human
aggaagccugcaggugacugcu

SEQ ID NO: 139419 - RNA, 22 nt, Human
augcacccagugucuggacuau

SEQ ID NO: 139420 - RNA, 22 nt, Human
aguauguauuuuauacuuacag

SEQ ID NO: 139421 - RNA, 22 nt, Human
caagggaccugagauggucucu

SEQ ID NO: 139422 - RNA, 22 nt, Human
uguggccugggaaaugaguguu

SEQ ID NO: 139423 - RNA, 22 nt, Human
guguaugcuuagccagagauuu

SEQ ID NO: 139424 - RNA, 22 nt, Human
cauacauugcucauucaguauc

SEQ ID NO: 139425 - RNA, 22 nt, Human
uguccacaucacucacuuguca

SEQ ID NO: 139426 - RNA, 22 nt, Human
cccagcagugacccagugauac

SEQ ID NO: 139427 - RNA, 22 nt, Human
ucugugugaccauaagccagcu

SEQ ID NO: 139428 - RNA, 22 nt, Human
caggguggcacucagcgcaucu

SEQ ID NO: 139429 - RNA, 22 nt, Human
gggcagcagaggaucccuuaau

SEQ ID NO: 139430 - RNA, 22 nt, Human
ucugcuggccuuagcaggucua

SEQ ID NO: 139431 - RNA, 22 nt, Human
guguuuccuaguuuaaugaaug

SEQ ID NO: 139432 - RNA, 22 nt, Human
guggccucuguuggcuccuagg

SEQ ID NO: 139433 - RNA, 17 nt, Human
cauuuguugaucaguug

SEQ ID NO: 139434 - RNA, 22 nt, Human
ugcagcugaggccagcuaugcc

SEQ ID NO: 139435 - RNA, 22 nt, Human
cuuacaguguugagggaauuaa

SEQ ID NO: 139436 - RNA, 22 nt, Human
augggaggguggaaaggcucug

SEQ ID NO: 139437 - RNA, 22 nt, Human
aaacuuuuuuagguucauaggc

SEQ ID NO: 139438 - RNA, 22 nt, Human
uuuguguguauauguauauaga

SEQ ID NO: 139439 - RNA, 22 nt, Human
ucuguguacgcaggcgugcgcg

SEQ ID NO: 139440 - RNA, 22 nt, Human
ccugggaggcuguuuccagccu

SEQ ID NO: 139441 - RNA, 22 nt, Human
uuuccuuccagguuccuaaggc

SEQ ID NO: 139442 - RNA, 22 nt, Human
aggcugugagcaagaacaccua

SEQ ID NO: 139443 - RNA, 22 nt, Human
aggcugugcgaggucucagagu

SEQ ID NO: 139444 - RNA, 22 nt, Human
ggcucuggugggaagguuagau

SEQ ID NO: 139445 - RNA, 23 nt, Human
cagcugaagcagccugggcugga

SEQ ID NO: 139446 - RNA, 22 nt, Human
ucacguuuuacugagugagaua

SEQ ID NO: 139447 - RNA, 22 nt, Human
gacccuguuucuacaaauaauu

SEQ ID NO: 139448 - RNA, 22 nt, Human
cccugcaggggaccugcagccu

SEQ ID NO: 139449 - RNA, 22 nt, Human
gaaggccauuagagccugugcc

SEQ ID NO: 139450 - RNA, 22 nt, Human
ggcagggagagcaugcugauaa

SEQ ID NO: 139451 - RNA, 22 nt, Human
aucuggcuauugacauguuaua

SEQ ID NO: 139452 - RNA, 22 nt, Human
cccaugccuucugacucacagg

SEQ ID NO: 139453 - RNA, 22 nt, Human
ugcccacaggaagacaccagcg

SEQ ID NO: 139454 - RNA, 22 nt, Human
gcucucuuugugccacuuaagg

SEQ ID NO: 139455 - RNA, 22 nt, Human
acaguagucuuaauuucaugua

SEQ ID NO: 139456 - RNA, 22 nt, Human
acucaggaaaugaagacugguu

SEQ ID NO: 139457 - RNA, 22 nt, Human
gaaaaaugagcugaugucaggg

SEQ ID NO: 139458 - RNA, 22 nt, Human
ggggcugggauuugaacccagg

SEQ ID NO: 139459 - RNA, 22 nt, Human
ccaggguggggcaggcccacug

SEQ ID NO: 139460 - RNA, 22 nt, Human
uuugaaaguccuaggagagucc

SEQ ID NO: 139461 - RNA, 22 nt, Human
uuuccucuuugugacacagcug

SEQ ID NO: 139462 - RNA, 22 nt, Human
gaggcagagucacaaagagucu

SEQ ID NO: 139463 - RNA, 22 nt, Human
acugaaggcuuaacucuuucau

SEQ ID NO: 139464 - RNA, 22 nt, Human
ccucucucuccugcacacacac

SEQ ID NO: 139465 - RNA, 22 nt, Human
ggcagaguggagugcggccucc

SEQ ID NO: 139466 - RNA, 22 nt, Human
ccugggaggcugugggucugcu

SEQ ID NO: 139467 - RNA, 22 nt, Human
uggcugugccucuuuccaggcc

SEQ ID NO: 139468 - RNA, 22 nt, Human
ugugugggagcacgggcuguug

SEQ ID NO: 139469 - RNA, 22 nt, Human
aagcaauagcaacaacuuuaca

SEQ ID NO: 139470 - RNA, 22 nt, Human
aagugguaggaagagagcacug

SEQ ID NO: 139471 - RNA, 22 nt, Human
agaggcaggaagagcugauuuu

SEQ ID NO: 139472 - RNA, 22 nt, Human
caguggcuguuucuggaaggca

SEQ ID NO: 139473 - RNA, 22 nt, Human
aagauuuccuucaguagagcua

SEQ ID NO: 139474 - RNA, 22 nt, Human
uauuucugggaguucagaaauu

SEQ ID NO: 139475 - RNA, 22 nt, Human
uuucuugucuuuaguaucuggc

SEQ ID NO: 139476 - RNA, 22 nt, Human
acauuucuggaguuucucaaca

SEQ ID NO: 139477 - RNA, 22 nt, Human
ugaggcaggaguucaggcugcg

SEQ ID NO: 139478 - RNA, 22 nt, Human
ugucaccagcugcuccucagga

SEQ ID NO: 139479 - RNA, 22 nt, Human
gagcagcugagcuggaaugaga

SEQ ID NO: 139480 - RNA, 22 nt, Human
cucuggagaacuccuugugucu

SEQ ID NO: 139481 - RNA, 22 nt, Human
gcuugcucaacccccgucucuc

SEQ ID NO: 139482 - RNA, 22 nt, Human
aggacucaucccugcuugucag

SEQ ID NO: 139483 - RNA, 22 nt, Human
uugaaagggauauaucuuucug

SEQ ID NO: 139484 - RNA, 21 nt, Human
guguuuccuguuuauggcuug

SEQ ID NO: 139485 - RNA, 22 nt, Human
caggcagcugacugucagauau

SEQ ID NO: 139486 - RNA, 22 nt, Human
cucacugucuguacuagcugau

SEQ ID NO: 139487 - RNA, 22 nt, Human
ccuccaggaacuugagagacac

SEQ ID NO: 139488 - RNA, 22 nt, Human
cucagggccaaggaugcuguug

SEQ ID NO: 139489 - RNA, 22 nt, Human
caguagcacucugucagugaag

SEQ ID NO: 139490 - RNA, 23 nt, Human
aaaguguagccagguuaagaacc

SEQ ID NO: 139491 - RNA, 19 nt, Human
uguguaaagucugugguca

SEQ ID NO: 139492 - RNA, 22 nt, Human
aagccaggaagagagccuucac

SEQ ID NO: 139493 - RNA, 22 nt, Human
ugaggugaccgcagaugggaag

SEQ ID NO: 139494 - RNA, 22 nt, Human
ucugugugcccuaaagccugcu

SEQ ID NO: 139495 - RNA, 22 nt, Human
acaaaugucuccucuuuuguua

SEQ ID NO: 139496 - RNA, 22 nt, Human
cuguucaugcugauucuguaug

SEQ ID NO: 139497 - RNA, 22 nt, Human
gugaaaucugaggcccaugaug

SEQ ID NO: 139498 - RNA, 22 nt, Human
cucccuggcacagcgagagguu

SEQ ID NO: 139499 - RNA, 19 nt, Human
gagcacagcggcauuuggu

SEQ ID NO: 139500 - RNA, 20 nt, Human
cccugagaccagagagcagc

SEQ ID NO: 139501 - RNA, 18 nt, Human
ccgggcuuuggugacaca

SEQ ID NO: 139502 - RNA, 17 nt, Human
uauguguguuugcagca

SEQ ID NO: 139503 - RNA, 22 nt, Human
gcugcugcgcuugucuacuguu

SEQ ID NO: 139504 - RNA, 22 nt, Human
cagccaggagccucugcaacua

SEQ ID NO: 139505 - RNA, 22 nt, Human
caggccugugacaccgugucug

SEQ ID NO: 139506 - RNA, 22 nt, Human
agagaagacuuacagccacagu

SEQ ID NO: 139507 - RNA, 19 nt, Human
agccuggcuuugcucugcu

SEQ ID NO: 139508 - RNA, 22 nt, Human
ucugucuucaucagcaugugau

SEQ ID NO: 139509 - RNA, 22 nt, Human
uucuuuggggaauauucugguu

SEQ ID NO: 139510 - RNA, 22 nt, Human
agcagcucuguuuaccuggagg

SEQ ID NO: 139511 - RNA, 22 nt, Human
uggaaagacauucagccgcugg

SEQ ID NO: 139512 - RNA, 22 nt, Human
cagcauggggcuuggagucagc

SEQ ID NO: 139513 - RNA, 22 nt, Human
ucaguaacuuacuuauucaccu

SEQ ID NO: 139514 - RNA, 22 nt, Human
agcuggagaaaccugggagggu

SEQ ID NO: 139515 - RNA, 22 nt, Human
acagauauaugauuguguaaau

SEQ ID NO: 139516 - RNA, 22 nt, Human
gccccuggcuggccagcuccuc

SEQ ID NO: 139517 - RNA, 22 nt, Human
ugcugaggagguggcugugcuu

SEQ ID NO: 139518 - RNA, 22 nt, Human
uccagaguacggaagagucauc

SEQ ID NO: 139519 - RNA, 22 nt, Human
uagaaaucauuuagaaguauug

SEQ ID NO: 139520 - RNA, 22 nt, Human
aggagguggccugagcgugccc

SEQ ID NO: 139521 - RNA, 23 nt, Human
ucugcucugaaguucggcugagc

SEQ ID NO: 139522 - RNA, 22 nt, Human
ucacaggacccugaggguggcg

SEQ ID NO: 139523 - RNA, 22 nt, Human
cccuggaggaccccaauguggc

SEQ ID NO: 139524 - RNA, 22 nt, Human
ugauggcuaucccuggaagggc

SEQ ID NO: 139525 - RNA, 20 nt, Human
agggcagagggauuacaggc

SEQ ID NO: 139526 - RNA, 22 nt, Human
aaugucugccugaacuuuauau

SEQ ID NO: 139527 - RNA, 19 nt, Human
cuggggcuuugguacugcc

SEQ ID NO: 139528 - RNA, 22 nt, Human
uggcagcuguguccagguagaa

SEQ ID NO: 139529 - RNA, 22 nt, Human
aacaacugaaaagcuuuuucug

SEQ ID NO: 139530 - RNA, 22 nt, Human
uucuuuuccuacacagcgauuu

SEQ ID NO: 139531 - RNA, 22 nt, Human
gcugucuguucgagcguguguu

SEQ ID NO: 139532 - RNA, 22 nt, Human
guggcagagguuccucagugug

SEQ ID NO: 139533 - RNA, 22 nt, Human
ccagcccuugcugaaggguggc

SEQ ID NO: 139534 - RNA, 22 nt, Human
agcagcugggcucagagcuggg

SEQ ID NO: 139535 - RNA, 22 nt, Human
ucaggggcccuucccucagcag

SEQ ID NO: 139536 - RNA, 22 nt, Human
agcugugugcauuugggucuca

SEQ ID NO: 139537 - RNA, 22 nt, Human
accagagcgcucaagccuuccc

SEQ ID NO: 139538 - RNA, 22 nt, Human
gugaccaucagagaauaacaaa

SEQ ID NO: 139539 - RNA, 22 nt, Human
cagccaggagcucccccugcuc

SEQ ID NO: 139540 - RNA, 22 nt, Human
uucuucuucuggcugcaccugg

SEQ ID NO: 139541 - RNA, 22 nt, Human
gcagugacagggcugcugccuu

SEQ ID NO: 139542 - RNA, 21 nt, Human
ugggagagggcucagcuaccc

SEQ ID NO: 139543 - RNA, 21 nt, Human
ugcccacagcaaaugcagagg

SEQ ID NO: 139544 - RNA, 22 nt, Human
uuccauaauaaccugagagaaa

SEQ ID NO: 139545 - RNA, 22 nt, Human
ugaagcagagugaaggugaauu

SEQ ID NO: 139546 - RNA, 22 nt, Human
guuacagugcuuggcaauaagu

SEQ ID NO: 139547 - RNA, 22 nt, Human
gugugcagugagcaaaagaucu

SEQ ID NO: 139548 - RNA, 22 nt, Human
auauuucuugagcaccugguau

SEQ ID NO: 139549 - RNA, 22 nt, Human
gcccagcaggacagagugguuu

SEQ ID NO: 139550 - RNA, 22 nt, Human
aguggcugugaaauacauggga

SEQ ID NO: 139551 - RNA, 22 nt, Human
ggacacaguggaagacagcuug

SEQ ID NO: 139552 - RNA, 22 nt, Human
agaucaaagccaugagagauuu

SEQ ID NO: 139553 - RNA, 22 nt, Human
gcuggagauaguaggauccaua

SEQ ID NO: 139554 - RNA, 22 nt, Human
uauguuuccugagcuuacacca

SEQ ID NO: 139555 - RNA, 20 nt, Human
uucucuuuggguccagagaa

SEQ ID NO: 139556 - RNA, 22 nt, Human
cauugcaccacauugcaucccu

SEQ ID NO: 139557 - RNA, 22 nt, Human
uauagaaguaagcauugugaug

SEQ ID NO: 139558 - RNA, 22 nt, Human
gcacuaaaccaacauguaauaa

SEQ ID NO: 139559 - RNA, 22 nt, Human
cagagcucagagcagggcacuc

SEQ ID NO: 139560 - RNA, 22 nt, Human
gagagugagauaauuucacaua

SEQ ID NO: 139561 - RNA, 22 nt, Human
aaggcgacacaggcagcaggcc

SEQ ID NO: 139562 - RNA, 22 nt, Human
cccaggagguggagguugcagc

SEQ ID NO: 139563 - RNA, 21 nt, Human
gaaaggucuuaacuuacagag

SEQ ID NO: 139564 - RNA, 22 nt, Human
acaggcagcgucauugcugcuc

SEQ ID NO: 139565 - RNA, 22 nt, Human
gaugagggccugguggcugugc

SEQ ID NO: 139566 - RNA, 19 nt, Human
cucuuuccauuguauuugc

SEQ ID NO: 139567 - RNA, 22 nt, Human
cuacauggagaagaaaauucuu

SEQ ID NO: 139568 - RNA, 20 nt, Human
ccuccuggucaggugugcag

SEQ ID NO: 139569 - RNA, 22 nt, Human
ugccugggccucugaggaaggc

SEQ ID NO: 139570 - RNA, 22 nt, Human
ucaagagaaggggaaauagacu

SEQ ID NO: 139571 - RNA, 22 nt, Human
aagggaggggauguaagccugg

SEQ ID NO: 139572 - RNA, 22 nt, Human
auguuauaguuauaaaaugagg

SEQ ID NO: 139573 - RNA, 22 nt, Human
gcugcucucucccuaaguuggg

SEQ ID NO: 139574 - RNA, 22 nt, Human
ugggaggcagguaggugaugau

SEQ ID NO: 139575 - RNA, 18 nt, Human
cugccuguugcugagagg

SEQ ID NO: 139576 - RNA, 22 nt, Human
ccagaggcauguucaaagcaau

SEQ ID NO: 139577 - RNA, 22 nt, Human
gccagcagggcccaaaugcugg

SEQ ID NO: 139578 - RNA, 22 nt, Human
uuuuccugggcuuucuguguaa

SEQ ID NO: 139579 - RNA, 22 nt, Human
ggcccacacugacagcugagcu

SEQ ID NO: 139580 - RNA, 22 nt, Human
cuuagaaaugcagauucucagg

SEQ ID NO: 139581 - RNA, 22 nt, Human
gacagguggggaaacuaaggua

SEQ ID NO: 139582 - RNA, 18 nt, Human
caggucagccuggccuca

SEQ ID NO: 139583 - RNA, 22 nt, Human
acagugaaugcccaagaaaagu

SEQ ID NO: 139584 - RNA, 22 nt, Human
cagcugccacuugcucucggcu

SEQ ID NO: 139585 - RNA, 22 nt, Human
uaacagaaauauuuccagguga

SEQ ID NO: 139586 - RNA, 22 nt, Human
cugaaggagcauagucaguuuu

SEQ ID NO: 139587 - RNA, 22 nt, Human
auugacaagacaauggcucuua

SEQ ID NO: 139588 - RNA, 22 nt, Human
gauuuccuaauguggaucucug

SEQ ID NO: 139589 - RNA, 18 nt, Human
gaugggagcaagagaaga

SEQ ID NO: 139590 - RNA, 22 nt, Human
aaaugcacugaacacauguugu

SEQ ID NO: 139591 - RNA, 22 nt, Human
uuucuauuggcgucacuguugu

SEQ ID NO: 139592 - RNA, 22 nt, Human
cucuauuuauggcaucuuuaug

SEQ ID NO: 139593 - RNA, 22 nt, Human
uauugacaauaggcaacugagg

SEQ ID NO: 139594 - RNA, 22 nt, Human
agguagagcuccaguagaaaau

SEQ ID NO: 139595 - RNA, 22 nt, Human
auuuucaugacuaccuuaaaua

SEQ ID NO: 139596 - RNA, 22 nt, Human
ggcuguguuccaagugucagga

SEQ ID NO: 139597 - RNA, 22 nt, Human
ugaagcagauggucuggucauu

SEQ ID NO: 139598 - RNA, 22 nt, Human
agggcagaccacgugcaaggau

SEQ ID NO: 139599 - RNA, 22 nt, Human
caguggaggccuugggaccuuu

SEQ ID NO: 139600 - RNA, 22 nt, Human
auucucaaacaagugguuugau

SEQ ID NO: 139601 - RNA, 22 nt, Human
ccugccugcagaaaguaucucc

SEQ ID NO: 139602 - RNA, 22 nt, Human
aggccuguuccuuccugggcac

SEQ ID NO: 139603 - RNA, 22 nt, Human
ucacaguacaugauucaguggu

SEQ ID NO: 139604 - RNA, 22 nt, Human
uucacaggauauaugugcaggg

SEQ ID NO: 139605 - RNA, 19 nt, Human
ugugugcaugcgcacgugu

SEQ ID NO: 139606 - RNA, 22 nt, Human
ugugcagcuaguccuggacuug

SEQ ID NO: 139607 - RNA, 22 nt, Human
uccucuggauauaagccucacc

SEQ ID NO: 139608 - RNA, 20 nt, Human
gagccugggaagucuaaggu

SEQ ID NO: 139609 - RNA, 22 nt, Human
auucuguauuucuaauaagauc

SEQ ID NO: 139610 - RNA, 22 nt, Human
agucccaggcagccgagccggu

SEQ ID NO: 139611 - RNA, 22 nt, Human
ugcucuguaaggucagaaaagg

SEQ ID NO: 139612 - RNA, 22 nt, Human
aaguauauuuuuugaagcauau

SEQ ID NO: 139613 - RNA, 22 nt, Human
cccuggcauaaaacuucuccag

SEQ ID NO: 139614 - RNA, 22 nt, Human
agaggucauaucucagaagaga

SEQ ID NO: 139615 - RNA, 22 nt, Human
ucaguuuuuaagaguuaugcga

SEQ ID NO: 139616 - RNA, 22 nt, Human
auauuuguauuucgugugugua

SEQ ID NO: 139617 - RNA, 22 nt, Human
gcugucuggaggcucugaggga

SEQ ID NO: 139618 - RNA, 22 nt, Human
ugugccugcuagaugguugucg

SEQ ID NO: 139619 - RNA, 22 nt, Human
guggccagaagacugcaaugcu

SEQ ID NO: 139620 - RNA, 22 nt, Human
agguggaacguucaggugcuag

SEQ ID NO: 139621 - RNA, 22 nt, Human
caggaagagaacauggaggcug

SEQ ID NO: 139622 - RNA, 20 nt, Human
cagcaguggaugagaguuuu

SEQ ID NO: 139623 - RNA, 22 nt, Human
ccaccuccaccuauugccagcc

SEQ ID NO: 139624 - RNA, 22 nt, Human
aguuauauaacuaucuagaugc

SEQ ID NO: 139625 - RNA, 22 nt, Human
acagucuaggugugugauuuaa

SEQ ID NO: 139626 - RNA, 22 nt, Human
aaaugguguuucuaaugcuaga

SEQ ID NO: 139627 - RNA, 22 nt, Human
gggcagagaaauggacaguugg

SEQ ID NO: 139628 - RNA, 22 nt, Human
cuuuuuauaccgugccaguuga

SEQ ID NO: 139629 - RNA, 22 nt, Human
ucagaacagaagaaggaacacg

SEQ ID NO: 139630 - RNA, 22 nt, Human
uuucauaugggcauuggcaaua

SEQ ID NO: 139631 - RNA, 22 nt, Human
aucuuucaguuucauaccaauu

SEQ ID NO: 139632 - RNA, 22 nt, Human
uuacagcacagugcuuuuacug

SEQ ID NO: 139633 - RNA, 22 nt, Human
ucacaucucccuggaggacaca

SEQ ID NO: 139634 - RNA, 22 nt, Human
aaggccuggauuuagguuguga

SEQ ID NO: 139635 - RNA, 22 nt, Human
gcagcaggagaguuuguccugc

SEQ ID NO: 139636 - RNA, 22 nt, Human
agcagaugagccucaugacugg

SEQ ID NO: 139637 - RNA, 22 nt, Human
ugcagcagacugaguaugagaa

SEQ ID NO: 139638 - RNA, 22 nt, Human
ccagagugacgugaagugugaa

SEQ ID NO: 139639 - RNA, 22 nt, Human
aagccagggauuccugagggag

SEQ ID NO: 139640 - RNA, 22 nt, Human
ugggugugcccagauggugucc

SEQ ID NO: 139641 - RNA, 22 nt, Human
auuugcucuagcugcagugaau

SEQ ID NO: 139642 - RNA, 22 nt, Human
caggccuggagugcaauggcac

SEQ ID NO: 139643 - RNA, 23 nt, Human
gcugucugucaucucugcgggag

SEQ ID NO: 139644 - RNA, 22 nt, Human
gcuggugagcaaaggagaagga

SEQ ID NO: 139645 - RNA, 22 nt, Human
aaugcagugagccauuaaaugg

SEQ ID NO: 139646 - RNA, 22 nt, Human
cucuggaauguuuacaugcccu

SEQ ID NO: 139647 - RNA, 22 nt, Human
acaaaaguguaggaauuccuua

SEQ ID NO: 139648 - RNA, 17 nt, Human
ucugugauaguguagau

SEQ ID NO: 139649 - RNA, 20 nt, Human
accuuucaaaugauucagca

SEQ ID NO: 139650 - RNA, 22 nt, Human
ccuucugcuggucaucccagug

SEQ ID NO: 139651 - RNA, 17 nt, Human
ucuguccagggagugug

SEQ ID NO: 139652 - RNA, 22 nt, Human
ugugaauguauaguuuguauau

SEQ ID NO: 139653 - RNA, 22 nt, Human
cuuguacacucaguacuucuag

SEQ ID NO: 139654 - RNA, 22 nt, Human
cucuuuucaaaccuguuuaugg

SEQ ID NO: 139655 - RNA, 22 nt, Human
cugcaggcccccuuccuggagu

SEQ ID NO: 139656 - RNA, 22 nt, Human
aggcagagaaaaaccagauaug

SEQ ID NO: 139657 - RNA, 22 nt, Human
uuuaaucucccacucucagccu

SEQ ID NO: 139658 - RNA, 22 nt, Human
auccuugagccaaugacugauu

SEQ ID NO: 139659 - RNA, 23 nt, Human
uccagggauuaaugaagucaguc

SEQ ID NO: 139660 - RNA, 22 nt, Human
gcacagaacuucucuuaguagg

SEQ ID NO: 139661 - RNA, 22 nt, Human
ucagagugaggcccagcaaucu

SEQ ID NO: 139662 - RNA, 22 nt, Human
aggcaggugggucacuugaguc

SEQ ID NO: 139663 - RNA, 22 nt, Human
uuuagagucauuuuauauugac

SEQ ID NO: 139664 - RNA, 22 nt, Human
cagagccagcuguccuuggcau

SEQ ID NO: 139665 - RNA, 18 nt, Human
aggccagcccugcuacug

SEQ ID NO: 139666 - RNA, 22 nt, Human
ggcacugauaauguccucucuc

SEQ ID NO: 139667 - RNA, 19 nt, Human
cuguacagguugcuucugg

SEQ ID NO: 139668 - RNA, 22 nt, Human
cuccucuggcuuccuggaggca

SEQ ID NO: 139669 - RNA, 22 nt, Human
ugaagcaggaaacuucuuguuu

SEQ ID NO: 139670 - RNA, 22 nt, Human
uggcucagcgguggcagcagac

SEQ ID NO: 139671 - RNA, 22 nt, Human
cagagcagguaucuuuggugaa

SEQ ID NO: 139672 - RNA, 22 nt, Human
aaaggcaggcuuucacaucuca

SEQ ID NO: 139673 - RNA, 22 nt, Human
ccagcuggugggucuuucucug

SEQ ID NO: 139674 - RNA, 20 nt, Human
uccaguauguuauuuggugu

SEQ ID NO: 139675 - RNA, 22 nt, Human
cucaggauagcugcgcagccug

SEQ ID NO: 139676 - RNA, 22 nt, Human
gagccuguguuuccuguagcca

SEQ ID NO: 139677 - RNA, 22 nt, Human
gacagggcaagacucugucuaa

SEQ ID NO: 139678 - RNA, 22 nt, Human
auucucucuagaagcugagaug

SEQ ID NO: 139679 - RNA, 22 nt, Human
uggacaggugagugacucaggg

SEQ ID NO: 139680 - RNA, 22 nt, Human
uaagaacagauaaaguuucccc

SEQ ID NO: 139681 - RNA, 22 nt, Human
ugcagggcacacgcacgggugu

SEQ ID NO: 139682 - RNA, 22 nt, Human
cugugucggacgugggcagcag

SEQ ID NO: 139683 - RNA, 22 nt, Human
ugcagaagaaugagcuuggagu

SEQ ID NO: 139684 - RNA, 22 nt, Human
acuuuuaaaugaguuucaguug

SEQ ID NO: 139685 - RNA, 22 nt, Human
aggccagggucccacacucgca

SEQ ID NO: 139686 - RNA, 22 nt, Human
agaggccuuucuguugagugaa

SEQ ID NO: 139687 - RNA, 22 nt, Human
ggcucacgcaauuaucccggcc

SEQ ID NO: 139688 - RNA, 22 nt, Human
caggccugauacacugaacucu

SEQ ID NO: 139689 - RNA, 22 nt, Human
cuggcagcuggaggcuagaggc

SEQ ID NO: 139690 - RNA, 22 nt, Human
cuggcuugcagcucaucauaaa

SEQ ID NO: 139691 - RNA, 22 nt, Human
uggagcccagacacuggcauug

SEQ ID NO: 139692 - RNA, 22 nt, Human
aguggcagagccaaguagagcc

SEQ ID NO: 139693 - RNA, 22 nt, Human
uucucuagguuuuagaugaaga

SEQ ID NO: 139694 - RNA, 22 nt, Human
agcccuagagcuggaggucagu

SEQ ID NO: 139695 - RNA, 22 nt, Human
auuuucugugugcagauaaaua

SEQ ID NO: 139696 - RNA, 22 nt, Human
uggggaagggcacccuggagac

SEQ ID NO: 139697 - RNA, 22 nt, Human
ccaaaguccauaguuuacuuua

SEQ ID NO: 139698 - RNA, 21 nt, Human
gugugaguagcaugugucuca

SEQ ID NO: 139699 - RNA, 22 nt, Human
gccaggugcuaucccugcgcug

SEQ ID NO: 139700 - RNA, 22 nt, Human
guaugcaugcauguguauguac

SEQ ID NO: 139701 - RNA, 22 nt, Human
uauauuaacacccacuugccuc

SEQ ID NO: 139702 - RNA, 20 nt, Human
agaguaacuggcacauaggg

SEQ ID NO: 139703 - RNA, 22 nt, Human
agggcuggccacaugauuuggu

SEQ ID NO: 139704 - RNA, 18 nt, Human
ggagagugacagagucgu

SEQ ID NO: 139705 - RNA, 22 nt, Human
uccucaugccgggucucacgcu

SEQ ID NO: 139706 - RNA, 21 nt, Human
ggagggcagcccagacuggcu

SEQ ID NO: 139707 - RNA, 22 nt, Human
auuugcaaagucguaucuguga

SEQ ID NO: 139708 - RNA, 22 nt, Human
ggccucagaccggagcuggcca

SEQ ID NO: 139709 - RNA, 22 nt, Human
acaggcuucucacagaaaaggg

SEQ ID NO: 139710 - RNA, 22 nt, Human
acuuggcaaguaucuauaaagu

SEQ ID NO: 139711 - RNA, 22 nt, Human
agggcugcccagugugagagcu

SEQ ID NO: 139712 - RNA, 22 nt, Human
uuuggaaaguugucacuuuaga

SEQ ID NO: 139713 - RNA, 22 nt, Human
cggagccugcuuguugcagcug

SEQ ID NO: 139714 - RNA, 20 nt, Human
gaggcugcggacugcuggac

SEQ ID NO: 139715 - RNA, 22 nt, Human
cuccaguaucuguaggaaaagg

SEQ ID NO: 139716 - RNA, 22 nt, Human
uuucucauggaacaucguuuag

SEQ ID NO: 139717 - RNA, 22 nt, Human
ccauccugcauugcuauucaga

SEQ ID NO: 139718 - RNA, 20 nt, Human
cucugcugcccgccggcugc

SEQ ID NO: 139719 - RNA, 22 nt, Human
gagggggagaugugcacacacu

SEQ ID NO: 139720 - RNA, 22 nt, Human
ggcuggcucagggcuugagaga

SEQ ID NO: 139721 - RNA, 22 nt, Human
uucugucuucucgguuguuuac

SEQ ID NO: 139722 - RNA, 22 nt, Human
uggcccugucccuggagccugg

SEQ ID NO: 139723 - RNA, 22 nt, Human
aaggcagccucugccagccggg

SEQ ID NO: 139724 - RNA, 22 nt, Human
uugaagcaaggcgaaucuugug

SEQ ID NO: 139725 - RNA, 22 nt, Human
gggcccacuggcugucugaccc

SEQ ID NO: 139726 - RNA, 21 nt, Human
aguguguguggaaugagaaua

SEQ ID NO: 139727 - RNA, 22 nt, Human
gggucuggcaugcugagaugga

SEQ ID NO: 139728 - RNA, 22 nt, Human
uuuuauguaauccuuacugucg

SEQ ID NO: 139729 - RNA, 22 nt, Human
uaguauuugcagauuuguguca

SEQ ID NO: 139730 - RNA, 22 nt, Human
agugggcaugaucuggugucug

SEQ ID NO: 139731 - RNA, 22 nt, Human
ggccucucuccuuggcuugcag

SEQ ID NO: 139732 - RNA, 22 nt, Human
agggggcaucagguccuggcuc

SEQ ID NO: 139733 - RNA, 22 nt, Human
gacaguauuuaacuaguucauu

SEQ ID NO: 139734 - RNA, 22 nt, Human
agaaguaggcagggcuguauca

SEQ ID NO: 139735 - RNA, 22 nt, Human
uuucaucuaacacuacauaggg

SEQ ID NO: 139736 - RNA, 22 nt, Human
gcucugagucucagcuaccaca

SEQ ID NO: 139737 - RNA, 22 nt, Human
uccucagaugcucuuggacgcc

SEQ ID NO: 139738 - RNA, 22 nt, Human
uuugucugccuugcuggacugu

SEQ ID NO: 139739 - RNA, 22 nt, Human
uguguuguuuuaagcugcugca

SEQ ID NO: 139740 - RNA, 22 nt, Human
caggagugcagguggugaggca

SEQ ID NO: 139741 - RNA, 22 nt, Human
ucuuuggauaucgcuagaccgu

SEQ ID NO: 139742 - RNA, 23 nt, Human
uccaagggcuacaaacacagacc

SEQ ID NO: 139743 - RNA, 22 nt, Human
agcagcaucaacccucccgugu

SEQ ID NO: 139744 - RNA, 22 nt, Human
cuggguggaucgcagccccagg

SEQ ID NO: 139745 - RNA, 22 nt, Human
gcugccuucaguucugauucau

SEQ ID NO: 139746 - RNA, 22 nt, Human
aaagauaauguuuccuuauucu

SEQ ID NO: 139747 - RNA, 22 nt, Human
ucagaccauccugcuguuagug

SEQ ID NO: 139748 - RNA, 22 nt, Human
gccaggcagcaggaagccagug

SEQ ID NO: 139749 - RNA, 22 nt, Human
augugugccccuuuuacucuuu

SEQ ID NO: 139750 - RNA, 19 nt, Human
gccugagccagccaugcaa

SEQ ID NO: 139751 - RNA, 22 nt, Human
ccucucccacguggcagaggcu

SEQ ID NO: 139752 - RNA, 22 nt, Human
ugguaaauauguccauucucuu

SEQ ID NO: 139753 - RNA, 19 nt, Human
cucuuuacucccuugccuu

SEQ ID NO: 139754 - RNA, 22 nt, Human
ucugggcccuaaaccagcucua

SEQ ID NO: 139755 - RNA, 22 nt, Human
gcugauguuuaguugauguuac

SEQ ID NO: 139756 - RNA, 22 nt, Human
uggcugaacuaaugugcuguuu

SEQ ID NO: 139757 - RNA, 22 nt, Human
gugugcuguuguucagguagaa

SEQ ID NO: 139758 - RNA, 23 nt, Human
auaaggcauaaagguacauugga

SEQ ID NO: 139759 - RNA, 22 nt, Human
cagcaauaagguaagcuucucc

SEQ ID NO: 139760 - RNA, 22 nt, Human
uccaguggagugugggggugaa

SEQ ID NO: 139761 - RNA, 22 nt, Human
uuuuaauacugcuauuguagga

SEQ ID NO: 139762 - RNA, 23 nt, Human
ggaguuggauuguacuugcugcu

SEQ ID NO: 139763 - RNA, 22 nt, Human
cagaaauggaauuuuccaucac

SEQ ID NO: 139764 - RNA, 22 nt, Human
guggccaggacauugccaggca

SEQ ID NO: 139765 - RNA, 20 nt, Human
uccagggcuagggagcucau

SEQ ID NO: 139766 - RNA, 22 nt, Human
aagaaaagaaaccugaggcuuu

SEQ ID NO: 139767 - RNA, 23 nt, Human
uguguauguaucuaugcauaggu

SEQ ID NO: 139768 - RNA, 22 nt, Human
uuuuuccuagugcuuucuggua

SEQ ID NO: 139769 - RNA, 22 nt, Human
aggucauuccuugucuucuugc

SEQ ID NO: 139770 - RNA, 22 nt, Human
uuuacaguuaagaaauguuacc

SEQ ID NO: 139771 - RNA, 22 nt, Human
uuucucucugacugggagcuga

SEQ ID NO: 139772 - RNA, 22 nt, Human
gcuggccugggcagccugucgg

SEQ ID NO: 139773 - RNA, 22 nt, Human
ucauuguuucugcuuuucauga

SEQ ID NO: 139774 - RNA, 20 nt, Human
cagucccaauccagggccag

SEQ ID NO: 139775 - RNA, 22 nt, Human
uguggguuuguaguuaaguucu

SEQ ID NO: 139776 - RNA, 22 nt, Human
acugugugaaacaucaaugugu

SEQ ID NO: 139777 - RNA, 22 nt, Human
gagccagguuugaaucucaguc

SEQ ID NO: 139778 - RNA, 22 nt, Human
ugucccagaucacaggagggga

SEQ ID NO: 139779 - RNA, 22 nt, Human
uuaucguacgcuucagaaauuu

SEQ ID NO: 139780 - RNA, 22 nt, Human
cuggacagaaagggcugcugug

SEQ ID NO: 139781 - RNA, 22 nt, Human
ugagcugucuaugguccugucu

SEQ ID NO: 139782 - RNA, 22 nt, Human
cugccuggggaaugugaggauu

SEQ ID NO: 139783 - RNA, 22 nt, Human
agcagaagaaagccacaugacu

SEQ ID NO: 139784 - RNA, 22 nt, Human
cagccagguucaaguccuuaua

SEQ ID NO: 139785 - RNA, 22 nt, Human
uccuugaaaaucuugguuuaga

SEQ ID NO: 139786 - RNA, 22 nt, Human
cagcagcugggaaggaggcuga

SEQ ID NO: 139787 - RNA, 19 nt, Human
uuuucucgugcuugucugc

SEQ ID NO: 139788 - RNA, 22 nt, Human
ugcagccaucgcagagucugua

SEQ ID NO: 139789 - RNA, 23 nt, Human
uuccagaguccacaucugccacc

SEQ ID NO: 139790 - RNA, 22 nt, Human
auuuacagaaacuuaaucauag

SEQ ID NO: 139791 - RNA, 22 nt, Human
ccguguguaugguggaacugcu

SEQ ID NO: 139792 - RNA, 22 nt, Human
cuggagccugcaguuuucacuu

SEQ ID NO: 139793 - RNA, 17 nt, Human
ugauaguucauuuuaag

SEQ ID NO: 139794 - RNA, 22 nt, Human
uucauuaguucugaagaugucu

SEQ ID NO: 139795 - RNA, 22 nt, Human
ugcagaagaaaacagcugugug

SEQ ID NO: 139796 - RNA, 21 nt, Human
ucuuuccaauauucaugucuc

SEQ ID NO: 139797 - RNA, 22 nt, Human
cugggaggcagucucucuagaa

SEQ ID NO: 139798 - RNA, 22 nt, Human
aagcaaaagguuacacuucugg

SEQ ID NO: 139799 - RNA, 22 nt, Human
aucaguauauuccuuggucuuu

SEQ ID NO: 139800 - RNA, 22 nt, Human
uuuguuuacucauucauugaug

SEQ ID NO: 139801 - RNA, 22 nt, Human
ugggcccugacuucaagcaucc

SEQ ID NO: 139802 - RNA, 22 nt, Human
cuccuugguguaguacugagca

SEQ ID NO: 139803 - RNA, 22 nt, Human
aaggcugagacagcacaggucc

SEQ ID NO: 139804 - RNA, 22 nt, Human
ucuacuuucacucauacuuauu

SEQ ID NO: 139805 - RNA, 22 nt, Human
cagcagugugcaggugugcugg

SEQ ID NO: 139806 - RNA, 22 nt, Human
ucaggcagaggauggggagcgu

SEQ ID NO: 139807 - RNA, 22 nt, Human
agaauaaaucaaauguccugag

SEQ ID NO: 139808 - RNA, 22 nt, Human
ggcagauggagaagcagcaggu

SEQ ID NO: 139809 - RNA, 22 nt, Human
uacaguaaccuuauuugucauu

SEQ ID NO: 139810 - RNA, 22 nt, Human
auguauauacuuacaugugugg

SEQ ID NO: 139811 - RNA, 22 nt, Human
gugcucuguguauuaggauguc

SEQ ID NO: 139812 - RNA, 17 nt, Human
ggugagaccucccacuc

SEQ ID NO: 139813 - RNA, 22 nt, Human
cuggcagcgcagcaugaagucg

SEQ ID NO: 139814 - RNA, 22 nt, Human
uauucucugcagcugaauguuu

SEQ ID NO: 139815 - RNA, 22 nt, Human
uuuccauguuggugaaaugagg

SEQ ID NO: 139816 - RNA, 22 nt, Human
ugggcugcugcggugcucuugg

SEQ ID NO: 139817 - RNA, 22 nt, Human
ugaaaucuccucuuuauauauc

SEQ ID NO: 139818 - RNA, 22 nt, Human
uuucuguauuuaaaagaucugg

SEQ ID NO: 139819 - RNA, 22 nt, Human
auguaguauuuggaaauguaaa

SEQ ID NO: 139820 - RNA, 22 nt, Human
acacuuuacagcuuccuuugca

SEQ ID NO: 139821 - RNA, 22 nt, Human
ucuguuccauguuuuguuccau

SEQ ID NO: 139822 - RNA, 22 nt, Human
ccucacuuuccuuucuccuggg

SEQ ID NO: 139823 - RNA, 22 nt, Human
ggccuguggcaaggugagaaug

SEQ ID NO: 139824 - RNA, 22 nt, Human
cacuucaauuaacuucagcauu

SEQ ID NO: 139825 - RNA, 22 nt, Human
acagagguaggacaugagauau

SEQ ID NO: 139826 - RNA, 22 nt, Human
aaauuguugaucuacaguaagg

SEQ ID NO: 139827 - RNA, 22 nt, Human
cugucccuucauuauucacuac

SEQ ID NO: 139828 - RNA, 22 nt, Human
ccagagcugauuccugggacuu

SEQ ID NO: 139829 - RNA, 22 nt, Human
gcagauggugccaugucuugug

SEQ ID NO: 139830 - RNA, 22 nt, Human
aagggcagaaagggacgcuuug

SEQ ID NO: 139831 - RNA, 18 nt, Human
cuucagugacagucuggc

SEQ ID NO: 139832 - RNA, 22 nt, Human
aucuaagauguauugagcacuu

SEQ ID NO: 139833 - RNA, 17 nt, Human
uauguguguguuuauac

SEQ ID NO: 139834 - RNA, 22 nt, Human
acagagcacugcccugugccgc

SEQ ID NO: 139835 - RNA, 21 nt, Human
gcagggacaaagcuucaggag

SEQ ID NO: 139836 - RNA, 22 nt, Human
gcagggugccgacuucagggau

SEQ ID NO: 139837 - RNA, 19 nt, Human
aaaaacuuaguccagaaag

SEQ ID NO: 139838 - RNA, 22 nt, Human
agagcuggggccagagucaagg

SEQ ID NO: 139839 - RNA, 22 nt, Human
cauuaucugccauugacaccau

SEQ ID NO: 139840 - RNA, 22 nt, Human
uaguuucugguucuugcucugg

SEQ ID NO: 139841 - RNA, 17 nt, Human
gcugagugcagggaguc

SEQ ID NO: 139842 - RNA, 22 nt, Human
uaaauucugaucaaguuccuuc

SEQ ID NO: 139843 - RNA, 22 nt, Human
cugagguguugaugaccuaugc

SEQ ID NO: 139844 - RNA, 22 nt, Human
aucuuccuucacuuucucccac

SEQ ID NO: 139845 - RNA, 22 nt, Human
auguggcucauuguuugcuuac

SEQ ID NO: 139846 - RNA, 22 nt, Human
auguacaguuucuagacucaaa

SEQ ID NO: 139847 - RNA, 22 nt, Human
auguguauguguauacacacag

SEQ ID NO: 139848 - RNA, 22 nt, Human
aggcuguguucugguucuuagc

SEQ ID NO: 139849 - RNA, 22 nt, Human
uguguacaagaguguuuacugu

SEQ ID NO: 139850 - RNA, 22 nt, Human
aggaaagggguagguguggacg

SEQ ID NO: 139851 - RNA, 22 nt, Human
ugcucuggaguggcuugugcac

SEQ ID NO: 139852 - RNA, 22 nt, Human
gaagcacauggcuauagcuauu

SEQ ID NO: 139853 - RNA, 22 nt, Human
uuguaacagguacuaaauaacu

SEQ ID NO: 139854 - RNA, 22 nt, Human
guucuugccagcauccucaggu

SEQ ID NO: 139855 - RNA, 22 nt, Human
gcugcucuacccaugcaucugu

SEQ ID NO: 139856 - RNA, 18 nt, Human
agccuggaggguugaagu

SEQ ID NO: 139857 - RNA, 22 nt, Human
ggccuugguaaagggaugcaug

SEQ ID NO: 139858 - RNA, 22 nt, Human
auuugucugcuugcugccuucc

SEQ ID NO: 139859 - RNA, 22 nt, Human
uggcucaggaucuaagcagaau

SEQ ID NO: 139860 - RNA, 17 nt, Human
ucaggcugugccuggua

SEQ ID NO: 139861 - RNA, 22 nt, Human
ucacuguaucauguugcacuua

SEQ ID NO: 139862 - RNA, 20 nt, Human
gagggcaggcacccauuuca

SEQ ID NO: 139863 - RNA, 22 nt, Human
agggcacagccuaaagccuaug

SEQ ID NO: 139864 - RNA, 22 nt, Human
cacagaguggaggcuuggccug

SEQ ID NO: 139865 - RNA, 21 nt, Human
agguggggcugcaccucugcu

SEQ ID NO: 139866 - RNA, 22 nt, Human
uacaguauguucuugaauuugg

SEQ ID NO: 139867 - RNA, 22 nt, Human
ggaggguuagcaaaggcacaga

SEQ ID NO: 139868 - RNA, 22 nt, Human
acugcagccuugaacucugggc

SEQ ID NO: 139869 - RNA, 22 nt, Human
agacagcugcucgcagagcuau

SEQ ID NO: 139870 - RNA, 22 nt, Human
uagcuuuaccauagaagaguau

SEQ ID NO: 139871 - RNA, 22 nt, Human
ugcagaagugagucaugaggaa

SEQ ID NO: 139872 - RNA, 22 nt, Human
agggccagaaucccucagucua

SEQ ID NO: 139873 - RNA, 22 nt, Human
ucagaaauagucuuuaaaauga

SEQ ID NO: 139874 - RNA, 23 nt, Human
ggcagcucucaucugaugacuga

SEQ ID NO: 139875 - RNA, 22 nt, Human
cagccugggcuccagagucccu

SEQ ID NO: 139876 - RNA, 23 nt, Human
caugccaguuugugcaggcagau

SEQ ID NO: 139877 - RNA, 20 nt, Human
acugccuugguucaguaggu

SEQ ID NO: 139878 - RNA, 22 nt, Human
cuuuacagauggauaauuguuu

SEQ ID NO: 139879 - RNA, 22 nt, Human
cuuaacuugaugucucucugcu

SEQ ID NO: 139880 - RNA, 18 nt, Human
uggcucugcagccagaug

SEQ ID NO: 139881 - RNA, 22 nt, Human
ugcuggggguucagaugaguaa

SEQ ID NO: 139882 - RNA, 22 nt, Human
gugcccaggcccaaggcaccac

SEQ ID NO: 139883 - RNA, 22 nt, Human
ugucaugcuuauguuacauacu

SEQ ID NO: 139884 - RNA, 22 nt, Human
gccugccuucggugcgcagcgg

SEQ ID NO: 139885 - RNA, 22 nt, Human
uaguauaucuuuaguacauagu

SEQ ID NO: 139886 - RNA, 22 nt, Human
gcaggagcucguuuccaggcug

SEQ ID NO: 139887 - RNA, 22 nt, Human
aagcuggaacaucuugaggaag

SEQ ID NO: 139888 - RNA, 22 nt, Human
aggcuguguggaugagucuuac

SEQ ID NO: 139889 - RNA, 22 nt, Human
uuuuagauugggaaauguaaag

SEQ ID NO: 139890 - RNA, 22 nt, Human
aaggucauugguucugaauucu

SEQ ID NO: 139891 - RNA, 22 nt, Human
gaucaaaagcuggguucuaaaa

SEQ ID NO: 139892 - RNA, 22 nt, Human
gcagcaggcacggucucgacau

SEQ ID NO: 139893 - RNA, 22 nt, Human
ggcucagagaccugcgaucuga

SEQ ID NO: 139894 - RNA, 22 nt, Human
ccucucuguaagggucccuccc

SEQ ID NO: 139895 - RNA, 22 nt, Human
agcagccaagguaaccugugcu

SEQ ID NO: 139896 - RNA, 22 nt, Human
gguggcugggauuaguagccca

SEQ ID NO: 139897 - RNA, 22 nt, Human
auauuuucuggaacuaugccug

SEQ ID NO: 139898 - RNA, 22 nt, Human
gagcugccaguguaugaauucu

SEQ ID NO: 139899 - RNA, 22 nt, Human
uggguaaacugggucuggagag

SEQ ID NO: 139900 - RNA, 22 nt, Human
ucucugugggcuuuggacuuga

SEQ ID NO: 139901 - RNA, 21 nt, Human
ugcucacagaugugcucagug

SEQ ID NO: 139902 - RNA, 22 nt, Human
agggccugucagcgguguccug

SEQ ID NO: 139903 - RNA, 22 nt, Human
ugcguggcgcagcgugugggau

SEQ ID NO: 139904 - RNA, 22 nt, Human
agggcucuguccccagaggccc

SEQ ID NO: 139905 - RNA, 22 nt, Human
ugcuggagaucauuaauguuca

SEQ ID NO: 139906 - RNA, 22 nt, Human
cagagcugcagauugaaggcau

SEQ ID NO: 139907 - RNA, 22 nt, Human
uccucacauggugagccacaca

SEQ ID NO: 139908 - RNA, 21 nt, Human
uggagcugccacuuguccucc

SEQ ID NO: 139909 - RNA, 22 nt, Human
uguacaguggaaaauggauucg

SEQ ID NO: 139910 - RNA, 22 nt, Human
cuggccuguccugacccagccu

SEQ ID NO: 139911 - RNA, 23 nt, Human
ucucuuaucacaauucauuuugc

SEQ ID NO: 139912 - RNA, 22 nt, Human
guccucuggaagaugaguucuu

SEQ ID NO: 139913 - RNA, 22 nt, Human
acaugcauacacguacauaccu

SEQ ID NO: 139914 - RNA, 22 nt, Human
uuccuucucagcccucgaggau

SEQ ID NO: 139915 - RNA, 22 nt, Human
cagcuauauuguuuucuacugu

SEQ ID NO: 139916 - RNA, 22 nt, Human
cucaggauugugccuagggaga

SEQ ID NO: 139917 - RNA, 18 nt, Human
uccagagguguuggagcc

SEQ ID NO: 139918 - RNA, 22 nt, Human
accuuuuuccaaagcuucuuac

SEQ ID NO: 139919 - RNA, 17 nt, Human
uuccucucacauuuuuu

SEQ ID NO: 139920 - RNA, 22 nt, Human
cuucuggaggacacuggcccca

SEQ ID NO: 139921 - RNA, 22 nt, Human
auuuccauagagcgucucacag

SEQ ID NO: 139922 - RNA, 22 nt, Human
ugagguaggugguaagagauac

SEQ ID NO: 139923 - RNA, 22 nt, Human
uguuugugagaugugagguacg

SEQ ID NO: 139924 - RNA, 22 nt, Human
gcagggucuugagaggcagcca

SEQ ID NO: 139925 - RNA, 22 nt, Human
uccuucagcuuauuucuuagga

SEQ ID NO: 139926 - RNA, 22 nt, Human
gccucugcggggcccgagcccg

SEQ ID NO: 139927 - RNA, 22 nt, Human
acugugcuuucucuggaggcau

SEQ ID NO: 139928 - RNA, 22 nt, Human
uucuacaauaugaauaaugaag

SEQ ID NO: 139929 - RNA, 19 nt, Human
agaggccucagcagcuggc

SEQ ID NO: 139930 - RNA, 22 nt, Human
ggccucaguuucuucaacugua

SEQ ID NO: 139931 - RNA, 22 nt, Human
agaagccauucccuguaggcuc

SEQ ID NO: 139932 - RNA, 19 nt, Human
ucuaacagaagugucgucc

SEQ ID NO: 139933 - RNA, 22 nt, Human
cuuuucucugcaccauguguga

SEQ ID NO: 139934 - RNA, 22 nt, Human
aauaucaacaguguccuucuaa

SEQ ID NO: 139935 - RNA, 20 nt, Human
cugcucugcuuugcaggugg

SEQ ID NO: 139936 - RNA, 22 nt, Human
acuuuguugaagaauauguuag

SEQ ID NO: 139937 - RNA, 22 nt, Human
cuuuauguucaguacaaugcuu

SEQ ID NO: 139938 - RNA, 22 nt, Human
uggggcuguggauucucacgaa

SEQ ID NO: 139939 - RNA, 22 nt, Human
ucuguguuuaaaagauaugucc

SEQ ID NO: 139940 - RNA, 22 nt, Human
ccagggcagaaaaagagggaau

SEQ ID NO: 139941 - RNA, 22 nt, Human
gguagcacauugcauuaggaga

SEQ ID NO: 139942 - RNA, 22 nt, Human
aucuggcuuucuuaaugacuua

SEQ ID NO: 139943 - RNA, 22 nt, Human
auuacaguaaaugcuacaggca

SEQ ID NO: 139944 - RNA, 22 nt, Human
uggcugggggugcuauagcugc

SEQ ID NO: 139945 - RNA, 22 nt, Human
ugucuuccucuuggcuugagcu

SEQ ID NO: 139946 - RNA, 22 nt, Human
uggcucugggcaccguguccac

SEQ ID NO: 139947 - RNA, 22 nt, Human
ucucugcugagaagggcuggca

SEQ ID NO: 139948 - RNA, 22 nt, Human
auauauuugagaauauucauga

SEQ ID NO: 139949 - RNA, 22 nt, Human
cagggucuuauaaggccaauuu

SEQ ID NO: 139950 - RNA, 22 nt, Human
cucagggcuugaguguccagga

SEQ ID NO: 139951 - RNA, 22 nt, Human
ucugagagagggucagaugcua

SEQ ID NO: 139952 - RNA, 22 nt, Human
uccuauugguagacauuucugu

SEQ ID NO: 139953 - RNA, 22 nt, Human
uuguggcugugcaccgcugccu

SEQ ID NO: 139954 - RNA, 22 nt, Human
acugcagggcauccuggccaag

SEQ ID NO: 139955 - RNA, 21 nt, Human
uacagucuccccuguugucca

SEQ ID NO: 139956 - RNA, 20 nt, Human
gccagcccugacacaggagc

SEQ ID NO: 139957 - RNA, 22 nt, Human
gagccagguuggaggcugcagu

SEQ ID NO: 139958 - RNA, 22 nt, Human
cugcugggucuaugcaagugga

SEQ ID NO: 139959 - RNA, 22 nt, Human
ccaggccuagccccugagggua

SEQ ID NO: 139960 - RNA, 22 nt, Human
ucagagugugagacauauugga

SEQ ID NO: 139961 - RNA, 22 nt, Human
ucucagagcuucagaaagcacc

SEQ ID NO: 139962 - RNA, 22 nt, Human
uuccucagagggcgcuggggaa

SEQ ID NO: 139963 - RNA, 22 nt, Human
cugggcuacguguugacagcau

SEQ ID NO: 139964 - RNA, 22 nt, Human
cucuggaguggguggccgggag

SEQ ID NO: 139965 - RNA, 22 nt, Human
ugcaccauguaaguggccacgu

SEQ ID NO: 139966 - RNA, 20 nt, Human
cacugaagacuucuugcuca

SEQ ID NO: 139967 - RNA, 22 nt, Human
caggggcugugggcggagccuc

SEQ ID NO: 139968 - RNA, 22 nt, Human
cagggagaagucuggucagucc

SEQ ID NO: 139969 - RNA, 22 nt, Human
ggcuguagguuggugcuggaca

SEQ ID NO: 139970 - RNA, 22 nt, Human
uagaaguuaaaggaauacagaa

SEQ ID NO: 139971 - RNA, 22 nt, Human
gagagugaggcaucaggggcag

SEQ ID NO: 139972 - RNA, 22 nt, Human
auucucucauuuaucuguccua

SEQ ID NO: 139973 - RNA, 20 nt, Human
uguguagcaggugcugugcc

SEQ ID NO: 139974 - RNA, 15 nt, Human
ugggcagaucacuug

SEQ ID NO: 139975 - RNA, 22 nt, Human
ugaucagucccaugaucuucca

SEQ ID NO: 139976 - RNA, 22 nt, Human
ucucuucuauuugagacuauuu

SEQ ID NO: 139977 - RNA, 20 nt, Human
gucaucgccggcagcaaaga

SEQ ID NO: 139978 - RNA, 22 nt, Human
gccagcaguauguccuggcagu

SEQ ID NO: 139979 - RNA, 22 nt, Human
ucuaugugcccuuugugugaug

SEQ ID NO: 139980 - RNA, 22 nt, Human
ucaauucugguccucaggaacu

SEQ ID NO: 139981 - RNA, 22 nt, Human
aggcacugauucucagaguuac

SEQ ID NO: 139982 - RNA, 22 nt, Human
ggagugacucacagcugggaca

SEQ ID NO: 139983 - RNA, 22 nt, Human
uuccuguaguugugcaauguac

SEQ ID NO: 139984 - RNA, 22 nt, Human
cauuaugugggaaaauguucuu

SEQ ID NO: 139985 - RNA, 22 nt, Human
ggccucuggucaagacaagcau

SEQ ID NO: 139986 - RNA, 22 nt, Human
uaacuucucugagccucauucc

SEQ ID NO: 139987 - RNA, 22 nt, Human
ccucaugguacuuacuguagcu

SEQ ID NO: 139988 - RNA, 22 nt, Human
caggcacugugcuagauccuug

SEQ ID NO: 139989 - RNA, 22 nt, Human
uggaagggagugacagucagag

SEQ ID NO: 139990 - RNA, 21 nt, Human
ucucuacacuuucacuaggcu

SEQ ID NO: 139991 - RNA, 22 nt, Human
auuuuccuagucaugugcuucu

SEQ ID NO: 139992 - RNA, 22 nt, Human
uggcagcagggaggccaguguu

SEQ ID NO: 139993 - RNA, 22 nt, Human
gcucugggaacugacugccuuc

SEQ ID NO: 139994 - RNA, 22 nt, Human
gcugccugauguccagcaggac

SEQ ID NO: 139995 - RNA, 22 nt, Human
cagcccagcagggucuggcccu

SEQ ID NO: 139996 - RNA, 23 nt, Human
aucaaacuggugagaaugucagu

SEQ ID NO: 139997 - RNA, 22 nt, Human
auugacaaucuacuauguucug

SEQ ID NO: 139998 - RNA, 20 nt, Human
cagcugccuggcucugggau

SEQ ID NO: 139999 - RNA, 20 nt, Human
cuuccacacaagaagcacag

SEQ ID NO: 140000 - RNA, 22 nt, Human
aaguucaaucagaugaaaaagc

SEQ ID NO: 140001 - RNA, 22 nt, Human
acaauacaggcuucuggacuua

SEQ ID NO: 140002 - RNA, 22 nt, Human
auuccaguucuccucucuaaag

SEQ ID NO: 140003 - RNA, 22 nt, Human
ucaaagcaucagucaauuuagg

SEQ ID NO: 140004 - RNA, 22 nt, Human
gcucagaggcacgaccucuugg

SEQ ID NO: 140005 - RNA, 22 nt, Human
cuggccgguauuugccucuggg

SEQ ID NO: 140006 - RNA, 20 nt, Human
gccugcagguuggaugggau

SEQ ID NO: 140007 - RNA, 22 nt, Human
ccaggagcaacuugaaggcaag

SEQ ID NO: 140008 - RNA, 21 nt, Human
agcugcuuucagcuccuagag

SEQ ID NO: 140009 - RNA, 22 nt, Human
uggacagguugaguaggaggag

SEQ ID NO: 140010 - RNA, 22 nt, Human
ggaggccaaagugugggcggcu

SEQ ID NO: 140011 - RNA, 22 nt, Human
gcugccacuuggucaugucaug

SEQ ID NO: 140012 - RNA, 22 nt, Human
uuucuguagggauuucacaguu

SEQ ID NO: 140013 - RNA, 22 nt, Human
guuugcauauuugcacaggaau

SEQ ID NO: 140014 - RNA, 22 nt, Human
aagcagcuuaaauuagagccug

SEQ ID NO: 140015 - RNA, 22 nt, Human
ggccccaggaccuccacggucc

SEQ ID NO: 140016 - RNA, 19 nt, Human
uuucugucuguguuuugcc

SEQ ID NO: 140017 - RNA, 22 nt, Human
cccagagccucauucuguuggg

SEQ ID NO: 140018 - RNA, 22 nt, Human
aaacuuuugguccucauggguu

SEQ ID NO: 140019 - RNA, 22 nt, Human
cuaauacucauuucuguaacuc

SEQ ID NO: 140020 - RNA, 20 nt, Human
acagccagaggaggcagaca

SEQ ID NO: 140021 - RNA, 22 nt, Human
augcaguauaaaucauuucugg

SEQ ID NO: 140022 - RNA, 22 nt, Human
agcucccauuaucuucugaaac

SEQ ID NO: 140023 - RNA, 22 nt, Human
augugaaagagguguucagugg

SEQ ID NO: 140024 - RNA, 22 nt, Human
uuguaacuuaaguuuugcauau

SEQ ID NO: 140025 - RNA, 22 nt, Human
ggcugcuugcuguuucuuggau

SEQ ID NO: 140026 - RNA, 23 nt, Human
uggcucugagagguucagaugcu

SEQ ID NO: 140027 - RNA, 22 nt, Human
uucauguaauuccauaagguaa

SEQ ID NO: 140028 - RNA, 22 nt, Human
gccuugccucagccauggaaac

SEQ ID NO: 140029 - RNA, 22 nt, Human
ugagcccaggaguuggagaccg

SEQ ID NO: 140030 - RNA, 22 nt, Human
cuguuuuugugcugugucuccc

SEQ ID NO: 140031 - RNA, 22 nt, Human
aggggcugccuggcuuggcacu

SEQ ID NO: 140032 - RNA, 22 nt, Human
ggagagcugguagcuggcucca

SEQ ID NO: 140033 - RNA, 17 nt, Human
ggccuuggggccucagu

SEQ ID NO: 140034 - RNA, 22 nt, Human
cuggaggcugaguugggucucc

SEQ ID NO: 140035 - RNA, 22 nt, Human
caaugauucugcaacugugugc

SEQ ID NO: 140036 - RNA, 21 nt, Human
uguucacauggagcagaaugu

SEQ ID NO: 140037 - RNA, 22 nt, Human
caaggccugccucuggcagaaa

SEQ ID NO: 140038 - RNA, 18 nt, Human
uuccaguagcuguaucac

SEQ ID NO: 140039 - RNA, 22 nt, Human
caggcuggagugaguguagugg

SEQ ID NO: 140040 - RNA, 22 nt, Human
aguguguacucauauacuucca

SEQ ID NO: 140041 - RNA, 22 nt, Human
ugaagccacagagcaucugccu

SEQ ID NO: 140042 - RNA, 22 nt, Human
aggcuucuaggguuggcagcgg

SEQ ID NO: 140043 - RNA, 22 nt, Human
ggcugggcaggucugcacaggg

SEQ ID NO: 140044 - RNA, 22 nt, Human
caucucaugggcaugccaagcu

SEQ ID NO: 140045 - RNA, 22 nt, Human
cagaguggcgacccccucagcu

SEQ ID NO: 140046 - RNA, 22 nt, Human
uguguacauaucuauccuagau

SEQ ID NO: 140047 - RNA, 22 nt, Human
accugagggcccaaacuuggua

SEQ ID NO: 140048 - RNA, 22 nt, Human
agccaggacguugcucagcucc

SEQ ID NO: 140049 - RNA, 22 nt, Human
cugccuuggcccuaguucaugg

SEQ ID NO: 140050 - RNA, 22 nt, Human
aacaguaaagacagaauuuauc

SEQ ID NO: 140051 - RNA, 22 nt, Human
uuccauaaaggugauaguauac

SEQ ID NO: 140052 - RNA, 22 nt, Human
gaagcagcgaaguggaagggac

SEQ ID NO: 140053 - RNA, 22 nt, Human
agggccagcugaugagaaugag

SEQ ID NO: 140054 - RNA, 22 nt, Human
aaguauaagcuauucuucauga

SEQ ID NO: 140055 - RNA, 22 nt, Human
gucucagggacugcuucugggg

SEQ ID NO: 140056 - RNA, 22 nt, Human
caaauguguagagcuuuugggg

SEQ ID NO: 140057 - RNA, 22 nt, Human
uuucuuauauucugucauuguu

SEQ ID NO: 140058 - RNA, 22 nt, Human
ggcugugcgggcagccguggga

SEQ ID NO: 140059 - RNA, 22 nt, Human
cagaaugcaaauuuuauaauau

SEQ ID NO: 140060 - RNA, 22 nt, Human
gaggcugaggguuagagaguca

SEQ ID NO: 140061 - RNA, 22 nt, Human
acucaagauagggaaaguacaa

SEQ ID NO: 140062 - RNA, 22 nt, Human
caacauuucaaggucuuuagga

SEQ ID NO: 140063 - RNA, 22 nt, Human
gcagcugaauguccauugcugc

SEQ ID NO: 140064 - RNA, 21 nt, Human
ucucuuugggaacauuaauca

SEQ ID NO: 140065 - RNA, 22 nt, Human
ucagagaguuagugucuuagcu

SEQ ID NO: 140066 - RNA, 22 nt, Human
guaaaguucuauuugaauuuag

SEQ ID NO: 140067 - RNA, 22 nt, Human
acagagcaugcucaguguguga

SEQ ID NO: 140068 - RNA, 19 nt, Human
uuagaaacuguugacacug

SEQ ID NO: 140069 - RNA, 22 nt, Human
uacagcauugcauuuuccuuug

SEQ ID NO: 140070 - RNA, 22 nt, Human
cuuacauuuaaucaugugucau

SEQ ID NO: 140071 - RNA, 22 nt, Human
cagggccugagggcugcucugc

SEQ ID NO: 140072 - RNA, 23 nt, Human
gccuggccaccccagggcugcuu

SEQ ID NO: 140073 - RNA, 19 nt, Human
ccucugcgcuguccugcuc

SEQ ID NO: 140074 - RNA, 22 nt, Human
uucugcucaguaguaagagugc

SEQ ID NO: 140075 - RNA, 22 nt, Human
aggccuccugcagggaugagug

SEQ ID NO: 140076 - RNA, 23 nt, Human
cuggcuccgaagacuccaggauc

SEQ ID NO: 140077 - RNA, 22 nt, Human
ugcucugggcaacagccucccu

SEQ ID NO: 140078 - RNA, 22 nt, Human
ccaggaguuugaggcugcagug

SEQ ID NO: 140079 - RNA, 22 nt, Human
uggcucagauuuuuguaggcuu

SEQ ID NO: 140080 - RNA, 22 nt, Human
uccaggaggguuuucugccuuc

SEQ ID NO: 140081 - RNA, 22 nt, Human
uuccauaauuaaguggagagaa

SEQ ID NO: 140082 - RNA, 22 nt, Human
gaggaaaagagacagguuauug

SEQ ID NO: 140083 - RNA, 22 nt, Human
uacaaaugaaccaacuuugaug

SEQ ID NO: 140084 - RNA, 22 nt, Human
auacuguuucucuucuacauga

SEQ ID NO: 140085 - RNA, 22 nt, Human
aggcuguguggucaugguggcu

SEQ ID NO: 140086 - RNA, 20 nt, Human
uuucaagucagcaauucuca

SEQ ID NO: 140087 - RNA, 22 nt, Human
ggcugaguugagaggauuacuu

SEQ ID NO: 140088 - RNA, 21 nt, Human
guuauuuuaagugagcuuugc

SEQ ID NO: 140089 - RNA, 22 nt, Human
uuuuaugugucaaagcaguggu

SEQ ID NO: 140090 - RNA, 22 nt, Human
uuucucccuccacuacaggcuc

SEQ ID NO: 140091 - RNA, 22 nt, Human
ucguaugcucucuguguccugu

SEQ ID NO: 140092 - RNA, 22 nt, Human
uuuacuuuugguaaggucauuu

SEQ ID NO: 140093 - RNA, 22 nt, Human
aaucagaaaauucaguggaauu

SEQ ID NO: 140094 - RNA, 22 nt, Human
cuggcccauggugagcucuggg

SEQ ID NO: 140095 - RNA, 22 nt, Human
ggaggccaggguggguggaucg

SEQ ID NO: 140096 - RNA, 22 nt, Human
agcagcugcagagggcuccccc

SEQ ID NO: 140097 - RNA, 22 nt, Human
ugagcccaggaguuggaggcug

SEQ ID NO: 140098 - RNA, 21 nt, Human
agagucugcauuucugacaag

SEQ ID NO: 140099 - RNA, 22 nt, Human
cugcagccuccugggguacaug

SEQ ID NO: 140100 - RNA, 22 nt, Human
caagagcuagaaauugguuaga

SEQ ID NO: 140101 - RNA, 22 nt, Human
cccuggagggacagcugcucua

SEQ ID NO: 140102 - RNA, 22 nt, Human
cagcugccuguauuguccucau

SEQ ID NO: 140103 - RNA, 22 nt, Human
guuguauucuucaauaucagag

SEQ ID NO: 140104 - RNA, 22 nt, Human
cuucuucagcacaauauugaug

SEQ ID NO: 140105 - RNA, 22 nt, Human
caguagcaggcaggugcuuuug

SEQ ID NO: 140106 - RNA, 22 nt, Human
guugaguggguuaggaugcuga

SEQ ID NO: 140107 - RNA, 22 nt, Human
augcagagacagauguggcaug

SEQ ID NO: 140108 - RNA, 21 nt, Human
ccugugugugucccuuuaaga

SEQ ID NO: 140109 - RNA, 22 nt, Human
uaagaacaagcuggggguucca

SEQ ID NO: 140110 - RNA, 22 nt, Human
ugggcaagucacuucugucuuu

SEQ ID NO: 140111 - RNA, 21 nt, Human
cuggacugaggagacagucgc

SEQ ID NO: 140112 - RNA, 21 nt, Human
aauaaaacaguuggugucaau

SEQ ID NO: 140113 - RNA, 22 nt, Human
cugagccauccauaccagcuua

SEQ ID NO: 140114 - RNA, 22 nt, Human
ugggccuguggcuuggcucuag

SEQ ID NO: 140115 - RNA, 22 nt, Human
ugagcuucuuuauuuggccaga

SEQ ID NO: 140116 - RNA, 22 nt, Human
uccuggaggcaaaugagcacau

SEQ ID NO: 140117 - RNA, 22 nt, Human
cuggagcugucuucacaggccu

SEQ ID NO: 140118 - RNA, 22 nt, Human
agucucaggcagaggaaggcua

SEQ ID NO: 140119 - RNA, 22 nt, Human
ugcagcucauugcuggggucug

SEQ ID NO: 140120 - RNA, 22 nt, Human
ccaggcucaggugcgagagaca

SEQ ID NO: 140121 - RNA, 20 nt, Human
agaggccaguuaggagucua

SEQ ID NO: 140122 - RNA, 22 nt, Human
cacagggcaccaguuggccauc

SEQ ID NO: 140123 - RNA, 22 nt, Human
gcaucuucacacaaagccagug

SEQ ID NO: 140124 - RNA, 22 nt, Human
ucugggaaccagugcggcuggg

SEQ ID NO: 140125 - RNA, 22 nt, Human
gcagcugcuggaaguuccugcc

SEQ ID NO: 140126 - RNA, 22 nt, Human
ucccagaggucucugcugguuc

SEQ ID NO: 140127 - RNA, 22 nt, Human
gcuaccugagcaagagcuucaa

SEQ ID NO: 140128 - RNA, 18 nt, Human
cccucuccugcuaguggg

SEQ ID NO: 140129 - RNA, 22 nt, Human
ggcagaggaaggaugaauucac

SEQ ID NO: 140130 - RNA, 22 nt, Human
agcauuuaauuacaguuuaauu

SEQ ID NO: 140131 - RNA, 22 nt, Human
gccccagccaaggugacacgaa

SEQ ID NO: 140132 - RNA, 23 nt, Human
agcagccagagauccucggcccu

SEQ ID NO: 140133 - RNA, 22 nt, Human
ggcucagguuaccagucccucc

SEQ ID NO: 140134 - RNA, 22 nt, Human
ugggccugugaugcugggcuau

SEQ ID NO: 140135 - RNA, 22 nt, Human
aacuuuaaggcuauaaauuaug

SEQ ID NO: 140136 - RNA, 21 nt, Human
uauacaugugugcauacgugu

SEQ ID NO: 140137 - RNA, 22 nt, Human
acauuucugcaucucagagcua

SEQ ID NO: 140138 - RNA, 22 nt, Human
guggaggagaggcgccuugcgg

SEQ ID NO: 140139 - RNA, 22 nt, Human
gauccuugcacuugacuuggca

SEQ ID NO: 140140 - RNA, 22 nt, Human
guucucucaaacuuuguguuug

SEQ ID NO: 140141 - RNA, 18 nt, Human
aaaaugcaggcgacaugg

SEQ ID NO: 140142 - RNA, 22 nt, Human
uuauguacaauguuaauguaaa

SEQ ID NO: 140143 - RNA, 22 nt, Human
aggccucagugaucaucaucag

SEQ ID NO: 140144 - RNA, 22 nt, Human
uuucuuauacuauauugucauc

SEQ ID NO: 140145 - RNA, 22 nt, Human
ugggccugauucuugaauccug

SEQ ID NO: 140146 - RNA, 22 nt, Human
gaugauuuuaugucuugucauu

SEQ ID NO: 140147 - RNA, 22 nt, Human
cuguggcuuuggggcggaggac

SEQ ID NO: 140148 - RNA, 22 nt, Human
gagguagcaugcuggaagggac

SEQ ID NO: 140149 - RNA, 22 nt, Human
gggagguucuguucgcacuuga

SEQ ID NO: 140150 - RNA, 22 nt, Human
cuuuggaagugaccacaauccu

SEQ ID NO: 140151 - RNA, 22 nt, Human
gcagugggagcuuaggcagugc

SEQ ID NO: 140152 - RNA, 22 nt, Human
uggggcuccuccuggcaggagg

SEQ ID NO: 140153 - RNA, 20 nt, Human
uggggccuguuucugugguu

SEQ ID NO: 140154 - RNA, 22 nt, Human
agaggggcucaagcaguggucu

SEQ ID NO: 140155 - RNA, 21 nt, Human
uccauuguuuucccaggguuu

SEQ ID NO: 140156 - RNA, 21 nt, Human
ggagucagggucuggcugggg

SEQ ID NO: 140157 - RNA, 20 nt, Human
aggaaaaauggaaacuggag

SEQ ID NO: 140158 - RNA, 22 nt, Human
gguggcugcuuccucaagagga

SEQ ID NO: 140159 - RNA, 22 nt, Human
uacauauuugucuuuguacugu

SEQ ID NO: 140160 - RNA, 22 nt, Human
auucuccacacauccagaccuu

SEQ ID NO: 140161 - RNA, 22 nt, Human
ggccuggccuccagaugugggc

SEQ ID NO: 140162 - RNA, 22 nt, Human
ucagcagugcagggugaggcag

SEQ ID NO: 140163 - RNA, 22 nt, Human
cagcagagcugugugggaaggg

SEQ ID NO: 140164 - RNA, 22 nt, Human
ugucagggcaugcgguccagcc

SEQ ID NO: 140165 - RNA, 22 nt, Human
uucaggaugcucagaguagucu

SEQ ID NO: 140166 - RNA, 22 nt, Human
gaaggccacaaaaaaugucaua

SEQ ID NO: 140167 - RNA, 22 nt, Human
aacaaaugauuguugguuggag

SEQ ID NO: 140168 - RNA, 22 nt, Human
guacaguaaauguaaauggauu

SEQ ID NO: 140169 - RNA, 22 nt, Human
caggaaagaaaugagaacacca

SEQ ID NO: 140170 - RNA, 22 nt, Human
augaggcauuccacucaaacuc

SEQ ID NO: 140171 - RNA, 22 nt, Human
cauacauaugcauguguguaua

SEQ ID NO: 140172 - RNA, 22 nt, Human
ccuggcuggcaagaucgugaag

SEQ ID NO: 140173 - RNA, 22 nt, Human
gucucagauucagacaucuaca

SEQ ID NO: 140174 - RNA, 18 nt, Human
ugucucugaauuccagug

SEQ ID NO: 140175 - RNA, 22 nt, Human
uggccugcagcucucagggaag

SEQ ID NO: 140176 - RNA, 22 nt, Human
uguaggacauguacuuguaaca

SEQ ID NO: 140177 - RNA, 22 nt, Human
uacuuucuagcucuccccaguu

SEQ ID NO: 140178 - RNA, 22 nt, Human
gcagcguggggacaggagcuca

SEQ ID NO: 140179 - RNA, 22 nt, Human
uggggcugucccgguuuggcga

SEQ ID NO: 140180 - RNA, 18 nt, Human
cuuuaugugcagagcuuu

SEQ ID NO: 140181 - RNA, 22 nt, Human
gagagcugcauucucagacaca

SEQ ID NO: 140182 - RNA, 22 nt, Human
uauaucauggagauuaacauuc

SEQ ID NO: 140183 - RNA, 22 nt, Human
aagcccagcaucccugcaccag

SEQ ID NO: 140184 - RNA, 22 nt, Human
ucuuuccagaggaauuuuuaga

SEQ ID NO: 140185 - RNA, 22 nt, Human
gcagcugaagcugcaguuccag

SEQ ID NO: 140186 - RNA, 22 nt, Human
ugaagcaggaucguuugcuuca

SEQ ID NO: 140187 - RNA, 18 nt, Human
uguggcugguccacacug

SEQ ID NO: 140188 - RNA, 23 nt, Human
guggccuccccggaaugccucgc

SEQ ID NO: 140189 - RNA, 22 nt, Human
uucacaguggcccucucugagu

SEQ ID NO: 140190 - RNA, 22 nt, Human
cagacaggcuagccagacucac

SEQ ID NO: 140191 - RNA, 20 nt, Human
ucacaucuggcagcugauga

SEQ ID NO: 140192 - RNA, 22 nt, Human
agcagcucuggcacuguagcau

SEQ ID NO: 140193 - RNA, 22 nt, Human
uccauuuacuauucucauaucg

SEQ ID NO: 140194 - RNA, 22 nt, Human
cccaagaucuuucgugcacuaa

SEQ ID NO: 140195 - RNA, 22 nt, Human
gggagccaugcuggucuucuuu

SEQ ID NO: 140196 - RNA, 17 nt, Human
uggcuucccugggccac

SEQ ID NO: 140197 - RNA, 22 nt, Human
auguacauuuuccuaauguuuu

SEQ ID NO: 140198 - RNA, 22 nt, Human
uagggcaguuucauguuaucuu

SEQ ID NO: 140199 - RNA, 22 nt, Human
aucagcaagcauuuauugagug

SEQ ID NO: 140200 - RNA, 22 nt, Human
caaaguuuaaaguagauuucag

SEQ ID NO: 140201 - RNA, 18 nt, Human
gguggcucagucaugggg

SEQ ID NO: 140202 - RNA, 17 nt, Human
agcagcugaagcagcca

SEQ ID NO: 140203 - RNA, 22 nt, Human
uggggacauagccagucuggcu

SEQ ID NO: 140204 - RNA, 22 nt, Human
ucacauacacuaggauauuuuu

SEQ ID NO: 140205 - RNA, 22 nt, Human
cuggcagcccaaccuagagucu

SEQ ID NO: 140206 - RNA, 22 nt, Human
agcugagcugcagaugacugua

SEQ ID NO: 140207 - RNA, 22 nt, Human
uggggcuggcuauugucucccu

SEQ ID NO: 140208 - RNA, 20 nt, Human
cagaaggucuaagcuuuaga

SEQ ID NO: 140209 - RNA, 19 nt, Human
aggaaagguggccuuagca

SEQ ID NO: 140210 - RNA, 22 nt, Human
gaaaggucuuccggucuuccag

SEQ ID NO: 140211 - RNA, 22 nt, Human
uggaagccaggcccgcuccuaa

SEQ ID NO: 140212 - RNA, 22 nt, Human
agcaggcuaagggaccuguuua

SEQ ID NO: 140213 - RNA, 22 nt, Human
uuugggaagaggaaucucugga

SEQ ID NO: 140214 - RNA, 22 nt, Human
cuucagaggggacucaaaguca

SEQ ID NO: 140215 - RNA, 22 nt, Human
aguggcaggaaaguggaagaga

SEQ ID NO: 140216 - RNA, 22 nt, Human
ucaaaguccuugcuuuuucugu

SEQ ID NO: 140217 - RNA, 22 nt, Human
uaguuucugaggauugaaagau

SEQ ID NO: 140218 - RNA, 22 nt, Human
aaguguauauaugacuuauaaa

SEQ ID NO: 140219 - RNA, 23 nt, Human
ggcagagagcauggcuggggccc

SEQ ID NO: 140220 - RNA, 22 nt, Human
aagaggaaaugauugacuauau

SEQ ID NO: 140221 - RNA, 22 nt, Human
aguguggcugcguagggcucuc

SEQ ID NO: 140222 - RNA, 22 nt, Human
gagagggccgggggccagcucc

SEQ ID NO: 140223 - RNA, 22 nt, Human
ucagucucuggggcuucuguuu

SEQ ID NO: 140224 - RNA, 22 nt, Human
cuggcugggagcgagcugcuca

SEQ ID NO: 140225 - RNA, 22 nt, Human
guguguaaugcuuauugugcuu

SEQ ID NO: 140226 - RNA, 22 nt, Human
agcagagcugcaguggccugcu

SEQ ID NO: 140227 - RNA, 22 nt, Human
gcaguauauccauuacuucaua

SEQ ID NO: 140228 - RNA, 22 nt, Human
gcagaagcugggcagcgaggug

SEQ ID NO: 140229 - RNA, 22 nt, Human
cccuggagcuagucugagcaga

SEQ ID NO: 140230 - RNA, 22 nt, Human
cugccucuugacagaucguggc

SEQ ID NO: 140231 - RNA, 22 nt, Human
auguggcuugucgauauuagca

SEQ ID NO: 140232 - RNA, 22 nt, Human
uuguggcugucgagaauugagg

SEQ ID NO: 140233 - RNA, 22 nt, Human
caggaaugacugcagauggggc

SEQ ID NO: 140234 - RNA, 22 nt, Human
cacuauaucuguucuuguuuau

SEQ ID NO: 140235 - RNA, 22 nt, Human
uuucaguggguuuauuucaugu

SEQ ID NO: 140236 - RNA, 22 nt, Human
uggcucaggugugagcugaaga

SEQ ID NO: 140237 - RNA, 22 nt, Human
aagaugcuuauugcuccugcag

SEQ ID NO: 140238 - RNA, 22 nt, Human
uucugucacuuaggaggucaua

SEQ ID NO: 140239 - RNA, 22 nt, Human
gcugcaggcgccugcggucucu

SEQ ID NO: 140240 - RNA, 22 nt, Human
cugucccucaucaccucugggu

SEQ ID NO: 140241 - RNA, 23 nt, Human
ucccagccucuucucuugcauac

SEQ ID NO: 140242 - RNA, 17 nt, Human
aggugcuggagcaucag

SEQ ID NO: 140243 - RNA, 22 nt, Human
ugcaucuguucagagcugucga

SEQ ID NO: 140244 - RNA, 22 nt, Human
cuucugggcauucagcugcaca

SEQ ID NO: 140245 - RNA, 22 nt, Human
auggcuguccaguuucuagaga

SEQ ID NO: 140246 - RNA, 22 nt, Human
agccucugugacucacagguca

SEQ ID NO: 140247 - RNA, 22 nt, Human
guccucugggcagcugccccac

SEQ ID NO: 140248 - RNA, 22 nt, Human
caggaguggugugagggacucc

SEQ ID NO: 140249 - RNA, 22 nt, Human
caggccucuauggucagcugag

SEQ ID NO: 140250 - RNA, 22 nt, Human
uccagggauguccuguagcacu

SEQ ID NO: 140251 - RNA, 22 nt, Human
ucaguguggguaagcaugcugu

SEQ ID NO: 140252 - RNA, 22 nt, Human
ucuucccuaaucaccaucuuca

SEQ ID NO: 140253 - RNA, 22 nt, Human
uguuccuaaauaugaauggaga

SEQ ID NO: 140254 - RNA, 22 nt, Human
gcuuccugagaaacaaucugau

SEQ ID NO: 140255 - RNA, 22 nt, Human
aaauauguauggaguucaugaa

SEQ ID NO: 140256 - RNA, 22 nt, Human
ggcuguaguuaccugaugaaau

SEQ ID NO: 140257 - RNA, 22 nt, Human
cacaaauggccguguucaaaga

SEQ ID NO: 140258 - RNA, 22 nt, Human
ugucucagaauggcucauaaua

SEQ ID NO: 140259 - RNA, 22 nt, Human
ggcaguggaggacccugugucu

SEQ ID NO: 140260 - RNA, 22 nt, Human
ugcugggcuagaagcugaggcc

SEQ ID NO: 140261 - RNA, 22 nt, Human
ccacagggcucuaggcgcuucc

SEQ ID NO: 140262 - RNA, 22 nt, Human
uggagccagcccaggccccucu

SEQ ID NO: 140263 - RNA, 22 nt, Human
aagauacugaugauguaggcua

SEQ ID NO: 140264 - RNA, 22 nt, Human
uggcucagaggggaagugguuu

SEQ ID NO: 140265 - RNA, 22 nt, Human
gucacacuagggccaaguggag

SEQ ID NO: 140266 - RNA, 22 nt, Human
gcagauggaaagugcuugaggg

SEQ ID NO: 140267 - RNA, 22 nt, Human
uguuuacagggugauuuuaccu

SEQ ID NO: 140268 - RNA, 22 nt, Human
ccaggccauucccagaguugcu

SEQ ID NO: 140269 - RNA, 21 nt, Human
guuuuaagggagaaaaccuag

SEQ ID NO: 140270 - RNA, 22 nt, Human
aaaguguugggauuacaggugu

SEQ ID NO: 140271 - RNA, 22 nt, Human
gggaccaggugggugcauuccg

SEQ ID NO: 140272 - RNA, 22 nt, Human
uauugucuaucgcugcuuucau

SEQ ID NO: 140273 - RNA, 22 nt, Human
ugcugcucucagccaccaggaa

SEQ ID NO: 140274 - RNA, 22 nt, Human
auguauguaugcugugcuugca

SEQ ID NO: 140275 - RNA, 22 nt, Human
ggacagcccauacacaugucug

SEQ ID NO: 140276 - RNA, 22 nt, Human
aggauccuguauggagaagcug

SEQ ID NO: 140277 - RNA, 22 nt, Human
ugcuggcucaguuugcagacuc

SEQ ID NO: 140278 - RNA, 23 nt, Human
cacugcagcguggucuggcagga

SEQ ID NO: 140279 - RNA, 22 nt, Human
ccagcaggggaauauuuuuagg

SEQ ID NO: 140280 - RNA, 22 nt, Human
uucaacuauuaugaauaaaauu

SEQ ID NO: 140281 - RNA, 22 nt, Human
ggagcugcucagagccaguccc

SEQ ID NO: 140282 - RNA, 22 nt, Human
cagcaauauacacagucuaugg

SEQ ID NO: 140283 - RNA, 22 nt, Human
agagccacugggagacagagca

SEQ ID NO: 140284 - RNA, 22 nt, Human
uguaaucauuacaguacaugga

SEQ ID NO: 140285 - RNA, 22 nt, Human
uccucuucugcccaucagaggc

SEQ ID NO: 140286 - RNA, 22 nt, Human
uggcuucuuagaccaguggccu

SEQ ID NO: 140287 - RNA, 19 nt, Human
ccagucccauacaggagau

SEQ ID NO: 140288 - RNA, 22 nt, Human
cugggccucauccucagaguuu

SEQ ID NO: 140289 - RNA, 22 nt, Human
gcagagccaugggagguuuuug

SEQ ID NO: 140290 - RNA, 22 nt, Human
aggcagagcugauguucuguga

SEQ ID NO: 140291 - RNA, 22 nt, Human
cauuauauuuuacugcauggga

SEQ ID NO: 140292 - RNA, 22 nt, Human
cccagcauggagugaggacuca

SEQ ID NO: 140293 - RNA, 20 nt, Human
uggcaucucucaauuguagg

SEQ ID NO: 140294 - RNA, 22 nt, Human
ugaaagguuauuuaggucugcu

SEQ ID NO: 140295 - RNA, 22 nt, Human
gagggaaagguuaauacaugau

SEQ ID NO: 140296 - RNA, 22 nt, Human
gcucaggaaaacagucuaguaa

SEQ ID NO: 140297 - RNA, 21 nt, Human
gaggccacuaauaggggcaga

SEQ ID NO: 140298 - RNA, 22 nt, Human
uccauucauucauugaugaaca

SEQ ID NO: 140299 - RNA, 22 nt, Human
caggcagcaggagcccugcucg

SEQ ID NO: 140300 - RNA, 22 nt, Human
gcugucacaucaaggcacuaaa

SEQ ID NO: 140301 - RNA, 22 nt, Human
gcuggcucuucaguggagauag

SEQ ID NO: 140302 - RNA, 22 nt, Human
uagacacauccguggaagcuuc

SEQ ID NO: 140303 - RNA, 22 nt, Human
uuccagaauuuuguucugcuug

SEQ ID NO: 140304 - RNA, 22 nt, Human
caggccucuccuuagucuggca

SEQ ID NO: 140305 - RNA, 22 nt, Human
agccuggcccugcugaacucug

SEQ ID NO: 140306 - RNA, 22 nt, Human
gagcccucucuguaggcaagua

SEQ ID NO: 140307 - RNA, 22 nt, Human
ucugugcggucuguguuaugaa

SEQ ID NO: 140308 - RNA, 19 nt, Human
ggcugucuggcguguggau

SEQ ID NO: 140309 - RNA, 22 nt, Human
agagugauggguugugcugacc

SEQ ID NO: 140310 - RNA, 22 nt, Human
gcccagcuuuuugaggcaggca

SEQ ID NO: 140311 - RNA, 22 nt, Human
augcugaggacaaagagaucaa

SEQ ID NO: 140312 - RNA, 22 nt, Human
uggcccuguguccugcugccag

SEQ ID NO: 140313 - RNA, 20 nt, Human
ccugugugguuugcacuaca

SEQ ID NO: 140314 - RNA, 21 nt, Human
acagcauguuuguguguuugc

SEQ ID NO: 140315 - RNA, 22 nt, Human
uuauuuacaacucuucucuucc

SEQ ID NO: 140316 - RNA, 22 nt, Human
ccuuucagaugggcauggaccg

SEQ ID NO: 140317 - RNA, 22 nt, Human
uuuugcuugagugcacaaaaug

SEQ ID NO: 140318 - RNA, 22 nt, Human
uguguguguuuacaguuucuca

SEQ ID NO: 140319 - RNA, 22 nt, Human
auguguccacaggugugagaga

SEQ ID NO: 140320 - RNA, 22 nt, Human
caggguggcaggcaccauggcc

SEQ ID NO: 140321 - RNA, 22 nt, Human
aggaaaaaccuguuaaugguag

SEQ ID NO: 140322 - RNA, 22 nt, Human
agcagcaucucuuauugcagug

SEQ ID NO: 140323 - RNA, 22 nt, Human
cuucuguguuuuacuauaugua

SEQ ID NO: 140324 - RNA, 22 nt, Human
cuucuuauuaauccuucucugu

SEQ ID NO: 140325 - RNA, 22 nt, Human
gccagguggucuggcuccagag

SEQ ID NO: 140326 - RNA, 22 nt, Human
gucccagggagguucagggcuu

SEQ ID NO: 140327 - RNA, 22 nt, Human
cugggagcggcugucacugguu

SEQ ID NO: 140328 - RNA, 22 nt, Human
ugggccacggggguggagagcu

SEQ ID NO: 140329 - RNA, 22 nt, Human
agggcuggaggguacuaguuua

SEQ ID NO: 140330 - RNA, 22 nt, Human
agcugugugccaggggagaugu

SEQ ID NO: 140331 - RNA, 22 nt, Human
caggcagcucgaugccuuguug

SEQ ID NO: 140332 - RNA, 22 nt, Human
uuugacaguccccugauguuug

SEQ ID NO: 140333 - RNA, 17 nt, Human
aaucuguuuacagucag

SEQ ID NO: 140334 - RNA, 22 nt, Human
uagcagggguagauagagugug

SEQ ID NO: 140335 - RNA, 22 nt, Human
gcucugucaacagcuagcugug

SEQ ID NO: 140336 - RNA, 19 nt, Human
aggacucuggaggcaugag

SEQ ID NO: 140337 - RNA, 17 nt, Human
cugcuuugugcaacgcu

SEQ ID NO: 140338 - RNA, 19 nt, Human
gcuggggccugaccagaca

SEQ ID NO: 140339 - RNA, 22 nt, Human
ucauggagacuuugagccuguu

SEQ ID NO: 140340 - RNA, 22 nt, Human
uaagaacauaaauucauacggg

SEQ ID NO: 140341 - RNA, 22 nt, Human
acagcugggugcugcucagagc

SEQ ID NO: 140342 - RNA, 22 nt, Human
gagcaacaguuuaugguuuuuc

SEQ ID NO: 140343 - RNA, 22 nt, Human
ugcccacauucaaaaggugaug

SEQ ID NO: 140344 - RNA, 22 nt, Human
agcagcagauccaaaaaaugug

SEQ ID NO: 140345 - RNA, 22 nt, Human
cagaaugagauaacccagauug

SEQ ID NO: 140346 - RNA, 22 nt, Human
auaaacagcuccauuuagugcc

SEQ ID NO: 140347 - RNA, 22 nt, Human
ccugucuggaacauggccuguu

SEQ ID NO: 140348 - RNA, 22 nt, Human
cuggguggcgucuggggccagu

SEQ ID NO: 140349 - RNA, 22 nt, Human
gcugccuggaauaacggcuggc

SEQ ID NO: 140350 - RNA, 22 nt, Human
ccugcacuaccuggggcugcug

SEQ ID NO: 140351 - RNA, 22 nt, Human
ggagccaggcaaucuguacuuu

SEQ ID NO: 140352 - RNA, 22 nt, Human
uagggcagaguccaggaugggc

SEQ ID NO: 140353 - RNA, 22 nt, Human
ucuucuccagugcuucugcaca

SEQ ID NO: 140354 - RNA, 23 nt, Human
agacagaggcugaggcuggccgc

SEQ ID NO: 140355 - RNA, 18 nt, Human
uguacaguuaugagcauu

SEQ ID NO: 140356 - RNA, 22 nt, Human
agagauguucauucagcauguu

SEQ ID NO: 140357 - RNA, 22 nt, Human
gggaaggagccugcuugcuaga

SEQ ID NO: 140358 - RNA, 22 nt, Human
cauuugaugacucaacucauaa

SEQ ID NO: 140359 - RNA, 22 nt, Human
uguggccuccccacuucugggg

SEQ ID NO: 140360 - RNA, 21 nt, Human
uggcacugcuuagcagguucc

SEQ ID NO: 140361 - RNA, 22 nt, Human
cuagagggauguuaggauagca

SEQ ID NO: 140362 - RNA, 19 nt, Human
ccuuugaaucaggacacuu

SEQ ID NO: 140363 - RNA, 22 nt, Human
uucguguggagauguuucugca

SEQ ID NO: 140364 - RNA, 22 nt, Human
cagacacagcaauucuguguug

SEQ ID NO: 140365 - RNA, 22 nt, Human
gcccagcugucuggcagggaug

SEQ ID NO: 140366 - RNA, 22 nt, Human
gagagcugggcuuugggugaag

SEQ ID NO: 140367 - RNA, 20 nt, Human
uggcuccucuuggcuguggc

SEQ ID NO: 140368 - RNA, 22 nt, Human
cagaaauggagcccaggaaucu

SEQ ID NO: 140369 - RNA, 22 nt, Human
ccuuuacaaaguucuucauggg

SEQ ID NO: 140370 - RNA, 22 nt, Human
gucuccugagacugcagucacc

SEQ ID NO: 140371 - RNA, 22 nt, Human
aggagcugcaaauauuaguaau

SEQ ID NO: 140372 - RNA, 22 nt, Human
auaucacaguaguuguuuaguu

SEQ ID NO: 140373 - RNA, 22 nt, Human
ugggaggaaugucacugagcca

SEQ ID NO: 140374 - RNA, 22 nt, Human
uuccaaagucauguugcugaua

SEQ ID NO: 140375 - RNA, 22 nt, Human
caggccuccacuccacgcagac

SEQ ID NO: 140376 - RNA, 22 nt, Human
uggccuuggcagugagaagagu

SEQ ID NO: 140377 - RNA, 22 nt, Human
acaauucucucauaucuuauua

SEQ ID NO: 140378 - RNA, 19 nt, Human
uuccugugcugcugugucc

SEQ ID NO: 140379 - RNA, 22 nt, Human
auugacaaauggauguugacau

SEQ ID NO: 140380 - RNA, 22 nt, Human
aaaugcagaucccugaaucuca

SEQ ID NO: 140381 - RNA, 15 nt, Human
uucaggauaugacuc

SEQ ID NO: 140382 - RNA, 19 nt, Human
uuuucucagcuucuagcgg

SEQ ID NO: 140383 - RNA, 21 nt, Human
aguggcugucaagggggccuu

SEQ ID NO: 140384 - RNA, 20 nt, Human
uugcagcagugaggugaagg

SEQ ID NO: 140385 - RNA, 22 nt, Human
gugauuucaaauauagagugag

SEQ ID NO: 140386 - RNA, 22 nt, Human
uuccucagaaaauacuguccaa

SEQ ID NO: 140387 - RNA, 18 nt, Human
ugcucuggucucacuugg

SEQ ID NO: 140388 - RNA, 22 nt, Human
augaggcaucugcagucacuag

SEQ ID NO: 140389 - RNA, 22 nt, Human
cccuccagccauggacccaggu

SEQ ID NO: 140390 - RNA, 22 nt, Human
ucacacagguuugcaaugauuu

SEQ ID NO: 140391 - RNA, 22 nt, Human
agggagcuuccgaacuacagcu

SEQ ID NO: 140392 - RNA, 22 nt, Human
ucuuuaacaggaauuauuacag

SEQ ID NO: 140393 - RNA, 22 nt, Human
cagagccaaaugcugugguuau

SEQ ID NO: 140394 - RNA, 20 nt, Human
gggcugugccuccucguggu

SEQ ID NO: 140395 - RNA, 22 nt, Human
agccaggaauuggacaacacau

SEQ ID NO: 140396 - RNA, 20 nt, Human
acaauagauuugagcaaagu

SEQ ID NO: 140397 - RNA, 21 nt, Human
cauugucgacauuuuccccuc

SEQ ID NO: 140398 - RNA, 22 nt, Human
uauaguacauggaaucuucaua

SEQ ID NO: 140399 - RNA, 22 nt, Human
aacaucuuuuuguuugcugaaa

SEQ ID NO: 140400 - RNA, 19 nt, Human
gggaugggcccucacccuc

SEQ ID NO: 140401 - RNA, 22 nt, Human
ugaagccuuguguggccucucu

SEQ ID NO: 140402 - RNA, 22 nt, Human
ugcucagggacaauggagaggg

SEQ ID NO: 140403 - RNA, 22 nt, Human
gaugcugagagguggagggaac

SEQ ID NO: 140404 - RNA, 22 nt, Human
ucccaaggcacagggcagggac

SEQ ID NO: 140405 - RNA, 22 nt, Human
caucugccuaaguggcccuguu

SEQ ID NO: 140406 - RNA, 22 nt, Human
uuccucucaacaugccugccgg

SEQ ID NO: 140407 - RNA, 22 nt, Human
cucagagaggcaguggaaguca

SEQ ID NO: 140408 - RNA, 22 nt, Human
acaagagauuaucuacagauga

SEQ ID NO: 140409 - RNA, 22 nt, Human
ugcagcuguuacggacccuguc

SEQ ID NO: 140410 - RNA, 22 nt, Human
aauaauuagugggacagagaac

SEQ ID NO: 140411 - RNA, 22 nt, Human
ugaaggccuaacuuccagugcu

SEQ ID NO: 140412 - RNA, 22 nt, Human
gcucugucauuuugcagacacu

SEQ ID NO: 140413 - RNA, 21 nt, Human
ccagacuggccuaugugguag

SEQ ID NO: 140414 - RNA, 22 nt, Human
ucugugguggagugggcaugag

SEQ ID NO: 140415 - RNA, 22 nt, Human
ggcaaaaaccgcaauaacuucu

SEQ ID NO: 140416 - RNA, 22 nt, Human
ugcugucccccgugucugggcu

SEQ ID NO: 140417 - RNA, 22 nt, Human
ccugagggcgccgagcucccag

SEQ ID NO: 140418 - RNA, 22 nt, Human
cagcugaguuacucugaggucu

SEQ ID NO: 140419 - RNA, 22 nt, Human
uaugcacauauaaccugcacug

SEQ ID NO: 140420 - RNA, 22 nt, Human
aagaugcagcuuccacuuuugc

SEQ ID NO: 140421 - RNA, 22 nt, Human
uugcagagaucagcagguuuga

SEQ ID NO: 140422 - RNA, 22 nt, Human
ugaggcucaaggucugguggag

SEQ ID NO: 140423 - RNA, 22 nt, Human
ugcuuuuaagaacaaugcugcu

SEQ ID NO: 140424 - RNA, 22 nt, Human
aaggccaugaccacuugcugug

SEQ ID NO: 140425 - RNA, 18 nt, Human
agcagcugucagaaugcc

SEQ ID NO: 140426 - RNA, 22 nt, Human
caggagcucucaucgucagggc

SEQ ID NO: 140427 - RNA, 22 nt, Human
agcugucuuucugccuccugau

SEQ ID NO: 140428 - RNA, 22 nt, Human
agggacacugaugagaaauucu

SEQ ID NO: 140429 - RNA, 22 nt, Human
cagggcccauggcucagguagg

SEQ ID NO: 140430 - RNA, 22 nt, Human
cagcucccaguggcagcuccuu

SEQ ID NO: 140431 - RNA, 22 nt, Human
gggagcuggagcuggaagacuc

SEQ ID NO: 140432 - RNA, 22 nt, Human
aaggcaggaugggaaaagauuu

SEQ ID NO: 140433 - RNA, 22 nt, Human
uucucugccucacaggucuaag

SEQ ID NO: 140434 - RNA, 22 nt, Human
uuuaaccugucaauuugcaugc

SEQ ID NO: 140435 - RNA, 17 nt, Human
aucuggcugcuucuaga

SEQ ID NO: 140436 - RNA, 22 nt, Human
uagaauaugugguaggaucugg

SEQ ID NO: 140437 - RNA, 22 nt, Human
gcuggccucuggagaagggcuu

SEQ ID NO: 140438 - RNA, 22 nt, Human
agcagcaucuucuaaguaaggc

SEQ ID NO: 140439 - RNA, 22 nt, Human
caucacagauguuguguggagu

SEQ ID NO: 140440 - RNA, 22 nt, Human
gcuugcuggugccugcaggcuc

SEQ ID NO: 140441 - RNA, 22 nt, Human
uccuugaaugaagagaggugac

SEQ ID NO: 140442 - RNA, 22 nt, Human
uagaaauaaaucugcagcuggg

SEQ ID NO: 140443 - RNA, 20 nt, Human
cucaggauacugcaaaguug

SEQ ID NO: 140444 - RNA, 22 nt, Human
agcagccaguucucugugguag

SEQ ID NO: 140445 - RNA, 22 nt, Human
acugaaggaaagccuuugcaug

SEQ ID NO: 140446 - RNA, 22 nt, Human
uccugagaugagacagugcugc

SEQ ID NO: 140447 - RNA, 22 nt, Human
cacugaaggcugcagcucagcc

SEQ ID NO: 140448 - RNA, 22 nt, Human
agcugccauccgaggugucaga

SEQ ID NO: 140449 - RNA, 22 nt, Human
gaggcugauucggggaacagca

SEQ ID NO: 140450 - RNA, 22 nt, Human
uauucacaggcuggagugaugu

SEQ ID NO: 140451 - RNA, 22 nt, Human
ggacucagcagccaggaguggc

SEQ ID NO: 140452 - RNA, 22 nt, Human
cuggagcccugaaugggcagga

SEQ ID NO: 140453 - RNA, 20 nt, Human
uagaaaucuuauaaaagacu

SEQ ID NO: 140454 - RNA, 22 nt, Human
gugugucugaaguugaguagac

SEQ ID NO: 140455 - RNA, 22 nt, Human
acaugcauacaagcacauguag

SEQ ID NO: 140456 - RNA, 22 nt, Human
agugcagccgagaucaggugcu

SEQ ID NO: 140457 - RNA, 22 nt, Human
gccagagccggcuucacaggau

SEQ ID NO: 140458 - RNA, 22 nt, Human
uguguguguuccuccucagcua

SEQ ID NO: 140459 - RNA, 22 nt, Human
cagcugagucugagguucuuug

SEQ ID NO: 140460 - RNA, 22 nt, Human
guguggguguacuguucuagau

SEQ ID NO: 140461 - RNA, 22 nt, Human
agucucagaaaauaugcuuuuu

SEQ ID NO: 140462 - RNA, 21 nt, Human
ucugugcuuuuuuggcuccua

SEQ ID NO: 140463 - RNA, 22 nt, Human
uagaaagcuugggguguuuaaa

SEQ ID NO: 140464 - RNA, 22 nt, Human
cagcauggagacaaagugggca

SEQ ID NO: 140465 - RNA, 22 nt, Human
guggccugggguuuguucugag

SEQ ID NO: 140466 - RNA, 22 nt, Human
gaggugagaagggggucagaug

SEQ ID NO: 140467 - RNA, 22 nt, Human
uuaaacagucccagaggcugac

SEQ ID NO: 140468 - RNA, 22 nt, Human
aaggccauuauucugauauauu

SEQ ID NO: 140469 - RNA, 22 nt, Human
uucucucuggaccugggaugcg

SEQ ID NO: 140470 - RNA, 22 nt, Human
cagggccagcgucucgggcuau

SEQ ID NO: 140471 - RNA, 22 nt, Human
uauguacaugauuucauuugcu

SEQ ID NO: 140472 - RNA, 22 nt, Human
cuucuucaucuguaaaacuugg

SEQ ID NO: 140473 - RNA, 22 nt, Human
aauuuccaaauuucugucacac

SEQ ID NO: 140474 - RNA, 22 nt, Human
ccucaggauccgcaggugcagu

SEQ ID NO: 140475 - RNA, 22 nt, Human
cuugaaagucacaugcagcccu

SEQ ID NO: 140476 - RNA, 22 nt, Human
uuauguuuuauggcuauaucau

SEQ ID NO: 140477 - RNA, 22 nt, Human
cagccaucccagccugugguuc

SEQ ID NO: 140478 - RNA, 22 nt, Human
cuguggcugugaaacuucucag

SEQ ID NO: 140479 - RNA, 22 nt, Human
cccagccuuugcuuccugguuc

SEQ ID NO: 140480 - RNA, 22 nt, Human
aggccuguuggcgugggcucua

SEQ ID NO: 140481 - RNA, 22 nt, Human
ugagagugguucagcucagaag

SEQ ID NO: 140482 - RNA, 18 nt, Human
cugaaggauccaggugua

SEQ ID NO: 140483 - RNA, 22 nt, Human
ucucuguggcaagcaugcugcu

SEQ ID NO: 140484 - RNA, 22 nt, Human
uuacacuaagcuacuucuauau

SEQ ID NO: 140485 - RNA, 22 nt, Human
augcaguacagauaauucuaca

SEQ ID NO: 140486 - RNA, 22 nt, Human
gcauuucugugcauacacauga

SEQ ID NO: 140487 - RNA, 22 nt, Human
cagcaggaggugaguagcaggu

SEQ ID NO: 140488 - RNA, 22 nt, Human
uggcucugugcuucuaguaucu

SEQ ID NO: 140489 - RNA, 22 nt, Human
gcugggcagccccuacagagag

SEQ ID NO: 140490 - RNA, 22 nt, Human
cagcccagcagucuuagccugc

SEQ ID NO: 140491 - RNA, 22 nt, Human
uuguuuuggaagaacuuacucu

SEQ ID NO: 140492 - RNA, 22 nt, Human
ucagguggcuucggggaguggc

SEQ ID NO: 140493 - RNA, 22 nt, Human
ggucccaggaaucuguguucua

SEQ ID NO: 140494 - RNA, 22 nt, Human
uugaaaggaauacagaggccua

SEQ ID NO: 140495 - RNA, 22 nt, Human
gcugucacaagcaucuggggca

SEQ ID NO: 140496 - RNA, 22 nt, Human
agcucauggugcuaucucaggg

SEQ ID NO: 140497 - RNA, 18 nt, Human
uuuuacucauagcaggcc

SEQ ID NO: 140498 - RNA, 22 nt, Human
aggagcugaaacuucucauaug

SEQ ID NO: 140499 - RNA, 23 nt, Human
auuugagaaaguauuuuuaagac

SEQ ID NO: 140500 - RNA, 22 nt, Human
cuguguaguauuuguacacaua

SEQ ID NO: 140501 - RNA, 22 nt, Human
aagauuuacuagcauaauagcu

SEQ ID NO: 140502 - RNA, 22 nt, Human
cauacuuugggauaagagugga

SEQ ID NO: 140503 - RNA, 22 nt, Human
ccacagccauuccagggaggcu

SEQ ID NO: 140504 - RNA, 22 nt, Human
aggacuucaucaccuguauaaa

SEQ ID NO: 140505 - RNA, 22 nt, Human
gucauuucuguuucuucagugc

SEQ ID NO: 140506 - RNA, 19 nt, Human
gccaggagggcucuggcug

SEQ ID NO: 140507 - RNA, 22 nt, Human
acccugccgugggcugcuugug

SEQ ID NO: 140508 - RNA, 22 nt, Human
aggcccugcuuuccagagcuca

SEQ ID NO: 140509 - RNA, 22 nt, Human
cacaaaugugcagaaaugugag

SEQ ID NO: 140510 - RNA, 23 nt, Human
ccuggcuggauucucugcauuca

SEQ ID NO: 140511 - RNA, 22 nt, Human
uggccagguguggguucucaga

SEQ ID NO: 140512 - RNA, 22 nt, Human
uguguguucucaauuauugaug

SEQ ID NO: 140513 - RNA, 22 nt, Human
aggcuguggcauuaaacguuug

SEQ ID NO: 140514 - RNA, 22 nt, Human
uuagauaauguagagauaugag

SEQ ID NO: 140515 - RNA, 22 nt, Human
acauauaugugcacaugugcag

SEQ ID NO: 140516 - RNA, 21 nt, Human
auauuuuuguuuggacuguca

SEQ ID NO: 140517 - RNA, 17 nt, Human
uuccaguuuaguauugu

SEQ ID NO: 140518 - RNA, 22 nt, Human
auggcccaggccuccuguggcu

SEQ ID NO: 140519 - RNA, 22 nt, Human
cugucccaggagcuguaagaca

SEQ ID NO: 140520 - RNA, 22 nt, Human
acuuucuaggucucaguccuuu

SEQ ID NO: 140521 - RNA, 22 nt, Human
auuuuacuacuccaauuaauga

SEQ ID NO: 140522 - RNA, 22 nt, Human
guggcugcagagggcacagcau

SEQ ID NO: 140523 - RNA, 22 nt, Human
acagggcaccugagguaggaag

SEQ ID NO: 140524 - RNA, 23 nt, Human
ugcugguguuuuugggaccaggg

SEQ ID NO: 140525 - RNA, 22 nt, Human
cuuuuccacugagccucacaaa

SEQ ID NO: 140526 - RNA, 22 nt, Human
guuuacaaauauuuuaaauggu

SEQ ID NO: 140527 - RNA, 22 nt, Human
caaggagauaaaauguugagcu

SEQ ID NO: 140528 - RNA, 22 nt, Human
augugaggcagcacggagauua

SEQ ID NO: 140529 - RNA, 22 nt, Human
ucugucacugagcucaggauuc

SEQ ID NO: 140530 - RNA, 22 nt, Human
ucuuuuuauauugacaaaaggu

SEQ ID NO: 140531 - RNA, 22 nt, Human
guccuggcuuaguucgcuguaa

SEQ ID NO: 140532 - RNA, 22 nt, Human
ugucuccucauacugucauauu

SEQ ID NO: 140533 - RNA, 22 nt, Human
ggcuagaauaauugacuucauu

SEQ ID NO: 140534 - RNA, 22 nt, Human
auuacaguggguaaacagaauu

SEQ ID NO: 140535 - RNA, 22 nt, Human
gugcaugugucuuuauaguaga

SEQ ID NO: 140536 - RNA, 22 nt, Human
gcuguccagagcaugggagcaa

SEQ ID NO: 140537 - RNA, 22 nt, Human
ucuggagccacaaaccucagcu

SEQ ID NO: 140538 - RNA, 22 nt, Human
uucuuuauugagacuucauugu

SEQ ID NO: 140539 - RNA, 22 nt, Human
gaugauggacaaagcauuggug

SEQ ID NO: 140540 - RNA, 22 nt, Human
caagagcugaggcuggagaggu

SEQ ID NO: 140541 - RNA, 22 nt, Human
cugagauggaguuucgcucuuc

SEQ ID NO: 140542 - RNA, 22 nt, Human
ugccuggcaacuguggugggcu

SEQ ID NO: 140543 - RNA, 22 nt, Human
gaggccuggugugucucccgcu

SEQ ID NO: 140544 - RNA, 22 nt, Human
ccagcauggcaccugagaugag

SEQ ID NO: 140545 - RNA, 22 nt, Human
gcucccagggcagcgcagaaga

SEQ ID NO: 140546 - RNA, 22 nt, Human
agcagggcaaagucaggcuaac

SEQ ID NO: 140547 - RNA, 22 nt, Human
ccugaggacacacgcugcagga

SEQ ID NO: 140548 - RNA, 17 nt, Human
agguggcugcugcgccu

SEQ ID NO: 140549 - RNA, 22 nt, Human
caggggcucccugggugccagu

SEQ ID NO: 140550 - RNA, 22 nt, Human
caggccucccggugcacacuga

SEQ ID NO: 140551 - RNA, 22 nt, Human
uaagugcaauguuuuacuuaaa

SEQ ID NO: 140552 - RNA, 22 nt, Human
cagagccaggucuaggagucuc

SEQ ID NO: 140553 - RNA, 22 nt, Human
agccucucuguuagucacuggg

SEQ ID NO: 140554 - RNA, 22 nt, Human
uguggcugcuccugggugguca

SEQ ID NO: 140555 - RNA, 22 nt, Human
cugcgugucucugucucauggc

SEQ ID NO: 140556 - RNA, 22 nt, Human
agccauugaauuuagugccuuu

SEQ ID NO: 140557 - RNA, 22 nt, Human
ugaaauauuuagagaguaaguu

SEQ ID NO: 140558 - RNA, 22 nt, Human
gcucagagcaucccagugaaug

SEQ ID NO: 140559 - RNA, 21 nt, Human
cuguuucuugugaagugacac

SEQ ID NO: 140560 - RNA, 22 nt, Human
ccaggcugagcaugauuggagc

SEQ ID NO: 140561 - RNA, 22 nt, Human
uucuuuucuuggcaggaguaga

SEQ ID NO: 140562 - RNA, 22 nt, Human
uuacaguagauuuugaaugugg

SEQ ID NO: 140563 - RNA, 22 nt, Human
gcuggcccagggucaccuagga

SEQ ID NO: 140564 - RNA, 22 nt, Human
ccaaaguccuuucuccaccugc

SEQ ID NO: 140565 - RNA, 22 nt, Human
gacucugcuacaggccgagguu

SEQ ID NO: 140566 - RNA, 22 nt, Human
gcucuguacgcaggaugagggg

SEQ ID NO: 140567 - RNA, 22 nt, Human
uacaaagccugguagauaucug

SEQ ID NO: 140568 - RNA, 22 nt, Human
uaguuauuauuguuacuaucag

SEQ ID NO: 140569 - RNA, 22 nt, Human
ccuggagcccaaggcagugaga

SEQ ID NO: 140570 - RNA, 20 nt, Human
guggccucucacauucugag

SEQ ID NO: 140571 - RNA, 22 nt, Human
aggucauugaaguuauuuucuu

SEQ ID NO: 140572 - RNA, 22 nt, Human
gauugaaacauaggcagucgag

SEQ ID NO: 140573 - RNA, 22 nt, Human
gcuccuggcuccaggcagccaa

SEQ ID NO: 140574 - RNA, 22 nt, Human
caguacuuuucuggcuuucuac

SEQ ID NO: 140575 - RNA, 22 nt, Human
uggcccugcuuaugucucucuu

SEQ ID NO: 140576 - RNA, 22 nt, Human
gacagaggcaagaccagaagcc

SEQ ID NO: 140577 - RNA, 22 nt, Human
gccucugcaugcucagcaccca

SEQ ID NO: 140578 - RNA, 22 nt, Human
auuuaugacuggugaauagaac

SEQ ID NO: 140579 - RNA, 19 nt, Human
uuggaaggagccagagugg

SEQ ID NO: 140580 - RNA, 22 nt, Human
gccaccucuuugucucugccgc

SEQ ID NO: 140581 - RNA, 22 nt, Human
gcugugcagguccccacugccu

SEQ ID NO: 140582 - RNA, 22 nt, Human
agaggggcucauauccugucau

SEQ ID NO: 140583 - RNA, 22 nt, Human
ugcugccuccaacuccugggcu

SEQ ID NO: 140584 - RNA, 23 nt, Human
ucaguuuuggcuguucaguguug

SEQ ID NO: 140585 - RNA, 22 nt, Human
aagcuggcaauuaucaaaacug

SEQ ID NO: 140586 - RNA, 19 nt, Human
uucaggauugacccuacug

SEQ ID NO: 140587 - RNA, 22 nt, Human
caggugggccgggguuuguucu

SEQ ID NO: 140588 - RNA, 22 nt, Human
cuggaaggucuguccccacugc

SEQ ID NO: 140589 - RNA, 22 nt, Human
agggucuguggaugcaucuggg

SEQ ID NO: 140590 - RNA, 22 nt, Human
uagugauuaaaggcagaauguu

SEQ ID NO: 140591 - RNA, 22 nt, Human
agcuguguggugucugacagcu

SEQ ID NO: 140592 - RNA, 22 nt, Human
ugcugucuguuuacuggcuaua

SEQ ID NO: 140593 - RNA, 22 nt, Human
gucccuuggcucacaaacagcu

SEQ ID NO: 140594 - RNA, 22 nt, Human
aaggcagucugguuucaaagca

SEQ ID NO: 140595 - RNA, 22 nt, Human
aaugagcugcugcuguuccacc

SEQ ID NO: 140596 - RNA, 22 nt, Human
auguggaggaaaugaguguaca

SEQ ID NO: 140597 - RNA, 22 nt, Human
ucucagggagggcgagucagcg

SEQ ID NO: 140598 - RNA, 22 nt, Human
auuauguauuugguauaguuug

SEQ ID NO: 140599 - RNA, 22 nt, Human
gucucagauaacauguauucua

SEQ ID NO: 140600 - RNA, 23 nt, Human
ucucuuucaagagcuuaaugugc

SEQ ID NO: 140601 - RNA, 22 nt, Human
cuuucucuggaggggagugguu

SEQ ID NO: 140602 - RNA, 22 nt, Human
agcuguguuuccagaugguagc

SEQ ID NO: 140603 - RNA, 22 nt, Human
gccauccucugagcacuaggca

SEQ ID NO: 140604 - RNA, 22 nt, Human
cuguggcugucucuuucccaug

SEQ ID NO: 140605 - RNA, 22 nt, Human
gcugcccugucugcagcaggac

SEQ ID NO: 140606 - RNA, 22 nt, Human
uagggaggcuacuucuuguagg

SEQ ID NO: 140607 - RNA, 22 nt, Human
cugucaucacaguugagcagcc

SEQ ID NO: 140608 - RNA, 22 nt, Human
ucuuugcaucccuuccauaguu

SEQ ID NO: 140609 - RNA, 22 nt, Human
agauacauuaguaguuacuugu

SEQ ID NO: 140610 - RNA, 22 nt, Human
uguggaaaagaauaagggagau

SEQ ID NO: 140611 - RNA, 22 nt, Human
cagggugacugcccuggccacu

SEQ ID NO: 140612 - RNA, 22 nt, Human
auggcugugaaggucacacccu

SEQ ID NO: 140613 - RNA, 22 nt, Human
uacaaaguagaaauucaguaaa

SEQ ID NO: 140614 - RNA, 18 nt, Human
aagaggaggagcagguug

SEQ ID NO: 140615 - RNA, 22 nt, Human
cagggcaguuugugccuaugag

SEQ ID NO: 140616 - RNA, 22 nt, Human
guaacagaggguuugcagauau

SEQ ID NO: 140617 - RNA, 22 nt, Human
uuagccauugucagcacauggc

SEQ ID NO: 140618 - RNA, 22 nt, Human
aagacacagcgaaauguuccug

SEQ ID NO: 140619 - RNA, 22 nt, Human
uaagcugugggagauuggcaua

SEQ ID NO: 140620 - RNA, 22 nt, Human
ccagccucacuggcaucaccua

SEQ ID NO: 140621 - RNA, 22 nt, Human
ugcagggcuacaggacuacaac

SEQ ID NO: 140622 - RNA, 22 nt, Human
acugcuuuuagaaaucuauaga

SEQ ID NO: 140623 - RNA, 19 nt, Human
cugaggugcaguaagaggc

SEQ ID NO: 140624 - RNA, 22 nt, Human
gagaaccucuccacaagucugg

SEQ ID NO: 140625 - RNA, 22 nt, Human
aguugaaauuagaguccuggcu

SEQ ID NO: 140626 - RNA, 22 nt, Human
agaaaucaauaucuauauguug

SEQ ID NO: 140627 - RNA, 22 nt, Human
augaugguuguccuaggugcau

SEQ ID NO: 140628 - RNA, 22 nt, Human
acugugugccaggcgcuggucu

SEQ ID NO: 140629 - RNA, 18 nt, Human
uuccauaauguauguaac

SEQ ID NO: 140630 - RNA, 22 nt, Human
gaaggccacuuuguguugagaa

SEQ ID NO: 140631 - RNA, 21 nt, Human
ucccacucuaaauggacugaa

SEQ ID NO: 140632 - RNA, 22 nt, Human
uaauaucuacuucauagaguuu

SEQ ID NO: 140633 - RNA, 22 nt, Human
cuggcucucugagauauugagu

SEQ ID NO: 140634 - RNA, 22 nt, Human
auggcuguuggcaggaggccuc

SEQ ID NO: 140635 - RNA, 23 nt, Human
gggugggccaaauuagguagccu

SEQ ID NO: 140636 - RNA, 22 nt, Human
auuguauaacagcauguauuuu

SEQ ID NO: 140637 - RNA, 22 nt, Human
gcaggaguguauuugcauguaa

SEQ ID NO: 140638 - RNA, 17 nt, Human
uagagcugguucaggag

SEQ ID NO: 140639 - RNA, 22 nt, Human
uauccaauucaccauugauggg

SEQ ID NO: 140640 - RNA, 22 nt, Human
caggaacagcaccaggagcuag

SEQ ID NO: 140641 - RNA, 20 nt, Human
aggcagagcgcacuuuuaga

SEQ ID NO: 140642 - RNA, 22 nt, Human
auguaacuucugugaaucugac

SEQ ID NO: 140643 - RNA, 23 nt, Human
aaaugcagggucgcagguuacag

SEQ ID NO: 140644 - RNA, 22 nt, Human
acugccuugaaagauuguugag

SEQ ID NO: 140645 - RNA, 22 nt, Human
gcauuuagcuuuaaaauauuuc

SEQ ID NO: 140646 - RNA, 22 nt, Human
uggagcugguaaacagugacau

SEQ ID NO: 140647 - RNA, 17 nt, Human
ucagcaggggccaagcu

SEQ ID NO: 140648 - RNA, 22 nt, Human
uggcugggcccccaccugccuc

SEQ ID NO: 140649 - RNA, 22 nt, Human
cuguguguuuauaucauuuccu

SEQ ID NO: 140650 - RNA, 22 nt, Human
gaaaaugugccuuuggguauug

SEQ ID NO: 140651 - RNA, 22 nt, Human
cuguguagagcggcugcgagcg

SEQ ID NO: 140652 - RNA, 23 nt, Human
cagaagcaccuguugacugcugc

SEQ ID NO: 140653 - RNA, 22 nt, Human
ggagaugguggaagcuggugca

SEQ ID NO: 140654 - RNA, 22 nt, Human
ggcugccauaacagaguaccac

SEQ ID NO: 140655 - RNA, 22 nt, Human
ggaaccaguggaaugauaugcu

SEQ ID NO: 140656 - RNA, 22 nt, Human
uucuuuccacagaggggaugau

SEQ ID NO: 140657 - RNA, 19 nt, Human
aagaagcaauaagcuguga

SEQ ID NO: 140658 - RNA, 22 nt, Human
uggcagaggcucugugauguug

SEQ ID NO: 140659 - RNA, 22 nt, Human
accauuuaauaaguauuuccau

SEQ ID NO: 140660 - RNA, 22 nt, Human
cucucuguauguguauauuuau

SEQ ID NO: 140661 - RNA, 22 nt, Human
agagaggcugggcguagggcuu

SEQ ID NO: 140662 - RNA, 22 nt, Human
aaaugcacagagccuuagagau

SEQ ID NO: 140663 - RNA, 22 nt, Human
uuaaaaccaucagcuguaagau

SEQ ID NO: 140664 - RNA, 23 nt, Human
aggagccaggaaccagcuucccc

SEQ ID NO: 140665 - RNA, 22 nt, Human
gccaggggacgcggagcgacga

SEQ ID NO: 140666 - RNA, 22 nt, Human
cugagccaugagccugcgccca

SEQ ID NO: 140667 - RNA, 22 nt, Human
uagcugccaaaagggugggcua

SEQ ID NO: 140668 - RNA, 21 nt, Human
uguguuugagacuauguuucc

SEQ ID NO: 140669 - RNA, 22 nt, Human
gagggcugccacguugggcgag

SEQ ID NO: 140670 - RNA, 22 nt, Human
agggcagaaguacagacacuua

SEQ ID NO: 140671 - RNA, 22 nt, Human
auaaacaguagagaaagguggu

SEQ ID NO: 140672 - RNA, 22 nt, Human
gaggccugucgcuaggccucug

SEQ ID NO: 140673 - RNA, 22 nt, Human
aaaugucuuucuucugcuacgu

SEQ ID NO: 140674 - RNA, 22 nt, Human
ugggggagccuucacaguagcu

SEQ ID NO: 140675 - RNA, 22 nt, Human
uauguacagggauagaacuuga

SEQ ID NO: 140676 - RNA, 22 nt, Human
ggucccaggcugcgggcuggug

SEQ ID NO: 140677 - RNA, 22 nt, Human
uuauuauugauucgcucucaaa

SEQ ID NO: 140678 - RNA, 22 nt, Human
uuauugccugauugaggucauu

SEQ ID NO: 140679 - RNA, 22 nt, Human
gccccagguugccugucccagg

SEQ ID NO: 140680 - RNA, 22 nt, Human
gggccugacugagagcuccuca

SEQ ID NO: 140681 - RNA, 22 nt, Human
aaaggaagaugccaggacucug

SEQ ID NO: 140682 - RNA, 22 nt, Human
ucauaaaacacaccagguaguu

SEQ ID NO: 140683 - RNA, 22 nt, Human
ucugccuuuucacugccacuaa

SEQ ID NO: 140684 - RNA, 22 nt, Human
ucaggggcuugaggugcauguc

SEQ ID NO: 140685 - RNA, 22 nt, Human
cuguggcuccauagaaguugca

SEQ ID NO: 140686 - RNA, 22 nt, Human
uuuccucugaugcugacuugga

SEQ ID NO: 140687 - RNA, 22 nt, Human
ucauuucaaugauacuacuaag

SEQ ID NO: 140688 - RNA, 22 nt, Human
ugcugccacugguagucucauu

SEQ ID NO: 140689 - RNA, 22 nt, Human
uuacaggggacauuggggacau

SEQ ID NO: 140690 - RNA, 22 nt, Human
cuggccaguuguccuggcuugg

SEQ ID NO: 140691 - RNA, 22 nt, Human
guguguauuauugcauacacau

SEQ ID NO: 140692 - RNA, 22 nt, Human
auuuacagccuugccaucuaua

SEQ ID NO: 140693 - RNA, 22 nt, Human
cagaccugagguugaguaccag

SEQ ID NO: 140694 - RNA, 22 nt, Human
aucuauuaugcugagaaacugu

SEQ ID NO: 140695 - RNA, 22 nt, Human
cucuccuccaacagcccugccg

SEQ ID NO: 140696 - RNA, 22 nt, Human
agcugccaggccccugagaacc

SEQ ID NO: 140697 - RNA, 22 nt, Human
cauucuuauauuuacucauuca

SEQ ID NO: 140698 - RNA, 22 nt, Human
gagcagaacuacucacauaucg

SEQ ID NO: 140699 - RNA, 22 nt, Human
ugaaggaauggaggaucagagc

SEQ ID NO: 140700 - RNA, 22 nt, Human
acuuuacacaucuuuucucauu

SEQ ID NO: 140701 - RNA, 22 nt, Human
cuaacuuuagcuuagauuauca

SEQ ID NO: 140702 - RNA, 22 nt, Human
agcagcauccccggccuccacc

SEQ ID NO: 140703 - RNA, 22 nt, Human
uucacagugagcuaugucuugu

SEQ ID NO: 140704 - RNA, 23 nt, Human
auuuccuacuauaaaagagguaa

SEQ ID NO: 140705 - RNA, 22 nt, Human
cuguucucuggcgguggcuguu

SEQ ID NO: 140706 - RNA, 22 nt, Human
cugucuguucagauucauuacu

SEQ ID NO: 140707 - RNA, 20 nt, Human
uguuugugccagcuuuguca

SEQ ID NO: 140708 - RNA, 22 nt, Human
uuguaacuguggguugauuaga

SEQ ID NO: 140709 - RNA, 22 nt, Human
uuuccauauuuggucuuuggga

SEQ ID NO: 140710 - RNA, 22 nt, Human
uccuggcccacuaugccagcau

SEQ ID NO: 140711 - RNA, 19 nt, Human
cccagcuugaccaccugcu

SEQ ID NO: 140712 - RNA, 22 nt, Human
gccaugcuugguaugcugugag

SEQ ID NO: 140713 - RNA, 22 nt, Human
gugccugcagcaauccauggca

SEQ ID NO: 140714 - RNA, 22 nt, Human
uagauuuccucuuccucauucc

SEQ ID NO: 140715 - RNA, 22 nt, Human
auauuugugguuuuuggcuccu

SEQ ID NO: 140716 - RNA, 22 nt, Human
aaagguuaagguguucaagaaa

SEQ ID NO: 140717 - RNA, 22 nt, Human
auccuugaacuuagacacuagg

SEQ ID NO: 140718 - RNA, 22 nt, Human
agccuuguuggucugaguuugg

SEQ ID NO: 140719 - RNA, 22 nt, Human
auucucucucuaugaaaacuga

SEQ ID NO: 140720 - RNA, 22 nt, Human
uacaguaaagcugcuaugaauu

SEQ ID NO: 140721 - RNA, 22 nt, Human
guucuucacauuucauugagga

SEQ ID NO: 140722 - RNA, 22 nt, Human
auuuacucgugcuucauugaau

SEQ ID NO: 140723 - RNA, 22 nt, Human
ucugagcuggagcccaucaccu

SEQ ID NO: 140724 - RNA, 22 nt, Human
uccagggacagcgcuggagcua

SEQ ID NO: 140725 - RNA, 22 nt, Human
auucuuauuuaaauagagucug

SEQ ID NO: 140726 - RNA, 22 nt, Human
aacccagccguguagcugccgc

SEQ ID NO: 140727 - RNA, 23 nt, Human
ccucucuuuuuaggugguguuug

SEQ ID NO: 140728 - RNA, 22 nt, Human
ccagggagccuggugugucagc

SEQ ID NO: 140729 - RNA, 22 nt, Human
gccaggcucucagugacugccc

SEQ ID NO: 140730 - RNA, 21 nt, Human
ccuauugaauauaggaagauu

SEQ ID NO: 140731 - RNA, 22 nt, Human
ggaggccaaggcagguggauca

SEQ ID NO: 140732 - RNA, 22 nt, Human
uauguacauguuaaagggcaaa

SEQ ID NO: 140733 - RNA, 22 nt, Human
ucucagaggcccgacguucucc

SEQ ID NO: 140734 - RNA, 22 nt, Human
gaggccuggcugucagucccca

SEQ ID NO: 140735 - RNA, 22 nt, Human
uauucacagcugccgcacucag

SEQ ID NO: 140736 - RNA, 22 nt, Human
uuagaaaggaaucuucauuuca

SEQ ID NO: 140737 - RNA, 18 nt, Human
uccauuguucuacuguga

SEQ ID NO: 140738 - RNA, 22 nt, Human
cuuugcagauuuguuuagugcu

SEQ ID NO: 140739 - RNA, 22 nt, Human
uuaugcuaguauaguccuuaga

SEQ ID NO: 140740 - RNA, 22 nt, Human
cuggugguucaggagaauggcu

SEQ ID NO: 140741 - RNA, 22 nt, Human
caaggagaaaacggcuucugaa

SEQ ID NO: 140742 - RNA, 22 nt, Human
gcagagccgugaauggauuuca

SEQ ID NO: 140743 - RNA, 23 nt, Human
ccaggccucucagagggugugcc

SEQ ID NO: 140744 - RNA, 22 nt, Human
cuucaagagaaugcagggaugu

SEQ ID NO: 140745 - RNA, 22 nt, Human
ucccagagccucugccacucug

SEQ ID NO: 140746 - RNA, 22 nt, Human
cuggcucacaggugagaugcau

SEQ ID NO: 140747 - RNA, 22 nt, Human
gcucccagacugaccagaggug

SEQ ID NO: 140748 - RNA, 22 nt, Human
gcagagccugacgggauuuuuc

SEQ ID NO: 140749 - RNA, 22 nt, Human
acaguagauugguaugauguca

SEQ ID NO: 140750 - RNA, 22 nt, Human
cggcagagacggcgcuuugaac

SEQ ID NO: 140751 - RNA, 22 nt, Human
uggcagucggacuucuaucuca

SEQ ID NO: 140752 - RNA, 21 nt, Human
aggcucagcagguguauaaag

SEQ ID NO: 140753 - RNA, 22 nt, Human
ggggacaguuaaagaccaagac

SEQ ID NO: 140754 - RNA, 22 nt, Human
cagcccaggccgacaguuccuc

SEQ ID NO: 140755 - RNA, 23 nt, Human
ucagcugcuuccuccugccugcc

SEQ ID NO: 140756 - RNA, 19 nt, Human
auuuuucuuccucugugca

SEQ ID NO: 140757 - RNA, 22 nt, Human
gugcagagaaaugagaagucga

SEQ ID NO: 140758 - RNA, 22 nt, Human
ugggcacaaacaucugccuguu

SEQ ID NO: 140759 - RNA, 22 nt, Human
ggcucaagcagucugccugccu

SEQ ID NO: 140760 - RNA, 22 nt, Human
gugugccagacaugaugcuaug

SEQ ID NO: 140761 - RNA, 22 nt, Human
augguguagcaugugauaugac

SEQ ID NO: 140762 - RNA, 22 nt, Human
gccuucaguaguauccucauga

SEQ ID NO: 140763 - RNA, 21 nt, Human
uagggcaggcauuggaagaga

SEQ ID NO: 140764 - RNA, 22 nt, Human
uuauccaaacuggugaaucauu

SEQ ID NO: 140765 - RNA, 22 nt, Human
uagcagaaccagcagucaauuu

SEQ ID NO: 140766 - RNA, 22 nt, Human
agccaagcugaucuccugcuga

SEQ ID NO: 140767 - RNA, 22 nt, Human
ccugccuggcuuccagaagaga

SEQ ID NO: 140768 - RNA, 22 nt, Human
uguauguguccuaauucaagca

SEQ ID NO: 140769 - RNA, 22 nt, Human
agagccuggacuuuucugagcc

SEQ ID NO: 140770 - RNA, 22 nt, Human
uuucuauuguaagucuccuaua

SEQ ID NO: 140771 - RNA, 22 nt, Human
agcaauauuuaaagguuugcaa

SEQ ID NO: 140772 - RNA, 18 nt, Human
aggagccuuugcacugga

SEQ ID NO: 140773 - RNA, 22 nt, Human
ccaggacucaguggggaaaggg

SEQ ID NO: 140774 - RNA, 22 nt, Human
cucugucccagacccaccucuc

SEQ ID NO: 140775 - RNA, 22 nt, Human
gucuuuauuugagauugucauu

SEQ ID NO: 140776 - RNA, 22 nt, Human
uauuuagaacagacaauagaaa

SEQ ID NO: 140777 - RNA, 22 nt, Human
cuuuuuacucuguugucucagc

SEQ ID NO: 140778 - RNA, 22 nt, Human
cauggacucugguuuggggagc

SEQ ID NO: 140779 - RNA, 22 nt, Human
auguaugcaugcuacaguuuuc

SEQ ID NO: 140780 - RNA, 22 nt, Human
aggcugagauagguggaucauu

SEQ ID NO: 140781 - RNA, 22 nt, Human
caggcugcagaggccuuucaug

SEQ ID NO: 140782 - RNA, 22 nt, Human
cagagggcacaugguuuccuca

SEQ ID NO: 140783 - RNA, 17 nt, Human
ccagguggaaucgugga

SEQ ID NO: 140784 - RNA, 22 nt, Human
cagcagcaacaacggaagccuu

SEQ ID NO: 140785 - RNA, 22 nt, Human
ugauuaacugucuauuaaucau

SEQ ID NO: 140786 - RNA, 22 nt, Human
uuugaaaauuuaagugcuacac

SEQ ID NO: 140787 - RNA, 22 nt, Human
aacaguaaugugguguuggguu

SEQ ID NO: 140788 - RNA, 22 nt, Human
ucugggcucugucagcaccucu

SEQ ID NO: 140789 - RNA, 22 nt, Human
aggccuggcaugagaccugaga

SEQ ID NO: 140790 - RNA, 22 nt, Human
aggcaguguauugcuagcggcu

SEQ ID NO: 140791 - RNA, 22 nt, Human
agcuggaggggccagcaggugu

SEQ ID NO: 140792 - RNA, 22 nt, Human
agagcuguagcuuccuagagcc

SEQ ID NO: 140793 - RNA, 22 nt, Human
aggcuggguaccugucauaugc

SEQ ID NO: 140794 - RNA, 20 nt, Human
aagagaagaagucuuugaaa

SEQ ID NO: 140795 - RNA, 22 nt, Human
agggugcauguuugcaagagug

SEQ ID NO: 140796 - RNA, 19 nt, Human
ucucugcuucucuuggcau

SEQ ID NO: 140797 - RNA, 22 nt, Human
gaggcccaggucaagcagccac

SEQ ID NO: 140798 - RNA, 21 nt, Human
agggcagauuagcuguaagag

SEQ ID NO: 140799 - RNA, 22 nt, Human
cagcuggcuccaccucugggcu

SEQ ID NO: 140800 - RNA, 22 nt, Human
uucacagaauggcaaguuaugg

SEQ ID NO: 140801 - RNA, 22 nt, Human
cagccaggacagggaaacuagu

SEQ ID NO: 140802 - RNA, 21 nt, Human
agacagaacaacugcucucca

SEQ ID NO: 140803 - RNA, 22 nt, Human
ggcugaaacagauuucaagaca

SEQ ID NO: 140804 - RNA, 22 nt, Human
uaucuaaaggauuuaauuuagu

SEQ ID NO: 140805 - RNA, 22 nt, Human
acagugucugacacauuguagc

SEQ ID NO: 140806 - RNA, 22 nt, Human
aucuguguaugaaaguauaacu

SEQ ID NO: 140807 - RNA, 22 nt, Human
aaagccuuggucaucugguucc

SEQ ID NO: 140808 - RNA, 22 nt, Human
ugaagcccugugucagcuucca

SEQ ID NO: 140809 - RNA, 19 nt, Human
uucauucucuuauuguugu

SEQ ID NO: 140810 - RNA, 20 nt, Human
ucccuggaggugguggcauc

SEQ ID NO: 140811 - RNA, 22 nt, Human
ucaaaugcuucuacuccuaaga

SEQ ID NO: 140812 - RNA, 23 nt, Human
uguagcaucucuuauuucucagc

SEQ ID NO: 140813 - RNA, 22 nt, Human
ccacagagacagagcccagggu

SEQ ID NO: 140814 - RNA, 22 nt, Human
agaugcuucaguguuuaauuua

SEQ ID NO: 140815 - RNA, 22 nt, Human
ucuaacuuagggaauacuuuag

SEQ ID NO: 140816 - RNA, 22 nt, Human
caagggcucuuuugaggaaugu

SEQ ID NO: 140817 - RNA, 22 nt, Human
agggugccuggaagccacucac

SEQ ID NO: 140818 - RNA, 22 nt, Human
uuacuuuguucucaagauaugu

SEQ ID NO: 140819 - RNA, 22 nt, Human
uuucucuggcauuagguauaaa

SEQ ID NO: 140820 - RNA, 22 nt, Human
gccccucccagucaggagcacu

SEQ ID NO: 140821 - RNA, 22 nt, Human
guggcugcuguccucucugguu

SEQ ID NO: 140822 - RNA, 22 nt, Human
caggucagaggcgcagccccca

SEQ ID NO: 140823 - RNA, 22 nt, Human
acagagcaauucuuggguguuu

SEQ ID NO: 140824 - RNA, 20 nt, Human
ugugugcaucuguauguauu

SEQ ID NO: 140825 - RNA, 22 nt, Human
uccugccucaggcucuggagua

SEQ ID NO: 140826 - RNA, 22 nt, Human
uguucauuuggcccuuuuguau

SEQ ID NO: 140827 - RNA, 22 nt, Human
agcccagcagaaaguccagccu

SEQ ID NO: 140828 - RNA, 22 nt, Human
cagcccuggccccagguggucu

SEQ ID NO: 140829 - RNA, 23 nt, Human
agaugaggcuucuccauguuggu

SEQ ID NO: 140830 - RNA, 16 nt, Human
gggcugggggauucug

SEQ ID NO: 140831 - RNA, 22 nt, Human
agccuggaauuaaggaaaugca

SEQ ID NO: 140832 - RNA, 20 nt, Human
agucucuguagugccugaga

SEQ ID NO: 140833 - RNA, 19 nt, Human
uguguguuuauauauguau

SEQ ID NO: 140834 - RNA, 22 nt, Human
ucauugcagaaauaaaggugaa

SEQ ID NO: 140835 - RNA, 22 nt, Human
aguggcagaucucuggucugga

SEQ ID NO: 140836 - RNA, 22 nt, Human
cagggcuggauccuccagacuc

SEQ ID NO: 140837 - RNA, 22 nt, Human
ucuuuuggguucuuaugauuua

SEQ ID NO: 140838 - RNA, 19 nt, Human
uuugucucugaauaauauu

SEQ ID NO: 140839 - RNA, 22 nt, Human
uccuggagggaggcggugcuac

SEQ ID NO: 140840 - RNA, 22 nt, Human
ggcuuccuggggccuccugcaa

SEQ ID NO: 140841 - RNA, 22 nt, Human
uuucaaaguugggaauuguaau

SEQ ID NO: 140842 - RNA, 22 nt, Human
uccaugagagguaacuuuacaa

SEQ ID NO: 140843 - RNA, 23 nt, Human
uacuguauauuacuguguuauac

SEQ ID NO: 140844 - RNA, 22 nt, Human
ugcauuguugaugaguugaaua

SEQ ID NO: 140845 - RNA, 22 nt, Human
ggaggccaucuggcuggaggcu

SEQ ID NO: 140846 - RNA, 22 nt, Human
acagccagaggagccaggcugg

SEQ ID NO: 140847 - RNA, 22 nt, Human
cuucuucaguugcauguauugg

SEQ ID NO: 140848 - RNA, 21 nt, Human
ccaggcuccugaggcugguca

SEQ ID NO: 140849 - RNA, 22 nt, Human
agugcugaagacuggcuaggga

SEQ ID NO: 140850 - RNA, 22 nt, Human
auguguagaacuguaaugccca

SEQ ID NO: 140851 - RNA, 22 nt, Human
acaguauaacuccaugccaccc

SEQ ID NO: 140852 - RNA, 22 nt, Human
ugaaucauggauaaauagcuua

SEQ ID NO: 140853 - RNA, 22 nt, Human
aggugaaguugaggaggcagaa

SEQ ID NO: 140854 - RNA, 22 nt, Human
aagccucuggggccucaucugu

SEQ ID NO: 140855 - RNA, 22 nt, Human
ugugugccugagccgugccugg

SEQ ID NO: 140856 - RNA, 22 nt, Human
ucagcaguguaguuuaucauuc

SEQ ID NO: 140857 - RNA, 18 nt, Human
gugacagcugcuagcuca

SEQ ID NO: 140858 - RNA, 22 nt, Human
uuccaugugaguacacugugau

SEQ ID NO: 140859 - RNA, 22 nt, Human
uaggcagcugcaaacuucgguc

SEQ ID NO: 140860 - RNA, 22 nt, Human
gaucauuugcaggaaacauuaa

SEQ ID NO: 140861 - RNA, 22 nt, Human
ggcugcagaaguacuuccggau

SEQ ID NO: 140862 - RNA, 19 nt, Human
uguggcugagcacuccuua

SEQ ID NO: 140863 - RNA, 22 nt, Human
ggagccugggcauuaguaauuu

SEQ ID NO: 140864 - RNA, 19 nt, Human
ugaagcagcaaacucucag

SEQ ID NO: 140865 - RNA, 22 nt, Human
auuagcugaccucuaaggagcc

SEQ ID NO: 140866 - RNA, 21 nt, Human
caguauuuuaagcagugaguu

SEQ ID NO: 140867 - RNA, 22 nt, Human
aaucaguuagaaggaagagaau

SEQ ID NO: 140868 - RNA, 22 nt, Human
cagcuggcccuuugguagccuu

SEQ ID NO: 140869 - RNA, 22 nt, Human
uguauguggcuacuuuucuugc

SEQ ID NO: 140870 - RNA, 22 nt, Human
cccucuggcucuucucaggccg

SEQ ID NO: 140871 - RNA, 22 nt, Human
ucccagcauaacaaacugcccg

SEQ ID NO: 140872 - RNA, 22 nt, Human
ucacaauuuggauacagcuaug

SEQ ID NO: 140873 - RNA, 22 nt, Human
uuuauugcauacacaaauguca

SEQ ID NO: 140874 - RNA, 22 nt, Human
uuucuucuaugugugauauuuu

SEQ ID NO: 140875 - RNA, 20 nt, Human
uggagcuccagcguccaugu

SEQ ID NO: 140876 - RNA, 22 nt, Human
cucucugggcccaguuggcacc

SEQ ID NO: 140877 - RNA, 22 nt, Human
aucuggguucaccaugcuccug

SEQ ID NO: 140878 - RNA, 22 nt, Human
uggacagcgaaagugccuggga

SEQ ID NO: 140879 - RNA, 21 nt, Human
ggccucugccuugccccacuc

SEQ ID NO: 140880 - RNA, 22 nt, Human
ugggcagauuaaugcaguggcu

SEQ ID NO: 140881 - RNA, 22 nt, Human
gcuggccacacugcugauggag

SEQ ID NO: 140882 - RNA, 20 nt, Human
cuguaucagguuacaaagua

SEQ ID NO: 140883 - RNA, 22 nt, Human
gugccugggcaugagcuuguug

SEQ ID NO: 140884 - RNA, 22 nt, Human
uuggcugugcagaucuugccua

SEQ ID NO: 140885 - RNA, 22 nt, Human
ucuggcucuuugggugauugua

SEQ ID NO: 140886 - RNA, 22 nt, Human
auuuauuaugggauuuggcaca

SEQ ID NO: 140887 - RNA, 22 nt, Human
agcugguaugaacaggauagga

SEQ ID NO: 140888 - RNA, 19 nt, Human
gcagcugugggaagagcca

SEQ ID NO: 140889 - RNA, 22 nt, Human
cugugugcucggauggacucgu

SEQ ID NO: 140890 - RNA, 22 nt, Human
agagcuggaaucagaccucagg

SEQ ID NO: 140891 - RNA, 22 nt, Human
uuuuucauugcagccucucucc

SEQ ID NO: 140892 - RNA, 22 nt, Human
uaucuacaggugucagguaaga

SEQ ID NO: 140893 - RNA, 18 nt, Human
aagcugcccucaggcagg

SEQ ID NO: 140894 - RNA, 22 nt, Human
aagagcuggaugaagaaaucaa

SEQ ID NO: 140895 - RNA, 22 nt, Human
gggcugggaauggcuaaguaug

SEQ ID NO: 140896 - RNA, 22 nt, Human
agggcucugggguggcagagau

SEQ ID NO: 140897 - RNA, 22 nt, Human
agcuggugcugaagcucuugag

SEQ ID NO: 140898 - RNA, 22 nt, Human
cagaggcagaggucaucucugg

SEQ ID NO: 140899 - RNA, 22 nt, Human
gcagggacaacugugcaccuga

SEQ ID NO: 140900 - RNA, 20 nt, Human
auacacauauucuugcaacu

SEQ ID NO: 140901 - RNA, 22 nt, Human
acagcagccuuguugguuucga

SEQ ID NO: 140902 - RNA, 22 nt, Human
gagugugugacuucacuuuagc

SEQ ID NO: 140903 - RNA, 22 nt, Human
gguguguguggauuagcaugcc

SEQ ID NO: 140904 - RNA, 19 nt, Human
ccagcccugucacuucuug

SEQ ID NO: 140905 - RNA, 22 nt, Human
acagccagggcauugucgccga

SEQ ID NO: 140906 - RNA, 22 nt, Human
aaagcucacaguaauacaaggc

SEQ ID NO: 140907 - RNA, 22 nt, Human
uccagggcuggguuggcucagc

SEQ ID NO: 140908 - RNA, 22 nt, Human
ggcugccuacuuucccagaguu

SEQ ID NO: 140909 - RNA, 22 nt, Human
cuggggcuucaaugcuucggug

SEQ ID NO: 140910 - RNA, 22 nt, Human
uuuacaaggcaguuauuuuccu

SEQ ID NO: 140911 - RNA, 22 nt, Human
ggagauggcucugcaaggucua

SEQ ID NO: 140912 - RNA, 22 nt, Human
ggcaccuggauguagcagugaa

SEQ ID NO: 140913 - RNA, 22 nt, Human
cugcucugaguauuaacggagg

SEQ ID NO: 140914 - RNA, 22 nt, Human
ucauuuguucucauucucuacu

SEQ ID NO: 140915 - RNA, 23 nt, Human
cugcagccgcguggggacgugga

SEQ ID NO: 140916 - RNA, 22 nt, Human
cugcagugcaagcccagaugga

SEQ ID NO: 140917 - RNA, 22 nt, Human
gcuggcagaagagcugguucaa

SEQ ID NO: 140918 - RNA, 22 nt, Human
ugugucuaggcucaugcuugcu

SEQ ID NO: 140919 - RNA, 22 nt, Human
agcagaacugaugagacuugag

SEQ ID NO: 140920 - RNA, 22 nt, Human
uugauuuucaauucauugacaa

SEQ ID NO: 140921 - RNA, 19 nt, Human
cugguccugacugaggggu

SEQ ID NO: 140922 - RNA, 22 nt, Human
uccuguguuacccuugcaguga

SEQ ID NO: 140923 - RNA, 22 nt, Human
gcagcuggcucagagagguggg

SEQ ID NO: 140924 - RNA, 18 nt, Human
uccagcgugcuccagggc

SEQ ID NO: 140925 - RNA, 22 nt, Human
agaaggccuaacuugggggcaa

SEQ ID NO: 140926 - RNA, 22 nt, Human
acguguucaauuuccaucugac

SEQ ID NO: 140927 - RNA, 22 nt, Human
uaguuuuacuugcgaugauaau

SEQ ID NO: 140928 - RNA, 22 nt, Human
gggcuggaggaccggccucgga

SEQ ID NO: 140929 - RNA, 22 nt, Human
gucacuguauccagguuccagc

SEQ ID NO: 140930 - RNA, 22 nt, Human
ugaaauguuugaagaccacuga

SEQ ID NO: 140931 - RNA, 22 nt, Human
cugaggagagaucacguggugu

SEQ ID NO: 140932 - RNA, 22 nt, Human
guggguguggaacugugagacc

SEQ ID NO: 140933 - RNA, 22 nt, Human
uuuauguuugcauuuucaaaga

SEQ ID NO: 140934 - RNA, 22 nt, Human
ccucuggcuguaccacuggcac

SEQ ID NO: 140935 - RNA, 22 nt, Human
agcagccacacgccuccuucuc

SEQ ID NO: 140936 - RNA, 22 nt, Human
ugggcacuauggcucugugcac

SEQ ID NO: 140937 - RNA, 22 nt, Human
cagagcagaagcgguccucaca

SEQ ID NO: 140938 - RNA, 22 nt, Human
accugaggccuccccagcagac

SEQ ID NO: 140939 - RNA, 22 nt, Human
aggguggcaguuacuggagcaa

SEQ ID NO: 140940 - RNA, 22 nt, Human
uucuuaaaacuuauggacaggu

SEQ ID NO: 140941 - RNA, 22 nt, Human
aggcaguuuaggcagcgauuua

SEQ ID NO: 140942 - RNA, 22 nt, Human
aaugcacauauauguguauaca

SEQ ID NO: 140943 - RNA, 22 nt, Human
cugggaguguucuaggucacau

SEQ ID NO: 140944 - RNA, 22 nt, Human
uccagggacacagaguccuucu

SEQ ID NO: 140945 - RNA, 22 nt, Human
guacucucuugaaggccuuucu

SEQ ID NO: 140946 - RNA, 22 nt, Human
aacuagaaccacuuguauuucc

SEQ ID NO: 140947 - RNA, 23 nt, Human
uuugaaguugacugccuuccaga

SEQ ID NO: 140948 - RNA, 22 nt, Human
uucaauucugcucugaucuuag

SEQ ID NO: 140949 - RNA, 22 nt, Human
acauuucugcuagaauagguga

SEQ ID NO: 140950 - RNA, 21 nt, Human
gcccucaggggaggauggccu

SEQ ID NO: 140951 - RNA, 22 nt, Human
uccugccuagcaggugaccuau

SEQ ID NO: 140952 - RNA, 22 nt, Human
guaggaagcucugaggcuaguu

SEQ ID NO: 140953 - RNA, 19 nt, Human
uuaucuguguugcaguggu

SEQ ID NO: 140954 - RNA, 22 nt, Human
gcaaagucucaagacccaagug

SEQ ID NO: 140955 - RNA, 22 nt, Human
gcauucaucuuccuccaugcag

SEQ ID NO: 140956 - RNA, 22 nt, Human
guguguuuagcauuagcagggg

SEQ ID NO: 140957 - RNA, 22 nt, Human
uccuucagcucucuauuuagau

SEQ ID NO: 140958 - RNA, 22 nt, Human
uaaauucccaacucugcucuuc

SEQ ID NO: 140959 - RNA, 22 nt, Human
auuauguagcuaaaaauugugu

SEQ ID NO: 140960 - RNA, 22 nt, Human
cuccucuuuggggauuuacaca

SEQ ID NO: 140961 - RNA, 19 nt, Human
uggagacugagagugagca

SEQ ID NO: 140962 - RNA, 20 nt, Human
uauuuacaacuuagagccuc

SEQ ID NO: 140963 - RNA, 22 nt, Human
ucagggcauacucuucaagguc

SEQ ID NO: 140964 - RNA, 23 nt, Human
ggcacugaagcuacaauggugag

SEQ ID NO: 140965 - RNA, 22 nt, Human
cuggcagcugcccgagaugccc

SEQ ID NO: 140966 - RNA, 22 nt, Human
guggagacuucuacuagagacc

SEQ ID NO: 140967 - RNA, 22 nt, Human
cccucccaggaguggccagaga

SEQ ID NO: 140968 - RNA, 22 nt, Human
gacagggccgcagauggagacu

SEQ ID NO: 140969 - RNA, 22 nt, Human
caggcugccgugaagcaggccu

SEQ ID NO: 140970 - RNA, 23 nt, Human
ccugugugcccuuaauucacagc

SEQ ID NO: 140971 - RNA, 22 nt, Human
ugccuuggugcuucuucaugug

SEQ ID NO: 140972 - RNA, 22 nt, Human
acauuucuccuugcaggaguca

SEQ ID NO: 140973 - RNA, 20 nt, Human
uacaaguacauuauaguuau

SEQ ID NO: 140974 - RNA, 22 nt, Human
cuggccacaugugugcugagca

SEQ ID NO: 140975 - RNA, 20 nt, Human
ccugucuggagacaaagaga

SEQ ID NO: 140976 - RNA, 22 nt, Human
gucaaguuaagauaaggucaug

SEQ ID NO: 140977 - RNA, 19 nt, Human
ucucagagcccuagaggcc

SEQ ID NO: 140978 - RNA, 18 nt, Human
uggagcagguaggcauga

SEQ ID NO: 140979 - RNA, 22 nt, Human
cauuaaaauaucucaugguguu

SEQ ID NO: 140980 - RNA, 23 nt, Human
gcagacagagcagacuaagacaa

SEQ ID NO: 140981 - RNA, 22 nt, Human
ggagaaggugcuggucacugug

SEQ ID NO: 140982 - RNA, 22 nt, Human
caaauguauucucacuucaggg

SEQ ID NO: 140983 - RNA, 22 nt, Human
gccucacugcagccccaggaag

SEQ ID NO: 140984 - RNA, 22 nt, Human
ugcaggagcugugcggugaggg

SEQ ID NO: 140985 - RNA, 22 nt, Human
ugcauuguugaccaguugugca

SEQ ID NO: 140986 - RNA, 22 nt, Human
acucaggaaaugagaggcucuc

SEQ ID NO: 140987 - RNA, 22 nt, Human
ugccucagagugggcuugcuau

SEQ ID NO: 140988 - RNA, 22 nt, Human
uacagucuuuggaaagagauag

SEQ ID NO: 140989 - RNA, 22 nt, Human
uuacaaguacugaauaugauuu

SEQ ID NO: 140990 - RNA, 22 nt, Human
uaaaugugucuauggacccgcc

SEQ ID NO: 140991 - RNA, 22 nt, Human
caaaguccuagaacagugcuug

SEQ ID NO: 140992 - RNA, 22 nt, Human
ugucaaauuuuuauugcaguau

SEQ ID NO: 140993 - RNA, 22 nt, Human
aacaguaugugagauuuacaca

SEQ ID NO: 140994 - RNA, 22 nt, Human
caauguguuugcauauuaaaau

SEQ ID NO: 140995 - RNA, 22 nt, Human
cagccuucugaaugaacguacu

SEQ ID NO: 140996 - RNA, 22 nt, Human
ggccaagauggaaggagagaug

SEQ ID NO: 140997 - RNA, 22 nt, Human
auaaggcaagcugucaguuugu

SEQ ID NO: 140998 - RNA, 22 nt, Human
uuucuucucgacaccuuauccc

SEQ ID NO: 140999 - RNA, 22 nt, Human
aauuucucucucaugcuucaug

SEQ ID NO: 141000 - RNA, 22 nt, Human
ggagagaaauugagguagcaag

SEQ ID NO: 141001 - RNA, 22 nt, Human
cagcaggaccauugaggcauca

SEQ ID NO: 141002 - RNA, 22 nt, Human
guuauauucaaaaugaggcugu

SEQ ID NO: 141003 - RNA, 22 nt, Human
cccuggagucagguuggccugg

SEQ ID NO: 141004 - RNA, 22 nt, Human
uucucuucaucucaguaaaugu

SEQ ID NO: 141005 - RNA, 22 nt, Human
uagcccagagucccaauuccag

SEQ ID NO: 141006 - RNA, 22 nt, Human
agcucucaagauaagaaagaac

SEQ ID NO: 141007 - RNA, 22 nt, Human
ucagggcucaccagccucugcc

SEQ ID NO: 141008 - RNA, 22 nt, Human
caucugcuguuccuuggacuca

SEQ ID NO: 141009 - RNA, 22 nt, Human
agucucugugagcucccaaugg

SEQ ID NO: 141010 - RNA, 22 nt, Human
uccugagggcgauucagcaggu

SEQ ID NO: 141011 - RNA, 22 nt, Human
agauuuagugguggaauuuugg

SEQ ID NO: 141012 - RNA, 22 nt, Human
uagagcaguuggcagcuguauu

SEQ ID NO: 141013 - RNA, 22 nt, Human
ggcugcuguacugaugucaguu

SEQ ID NO: 141014 - RNA, 22 nt, Human
ugcagcauucuuggccacuacu

SEQ ID NO: 141015 - RNA, 22 nt, Human
aggaaucccgcaccagcugcug

SEQ ID NO: 141016 - RNA, 22 nt, Human
uguuugaauuuugcuaacgugu

SEQ ID NO: 141017 - RNA, 22 nt, Human
aggggugaaggcccgauaggag

SEQ ID NO: 141018 - RNA, 22 nt, Human
gaaaauguuuccuguuauuugc

SEQ ID NO: 141019 - RNA, 20 nt, Human
ccuccaggcacacccaugug

SEQ ID NO: 141020 - RNA, 22 nt, Human
uggcucucaggccugcugcguu

SEQ ID NO: 141021 - RNA, 22 nt, Human
uguuacacagcagaauagcaag

SEQ ID NO: 141022 - RNA, 22 nt, Human
aggucaaggccaaaagaguggu

SEQ ID NO: 141023 - RNA, 19 nt, Human
agcagccaucgaccaugga

SEQ ID NO: 141024 - RNA, 22 nt, Human
auuaaauuagcaaacugugaaa

SEQ ID NO: 141025 - RNA, 22 nt, Human
agaaugcaguuugaaauaaggu

SEQ ID NO: 141026 - RNA, 22 nt, Human
aagacaagcaucaaaucaggca

SEQ ID NO: 141027 - RNA, 22 nt, Human
agcagccaggaaucugcagagc

SEQ ID NO: 141028 - RNA, 19 nt, Human
gcagccaccgcggcggccg

SEQ ID NO: 141029 - RNA, 22 nt, Human
aagagcuggaagugaagauaac

SEQ ID NO: 141030 - RNA, 22 nt, Human
gugaggggaguaaagccauguu

SEQ ID NO: 141031 - RNA, 22 nt, Human
gcuuuacacagaugaauauuuc

SEQ ID NO: 141032 - RNA, 22 nt, Human
cuucaagaagacagcagagcau

SEQ ID NO: 141033 - RNA, 20 nt, Human
agaaucugacccagagagac

SEQ ID NO: 141034 - RNA, 22 nt, Human
uuuauucuugagagugagaaga

SEQ ID NO: 141035 - RNA, 22 nt, Human
caucuggcuagcuaucauugug

SEQ ID NO: 141036 - RNA, 22 nt, Human
ggucccugaagaggccuggggu

SEQ ID NO: 141037 - RNA, 22 nt, Human
cugggcagcuaccaccacugcu

SEQ ID NO: 141038 - RNA, 22 nt, Human
uguaugugcaauguuuauaugu

SEQ ID NO: 141039 - RNA, 22 nt, Human
caguuuauaguuguuaugugug

SEQ ID NO: 141040 - RNA, 21 nt, Human
ggccugaguauaggacaggcc

SEQ ID NO: 141041 - RNA, 22 nt, Human
cagagccauuauggagacuugc

SEQ ID NO: 141042 - RNA, 22 nt, Human
cauuuguauagugcuuagacca

SEQ ID NO: 141043 - RNA, 19 nt, Human
cagucccaaauucuuguca

SEQ ID NO: 141044 - RNA, 19 nt, Human
gaguuauugccagggcaug

SEQ ID NO: 141045 - RNA, 22 nt, Human
gcagaagcccggucagcgcacg

SEQ ID NO: 141046 - RNA, 22 nt, Human
caaggccacguucugcaugcgg

SEQ ID NO: 141047 - RNA, 22 nt, Human
agaagccaauucugugugaguc

SEQ ID NO: 141048 - RNA, 22 nt, Human
ugccacacucacuucuguggac

SEQ ID NO: 141049 - RNA, 22 nt, Human
uggaggcauaggccugggcccu

SEQ ID NO: 141050 - RNA, 22 nt, Human
cccaucaggaacccaggagccc

SEQ ID NO: 141051 - RNA, 22 nt, Human
gcuuuacacagcugguucuugu

SEQ ID NO: 141052 - RNA, 19 nt, Human
ggugugugcuggggccugu

SEQ ID NO: 141053 - RNA, 22 nt, Human
ggaggcuccacugcucuuccug

SEQ ID NO: 141054 - RNA, 22 nt, Human
cccuggaggcggagcuugcagu

SEQ ID NO: 141055 - RNA, 22 nt, Human
gagcagcuguccccaaagcuuc

SEQ ID NO: 141056 - RNA, 22 nt, Human
guuaacuuuuuacagaaaugaa

SEQ ID NO: 141057 - RNA, 22 nt, Human
ugguuuugcuccaguauaaaua

SEQ ID NO: 141058 - RNA, 22 nt, Human
uuagcuaaacuguaacuagaau

SEQ ID NO: 141059 - RNA, 22 nt, Human
cugggagcugucaggagcgugu

SEQ ID NO: 141060 - RNA, 22 nt, Human
gaacaguaaauuuaugcagcac

SEQ ID NO: 141061 - RNA, 22 nt, Human
cccaugagguggagguugcagu

SEQ ID NO: 141062 - RNA, 22 nt, Human
aguacuucagaggcugcccagg

SEQ ID NO: 141063 - RNA, 22 nt, Human
cauuaucucuucuauaugcuag

SEQ ID NO: 141064 - RNA, 22 nt, Human
agaacagaggccuuauguuuca

SEQ ID NO: 141065 - RNA, 22 nt, Human
uauugaguuacagaaaauacuu

SEQ ID NO: 141066 - RNA, 22 nt, Human
augaagauaagaccaggcugga

SEQ ID NO: 141067 - RNA, 22 nt, Human
agcaccugcuuaaugugcagug

SEQ ID NO: 141068 - RNA, 18 nt, Human
acagacaaaauggaaaug

SEQ ID NO: 141069 - RNA, 22 nt, Human
auaacagaugugaagugcuaau

SEQ ID NO: 141070 - RNA, 22 nt, Human
gcucaggaaauaguuuaguguu

SEQ ID NO: 141071 - RNA, 22 nt, Human
agggaaggaaaagcugucgcuu

SEQ ID NO: 141072 - RNA, 22 nt, Human
cagugauguuucugcaucagag

SEQ ID NO: 141073 - RNA, 22 nt, Human
ggcagcuccaaaaggaaacacu

SEQ ID NO: 141074 - RNA, 22 nt, Human
ugaagccaucccucagauggcc

SEQ ID NO: 141075 - RNA, 22 nt, Human
uguguguguuucugcucauaca

SEQ ID NO: 141076 - RNA, 22 nt, Human
gggcagcucuggcugugggaag

SEQ ID NO: 141077 - RNA, 22 nt, Human
ccugggcucaagugauccuccu

SEQ ID NO: 141078 - RNA, 22 nt, Human
auucucuuuguauaacaucuug

SEQ ID NO: 141079 - RNA, 22 nt, Human
aguacagaccugucucuuccug

SEQ ID NO: 141080 - RNA, 22 nt, Human
ugcagauucaaaugaaaugcaa

SEQ ID NO: 141081 - RNA, 22 nt, Human
ccagguggaaggucugugcucu

SEQ ID NO: 141082 - RNA, 22 nt, Human
aucaggauggguuuggcuuagg

SEQ ID NO: 141083 - RNA, 22 nt, Human
acagcauaaucacuucuuucuu

SEQ ID NO: 141084 - RNA, 22 nt, Human
uuacagauucaagcucuuugaa

SEQ ID NO: 141085 - RNA, 18 nt, Human
agagcagcggcaucacac

SEQ ID NO: 141086 - RNA, 22 nt, Human
acagaguaggugcugucgacug

SEQ ID NO: 141087 - RNA, 22 nt, Human
caagggugguauugggagcaua

SEQ ID NO: 141088 - RNA, 22 nt, Human
agcagcuggugagcaagcucag

SEQ ID NO: 141089 - RNA, 22 nt, Human
acacacagguaaaggagccugg

SEQ ID NO: 141090 - RNA, 19 nt, Human
agcagagcagggccguggg

SEQ ID NO: 141091 - RNA, 22 nt, Human
ugaaggcuguuggauggggaag

SEQ ID NO: 141092 - RNA, 22 nt, Human
uaaauguggagacucaggaguc

SEQ ID NO: 141093 - RNA, 22 nt, Human
ccugggcaggaugggcccggug

SEQ ID NO: 141094 - RNA, 22 nt, Human
auucacaaaaugauauagauac

SEQ ID NO: 141095 - RNA, 22 nt, Human
ugcagagggacagccacagcuc

SEQ ID NO: 141096 - RNA, 22 nt, Human
ugacucuguaccugucugccuu

SEQ ID NO: 141097 - RNA, 19 nt, Human
ugaaggagggggauggcca

SEQ ID NO: 141098 - RNA, 22 nt, Human
ugcucuguauucuauggcaguu

SEQ ID NO: 141099 - RNA, 22 nt, Human
cugucugucaaguucaucucca

SEQ ID NO: 141100 - RNA, 22 nt, Human
ucagggcagguuaacuugggug

SEQ ID NO: 141101 - RNA, 22 nt, Human
auucuucaaagagugucaaagu

SEQ ID NO: 141102 - RNA, 22 nt, Human
gccccugggagcagagccacca

SEQ ID NO: 141103 - RNA, 18 nt, Human
ugagaggcagguagagga

SEQ ID NO: 141104 - RNA, 22 nt, Human
ugccucagucuaaagucucuca

SEQ ID NO: 141105 - RNA, 22 nt, Human
agcucccagggcugggcaaguu

SEQ ID NO: 141106 - RNA, 22 nt, Human
ucauacauaacuuguacaguga

SEQ ID NO: 141107 - RNA, 22 nt, Human
gagcagugggaaggaacagggu

SEQ ID NO: 141108 - RNA, 22 nt, Human
agugugugcuguuccccggagg

SEQ ID NO: 141109 - RNA, 22 nt, Human
aaagguuugcauggaauuuacc

SEQ ID NO: 141110 - RNA, 22 nt, Human
uggccacagccucugccaguuc

SEQ ID NO: 141111 - RNA, 22 nt, Human
guucuucaucuuaaccaucugu

SEQ ID NO: 141112 - RNA, 22 nt, Human
cacaguggcagguguggguugu

SEQ ID NO: 141113 - RNA, 22 nt, Human
accaggggugucaacagcauuu

SEQ ID NO: 141114 - RNA, 22 nt, Human
agcaggcuuucaagagucuucu

SEQ ID NO: 141115 - RNA, 22 nt, Human
gaccauuuguugaaaagauuau

SEQ ID NO: 141116 - RNA, 21 nt, Human
ugugugggcauaucugcugca

SEQ ID NO: 141117 - RNA, 22 nt, Human
ugaaaaggaguccuuguuuuca

SEQ ID NO: 141118 - RNA, 23 nt, Human
uggccuggagagaaaagaugagu

SEQ ID NO: 141119 - RNA, 20 nt, Human
cccaggagugagcagcuuua

SEQ ID NO: 141120 - RNA, 22 nt, Human
aaucaguuucuuggcaaguuua

SEQ ID NO: 141121 - RNA, 22 nt, Human
ugcaccccauuuuacauuuaca

SEQ ID NO: 141122 - RNA, 22 nt, Human
uuaacauuucuuuuccacucau

SEQ ID NO: 141123 - RNA, 22 nt, Human
uggcugagcucccuguguguug

SEQ ID NO: 141124 - RNA, 22 nt, Human
cguguggucccggcaaggcaag

SEQ ID NO: 141125 - RNA, 22 nt, Human
uuuucugugcccugcuagcugg

SEQ ID NO: 141126 - RNA, 22 nt, Human
uggaugcuguaggacacgcucu

SEQ ID NO: 141127 - RNA, 22 nt, Human
ugggaggagcccucugggaagg

SEQ ID NO: 141128 - RNA, 22 nt, Human
agaaauguacgauguuaugcag

SEQ ID NO: 141129 - RNA, 21 nt, Human
aucagcaaaugccugucuccc

SEQ ID NO: 141130 - RNA, 20 nt, Human
cugggcugcccagcuauggg

SEQ ID NO: 141131 - RNA, 22 nt, Human
ccagggcagccaacccagaugc

SEQ ID NO: 141132 - RNA, 22 nt, Human
ugugugugugcgcgcacgcaua

SEQ ID NO: 141133 - RNA, 22 nt, Human
ggagccuugggcgcucucccau

SEQ ID NO: 141134 - RNA, 22 nt, Human
ucuuagcacagcuauauaaguu

SEQ ID NO: 141135 - RNA, 22 nt, Human
uucacagugugaucuaugggca

SEQ ID NO: 141136 - RNA, 22 nt, Human
gccuguccacuaaacagccaag

SEQ ID NO: 141137 - RNA, 22 nt, Human
cuucuuaaugacagauuaaaau

SEQ ID NO: 141138 - RNA, 22 nt, Human
cccaggagguggagcuugcagu

SEQ ID NO: 141139 - RNA, 22 nt, Human
uuucaguucaguuuauuauauc

SEQ ID NO: 141140 - RNA, 22 nt, Human
ggcugaaggaugaaagcugcag

SEQ ID NO: 141141 - RNA, 21 nt, Human
uggcagaguugaguaguuaug

SEQ ID NO: 141142 - RNA, 22 nt, Human
augaaggcuguguagauggaug

SEQ ID NO: 141143 - RNA, 22 nt, Human
cauguacaguuuuucuguccug

SEQ ID NO: 141144 - RNA, 22 nt, Human
cucagggcaguauggcugagag

SEQ ID NO: 141145 - RNA, 22 nt, Human
guguaucaguaacuguggacag

SEQ ID NO: 141146 - RNA, 21 nt, Human
gcaggguccuuuccauuccua

SEQ ID NO: 141147 - RNA, 22 nt, Human
ugcagucuuccagcugcacaaa

SEQ ID NO: 141148 - RNA, 22 nt, Human
cuguguggacugguugaggccc

SEQ ID NO: 141149 - RNA, 22 nt, Human
agaaaucuaagaugcucaagga

SEQ ID NO: 141150 - RNA, 22 nt, Human
uaccaggcagcugcacagaggc

SEQ ID NO: 141151 - RNA, 22 nt, Human
acagccagaggugguccugggu

SEQ ID NO: 141152 - RNA, 21 nt, Human
ugagccaggcugacggcugug

SEQ ID NO: 141153 - RNA, 22 nt, Human
ucugggggcgaccagggacugc

SEQ ID NO: 141154 - RNA, 22 nt, Human
aggcccuggguuagggcccacu

SEQ ID NO: 141155 - RNA, 22 nt, Human
cagcagccuacaaugcacagaa

SEQ ID NO: 141156 - RNA, 22 nt, Human
ucauaauacaaagaguucugca

SEQ ID NO: 141157 - RNA, 22 nt, Human
aaggcaggaugcggacccaucu

SEQ ID NO: 141158 - RNA, 20 nt, Human
uuaucugucaaucugucuca

SEQ ID NO: 141159 - RNA, 22 nt, Human
ugcagccauuuucugccaaugc

SEQ ID NO: 141160 - RNA, 21 nt, Human
aggaaguggccagauugggaa

SEQ ID NO: 141161 - RNA, 22 nt, Human
uguuaucugagcaacgucgacg

SEQ ID NO: 141162 - RNA, 22 nt, Human
uucagcagucguccaggaaaag

SEQ ID NO: 141163 - RNA, 22 nt, Human
acagaggaaggcugagcugccc

SEQ ID NO: 141164 - RNA, 19 nt, Human
cucuggagcagacacugga

SEQ ID NO: 141165 - RNA, 22 nt, Human
acagagauggcacagagaaggu

SEQ ID NO: 141166 - RNA, 22 nt, Human
aaaagggacuacucucagcucc

SEQ ID NO: 141167 - RNA, 22 nt, Human
cuuucucuucagcacccagccc

SEQ ID NO: 141168 - RNA, 22 nt, Human
accuuucauuaaagucuguagu

SEQ ID NO: 141169 - RNA, 22 nt, Human
aggguggggugcuacaucuuua

SEQ ID NO: 141170 - RNA, 22 nt, Human
caaagaugcugauguuggauca

SEQ ID NO: 141171 - RNA, 22 nt, Human
gccucaggacuggcauacucau

SEQ ID NO: 141172 - RNA, 21 nt, Human
uccuuccuugagguccuuucc

SEQ ID NO: 141173 - RNA, 22 nt, Human
gggaaccagccgcuuccgccuc

SEQ ID NO: 141174 - RNA, 22 nt, Human
agcugggaugauaaccucaguc

SEQ ID NO: 141175 - RNA, 22 nt, Human
ucagugugaggggcuggguccu

SEQ ID NO: 141176 - RNA, 22 nt, Human
agucucugucguagaucagcgu

SEQ ID NO: 141177 - RNA, 22 nt, Human
uuacacaacaucuguauuauua

SEQ ID NO: 141178 - RNA, 22 nt, Human
ccaggagguggagauugcagug

SEQ ID NO: 141179 - RNA, 22 nt, Human
uuuacagucaccaaacuuugcu

SEQ ID NO: 141180 - RNA, 22 nt, Human
aggcagcagggccacuggcuga

SEQ ID NO: 141181 - RNA, 22 nt, Human
ugauuuucaugggugaucuuug

SEQ ID NO: 141182 - RNA, 22 nt, Human
gagauggggucagcugggacau

SEQ ID NO: 141183 - RNA, 22 nt, Human
aggaaaaauaaggcagcagggc

SEQ ID NO: 141184 - RNA, 22 nt, Human
ugcauuguuuagaacucuuugg

SEQ ID NO: 141185 - RNA, 22 nt, Human
ggcuuguggcaaguguuuuaag

SEQ ID NO: 141186 - RNA, 22 nt, Human
uggaagagggagcuggguggcc

SEQ ID NO: 141187 - RNA, 22 nt, Human
ugugugcuaauguaugcucuaa

SEQ ID NO: 141188 - RNA, 22 nt, Human
agccugagugcuuaggacuguu

SEQ ID NO: 141189 - RNA, 19 nt, Human
ugaguguguguuucucuaa

SEQ ID NO: 141190 - RNA, 22 nt, Human
ugaaccaggaggcagccagcac

SEQ ID NO: 141191 - RNA, 22 nt, Human
caguuucuauggcugggcucug

SEQ ID NO: 141192 - RNA, 22 nt, Human
caaugugugcuuacaggccagu

SEQ ID NO: 141193 - RNA, 22 nt, Human
ucuggcuccugaguccaugcuc

SEQ ID NO: 141194 - RNA, 22 nt, Human
uguuacagucauuguuuucuga

SEQ ID NO: 141195 - RNA, 22 nt, Human
cuucaucaacucuaacaaaugu

SEQ ID NO: 141196 - RNA, 22 nt, Human
ccucugcaccauagccuucagc

SEQ ID NO: 141197 - RNA, 22 nt, Human
gaggcaugucuggccuguccca

SEQ ID NO: 141198 - RNA, 22 nt, Human
gugcagcugugugagagcucca

SEQ ID NO: 141199 - RNA, 22 nt, Human
uuccauaacugaccgaaugcau

SEQ ID NO: 141200 - RNA, 22 nt, Human
aacugcauuugcauaaguccau

SEQ ID NO: 141201 - RNA, 19 nt, Human
gcccugcaggagguggggc

SEQ ID NO: 141202 - RNA, 20 nt, Human
uuauuugcucuuuaucugca

SEQ ID NO: 141203 - RNA, 22 nt, Human
uuacuguaugagugugguaguc

SEQ ID NO: 141204 - RNA, 22 nt, Human
caggugggcguggcgagaaggc

SEQ ID NO: 141205 - RNA, 18 nt, Human
ucugucuguguugucuuu

SEQ ID NO: 141206 - RNA, 22 nt, Human
uugcucaggcuuagagcuacua

SEQ ID NO: 141207 - RNA, 21 nt, Human
ugaaaguuggagucaaaugua

SEQ ID NO: 141208 - RNA, 23 nt, Human
uugaaagguagcuggcagcuaga

SEQ ID NO: 141209 - RNA, 21 nt, Human
auuuucauuaauucagugugg

SEQ ID NO: 141210 - RNA, 22 nt, Human
agaccauggccauccuaggaaa

SEQ ID NO: 141211 - RNA, 22 nt, Human
uuuguuuagaaagagauuggug

SEQ ID NO: 141212 - RNA, 22 nt, Human
acagcagagacacucaggaggc

SEQ ID NO: 141213 - RNA, 22 nt, Human
ccugcagguugcagaggcggaa

SEQ ID NO: 141214 - RNA, 22 nt, Human
guguauaacuaucuaucuagua

SEQ ID NO: 141215 - RNA, 22 nt, Human
uuucagauggagguuuaggaca

SEQ ID NO: 141216 - RNA, 22 nt, Human
agcagcaggagccgugggguga

SEQ ID NO: 141217 - RNA, 22 nt, Human
gagcuggcaggaggcuccccga

SEQ ID NO: 141218 - RNA, 22 nt, Human
cugcuuuguggaaucacacugg

SEQ ID NO: 141219 - RNA, 22 nt, Human
uagggcaguuauaacauuagug

SEQ ID NO: 141220 - RNA, 22 nt, Human
uggccacccagcugacgccuuc

SEQ ID NO: 141221 - RNA, 22 nt, Human
agagccagccuucucagcuuac

SEQ ID NO: 141222 - RNA, 22 nt, Human
guuugcauuuauuagucuucug

SEQ ID NO: 141223 - RNA, 22 nt, Human
ugcugucccuaagucucuucaa

SEQ ID NO: 141224 - RNA, 22 nt, Human
ucccagaggacuguuggugcua

SEQ ID NO: 141225 - RNA, 22 nt, Human
cuggcagcaguuaugaaacaau

SEQ ID NO: 141226 - RNA, 22 nt, Human
gaagagcugugauucaggcuua

SEQ ID NO: 141227 - RNA, 22 nt, Human
ggaggccaaggcgggcggauca

SEQ ID NO: 141228 - RNA, 22 nt, Human
ccuggcaggccccuccuggauu

SEQ ID NO: 141229 - RNA, 22 nt, Human
augggcuguccuaguccagccc

SEQ ID NO: 141230 - RNA, 22 nt, Human
uugaagcacaaugucuuuuauc

SEQ ID NO: 141231 - RNA, 18 nt, Human
gcuggcugcacuucugcu

SEQ ID NO: 141232 - RNA, 22 nt, Human
gcuucuggaggagcugggcuga

SEQ ID NO: 141233 - RNA, 23 nt, Human
ccugcagcugcuggggcuccacc

SEQ ID NO: 141234 - RNA, 22 nt, Human
ccugagagcgaguggccucaug

SEQ ID NO: 141235 - RNA, 19 nt, Human
guugaaaguaggugagggu

SEQ ID NO: 141236 - RNA, 22 nt, Human
aaugcuagugugauauguaagg

SEQ ID NO: 141237 - RNA, 22 nt, Human
cguggcuggggaggucagccag

SEQ ID NO: 141238 - RNA, 22 nt, Human
caggccuggcccccggcacacc

SEQ ID NO: 141239 - RNA, 22 nt, Human
gagcuucccucugcagucccug

SEQ ID NO: 141240 - RNA, 22 nt, Human
caugggcuuuggaggcuggagg

SEQ ID NO: 141241 - RNA, 22 nt, Human
cacagggcuuugauggcugagu

SEQ ID NO: 141242 - RNA, 22 nt, Human
uggcauguuugcuugugcauau

SEQ ID NO: 141243 - RNA, 22 nt, Human
gcaaauauucaagacuuuucca

SEQ ID NO: 141244 - RNA, 17 nt, Human
cugaggcccagggccca

SEQ ID NO: 141245 - RNA, 22 nt, Human
gccuaggaguacagaaugguuu

SEQ ID NO: 141246 - RNA, 22 nt, Human
uggcagggugccaguugcgagu

SEQ ID NO: 141247 - RNA, 22 nt, Human
ccuggcacgaagggcugagguu

SEQ ID NO: 141248 - RNA, 22 nt, Human
cugccagcagaggccagcgcug

SEQ ID NO: 141249 - RNA, 22 nt, Human
aggcuguggugcugaaggaggg

SEQ ID NO: 141250 - RNA, 22 nt, Human
aauguguacuuuuucaugcuca

SEQ ID NO: 141251 - RNA, 22 nt, Human
cccauuuaaacacaagcuuuca

SEQ ID NO: 141252 - RNA, 22 nt, Human
cugcccuggucccauggcugau

SEQ ID NO: 141253 - RNA, 22 nt, Human
aagaacauuuuguagaaugaca

SEQ ID NO: 141254 - RNA, 22 nt, Human
acuuugaaggggaacauuuuaa

SEQ ID NO: 141255 - RNA, 22 nt, Human
auguggcuuucugcguuuucuc

SEQ ID NO: 141256 - RNA, 22 nt, Human
uggcuggcaguaggcuaguggc

SEQ ID NO: 141257 - RNA, 22 nt, Human
ggccugagucacaucaggagag

SEQ ID NO: 141258 - RNA, 22 nt, Human
aagugacaaaaggguauccaaa

SEQ ID NO: 141259 - RNA, 22 nt, Human
uaagaauuguguugaauagagu

SEQ ID NO: 141260 - RNA, 22 nt, Human
agugaaaugacugaaucagaua

SEQ ID NO: 141261 - RNA, 22 nt, Human
uucagcaaauggacuguucagg

SEQ ID NO: 141262 - RNA, 22 nt, Human
ccugucucccuggcauggcuca

SEQ ID NO: 141263 - RNA, 23 nt, Human
ugaguucucaucuuggcuucuau

SEQ ID NO: 141264 - RNA, 22 nt, Human
cagcucucacacccuccuccca

SEQ ID NO: 141265 - RNA, 22 nt, Human
gugcgugugccuaucaauaaag

SEQ ID NO: 141266 - RNA, 22 nt, Human
gccaaagcagucuugccucugc

SEQ ID NO: 141267 - RNA, 22 nt, Human
aggcaggggagcuggaagggua

SEQ ID NO: 141268 - RNA, 22 nt, Human
aggccugagguuccugugcuca

SEQ ID NO: 141269 - RNA, 22 nt, Human
uccagggguaccggccaggcag

SEQ ID NO: 141270 - RNA, 22 nt, Human
aagagcuggagcugcuacagga

SEQ ID NO: 141271 - RNA, 22 nt, Human
cauuguuaauugguaucuuaca

SEQ ID NO: 141272 - RNA, 22 nt, Human
cuggagcuccagggucuccucu

SEQ ID NO: 141273 - RNA, 22 nt, Human
auuuacucgugucuccagugcu

SEQ ID NO: 141274 - RNA, 22 nt, Human
ggcccugugguuuugcaaaguc

SEQ ID NO: 141275 - RNA, 22 nt, Human
cauuuguaggaugcuucuuguu

SEQ ID NO: 141276 - RNA, 22 nt, Human
ggcucuggagacauguggagag

SEQ ID NO: 141277 - RNA, 22 nt, Human
ccagcugguuaaaauagagaaa

SEQ ID NO: 141278 - RNA, 19 nt, Human
agacagagcucaguggguu

SEQ ID NO: 141279 - RNA, 22 nt, Human
ucuggagagucacagugccaga

SEQ ID NO: 141280 - RNA, 22 nt, Human
aggcucuguuauucuagagggc

SEQ ID NO: 141281 - RNA, 22 nt, Human
cugagaaggaagccuccacucu

SEQ ID NO: 141282 - RNA, 22 nt, Human
accaggcuggagugcaguggcg

SEQ ID NO: 141283 - RNA, 22 nt, Human
gccucuggucccucaugcugug

SEQ ID NO: 141284 - RNA, 22 nt, Human
guuuuauuggaacacagccaug

SEQ ID NO: 141285 - RNA, 22 nt, Human
gagaugaauguaaacaaaggca

SEQ ID NO: 141286 - RNA, 16 nt, Human
cagaguguaaacagga

SEQ ID NO: 141287 - RNA, 22 nt, Human
ugggcugcacccucagccucug

SEQ ID NO: 141288 - RNA, 22 nt, Human
ucaaucacguguuccauguucu

SEQ ID NO: 141289 - RNA, 17 nt, Human
gagagcugcugcuuccg

SEQ ID NO: 141290 - RNA, 22 nt, Human
uauuucagggagaauaaauuug

SEQ ID NO: 141291 - RNA, 22 nt, Human
gcaggauggugcccuuucugcc

SEQ ID NO: 141292 - RNA, 22 nt, Human
cccagacuccucuggcuggugg

SEQ ID NO: 141293 - RNA, 22 nt, Human
cagaggcugaugugggaugggc

SEQ ID NO: 141294 - RNA, 22 nt, Human
uucuuuaccagugaaauguuau

SEQ ID NO: 141295 - RNA, 22 nt, Human
gugguaaucggauucuuaccgg

SEQ ID NO: 141296 - RNA, 22 nt, Human
guccucugcccaggucaagguu

SEQ ID NO: 141297 - RNA, 22 nt, Human
uuuauuauagugguggggacug

SEQ ID NO: 141298 - RNA, 22 nt, Human
uauuuuacagacuacuuuagau

SEQ ID NO: 141299 - RNA, 22 nt, Human
cagggcucaucugugugaccag

SEQ ID NO: 141300 - RNA, 22 nt, Human
gaguccaguuguucacagaggc

SEQ ID NO: 141301 - RNA, 22 nt, Human
caggccugagacaucugagaua

SEQ ID NO: 141302 - RNA, 21 nt, Human
acagaguaguugaaacagaga

SEQ ID NO: 141303 - RNA, 22 nt, Human
cauuuagacauuugauuugggg

SEQ ID NO: 141304 - RNA, 22 nt, Human
agacuuugagcucuuagagaag

SEQ ID NO: 141305 - RNA, 22 nt, Human
ggaaggucgagcugcaucuggc

SEQ ID NO: 141306 - RNA, 22 nt, Human
aucaggaugacaacugcugggu

SEQ ID NO: 141307 - RNA, 22 nt, Human
cugccagcacugccuccugagg

SEQ ID NO: 141308 - RNA, 22 nt, Human
auacaacagaaaaugauuauuc

SEQ ID NO: 141309 - RNA, 20 nt, Human
acagaauaugcugguugugg

SEQ ID NO: 141310 - RNA, 22 nt, Human
cugaaggagguagagugacaua

SEQ ID NO: 141311 - RNA, 22 nt, Human
ucacaggagggagagacaccca

SEQ ID NO: 141312 - RNA, 22 nt, Human
auggcagcaaaugucuggcugg

SEQ ID NO: 141313 - RNA, 22 nt, Human
uuuuccagauuggacuuagucc

SEQ ID NO: 141314 - RNA, 22 nt, Human
uacaaaguuugggguccucaaa

SEQ ID NO: 141315 - RNA, 22 nt, Human
agaggccaugcuagaggccugg

SEQ ID NO: 141316 - RNA, 22 nt, Human
cccagcaggcauguugggagga

SEQ ID NO: 141317 - RNA, 22 nt, Human
gcagauggacuguaugaccuga

SEQ ID NO: 141318 - RNA, 22 nt, Human
gggccuguguguucaggagccu

SEQ ID NO: 141319 - RNA, 22 nt, Human
aggcccaguagugcugccuuua

SEQ ID NO: 141320 - RNA, 22 nt, Human
auguacauuuagaucauuucug

SEQ ID NO: 141321 - RNA, 22 nt, Human
aggcagaggagaaugaucuucc

SEQ ID NO: 141322 - RNA, 20 nt, Human
aggaaaaggguggugguaga

SEQ ID NO: 141323 - RNA, 22 nt, Human
gccagacacuccccugggcagg

SEQ ID NO: 141324 - RNA, 22 nt, Human
uucugucucuguguuuacauua

SEQ ID NO: 141325 - RNA, 22 nt, Human
ucacugcagagaccucuaguca

SEQ ID NO: 141326 - RNA, 22 nt, Human
gcuuuccuggcccugucccugc

SEQ ID NO: 141327 - RNA, 22 nt, Human
aaucaguuguucacucugaaaa

SEQ ID NO: 141328 - RNA, 22 nt, Human
gcuggagcugaguucccugggc

SEQ ID NO: 141329 - RNA, 22 nt, Human
guaaaugugcuucuuuuaacuu

SEQ ID NO: 141330 - RNA, 22 nt, Human
aauuucaauuacuuuugcacca

SEQ ID NO: 141331 - RNA, 22 nt, Human
agaugcugccucuccucacaag

SEQ ID NO: 141332 - RNA, 22 nt, Human
acagagcuucccagccugagca

SEQ ID NO: 141333 - RNA, 22 nt, Human
cuggagccuucaccaggggaaa

SEQ ID NO: 141334 - RNA, 22 nt, Human
aggagaguaccauugggccgca

SEQ ID NO: 141335 - RNA, 22 nt, Human
ugagccugaguucaaggcugca

SEQ ID NO: 141336 - RNA, 23 nt, Human
uccagcagagccuuccaggaggg

SEQ ID NO: 141337 - RNA, 22 nt, Human
ggagagagaugccgccuugcuc

SEQ ID NO: 141338 - RNA, 22 nt, Human
auauauuuuuugagacagaguc

SEQ ID NO: 141339 - RNA, 21 nt, Human
aguucauacugaguaacaaaa

SEQ ID NO: 141340 - RNA, 22 nt, Human
gccuggagggcucuagagaggc

SEQ ID NO: 141341 - RNA, 22 nt, Human
agcugugugugcuugggauuau

SEQ ID NO: 141342 - RNA, 22 nt, Human
cuugccuucuuuuccuauagaa

SEQ ID NO: 141343 - RNA, 22 nt, Human
ccuuucucauuuuaagcauuag

SEQ ID NO: 141344 - RNA, 22 nt, Human
agggagagguugaaaccucagu

SEQ ID NO: 141345 - RNA, 15 nt, Human
aaucuggcggcaagu

SEQ ID NO: 141346 - RNA, 22 nt, Human
acauuaucccuggcacaacugc

SEQ ID NO: 141347 - RNA, 22 nt, Human
aggagcugggcugcugcuggga

SEQ ID NO: 141348 - RNA, 22 nt, Human
uaacaguauccccauuugcaag

SEQ ID NO: 141349 - RNA, 22 nt, Human
ccucaggaaccacauugcugcu

SEQ ID NO: 141350 - RNA, 22 nt, Human
agggcagcacaaggcauggacu

SEQ ID NO: 141351 - RNA, 21 nt, Human
uuccagagauuguuucaccug

SEQ ID NO: 141352 - RNA, 19 nt, Human
uuucucucccucaucccga

SEQ ID NO: 141353 - RNA, 22 nt, Human
uguaccuuuuucugugcaugcu

SEQ ID NO: 141354 - RNA, 19 nt, Human
uugcauuguaguuggacug

SEQ ID NO: 141355 - RNA, 22 nt, Human
aaaaacuguaauuacuuuugca

SEQ ID NO: 141356 - RNA, 22 nt, Human
agcugcagauucuaucuagaag

SEQ ID NO: 141357 - RNA, 22 nt, Human
guggcccugucccaggccuccu

SEQ ID NO: 141358 - RNA, 22 nt, Human
ggcugccugaacuuuggggaaa

SEQ ID NO: 141359 - RNA, 22 nt, Human
uuucacaguagaaaucauuaug

SEQ ID NO: 141360 - RNA, 22 nt, Human
cagacagaaggcuccuugaggu

SEQ ID NO: 141361 - RNA, 22 nt, Human
agcaggugacagggcuguggug

SEQ ID NO: 141362 - RNA, 22 nt, Human
aagauuucagaguuugggggaa

SEQ ID NO: 141363 - RNA, 22 nt, Human
ugcagaccucccauggcugccu

SEQ ID NO: 141364 - RNA, 21 nt, Human
cuuuuacauucagucaugaug

SEQ ID NO: 141365 - RNA, 22 nt, Human
aaaguguugauaugugacaucc

SEQ ID NO: 141366 - RNA, 22 nt, Human
cugacucuccucaagcauaaau

SEQ ID NO: 141367 - RNA, 22 nt, Human
aucuggcucgcuaggcucuggg

SEQ ID NO: 141368 - RNA, 23 nt, Human
acagagguccaaacaguauaagc

SEQ ID NO: 141369 - RNA, 22 nt, Human
ccagcugcaggggagcagugga

SEQ ID NO: 141370 - RNA, 22 nt, Human
aaauuuaagaagugugugcgug

SEQ ID NO: 141371 - RNA, 21 nt, Human
gccaccucgucucggagcagc

SEQ ID NO: 141372 - RNA, 22 nt, Human
cccagccucagcuuuacuucca

SEQ ID NO: 141373 - RNA, 20 nt, Human
aagcagaagcugcucucagc

SEQ ID NO: 141374 - RNA, 22 nt, Human
agaagcugacagaugcagcagg

SEQ ID NO: 141375 - RNA, 22 nt, Human
aaggcagcccuggcucagccug

SEQ ID NO: 141376 - RNA, 22 nt, Human
cugaggcugcccagggccaggu

SEQ ID NO: 141377 - RNA, 22 nt, Human
gcugucacucuccggccuuccc

SEQ ID NO: 141378 - RNA, 22 nt, Human
agaggccaucugcucugugggg

SEQ ID NO: 141379 - RNA, 22 nt, Human
caguggcgugaucucugcucac

SEQ ID NO: 141380 - RNA, 22 nt, Human
ucucagagcucacaccuccugg

SEQ ID NO: 141381 - RNA, 22 nt, Human
gcagggacaucuuugucuagua

SEQ ID NO: 141382 - RNA, 21 nt, Human
uacuguauagauguguucuug

SEQ ID NO: 141383 - RNA, 22 nt, Human
cuucuaggcuucucagggggca

SEQ ID NO: 141384 - RNA, 22 nt, Human
uguacaauagcuauuaucucca

SEQ ID NO: 141385 - RNA, 22 nt, Human
aguguguacauuuggugcaguu

SEQ ID NO: 141386 - RNA, 22 nt, Human
acaggggcuccgaaggugaggg

SEQ ID NO: 141387 - RNA, 22 nt, Human
agccccaggcccggacgccucu

SEQ ID NO: 141388 - RNA, 22 nt, Human
uaauuauucuagucacauagca

SEQ ID NO: 141389 - RNA, 22 nt, Human
ccugcugugaaacuggcauaug

SEQ ID NO: 141390 - RNA, 22 nt, Human
caguucuuaauaccaugugguu

SEQ ID NO: 141391 - RNA, 22 nt, Human
gcaaggcugcugccacccaucu

SEQ ID NO: 141392 - RNA, 22 nt, Human
guggauggacaugggcaagagg

SEQ ID NO: 141393 - RNA, 22 nt, Human
gcugccaguaguuggagcucca

SEQ ID NO: 141394 - RNA, 22 nt, Human
acaacauuauacauagaaagcu

SEQ ID NO: 141395 - RNA, 22 nt, Human
ccccuuccaggaagcagaaucg

SEQ ID NO: 141396 - RNA, 22 nt, Human
uuucaaauaccauaaaccuaau

SEQ ID NO: 141397 - RNA, 22 nt, Human
cugccgagugggucaugaggca

SEQ ID NO: 141398 - RNA, 22 nt, Human
agguggagaagagaugggcagu

SEQ ID NO: 141399 - RNA, 23 nt, Human
uguggcugagaaauugacaacuu

SEQ ID NO: 141400 - RNA, 22 nt, Human
ccuggcagguggcgcccucggc

SEQ ID NO: 141401 - RNA, 22 nt, Human
uggcagggaauacagauguuua

SEQ ID NO: 141402 - RNA, 22 nt, Human
gggcucugguacuuccuggcuc

SEQ ID NO: 141403 - RNA, 22 nt, Human
cuuaacagauacaucugugguu

SEQ ID NO: 141404 - RNA, 22 nt, Human
cgucccaguuccagccgcgcug

SEQ ID NO: 141405 - RNA, 22 nt, Human
auguccuucuccucuuaccugc

SEQ ID NO: 141406 - RNA, 22 nt, Human
uaaggccagcaugaaugcagca

SEQ ID NO: 141407 - RNA, 22 nt, Human
uauguuuuucaagugcacacua

SEQ ID NO: 141408 - RNA, 22 nt, Human
cuggccucaccucagacuuacu

SEQ ID NO: 141409 - RNA, 22 nt, Human
uguuccaugucuuuguaggacu

SEQ ID NO: 141410 - RNA, 17 nt, Human
cuuuuaauuuacuuccc

SEQ ID NO: 141411 - RNA, 22 nt, Human
aguggcagagguugacugcagu

SEQ ID NO: 141412 - RNA, 22 nt, Human
agagaugucgccuugcccaggg

SEQ ID NO: 141413 - RNA, 21 nt, Human
agcuuguguguaucacagugu

SEQ ID NO: 141414 - RNA, 22 nt, Human
agccaggauggucucgaucggc

SEQ ID NO: 141415 - RNA, 22 nt, Human
agccccugggaguagcugcugc

SEQ ID NO: 141416 - RNA, 22 nt, Human
aggagcccugcgggaggcagag

SEQ ID NO: 141417 - RNA, 22 nt, Human
ggcugugauugguggaugugaa

SEQ ID NO: 141418 - RNA, 22 nt, Human
ggucccagcuggucacugucag

SEQ ID NO: 141419 - RNA, 22 nt, Human
ugugugugcacaugcauauaca

SEQ ID NO: 141420 - RNA, 22 nt, Human
gcagcuggagcaucuucucauc

SEQ ID NO: 141421 - RNA, 17 nt, Human
cccagagaugcugccuu

SEQ ID NO: 141422 - RNA, 22 nt, Human
cagagcaguaaaucuggggcac

SEQ ID NO: 141423 - RNA, 22 nt, Human
gcugggaggaucucucccuguc

SEQ ID NO: 141424 - RNA, 23 nt, Human
ucuuuccucagcacacaccaaga

SEQ ID NO: 141425 - RNA, 22 nt, Human
agcugccaccucugccuuuggg

SEQ ID NO: 141426 - RNA, 22 nt, Human
uucaagauccagcacaacagug

SEQ ID NO: 141427 - RNA, 22 nt, Human
cuguggcucuuuaguugagcac

SEQ ID NO: 141428 - RNA, 22 nt, Human
gagugugucggucagcguggcg

SEQ ID NO: 141429 - RNA, 22 nt, Human
agcagaaccugcagaccugucu

SEQ ID NO: 141430 - RNA, 22 nt, Human
ucuagaaacaugacauugaucu

SEQ ID NO: 141431 - RNA, 22 nt, Human
caagaaauuucuuaagaacuaa

SEQ ID NO: 141432 - RNA, 22 nt, Human
uuggccuucccuaccugggcca

SEQ ID NO: 141433 - RNA, 22 nt, Human
cauuuguuuagaagucuuuaua

SEQ ID NO: 141434 - RNA, 22 nt, Human
cagaccagaaggaagccgacaa

SEQ ID NO: 141435 - RNA, 22 nt, Human
cagaguguuagcgcugguuggg

SEQ ID NO: 141436 - RNA, 22 nt, Human
aaguuacaggagaaagagauca

SEQ ID NO: 141437 - RNA, 22 nt, Human
ccagcuccccucagcagguaau

SEQ ID NO: 141438 - RNA, 22 nt, Human
caaaugcuaacuucuuuccaaa

SEQ ID NO: 141439 - RNA, 19 nt, Human
ucauucaggaccaguggau

SEQ ID NO: 141440 - RNA, 22 nt, Human
uacaaguagcucagguuuucug

SEQ ID NO: 141441 - RNA, 22 nt, Human
gcugcagcuuuaggauccagug

SEQ ID NO: 141442 - RNA, 22 nt, Human
agcagggccucuggcacugguc

SEQ ID NO: 141443 - RNA, 22 nt, Human
ggcaggguggcccuccagugag

SEQ ID NO: 141444 - RNA, 20 nt, Human
gugcuucagaagccauugcu

SEQ ID NO: 141445 - RNA, 22 nt, Human
ugaagccaucaggaagccagca

SEQ ID NO: 141446 - RNA, 22 nt, Human
agggccugcaucaggagcuugg

SEQ ID NO: 141447 - RNA, 22 nt, Human
ggcugccagugagugcagaccg

SEQ ID NO: 141448 - RNA, 22 nt, Human
gcucucuggguggugggcaaca

SEQ ID NO: 141449 - RNA, 22 nt, Human
aguguaugaacuuaagagagag

SEQ ID NO: 141450 - RNA, 22 nt, Human
aguauguagugcaaucagucag

SEQ ID NO: 141451 - RNA, 22 nt, Human
ccuccagguguuacauaugacu

SEQ ID NO: 141452 - RNA, 22 nt, Human
gccuucugauaucucuuggcau

SEQ ID NO: 141453 - RNA, 22 nt, Human
aaaguuugagugauuugacaca

SEQ ID NO: 141454 - RNA, 22 nt, Human
aaauguguuuagaugguuuauu

SEQ ID NO: 141455 - RNA, 21 nt, Human
cuccugggcuaagauauagug

SEQ ID NO: 141456 - RNA, 22 nt, Human
gcuggccugcgagggcaggcug

SEQ ID NO: 141457 - RNA, 22 nt, Human
aaaggccacacagagcagggag

SEQ ID NO: 141458 - RNA, 22 nt, Human
aucaggauuacacggggaugcu

SEQ ID NO: 141459 - RNA, 22 nt, Human
cugagcugggcucucuugaggg

SEQ ID NO: 141460 - RNA, 21 nt, Human
auacuuugaauuacagccuug

SEQ ID NO: 141461 - RNA, 22 nt, Human
cacagcuucugagugaggauuu

SEQ ID NO: 141462 - RNA, 22 nt, Human
ggcagccuccagggcacuggug

SEQ ID NO: 141463 - RNA, 22 nt, Human
gcagccuguuguaccagccugu

SEQ ID NO: 141464 - RNA, 22 nt, Human
caaaugcagucccuuuguugcu

SEQ ID NO: 141465 - RNA, 22 nt, Human
acagggucauuuuaugaucugu

SEQ ID NO: 141466 - RNA, 22 nt, Human
gacagcauggugucuguucagg

SEQ ID NO: 141467 - RNA, 22 nt, Human
gccucugccaagggggcugcgg

SEQ ID NO: 141468 - RNA, 22 nt, Human
ucugucugacaggguaugaacu

SEQ ID NO: 141469 - RNA, 19 nt, Human
gcauuucucuuuacagcca

SEQ ID NO: 141470 - RNA, 22 nt, Human
agucccagcuacucaagaggcu

SEQ ID NO: 141471 - RNA, 22 nt, Human
uauuucuuucagguauguguug

SEQ ID NO: 141472 - RNA, 22 nt, Human
aacucaguuacauauuagaaua

SEQ ID NO: 141473 - RNA, 22 nt, Human
uuuaaauaggacuccugggggu

SEQ ID NO: 141474 - RNA, 22 nt, Human
agagcuggccagggaucacucu

SEQ ID NO: 141475 - RNA, 18 nt, Human
ugagagugugugcucuug

SEQ ID NO: 141476 - RNA, 22 nt, Human
accugagaaugggggcaugugu

SEQ ID NO: 141477 - RNA, 22 nt, Human
guugacagcuggugagcugcua

SEQ ID NO: 141478 - RNA, 22 nt, Human
aacucaguucuuuccacaaugc

SEQ ID NO: 141479 - RNA, 22 nt, Human
auguccuuugcuucucuggucc

SEQ ID NO: 141480 - RNA, 22 nt, Human
ggcuguccuuggccaaggcacu

SEQ ID NO: 141481 - RNA, 22 nt, Human
uguggcugugccgucacacgug

SEQ ID NO: 141482 - RNA, 19 nt, Human
cuguccuuggcugcacugu

SEQ ID NO: 141483 - RNA, 22 nt, Human
gggcugcuuuuuucuuagcaga

SEQ ID NO: 141484 - RNA, 22 nt, Human
agcucccagaguccucugccca

SEQ ID NO: 141485 - RNA, 22 nt, Human
cugagccacugcuuguucagug

SEQ ID NO: 141486 - RNA, 21 nt, Human
ugcagcagaguaagcagggga

SEQ ID NO: 141487 - RNA, 22 nt, Human
gcuguguugggaaucauguggg

SEQ ID NO: 141488 - RNA, 22 nt, Human
gggcugcuguagagaacauguu

SEQ ID NO: 141489 - RNA, 22 nt, Human
ggcagcuccuccuagucugccc

SEQ ID NO: 141490 - RNA, 22 nt, Human
uggccaggggaguuccccucca

SEQ ID NO: 141491 - RNA, 22 nt, Human
aaaucacuaaguuauagugugg

SEQ ID NO: 141492 - RNA, 22 nt, Human
uugcauugcuuggucuucaaga

SEQ ID NO: 141493 - RNA, 22 nt, Human
agugguaacuaaguccugcuua

SEQ ID NO: 141494 - RNA, 22 nt, Human
agcagcauggaugggccucagc

SEQ ID NO: 141495 - RNA, 22 nt, Human
caaggccaugagcagcgagugu

SEQ ID NO: 141496 - RNA, 22 nt, Human
gaggagcuggcagcgucuccgc

SEQ ID NO: 141497 - RNA, 22 nt, Human
uggccugcccagagcagcucug

SEQ ID NO: 141498 - RNA, 22 nt, Human
uuggcugagagaggaaaagggc

SEQ ID NO: 141499 - RNA, 22 nt, Human
uguguuuugaacucaucuacug

SEQ ID NO: 141500 - RNA, 22 nt, Human
aaucuguuuaguucugcguaug

SEQ ID NO: 141501 - RNA, 22 nt, Human
uuuacgagugcuaaugauauug

SEQ ID NO: 141502 - RNA, 22 nt, Human
cuaaaugccuuuccuaccuaac

SEQ ID NO: 141503 - RNA, 22 nt, Human
aagggccauaacuugcaguguu

SEQ ID NO: 141504 - RNA, 22 nt, Human
ucucagagaggggccgggccuu

SEQ ID NO: 141505 - RNA, 20 nt, Human
cguaaggcaagugcugcauc

SEQ ID NO: 141506 - RNA, 22 nt, Human
ugauuucccucaucauaacaga

SEQ ID NO: 141507 - RNA, 22 nt, Human
agcaggaggguuuuguagaguc

SEQ ID NO: 141508 - RNA, 22 nt, Human
gacucagugauuugacaugccu

SEQ ID NO: 141509 - RNA, 22 nt, Human
caaauacuggguaaguuaauuu

SEQ ID NO: 141510 - RNA, 23 nt, Human
gcagaggagcaagcuggacacca

SEQ ID NO: 141511 - RNA, 22 nt, Human
ggcugcuggcagauguaguuua

SEQ ID NO: 141512 - RNA, 22 nt, Human
cacugaagccugggaguaagac

SEQ ID NO: 141513 - RNA, 22 nt, Human
gccuuggccuuccuaggccuga

SEQ ID NO: 141514 - RNA, 22 nt, Human
agaccaagacuauaaugagagg

SEQ ID NO: 141515 - RNA, 22 nt, Human
ugucacagggauaccauggggc

SEQ ID NO: 141516 - RNA, 22 nt, Human
gcccagcaccucucucaggguu

SEQ ID NO: 141517 - RNA, 22 nt, Human
ugccucuguugagccuuggcug

SEQ ID NO: 141518 - RNA, 22 nt, Human
ccaggagcauuaagagaacaua

SEQ ID NO: 141519 - RNA, 22 nt, Human
gccuggagacagcagaggcggc

SEQ ID NO: 141520 - RNA, 22 nt, Human
ugucccaggcugaaguacagug

SEQ ID NO: 141521 - RNA, 22 nt, Human
ugucucuccacacagccagugc

SEQ ID NO: 141522 - RNA, 22 nt, Human
gcugccugaagugucuacacug

SEQ ID NO: 141523 - RNA, 22 nt, Human
gucccuggaucugggacagcug

SEQ ID NO: 141524 - RNA, 22 nt, Human
ggccagggggcuucagacucca

SEQ ID NO: 141525 - RNA, 22 nt, Human
ccagagccucgcccggagccuc

SEQ ID NO: 141526 - RNA, 22 nt, Human
ccucccacuucuugcugagguc

SEQ ID NO: 141527 - RNA, 22 nt, Human
caagaugugccuaaucagaccu

SEQ ID NO: 141528 - RNA, 22 nt, Human
gggugcugacuggggccugaaa

SEQ ID NO: 141529 - RNA, 22 nt, Human
uuuuagaaauacugauuuagug

SEQ ID NO: 141530 - RNA, 22 nt, Human
uggcugcucaagggaggaggcu

SEQ ID NO: 141531 - RNA, 22 nt, Human
gccugggagugcacagugaggu

SEQ ID NO: 141532 - RNA, 22 nt, Human
uugcauugaucccagcuugggc

SEQ ID NO: 141533 - RNA, 22 nt, Human
gagcagggagacaacucuggug

SEQ ID NO: 141534 - RNA, 22 nt, Human
cccagcuccgagcuccgagccg

SEQ ID NO: 141535 - RNA, 22 nt, Human
cuggggcucucuggaaugcuug

SEQ ID NO: 141536 - RNA, 22 nt, Human
cuacauuuguucuauagcuuuu

SEQ ID NO: 141537 - RNA, 18 nt, Human
acucaggaaaugaugaca

SEQ ID NO: 141538 - RNA, 22 nt, Human
ggccagaggugguacauagcuu

SEQ ID NO: 141539 - RNA, 22 nt, Human
agaaaagguugaaaguaggauu

SEQ ID NO: 141540 - RNA, 22 nt, Human
uuuacagggaauauuuuggcuu

SEQ ID NO: 141541 - RNA, 22 nt, Human
ucagcaggcgguuccuuguggg

SEQ ID NO: 141542 - RNA, 22 nt, Human
ccucugaguccucccugguugc

SEQ ID NO: 141543 - RNA, 22 nt, Human
ugggccuguugccugaguccau

SEQ ID NO: 141544 - RNA, 22 nt, Human
ugagagagccugaaucucuuac

SEQ ID NO: 141545 - RNA, 23 nt, Human
cuggcucauccugguugcagugg

SEQ ID NO: 141546 - RNA, 22 nt, Human
gcuggagguuucaccugaguuu

SEQ ID NO: 141547 - RNA, 22 nt, Human
aaugaugggaaggagaaaagca

SEQ ID NO: 141548 - RNA, 22 nt, Human
gcaguggggaaugcuggggaga

SEQ ID NO: 141549 - RNA, 22 nt, Human
cauucauuuacuuucaacagcu

SEQ ID NO: 141550 - RNA, 22 nt, Human
acauugaugaaaagguaucauu

SEQ ID NO: 141551 - RNA, 22 nt, Human
ugcagugguguccagguguacu

SEQ ID NO: 141552 - RNA, 22 nt, Human
ccagcagcuuuauuggcucucc

SEQ ID NO: 141553 - RNA, 22 nt, Human
aaacaugagcaucucuucaagc

SEQ ID NO: 141554 - RNA, 22 nt, Human
ggccugaggcaauagucagaca

SEQ ID NO: 141555 - RNA, 22 nt, Human
gcugugugaccugggcaagucu

SEQ ID NO: 141556 - RNA, 22 nt, Human
ggagccuggccuggcucugugu

SEQ ID NO: 141557 - RNA, 22 nt, Human
uagcagcuuaaguaauuagaau

SEQ ID NO: 141558 - RNA, 22 nt, Human
cccagcucuuuuagcggcaucu

SEQ ID NO: 141559 - RNA, 22 nt, Human
ccauaagguugaaaacuguaca

SEQ ID NO: 141560 - RNA, 22 nt, Human
gugugauaacagggcaugacgg

SEQ ID NO: 141561 - RNA, 22 nt, Human
aaguuucauguggagguagacu

SEQ ID NO: 141562 - RNA, 22 nt, Human
aaggcacugagccagccgucuc

SEQ ID NO: 141563 - RNA, 23 nt, Human
cacaccaggagccgucugggcca

SEQ ID NO: 141564 - RNA, 22 nt, Human
caggcugggcagccuccccggc

SEQ ID NO: 141565 - RNA, 22 nt, Human
guggcuucacauggcauuuggc

SEQ ID NO: 141566 - RNA, 22 nt, Human
acauuucuucccuuuagcagaa

SEQ ID NO: 141567 - RNA, 21 nt, Human
uggcugccuacaugcugcagg

SEQ ID NO: 141568 - RNA, 22 nt, Human
aagggcaggcacccacccucac

SEQ ID NO: 141569 - RNA, 22 nt, Human
ccuggagcucacugggagccgg

SEQ ID NO: 141570 - RNA, 22 nt, Human
cugcucugcagcuuggacuccc

SEQ ID NO: 141571 - RNA, 22 nt, Human
cagguggcaugacugccuacaa

SEQ ID NO: 141572 - RNA, 22 nt, Human
gcuguguuggugaagcuguagc

SEQ ID NO: 141573 - RNA, 22 nt, Human
agggcagcucucaccucuggcc

SEQ ID NO: 141574 - RNA, 22 nt, Human
uuugucagucaugucugcuuuu

SEQ ID NO: 141575 - RNA, 22 nt, Human
acagagcacauagauuggaguu

SEQ ID NO: 141576 - RNA, 22 nt, Human
gggcagcagagcccugccgagu

SEQ ID NO: 141577 - RNA, 22 nt, Human
gcaugucaugucauguaggaau

SEQ ID NO: 141578 - RNA, 22 nt, Human
cucuguguauccaaguucaggu

SEQ ID NO: 141579 - RNA, 22 nt, Human
cagagguaccagcagccucugg

SEQ ID NO: 141580 - RNA, 22 nt, Human
gagacagaguuucacucuuguu

SEQ ID NO: 141581 - RNA, 22 nt, Human
ggacagaggguugacagaguau

SEQ ID NO: 141582 - RNA, 22 nt, Human
agcugugugacucuaagcaagu

SEQ ID NO: 141583 - RNA, 17 nt, Human
agugugugaaauggugg

SEQ ID NO: 141584 - RNA, 22 nt, Human
cagcagugcuucagugugagau

SEQ ID NO: 141585 - RNA, 22 nt, Human
ucccagagacaucauuucuccg

SEQ ID NO: 141586 - RNA, 21 nt, Human
gcucuuggaaggggcucagcu

SEQ ID NO: 141587 - RNA, 19 nt, Human
ugggccugcaucugggucu

SEQ ID NO: 141588 - RNA, 19 nt, Human
uuuagcuuacguuucauug

SEQ ID NO: 141589 - RNA, 22 nt, Human
auuguaucuugucauuaugcau

SEQ ID NO: 141590 - RNA, 22 nt, Human
ugucagugaguuaguugcaagu

SEQ ID NO: 141591 - RNA, 22 nt, Human
caaggcaggcaguucacuugag

SEQ ID NO: 141592 - RNA, 22 nt, Human
gcuggccauauauuuugcuguu

SEQ ID NO: 141593 - RNA, 22 nt, Human
agggcagagaucugagugggca

SEQ ID NO: 141594 - RNA, 22 nt, Human
uaugcgugccucugucugucug

SEQ ID NO: 141595 - RNA, 22 nt, Human
ggccucuguucugcauuccucc

SEQ ID NO: 141596 - RNA, 22 nt, Human
ggccugcucugcagccucuaca

SEQ ID NO: 141597 - RNA, 22 nt, Human
agagauucauguuuacuguagg

SEQ ID NO: 141598 - RNA, 19 nt, Human
uagaaugcccacuuaaaaa

SEQ ID NO: 141599 - RNA, 22 nt, Human
uggcccugcagaacuagccugg

SEQ ID NO: 141600 - RNA, 22 nt, Human
aucauuuuauggcugagaggac

SEQ ID NO: 141601 - RNA, 21 nt, Human
acagucuccccagaucucucc

SEQ ID NO: 141602 - RNA, 22 nt, Human
cuuguggcccauggcuuccugc

SEQ ID NO: 141603 - RNA, 22 nt, Human
ucacuugccuagcccaguucag

SEQ ID NO: 141604 - RNA, 20 nt, Human
acaaaugcauucugugacau

SEQ ID NO: 141605 - RNA, 19 nt, Human
agacacacuugauaugugu

SEQ ID NO: 141606 - RNA, 22 nt, Human
gccucuggggcagcugagucau

SEQ ID NO: 141607 - RNA, 23 nt, Human
aaguaacagggauaauagcaguu

SEQ ID NO: 141608 - RNA, 22 nt, Human
aucagcaaucucguguauuagg

SEQ ID NO: 141609 - RNA, 23 nt, Human
auguuauuauuagcagucuugcc

SEQ ID NO: 141610 - RNA, 23 nt, Human
acagcugcaccuggccgccuggc

SEQ ID NO: 141611 - RNA, 22 nt, Human
ggugaguugggguucacagguc

SEQ ID NO: 141612 - RNA, 20 nt, Human
gcagcugaaaguaugacacc

SEQ ID NO: 141613 - RNA, 22 nt, Human
uucuuuacaguggguuuugaau

SEQ ID NO: 141614 - RNA, 22 nt, Human
augaagcugguuuuggcuuggg

SEQ ID NO: 141615 - RNA, 20 nt, Human
cuguggaauuuuaccaugcg

SEQ ID NO: 141616 - RNA, 22 nt, Human
uacuuuuugucucuuugaaugu

SEQ ID NO: 141617 - RNA, 23 nt, Human
gggcugcuccaggccaaggcugg

SEQ ID NO: 141618 - RNA, 22 nt, Human
acugagcugcaagucagggagg

SEQ ID NO: 141619 - RNA, 19 nt, Human
agccagggugagaaggagc

SEQ ID NO: 141620 - RNA, 22 nt, Human
cucugagaggugagaagcagca

SEQ ID NO: 141621 - RNA, 22 nt, Human
auguggcuaguccucugcggca

SEQ ID NO: 141622 - RNA, 22 nt, Human
acagagaaagugggcugaagau

SEQ ID NO: 141623 - RNA, 20 nt, Human
cuccagggaacagacuggag

SEQ ID NO: 141624 - RNA, 22 nt, Human
aggagccuccuucucaugugca

SEQ ID NO: 141625 - RNA, 22 nt, Human
auaucuucuuuauuuugugagg

SEQ ID NO: 141626 - RNA, 22 nt, Human
ucuggcucuauaacuccuagcu

SEQ ID NO: 141627 - RNA, 22 nt, Human
guuccuauauagccuuaaggau

SEQ ID NO: 141628 - RNA, 22 nt, Human
gcuguguccucacacagccuuu

SEQ ID NO: 141629 - RNA, 22 nt, Human
ggcaggcuggcuuuguuccagg

SEQ ID NO: 141630 - RNA, 22 nt, Human
ggggccugcgagguucaacuuc

SEQ ID NO: 141631 - RNA, 22 nt, Human
ggguccagaguugaagagguua

SEQ ID NO: 141632 - RNA, 22 nt, Human
caggauccccaggucgccgucc

SEQ ID NO: 141633 - RNA, 22 nt, Human
cacucugacuggcccugcagga

SEQ ID NO: 141634 - RNA, 22 nt, Human
ggcucugcagugacuugagggg

SEQ ID NO: 141635 - RNA, 22 nt, Human
uggaaggggagcuggaaagggg

SEQ ID NO: 141636 - RNA, 22 nt, Human
caggugcugcguggcggagcug

SEQ ID NO: 141637 - RNA, 22 nt, Human
aguggcuguccuggcucuaacu

SEQ ID NO: 141638 - RNA, 22 nt, Human
aucuggcucacuuagucuagga

SEQ ID NO: 141639 - RNA, 22 nt, Human
aguuuuuccugauuuuacagaa

SEQ ID NO: 141640 - RNA, 22 nt, Human
cugugcuggcagaccuggaguu

SEQ ID NO: 141641 - RNA, 22 nt, Human
guccucugaaguugugcaaugc

SEQ ID NO: 141642 - RNA, 22 nt, Human
uagacuuuccagccugcugcuu

SEQ ID NO: 141643 - RNA, 22 nt, Human
uccucugcuccaggcuggacuu

SEQ ID NO: 141644 - RNA, 22 nt, Human
acagguggccccgagggagugg

SEQ ID NO: 141645 - RNA, 22 nt, Human
gagacacaggugguuccuguca

SEQ ID NO: 141646 - RNA, 22 nt, Human
agugaccauuuucagcuagagg

SEQ ID NO: 141647 - RNA, 19 nt, Human
auucucugguuugcuggcu

SEQ ID NO: 141648 - RNA, 22 nt, Human
ggcugcucugccuuccagcugg

SEQ ID NO: 141649 - RNA, 22 nt, Human
aagccaggcaugcuuggacagu

SEQ ID NO: 141650 - RNA, 18 nt, Human
cagauccaggcagcuauu

SEQ ID NO: 141651 - RNA, 22 nt, Human
ccuuuacaguaugguuguauca

SEQ ID NO: 141652 - RNA, 22 nt, Human
uacauugugauguuucaauaca

SEQ ID NO: 141653 - RNA, 19 nt, Human
ugcucauggggacuucucc

SEQ ID NO: 141654 - RNA, 21 nt, Human
ucacaugcccauuacuggagc

SEQ ID NO: 141655 - RNA, 22 nt, Human
gggcacagaagucuaagacauc

SEQ ID NO: 141656 - RNA, 22 nt, Human
ucugggcacugcugagccugua

SEQ ID NO: 141657 - RNA, 22 nt, Human
auguguaggugaaucgaggcug

SEQ ID NO: 141658 - RNA, 22 nt, Human
gcaggagcagucaggggcagcu

SEQ ID NO: 141659 - RNA, 22 nt, Human
uaaaugugcacagguuagaagg

SEQ ID NO: 141660 - RNA, 22 nt, Human
ucaccaggcuggaaugcagugg

SEQ ID NO: 141661 - RNA, 22 nt, Human
uggcucagagccuugagagcug

SEQ ID NO: 141662 - RNA, 22 nt, Human
uuagaaagcuuuccauagucaa

SEQ ID NO: 141663 - RNA, 22 nt, Human
aguaggaggcgggagcaugaag

SEQ ID NO: 141664 - RNA, 22 nt, Human
aucuacagugcacaggacagcc

SEQ ID NO: 141665 - RNA, 22 nt, Human
gcuuccuagaucugugguacuc

SEQ ID NO: 141666 - RNA, 22 nt, Human
uucucucugugucauuauggac

SEQ ID NO: 141667 - RNA, 22 nt, Human
aaguaacaaugcuguugaauug

SEQ ID NO: 141668 - RNA, 22 nt, Human
uggcucaggauaauuuucccaa

SEQ ID NO: 141669 - RNA, 22 nt, Human
auagauacauuagguaacuugu

SEQ ID NO: 141670 - RNA, 23 nt, Human
gagcugggauacaggcuuacugc

SEQ ID NO: 141671 - RNA, 22 nt, Human
uggcugugugccaggcugucug

SEQ ID NO: 141672 - RNA, 23 nt, Human
ccaaagucgaagucuaguccaga

SEQ ID NO: 141673 - RNA, 22 nt, Human
cucagagucccuucccucgugg

SEQ ID NO: 141674 - RNA, 21 nt, Human
cagcaaaucauugggcagacu

SEQ ID NO: 141675 - RNA, 17 nt, Human
cccugccaccaggaagc

SEQ ID NO: 141676 - RNA, 22 nt, Human
gauccuugcaacucugugaggu

SEQ ID NO: 141677 - RNA, 22 nt, Human
caggcagaagaaguggaaggac

SEQ ID NO: 141678 - RNA, 22 nt, Human
ccugccugcaccuucucugggg

SEQ ID NO: 141679 - RNA, 22 nt, Human
ucuggcuccuggcuccacugcc

SEQ ID NO: 141680 - RNA, 22 nt, Human
aucaguuuugggggacauacug

SEQ ID NO: 141681 - RNA, 22 nt, Human
agucagcagccuggccaggaga

SEQ ID NO: 141682 - RNA, 23 nt, Human
agucaguguaaguuuggaaugca

SEQ ID NO: 141683 - RNA, 22 nt, Human
ucuccuggauggaccuucucuu

SEQ ID NO: 141684 - RNA, 22 nt, Human
ucaggauguuaauauagcauua

SEQ ID NO: 141685 - RNA, 22 nt, Human
uuugcauugcauacaaggaacu

SEQ ID NO: 141686 - RNA, 22 nt, Human
ccauggaguuccucuggucuau

SEQ ID NO: 141687 - RNA, 22 nt, Human
uggcugggugcuauccaguacu

SEQ ID NO: 141688 - RNA, 22 nt, Human
uccaugagcuagcuuuccaaag

SEQ ID NO: 141689 - RNA, 22 nt, Human
ccagcccuccuccaucagagga

SEQ ID NO: 141690 - RNA, 22 nt, Human
cuggcugcgucugcucugacag

SEQ ID NO: 141691 - RNA, 22 nt, Human
cuucagagugcagaagauuggg

SEQ ID NO: 141692 - RNA, 22 nt, Human
guccucuguguaggcugcagac

SEQ ID NO: 141693 - RNA, 22 nt, Human
ugggcuccagcaccugugcucu

SEQ ID NO: 141694 - RNA, 22 nt, Human
agcuugaguuuuggaugaagug

SEQ ID NO: 141695 - RNA, 22 nt, Human
agcugugucauccuggaaaaug

SEQ ID NO: 141696 - RNA, 22 nt, Human
ggcugggcugcugggucagagc

SEQ ID NO: 141697 - RNA, 22 nt, Human
aagguacaguuuuaagaauaag

SEQ ID NO: 141698 - RNA, 22 nt, Human
ggggauggugggaaggcaaucu

SEQ ID NO: 141699 - RNA, 22 nt, Human
gcuggcagggacagcugcgugu

SEQ ID NO: 141700 - RNA, 22 nt, Human
gagacacagagaggcuguguga

SEQ ID NO: 141701 - RNA, 22 nt, Human
ggucauuguucuuuucugugau

SEQ ID NO: 141702 - RNA, 22 nt, Human
cugggugguuuugaugugaauu

SEQ ID NO: 141703 - RNA, 22 nt, Human
aagauucucagagugaaagaau

SEQ ID NO: 141704 - RNA, 22 nt, Human
auaaagaggauguauuuacagc

SEQ ID NO: 141705 - RNA, 22 nt, Human
uuucucuuucaaucugcaguac

SEQ ID NO: 141706 - RNA, 22 nt, Human
cagcauggugccagugagucca

SEQ ID NO: 141707 - RNA, 22 nt, Human
ugcagcccuuccuuccucuggg

SEQ ID NO: 141708 - RNA, 22 nt, Human
aaggcacuguacuaguuaguua

SEQ ID NO: 141709 - RNA, 22 nt, Human
uggcagaaguucacuaguagcu

SEQ ID NO: 141710 - RNA, 22 nt, Human
gccuggaguuguggugaagcca

SEQ ID NO: 141711 - RNA, 22 nt, Human
cagaacauucacucauaugugg

SEQ ID NO: 141712 - RNA, 22 nt, Human
ccaaagucugcauuuuaacaug

SEQ ID NO: 141713 - RNA, 22 nt, Human
uugaagcaggaaaauuucuauu

SEQ ID NO: 141714 - RNA, 22 nt, Human
cagagccaacgccaccugccca

SEQ ID NO: 141715 - RNA, 21 nt, Human
ugcugccaucaugcagagaug

SEQ ID NO: 141716 - RNA, 22 nt, Human
ucugggagagcugcugucagag

SEQ ID NO: 141717 - RNA, 22 nt, Human
cauugcugugggcauuugcugc

SEQ ID NO: 141718 - RNA, 22 nt, Human
ugaauggucacugagcaucugu

SEQ ID NO: 141719 - RNA, 22 nt, Human
aguuauucauuuauucuguaca

SEQ ID NO: 141720 - RNA, 22 nt, Human
guucacaucacuucacugaacc

SEQ ID NO: 141721 - RNA, 22 nt, Human
cugggcacagcguugggcucuu

SEQ ID NO: 141722 - RNA, 22 nt, Human
agugacugacaccuguaauccc

SEQ ID NO: 141723 - RNA, 22 nt, Human
aaauaauguuaggccuuugcuc

SEQ ID NO: 141724 - RNA, 22 nt, Human
agugggcagcccaggaggucuu

SEQ ID NO: 141725 - RNA, 22 nt, Human
acucugagcaucccaagucuua

SEQ ID NO: 141726 - RNA, 22 nt, Human
cuuccucugcggcgccgggcgc

SEQ ID NO: 141727 - RNA, 22 nt, Human
aggcugugacuacgcagggaag

SEQ ID NO: 141728 - RNA, 22 nt, Human
uggcucagcgcggccuggucuu

SEQ ID NO: 141729 - RNA, 22 nt, Human
cugggaggauacacaagaucag

SEQ ID NO: 141730 - RNA, 22 nt, Human
gggcuguguacuaugaggaggg

SEQ ID NO: 141731 - RNA, 22 nt, Human
agcaggagagcagugcgugguc

SEQ ID NO: 141732 - RNA, 22 nt, Human
uuaaugcagaaaucaaacugac

SEQ ID NO: 141733 - RNA, 22 nt, Human
cuuuacagccccacuuccgggc

SEQ ID NO: 141734 - RNA, 22 nt, Human
gcguggugcugcccugcacaca

SEQ ID NO: 141735 - RNA, 22 nt, Human
ucucugugcaggaugcugaguu

SEQ ID NO: 141736 - RNA, 19 nt, Human
ccauggcaaugaucugaug

SEQ ID NO: 141737 - RNA, 22 nt, Human
augaggcaguacacacaaagcc

SEQ ID NO: 141738 - RNA, 22 nt, Human
uaguauauuuuguugcaauuca

SEQ ID NO: 141739 - RNA, 22 nt, Human
ggcagcaguggcugcuauuguc

SEQ ID NO: 141740 - RNA, 22 nt, Human
gucccagaugucuggaacuccc

SEQ ID NO: 141741 - RNA, 22 nt, Human
uaacuucuggaaaugcaucugc

SEQ ID NO: 141742 - RNA, 22 nt, Human
cagcaggaggcauggcuucccu

SEQ ID NO: 141743 - RNA, 22 nt, Human
agcaggcuccuuccuucucugg

SEQ ID NO: 141744 - RNA, 22 nt, Human
ugugcuucagguugucgccacg

SEQ ID NO: 141745 - RNA, 22 nt, Human
gggauggggggaagcguccaug

SEQ ID NO: 141746 - RNA, 22 nt, Human
auaacuuucuucacccuugcug

SEQ ID NO: 141747 - RNA, 16 nt, Human
ccacagggcaaggggc

SEQ ID NO: 141748 - RNA, 19 nt, Human
cugaagucuuuucagcugg

SEQ ID NO: 141749 - RNA, 22 nt, Human
ccagggcaggggcuggaguuca

SEQ ID NO: 141750 - RNA, 22 nt, Human
gcugaagcccacguggcuugua

SEQ ID NO: 141751 - RNA, 22 nt, Human
ggcagcaggagccaucugguag

SEQ ID NO: 141752 - RNA, 22 nt, Human
accaggggaugguuggcacugu

SEQ ID NO: 141753 - RNA, 19 nt, Human
aucugccuguuaucacaua

SEQ ID NO: 141754 - RNA, 22 nt, Human
aucuggcugacuuugugggaca

SEQ ID NO: 141755 - RNA, 22 nt, Human
ucuggccuauuucugucagauc

SEQ ID NO: 141756 - RNA, 22 nt, Human
gaaggcaggcuucugauuaggu

SEQ ID NO: 141757 - RNA, 19 nt, Human
aggcugugagggaggacuc

SEQ ID NO: 141758 - RNA, 20 nt, Human
uccucagaagacauuugggg

SEQ ID NO: 141759 - RNA, 22 nt, Human
gccuggcccagggcuccgcagg

SEQ ID NO: 141760 - RNA, 20 nt, Human
auauguguacguguauacau

SEQ ID NO: 141761 - RNA, 22 nt, Human
gcaguucuacuuauccauagac

SEQ ID NO: 141762 - RNA, 22 nt, Human
ugugugucagagucuccauggu

SEQ ID NO: 141763 - RNA, 22 nt, Human
gagcugucuggggacucugggu

SEQ ID NO: 141764 - RNA, 22 nt, Human
uagcaggguaaauguagaugga

SEQ ID NO: 141765 - RNA, 22 nt, Human
cagcuugcuaauuuugacuuca

SEQ ID NO: 141766 - RNA, 20 nt, Human
ugucagugccugaggcacag

SEQ ID NO: 141767 - RNA, 22 nt, Human
ugcucacugaacucuugcuguc

SEQ ID NO: 141768 - RNA, 22 nt, Human
caggauggucucgaucuccuga

SEQ ID NO: 141769 - RNA, 20 nt, Human
uguguaugugcacaugcgaa

SEQ ID NO: 141770 - RNA, 22 nt, Human
aauuucucauggauucaguuau

SEQ ID NO: 141771 - RNA, 18 nt, Human
ggcugagguugacuagaa

SEQ ID NO: 141772 - RNA, 22 nt, Human
ucagcaguggcucucaugcagu

SEQ ID NO: 141773 - RNA, 20 nt, Human
ggcacuggaagcacacagga

SEQ ID NO: 141774 - RNA, 22 nt, Human
acagcaggauuuggcgauguug

SEQ ID NO: 141775 - RNA, 22 nt, Human
uggagggcaugcuguccauggg

SEQ ID NO: 141776 - RNA, 22 nt, Human
uuguuucugaguuuucauguau

SEQ ID NO: 141777 - RNA, 22 nt, Human
guccucugacucagccuuggga

SEQ ID NO: 141778 - RNA, 22 nt, Human
aacaaauggggccuuguaugaa

SEQ ID NO: 141779 - RNA, 21 nt, Human
ccucuggcuugugcugugccc

SEQ ID NO: 141780 - RNA, 22 nt, Human
gggcacagagggucuugaagaa

SEQ ID NO: 141781 - RNA, 22 nt, Human
gcagccacugggagugcuuaua

SEQ ID NO: 141782 - RNA, 22 nt, Human
gcccucagaugggaaaggaggg

SEQ ID NO: 141783 - RNA, 22 nt, Human
gcucugcuugcaucaugacugc

SEQ ID NO: 141784 - RNA, 22 nt, Human
caaauguguuuuuucuucuaca

SEQ ID NO: 141785 - RNA, 22 nt, Human
cuuuucucuguaccguauaucu

SEQ ID NO: 141786 - RNA, 22 nt, Human
cagaggcugcucuggguggcau

SEQ ID NO: 141787 - RNA, 22 nt, Human
ucauuuauaaggaugcaauuaa

SEQ ID NO: 141788 - RNA, 22 nt, Human
caggcacuucugcugcuugucu

SEQ ID NO: 141789 - RNA, 22 nt, Human
gagagucuagugcaccuaguuu

SEQ ID NO: 141790 - RNA, 22 nt, Human
gggcugcuuccuggggaaugcu

SEQ ID NO: 141791 - RNA, 22 nt, Human
acagaguaucuaucaggaguau

SEQ ID NO: 141792 - RNA, 22 nt, Human
cuuuggcaaugaaacacaagaa

SEQ ID NO: 141793 - RNA, 22 nt, Human
uuuacauugcauuagguauuau

SEQ ID NO: 141794 - RNA, 22 nt, Human
gaaaaugugucaucccuacugu

SEQ ID NO: 141795 - RNA, 18 nt, Human
ucucucugauaacauuuu

SEQ ID NO: 141796 - RNA, 22 nt, Human
uguucucucuccuuuugaagug

SEQ ID NO: 141797 - RNA, 22 nt, Human
ucucucugaguugagcaggagu

SEQ ID NO: 141798 - RNA, 22 nt, Human
guuauaaaaugcacaguuguuu

SEQ ID NO: 141799 - RNA, 22 nt, Human
uccuuuuugguccaaggugacc

SEQ ID NO: 141800 - RNA, 22 nt, Human
cagucccagacauaguaaggga

SEQ ID NO: 141801 - RNA, 22 nt, Human
ucacuuaaaaauucuaguuaug

SEQ ID NO: 141802 - RNA, 22 nt, Human
aggcugugggacaguuaggaga

SEQ ID NO: 141803 - RNA, 22 nt, Human
caggguccaucuuucaucacug

SEQ ID NO: 141804 - RNA, 22 nt, Human
uuagcaucugcuguaagcuuau

SEQ ID NO: 141805 - RNA, 22 nt, Human
gccugcuggauguggccaggcc

SEQ ID NO: 141806 - RNA, 20 nt, Human
uccuugaaagugggguauau

SEQ ID NO: 141807 - RNA, 22 nt, Human
cugagcuuggccaggaaugaau

SEQ ID NO: 141808 - RNA, 22 nt, Human
aagcagccacuggccaguuaua

SEQ ID NO: 141809 - RNA, 19 nt, Human
uauuuucguggaggccuau

SEQ ID NO: 141810 - RNA, 22 nt, Human
cuucucucugcauaggcauggg

SEQ ID NO: 141811 - RNA, 22 nt, Human
gcaaagguagccaaggagcuca

SEQ ID NO: 141812 - RNA, 22 nt, Human
ggugggcacauucagucucugu

SEQ ID NO: 141813 - RNA, 22 nt, Human
cagauccacccuuguagugaca

SEQ ID NO: 141814 - RNA, 22 nt, Human
cccagggaaugacucuggccuu

SEQ ID NO: 141815 - RNA, 22 nt, Human
uugugguuaaccgcacauuuuu

SEQ ID NO: 141816 - RNA, 21 nt, Human
ucacuuauaauguauuugcug

SEQ ID NO: 141817 - RNA, 22 nt, Human
gaagcagcugccagagaugucu

SEQ ID NO: 141818 - RNA, 22 nt, Human
uccucagaaaccccugugaggu

SEQ ID NO: 141819 - RNA, 19 nt, Human
ucucaauguucagaaagcu

SEQ ID NO: 141820 - RNA, 22 nt, Human
uagagcuagcuucaaaaugcga

SEQ ID NO: 141821 - RNA, 22 nt, Human
uuucacaaguuucaggauucug

SEQ ID NO: 141822 - RNA, 22 nt, Human
uggcugugaauggcaaauaauc

SEQ ID NO: 141823 - RNA, 22 nt, Human
caaauagugucacauugugagg

SEQ ID NO: 141824 - RNA, 22 nt, Human
aguguacauguuuacagcaucu

SEQ ID NO: 141825 - RNA, 22 nt, Human
uuggcuuccaggaucucagcag

SEQ ID NO: 141826 - RNA, 22 nt, Human
gccaggcugcuccagggaggcc

SEQ ID NO: 141827 - RNA, 22 nt, Human
acagcuggaggucugugagcac

SEQ ID NO: 141828 - RNA, 23 nt, Human
gugagcagcccacuaggaaugcc

SEQ ID NO: 141829 - RNA, 22 nt, Human
accaaggagaaggugcaagcuu

SEQ ID NO: 141830 - RNA, 22 nt, Human
ugugcugguacaugugaggaug

SEQ ID NO: 141831 - RNA, 22 nt, Human
ccugggaggcagagguugcagu

SEQ ID NO: 141832 - RNA, 22 nt, Human
gcugcagcccggcgcgccugag

SEQ ID NO: 141833 - RNA, 22 nt, Human
aauaauuuccagccaacuggaa

SEQ ID NO: 141834 - RNA, 22 nt, Human
gagcagggccacuucuguaccu

SEQ ID NO: 141835 - RNA, 21 nt, Human
aaauguguuccauaaugcuuu

SEQ ID NO: 141836 - RNA, 22 nt, Human
gccuggaguucagccaaguccc

SEQ ID NO: 141837 - RNA, 22 nt, Human
uguggcugccacccugaagccg

SEQ ID NO: 141838 - RNA, 22 nt, Human
caguuauuaugaggucauuagg

SEQ ID NO: 141839 - RNA, 22 nt, Human
uggcaggagguuuucuccagga

SEQ ID NO: 141840 - RNA, 22 nt, Human
acaggcucuggggcaggauggc

SEQ ID NO: 141841 - RNA, 22 nt, Human
cacucccuucaggagccuagga

SEQ ID NO: 141842 - RNA, 22 nt, Human
uuuccagagcaugucugcucag

SEQ ID NO: 141843 - RNA, 22 nt, Human
ucaguuuucucauuuaugagau

SEQ ID NO: 141844 - RNA, 22 nt, Human
auccaguucucagugcuuacag

SEQ ID NO: 141845 - RNA, 22 nt, Human
cugagaggcacaaggcauuucg

SEQ ID NO: 141846 - RNA, 22 nt, Human
cugcaagauuggaagaugcaau

SEQ ID NO: 141847 - RNA, 22 nt, Human
uuuccuuccaaaugcccgggag

SEQ ID NO: 141848 - RNA, 22 nt, Human
ccagggcacuuaggcccagccc

SEQ ID NO: 141849 - RNA, 22 nt, Human
ucugccuuccccauaaucugau

SEQ ID NO: 141850 - RNA, 22 nt, Human
augcacuugcguguuugcaaau

SEQ ID NO: 141851 - RNA, 22 nt, Human
ucaguuuucauuucaugagcag

SEQ ID NO: 141852 - RNA, 22 nt, Human
ggacacagauaaucacacagau

SEQ ID NO: 141853 - RNA, 22 nt, Human
agcagcagaggucagaaaggua

SEQ ID NO: 141854 - RNA, 22 nt, Human
cuggcagguuuggugucuggug

SEQ ID NO: 141855 - RNA, 22 nt, Human
uuugcauuuguuuagaaccuga

SEQ ID NO: 141856 - RNA, 22 nt, Human
accugccuaguugguucugccc

SEQ ID NO: 141857 - RNA, 22 nt, Human
cugccgaguacagccauagaaa

SEQ ID NO: 141858 - RNA, 22 nt, Human
gcuuccuucuaccacaucaugc

SEQ ID NO: 141859 - RNA, 22 nt, Human
guggccuggcgagcuggcgcgg

SEQ ID NO: 141860 - RNA, 20 nt, Human
gucagugucuucaguaguga

SEQ ID NO: 141861 - RNA, 22 nt, Human
acccugggucauauacagugug

SEQ ID NO: 141862 - RNA, 22 nt, Human
gccucugcucucagguagccuc

SEQ ID NO: 141863 - RNA, 22 nt, Human
ucugagugaguguaggccugac

SEQ ID NO: 141864 - RNA, 18 nt, Human
ggaaaaggagugucuagc

SEQ ID NO: 141865 - RNA, 22 nt, Human
uuuauguaguuacggacuauca

SEQ ID NO: 141866 - RNA, 22 nt, Human
ugugaaaggagccauagacagu

SEQ ID NO: 141867 - RNA, 21 nt, Human
gcaugccugcaucuuaguguu

SEQ ID NO: 141868 - RNA, 22 nt, Human
ugcagagguguugcugagauaa

SEQ ID NO: 141869 - RNA, 22 nt, Human
agcccccaaaagugcuuaugau

SEQ ID NO: 141870 - RNA, 22 nt, Human
gcccugggauuggguggaggcu

SEQ ID NO: 141871 - RNA, 22 nt, Human
ccucagccuuggccccaggcag

SEQ ID NO: 141872 - RNA, 22 nt, Human
aggcagaauguuggaaaggaag

SEQ ID NO: 141873 - RNA, 22 nt, Human
gaaaucugaacaacagcuguca

SEQ ID NO: 141874 - RNA, 22 nt, Human
ugacuuccugcacucaggugau

SEQ ID NO: 141875 - RNA, 22 nt, Human
uagagaaaagcagggaucagga

SEQ ID NO: 141876 - RNA, 22 nt, Human
gugugagugaaaguaguuugau

SEQ ID NO: 141877 - RNA, 22 nt, Human
ccuggagauuauuugguccaau

SEQ ID NO: 141878 - RNA, 22 nt, Human
gcucugaggcugugaggugcug

SEQ ID NO: 141879 - RNA, 22 nt, Human
augucuuucgcaucaguagcua

SEQ ID NO: 141880 - RNA, 22 nt, Human
ccaggaagccucagaugcugag

SEQ ID NO: 141881 - RNA, 22 nt, Human
uggggacacagagccaaacuau

SEQ ID NO: 141882 - RNA, 22 nt, Human
cccugcagccuugcaugccuuc

SEQ ID NO: 141883 - RNA, 22 nt, Human
agaggagcugggaggcccucgu

SEQ ID NO: 141884 - RNA, 22 nt, Human
ucucuuuaaaaauagugaaaua

SEQ ID NO: 141885 - RNA, 22 nt, Human
uuaauuuauguccaaaccagau

SEQ ID NO: 141886 - RNA, 22 nt, Human
ucagaguguggugagaugugca

SEQ ID NO: 141887 - RNA, 22 nt, Human
guuccacaaaauguacccaguu

SEQ ID NO: 141888 - RNA, 22 nt, Human
cugcccugugaggguccuuggg

SEQ ID NO: 141889 - RNA, 22 nt, Human
aacauucugguucuaaaaaccu

SEQ ID NO: 141890 - RNA, 22 nt, Human
gugugcaugcauagacaccaca

SEQ ID NO: 141891 - RNA, 22 nt, Human
uguguuggcuugccuguuaggc

SEQ ID NO: 141892 - RNA, 18 nt, Human
uccuccuuuggccuuuuc

SEQ ID NO: 141893 - RNA, 22 nt, Human
ugcaggccggcccuaggccuca

SEQ ID NO: 141894 - RNA, 22 nt, Human
aaguucaaguguaaucuuuauu

SEQ ID NO: 141895 - RNA, 22 nt, Human
ucucuuuagugcuuagacgucu

SEQ ID NO: 141896 - RNA, 22 nt, Human
gccugugcauagcagcggacuc

SEQ ID NO: 141897 - RNA, 17 nt, Human
ugcgaugucuguguuug

SEQ ID NO: 141898 - RNA, 22 nt, Human
cugucagcacucuacuacagau

SEQ ID NO: 141899 - RNA, 22 nt, Human
agugcauuauauguuucaaugg

SEQ ID NO: 141900 - RNA, 22 nt, Human
ugaagcaaacgcuucuguuccu

SEQ ID NO: 141901 - RNA, 22 nt, Human
agcagcaacuuauuuuucuuau

SEQ ID NO: 141902 - RNA, 22 nt, Human
ucauuuacuugguuuuaaucuu

SEQ ID NO: 141903 - RNA, 22 nt, Human
agggcugccugacuccagagcc

SEQ ID NO: 141904 - RNA, 22 nt, Human
ucaugugucugcugcagcuguu

SEQ ID NO: 141905 - RNA, 22 nt, Human
cacaggcugcccgcagcuggga

SEQ ID NO: 141906 - RNA, 22 nt, Human
auuauucuuaugucaucauggc

SEQ ID NO: 141907 - RNA, 22 nt, Human
cauuuguuaaccaguguggauu

SEQ ID NO: 141908 - RNA, 22 nt, Human
uuaaacagacaguaaaugaaac

SEQ ID NO: 141909 - RNA, 22 nt, Human
acugcagcaaagcccgugucuu

SEQ ID NO: 141910 - RNA, 22 nt, Human
acauguaaaaggaacaugcaug

SEQ ID NO: 141911 - RNA, 22 nt, Human
gccagguggcugagcagcugca

SEQ ID NO: 141912 - RNA, 22 nt, Human
cagggcagggagcuuagaauga

SEQ ID NO: 141913 - RNA, 22 nt, Human
auuguacaaugccuggaacauu

SEQ ID NO: 141914 - RNA, 22 nt, Human
gacagcagggacauguaggaag

SEQ ID NO: 141915 - RNA, 22 nt, Human
ugucuagggagcugcucaggcu

SEQ ID NO: 141916 - RNA, 22 nt, Human
ucagaaauuuucucaguaguuc

SEQ ID NO: 141917 - RNA, 22 nt, Human
acucagaguuugcguuccauac

SEQ ID NO: 141918 - RNA, 22 nt, Human
cugugcaagcccaagauaaaac

SEQ ID NO: 141919 - RNA, 22 nt, Human
auacaucucauguaagagauaa

SEQ ID NO: 141920 - RNA, 22 nt, Human
ugcuguguucaccaauaugugu

SEQ ID NO: 141921 - RNA, 22 nt, Human
aucaggaucacagaaacuuuua

SEQ ID NO: 141922 - RNA, 22 nt, Human
cauuauguucaguagcuuaaaa

SEQ ID NO: 141923 - RNA, 22 nt, Human
ggaaaaggccauuguuucucug

SEQ ID NO: 141924 - RNA, 22 nt, Human
ggccucagugggccgcugcagg

SEQ ID NO: 141925 - RNA, 22 nt, Human
ccucuuccacugggccccaucc

SEQ ID NO: 141926 - RNA, 22 nt, Human
aucaggauuauuaaaucuggau

SEQ ID NO: 141927 - RNA, 22 nt, Human
agcaugcacaugacuggcuuaa

SEQ ID NO: 141928 - RNA, 19 nt, Human
uguuggugcggauguggag

SEQ ID NO: 141929 - RNA, 22 nt, Human
ugagagucucagaccuccuggu

SEQ ID NO: 141930 - RNA, 22 nt, Human
gcucaggaaacagcagggcuug

SEQ ID NO: 141931 - RNA, 22 nt, Human
guacuucccugggaggcaagca

SEQ ID NO: 141932 - RNA, 22 nt, Human
cuggccagacuacacaugugug

SEQ ID NO: 141933 - RNA, 22 nt, Human
aacauucuauuuugcuaaaaca

SEQ ID NO: 141934 - RNA, 22 nt, Human
ugucuguauugaggugcauauu

SEQ ID NO: 141935 - RNA, 22 nt, Human
auggcaggcccagguguucauu

SEQ ID NO: 141936 - RNA, 22 nt, Human
gagaagcaaucaguggccaccc

SEQ ID NO: 141937 - RNA, 22 nt, Human
uucugugugucucagcaagcug

SEQ ID NO: 141938 - RNA, 22 nt, Human
ucauuacaguguuuauaugucu

SEQ ID NO: 141939 - RNA, 22 nt, Human
ggcucugggucuguggggagcg

SEQ ID NO: 141940 - RNA, 22 nt, Human
gccuaggaguggggauggcggu

SEQ ID NO: 141941 - RNA, 22 nt, Human
acagccagggucucaggaggcg

SEQ ID NO: 141942 - RNA, 22 nt, Human
ugccuugcacauaauauacauu

SEQ ID NO: 141943 - RNA, 22 nt, Human
uccucaggaucuaggagugcuu

SEQ ID NO: 141944 - RNA, 22 nt, Human
guauuugauacaugaaauggug

SEQ ID NO: 141945 - RNA, 23 nt, Human
uucauuugucuacuucacuuguu

SEQ ID NO: 141946 - RNA, 22 nt, Human
gccuuccugcagcucugagcgu

SEQ ID NO: 141947 - RNA, 22 nt, Human
ugugugcacguacauacuguau

SEQ ID NO: 141948 - RNA, 23 nt, Human
agcuggaggcugucuacucccaa

SEQ ID NO: 141949 - RNA, 22 nt, Human
acugggccuugccauggcagcc

SEQ ID NO: 141950 - RNA, 19 nt, Human
agccuggagggcuggucac

SEQ ID NO: 141951 - RNA, 22 nt, Human
gggcugcugccaaucacagccu

SEQ ID NO: 141952 - RNA, 22 nt, Human
ucugccugcuaacuccugcacc

SEQ ID NO: 141953 - RNA, 22 nt, Human
gcagugguggagcuuacauauc

SEQ ID NO: 141954 - RNA, 22 nt, Human
gcugucccgcugacuuccagcu

SEQ ID NO: 141955 - RNA, 22 nt, Human
ucucugauguauaucagagaac

SEQ ID NO: 141956 - RNA, 22 nt, Human
uucugugugcugucuuggcuuu

SEQ ID NO: 141957 - RNA, 22 nt, Human
auguaugcuuugauuuuagaug

SEQ ID NO: 141958 - RNA, 21 nt, Human
ugggcacugagggugcugcuc

SEQ ID NO: 141959 - RNA, 22 nt, Human
ugccugagugauguggcagcca

SEQ ID NO: 141960 - RNA, 22 nt, Human
uuugugugguggauacugggua

SEQ ID NO: 141961 - RNA, 22 nt, Human
ugugugagacaauuggcugugg

SEQ ID NO: 141962 - RNA, 22 nt, Human
guguaugcagaaacaugcaaag

SEQ ID NO: 141963 - RNA, 22 nt, Human
gcacagggccuggcacauaaga

SEQ ID NO: 141964 - RNA, 22 nt, Human
ucuguaucuaauuuuacaguag

SEQ ID NO: 141965 - RNA, 22 nt, Human
cagguaggauggaagggcucaa

SEQ ID NO: 141966 - RNA, 22 nt, Human
agaaaagggcaggagggauaca

SEQ ID NO: 141967 - RNA, 23 nt, Human
acacauuuuucccguucugaggu

SEQ ID NO: 141968 - RNA, 17 nt, Human
gugccuguuguccugga

SEQ ID NO: 141969 - RNA, 22 nt, Human
agccacagcauguguguaugua

SEQ ID NO: 141970 - RNA, 22 nt, Human
guggcuagaaaaauaugggugc

SEQ ID NO: 141971 - RNA, 22 nt, Human
ugcugcacaauuggaaaguauc

SEQ ID NO: 141972 - RNA, 22 nt, Human
cuggccuuuuguuucuggagaa

SEQ ID NO: 141973 - RNA, 22 nt, Human
ggaggccaguccuggccgggcu

SEQ ID NO: 141974 - RNA, 22 nt, Human
aucauucugauggucaaugcua

SEQ ID NO: 141975 - RNA, 22 nt, Human
caagauggaguccgggaaugug

SEQ ID NO: 141976 - RNA, 22 nt, Human
gucugugugcacagagcuuugg

SEQ ID NO: 141977 - RNA, 22 nt, Human
uucugugugccagaguugugcu

SEQ ID NO: 141978 - RNA, 22 nt, Human
ucagagugaggcgucaacauga

SEQ ID NO: 141979 - RNA, 22 nt, Human
gcagcugagagaagaacagggc

SEQ ID NO: 141980 - RNA, 22 nt, Human
gaaaucugcuucuugcauagua

SEQ ID NO: 141981 - RNA, 20 nt, Human
ggggcugcaugcagagaaga

SEQ ID NO: 141982 - RNA, 22 nt, Human
aggucauuguuaagucaccaua

SEQ ID NO: 141983 - RNA, 22 nt, Human
ucauccaguuguggagagggaa

SEQ ID NO: 141984 - RNA, 22 nt, Human
ccagcuccuucugucuguggag

SEQ ID NO: 141985 - RNA, 22 nt, Human
agagacaggaguucuguuucca

SEQ ID NO: 141986 - RNA, 22 nt, Human
caggaccuggaaugcuugugaa

SEQ ID NO: 141987 - RNA, 22 nt, Human
uggcagcaauuugugauguuga

SEQ ID NO: 141988 - RNA, 22 nt, Human
aagcccaguuucacacugagac

SEQ ID NO: 141989 - RNA, 22 nt, Human
ugggcaggaugcguugauucuu

SEQ ID NO: 141990 - RNA, 22 nt, Human
cagccaggccuggugaccaaag

SEQ ID NO: 141991 - RNA, 22 nt, Human
auucauuugcuauuguguaugg

SEQ ID NO: 141992 - RNA, 22 nt, Human
aaaguucagauuagacucaaga

SEQ ID NO: 141993 - RNA, 22 nt, Human
ugcccaaguccuccaccgaggu

SEQ ID NO: 141994 - RNA, 22 nt, Human
agugugagcccuggaguggugc

SEQ ID NO: 141995 - RNA, 22 nt, Human
ugggcagagucguggggaauag

SEQ ID NO: 141996 - RNA, 22 nt, Human
aagggcagggaguuugugucua

SEQ ID NO: 141997 - RNA, 18 nt, Human
acauuucuaugcuucugg

SEQ ID NO: 141998 - RNA, 22 nt, Human
agcugcucucacuggacgccug

SEQ ID NO: 141999 - RNA, 22 nt, Human
uacaguuuguuacauuguuagu

SEQ ID NO: 142000 - RNA, 19 nt, Human
ucaaaugccaaugucacag

SEQ ID NO: 142001 - RNA, 22 nt, Human
ugcucagacaagcugaacagua

SEQ ID NO: 142002 - RNA, 22 nt, Human
gggacaggccccucgcuagcuu

SEQ ID NO: 142003 - RNA, 22 nt, Human
ucucccacagucucccauggcu

SEQ ID NO: 142004 - RNA, 22 nt, Human
ccaggguguagggauuccagau

SEQ ID NO: 142005 - RNA, 19 nt, Human
uccauaagcuuguguucau

SEQ ID NO: 142006 - RNA, 22 nt, Human
uaugccugauaacugugucucu

SEQ ID NO: 142007 - RNA, 22 nt, Human
cucuguguuaaauuggguuuuu

SEQ ID NO: 142008 - RNA, 22 nt, Human
ggcucaggaugagccuucucau

SEQ ID NO: 142009 - RNA, 22 nt, Human
aggcucagagagcuguguccau

SEQ ID NO: 142010 - RNA, 22 nt, Human
aagauuucugcuccugagagaa

SEQ ID NO: 142011 - RNA, 22 nt, Human
ccaggagcagauauggacauaa

SEQ ID NO: 142012 - RNA, 22 nt, Human
ucugggagauccaagcagaacu

SEQ ID NO: 142013 - RNA, 22 nt, Human
cucugggcaaagaugccucauc

SEQ ID NO: 142014 - RNA, 22 nt, Human
agcaguggcuggauggugugcu

SEQ ID NO: 142015 - RNA, 22 nt, Human
aggcuggagggcaauggcaaga

SEQ ID NO: 142016 - RNA, 22 nt, Human
aagagggaggugcgggugcaga

SEQ ID NO: 142017 - RNA, 22 nt, Human
gcucuggaagcaucugagagga

SEQ ID NO: 142018 - RNA, 22 nt, Human
cugcagccuaggugcagcuggg

SEQ ID NO: 142019 - RNA, 17 nt, Human
ugagcaguagaagaugc

SEQ ID NO: 142020 - RNA, 18 nt, Human
uccugccugcgggcuccc

SEQ ID NO: 142021 - RNA, 22 nt, Human
uaacucuuuacuauacauuuau

SEQ ID NO: 142022 - RNA, 22 nt, Human
agccugcaggaugggcagcacc

SEQ ID NO: 142023 - RNA, 22 nt, Human
uggccuggccacauccagcagg

SEQ ID NO: 142024 - RNA, 22 nt, Human
gccugguguccagaggcgagug

SEQ ID NO: 142025 - RNA, 22 nt, Human
aggugcagcugguggagucugg

SEQ ID NO: 142026 - RNA, 22 nt, Human
ugcaguggaaucuggagagcag

SEQ ID NO: 142027 - RNA, 22 nt, Human
uguauacauuuaacuagauaga

SEQ ID NO: 142028 - RNA, 22 nt, Human
caggcugcggucggcucugguc

SEQ ID NO: 142029 - RNA, 19 nt, Human
gucuguguauuuguugcug

SEQ ID NO: 142030 - RNA, 22 nt, Human
ugagguguguccccagggaggu

SEQ ID NO: 142031 - RNA, 19 nt, Human
aggccugggguuuugcacu

SEQ ID NO: 142032 - RNA, 22 nt, Human
uugucugaaagaucauuacauu

SEQ ID NO: 142033 - RNA, 22 nt, Human
aaagccagagcaagcugucaca

SEQ ID NO: 142034 - RNA, 22 nt, Human
gcucagagcacucagacucagc

SEQ ID NO: 142035 - RNA, 20 nt, Human
aacuuguucuaccuguuuca

SEQ ID NO: 142036 - RNA, 22 nt, Human
ucaucucucaggauaccagcag

SEQ ID NO: 142037 - RNA, 22 nt, Human
ugagugugcuaggugucucggu

SEQ ID NO: 142038 - RNA, 22 nt, Human
cuuucagagguuacucaggaaa

SEQ ID NO: 142039 - RNA, 22 nt, Human
acagcagcacuauugacauuuu

SEQ ID NO: 142040 - RNA, 22 nt, Human
guauucuugguuaucaaaauac

SEQ ID NO: 142041 - RNA, 20 nt, Human
aauuuacucacagaaugaau

SEQ ID NO: 142042 - RNA, 22 nt, Human
guacaugucaaaaaaugcauaa

SEQ ID NO: 142043 - RNA, 22 nt, Human
ucagauggcacacagagccugc

SEQ ID NO: 142044 - RNA, 22 nt, Human
cagcaggaaaaucaauucugug

SEQ ID NO: 142045 - RNA, 22 nt, Human
ugaaagcagcaccaauaccauu

SEQ ID NO: 142046 - RNA, 22 nt, Human
gguugccggggcaggacuggaa

SEQ ID NO: 142047 - RNA, 19 nt, Human
cagaguccuugaccagucc

SEQ ID NO: 142048 - RNA, 23 nt, Human
caugggagugagaaugccagcuc

SEQ ID NO: 142049 - RNA, 22 nt, Human
guaguauuuucugugauguagg

SEQ ID NO: 142050 - RNA, 22 nt, Human
ugugucugaacaugcuuuguaa

SEQ ID NO: 142051 - RNA, 22 nt, Human
uucugugucuucuuguucugug

SEQ ID NO: 142052 - RNA, 23 nt, Human
ggguccagagacaggcaugggug

SEQ ID NO: 142053 - RNA, 22 nt, Human
uccagugguuugaaaggggugu

SEQ ID NO: 142054 - RNA, 22 nt, Human
gggcucuggaaggugcaccaug

SEQ ID NO: 142055 - RNA, 22 nt, Human
ccugggcaacauagugagaccu

SEQ ID NO: 142056 - RNA, 22 nt, Human
ggcccucccugagccagguggg

SEQ ID NO: 142057 - RNA, 22 nt, Human
uucuauguagauaaggcugcuc

SEQ ID NO: 142058 - RNA, 22 nt, Human
uguggcuguguccaccugcugc

SEQ ID NO: 142059 - RNA, 22 nt, Human
uaacaucuuuagcagcucgaac

SEQ ID NO: 142060 - RNA, 22 nt, Human
aggagucaggaccaaauggaaa

SEQ ID NO: 142061 - RNA, 19 nt, Human
ucaaggcucccugagggau

SEQ ID NO: 142062 - RNA, 22 nt, Human
uaaggcagaaauaugagcaggg

SEQ ID NO: 142063 - RNA, 22 nt, Human
ucagcuuggacagcuugguuga

SEQ ID NO: 142064 - RNA, 22 nt, Human
cccucugcaggcuggaccugcc

SEQ ID NO: 142065 - RNA, 22 nt, Human
acaguauaccauugugacuuug

SEQ ID NO: 142066 - RNA, 22 nt, Human
augugugguuuguaaaugauuu

SEQ ID NO: 142067 - RNA, 22 nt, Human
gggcagaggggcgcuucccucu

SEQ ID NO: 142068 - RNA, 22 nt, Human
uugugcauuucucugagugugu

SEQ ID NO: 142069 - RNA, 22 nt, Human
gcccagagagaugcuguagacc

SEQ ID NO: 142070 - RNA, 23 nt, Human
auacauacagucuuacugacuuu

SEQ ID NO: 142071 - RNA, 22 nt, Human
ugcagugggccggaggccaggg

SEQ ID NO: 142072 - RNA, 22 nt, Human
cugccuugaggagguuguggga

SEQ ID NO: 142073 - RNA, 22 nt, Human
acacaggagauauguaauggcu

SEQ ID NO: 142074 - RNA, 22 nt, Human
uucuuuccaaccagauauuggu

SEQ ID NO: 142075 - RNA, 22 nt, Human
cagagccuuccuagcagacucu

SEQ ID NO: 142076 - RNA, 22 nt, Human
uauguggccuuuuaugucugac

SEQ ID NO: 142077 - RNA, 22 nt, Human
ugguguguacauuuuugcuucu

SEQ ID NO: 142078 - RNA, 22 nt, Human
ggcucuggguucugcaaugcgu

SEQ ID NO: 142079 - RNA, 22 nt, Human
gaggcagaggaagguggucucu

SEQ ID NO: 142080 - RNA, 22 nt, Human
agucaauuaucucuaggucauc

SEQ ID NO: 142081 - RNA, 22 nt, Human
ugagaaccaugaaaagcuguca

SEQ ID NO: 142082 - RNA, 22 nt, Human
ucuucacaucauguuuuuuaau

SEQ ID NO: 142083 - RNA, 22 nt, Human
cccuggaagguucucuggcuca

SEQ ID NO: 142084 - RNA, 22 nt, Human
aacuagaacgucuaguugcugg

SEQ ID NO: 142085 - RNA, 22 nt, Human
gaggcaggcagauugcuugagg

SEQ ID NO: 142086 - RNA, 22 nt, Human
cugagccuuauucaccagcccu

SEQ ID NO: 142087 - RNA, 22 nt, Human
aggcucagauccuuguguccug

SEQ ID NO: 142088 - RNA, 22 nt, Human
uuccucuccucacaugagucac

SEQ ID NO: 142089 - RNA, 22 nt, Human
aucuggcuugacuuugcgacuu

SEQ ID NO: 142090 - RNA, 22 nt, Human
uuaacuuuuauuucugcucgcc

SEQ ID NO: 142091 - RNA, 22 nt, Human
cugccuugaaaaugaagcuuua

SEQ ID NO: 142092 - RNA, 22 nt, Human
cucugcaggggaggcaugcacu

SEQ ID NO: 142093 - RNA, 20 nt, Human
ccagagcugauggcugcccg

SEQ ID NO: 142094 - RNA, 22 nt, Human
gugauuucuaaucaucugaaug

SEQ ID NO: 142095 - RNA, 22 nt, Human
aucagcugaaaaacaggcagca

SEQ ID NO: 142096 - RNA, 17 nt, Human
ggcagcugccacuuuuu

SEQ ID NO: 142097 - RNA, 23 nt, Human
uggauaaagcugugcugcauagg

SEQ ID NO: 142098 - RNA, 22 nt, Human
gauuuagagaauguuuuguaag

SEQ ID NO: 142099 - RNA, 22 nt, Human
uugcauaaaugcuuaaaauuug

SEQ ID NO: 142100 - RNA, 22 nt, Human
cuuugcagugauuguucuugga

SEQ ID NO: 142101 - RNA, 22 nt, Human
caggcagcugggucaccguccc

SEQ ID NO: 142102 - RNA, 22 nt, Human
aucuuugaagaggacuugaagu

SEQ ID NO: 142103 - RNA, 22 nt, Human
gcaggaugggagcuucacuuug

SEQ ID NO: 142104 - RNA, 22 nt, Human
ggcucaggcuggagugcagugg

SEQ ID NO: 142105 - RNA, 22 nt, Human
acugccauuggucaaaugagug

SEQ ID NO: 142106 - RNA, 19 nt, Human
ccuggaggugaagguucuc

SEQ ID NO: 142107 - RNA, 22 nt, Human
uauuuguugaguuguuaugucu

SEQ ID NO: 142108 - RNA, 22 nt, Human
cucuccucugaaguggugaccc

SEQ ID NO: 142109 - RNA, 22 nt, Human
caggcacugugcugagcucugc

SEQ ID NO: 142110 - RNA, 22 nt, Human
ucaaugauaucagcaggaugug

SEQ ID NO: 142111 - RNA, 22 nt, Human
gauuucaaggauguuagaggug

SEQ ID NO: 142112 - RNA, 22 nt, Human
gcugcagcaagcccuccagggg

SEQ ID NO: 142113 - RNA, 22 nt, Human
guccucugcuucaugcccugau

SEQ ID NO: 142114 - RNA, 22 nt, Human
cugugcuucgcaacuccaaggu

SEQ ID NO: 142115 - RNA, 22 nt, Human
ugcaaacaggagaguaaguaua

SEQ ID NO: 142116 - RNA, 23 nt, Human
ucugagagaacaaugccuccuau

SEQ ID NO: 142117 - RNA, 22 nt, Human
aguuugaaaguauugacagaag

SEQ ID NO: 142118 - RNA, 22 nt, Human
ucucuccuuaucauuguguuua

SEQ ID NO: 142119 - RNA, 22 nt, Human
cuucuucauguauugauagucu

SEQ ID NO: 142120 - RNA, 22 nt, Human
agccugccuugggcugcuugag

SEQ ID NO: 142121 - RNA, 22 nt, Human
agagacaggguuuugccauguu

SEQ ID NO: 142122 - RNA, 22 nt, Human
ccagguggacggcgaguacagg

SEQ ID NO: 142123 - RNA, 19 nt, Human
uucauucuuucuacuuacc

SEQ ID NO: 142124 - RNA, 22 nt, Human
cugaagcacagcauauaaauaa

SEQ ID NO: 142125 - RNA, 22 nt, Human
uguuacagaaugaauuuccgga

SEQ ID NO: 142126 - RNA, 18 nt, Human
caggaugagugaugggga

SEQ ID NO: 142127 - RNA, 22 nt, Human
uccagccaagccuugguagcug

SEQ ID NO: 142128 - RNA, 21 nt, Human
auuuucugugauagcugucuc

SEQ ID NO: 142129 - RNA, 22 nt, Human
gcaaagcugggugugaaugcac

SEQ ID NO: 142130 - RNA, 22 nt, Human
uggcagcauuuuuuccagaaca

SEQ ID NO: 142131 - RNA, 22 nt, Human
acagacagauuuugucugaugu

SEQ ID NO: 142132 - RNA, 22 nt, Human
caccagcagaagacugagggug

SEQ ID NO: 142133 - RNA, 22 nt, Human
ucaaagucucugcuucuguaac

SEQ ID NO: 142134 - RNA, 22 nt, Human
ucagaacauugacauucuuauu

SEQ ID NO: 142135 - RNA, 22 nt, Human
acaguguacuagguacauguuc

SEQ ID NO: 142136 - RNA, 22 nt, Human
cacaggaggaggccagagcgua

SEQ ID NO: 142137 - RNA, 22 nt, Human
ugcuuuauuuauaaaauagcaa

SEQ ID NO: 142138 - RNA, 22 nt, Human
aggguccaucaaggacugcaca

SEQ ID NO: 142139 - RNA, 22 nt, Human
aagcuggagaguuaggugaaua

SEQ ID NO: 142140 - RNA, 22 nt, Human
caguaaauuuuauuugugggug

SEQ ID NO: 142141 - RNA, 22 nt, Human
agaggagguggugaugcuuuaa

SEQ ID NO: 142142 - RNA, 22 nt, Human
ggccucucuggcauggcugccc

SEQ ID NO: 142143 - RNA, 22 nt, Human
ucccuggguccugcuugcucuc

SEQ ID NO: 142144 - RNA, 22 nt, Human
gagucccaugaugauagccaca

SEQ ID NO: 142145 - RNA, 22 nt, Human
cguuggagacacuugaggacuu

SEQ ID NO: 142146 - RNA, 22 nt, Human
cugucugcuagaacaucuauac

SEQ ID NO: 142147 - RNA, 22 nt, Human
agcugcaguaaagcucuccagg

SEQ ID NO: 142148 - RNA, 22 nt, Human
uggcuucuugggaugggucauu

SEQ ID NO: 142149 - RNA, 22 nt, Human
gaaaaaugcuccaaaucugugg

SEQ ID NO: 142150 - RNA, 22 nt, Human
caguguuccaggcggcagugaa

SEQ ID NO: 142151 - RNA, 22 nt, Human
uggcagagucugggcuugggca

SEQ ID NO: 142152 - RNA, 22 nt, Human
aguuuucacacucaccaaaagg

SEQ ID NO: 142153 - RNA, 22 nt, Human
cacacaugucucuccaugcucu

SEQ ID NO: 142154 - RNA, 22 nt, Human
ccugaagagcacucuagaguug

SEQ ID NO: 142155 - RNA, 22 nt, Human
agcuguguccugaagacacugc

SEQ ID NO: 142156 - RNA, 22 nt, Human
cagagcugguguuacaagucca

SEQ ID NO: 142157 - RNA, 22 nt, Human
auuuacagguagaauuuuaagu

SEQ ID NO: 142158 - RNA, 22 nt, Human
uuucugucauaguuaucuuugu

SEQ ID NO: 142159 - RNA, 22 nt, Human
uucucucuguuauggauuuuac

SEQ ID NO: 142160 - RNA, 22 nt, Human
ugggcucugugccagguuggug

SEQ ID NO: 142161 - RNA, 22 nt, Human
caauauucaguggaaaagccau

SEQ ID NO: 142162 - RNA, 22 nt, Human
ggcagccaugcacgcugccugg

SEQ ID NO: 142163 - RNA, 22 nt, Human
agcuuuauuugucauucacggc

SEQ ID NO: 142164 - RNA, 22 nt, Human
guacaguacuucagaaccagcc

SEQ ID NO: 142165 - RNA, 22 nt, Human
ucaguggagcuaagcaugagau

SEQ ID NO: 142166 - RNA, 22 nt, Human
aaauauguaagauuagcacuag

SEQ ID NO: 142167 - RNA, 21 nt, Human
aggugccaaggagaagcaggc

SEQ ID NO: 142168 - RNA, 22 nt, Human
aacaaauguguuuuguaauuaa

SEQ ID NO: 142169 - RNA, 22 nt, Human
aggccuggugugccggaugcag

SEQ ID NO: 142170 - RNA, 22 nt, Human
aauauaugugguauugaccagc

SEQ ID NO: 142171 - RNA, 22 nt, Human
gucucccaucguuugugaggaa

SEQ ID NO: 142172 - RNA, 22 nt, Human
uguguauguuuugagguugcua

SEQ ID NO: 142173 - RNA, 22 nt, Human
uguacaugugucuguauaucuu

SEQ ID NO: 142174 - RNA, 22 nt, Human
aaaugcaggaaauuaugcuuuu

SEQ ID NO: 142175 - RNA, 22 nt, Human
cuucugcaauaaguuuuggucc

SEQ ID NO: 142176 - RNA, 22 nt, Human
aggcugaggcagguggaucacu

SEQ ID NO: 142177 - RNA, 22 nt, Human
gauuuauuggucuuucauuggu

SEQ ID NO: 142178 - RNA, 22 nt, Human
uuugaacaugcugcaugauaau

SEQ ID NO: 142179 - RNA, 19 nt, Human
ugcauaaauuauauacuuu

SEQ ID NO: 142180 - RNA, 22 nt, Human
uauagagguggaaacugagguu

SEQ ID NO: 142181 - RNA, 22 nt, Human
cagcuccugccugggcagcugu

SEQ ID NO: 142182 - RNA, 22 nt, Human
gagugcaucguggccauuuuaa

SEQ ID NO: 142183 - RNA, 22 nt, Human
cucucucuuguguugcugcaga

SEQ ID NO: 142184 - RNA, 21 nt, Human
ccugugugucugacugggcua

SEQ ID NO: 142185 - RNA, 22 nt, Human
auuuagaaguuggagggcaaga

SEQ ID NO: 142186 - RNA, 22 nt, Human
gggcacugaaugccaagcuagg

SEQ ID NO: 142187 - RNA, 22 nt, Human
caggcagcugaggacuuugcua

SEQ ID NO: 142188 - RNA, 22 nt, Human
uccaggcugggcugaagggugc

SEQ ID NO: 142189 - RNA, 22 nt, Human
aauuaacaaauguagcugugau

SEQ ID NO: 142190 - RNA, 22 nt, Human
aauuucaaugcacucaugguug

SEQ ID NO: 142191 - RNA, 22 nt, Human
ucagggcauguauguuucuuua

SEQ ID NO: 142192 - RNA, 19 nt, Human
acaggcagaauugggugug

SEQ ID NO: 142193 - RNA, 22 nt, Human
cugaagaugucugagaugcuca

SEQ ID NO: 142194 - RNA, 22 nt, Human
ucugggagguaaccaugcugau

SEQ ID NO: 142195 - RNA, 22 nt, Human
agggcagagcugucuaaauggc

SEQ ID NO: 142196 - RNA, 22 nt, Human
uucacauugugcagauuauggu

SEQ ID NO: 142197 - RNA, 18 nt, Human
gccugggaggaggaaaug

SEQ ID NO: 142198 - RNA, 22 nt, Human
gcugccuguugaagggucugug

SEQ ID NO: 142199 - RNA, 22 nt, Human
uaagaacuucggacauguuauc

SEQ ID NO: 142200 - RNA, 22 nt, Human
uuauuaaugaguacaaguuauu

SEQ ID NO: 142201 - RNA, 22 nt, Human
gcaugcugcaccagagccucuc

SEQ ID NO: 142202 - RNA, 22 nt, Human
aguuauuuggcuauagauggua

SEQ ID NO: 142203 - RNA, 22 nt, Human
ugacagaacagguugggagcaa

SEQ ID NO: 142204 - RNA, 22 nt, Human
aucagcaagauguaauuucuau

SEQ ID NO: 142205 - RNA, 22 nt, Human
cacugaaucucaaggggagggu

SEQ ID NO: 142206 - RNA, 22 nt, Human
aggaagcucggagagggcaaau

SEQ ID NO: 142207 - RNA, 22 nt, Human
cuauacagcagcuuacuaguua

SEQ ID NO: 142208 - RNA, 21 nt, Human
ccugggccaaauucccuggac

SEQ ID NO: 142209 - RNA, 18 nt, Human
uauauucugugcccuggu

SEQ ID NO: 142210 - RNA, 20 nt, Human
uguuaaaggacacuugcuuu

SEQ ID NO: 142211 - RNA, 17 nt, Human
cccaugagcccacuccc

SEQ ID NO: 142212 - RNA, 23 nt, Human
ucacaggggccagcgcucugugg

SEQ ID NO: 142213 - RNA, 22 nt, Human
uacaguauggaaaauguauagu

SEQ ID NO: 142214 - RNA, 22 nt, Human
uuuacuuugugucaagucaaga

SEQ ID NO: 142215 - RNA, 22 nt, Human
uuucucugaggcuggccucccu

SEQ ID NO: 142216 - RNA, 22 nt, Human
gggagcugaauggcaauggaga

SEQ ID NO: 142217 - RNA, 22 nt, Human
cugggaugucuauagaacacuu

SEQ ID NO: 142218 - RNA, 18 nt, Human
gcugccugcauuccucac

SEQ ID NO: 142219 - RNA, 22 nt, Human
gcucacagccggcuggcagggg

SEQ ID NO: 142220 - RNA, 22 nt, Human
ccacagggaacaugacagccuu

SEQ ID NO: 142221 - RNA, 22 nt, Human
ggaccagagaagugagcaccug

SEQ ID NO: 142222 - RNA, 22 nt, Human
ggaggggccggcugccugccac

SEQ ID NO: 142223 - RNA, 22 nt, Human
gggcauggaggucugucugcag

SEQ ID NO: 142224 - RNA, 22 nt, Human
gguggcugugagcauuauguga

SEQ ID NO: 142225 - RNA, 22 nt, Human
uauguguaaucauaucugauac

SEQ ID NO: 142226 - RNA, 22 nt, Human
aauuucaagucuugaagaagua

SEQ ID NO: 142227 - RNA, 22 nt, Human
agaauauugaaaguucuugaca

SEQ ID NO: 142228 - RNA, 22 nt, Human
gagaggcugacuggcuguccug

SEQ ID NO: 142229 - RNA, 22 nt, Human
uucaacacaggaacaugauaua

SEQ ID NO: 142230 - RNA, 22 nt, Human
ccagagccugcugagccccauu

SEQ ID NO: 142231 - RNA, 22 nt, Human
cuguggcucucugcaggguccc

SEQ ID NO: 142232 - RNA, 22 nt, Human
cacacagaugguaagggaggga

SEQ ID NO: 142233 - RNA, 22 nt, Human
aggagccaagcagaacuaagga

SEQ ID NO: 142234 - RNA, 22 nt, Human
ucaacagaagugauagcuauua

SEQ ID NO: 142235 - RNA, 22 nt, Human
cuccuuccugccccagugauaa

SEQ ID NO: 142236 - RNA, 22 nt, Human
auaaggcagugacuucaucuau

SEQ ID NO: 142237 - RNA, 20 nt, Human
ugcagcugguuucacaggga

SEQ ID NO: 142238 - RNA, 18 nt, Human
ucagagguacagaaaagu

SEQ ID NO: 142239 - RNA, 22 nt, Human
uggucaggcugcucugcggcgu

SEQ ID NO: 142240 - RNA, 22 nt, Human
ucaaguauaucuagucauuagg

SEQ ID NO: 142241 - RNA, 22 nt, Human
ucucagagaucuuucugcaugu

SEQ ID NO: 142242 - RNA, 22 nt, Human
accaugggucagccaccucagc

SEQ ID NO: 142243 - RNA, 23 nt, Human
cauguacacacagcuguacagug

SEQ ID NO: 142244 - RNA, 22 nt, Human
ucugccugcaguguggcagggc

SEQ ID NO: 142245 - RNA, 22 nt, Human
gcagggugauagugaggcucag

SEQ ID NO: 142246 - RNA, 22 nt, Human
gggacagaaggaagugagcaca

SEQ ID NO: 142247 - RNA, 22 nt, Human
ugauuuccaguugcugggugcu

SEQ ID NO: 142248 - RNA, 22 nt, Human
cugugggcugaaagugcucccg

SEQ ID NO: 142249 - RNA, 22 nt, Human
auuugcuuaucuccacaguugu

SEQ ID NO: 142250 - RNA, 22 nt, Human
uauuuucuggggagagugaacc

SEQ ID NO: 142251 - RNA, 22 nt, Human
ugggccugggucuuugcugcca

SEQ ID NO: 142252 - RNA, 22 nt, Human
uaaauguguaaaccuccauuac

SEQ ID NO: 142253 - RNA, 22 nt, Human
cuggcagcauuaacagagagca

SEQ ID NO: 142254 - RNA, 22 nt, Human
agggagccagaguugggagcuc

SEQ ID NO: 142255 - RNA, 22 nt, Human
aguguccccuccaagggccugg

SEQ ID NO: 142256 - RNA, 22 nt, Human
gucuggcuuuugcccuguguuu

SEQ ID NO: 142257 - RNA, 22 nt, Human
gcagaugguggggcaggaaaau

SEQ ID NO: 142258 - RNA, 22 nt, Human
uuuuccagagcugucucuugca

SEQ ID NO: 142259 - RNA, 22 nt, Human
gagcaggccagcaauggaaggg

SEQ ID NO: 142260 - RNA, 22 nt, Human
uguggcuguggaugcuuuccag

SEQ ID NO: 142261 - RNA, 22 nt, Human
ugcuggcccaguauggacugca

SEQ ID NO: 142262 - RNA, 22 nt, Human
ucaaaguagggguaagccaggc

SEQ ID NO: 142263 - RNA, 22 nt, Human
ucagaggugguaaaggacagca

SEQ ID NO: 142264 - RNA, 22 nt, Human
aggagcuggguuccuuuggugg

SEQ ID NO: 142265 - RNA, 22 nt, Human
uaaaugcaguuaguacuugcca

SEQ ID NO: 142266 - RNA, 21 nt, Human
gccagggaagagaguuggcug

SEQ ID NO: 142267 - RNA, 22 nt, Human
gcagagccugugucugagcaaa

SEQ ID NO: 142268 - RNA, 22 nt, Human
uguugagacugagggagucagc

SEQ ID NO: 142269 - RNA, 22 nt, Human
aguuucauauuaccaugucacc

SEQ ID NO: 142270 - RNA, 22 nt, Human
caggauggagaguuguugguug

SEQ ID NO: 142271 - RNA, 22 nt, Human
ccucuugccaaucagcuacaga

SEQ ID NO: 142272 - RNA, 22 nt, Human
cugggcucagcccaugcugucc

SEQ ID NO: 142273 - RNA, 22 nt, Human
gaagaagcaggaguguguagca

SEQ ID NO: 142274 - RNA, 22 nt, Human
gcuugggauaugcugauguaaa

SEQ ID NO: 142275 - RNA, 22 nt, Human
augacagaggagugcaggugau

SEQ ID NO: 142276 - RNA, 20 nt, Human
uucuaacuacucucccuuug

SEQ ID NO: 142277 - RNA, 22 nt, Human
aaggcaguaggaucuuccacag

SEQ ID NO: 142278 - RNA, 22 nt, Human
accaaggaagagauucucaguu

SEQ ID NO: 142279 - RNA, 21 nt, Human
aacauuucaggauccaaauug

SEQ ID NO: 142280 - RNA, 22 nt, Human
ggcagcacugcagcuuguuggg

SEQ ID NO: 142281 - RNA, 22 nt, Human
ucacagggcauuauggcuccag

SEQ ID NO: 142282 - RNA, 22 nt, Human
aaaauguguuuaugcauuucgu

SEQ ID NO: 142283 - RNA, 19 nt, Human
aggcugcaagguggugggc

SEQ ID NO: 142284 - RNA, 22 nt, Human
agcugaguuaauucaucacuua

SEQ ID NO: 142285 - RNA, 22 nt, Human
uuaugauuugccacagauuggu

SEQ ID NO: 142286 - RNA, 22 nt, Human
uagugugucccuggggaguguu

SEQ ID NO: 142287 - RNA, 22 nt, Human
aucuggcucaccuggguaaaua

SEQ ID NO: 142288 - RNA, 22 nt, Human
uaaaugcagcaguuucuguucu

SEQ ID NO: 142289 - RNA, 22 nt, Human
uuaacagagugccuggcaugua

SEQ ID NO: 142290 - RNA, 22 nt, Human
ugguuucccauuaucugcagga

SEQ ID NO: 142291 - RNA, 22 nt, Human
cagaagcaaaugccuugcugag

SEQ ID NO: 142292 - RNA, 22 nt, Human
cugggcacuuuggggagccuac

SEQ ID NO: 142293 - RNA, 22 nt, Human
cuagcaucagaugagaagcugu

SEQ ID NO: 142294 - RNA, 22 nt, Human
uauuugcaacauaaaacucuga

SEQ ID NO: 142295 - RNA, 22 nt, Human
aaauguauccuacuuccugagu

SEQ ID NO: 142296 - RNA, 22 nt, Human
gcugccuguggcccuucugggu

SEQ ID NO: 142297 - RNA, 22 nt, Human
ggcaguagccagggacuggcag

SEQ ID NO: 142298 - RNA, 22 nt, Human
cuggcugugcagucuuccagaa

SEQ ID NO: 142299 - RNA, 22 nt, Human
acccugagucagacagccugac

SEQ ID NO: 142300 - RNA, 22 nt, Human
uugguuuagagagugugguuac

SEQ ID NO: 142301 - RNA, 21 nt, Human
augcauguuacaguauaugcc

SEQ ID NO: 142302 - RNA, 22 nt, Human
uggagcccagggugagaaggag

SEQ ID NO: 142303 - RNA, 22 nt, Human
agcuggccuucggugucacugg

SEQ ID NO: 142304 - RNA, 22 nt, Human
auacuuacuuuucuucagacua

SEQ ID NO: 142305 - RNA, 22 nt, Human
ccuggcagucaggggaguccuu

SEQ ID NO: 142306 - RNA, 22 nt, Human
uggcugagagucauccugugug

SEQ ID NO: 142307 - RNA, 22 nt, Human
gugcuaggauuacaggcauggg

SEQ ID NO: 142308 - RNA, 22 nt, Human
auguacacaugcaugcaugugc

SEQ ID NO: 142309 - RNA, 22 nt, Human
ucugcucuguggcuucagcuaa

SEQ ID NO: 142310 - RNA, 22 nt, Human
cugggagcuagcucugagcuga

SEQ ID NO: 142311 - RNA, 22 nt, Human
gaaggccaguuuugagauaggu

SEQ ID NO: 142312 - RNA, 22 nt, Human
uucaugugauaaaugugugacu

SEQ ID NO: 142313 - RNA, 22 nt, Human
cauucauuuaugaaauaucuau

SEQ ID NO: 142314 - RNA, 22 nt, Human
uagccucucuccuccacaaccu

SEQ ID NO: 142315 - RNA, 22 nt, Human
cugccuggaccggcagcccucc

SEQ ID NO: 142316 - RNA, 22 nt, Human
ugccacacuccccugcugcagu

SEQ ID NO: 142317 - RNA, 22 nt, Human
aagaacugugcuccaggcucca

SEQ ID NO: 142318 - RNA, 22 nt, Human
acucaggaauggggcugggacu

SEQ ID NO: 142319 - RNA, 22 nt, Human
uaauguguugaauauuuguaca

SEQ ID NO: 142320 - RNA, 22 nt, Human
uuuacaguuccaugugauaggc

SEQ ID NO: 142321 - RNA, 22 nt, Human
cugcccagaagccagaugggca

SEQ ID NO: 142322 - RNA, 22 nt, Human
auuuucugaguccagaauuuac

SEQ ID NO: 142323 - RNA, 22 nt, Human
ccagaccacccuggccaugcac

SEQ ID NO: 142324 - RNA, 22 nt, Human
uguguggguacagaugauuguu

SEQ ID NO: 142325 - RNA, 22 nt, Human
uuguauuuuguuaugcuacugc

SEQ ID NO: 142326 - RNA, 22 nt, Human
cccuucagcugagugggacagc

SEQ ID NO: 142327 - RNA, 22 nt, Human
ugaccaaaggugguuuauuugg

SEQ ID NO: 142328 - RNA, 22 nt, Human
uggagugaaguaaagaggacaa

SEQ ID NO: 142329 - RNA, 21 nt, Human
ggcagccugacccccagagag

SEQ ID NO: 142330 - RNA, 22 nt, Human
ggugcuggacacguggcacucc

SEQ ID NO: 142331 - RNA, 22 nt, Human
ugaugcugcugggaguggugcu

SEQ ID NO: 142332 - RNA, 22 nt, Human
ucuuuagacauccaguuucucu

SEQ ID NO: 142333 - RNA, 22 nt, Human
cacaugaguccugccagguaug

SEQ ID NO: 142334 - RNA, 22 nt, Human
guagcuuauuagggauaauagu

SEQ ID NO: 142335 - RNA, 22 nt, Human
agaugggcgcccuggacugagg

SEQ ID NO: 142336 - RNA, 22 nt, Human
aggccuggugaaugaaguaucu

SEQ ID NO: 142337 - RNA, 22 nt, Human
accccagaggcggaggcugcag

SEQ ID NO: 142338 - RNA, 22 nt, Human
aaaggccacacugcucuuucuc

SEQ ID NO: 142339 - RNA, 22 nt, Human
cuucuucaaccugaaaguuuca

SEQ ID NO: 142340 - RNA, 22 nt, Human
caggcaggugcagauuccucuu

SEQ ID NO: 142341 - RNA, 18 nt, Human
uucagcagcagacacacu

SEQ ID NO: 142342 - RNA, 22 nt, Human
auguucuuccaaaucuguaaca

SEQ ID NO: 142343 - RNA, 22 nt, Human
uaauccacaauagagauuaucu

SEQ ID NO: 142344 - RNA, 22 nt, Human
cagcauggcuugaguguuuccu

SEQ ID NO: 142345 - RNA, 22 nt, Human
ggcacugauuccauucaugaag

SEQ ID NO: 142346 - RNA, 20 nt, Human
ugcagcuucaccugugucau

SEQ ID NO: 142347 - RNA, 22 nt, Human
auggggagagaagggcugagcu

SEQ ID NO: 142348 - RNA, 22 nt, Human
gcuguccaugucuggccucagu

SEQ ID NO: 142349 - RNA, 22 nt, Human
ucuuuagccaguaucauaauga

SEQ ID NO: 142350 - RNA, 22 nt, Human
gagcagcugguaggugaaccca

SEQ ID NO: 142351 - RNA, 19 nt, Human
acaaagcugugagcagcuu

SEQ ID NO: 142352 - RNA, 22 nt, Human
uauguguauguucauucaugca

SEQ ID NO: 142353 - RNA, 22 nt, Human
ggggugggcgugcagggacacc

SEQ ID NO: 142354 - RNA, 22 nt, Human
ccaucagcuccaguaucuucug

SEQ ID NO: 142355 - RNA, 22 nt, Human
uacaguaucuucuggcaagcau

SEQ ID NO: 142356 - RNA, 22 nt, Human
acacauuucucuuuuuguaagu

SEQ ID NO: 142357 - RNA, 22 nt, Human
cccagggcuuuucucacuagac

SEQ ID NO: 142358 - RNA, 22 nt, Human
ucagaggucccuagcaggagug

SEQ ID NO: 142359 - RNA, 23 nt, Human
auuacaguuaauuacaacaucuu

SEQ ID NO: 142360 - RNA, 22 nt, Human
ugcggguugguggcauaugcag

SEQ ID NO: 142361 - RNA, 22 nt, Human
gagccuggauugucaccgacuu

SEQ ID NO: 142362 - RNA, 22 nt, Human
agugaaauggaugcugcuacug

SEQ ID NO: 142363 - RNA, 22 nt, Human
ugaggaugacgauggcaauggc

SEQ ID NO: 142364 - RNA, 22 nt, Human
cuguggcuggcucaucauaggu

SEQ ID NO: 142365 - RNA, 22 nt, Human
uuacaguaauguauuauuuaac

SEQ ID NO: 142366 - RNA, 22 nt, Human
gcuguauuuauuuucuaggguu

SEQ ID NO: 142367 - RNA, 22 nt, Human
auacauguucguguacauguuc

SEQ ID NO: 142368 - RNA, 22 nt, Human
gccuggagcucaugugggcauu

SEQ ID NO: 142369 - RNA, 22 nt, Human
acucugcuuauugcugcaggca

SEQ ID NO: 142370 - RNA, 19 nt, Human
uggcugggugccaauggcc

SEQ ID NO: 142371 - RNA, 22 nt, Human
uaagaacaucuguccccagauu

SEQ ID NO: 142372 - RNA, 22 nt, Human
ucacagaaauaagauaguuauu

SEQ ID NO: 142373 - RNA, 22 nt, Human
ccacucugauuuuggcuccacu

SEQ ID NO: 142374 - RNA, 22 nt, Human
uacuuucuguccuucuguuaaa

SEQ ID NO: 142375 - RNA, 22 nt, Human
gagggagugccagagggccagc

SEQ ID NO: 142376 - RNA, 22 nt, Human
guugaaagaucauguggcugcc

SEQ ID NO: 142377 - RNA, 22 nt, Human
gggagagaugcugauugccaau

SEQ ID NO: 142378 - RNA, 22 nt, Human
ugaugggaaaaugaggccuggg

SEQ ID NO: 142379 - RNA, 22 nt, Human
ccaaagugcugagauuacaggu

SEQ ID NO: 142380 - RNA, 22 nt, Human
caggcacuggccagucagcaca

SEQ ID NO: 142381 - RNA, 22 nt, Human
ugucuuuaguuuuacugucugg

SEQ ID NO: 142382 - RNA, 22 nt, Human
gucugucaucugagauggagug

SEQ ID NO: 142383 - RNA, 22 nt, Human
uaaguucaguuggucgaaguag

SEQ ID NO: 142384 - RNA, 22 nt, Human
gcuggagccuucugcucuguug

SEQ ID NO: 142385 - RNA, 22 nt, Human
cccagacauaacagcagagagg

SEQ ID NO: 142386 - RNA, 21 nt, Human
cugagggccgcagcugggcuc

SEQ ID NO: 142387 - RNA, 22 nt, Human
uggcuuccugcauggauccucu

SEQ ID NO: 142388 - RNA, 22 nt, Human
acagcagcuggguucccaccau

SEQ ID NO: 142389 - RNA, 22 nt, Human
gagggcagagacagugauucac

SEQ ID NO: 142390 - RNA, 22 nt, Human
agcaauauaaauguuggguaga

SEQ ID NO: 142391 - RNA, 22 nt, Human
uccagcagaccaucaaggcuca

SEQ ID NO: 142392 - RNA, 22 nt, Human
ccuccucugggaagauucagag

SEQ ID NO: 142393 - RNA, 22 nt, Human
augggggccugaacaggcaaaa

SEQ ID NO: 142394 - RNA, 22 nt, Human
uuaugacaggaaaaucacagaa

SEQ ID NO: 142395 - RNA, 22 nt, Human
caggugcccagcuccugcugug

SEQ ID NO: 142396 - RNA, 22 nt, Human
aagcacaaugaacaucuuagau

SEQ ID NO: 142397 - RNA, 22 nt, Human
aguggcuguucauuuuacacaa

SEQ ID NO: 142398 - RNA, 22 nt, Human
aucuguguguugaguucucagc

SEQ ID NO: 142399 - RNA, 22 nt, Human
gccugaggaaugcuccugacuu

SEQ ID NO: 142400 - RNA, 22 nt, Human
ccuggcugggguagaagugagg

SEQ ID NO: 142401 - RNA, 22 nt, Human
aaaugcacucugcuucugugac

SEQ ID NO: 142402 - RNA, 22 nt, Human
uucuccucuguuggccuucccu

SEQ ID NO: 142403 - RNA, 22 nt, Human
gaaaucugcccagugcacuggu

SEQ ID NO: 142404 - RNA, 20 nt, Human
cguguguggcuauuuugggu

SEQ ID NO: 142405 - RNA, 22 nt, Human
cuggcuuccaugcuguaguggc

SEQ ID NO: 142406 - RNA, 22 nt, Human
ccucugagaccagcucugcacc

SEQ ID NO: 142407 - RNA, 22 nt, Human
cagggcagaaggcacucuacuc

SEQ ID NO: 142408 - RNA, 22 nt, Human
cucugugugguagauuccauua

SEQ ID NO: 142409 - RNA, 22 nt, Human
ucccagccugacagugcaucaa

SEQ ID NO: 142410 - RNA, 22 nt, Human
uaaguucauuagacuacagaua

SEQ ID NO: 142411 - RNA, 22 nt, Human
cuggagcagguuuaggaguccc

SEQ ID NO: 142412 - RNA, 22 nt, Human
cagucuucuaaccuagcagccu

SEQ ID NO: 142413 - RNA, 22 nt, Human
uaugugcaguuugcucuuaaca

SEQ ID NO: 142414 - RNA, 22 nt, Human
agggagcaugggugaagcaggc

SEQ ID NO: 142415 - RNA, 22 nt, Human
uuuaaaaaacuagucugagucu

SEQ ID NO: 142416 - RNA, 22 nt, Human
gggcugugggacccggcacuuu

SEQ ID NO: 142417 - RNA, 22 nt, Human
aggacagaccuaggacuggagc

SEQ ID NO: 142418 - RNA, 22 nt, Human
gcugucuugcucacucuugcag

SEQ ID NO: 142419 - RNA, 22 nt, Human
uccagucauuuccauuguuccc

SEQ ID NO: 142420 - RNA, 22 nt, Human
auaugaagaauuccaauuugga

SEQ ID NO: 142421 - RNA, 22 nt, Human
cugggcacuugcucacagcucu

SEQ ID NO: 142422 - RNA, 22 nt, Human
auggcuguuccugggaguucua

SEQ ID NO: 142423 - RNA, 22 nt, Human
ugugacaugugucaucuuuucu

SEQ ID NO: 142424 - RNA, 22 nt, Human
uggcagcuggagggcaauggcc

SEQ ID NO: 142425 - RNA, 22 nt, Human
augcauguauucaugugugaca

SEQ ID NO: 142426 - RNA, 21 nt, Human
uuucuuucuggcucucacagu

SEQ ID NO: 142427 - RNA, 22 nt, Human
ugcaccauuuugucaggcuacu

SEQ ID NO: 142428 - RNA, 22 nt, Human
auauacuuggagacuaucauug

SEQ ID NO: 142429 - RNA, 22 nt, Human
caagaauuguacaaacugggug

SEQ ID NO: 142430 - RNA, 22 nt, Human
ggagccaggggaccuucacaga

SEQ ID NO: 142431 - RNA, 22 nt, Human
cuguaaauaugaagaauauaug

SEQ ID NO: 142432 - RNA, 19 nt, Human
cccuggcaggcaagccugg

SEQ ID NO: 142433 - RNA, 22 nt, Human
uuugggaaacuuaggggucaga

SEQ ID NO: 142434 - RNA, 22 nt, Human
ugcagcuucuuguccugugauu

SEQ ID NO: 142435 - RNA, 22 nt, Human
gcucccagaaccaaggcugggg

SEQ ID NO: 142436 - RNA, 22 nt, Human
cacauggggcgcugcauuggcc

SEQ ID NO: 142437 - RNA, 22 nt, Human
ugucccuggaacuauggcucca

SEQ ID NO: 142438 - RNA, 22 nt, Human
agcccaagcauaggagggaggc

SEQ ID NO: 142439 - RNA, 22 nt, Human
uuuauuguugggucuuaagcug

SEQ ID NO: 142440 - RNA, 22 nt, Human
cgcugggcgccgaccugcuggc

SEQ ID NO: 142441 - RNA, 22 nt, Human
ugcaguggaagagguggagauc

SEQ ID NO: 142442 - RNA, 22 nt, Human
ggugcagugguguggcaaaggg

SEQ ID NO: 142443 - RNA, 22 nt, Human
auggcugugagacaaagagcug

SEQ ID NO: 142444 - RNA, 22 nt, Human
auacauuagaaucugguacuca

SEQ ID NO: 142445 - RNA, 22 nt, Human
uccugccucacaguugaaguuu

SEQ ID NO: 142446 - RNA, 22 nt, Human
caaaguccauaguuuacaauag

SEQ ID NO: 142447 - RNA, 22 nt, Human
uccagcaguccaugugagacac

SEQ ID NO: 142448 - RNA, 22 nt, Human
auuugucuuuggaccugugaga

SEQ ID NO: 142449 - RNA, 22 nt, Human
ccuccagcgcgauccacuccgg

SEQ ID NO: 142450 - RNA, 22 nt, Human
uggcaggguuggccaccuuacc

SEQ ID NO: 142451 - RNA, 22 nt, Human
ggggcagaguagcuggggugug

SEQ ID NO: 142452 - RNA, 22 nt, Human
ccaaagucagugcucagucguc

SEQ ID NO: 142453 - RNA, 22 nt, Human
gagacacaaacauuuauuccac

SEQ ID NO: 142454 - RNA, 22 nt, Human
aagacauuuauuugaaucaauu

SEQ ID NO: 142455 - RNA, 22 nt, Human
gguggccucugcaggccucgac

SEQ ID NO: 142456 - RNA, 22 nt, Human
cugcuuugcauagcugccagag

SEQ ID NO: 142457 - RNA, 22 nt, Human
gugcagggcuggcaccggaggc

SEQ ID NO: 142458 - RNA, 22 nt, Human
augauguugauaaauuacuuua

SEQ ID NO: 142459 - RNA, 22 nt, Human
ugcuuccugaggccgucuucuc

SEQ ID NO: 142460 - RNA, 22 nt, Human
gucccagaggcuuuggccacag

SEQ ID NO: 142461 - RNA, 22 nt, Human
ccaugagcuucaacugacacag

SEQ ID NO: 142462 - RNA, 22 nt, Human
ugaacagaucaauagaacugac

SEQ ID NO: 142463 - RNA, 22 nt, Human
uguggcugggaagaagguaacu

SEQ ID NO: 142464 - RNA, 22 nt, Human
auuaacuuuugaucaguguggu

SEQ ID NO: 142465 - RNA, 22 nt, Human
ugagccagccuugcagcugugc

SEQ ID NO: 142466 - RNA, 22 nt, Human
gcagcugcaggcaggcuugcug

SEQ ID NO: 142467 - RNA, 22 nt, Human
cauuaagauuuuuuucuacugg

SEQ ID NO: 142468 - RNA, 22 nt, Human
ggcugcagcagagggacucacg

SEQ ID NO: 142469 - RNA, 22 nt, Human
uucacauuugcccuuaugugug

SEQ ID NO: 142470 - RNA, 22 nt, Human
agccuggauucgugcauccaca

SEQ ID NO: 142471 - RNA, 22 nt, Human
cacccacccacugcucauuggc

SEQ ID NO: 142472 - RNA, 22 nt, Human
ccagaggcuggguucaccucag

SEQ ID NO: 142473 - RNA, 22 nt, Human
ugucucuggcccaugagcagag

SEQ ID NO: 142474 - RNA, 22 nt, Human
ugcucugguccucccucggcgc

SEQ ID NO: 142475 - RNA, 22 nt, Human
aaaggucaagcuggacucaggu

SEQ ID NO: 142476 - RNA, 22 nt, Human
agugucugccagcugccaggug

SEQ ID NO: 142477 - RNA, 22 nt, Human
ugggcugccagcucuccagaug

SEQ ID NO: 142478 - RNA, 23 nt, Human
acucacaaagcaggaucauguug

SEQ ID NO: 142479 - RNA, 22 nt, Human
ggcugaguucucuugcugaauc

SEQ ID NO: 142480 - RNA, 22 nt, Human
guuuuuccuugcugaggacccg

SEQ ID NO: 142481 - RNA, 22 nt, Human
cucugugucugaagcccuauuu

SEQ ID NO: 142482 - RNA, 22 nt, Human
cuggggcucacuuuggucaggc

SEQ ID NO: 142483 - RNA, 22 nt, Human
aaaauuauggaguaucccaaag

SEQ ID NO: 142484 - RNA, 22 nt, Human
ccagcaggagagaacauuuccc

SEQ ID NO: 142485 - RNA, 22 nt, Human
uagggcaggggaggaaucugaa

SEQ ID NO: 142486 - RNA, 22 nt, Human
aggcaguggcugagaccagggg

SEQ ID NO: 142487 - RNA, 22 nt, Human
agugucugaaccaccggggcau

SEQ ID NO: 142488 - RNA, 22 nt, Human
uccucuuuaaaugcuuuuaucu

SEQ ID NO: 142489 - RNA, 22 nt, Human
cuggguaaguuccuaaggcuca

SEQ ID NO: 142490 - RNA, 22 nt, Human
ucucugggauaaacugggccag

SEQ ID NO: 142491 - RNA, 22 nt, Human
cugcagccucaaccuccugagc

SEQ ID NO: 142492 - RNA, 22 nt, Human
gggcacugcuggaggcucccug

SEQ ID NO: 142493 - RNA, 22 nt, Human
gcugagagaaaagugagguucu

SEQ ID NO: 142494 - RNA, 22 nt, Human
aauaugugagguauguucagug

SEQ ID NO: 142495 - RNA, 23 nt, Human
gggagaauaugaggaugauggug

SEQ ID NO: 142496 - RNA, 22 nt, Human
ucucacugcaaauauuauguau

SEQ ID NO: 142497 - RNA, 22 nt, Human
ucugagugucuuaauaggcucu

SEQ ID NO: 142498 - RNA, 18 nt, Human
ccuggcagccaugcgcgc

SEQ ID NO: 142499 - RNA, 22 nt, Human
agggauguaaauucuucuucuu

SEQ ID NO: 142500 - RNA, 23 nt, Human
uguugaaguaacuguuacauaga

SEQ ID NO: 142501 - RNA, 22 nt, Human
uuucuuaggcucuaaaaugacu

SEQ ID NO: 142502 - RNA, 22 nt, Human
gagcaggcucugccuguguguc

SEQ ID NO: 142503 - RNA, 22 nt, Human
gccugcuguuaacugcaggaau

SEQ ID NO: 142504 - RNA, 22 nt, Human
gguggccucgguggugcacagg

SEQ ID NO: 142505 - RNA, 22 nt, Human
accuggccauccagcuggcauc

SEQ ID NO: 142506 - RNA, 22 nt, Human
caggugcucccagagaagugcu

SEQ ID NO: 142507 - RNA, 22 nt, Human
cucuuucaguucugauagucuc

SEQ ID NO: 142508 - RNA, 22 nt, Human
guuauaaauaccuaauaggauu

SEQ ID NO: 142509 - RNA, 22 nt, Human
caggggcaagaaugcugucagc

SEQ ID NO: 142510 - RNA, 22 nt, Human
cagauauauuuuauuuggucaa

SEQ ID NO: 142511 - RNA, 22 nt, Human
gcugucaggaacaugccuuggu

SEQ ID NO: 142512 - RNA, 22 nt, Human
acaaaggugcgucccuucagcu

SEQ ID NO: 142513 - RNA, 18 nt, Human
gggcaagcggcugucacc

SEQ ID NO: 142514 - RNA, 22 nt, Human
guguaaggugaaaucaacaaau

SEQ ID NO: 142515 - RNA, 22 nt, Human
agcagcauagaagcugggagga

SEQ ID NO: 142516 - RNA, 22 nt, Human
cuguuugugauuagcagugggu

SEQ ID NO: 142517 - RNA, 22 nt, Human
aaggccaggacaccaggggacu

SEQ ID NO: 142518 - RNA, 22 nt, Human
uugaaaggguuaaagugguaaa

SEQ ID NO: 142519 - RNA, 22 nt, Human
uuauuuauuguguaccuacugu

SEQ ID NO: 142520 - RNA, 22 nt, Human
uuucauguuuauggaaaaugag

SEQ ID NO: 142521 - RNA, 19 nt, Human
aguguauuuuuuucuguag

SEQ ID NO: 142522 - RNA, 22 nt, Human
agagcugugcuuugcaccacgu

SEQ ID NO: 142523 - RNA, 22 nt, Human
gccaccagggggcuccagugag

SEQ ID NO: 142524 - RNA, 22 nt, Human
ccaggagucuggaugagguguc

SEQ ID NO: 142525 - RNA, 22 nt, Human
ccuguguguaggccaggggagu

SEQ ID NO: 142526 - RNA, 22 nt, Human
ucucagucagccuugauguccc

SEQ ID NO: 142527 - RNA, 22 nt, Human
ugugugugaaccauugagggcu

SEQ ID NO: 142528 - RNA, 22 nt, Human
caggcagagugagguggucuaa

SEQ ID NO: 142529 - RNA, 22 nt, Human
uacuauuuauggagugguuauu

SEQ ID NO: 142530 - RNA, 22 nt, Human
guuauaaaggugauaaugguca

SEQ ID NO: 142531 - RNA, 22 nt, Human
ggcuggccuguguggccgccac

SEQ ID NO: 142532 - RNA, 20 nt, Human
gcaaggcacagugaggaggg

SEQ ID NO: 142533 - RNA, 20 nt, Human
uacagaaugcaauaaaaugg

SEQ ID NO: 142534 - RNA, 22 nt, Human
agugggcagugcgcucggaugc

SEQ ID NO: 142535 - RNA, 22 nt, Human
gucaccagugcuaagaggugga

SEQ ID NO: 142536 - RNA, 22 nt, Human
uucaguauauuacucuugucaa

SEQ ID NO: 142537 - RNA, 22 nt, Human
guccuggggauacagaagugaa

SEQ ID NO: 142538 - RNA, 22 nt, Human
aaaugcauaucaaagacuugaa

SEQ ID NO: 142539 - RNA, 22 nt, Human
gcucagaggaugcuccuuuaug

SEQ ID NO: 142540 - RNA, 22 nt, Human
aaagaggaaccaagagcacgug

SEQ ID NO: 142541 - RNA, 22 nt, Human
uucaguaaaacacugcaauguc

SEQ ID NO: 142542 - RNA, 20 nt, Human
caggccucugggggcccugg

SEQ ID NO: 142543 - RNA, 22 nt, Human
agaaaugugaauuucauuuccu

SEQ ID NO: 142544 - RNA, 22 nt, Human
gcagcagaugcuuucauggaca

SEQ ID NO: 142545 - RNA, 22 nt, Human
uaaggcacuucaauguuuagaa

SEQ ID NO: 142546 - RNA, 22 nt, Human
ccagggcagugggagaaggugc

SEQ ID NO: 142547 - RNA, 22 nt, Human
cagcaguggccaucuguguggu

SEQ ID NO: 142548 - RNA, 22 nt, Human
uguaggaguccaaucaggagac

SEQ ID NO: 142549 - RNA, 22 nt, Human
uuguaugcugaucaaaagcuuc

SEQ ID NO: 142550 - RNA, 21 nt, Human
aaugugugcuauuuaucuuuu

SEQ ID NO: 142551 - RNA, 22 nt, Human
cagcucugaggaacacuccuuu

SEQ ID NO: 142552 - RNA, 22 nt, Human
ccuggcuguggcggugcucuca

SEQ ID NO: 142553 - RNA, 22 nt, Human
ucaugacaucuguuuaucucaa

SEQ ID NO: 142554 - RNA, 22 nt, Human
ggagcugcauuuagggagccuu

SEQ ID NO: 142555 - RNA, 22 nt, Human
uucacagacuuuccauagauug

SEQ ID NO: 142556 - RNA, 22 nt, Human
cccagcuccagagccagaaaca

SEQ ID NO: 142557 - RNA, 22 nt, Human
augcuuuuccuaaaaugaugcc

SEQ ID NO: 142558 - RNA, 22 nt, Human
gaagccaagugcaaaugccuua

SEQ ID NO: 142559 - RNA, 22 nt, Human
ggagagaauuccauggacaugu

SEQ ID NO: 142560 - RNA, 22 nt, Human
gcugugugcuaggauauguuuu

SEQ ID NO: 142561 - RNA, 22 nt, Human
accagcucagaagccagaaaga

SEQ ID NO: 142562 - RNA, 22 nt, Human
ugugugcacaggaguguuugaa

SEQ ID NO: 142563 - RNA, 22 nt, Human
cuuucucuuacccaaggaucug

SEQ ID NO: 142564 - RNA, 22 nt, Human
uuuaucaguagcaaaguuuuaa

SEQ ID NO: 142565 - RNA, 22 nt, Human
gcacagaaguaaaauacaaguc

SEQ ID NO: 142566 - RNA, 22 nt, Human
aagccgggccugagaaaugaca

SEQ ID NO: 142567 - RNA, 22 nt, Human
gagcacugauuuauuuuugucu

SEQ ID NO: 142568 - RNA, 22 nt, Human
caaaguauauuggauugaaugg

SEQ ID NO: 142569 - RNA, 22 nt, Human
uggcacuggcgcaggauggcgg

SEQ ID NO: 142570 - RNA, 22 nt, Human
cuggcuguguccacagaguaag

SEQ ID NO: 142571 - RNA, 16 nt, Human
uuucucucugcuauuu

SEQ ID NO: 142572 - RNA, 22 nt, Human
uguguaugucuguaugcacaca

SEQ ID NO: 142573 - RNA, 22 nt, Human
uacauucuggaaaggcacagac

SEQ ID NO: 142574 - RNA, 20 nt, Human
ggagagcagggaagacagua

SEQ ID NO: 142575 - RNA, 22 nt, Human
ucaaagucacaacucucuaauu

SEQ ID NO: 142576 - RNA, 22 nt, Human
uugucucugggacaugguauua

SEQ ID NO: 142577 - RNA, 22 nt, Human
aagcagaaguugaucuaccaua

SEQ ID NO: 142578 - RNA, 22 nt, Human
ugugugccccagaugaguagcu

SEQ ID NO: 142579 - RNA, 22 nt, Human
cagagccccucagcucucuccc

SEQ ID NO: 142580 - RNA, 22 nt, Human
gaggcagcugaaggagugacag

SEQ ID NO: 142581 - RNA, 22 nt, Human
gcagcccaauggacugagacag

SEQ ID NO: 142582 - RNA, 22 nt, Human
guucuucaucauuuuagauagg

SEQ ID NO: 142583 - RNA, 22 nt, Human
cugcuuuggcucagugacauca

SEQ ID NO: 142584 - RNA, 22 nt, Human
uaucuuuagaggaagagaaucu

SEQ ID NO: 142585 - RNA, 22 nt, Human
ccuggagcgcgggucaagcugg

SEQ ID NO: 142586 - RNA, 22 nt, Human
uggcagagcuggcugcggauga

SEQ ID NO: 142587 - RNA, 20 nt, Human
uacuugaauguugcagcagu

SEQ ID NO: 142588 - RNA, 22 nt, Human
agucccagccuguaggauuggg

SEQ ID NO: 142589 - RNA, 20 nt, Human
uuauuucucauucuccuacu

SEQ ID NO: 142590 - RNA, 22 nt, Human
cacaggguuguucugaggauuc

SEQ ID NO: 142591 - RNA, 19 nt, Human
ccaguagagacagcugcag

SEQ ID NO: 142592 - RNA, 22 nt, Human
ucuacccagagcuaugaccuga

SEQ ID NO: 142593 - RNA, 22 nt, Human
ccagggcauguccaagacuuag

SEQ ID NO: 142594 - RNA, 22 nt, Human
aggcacugaagaacucuuuuug

SEQ ID NO: 142595 - RNA, 22 nt, Human
ccuggcucuucagagguuccua

SEQ ID NO: 142596 - RNA, 20 nt, Human
cucucuggaaggugggagcc

SEQ ID NO: 142597 - RNA, 17 nt, Human
ucaggauguagcaguag

SEQ ID NO: 142598 - RNA, 21 nt, Human
aggcugugacuuacacuaucu

SEQ ID NO: 142599 - RNA, 22 nt, Human
cugugcugauucagcacaggcc

SEQ ID NO: 142600 - RNA, 22 nt, Human
cagcugaguguuggcauguuca

SEQ ID NO: 142601 - RNA, 22 nt, Human
caggaccccauauucacugaac

SEQ ID NO: 142602 - RNA, 20 nt, Human
gugaccagaagacagugggu

SEQ ID NO: 142603 - RNA, 22 nt, Human
agagugaaguuuuugaaaguga

SEQ ID NO: 142604 - RNA, 22 nt, Human
gcccagcagcugguggagaagg

SEQ ID NO: 142605 - RNA, 22 nt, Human
ggagccuuccagacugcccaca

SEQ ID NO: 142606 - RNA, 22 nt, Human
gauacaaauucaugucugaauu

SEQ ID NO: 142607 - RNA, 22 nt, Human
uuaauacagucuccagaaguaa

SEQ ID NO: 142608 - RNA, 22 nt, Human
uaagaacagugucugucucaca

SEQ ID NO: 142609 - RNA, 18 nt, Human
gcugcgugggaugugacc

SEQ ID NO: 142610 - RNA, 22 nt, Human
gcacagguugcaaaaguucaca

SEQ ID NO: 142611 - RNA, 22 nt, Human
cucaaguaagaaacagaauugg

SEQ ID NO: 142612 - RNA, 22 nt, Human
cagcaaaauuugaggauugccu

SEQ ID NO: 142613 - RNA, 22 nt, Human
ugccuggcaagaggggcuggcu

SEQ ID NO: 142614 - RNA, 22 nt, Human
guguauugcacauccuguagcc

SEQ ID NO: 142615 - RNA, 22 nt, Human
cugggguggauggguccaaguu

SEQ ID NO: 142616 - RNA, 22 nt, Human
gagaaguuucugguuugcauag

SEQ ID NO: 142617 - RNA, 22 nt, Human
cacacaggaugaagcagcagaa

SEQ ID NO: 142618 - RNA, 22 nt, Human
gugcagcagggggaagacagug

SEQ ID NO: 142619 - RNA, 22 nt, Human
cccuguccuggaugggagcacu

SEQ ID NO: 142620 - RNA, 22 nt, Human
aggcagugcagaguccucuucu

SEQ ID NO: 142621 - RNA, 22 nt, Human
uucaaugagcccaagaacguga

SEQ ID NO: 142622 - RNA, 22 nt, Human
aaacuuuuucuuagguaugucu

SEQ ID NO: 142623 - RNA, 22 nt, Human
guggagccaggaucuccgcaca

SEQ ID NO: 142624 - RNA, 22 nt, Human
cuacauuuuucaccgagccucu

SEQ ID NO: 142625 - RNA, 22 nt, Human
cacugagcugauagaauuccag

SEQ ID NO: 142626 - RNA, 22 nt, Human
cugaaugaggaaaagagugagg

SEQ ID NO: 142627 - RNA, 22 nt, Human
ugucucuuggcucuaucacuua

SEQ ID NO: 142628 - RNA, 22 nt, Human
gguaacaguauguagaguaaga

SEQ ID NO: 142629 - RNA, 18 nt, Human
ggagagugagaucaaaca

SEQ ID NO: 142630 - RNA, 22 nt, Human
ugaaaggugacauuucuuggau

SEQ ID NO: 142631 - RNA, 22 nt, Human
cucccagagaccaagcugagaa

SEQ ID NO: 142632 - RNA, 22 nt, Human
ccuuuugcucucccauccagaa

SEQ ID NO: 142633 - RNA, 22 nt, Human
cugucuuuucauacuuucccuc

SEQ ID NO: 142634 - RNA, 22 nt, Human
aucugguuuggggauccuugug

SEQ ID NO: 142635 - RNA, 22 nt, Human
guggccaggccgacugccaggc

SEQ ID NO: 142636 - RNA, 22 nt, Human
gagccuggauugaagugggugg

SEQ ID NO: 142637 - RNA, 22 nt, Human
agagggagcccagucauagcug

SEQ ID NO: 142638 - RNA, 20 nt, Human
auaauuuacccugcaccacu

SEQ ID NO: 142639 - RNA, 22 nt, Human
uauaauuuuagaagagauggaa

SEQ ID NO: 142640 - RNA, 22 nt, Human
cccagccucugggcucacccaa

SEQ ID NO: 142641 - RNA, 22 nt, Human
gcacccagccagcaucucagag

SEQ ID NO: 142642 - RNA, 22 nt, Human
uaaacagaaagcagauguacuu

SEQ ID NO: 142643 - RNA, 22 nt, Human
aggcacugaccugcuuccuuga

SEQ ID NO: 142644 - RNA, 20 nt, Human
cacaagagaauacacacugg

SEQ ID NO: 142645 - RNA, 22 nt, Human
ugugcguggauuccuguacuca

SEQ ID NO: 142646 - RNA, 20 nt, Human
ucucaggguucagcaaagua

SEQ ID NO: 142647 - RNA, 23 nt, Human
uggcccugaaucuguccuggagg

SEQ ID NO: 142648 - RNA, 22 nt, Human
uuauucuuuaaacauauauguu

SEQ ID NO: 142649 - RNA, 22 nt, Human
gccuggcugagguggggaggca

SEQ ID NO: 142650 - RNA, 22 nt, Human
gcaguauacacugauacaugag

SEQ ID NO: 142651 - RNA, 22 nt, Human
uccuucuuucccccuagucauu

SEQ ID NO: 142652 - RNA, 22 nt, Human
acagugucuccugguacccagu

SEQ ID NO: 142653 - RNA, 22 nt, Human
uaggccaguggcagguugugug

SEQ ID NO: 142654 - RNA, 22 nt, Human
gccucugcugacaagauggaca

SEQ ID NO: 142655 - RNA, 22 nt, Human
agcuguguguuugucaugggcg

SEQ ID NO: 142656 - RNA, 22 nt, Human
augggagugacagggccacugg

SEQ ID NO: 142657 - RNA, 22 nt, Human
aagugguagacaaagauaauug

SEQ ID NO: 142658 - RNA, 22 nt, Human
aaauguguauaugaaacaugau

SEQ ID NO: 142659 - RNA, 19 nt, Human
uggccagguacugucugcu

SEQ ID NO: 142660 - RNA, 22 nt, Human
gaaaucugucuuuguuugaaua

SEQ ID NO: 142661 - RNA, 20 nt, Human
uccaguuuuggagacauucu

SEQ ID NO: 142662 - RNA, 22 nt, Human
uacauacacaaauauacuguuu

SEQ ID NO: 142663 - RNA, 22 nt, Human
uauuuucuggacagucuugcuu

SEQ ID NO: 142664 - RNA, 22 nt, Human
gcauggcagugaggauggugcu

SEQ ID NO: 142665 - RNA, 22 nt, Human
ucucucagucagaugcuaaaga

SEQ ID NO: 142666 - RNA, 22 nt, Human
auugacaauguauuuguaucug

SEQ ID NO: 142667 - RNA, 22 nt, Human
uauguacaccggggaagguggg

SEQ ID NO: 142668 - RNA, 22 nt, Human
ucugguaaccuuuaucccuccu

SEQ ID NO: 142669 - RNA, 22 nt, Human
uucaggauucugugucugacaa

SEQ ID NO: 142670 - RNA, 22 nt, Human
aaggccaugcacauccuaggca

SEQ ID NO: 142671 - RNA, 22 nt, Human
cuucacaggcaagucuguuuuu

SEQ ID NO: 142672 - RNA, 22 nt, Human
acauuucugucuuagggacugu

SEQ ID NO: 142673 - RNA, 22 nt, Human
ucucauuugccucaucuauaaa

SEQ ID NO: 142674 - RNA, 22 nt, Human
ggcaccuggagguuuacuggau

SEQ ID NO: 142675 - RNA, 22 nt, Human
uccaaacacccuccaugcugca

SEQ ID NO: 142676 - RNA, 22 nt, Human
uagugcacacgcauguagcagu

SEQ ID NO: 142677 - RNA, 22 nt, Human
cagagccugccucuggcugugg

SEQ ID NO: 142678 - RNA, 22 nt, Human
agcuucucaggagucugaggca

SEQ ID NO: 142679 - RNA, 22 nt, Human
ugugucuguccucgguugaugc

SEQ ID NO: 142680 - RNA, 22 nt, Human
aguuaaagucugaaauagagaa

SEQ ID NO: 142681 - RNA, 22 nt, Human
uuucaucuuauuugucuacauc

SEQ ID NO: 142682 - RNA, 22 nt, Human
ugggcuacucugggagccuaac

SEQ ID NO: 142683 - RNA, 23 nt, Human
ggcugagacuacaggcgcuugcc

SEQ ID NO: 142684 - RNA, 22 nt, Human
ucaaugauagacaagaucuaag

SEQ ID NO: 142685 - RNA, 22 nt, Human
gagcaggcuugcagagaagggg

SEQ ID NO: 142686 - RNA, 22 nt, Human
ccuccugguccagcaucucuuu

SEQ ID NO: 142687 - RNA, 16 nt, Human
ugggcagaugagaaga

SEQ ID NO: 142688 - RNA, 22 nt, Human
ucauuuaauaauuuuugaguag

SEQ ID NO: 142689 - RNA, 22 nt, Human
auguuucugaguguauauacau

SEQ ID NO: 142690 - RNA, 22 nt, Human
gaguguuccagaaacuggcccu

SEQ ID NO: 142691 - RNA, 22 nt, Human
ugauuuccuggcuuuggaguuc

SEQ ID NO: 142692 - RNA, 22 nt, Human
ggcccagcccgagucagccuuc

SEQ ID NO: 142693 - RNA, 22 nt, Human
uugaaaguagcagcugcauaug

SEQ ID NO: 142694 - RNA, 23 nt, Human
aggagaagagauuuccacaugca

SEQ ID NO: 142695 - RNA, 22 nt, Human
gagggcaggggucuugcacggu

SEQ ID NO: 142696 - RNA, 17 nt, Human
guuugcaugguguuaac

SEQ ID NO: 142697 - RNA, 22 nt, Human
ccaggggaaacagggagcacuc

SEQ ID NO: 142698 - RNA, 22 nt, Human
cuccaggggccagaagccuggc

SEQ ID NO: 142699 - RNA, 22 nt, Human
guguggcugauugacaugguca

SEQ ID NO: 142700 - RNA, 22 nt, Human
uccucagacuucccuuugugua

SEQ ID NO: 142701 - RNA, 22 nt, Human
uggagcugauacagcuggcuuu

SEQ ID NO: 142702 - RNA, 22 nt, Human
cuccucuggaaauuccucugcc

SEQ ID NO: 142703 - RNA, 22 nt, Human
uaucuuuaacuugcaguauuua

SEQ ID NO: 142704 - RNA, 22 nt, Human
gagcuggugugugcccgagcac

SEQ ID NO: 142705 - RNA, 22 nt, Human
cugcuucuaagaaccugcagcu

SEQ ID NO: 142706 - RNA, 18 nt, Human
gcugagguggugucagag

SEQ ID NO: 142707 - RNA, 22 nt, Human
caugaagcuugaagcaguccac

SEQ ID NO: 142708 - RNA, 17 nt, Human
uccuucagugccucugc

SEQ ID NO: 142709 - RNA, 22 nt, Human
aucuacaggcugaggugggagg

SEQ ID NO: 142710 - RNA, 22 nt, Human
aacaugaaaguugcuaagugca

SEQ ID NO: 142711 - RNA, 22 nt, Human
aaauguguguauguacauauau

SEQ ID NO: 142712 - RNA, 22 nt, Human
augaaggcuguguggagccccc

SEQ ID NO: 142713 - RNA, 22 nt, Human
cuugugcauuucauuccucagg

SEQ ID NO: 142714 - RNA, 22 nt, Human
cagcugugcuguauuaagcucu

SEQ ID NO: 142715 - RNA, 22 nt, Human
ggcagcagaacuggcccuguau

SEQ ID NO: 142716 - RNA, 22 nt, Human
gucuucuuuaaccuacuaaagc

SEQ ID NO: 142717 - RNA, 22 nt, Human
agcagcugaucaaagcacuuau

SEQ ID NO: 142718 - RNA, 22 nt, Human
ggucuuccgagaggccugugcu

SEQ ID NO: 142719 - RNA, 21 nt, Human
ugaaugaggaggauggcauuu

SEQ ID NO: 142720 - RNA, 20 nt, Human
auaaaauaacugccacaaga

SEQ ID NO: 142721 - RNA, 22 nt, Human
gagagugagauccuccugggga

SEQ ID NO: 142722 - RNA, 22 nt, Human
cagagaaaaaauccugcucuca

SEQ ID NO: 142723 - RNA, 22 nt, Human
agaacagaugugggcagaccug

SEQ ID NO: 142724 - RNA, 22 nt, Human
agccauggcgccacuagaggga

SEQ ID NO: 142725 - RNA, 19 nt, Human
ucucuacacuacauuucua

SEQ ID NO: 142726 - RNA, 22 nt, Human
cuggaaugccucccugucagag

SEQ ID NO: 142727 - RNA, 22 nt, Human
ugcaauaacccaguaucuguga

SEQ ID NO: 142728 - RNA, 22 nt, Human
gagcacugagcuggaauuggag

SEQ ID NO: 142729 - RNA, 22 nt, Human
gaaugcagauggcugguguaug

SEQ ID NO: 142730 - RNA, 22 nt, Human
augcaucauggaaaacucaguu

SEQ ID NO: 142731 - RNA, 22 nt, Human
cugugcuuccaggauggcagcu

SEQ ID NO: 142732 - RNA, 22 nt, Human
gccacaggcacuuaagggcugg

SEQ ID NO: 142733 - RNA, 22 nt, Human
ggcuggucacaccacugcaggg

SEQ ID NO: 142734 - RNA, 22 nt, Human
ggcagaggaagcuggaaguggg

SEQ ID NO: 142735 - RNA, 22 nt, Human
cucuucuugccugaugaggcag

SEQ ID NO: 142736 - RNA, 19 nt, Human
cagaacagaggucauggcc

SEQ ID NO: 142737 - RNA, 20 nt, Human
caggcacacucauuccugcu

SEQ ID NO: 142738 - RNA, 22 nt, Human
auugaauagaugcauuauacua

SEQ ID NO: 142739 - RNA, 22 nt, Human
ugggacagggaaucugaucccc

SEQ ID NO: 142740 - RNA, 22 nt, Human
aggacuucuccgauaagucaga

SEQ ID NO: 142741 - RNA, 22 nt, Human
ugggcugccggcaggcucugcc

SEQ ID NO: 142742 - RNA, 22 nt, Human
acuuugcagagccagaagagaa

SEQ ID NO: 142743 - RNA, 22 nt, Human
auguaucaauuaucugucugca

SEQ ID NO: 142744 - RNA, 22 nt, Human
cacugaagcuuucauucucuug

SEQ ID NO: 142745 - RNA, 20 nt, Human
gccagcacagggagcaguuc

SEQ ID NO: 142746 - RNA, 22 nt, Human
aggcaaaauuacaaaguuauua

SEQ ID NO: 142747 - RNA, 22 nt, Human
ucugugcugccauccuguggcc

SEQ ID NO: 142748 - RNA, 19 nt, Human
uggcaggcccaggauggac

SEQ ID NO: 142749 - RNA, 22 nt, Human
gaggccugcuuuggcacucugg

SEQ ID NO: 142750 - RNA, 22 nt, Human
aggcugucaucuuugcaggcag

SEQ ID NO: 142751 - RNA, 22 nt, Human
uaacuuuggggacacuucucuu

SEQ ID NO: 142752 - RNA, 22 nt, Human
aaaggccauuacuugcuuuuag

SEQ ID NO: 142753 - RNA, 22 nt, Human
cagcugccccuccagggcuggg

SEQ ID NO: 142754 - RNA, 22 nt, Human
guauuauucucagcuuugggau

SEQ ID NO: 142755 - RNA, 20 nt, Human
uuucacagucccuguuuccu

SEQ ID NO: 142756 - RNA, 21 nt, Human
agcugggccucagccugcagu

SEQ ID NO: 142757 - RNA, 22 nt, Human
uacagguagagucucuaguuua

SEQ ID NO: 142758 - RNA, 22 nt, Human
agccucugcuggcccuggcacu

SEQ ID NO: 142759 - RNA, 22 nt, Human
gagauggggaauaggagcaagc

SEQ ID NO: 142760 - RNA, 22 nt, Human
gggagcugguuccugcccucca

SEQ ID NO: 142761 - RNA, 22 nt, Human
caguauguccuuccucguuggc

SEQ ID NO: 142762 - RNA, 22 nt, Human
ccucagagaaagguauggcuga

SEQ ID NO: 142763 - RNA, 22 nt, Human
uagcacauaacuuagaauaguu

SEQ ID NO: 142764 - RNA, 22 nt, Human
cauugcacuucugcuuuuccuc

SEQ ID NO: 142765 - RNA, 22 nt, Human
ucagaguggugguuuugccuuc

SEQ ID NO: 142766 - RNA, 22 nt, Human
uacaguucacaguaucauaaau

SEQ ID NO: 142767 - RNA, 22 nt, Human
gcccuuccaacccagagggcaa

SEQ ID NO: 142768 - RNA, 22 nt, Human
gaggggcucuuuaauaguaaca

SEQ ID NO: 142769 - RNA, 22 nt, Human
cagcacugcugcuguacacaca

SEQ ID NO: 142770 - RNA, 21 nt, Human
ggccucugucauccugggaag

SEQ ID NO: 142771 - RNA, 21 nt, Human
aacaaagggaugcucaucuuu

SEQ ID NO: 142772 - RNA, 22 nt, Human
uguggcucucagauccuccaau

SEQ ID NO: 142773 - RNA, 22 nt, Human
cagggccaugaggcacaggguc

SEQ ID NO: 142774 - RNA, 21 nt, Human
cacucaggguaugugccaggc

SEQ ID NO: 142775 - RNA, 22 nt, Human
agcugguggauuaugcuguaca

SEQ ID NO: 142776 - RNA, 22 nt, Human
cugagcucuaaugucagccuug

SEQ ID NO: 142777 - RNA, 22 nt, Human
caggcacuguguuaggcacugu

SEQ ID NO: 142778 - RNA, 22 nt, Human
acuaagugauucuaagcaucuu

SEQ ID NO: 142779 - RNA, 22 nt, Human
acuccagggcuccaucccuugu

SEQ ID NO: 142780 - RNA, 22 nt, Human
ccugggaggcggagguugcagg

SEQ ID NO: 142781 - RNA, 22 nt, Human
ucacugcagacaaccucaguca

SEQ ID NO: 142782 - RNA, 21 nt, Human
ccuuuacaauuuugcauuccu

SEQ ID NO: 142783 - RNA, 19 nt, Human
uugaggggccaggggagau

SEQ ID NO: 142784 - RNA, 22 nt, Human
ucucaccaaagccuugaccaua

SEQ ID NO: 142785 - RNA, 22 nt, Human
gcaucuuucuguccauucagca

SEQ ID NO: 142786 - RNA, 23 nt, Human
ugcgugugugcugaggggcgucc

SEQ ID NO: 142787 - RNA, 22 nt, Human
aaaucagugcucauuugaaagg

SEQ ID NO: 142788 - RNA, 18 nt, Human
ugcucuguuuaaugauuu

SEQ ID NO: 142789 - RNA, 22 nt, Human
auuuacagacccucccacuaag

SEQ ID NO: 142790 - RNA, 22 nt, Human
uucccucuuuuccaacaguugu

SEQ ID NO: 142791 - RNA, 22 nt, Human
ccugccugaaggucagccaccc

SEQ ID NO: 142792 - RNA, 21 nt, Human
uggcugagccaggugugugga

SEQ ID NO: 142793 - RNA, 22 nt, Human
agggcccauagaucgucagcuu

SEQ ID NO: 142794 - RNA, 21 nt, Human
agcuggcagauauggugucug

SEQ ID NO: 142795 - RNA, 22 nt, Human
uggccugaauuauggcagaucu

SEQ ID NO: 142796 - RNA, 22 nt, Human
aggaaaaaagucugugauuaua

SEQ ID NO: 142797 - RNA, 22 nt, Human
uauuguucuucacuggucuuau

SEQ ID NO: 142798 - RNA, 22 nt, Human
uugaagcauuucuuugagcuuc

SEQ ID NO: 142799 - RNA, 22 nt, Human
aaaaucugguaauuugaaugug

SEQ ID NO: 142800 - RNA, 22 nt, Human
ugccacaccaacaucuuucagc

SEQ ID NO: 142801 - RNA, 22 nt, Human
gagcucagcacuaaaaucaugu

SEQ ID NO: 142802 - RNA, 22 nt, Human
ucuggaguccagauccauuugg

SEQ ID NO: 142803 - RNA, 23 nt, Human
ccagcucccaggucugaggacug

SEQ ID NO: 142804 - RNA, 20 nt, Human
cccuggagagaagcuccacg

SEQ ID NO: 142805 - RNA, 22 nt, Human
aagauuucugcuuuuggaggca

SEQ ID NO: 142806 - RNA, 22 nt, Human
uggcagagcccagaacugagca

SEQ ID NO: 142807 - RNA, 22 nt, Human
auggacaggaacucccuuggca

SEQ ID NO: 142808 - RNA, 22 nt, Human
cuggggaggcagggcugccccu

SEQ ID NO: 142809 - RNA, 22 nt, Human
aagcagccuggcaugaugcuuu

SEQ ID NO: 142810 - RNA, 20 nt, Human
gggcuggcgcauggggaaag

SEQ ID NO: 142811 - RNA, 22 nt, Human
uuuugucuaagaacuuugcaaa

SEQ ID NO: 142812 - RNA, 22 nt, Human
uuaaauauuuucagcaggguca

SEQ ID NO: 142813 - RNA, 22 nt, Human
ucugucacccgagcaggcgaga

SEQ ID NO: 142814 - RNA, 22 nt, Human
guccugggcccaggggcugccu

SEQ ID NO: 142815 - RNA, 19 nt, Human
uaaggccaaaaguaagugu

SEQ ID NO: 142816 - RNA, 22 nt, Human
aaaugucuuugaguauuucugc

SEQ ID NO: 142817 - RNA, 22 nt, Human
ggcuggcauccagggaaaucca

SEQ ID NO: 142818 - RNA, 22 nt, Human
agugcugucccgacaacugagg

SEQ ID NO: 142819 - RNA, 21 nt, Human
ucaggcaggcgcagagggaag

SEQ ID NO: 142820 - RNA, 18 nt, Human
acagugauuguucuaugc

SEQ ID NO: 142821 - RNA, 20 nt, Human
ugggagcuggugaggucuca

SEQ ID NO: 142822 - RNA, 22 nt, Human
guucuucaggcugugcucuaga

SEQ ID NO: 142823 - RNA, 22 nt, Human
gcugucacauuuggagcacugg

SEQ ID NO: 142824 - RNA, 22 nt, Human
cccuggguucuggcugggcugc

SEQ ID NO: 142825 - RNA, 22 nt, Human
uuaaaaugcagauucugauuca

SEQ ID NO: 142826 - RNA, 21 nt, Human
uguggcugccucuggcccugg

SEQ ID NO: 142827 - RNA, 20 nt, Human
gcugucuggauuagaagccu

SEQ ID NO: 142828 - RNA, 20 nt, Human
aguguauuuggguagagugu

SEQ ID NO: 142829 - RNA, 22 nt, Human
agccuucacugggaccuuggau

SEQ ID NO: 142830 - RNA, 22 nt, Human
acagccaggagccaugggcagg

SEQ ID NO: 142831 - RNA, 22 nt, Human
gaaaugcagaaccugagaccau

SEQ ID NO: 142832 - RNA, 22 nt, Human
gugucccaaucuacuuuucccu

SEQ ID NO: 142833 - RNA, 22 nt, Human
ccuggccuccuggccuucucau

SEQ ID NO: 142834 - RNA, 22 nt, Human
uuacaguauuggucacguuugu

SEQ ID NO: 142835 - RNA, 22 nt, Human
uuuaaaaucagaugggaguugg

SEQ ID NO: 142836 - RNA, 22 nt, Human
uauuucucucacgguugccugg

SEQ ID NO: 142837 - RNA, 21 nt, Human
auaagcaugcugauuacauuu

SEQ ID NO: 142838 - RNA, 22 nt, Human
cucccuggcuuuguccugaggc

SEQ ID NO: 142839 - RNA, 22 nt, Human
caaggccaagucucugugaaga

SEQ ID NO: 142840 - RNA, 22 nt, Human
gcugucugucuucacaucucgc

SEQ ID NO: 142841 - RNA, 22 nt, Human
aagcaggauggaucuaguguuc

SEQ ID NO: 142842 - RNA, 22 nt, Human
aagcuuuuuggauuugcuucag

SEQ ID NO: 142843 - RNA, 22 nt, Human
agccuggagaagauguguauug

SEQ ID NO: 142844 - RNA, 22 nt, Human
gaagcccacguuuggugaugua

SEQ ID NO: 142845 - RNA, 22 nt, Human
uaacagaaauuuuaguuagggg

SEQ ID NO: 142846 - RNA, 22 nt, Human
gcacugaaaauguuggauucca

SEQ ID NO: 142847 - RNA, 18 nt, Human
uggcagccagcugcuccu

SEQ ID NO: 142848 - RNA, 22 nt, Human
cucuucagauaaaagggauauu

SEQ ID NO: 142849 - RNA, 19 nt, Human
uugugugucagucagaguu

SEQ ID NO: 142850 - RNA, 22 nt, Human
uccuuuuuauaguuagagaaac

SEQ ID NO: 142851 - RNA, 22 nt, Human
agucuucucauuucacaugcuu

SEQ ID NO: 142852 - RNA, 22 nt, Human
gccuccugaaaggaagagcucc

SEQ ID NO: 142853 - RNA, 22 nt, Human
uuuccucugggcccugccaccc

SEQ ID NO: 142854 - RNA, 22 nt, Human
cuuucucuguguuucacaugcu

SEQ ID NO: 142855 - RNA, 22 nt, Human
auuugucuaaugaguguguacu

SEQ ID NO: 142856 - RNA, 22 nt, Human
augugucuuugagacucugcua

SEQ ID NO: 142857 - RNA, 22 nt, Human
gcugucugggaggccuccacuu

SEQ ID NO: 142858 - RNA, 22 nt, Human
ucuucagauggccaguuguccc

SEQ ID NO: 142859 - RNA, 22 nt, Human
gcugcccaggguggagccggcu

SEQ ID NO: 142860 - RNA, 22 nt, Human
uauugaugcuuggauugggcca

SEQ ID NO: 142861 - RNA, 22 nt, Human
gaagcagcucagauugacugaa

SEQ ID NO: 142862 - RNA, 22 nt, Human
auggagacgcaagggaccuagg

SEQ ID NO: 142863 - RNA, 22 nt, Human
uggagccauaacccuuucguac

SEQ ID NO: 142864 - RNA, 22 nt, Human
ucccagagcucuggagguugga

SEQ ID NO: 142865 - RNA, 22 nt, Human
cuggcucccagcuuucagggag

SEQ ID NO: 142866 - RNA, 22 nt, Human
cagacccucgggugaguuggcc

SEQ ID NO: 142867 - RNA, 22 nt, Human
gucagaggggcagcugccaggc

SEQ ID NO: 142868 - RNA, 22 nt, Human
ggucaggguuccagguaucuuc

SEQ ID NO: 142869 - RNA, 20 nt, Human
ccagcauguacacaugugga

SEQ ID NO: 142870 - RNA, 22 nt, Human
gagccugaaauacaggucacug

SEQ ID NO: 142871 - RNA, 22 nt, Human
aguguguguuugggcgguuuau

SEQ ID NO: 142872 - RNA, 22 nt, Human
agcagggcugcagugugucuuu

SEQ ID NO: 142873 - RNA, 22 nt, Human
auuacaguaacagcuacaaugc

SEQ ID NO: 142874 - RNA, 22 nt, Human
cguguacagucuaucuuuuuuc

SEQ ID NO: 142875 - RNA, 20 nt, Human
acugcuucuuucucugaccu

SEQ ID NO: 142876 - RNA, 22 nt, Human
gcuggggaggcagcagagaaca

SEQ ID NO: 142877 - RNA, 22 nt, Human
uguaguaagugcgcaauaaaua

SEQ ID NO: 142878 - RNA, 22 nt, Human
uccauuuucuugcucuagguaa

SEQ ID NO: 142879 - RNA, 22 nt, Human
uuccauuguuucugucuucacu

SEQ ID NO: 142880 - RNA, 22 nt, Human
cuggccugaucucaugcugucc

SEQ ID NO: 142881 - RNA, 22 nt, Human
gacaggggucccucugggcugu

SEQ ID NO: 142882 - RNA, 21 nt, Human
uucuuuccccagaggacuaaa

SEQ ID NO: 142883 - RNA, 22 nt, Human
gaaaguuucuucauuaagaugu

SEQ ID NO: 142884 - RNA, 22 nt, Human
aucuggcuauuucuggucgggg

SEQ ID NO: 142885 - RNA, 22 nt, Human
caggagcucuuaaggaugugau

SEQ ID NO: 142886 - RNA, 23 nt, Human
agggcccaagccuggacagcagg

SEQ ID NO: 142887 - RNA, 17 nt, Human
ucuggccuuccugaacu

SEQ ID NO: 142888 - RNA, 22 nt, Human
aaaagacaucuauuucaggcag

SEQ ID NO: 142889 - RNA, 22 nt, Human
uucucuuuucaccaguugcuaa

SEQ ID NO: 142890 - RNA, 22 nt, Human
gcagagccugggggucugcgga

SEQ ID NO: 142891 - RNA, 22 nt, Human
aagcugccugccacgcuagaua

SEQ ID NO: 142892 - RNA, 19 nt, Human
aagcagcccuggcaagagc

SEQ ID NO: 142893 - RNA, 22 nt, Human
uccugucugcucacagagcugg

SEQ ID NO: 142894 - RNA, 22 nt, Human
gcuggcauuacaggagagaacc

SEQ ID NO: 142895 - RNA, 22 nt, Human
ggagccagugcccucuggugga

SEQ ID NO: 142896 - RNA, 22 nt, Human
aggggcucaguuacuuuggcag

SEQ ID NO: 142897 - RNA, 22 nt, Human
cccugccuugggguccacaccg

SEQ ID NO: 142898 - RNA, 22 nt, Human
gagccugaugaaacaggcagac

SEQ ID NO: 142899 - RNA, 22 nt, Human
ucauugaacgaagagcuccauu

SEQ ID NO: 142900 - RNA, 22 nt, Human
cagcugucuaaguugagcagga

SEQ ID NO: 142901 - RNA, 22 nt, Human
uccuuggcuuucuggagcuucu

SEQ ID NO: 142902 - RNA, 22 nt, Human
ccuggcagcuaagugcuuugag

SEQ ID NO: 142903 - RNA, 22 nt, Human
gguagcagggcugugagucaga

SEQ ID NO: 142904 - RNA, 22 nt, Human
ucaagcaucuuggucuacgauc

SEQ ID NO: 142905 - RNA, 18 nt, Human
gcaggagauggguggggu

SEQ ID NO: 142906 - RNA, 22 nt, Human
uuucagaaagcugaacauauga

SEQ ID NO: 142907 - RNA, 22 nt, Human
ugcugucuuccaggauggugaa

SEQ ID NO: 142908 - RNA, 22 nt, Human
auguggcuggugacugccguac

SEQ ID NO: 142909 - RNA, 22 nt, Human
gcaggugggggucggugcaucu

SEQ ID NO: 142910 - RNA, 20 nt, Human
aguguuccggaagacuggca

SEQ ID NO: 142911 - RNA, 22 nt, Human
gcugugugccaggggaaggcug

SEQ ID NO: 142912 - RNA, 22 nt, Human
gucaggauguuuauucuccagu

SEQ ID NO: 142913 - RNA, 22 nt, Human
agaugguguuuccccaggugga

SEQ ID NO: 142914 - RNA, 22 nt, Human
gguggccugcccugaucccugg

SEQ ID NO: 142915 - RNA, 22 nt, Human
cagcaugguggagcugcucuuu

SEQ ID NO: 142916 - RNA, 22 nt, Human
uggcucugccacuaacuuggua

SEQ ID NO: 142917 - RNA, 22 nt, Human
ugguacuuggaggcagaaaaau

SEQ ID NO: 142918 - RNA, 22 nt, Human
ugcagcuucuccaucuccuugu

SEQ ID NO: 142919 - RNA, 22 nt, Human
ggaggggcagccauggaacucc

SEQ ID NO: 142920 - RNA, 22 nt, Human
gcccaugcacuuucugugaugg

SEQ ID NO: 142921 - RNA, 22 nt, Human
gcagacagccagacugcacugg

SEQ ID NO: 142922 - RNA, 22 nt, Human
gucucucugacugguccacacc

SEQ ID NO: 142923 - RNA, 22 nt, Human
auacagaagaacuauagccacu

SEQ ID NO: 142924 - RNA, 22 nt, Human
cugccucuccccagaguggccc

SEQ ID NO: 142925 - RNA, 22 nt, Human
ucuggcucaggagcuguguuca

SEQ ID NO: 142926 - RNA, 22 nt, Human
uagcauuuauggucaugugucc

SEQ ID NO: 142927 - RNA, 22 nt, Human
uaacuuuuacauuuggcucacu

SEQ ID NO: 142928 - RNA, 22 nt, Human
uccaguggguugcugagggagg

SEQ ID NO: 142929 - RNA, 22 nt, Human
caguacuucuuggaaacuggau

SEQ ID NO: 142930 - RNA, 19 nt, Human
aguggcugggcagaagcaa

SEQ ID NO: 142931 - RNA, 22 nt, Human
ggaggccaccugaccugcuguu

SEQ ID NO: 142932 - RNA, 23 nt, Human
acuuaaaugguucuuuaucucag

SEQ ID NO: 142933 - RNA, 22 nt, Human
cuguggcuuugcagggcuuguu

SEQ ID NO: 142934 - RNA, 22 nt, Human
uuauuuuuaaaaguucacacag

SEQ ID NO: 142935 - RNA, 22 nt, Human
aaugggaggauuuucucucuug

SEQ ID NO: 142936 - RNA, 22 nt, Human
uggcucagccagcccuaggaac

SEQ ID NO: 142937 - RNA, 22 nt, Human
uuuuaucuaccuaugcucauuu

SEQ ID NO: 142938 - RNA, 22 nt, Human
agccaaagaucagugugcaagu

SEQ ID NO: 142939 - RNA, 22 nt, Human
ugaggccaggaucccaggcucu

SEQ ID NO: 142940 - RNA, 22 nt, Human
ccacagggccuuuccugcuggc

SEQ ID NO: 142941 - RNA, 22 nt, Human
uguccauggauagagcugcucg

SEQ ID NO: 142942 - RNA, 22 nt, Human
acagcacaaucugagucccaga

SEQ ID NO: 142943 - RNA, 22 nt, Human
uugaagauggaucgccacucuc

SEQ ID NO: 142944 - RNA, 22 nt, Human
auucaaguccagcuucucuaca

SEQ ID NO: 142945 - RNA, 19 nt, Human
ggacacagaaagcugcauu

SEQ ID NO: 142946 - RNA, 22 nt, Human
uuuucucuccagguggggugau

SEQ ID NO: 142947 - RNA, 17 nt, Human
gcagcagagagacccuc

SEQ ID NO: 142948 - RNA, 22 nt, Human
uuuuucauauuccccucucugg

SEQ ID NO: 142949 - RNA, 22 nt, Human
agccuggcacugaggcagggcg

SEQ ID NO: 142950 - RNA, 22 nt, Human
uggcagcacaagguggcccaug

SEQ ID NO: 142951 - RNA, 22 nt, Human
cagucucuugcuucauuaguug

SEQ ID NO: 142952 - RNA, 22 nt, Human
cacugcuuucacaguuuguucc

SEQ ID NO: 142953 - RNA, 22 nt, Human
gcacacagccagcugagggcua

SEQ ID NO: 142954 - RNA, 19 nt, Human
cugugagucuuguggccuc

SEQ ID NO: 142955 - RNA, 21 nt, Human
ugauuuccaucuuaaaauaaa

SEQ ID NO: 142956 - RNA, 22 nt, Human
gccagggcucgcggucccucgu

SEQ ID NO: 142957 - RNA, 22 nt, Human
gcagcuggaagugacacucugu

SEQ ID NO: 142958 - RNA, 21 nt, Human
cacaggugggucagugaggcc

SEQ ID NO: 142959 - RNA, 22 nt, Human
aaauugugcucacacugauauu

SEQ ID NO: 142960 - RNA, 22 nt, Human
ucucagagauuuuguuucccuu

SEQ ID NO: 142961 - RNA, 22 nt, Human
agggaaaguaagcauuucauua

SEQ ID NO: 142962 - RNA, 22 nt, Human
cauuuguaucauauguaucuua

SEQ ID NO: 142963 - RNA, 22 nt, Human
auucuucaucacuaccuuguga

SEQ ID NO: 142964 - RNA, 19 nt, Human
gcugugccucucuccugcu

SEQ ID NO: 142965 - RNA, 19 nt, Human
cugugcuuuaaacuccuau

SEQ ID NO: 142966 - RNA, 22 nt, Human
acacagggaggaggugcugugc

SEQ ID NO: 142967 - RNA, 22 nt, Human
ucaaauaaugccauucaucauc

SEQ ID NO: 142968 - RNA, 22 nt, Human
gcauuccuacaggcugcuauga

SEQ ID NO: 142969 - RNA, 22 nt, Human
ugucucuugaguuuguuuuaau

SEQ ID NO: 142970 - RNA, 22 nt, Human
cuuguagaauugaaauggucuc

SEQ ID NO: 142971 - RNA, 22 nt, Human
uggcagaggaaaaagucacugg

SEQ ID NO: 142972 - RNA, 22 nt, Human
ugccugugucacagugauguuu

SEQ ID NO: 142973 - RNA, 22 nt, Human
ucugagagccucuagccuaagu

SEQ ID NO: 142974 - RNA, 21 nt, Human
gagccuucccucugcccuuuc

SEQ ID NO: 142975 - RNA, 22 nt, Human
gcaggagcccuggcauguucuu

SEQ ID NO: 142976 - RNA, 22 nt, Human
uguguguccuugaccucagugg

SEQ ID NO: 142977 - RNA, 22 nt, Human
uguuaaucaaucaacaguauua

SEQ ID NO: 142978 - RNA, 22 nt, Human
cuguauuuguccucuauuuauu

SEQ ID NO: 142979 - RNA, 22 nt, Human
ggggcccagcaccccuccucgc

SEQ ID NO: 142980 - RNA, 22 nt, Human
aaggucauuguugcauguucuc

SEQ ID NO: 142981 - RNA, 22 nt, Human
aaaugccucugcuguacacaau

SEQ ID NO: 142982 - RNA, 22 nt, Human
ucuuuacaguccucugucaauc

SEQ ID NO: 142983 - RNA, 22 nt, Human
ugggcccaagagagucuccaac

SEQ ID NO: 142984 - RNA, 22 nt, Human
acaguacauaauccugagucug

SEQ ID NO: 142985 - RNA, 22 nt, Human
cagcuugggaguuugguuuuau

SEQ ID NO: 142986 - RNA, 22 nt, Human
gucuucuguaagaugagguccc

SEQ ID NO: 142987 - RNA, 22 nt, Human
cuggcucacuagcccugcccug

SEQ ID NO: 142988 - RNA, 20 nt, Human
gggagucuggaugaaagaug

SEQ ID NO: 142989 - RNA, 22 nt, Human
ccuccugggcuccugucugcac

SEQ ID NO: 142990 - RNA, 22 nt, Human
cagcugccccgcuggcugacca

SEQ ID NO: 142991 - RNA, 22 nt, Human
aggagccaagauggggcaagua

SEQ ID NO: 142992 - RNA, 22 nt, Human
agccuggccugggcaggcacau

SEQ ID NO: 142993 - RNA, 20 nt, Human
uggagccacagucagguucc

SEQ ID NO: 142994 - RNA, 22 nt, Human
gaguguggugaacaggagcacc

SEQ ID NO: 142995 - RNA, 23 nt, Human
agcuggguggccugcgugaagcu

SEQ ID NO: 142996 - RNA, 22 nt, Human
agccacagucugaugccugaga

SEQ ID NO: 142997 - RNA, 22 nt, Human
uggcagagucaucacaucugga

SEQ ID NO: 142998 - RNA, 22 nt, Human
agaagccagcuucagcugcccg

SEQ ID NO: 142999 - RNA, 22 nt, Human
uuuaucagagauauguguggac

SEQ ID NO: 143000 - RNA, 22 nt, Human
agccauugaguuuuaugugcua

SEQ ID NO: 143001 - RNA, 22 nt, Human
aagggagacaguugugugagga

SEQ ID NO: 143002 - RNA, 22 nt, Human
uucugugugcuuacugguguuc

SEQ ID NO: 143003 - RNA, 22 nt, Human
auucuucaccauggauaauuug

SEQ ID NO: 143004 - RNA, 22 nt, Human
guguguggaaugcucauuuauu

SEQ ID NO: 143005 - RNA, 22 nt, Human
cccagggacagcuagguggggc

SEQ ID NO: 143006 - RNA, 22 nt, Human
ugggcucugaagucagucugcu

SEQ ID NO: 143007 - RNA, 22 nt, Human
aggcacugggggaugagcaagg

SEQ ID NO: 143008 - RNA, 22 nt, Human
agugaaauuccuggucuuuguu

SEQ ID NO: 143009 - RNA, 22 nt, Human
ugaaaucuacccuauucagggu

SEQ ID NO: 143010 - RNA, 22 nt, Human
cagaggccuauccaguguccau

SEQ ID NO: 143011 - RNA, 22 nt, Human
ggucagccuuggauuugguagc

SEQ ID NO: 143012 - RNA, 20 nt, Human
cccuccagcaaccaggacuu

SEQ ID NO: 143013 - RNA, 21 nt, Human
guuugcaugaacaagucagcc

SEQ ID NO: 143014 - RNA, 20 nt, Human
cagggccacgcuccaaggca

SEQ ID NO: 143015 - RNA, 22 nt, Human
cagggcacaguuauggaggugg

SEQ ID NO: 143016 - RNA, 22 nt, Human
cuggccacaacuagcccaggac

SEQ ID NO: 143017 - RNA, 22 nt, Human
cagcugagcaucacuagucugg

SEQ ID NO: 143018 - RNA, 22 nt, Human
ccugacgaaaggcgugcuggag

SEQ ID NO: 143019 - RNA, 22 nt, Human
uuuuauuggagugauaccaagc

SEQ ID NO: 143020 - RNA, 22 nt, Human
aggaguggaauuacuggguucu

SEQ ID NO: 143021 - RNA, 22 nt, Human
uggcuaguaggugaguagugcu

SEQ ID NO: 143022 - RNA, 22 nt, Human
uuccaugaaggagacugagaag

SEQ ID NO: 143023 - RNA, 22 nt, Human
ccagggcaauuauuuggagggu

SEQ ID NO: 143024 - RNA, 22 nt, Human
ccagcuccucuucccaguguca

SEQ ID NO: 143025 - RNA, 22 nt, Human
uuaaauuagucaagcuucucug

SEQ ID NO: 143026 - RNA, 22 nt, Human
acaaaugccauauauaaauucu

SEQ ID NO: 143027 - RNA, 22 nt, Human
uuguacagaaaaaauucuuggu

SEQ ID NO: 143028 - RNA, 22 nt, Human
agcugguuagcaaucuaaguga

SEQ ID NO: 143029 - RNA, 22 nt, Human
agugaggcuaauaggcaauggu

SEQ ID NO: 143030 - RNA, 17 nt, Human
gagaguguauuggaugc

SEQ ID NO: 143031 - RNA, 22 nt, Human
gaaggaagugcucauacuaguu

SEQ ID NO: 143032 - RNA, 22 nt, Human
uccagggcuuggcugggacggu

SEQ ID NO: 143033 - RNA, 22 nt, Human
ucagagucauugcaaguagaag

SEQ ID NO: 143034 - RNA, 22 nt, Human
acaguaguacacaucuaugucc

SEQ ID NO: 143035 - RNA, 22 nt, Human
agucccagccuaggcugugcug

SEQ ID NO: 143036 - RNA, 22 nt, Human
uauguacaaucagcaguucaua

SEQ ID NO: 143037 - RNA, 22 nt, Human
gccuuggccaacaccuugcaaa

SEQ ID NO: 143038 - RNA, 22 nt, Human
acaaauguggacauggauaaug

SEQ ID NO: 143039 - RNA, 23 nt, Human
ugcucccaggugacgcugcuguu

SEQ ID NO: 143040 - RNA, 22 nt, Human
cuggagagaaaugacaaagcua

SEQ ID NO: 143041 - RNA, 22 nt, Human
aucuggcuggauucuuagcguu

SEQ ID NO: 143042 - RNA, 22 nt, Human
aagcugcccuguguuagaguuc

SEQ ID NO: 143043 - RNA, 18 nt, Human
gggaagaggaucuggccc

SEQ ID NO: 143044 - RNA, 22 nt, Human
aaucuucuacuugacaguucuc

SEQ ID NO: 143045 - RNA, 22 nt, Human
gggccuggggacaccaccauga

SEQ ID NO: 143046 - RNA, 22 nt, Human
cugggaggcacuauucaggagg

SEQ ID NO: 143047 - RNA, 22 nt, Human
acuuuacaauauccugugacuu

SEQ ID NO: 143048 - RNA, 22 nt, Human
ccagagcuccagggcuacagaa

SEQ ID NO: 143049 - RNA, 22 nt, Human
uuuguaaaaggaggaagcaugg

SEQ ID NO: 143050 - RNA, 19 nt, Human
ccuuccuccccagggccau

SEQ ID NO: 143051 - RNA, 22 nt, Human
gccagcccagcuccaggggaaa

SEQ ID NO: 143052 - RNA, 22 nt, Human
auggggugaccaugagcauuua

SEQ ID NO: 143053 - RNA, 22 nt, Human
uuacuuugaugaucaaugagcg

SEQ ID NO: 143054 - RNA, 22 nt, Human
caacagaaggaagcagggucag

SEQ ID NO: 143055 - RNA, 22 nt, Human
uucucucugagagcaucuggaa

SEQ ID NO: 143056 - RNA, 15 nt, Human
uguggcuggcuccug

SEQ ID NO: 143057 - RNA, 22 nt, Human
uggcucaguggcagccgcagcu

SEQ ID NO: 143058 - RNA, 22 nt, Human
agugggaggcggcugacgggcg

SEQ ID NO: 143059 - RNA, 22 nt, Human
cuggugggaggcaagguggaag

SEQ ID NO: 143060 - RNA, 22 nt, Human
uagccggguguugugucaugca

SEQ ID NO: 143061 - RNA, 22 nt, Human
gguggguauugaauacaggugu

SEQ ID NO: 143062 - RNA, 22 nt, Human
guuuucuuugaaugcuucuaga

SEQ ID NO: 143063 - RNA, 22 nt, Human
gcuccucuauuccccacauuuu

SEQ ID NO: 143064 - RNA, 22 nt, Human
ugcagcucauugguguccuggu

SEQ ID NO: 143065 - RNA, 22 nt, Human
ccaccagcuucagcagccgcgg

SEQ ID NO: 143066 - RNA, 22 nt, Human
ucuggcucuguguccccaccca

SEQ ID NO: 143067 - RNA, 22 nt, Human
guauuuauaggggaaugagagu

SEQ ID NO: 143068 - RNA, 21 nt, Human
uaacuuuugugccuaucuugu

SEQ ID NO: 143069 - RNA, 19 nt, Human
ugucuuaauuaacucagag

SEQ ID NO: 143070 - RNA, 22 nt, Human
agaauucuccuucagggcagga

SEQ ID NO: 143071 - RNA, 22 nt, Human
uguguguguccucauuugcaga

SEQ ID NO: 143072 - RNA, 22 nt, Human
agccagcaugaagacagaggcc

SEQ ID NO: 143073 - RNA, 19 nt, Human
ggccuggauuuagggcucc

SEQ ID NO: 143074 - RNA, 22 nt, Human
aggaccagaggccagagucagc

SEQ ID NO: 143075 - RNA, 23 nt, Human
uggcucuguggaucccucaggag

SEQ ID NO: 143076 - RNA, 22 nt, Human
aaaaguauuggccaccauuucu

SEQ ID NO: 143077 - RNA, 19 nt, Human
uuuggcacucugaaguguu

SEQ ID NO: 143078 - RNA, 22 nt, Human
gcugccuggcuuuaguccacuu

SEQ ID NO: 143079 - RNA, 22 nt, Human
ccuggcugcuauagcagcaugu

SEQ ID NO: 143080 - RNA, 22 nt, Human
ggggauggaauguaguagugau

SEQ ID NO: 143081 - RNA, 22 nt, Human
agccaagcaccacuggcacucg

SEQ ID NO: 143082 - RNA, 22 nt, Human
gggagggaaagcuugaucuguc

SEQ ID NO: 143083 - RNA, 22 nt, Human
aguggcuggucuaaggucacag

SEQ ID NO: 143084 - RNA, 22 nt, Human
uugaaaggugacauuguuagag

SEQ ID NO: 143085 - RNA, 18 nt, Human
caugucugcgccacaagg

SEQ ID NO: 143086 - RNA, 22 nt, Human
ugucacaaacauacauuauaga

SEQ ID NO: 143087 - RNA, 18 nt, Human
ucucuuuuccccucauug

SEQ ID NO: 143088 - RNA, 22 nt, Human
aggagccaguuccaccccagga

SEQ ID NO: 143089 - RNA, 23 nt, Human
agaugagccaacaccuccaugcc

SEQ ID NO: 143090 - RNA, 22 nt, Human
aagcagcugauuucacagcuca

SEQ ID NO: 143091 - RNA, 22 nt, Human
gggcaugagagggcagcuggca

SEQ ID NO: 143092 - RNA, 22 nt, Human
cccagcagcuugcacagugcug

SEQ ID NO: 143093 - RNA, 22 nt, Human
ccauggccgccgcugcucagga

SEQ ID NO: 143094 - RNA, 22 nt, Human
uccugugccuccaccugcuccg

SEQ ID NO: 143095 - RNA, 22 nt, Human
ccaguuuuuccagugcuuucug

SEQ ID NO: 143096 - RNA, 22 nt, Human
cuuugcagcaauuucuguuaaa

SEQ ID NO: 143097 - RNA, 22 nt, Human
cccaagcagggugcagaggcau

SEQ ID NO: 143098 - RNA, 22 nt, Human
gagugagggcagcaggggcugc

SEQ ID NO: 143099 - RNA, 22 nt, Human
uacaugaacaaaauagcagaaa

SEQ ID NO: 143100 - RNA, 23 nt, Human
acagcaagaggaccagaugugag

SEQ ID NO: 143101 - RNA, 22 nt, Human
aguaaugucccuuaaauguggu

SEQ ID NO: 143102 - RNA, 22 nt, Human
aguggcagccgagcaggagaug

SEQ ID NO: 143103 - RNA, 22 nt, Human
acagcugugaaaauccacagga

SEQ ID NO: 143104 - RNA, 22 nt, Human
guaucacuuuugagagugagaa

SEQ ID NO: 143105 - RNA, 22 nt, Human
cgcaccacugaauuccagccug

SEQ ID NO: 143106 - RNA, 23 nt, Human
cagugcagggcaacucagacucc

SEQ ID NO: 143107 - RNA, 22 nt, Human
cuggccuuuagccccagugucu

SEQ ID NO: 143108 - RNA, 22 nt, Human
gaguguucccacaccccaguug

SEQ ID NO: 143109 - RNA, 22 nt, Human
gcccagcugcacccuggugggu

SEQ ID NO: 143110 - RNA, 22 nt, Human
cccaggccagaacuugguugcu

SEQ ID NO: 143111 - RNA, 22 nt, Human
ccaggccuggaccaugccaggg

SEQ ID NO: 143112 - RNA, 22 nt, Human
uuuuucaugagacuagaaguca

SEQ ID NO: 143113 - RNA, 22 nt, Human
uuccagaaaucuuucagcucaa

SEQ ID NO: 143114 - RNA, 22 nt, Human
uggccugucuuguugugcuaga

SEQ ID NO: 143115 - RNA, 21 nt, Human
gccagccuguuuaccuguggu

SEQ ID NO: 143116 - RNA, 22 nt, Human
cuguggcucucagaggcugcug

SEQ ID NO: 143117 - RNA, 22 nt, Human
caguagccacuagacacaugua

SEQ ID NO: 143118 - RNA, 19 nt, Human
ucuuucauuucuagcucug

SEQ ID NO: 143119 - RNA, 22 nt, Human
auuuccaguccuaaugaucugg

SEQ ID NO: 143120 - RNA, 22 nt, Human
agugauggugagugagaagcuc

SEQ ID NO: 143121 - RNA, 22 nt, Human
uuguaacuuugcauacuccugu

SEQ ID NO: 143122 - RNA, 22 nt, Human
uucuuucucaacaugaauguuu

SEQ ID NO: 143123 - RNA, 22 nt, Human
ucuucuucccaucccucaaaug

SEQ ID NO: 143124 - RNA, 22 nt, Human
uggccugguuauauugcuauca

SEQ ID NO: 143125 - RNA, 22 nt, Human
aucuguguguuauuguuuauca

SEQ ID NO: 143126 - RNA, 22 nt, Human
gccucugcaucaucacuccagc

SEQ ID NO: 143127 - RNA, 22 nt, Human
aggggcucaaagugugcaggga

SEQ ID NO: 143128 - RNA, 22 nt, Human
ucagcugccccaguggccccag

SEQ ID NO: 143129 - RNA, 22 nt, Human
uuauuauugugguugcauuauc

SEQ ID NO: 143130 - RNA, 22 nt, Human
gcugagugagguccagagcuug

SEQ ID NO: 143131 - RNA, 22 nt, Human
ucaccugggagggcugugguag

SEQ ID NO: 143132 - RNA, 22 nt, Human
ugcugcucuguaaagugaugag

SEQ ID NO: 143133 - RNA, 22 nt, Human
ucuucagagacucugagccccu

SEQ ID NO: 143134 - RNA, 22 nt, Human
uuuaacuuagaagagauauccu

SEQ ID NO: 143135 - RNA, 22 nt, Human
ugucuauguauacauguguaua

SEQ ID NO: 143136 - RNA, 21 nt, Human
gcagagccugagguucuugag

SEQ ID NO: 143137 - RNA, 20 nt, Human
uuucugugagaaacacuguu

SEQ ID NO: 143138 - RNA, 22 nt, Human
uaguuucuagucaaucuucuuu

SEQ ID NO: 143139 - RNA, 22 nt, Human
gcacccagaauaaggacaggac

SEQ ID NO: 143140 - RNA, 22 nt, Human
ccugugugaagguuaggcaggu

SEQ ID NO: 143141 - RNA, 22 nt, Human
ccuggcagcaggugggcccgug

SEQ ID NO: 143142 - RNA, 22 nt, Human
gucaaguuuauccgcucauuca

SEQ ID NO: 143143 - RNA, 22 nt, Human
gaggcagcaugguaccuuggag

SEQ ID NO: 143144 - RNA, 22 nt, Human
gauguguguuuauacauauauu

SEQ ID NO: 143145 - RNA, 22 nt, Human
agggcugcuauguugauucaga

SEQ ID NO: 143146 - RNA, 22 nt, Human
gcagauggcagcccaggcuggg

SEQ ID NO: 143147 - RNA, 22 nt, Human
agucauauuuagcuuguggaau

SEQ ID NO: 143148 - RNA, 22 nt, Human
uaacacugauuuguucucaggg

SEQ ID NO: 143149 - RNA, 22 nt, Human
ucagaggaccuuacugagaacc

SEQ ID NO: 143150 - RNA, 22 nt, Human
cuauuuucauucuuacauuguc

SEQ ID NO: 143151 - RNA, 22 nt, Human
aacuuuuucugggauggagggu

SEQ ID NO: 143152 - RNA, 22 nt, Human
agggcagagcacugaauuggga

SEQ ID NO: 143153 - RNA, 22 nt, Human
aauuuucugccuagcaaaaacu

SEQ ID NO: 143154 - RNA, 22 nt, Human
ucccagacaaucauuggccacc

SEQ ID NO: 143155 - RNA, 22 nt, Human
augcaguagauaggcacuuuua

SEQ ID NO: 143156 - RNA, 22 nt, Human
cuggcucaauuuguacugcugu

SEQ ID NO: 143157 - RNA, 22 nt, Human
caguagcagggauuauuuuagg

SEQ ID NO: 143158 - RNA, 20 nt, Human
uuacagaaaugauguuauuu

SEQ ID NO: 143159 - RNA, 22 nt, Human
ugagaggccccagcucuuggcc

SEQ ID NO: 143160 - RNA, 22 nt, Human
ugugccaugaggcucugauaug

SEQ ID NO: 143161 - RNA, 22 nt, Human
gcugcccuaauaucacauguua

SEQ ID NO: 143162 - RNA, 22 nt, Human
uguguauauguaaauauaguug

SEQ ID NO: 143163 - RNA, 22 nt, Human
guuauuuuaacuucucaguaau

SEQ ID NO: 143164 - RNA, 16 nt, Human
cuuccucuucacuggc

SEQ ID NO: 143165 - RNA, 22 nt, Human
aucuggcuuuuaccccacggcc

SEQ ID NO: 143166 - RNA, 22 nt, Human
gagggugguggcuuaaggugcu

SEQ ID NO: 143167 - RNA, 22 nt, Human
cugugucuaaucuuauacauca

SEQ ID NO: 143168 - RNA, 22 nt, Human
agaagccaacagggcaggagag

SEQ ID NO: 143169 - RNA, 22 nt, Human
cuguuuaucuaggaguugcagg

SEQ ID NO: 143170 - RNA, 22 nt, Human
gucaccaggucugaugcagcca

SEQ ID NO: 143171 - RNA, 22 nt, Human
caugaagcacagcucucuuuuu

SEQ ID NO: 143172 - RNA, 22 nt, Human
ucuggcucacuucaggcuucac

SEQ ID NO: 143173 - RNA, 22 nt, Human
aaagaacaucggagugggcggg

SEQ ID NO: 143174 - RNA, 22 nt, Human
uacagaguggugagaucuuuug

SEQ ID NO: 143175 - RNA, 22 nt, Human
acauacuuuuuaaaagauugcu

SEQ ID NO: 143176 - RNA, 22 nt, Human
ucacacgugagguucuauccug

SEQ ID NO: 143177 - RNA, 22 nt, Human
ucaaaguuuuugagaauuacau

SEQ ID NO: 143178 - RNA, 22 nt, Human
agagccaggacugugucucacu

SEQ ID NO: 143179 - RNA, 22 nt, Human
uugaauucauuucucauugagu

SEQ ID NO: 143180 - RNA, 22 nt, Human
gaaucucaaggcuugugaggau

SEQ ID NO: 143181 - RNA, 22 nt, Human
gcagccccaggagacgcccagg

SEQ ID NO: 143182 - RNA, 22 nt, Human
gggcccuggggccugauuugca

SEQ ID NO: 143183 - RNA, 22 nt, Human
uaaagguagugugacauauugu

SEQ ID NO: 143184 - RNA, 22 nt, Human
aaaugcaauuguauguacucca

SEQ ID NO: 143185 - RNA, 22 nt, Human
aagggcaggaaaagauggaugu

SEQ ID NO: 143186 - RNA, 22 nt, Human
cuucugugacguaugugaggac

SEQ ID NO: 143187 - RNA, 22 nt, Human
cugcuuuguaaaauagacauaa

SEQ ID NO: 143188 - RNA, 22 nt, Human
caggcugaucagggcugggaug

SEQ ID NO: 143189 - RNA, 22 nt, Human
uggagcugaacuuugaggccag

SEQ ID NO: 143190 - RNA, 22 nt, Human
cguguaugugccugcauucaca

SEQ ID NO: 143191 - RNA, 18 nt, Human
auguguggcuuggggucc

SEQ ID NO: 143192 - RNA, 22 nt, Human
ucugucugggugccucgaguac

SEQ ID NO: 143193 - RNA, 22 nt, Human
uacacuuuauggauccuacuuu

SEQ ID NO: 143194 - RNA, 22 nt, Human
gcagagcauguccucaggacag

SEQ ID NO: 143195 - RNA, 22 nt, Human
agcagcauguaugagggugaac

SEQ ID NO: 143196 - RNA, 22 nt, Human
uuggcuguauguacaucuguua

SEQ ID NO: 143197 - RNA, 22 nt, Human
ucucucuugaaguauuagcuag

SEQ ID NO: 143198 - RNA, 22 nt, Human
ugucccauggauaccaggcuau

SEQ ID NO: 143199 - RNA, 22 nt, Human
aaguuauuuccucgugacugaa

SEQ ID NO: 143200 - RNA, 22 nt, Human
gcugagagcaaagcaugucuag

SEQ ID NO: 143201 - RNA, 22 nt, Human
auggaaagccaguguuccauca

SEQ ID NO: 143202 - RNA, 22 nt, Human
gggcuucuagaccagcagugag

SEQ ID NO: 143203 - RNA, 20 nt, Human
ucaggaugugcugagugaag

SEQ ID NO: 143204 - RNA, 23 nt, Human
gugugccaagcacugugccagga

SEQ ID NO: 143205 - RNA, 22 nt, Human
aauguguagggugccuguuuuu

SEQ ID NO: 143206 - RNA, 22 nt, Human
gcuguguucauuuugcauaugu

SEQ ID NO: 143207 - RNA, 22 nt, Human
uauuaguagcuugaaauuggug

SEQ ID NO: 143208 - RNA, 22 nt, Human
cccuguacagucucuguggcac

SEQ ID NO: 143209 - RNA, 22 nt, Human
uucugcugagugggcaggugca

SEQ ID NO: 143210 - RNA, 18 nt, Human
gccugcaggcacgggggu

SEQ ID NO: 143211 - RNA, 22 nt, Human
ccugucuggccuuccacggggg

SEQ ID NO: 143212 - RNA, 22 nt, Human
ugcuggaggccugacuguguuu

SEQ ID NO: 143213 - RNA, 22 nt, Human
uacaaaguauauuucuagcugu

SEQ ID NO: 143214 - RNA, 22 nt, Human
gcagcagaguuugggagauggu

SEQ ID NO: 143215 - RNA, 22 nt, Human
cugucuguuuuguauacaggcc

SEQ ID NO: 143216 - RNA, 22 nt, Human
gcccucagaggacagcugacuu

SEQ ID NO: 143217 - RNA, 22 nt, Human
cuuuuaaugagcauugcugucu

SEQ ID NO: 143218 - RNA, 18 nt, Human
cugagggcagccccuggg

SEQ ID NO: 143219 - RNA, 22 nt, Human
ccuguguggccgcacugcuccc

SEQ ID NO: 143220 - RNA, 22 nt, Human
cucaggagacaguguccacaug

SEQ ID NO: 143221 - RNA, 22 nt, Human
caaggcugcugcgggucgcacc

SEQ ID NO: 143222 - RNA, 22 nt, Human
uccuccagugucuggggccuug

SEQ ID NO: 143223 - RNA, 22 nt, Human
gcagagugauggaaugugggug

SEQ ID NO: 143224 - RNA, 22 nt, Human
cuuuccaaugcauuuccaaugu

SEQ ID NO: 143225 - RNA, 22 nt, Human
gcugccugccuaguuccacagu

SEQ ID NO: 143226 - RNA, 22 nt, Human
uugauacauagcacaguuuagg

SEQ ID NO: 143227 - RNA, 22 nt, Human
ugcugcuccccagcacacagca

SEQ ID NO: 143228 - RNA, 22 nt, Human
uagauuucaggcuggcuugcgg

SEQ ID NO: 143229 - RNA, 22 nt, Human
gggugggaacaggaugccagga

SEQ ID NO: 143230 - RNA, 21 nt, Human
aacauuucugggagaacucac

SEQ ID NO: 143231 - RNA, 22 nt, Human
gccuccugguugcuucuccaac

SEQ ID NO: 143232 - RNA, 22 nt, Human
augguuuguaacccaauacucc

SEQ ID NO: 143233 - RNA, 22 nt, Human
gcuggcagucccaucagcuggg

SEQ ID NO: 143234 - RNA, 22 nt, Human
cuggcugugcugcaggcuuugg

SEQ ID NO: 143235 - RNA, 22 nt, Human
gcuuccuaaaugcacagggcag

SEQ ID NO: 143236 - RNA, 22 nt, Human
cccaggcucccaggugggacaa

SEQ ID NO: 143237 - RNA, 22 nt, Human
ucuacagucaaguuauauugcu

SEQ ID NO: 143238 - RNA, 22 nt, Human
cugggaggcccacguugggaag

SEQ ID NO: 143239 - RNA, 22 nt, Human
cuguggcuggccuuauugcugc

SEQ ID NO: 143240 - RNA, 22 nt, Human
cuuacagugacccugcagauuu

SEQ ID NO: 143241 - RNA, 22 nt, Human
cugaaggacacgugaggagcca

SEQ ID NO: 143242 - RNA, 22 nt, Human
uucaguauuucaugacuuucuu

SEQ ID NO: 143243 - RNA, 22 nt, Human
uuucuuccuuaccuuacuagag

SEQ ID NO: 143244 - RNA, 23 nt, Human
uaaagacagccuucaggauucug

SEQ ID NO: 143245 - RNA, 22 nt, Human
aaggaaccuggaguagagggag

SEQ ID NO: 143246 - RNA, 22 nt, Human
ucuggccauggcaagccgagug

SEQ ID NO: 143247 - RNA, 22 nt, Human
ccagggcaggagaaagacucac

SEQ ID NO: 143248 - RNA, 22 nt, Human
ucugcuguucucaugcugauuu

SEQ ID NO: 143249 - RNA, 22 nt, Human
uaguauuuaaucacuuuugucu

SEQ ID NO: 143250 - RNA, 22 nt, Human
guuuggggucugcagagcggcg

SEQ ID NO: 143251 - RNA, 22 nt, Human
agaaacugaauuauuucugagg

SEQ ID NO: 143252 - RNA, 22 nt, Human
ucagcugaguucuagagcacuc

SEQ ID NO: 143253 - RNA, 22 nt, Human
ugagcuuacuucuguacacaga

SEQ ID NO: 143254 - RNA, 22 nt, Human
ccuggagcaaaaaucuaaggag

SEQ ID NO: 143255 - RNA, 22 nt, Human
gcagagaaaguuuuguccucag

SEQ ID NO: 143256 - RNA, 22 nt, Human
aaaucugguucaguaaguccuc

SEQ ID NO: 143257 - RNA, 22 nt, Human
gcaggcaguuauuuaguagaau

SEQ ID NO: 143258 - RNA, 22 nt, Human
gccuggagacaaggacaaaggg

SEQ ID NO: 143259 - RNA, 22 nt, Human
agcuggcccucgagagccaauu

SEQ ID NO: 143260 - RNA, 22 nt, Human
augucuaaaagauaaaguuuaa

SEQ ID NO: 143261 - RNA, 22 nt, Human
uccaaagggaagcgcuuucugu

SEQ ID NO: 143262 - RNA, 22 nt, Human
gccuaauaacuagcuguguaac

SEQ ID NO: 143263 - RNA, 22 nt, Human
ggucacaggggagaagagugau

SEQ ID NO: 143264 - RNA, 22 nt, Human
accauuuuggguauuuucagag

SEQ ID NO: 143265 - RNA, 22 nt, Human
ggcagccauggacacuggcuag

SEQ ID NO: 143266 - RNA, 22 nt, Human
ucagagugaccuuacauggucu

SEQ ID NO: 143267 - RNA, 22 nt, Human
ccagagccuggcaucugcauaa

SEQ ID NO: 143268 - RNA, 22 nt, Human
ucuguaguagguuguaguucuu

SEQ ID NO: 143269 - RNA, 22 nt, Human
gcucaggaucagccaccucuuu

SEQ ID NO: 143270 - RNA, 22 nt, Human
cuugaaagcuuugcgucuucua

SEQ ID NO: 143271 - RNA, 19 nt, Human
cagaccuguccagccugug

SEQ ID NO: 143272 - RNA, 23 nt, Human
uuacaugugugcacacauucugg

SEQ ID NO: 143273 - RNA, 22 nt, Human
aggcugugauggauguaaagga

SEQ ID NO: 143274 - RNA, 22 nt, Human
uggcaggguggcaacuuuuggu

SEQ ID NO: 143275 - RNA, 22 nt, Human
auuguuaugaaaauaagauguu

SEQ ID NO: 143276 - RNA, 23 nt, Human
cuugcagggcuggaggcuuagaa

SEQ ID NO: 143277 - RNA, 22 nt, Human
uugcauugaaugcacauuuuua

SEQ ID NO: 143278 - RNA, 22 nt, Human
cuggcagcagcuucuggaucga

SEQ ID NO: 143279 - RNA, 22 nt, Human
agcaguggagcgagauguuuaa

SEQ ID NO: 143280 - RNA, 22 nt, Human
aggagcuggaguccaggcaagu

SEQ ID NO: 143281 - RNA, 22 nt, Human
ccagucccaggcagaaauccag

SEQ ID NO: 143282 - RNA, 22 nt, Human
aauguguacaugacagauagaa

SEQ ID NO: 143283 - RNA, 22 nt, Human
gcucugcugcuuacuagauggu

SEQ ID NO: 143284 - RNA, 22 nt, Human
cugcccugagucaugccagaug

SEQ ID NO: 143285 - RNA, 22 nt, Human
gccuuuuuuguugcucugucac

SEQ ID NO: 143286 - RNA, 20 nt, Human
cuuuggcaaugagaacaggg

SEQ ID NO: 143287 - RNA, 22 nt, Human
gaggcugguaggaaaggaaaca

SEQ ID NO: 143288 - RNA, 22 nt, Human
uuaggaaauuaugguuucagau

SEQ ID NO: 143289 - RNA, 21 nt, Human
uugaaggaucacuucuguacc

SEQ ID NO: 143290 - RNA, 22 nt, Human
aagggcaggugggcauuucugg

SEQ ID NO: 143291 - RNA, 22 nt, Human
guuccaggcaagugggauagga

SEQ ID NO: 143292 - RNA, 22 nt, Human
aucacgucaugguuugaucugg

SEQ ID NO: 143293 - RNA, 22 nt, Human
uugcauguguaauuuuucuaaa

SEQ ID NO: 143294 - RNA, 22 nt, Human
aaauguguuccuuugcuacaga

SEQ ID NO: 143295 - RNA, 22 nt, Human
ugggccuggacaaggccacuag

SEQ ID NO: 143296 - RNA, 22 nt, Human
caggagugucuccacacagcaa

SEQ ID NO: 143297 - RNA, 22 nt, Human
aaagacuagcauuuauauguac

SEQ ID NO: 143298 - RNA, 22 nt, Human
aggccagagaggggaccagccu

SEQ ID NO: 143299 - RNA, 18 nt, Human
aggcuucuuggcucaguc

SEQ ID NO: 143300 - RNA, 22 nt, Human
ugcagggcuuccucuuggaguu

SEQ ID NO: 143301 - RNA, 22 nt, Human
gaugugugcuuuucgcaguguc

SEQ ID NO: 143302 - RNA, 22 nt, Human
uccaggcuggacaugaggcggg

SEQ ID NO: 143303 - RNA, 22 nt, Human
uuucagugcuucuguuuaccgg

SEQ ID NO: 143304 - RNA, 19 nt, Human
ggcccaaguacugagugcc

SEQ ID NO: 143305 - RNA, 22 nt, Human
uaucucuuucauuuuagaguca

SEQ ID NO: 143306 - RNA, 22 nt, Human
cagucccaggguugguucagcu

SEQ ID NO: 143307 - RNA, 22 nt, Human
cugugcuugacagugggaagca

SEQ ID NO: 143308 - RNA, 22 nt, Human
guguccaucagcagccacugug

SEQ ID NO: 143309 - RNA, 22 nt, Human
aaaaaguuucaacugccaacuc

SEQ ID NO: 143310 - RNA, 22 nt, Human
cccaggagguagagguugcagu

SEQ ID NO: 143311 - RNA, 22 nt, Human
cuuuaucauggagguaaauaug

SEQ ID NO: 143312 - RNA, 22 nt, Human
uucaagauggccccagugagcc

SEQ ID NO: 143313 - RNA, 20 nt, Human
aguagcagugugacauugac

SEQ ID NO: 143314 - RNA, 22 nt, Human
caggggcagucugugugcgugg

SEQ ID NO: 143315 - RNA, 22 nt, Human
uacauagcaaggaaaugacaga

SEQ ID NO: 143316 - RNA, 22 nt, Human
auuuacaggacagcuuggcauu

SEQ ID NO: 143317 - RNA, 23 nt, Human
ucucuuaccugagacauuuccua

SEQ ID NO: 143318 - RNA, 22 nt, Human
gcagagcugucuaagucacuuc

SEQ ID NO: 143319 - RNA, 22 nt, Human
ugaaggaaugaguauacuguuu

SEQ ID NO: 143320 - RNA, 22 nt, Human
ggaagagccuggggugucaggc

SEQ ID NO: 143321 - RNA, 22 nt, Human
gcaggcagaucaccugucagga

SEQ ID NO: 143322 - RNA, 17 nt, Human
ccucccacaccgcccug

SEQ ID NO: 143323 - RNA, 22 nt, Human
cucaggaggugguagaggcccu

SEQ ID NO: 143324 - RNA, 22 nt, Human
agcagggcucuguggagggugg

SEQ ID NO: 143325 - RNA, 22 nt, Human
cugggacuuuacccuguggccc

SEQ ID NO: 143326 - RNA, 22 nt, Human
ccagcaggguugguuucuucug

SEQ ID NO: 143327 - RNA, 22 nt, Human
uaacaguacauccuuuucucuu

SEQ ID NO: 143328 - RNA, 22 nt, Human
cuuucucugugugguaaagggc

SEQ ID NO: 143329 - RNA, 22 nt, Human
ugggcagacgggagcuugccuu

SEQ ID NO: 143330 - RNA, 22 nt, Human
cggagcugccugccaagccugc

SEQ ID NO: 143331 - RNA, 20 nt, Human
uucaggauucuagaccacac

SEQ ID NO: 143332 - RNA, 19 nt, Human
cuggcucuuggguggagga

SEQ ID NO: 143333 - RNA, 18 nt, Human
uaucuuuuccagugguau

SEQ ID NO: 143334 - RNA, 22 nt, Human
uuaacaugucuugacuucaucu

SEQ ID NO: 143335 - RNA, 22 nt, Human
caggaaagggaugggcugccac

SEQ ID NO: 143336 - RNA, 22 nt, Human
gcucaggacccaggugugaccu

SEQ ID NO: 143337 - RNA, 22 nt, Human
ucccagagguugagucacuuau

SEQ ID NO: 143338 - RNA, 22 nt, Human
ucucugcucugugccucaguuu

SEQ ID NO: 143339 - RNA, 22 nt, Human
uggcauguauuuguggugaauu

SEQ ID NO: 143340 - RNA, 22 nt, Human
cuggagccacuuuuuauccuuu

SEQ ID NO: 143341 - RNA, 22 nt, Human
ugaugaaacugagguuccaaga

SEQ ID NO: 143342 - RNA, 22 nt, Human
uauuucuaagagauaucuguac

SEQ ID NO: 143343 - RNA, 22 nt, Human
auggcucauuuaucuugcagcc

SEQ ID NO: 143344 - RNA, 22 nt, Human
uacuuagagcgauaauuuauac

SEQ ID NO: 143345 - RNA, 22 nt, Human
guagcccaccuggggagggcga

SEQ ID NO: 143346 - RNA, 22 nt, Human
gcagcuuggugaaaggugaugg

SEQ ID NO: 143347 - RNA, 22 nt, Human
uguaugcuuugguuguuucucu

SEQ ID NO: 143348 - RNA, 22 nt, Human
cacacuagucuauccauuagcu

SEQ ID NO: 143349 - RNA, 22 nt, Human
ccuggcugugcauugccggccc

SEQ ID NO: 143350 - RNA, 22 nt, Human
caggcagcagccacucugguau

SEQ ID NO: 143351 - RNA, 22 nt, Human
cucucccagucaggcucaggau

SEQ ID NO: 143352 - RNA, 21 nt, Human
aaggaaaagcuuggucucuga

SEQ ID NO: 143353 - RNA, 22 nt, Human
gagggcugcaaugagacagaga

SEQ ID NO: 143354 - RNA, 22 nt, Human
uccucugcucagcauuccucac

SEQ ID NO: 143355 - RNA, 22 nt, Human
uuugcucuuaugaacaaggugg

SEQ ID NO: 143356 - RNA, 22 nt, Human
ugcauauuauguguaucugucu

SEQ ID NO: 143357 - RNA, 22 nt, Human
caagaugccccugguagggauc

SEQ ID NO: 143358 - RNA, 20 nt, Human
uccagccacuuccgcugguc

SEQ ID NO: 143359 - RNA, 22 nt, Human
cuccucuucugaguaccaggga

SEQ ID NO: 143360 - RNA, 18 nt, Human
uggugaaggguggaggag

SEQ ID NO: 143361 - RNA, 22 nt, Human
ucccagggugcgccugcccucg

SEQ ID NO: 143362 - RNA, 22 nt, Human
caaggccagggaauuuuucugg

SEQ ID NO: 143363 - RNA, 22 nt, Human
ggugaaggaggaagcugaugga

SEQ ID NO: 143364 - RNA, 22 nt, Human
ccaggaggcggaagguacagug

SEQ ID NO: 143365 - RNA, 22 nt, Human
cugcaggauucucccaguugga

SEQ ID NO: 143366 - RNA, 22 nt, Human
acacccagagcgccagugccga

SEQ ID NO: 143367 - RNA, 22 nt, Human
gcagcagcccagggcucucaga

SEQ ID NO: 143368 - RNA, 22 nt, Human
uggcccucagucuugcuccugc

SEQ ID NO: 143369 - RNA, 22 nt, Human
agccacagagcaggagaccuuu

SEQ ID NO: 143370 - RNA, 22 nt, Human
uuagaaaaaggcuguggucuua

SEQ ID NO: 143371 - RNA, 22 nt, Human
cauuuccacuucugaaaacugg

SEQ ID NO: 143372 - RNA, 22 nt, Human
uuuaaacuguugauuuuaugaa

SEQ ID NO: 143373 - RNA, 22 nt, Human
uugaggagcacuagucagguau

SEQ ID NO: 143374 - RNA, 22 nt, Human
caggcagccuucucgucucaca

SEQ ID NO: 143375 - RNA, 22 nt, Human
acaaacuaccuacagauguuca

SEQ ID NO: 143376 - RNA, 22 nt, Human
ucagaggagaaguugggaaaau

SEQ ID NO: 143377 - RNA, 22 nt, Human
ggccucaguuucuccauggguu

SEQ ID NO: 143378 - RNA, 22 nt, Human
ccacagaggacaacugccuggc

SEQ ID NO: 143379 - RNA, 22 nt, Human
ccagggccaagagaccucgagg

SEQ ID NO: 143380 - RNA, 18 nt, Human
ucugucucuguccuugcu

SEQ ID NO: 143381 - RNA, 20 nt, Human
aagcaauauagugcaaaugu

SEQ ID NO: 143382 - RNA, 22 nt, Human
cuguguggccucaagccagccu

SEQ ID NO: 143383 - RNA, 22 nt, Human
ucugucuucuguagcuaauaau

SEQ ID NO: 143384 - RNA, 22 nt, Human
aacucagcauccugcacagaga

SEQ ID NO: 143385 - RNA, 22 nt, Human
guuuacagagacagaaaguagu

SEQ ID NO: 143386 - RNA, 22 nt, Human
aaguucuaauuuugcauucagg

SEQ ID NO: 143387 - RNA, 22 nt, Human
uaaagaacacagggaauagcac

SEQ ID NO: 143388 - RNA, 22 nt, Human
ucuggcucagggcucugaggga

SEQ ID NO: 143389 - RNA, 22 nt, Human
ggcccagccggcgagucucgcg

SEQ ID NO: 143390 - RNA, 22 nt, Human
gggcuucucuuuagugagcuga

SEQ ID NO: 143391 - RNA, 22 nt, Human
uugaaggaggcuccuuuuuaaa

SEQ ID NO: 143392 - RNA, 20 nt, Human
cucaggauugucuagccccu

SEQ ID NO: 143393 - RNA, 22 nt, Human
augcuguagaucuuagccucua

SEQ ID NO: 143394 - RNA, 22 nt, Human
acauuuuuauucaucaaagcag

SEQ ID NO: 143395 - RNA, 22 nt, Human
ugcuccauucucuagccagugc

SEQ ID NO: 143396 - RNA, 22 nt, Human
aucauguuccagaaacagugau

SEQ ID NO: 143397 - RNA, 22 nt, Human
acagagcaguucuggagcuggc

SEQ ID NO: 143398 - RNA, 22 nt, Human
cugucguguucacuguggccua

SEQ ID NO: 143399 - RNA, 22 nt, Human
uuacagaacugcccuaguuggc

SEQ ID NO: 143400 - RNA, 18 nt, Human
ucucagaggccauccuag

SEQ ID NO: 143401 - RNA, 22 nt, Human
ucauauuucaaaauggcuggag

SEQ ID NO: 143402 - RNA, 22 nt, Human
uccauuuuagagaugaagaaac

SEQ ID NO: 143403 - RNA, 22 nt, Human
cagccagggucaggcagcuucu

SEQ ID NO: 143404 - RNA, 22 nt, Human
uacaguauuugaagaauaugag

SEQ ID NO: 143405 - RNA, 22 nt, Human
agggccagcccauaaugccaaa

SEQ ID NO: 143406 - RNA, 20 nt, Human
gcugggggugugcugaguga

SEQ ID NO: 143407 - RNA, 22 nt, Human
gccuggcaaggcccuguugacu

SEQ ID NO: 143408 - RNA, 22 nt, Human
auucuucacauaagugcuguac

SEQ ID NO: 143409 - RNA, 22 nt, Human
uauuuccaggccccacucuaga

SEQ ID NO: 143410 - RNA, 17 nt, Human
agcugagcuggccaggg

SEQ ID NO: 143411 - RNA, 22 nt, Human
uccuguaguugcuaaguuuguu

SEQ ID NO: 143412 - RNA, 20 nt, Human
aguguaugaaucuggauggg

SEQ ID NO: 143413 - RNA, 22 nt, Human
acagauauuaugguuucuccuu

SEQ ID NO: 143414 - RNA, 22 nt, Human
auguacauuuguaguaauauca

SEQ ID NO: 143415 - RNA, 22 nt, Human
uucucuuucuacagugugauug

SEQ ID NO: 143416 - RNA, 22 nt, Human
aagggcuggccacauucugggu

SEQ ID NO: 143417 - RNA, 22 nt, Human
acauuucugcauguaggguaau

SEQ ID NO: 143418 - RNA, 22 nt, Human
guaagcaucugucucuucugca

SEQ ID NO: 143419 - RNA, 22 nt, Human
uccuugaauauaauaacaguag

SEQ ID NO: 143420 - RNA, 22 nt, Human
aaaaguaauugcaauuuuguag

SEQ ID NO: 143421 - RNA, 22 nt, Human
auccaaagauggaaagaacuuu

SEQ ID NO: 143422 - RNA, 20 nt, Human
auguagaugaaagcaaaggc

SEQ ID NO: 143423 - RNA, 22 nt, Human
uggcucugugucucccagcagc

SEQ ID NO: 143424 - RNA, 22 nt, Human
uguauuuucagaguggcauuuc

SEQ ID NO: 143425 - RNA, 22 nt, Human
ugcauuauaacugaauguuguu

SEQ ID NO: 143426 - RNA, 22 nt, Human
acagccagguaaaggcauggca

SEQ ID NO: 143427 - RNA, 19 nt, Human
uguggccaugguucagcug

SEQ ID NO: 143428 - RNA, 22 nt, Human
uccugucagugaggcagaugaa

SEQ ID NO: 143429 - RNA, 22 nt, Human
ucacaggguuuggaagccuccu

SEQ ID NO: 143430 - RNA, 22 nt, Human
aaaguguagagacuuuggaacc

SEQ ID NO: 143431 - RNA, 17 nt, Human
ucauuuguugugacuag

SEQ ID NO: 143432 - RNA, 22 nt, Human
cugggcagugcagcuauagaac

SEQ ID NO: 143433 - RNA, 19 nt, Human
gcuguauuaaagauacaug

SEQ ID NO: 143434 - RNA, 22 nt, Human
agcuggagccagugugaggcuu

SEQ ID NO: 143435 - RNA, 22 nt, Human
cagaggccauauuucuucacuc

SEQ ID NO: 143436 - RNA, 22 nt, Human
ugcccugugugugcaagcacug

SEQ ID NO: 143437 - RNA, 22 nt, Human
cugcugcugcuaucuacccagg

SEQ ID NO: 143438 - RNA, 22 nt, Human
gggcucuggauggagccugcag

SEQ ID NO: 143439 - RNA, 22 nt, Human
agauuucccucuuguauuugca

SEQ ID NO: 143440 - RNA, 20 nt, Human
cucugcuuuaggagagucag

SEQ ID NO: 143441 - RNA, 22 nt, Human
uuauguauggauggcugaaagu

SEQ ID NO: 143442 - RNA, 22 nt, Human
cauaacuagagugaaauguuga

SEQ ID NO: 143443 - RNA, 22 nt, Human
agccaaggcagcuagagcucug

SEQ ID NO: 143444 - RNA, 22 nt, Human
uggcccugcuaugauccugcaa

SEQ ID NO: 143445 - RNA, 20 nt, Human
gucucaaguaucucacaguc

SEQ ID NO: 143446 - RNA, 22 nt, Human
gcagggcuguucaggagggugg

SEQ ID NO: 143447 - RNA, 22 nt, Human
acugucacuccaacugagucgu

SEQ ID NO: 143448 - RNA, 22 nt, Human
cucagggucugguccuuagauu

SEQ ID NO: 143449 - RNA, 22 nt, Human
ggcuucucgugccgaagcaaga

SEQ ID NO: 143450 - RNA, 23 nt, Human
cccuggaguaaauucuuggaagg

SEQ ID NO: 143451 - RNA, 22 nt, Human
uccccagccgugaaggagagga

SEQ ID NO: 143452 - RNA, 22 nt, Human
caggagcccagaguccucagcu

SEQ ID NO: 143453 - RNA, 22 nt, Human
cuugcaggauuuugcugcugua

SEQ ID NO: 143454 - RNA, 22 nt, Human
cagggcaggacagauacauuac

SEQ ID NO: 143455 - RNA, 22 nt, Human
ccgggccucgggacaccgggua

SEQ ID NO: 143456 - RNA, 22 nt, Human
cuuuauguuggggugucuuagu

SEQ ID NO: 143457 - RNA, 22 nt, Human
ucuuuucuguaacucagugucu

SEQ ID NO: 143458 - RNA, 22 nt, Human
ucacaguaguuguucucuguuu

SEQ ID NO: 143459 - RNA, 22 nt, Human
uggcucagcagguuagaaacua

SEQ ID NO: 143460 - RNA, 22 nt, Human
ugagcccaggaguaugaggcug

SEQ ID NO: 143461 - RNA, 22 nt, Human
gcagggcagccacaggcccccu

SEQ ID NO: 143462 - RNA, 22 nt, Human
ccaaaauguuugaaugcaugug

SEQ ID NO: 143463 - RNA, 22 nt, Human
uuuaacuccuaguguguauuag

SEQ ID NO: 143464 - RNA, 22 nt, Human
aagugaguggccuggagaggug

SEQ ID NO: 143465 - RNA, 22 nt, Human
aaacuuuucuuggggaccugcc

SEQ ID NO: 143466 - RNA, 22 nt, Human
aauaauuuuagcucagaguugu

SEQ ID NO: 143467 - RNA, 22 nt, Human
aaaugcaucagcucauaagaga

SEQ ID NO: 143468 - RNA, 22 nt, Human
acauuucuuccacaugcugcug

SEQ ID NO: 143469 - RNA, 22 nt, Human
ccugucugaaggcagggggaug

SEQ ID NO: 143470 - RNA, 22 nt, Human
gugcagugacccuggagagcug

SEQ ID NO: 143471 - RNA, 22 nt, Human
agcuauauagaugguguguuug

SEQ ID NO: 143472 - RNA, 22 nt, Human
cagcuggcgggcagagccgcca

SEQ ID NO: 143473 - RNA, 22 nt, Human
uucucuuagcuguaaagucaau

SEQ ID NO: 143474 - RNA, 22 nt, Human
ccagagaccagaacauggggau

SEQ ID NO: 143475 - RNA, 22 nt, Human
cucuccagaauaugccgccgug

SEQ ID NO: 143476 - RNA, 22 nt, Human
gccuggagaauuaaaaggaagg

SEQ ID NO: 143477 - RNA, 22 nt, Human
aacuuuguuuuauucacugcug

SEQ ID NO: 143478 - RNA, 21 nt, Human
cagcuuugucugucuucgggg

SEQ ID NO: 143479 - RNA, 22 nt, Human
ggcucugguugaccaugauggc

SEQ ID NO: 143480 - RNA, 19 nt, Human
acacugaauguagaauugg

SEQ ID NO: 143481 - RNA, 23 nt, Human
gcucagagguuuuucucuggaug

SEQ ID NO: 143482 - RNA, 22 nt, Human
ucuucagaggaagucagucuuu

SEQ ID NO: 143483 - RNA, 23 nt, Human
gguggcaggaguggaugcugagc

SEQ ID NO: 143484 - RNA, 22 nt, Human
ggagcugcacgcucugaagccu

SEQ ID NO: 143485 - RNA, 21 nt, Human
uucagcaguccucuagagaua

SEQ ID NO: 143486 - RNA, 22 nt, Human
uauugacagagggucagaagag

SEQ ID NO: 143487 - RNA, 22 nt, Human
ggccuguccagccugccuggcu

SEQ ID NO: 143488 - RNA, 22 nt, Human
uucucauucugacucaguguag

SEQ ID NO: 143489 - RNA, 22 nt, Human
cucucucuaugcguuguuccua

SEQ ID NO: 143490 - RNA, 22 nt, Human
ggcgaggccgggacaggcugga

SEQ ID NO: 143491 - RNA, 23 nt, Human
uggcugagauccuacuguuugcu

SEQ ID NO: 143492 - RNA, 22 nt, Human
ugaggcagcuuuuucugugugu

SEQ ID NO: 143493 - RNA, 22 nt, Human
uggugccuugggccuacagcgc

SEQ ID NO: 143494 - RNA, 22 nt, Human
ccucagagguuuucauucugua

SEQ ID NO: 143495 - RNA, 22 nt, Human
ugcccacauggugccauggcca

SEQ ID NO: 143496 - RNA, 22 nt, Human
uuucaugaggggcaaaaucuca

SEQ ID NO: 143497 - RNA, 22 nt, Human
gcugucaguuuuacccacagac

SEQ ID NO: 143498 - RNA, 22 nt, Human
cacugcuuaguugguaaaugug

SEQ ID NO: 143499 - RNA, 23 nt, Human
agaggccaacuucuugccccucc

SEQ ID NO: 143500 - RNA, 22 nt, Human
ggcuguauauacuguauacagu

SEQ ID NO: 143501 - RNA, 22 nt, Human
uugaaagucacaauggcauuaa

SEQ ID NO: 143502 - RNA, 21 nt, Human
uuagacuuggguuuuuccugg

SEQ ID NO: 143503 - RNA, 22 nt, Human
uggcaguggcucagagugcaga

SEQ ID NO: 143504 - RNA, 22 nt, Human
cacccagcagcacuuaagacua

SEQ ID NO: 143505 - RNA, 22 nt, Human
cugagccagggccacacaugga

SEQ ID NO: 143506 - RNA, 22 nt, Human
auggacaggcugagcuuccuca

SEQ ID NO: 143507 - RNA, 22 nt, Human
cugccuggccugaucuccacgc

SEQ ID NO: 143508 - RNA, 22 nt, Human
cuuuacagugaacuugcuuguc

SEQ ID NO: 143509 - RNA, 22 nt, Human
guguugaugacauuuuagaaac

SEQ ID NO: 143510 - RNA, 22 nt, Human
cagggcagggauguugcggcag

SEQ ID NO: 143511 - RNA, 22 nt, Human
uaaucacaucaggguaaauggg

SEQ ID NO: 143512 - RNA, 22 nt, Human
gcaugggcaagaggacuggggg

SEQ ID NO: 143513 - RNA, 22 nt, Human
cagcagagcauuugguaggagg

SEQ ID NO: 143514 - RNA, 22 nt, Human
gcugccuuugugagccaagggg

SEQ ID NO: 143515 - RNA, 22 nt, Human
uucacauugguucuugauagcu

SEQ ID NO: 143516 - RNA, 22 nt, Human
gcuggcuccucuguccucacgg

SEQ ID NO: 143517 - RNA, 15 nt, Human
aucucucuagcugcu

SEQ ID NO: 143518 - RNA, 22 nt, Human
uuugcauugccucugacuuaug

SEQ ID NO: 143519 - RNA, 22 nt, Human
cugcugggcagaggcugcauga

SEQ ID NO: 143520 - RNA, 22 nt, Human
cuggggacuugcagacacaauu

SEQ ID NO: 143521 - RNA, 17 nt, Human
ggagagugggaauggcc

SEQ ID NO: 143522 - RNA, 22 nt, Human
uagugaaacaguuaucaaucug

SEQ ID NO: 143523 - RNA, 22 nt, Human
cagggagaggcaucauagggaa

SEQ ID NO: 143524 - RNA, 22 nt, Human
caauaugcaagcuauuaaguau

SEQ ID NO: 143525 - RNA, 22 nt, Human
aguggcuggacgacaaggguga

SEQ ID NO: 143526 - RNA, 22 nt, Human
agagcuuagaauuucagaugau

SEQ ID NO: 143527 - RNA, 22 nt, Human
guucuucaucauuaacacucug

SEQ ID NO: 143528 - RNA, 22 nt, Human
cccugggcaagcccuauuuucc

SEQ ID NO: 143529 - RNA, 22 nt, Human
gcauuucuuccuggugugagcc

SEQ ID NO: 143530 - RNA, 22 nt, Human
agugcuguccaguuucacaggu

SEQ ID NO: 143531 - RNA, 22 nt, Human
cugcagggcccgccugagcccu

SEQ ID NO: 143532 - RNA, 22 nt, Human
uaaggccaaguucauauacaac

SEQ ID NO: 143533 - RNA, 22 nt, Human
aggcuguguuuaagugguaaug

SEQ ID NO: 143534 - RNA, 22 nt, Human
uucucugugagggugcuggauu

SEQ ID NO: 143535 - RNA, 22 nt, Human
ucccagagcagaugugcuaaag

SEQ ID NO: 143536 - RNA, 23 nt, Human
ucagagagcuguugagagcugcc

SEQ ID NO: 143537 - RNA, 22 nt, Human
uucucugccucuagcuauauuc

SEQ ID NO: 143538 - RNA, 22 nt, Human
aaggccugggaguacugggaca

SEQ ID NO: 143539 - RNA, 22 nt, Human
gcuuuauguaaguccaaaggca

SEQ ID NO: 143540 - RNA, 22 nt, Human
ugaacccaggagguugcaguga

SEQ ID NO: 143541 - RNA, 22 nt, Human
cucugcuuggaacuggacagaa

SEQ ID NO: 143542 - RNA, 22 nt, Human
cccaggcuggagugcaauggca

SEQ ID NO: 143543 - RNA, 19 nt, Human
uacuuuuucaggacagagu

SEQ ID NO: 143544 - RNA, 22 nt, Human
agcagccacccagcugcucauu

SEQ ID NO: 143545 - RNA, 22 nt, Human
uuaaguccuugguaauuuucuu

SEQ ID NO: 143546 - RNA, 22 nt, Human
ugguggccaauucacagggcuc

SEQ ID NO: 143547 - RNA, 23 nt, Human
ugccagaggcagucacaguggug

SEQ ID NO: 143548 - RNA, 22 nt, Human
aggagcugaagucucugcacuc

SEQ ID NO: 143549 - RNA, 22 nt, Human
gaguggggcguggauccagcgu

SEQ ID NO: 143550 - RNA, 22 nt, Human
uguacaaugccgagacuaacuc

SEQ ID NO: 143551 - RNA, 22 nt, Human
agucucagaaaagaagcaugga

SEQ ID NO: 143552 - RNA, 19 nt, Human
ugccagcauuaggcugaag

SEQ ID NO: 143553 - RNA, 20 nt, Human
uuucaguuaucuugaccuuc

SEQ ID NO: 143554 - RNA, 22 nt, Human
cugccaucugagccaaaagugc

SEQ ID NO: 143555 - RNA, 22 nt, Human
aggugccagcucucaggcagga

SEQ ID NO: 143556 - RNA, 22 nt, Human
aaguucaaggugauaguggcag

SEQ ID NO: 143557 - RNA, 22 nt, Human
cuggagccacugggucuuguau

SEQ ID NO: 143558 - RNA, 22 nt, Human
gcccccucuuuggagccagcca

SEQ ID NO: 143559 - RNA, 23 nt, Human
ucccuggaggcagguccagggcc

SEQ ID NO: 143560 - RNA, 22 nt, Human
auuugucucucuggguuuacuu

SEQ ID NO: 143561 - RNA, 22 nt, Human
caggcagccugcggucugcaca

SEQ ID NO: 143562 - RNA, 22 nt, Human
caaggccaguucaccaagggca

SEQ ID NO: 143563 - RNA, 22 nt, Human
accugccuucucaaggacauga

SEQ ID NO: 143564 - RNA, 22 nt, Human
agggcagccaugagccuucagg

SEQ ID NO: 143565 - RNA, 22 nt, Human
ucuguguauaggguugugcgcu

SEQ ID NO: 143566 - RNA, 22 nt, Human
ucucugugucuuagugaaggga

SEQ ID NO: 143567 - RNA, 22 nt, Human
auaacagagagcuacugaacug

SEQ ID NO: 143568 - RNA, 22 nt, Human
accugccucuaagcagcaggug

SEQ ID NO: 143569 - RNA, 22 nt, Human
gugccugcugcagagucgcugu

SEQ ID NO: 143570 - RNA, 22 nt, Human
uguggcugaucaaagcgcucag

SEQ ID NO: 143571 - RNA, 19 nt, Human
ggaugagggucaggcauag

SEQ ID NO: 143572 - RNA, 22 nt, Human
gcaagauguuaacauagggaga

SEQ ID NO: 143573 - RNA, 22 nt, Human
ugugggugaugaauuuguucuu

SEQ ID NO: 143574 - RNA, 22 nt, Human
gacacagcacuguacaaggaau

SEQ ID NO: 143575 - RNA, 22 nt, Human
uggcucaggguccccaaauggu

SEQ ID NO: 143576 - RNA, 22 nt, Human
agcagcugagaugguaagauuc

SEQ ID NO: 143577 - RNA, 22 nt, Human
cacagaaaaaggcuugaaaauc

SEQ ID NO: 143578 - RNA, 22 nt, Human
uuuacagucugucuagcaaugu

SEQ ID NO: 143579 - RNA, 22 nt, Human
auugugcaaauauuaucuguag

SEQ ID NO: 143580 - RNA, 22 nt, Human
ccugcuggccaguggagggcug

SEQ ID NO: 143581 - RNA, 22 nt, Human
gagggggcgugcaaggcuccgc

SEQ ID NO: 143582 - RNA, 22 nt, Human
uuucuguaauuaaaagggcagg

SEQ ID NO: 143583 - RNA, 22 nt, Human
agaggccagguccagaguuugu

SEQ ID NO: 143584 - RNA, 22 nt, Human
gcugggcaccggagagacccca

SEQ ID NO: 143585 - RNA, 22 nt, Human
ugagccuggggccugggcagcg

SEQ ID NO: 143586 - RNA, 22 nt, Human
agcagggcagugaucagaaagg

SEQ ID NO: 143587 - RNA, 22 nt, Human
gcagaggcauuucugacgcugc

SEQ ID NO: 143588 - RNA, 22 nt, Human
uagcagggucucaggagucagg

SEQ ID NO: 143589 - RNA, 22 nt, Human
uauguguacaucugguugagca

SEQ ID NO: 143590 - RNA, 22 nt, Human
agcugugugcccaugguggagg

SEQ ID NO: 143591 - RNA, 22 nt, Human
uguguuuuacaaauucucuuaa

SEQ ID NO: 143592 - RNA, 22 nt, Human
aggcugcuggcaggcguggacg

SEQ ID NO: 143593 - RNA, 22 nt, Human
ucaaacuagccugacugguauu

SEQ ID NO: 143594 - RNA, 22 nt, Human
uuucagaugcaauuaauuuuca

SEQ ID NO: 143595 - RNA, 22 nt, Human
ugggcugcugucugcacaugcu

SEQ ID NO: 143596 - RNA, 22 nt, Human
uuuugaaagggugauuuggcuu

SEQ ID NO: 143597 - RNA, 22 nt, Human
ccacagagcauuagauuucaga

SEQ ID NO: 143598 - RNA, 22 nt, Human
cccagcaguaaccaguggaaau

SEQ ID NO: 143599 - RNA, 20 nt, Human
ucucuauucccacgaggaaa

SEQ ID NO: 143600 - RNA, 22 nt, Human
aacauuucagcaaauaagaaca

SEQ ID NO: 143601 - RNA, 22 nt, Human
uuucaaagucaauaucauuacc

SEQ ID NO: 143602 - RNA, 22 nt, Human
gaaacccaaacuaagacaguag

SEQ ID NO: 143603 - RNA, 22 nt, Human
gcuccucuucucccacugaaug

SEQ ID NO: 143604 - RNA, 22 nt, Human
augccacugacauggacaauuu

SEQ ID NO: 143605 - RNA, 22 nt, Human
cagcccucagguccucagcagc

SEQ ID NO: 143606 - RNA, 20 nt, Human
caguccaaucagaggccacc

SEQ ID NO: 143607 - RNA, 22 nt, Human
agggucccgaaggagacagcaa

SEQ ID NO: 143608 - RNA, 21 nt, Human
gcugagagguugggaaguuca

SEQ ID NO: 143609 - RNA, 22 nt, Human
cacucugcagcugaagggcugg

SEQ ID NO: 143610 - RNA, 22 nt, Human
ugugcccaucccucuggagugu

SEQ ID NO: 143611 - RNA, 22 nt, Human
ucuucauuuuauagcaucugug

SEQ ID NO: 143612 - RNA, 19 nt, Human
ccaggccaucccaguuccc

SEQ ID NO: 143613 - RNA, 22 nt, Human
ucaaaagucugcauucuucaca

SEQ ID NO: 143614 - RNA, 22 nt, Human
caaugugucaggaaaagggcca

SEQ ID NO: 143615 - RNA, 20 nt, Human
cugggaggucuuccaaauca

SEQ ID NO: 143616 - RNA, 22 nt, Human
cuggcucaccuccgcuccagca

SEQ ID NO: 143617 - RNA, 22 nt, Human
gcagggucgcucuaggagauca

SEQ ID NO: 143618 - RNA, 22 nt, Human
agugagggaugaagaacugcgg

SEQ ID NO: 143619 - RNA, 22 nt, Human
guuuucucugagaugccuuucu

SEQ ID NO: 143620 - RNA, 20 nt, Human
uccaggagaacugggagccg

SEQ ID NO: 143621 - RNA, 22 nt, Human
uuacaguaccuguauggccacu

SEQ ID NO: 143622 - RNA, 22 nt, Human
cugccuggaaugccagcuucuc

SEQ ID NO: 143623 - RNA, 22 nt, Human
uaacagaaaggggacagaaaua

SEQ ID NO: 143624 - RNA, 22 nt, Human
uguggucucguuauguugccca

SEQ ID NO: 143625 - RNA, 22 nt, Human
cugcugcauuacucuucucaag

SEQ ID NO: 143626 - RNA, 22 nt, Human
gaggccugguuugcaugagaau

SEQ ID NO: 143627 - RNA, 22 nt, Human
gggcugggcaugguguucccuc

SEQ ID NO: 143628 - RNA, 22 nt, Human
cacaggggcaaacuguagggga

SEQ ID NO: 143629 - RNA, 22 nt, Human
ggcagagcuuguuccuucuguu

SEQ ID NO: 143630 - RNA, 22 nt, Human
ucuguaucacccguucccagaa

SEQ ID NO: 143631 - RNA, 22 nt, Human
auaaggcaucucucaguuagca

SEQ ID NO: 143632 - RNA, 22 nt, Human
gcugucugcugugcacugagca

SEQ ID NO: 143633 - RNA, 22 nt, Human
cugaggccucuguucaccagaa

SEQ ID NO: 143634 - RNA, 22 nt, Human
cagccaggcccccgagucguug

SEQ ID NO: 143635 - RNA, 22 nt, Human
uccuuggcaugccgucuucucc

SEQ ID NO: 143636 - RNA, 22 nt, Human
ugacaccacaacuagccauuga

SEQ ID NO: 143637 - RNA, 22 nt, Human
gguccccagcaguggcugcuuc

SEQ ID NO: 143638 - RNA, 22 nt, Human
cucuguagaaacagggcagaag

SEQ ID NO: 143639 - RNA, 18 nt, Human
gucauugcaacauacugu

SEQ ID NO: 143640 - RNA, 22 nt, Human
ugagagugaaaugucacauguc

SEQ ID NO: 143641 - RNA, 22 nt, Human
guggaauguccuugaucauaag

SEQ ID NO: 143642 - RNA, 22 nt, Human
auguggcuuggcagggaauaug

SEQ ID NO: 143643 - RNA, 22 nt, Human
ggcccuguccuggcugucuccg

SEQ ID NO: 143644 - RNA, 22 nt, Human
uggaagcacuuggguuuuguug

SEQ ID NO: 143645 - RNA, 22 nt, Human
cccugcagcuuuugcauaguca

SEQ ID NO: 143646 - RNA, 21 nt, Human
agugaaauugcaucagaggga

SEQ ID NO: 143647 - RNA, 22 nt, Human
agccuucagcaguucaggugcc

SEQ ID NO: 143648 - RNA, 22 nt, Human
cccagcagccagaaugaggagc

SEQ ID NO: 143649 - RNA, 22 nt, Human
aauauuucuccuucguuauagc

SEQ ID NO: 143650 - RNA, 21 nt, Human
gugguuauuuucauuagcauc

SEQ ID NO: 143651 - RNA, 22 nt, Human
ugcagcauuauucacaguagcc

SEQ ID NO: 143652 - RNA, 22 nt, Human
guggagcccugguagggacccc

SEQ ID NO: 143653 - RNA, 22 nt, Human
uccugcagaccucagucagguc

SEQ ID NO: 143654 - RNA, 22 nt, Human
uuuuguaugagaagugcuuuac

SEQ ID NO: 143655 - RNA, 22 nt, Human
uacuuuagaaggaaauaaguuc

SEQ ID NO: 143656 - RNA, 22 nt, Human
ggagggcaucaaucaggccugg

SEQ ID NO: 143657 - RNA, 22 nt, Human
cccaggcuggauuucgguggca

SEQ ID NO: 143658 - RNA, 22 nt, Human
ccaggugggaggaaagcagaga

SEQ ID NO: 143659 - RNA, 23 nt, Human
agaaaagcuuggacacauggccu

SEQ ID NO: 143660 - RNA, 22 nt, Human
ggaggccaaggugggcggauca

SEQ ID NO: 143661 - RNA, 22 nt, Human
uucuauguaccuagcguuguau

SEQ ID NO: 143662 - RNA, 22 nt, Human
aaaggucaaaaucgugacauug

SEQ ID NO: 143663 - RNA, 22 nt, Human
uuuggaaaguguacaaauuuga

SEQ ID NO: 143664 - RNA, 22 nt, Human
cauauuuuaguugcugaacagc

SEQ ID NO: 143665 - RNA, 19 nt, Human
ccagcagacacagcugccc

SEQ ID NO: 143666 - RNA, 22 nt, Human
acuuguuucaacuguacucucc

SEQ ID NO: 143667 - RNA, 22 nt, Human
cagggguguuuuuggccaggag

SEQ ID NO: 143668 - RNA, 22 nt, Human
gguggcagcgucuaucugacau

SEQ ID NO: 143669 - RNA, 23 nt, Human
cuccucguaacucuguggugggu

SEQ ID NO: 143670 - RNA, 22 nt, Human
cagaccagcucuaugaacccaa

SEQ ID NO: 143671 - RNA, 22 nt, Human
gaagagcugcaguuuccugggc

SEQ ID NO: 143672 - RNA, 22 nt, Human
ggcugcuggaagacugaacaag

SEQ ID NO: 143673 - RNA, 22 nt, Human
ccuuccaggagucucugcaggu

SEQ ID NO: 143674 - RNA, 22 nt, Human
ggcuggcuugccaagcucaggg

SEQ ID NO: 143675 - RNA, 22 nt, Human
gggauggacuuggggacuccag

SEQ ID NO: 143676 - RNA, 22 nt, Human
aguauauuuaccauuggguggg

SEQ ID NO: 143677 - RNA, 23 nt, Human
ggccauggagacuuagaaugggc

SEQ ID NO: 143678 - RNA, 22 nt, Human
uucuucaaugugcccuguuuuc

SEQ ID NO: 143679 - RNA, 22 nt, Human
cugaaauuccauuucagccaca

SEQ ID NO: 143680 - RNA, 22 nt, Human
auccaaagcccuaaguuaacug

SEQ ID NO: 143681 - RNA, 22 nt, Human
gaauuguagagggaacagaagc

SEQ ID NO: 143682 - RNA, 22 nt, Human
ccugggugaaaucucuccugca

SEQ ID NO: 143683 - RNA, 22 nt, Human
agauaacuuuuggguauucaug

SEQ ID NO: 143684 - RNA, 22 nt, Human
agaauuguaagcaauuugauua

SEQ ID NO: 143685 - RNA, 20 nt, Human
ucuggcucuuugcuccuccc

SEQ ID NO: 143686 - RNA, 22 nt, Human
uacuguauacuacugcuguucu

SEQ ID NO: 143687 - RNA, 22 nt, Human
uugcagcuuagugauguuaucu

SEQ ID NO: 143688 - RNA, 22 nt, Human
agcugucuaccugcagaguccu

SEQ ID NO: 143689 - RNA, 22 nt, Human
uuguccuuaccucaaucuggaa

SEQ ID NO: 143690 - RNA, 22 nt, Human
acucacauuucaucaggccaag

SEQ ID NO: 143691 - RNA, 22 nt, Human
acuuucuuauccaugaucucac

SEQ ID NO: 143692 - RNA, 22 nt, Human
agucuauuuccccuucucuuga

SEQ ID NO: 143693 - RNA, 22 nt, Human
gcucugcuguguuuguucagca

SEQ ID NO: 143694 - RNA, 21 nt, Human
agaugaggauacugaggccua

SEQ ID NO: 143695 - RNA, 18 nt, Human
uggagcaggaagccuggc

SEQ ID NO: 143696 - RNA, 22 nt, Human
gauuuccuugcauauugguaau

SEQ ID NO: 143697 - RNA, 22 nt, Human
cccucugcucaggugcauaggc

SEQ ID NO: 143698 - RNA, 19 nt, Human
agggaaggauucugucauu

SEQ ID NO: 143699 - RNA, 22 nt, Human
agaaaguucugugaguuguuca

SEQ ID NO: 143700 - RNA, 22 nt, Human
augagcuucccagacaggaugg

SEQ ID NO: 143701 - RNA, 22 nt, Human
gcucccagauuucagccuugug

SEQ ID NO: 143702 - RNA, 17 nt, Human
aggcauggucuggggug

SEQ ID NO: 143703 - RNA, 22 nt, Human
ggcuucagugacuggugcccuc

SEQ ID NO: 143704 - RNA, 20 nt, Human
ucuuugugucagauggacag

SEQ ID NO: 143705 - RNA, 21 nt, Human
gccucugcugucuuauuguga

SEQ ID NO: 143706 - RNA, 19 nt, Human
gagaggccugugcuugaag

SEQ ID NO: 143707 - RNA, 22 nt, Human
auccaguuuaugucauauucuu

SEQ ID NO: 143708 - RNA, 19 nt, Human
cagagcagugguuccugaa

SEQ ID NO: 143709 - RNA, 22 nt, Human
uaaguucaaugaacucaguucu

SEQ ID NO: 143710 - RNA, 22 nt, Human
uggaaagaaaguaaaggcguau

SEQ ID NO: 143711 - RNA, 22 nt, Human
ucagucucaucaacucuauucc

SEQ ID NO: 143712 - RNA, 22 nt, Human
cagggccagagagggcuggcug

SEQ ID NO: 143713 - RNA, 22 nt, Human
aagcagcacgcuuugccaacaa

SEQ ID NO: 143714 - RNA, 21 nt, Human
ugaagccugaggcauagcccc

SEQ ID NO: 143715 - RNA, 22 nt, Human
agucccagcccaguccuguaag

SEQ ID NO: 143716 - RNA, 21 nt, Human
uuugaaagugggugauucuuu

SEQ ID NO: 143717 - RNA, 22 nt, Human
acagaacuuccugcuggagugg

SEQ ID NO: 143718 - RNA, 22 nt, Human
aggggugaaagagggcccucaa

SEQ ID NO: 143719 - RNA, 22 nt, Human
gcugugugcucacguaguggaa

SEQ ID NO: 143720 - RNA, 22 nt, Human
ccugucagaugaaguaauugug

SEQ ID NO: 143721 - RNA, 22 nt, Human
guucuucagucacaucacagaa

SEQ ID NO: 143722 - RNA, 22 nt, Human
ugaggugaagaguggagcucag

SEQ ID NO: 143723 - RNA, 22 nt, Human
uuuuucucuaaguagucccaaa

SEQ ID NO: 143724 - RNA, 20 nt, Human
uucauucauuccacaacuuc

SEQ ID NO: 143725 - RNA, 22 nt, Human
gggugggccacugagcagcgug

SEQ ID NO: 143726 - RNA, 22 nt, Human
acuaaggaauaugacaaacuca

SEQ ID NO: 143727 - RNA, 22 nt, Human
uugaaauaucaaguuauuagug

SEQ ID NO: 143728 - RNA, 22 nt, Human
aggaggcugguucaggccauau

SEQ ID NO: 143729 - RNA, 22 nt, Human
gcuguggccaacaaaccacuuu

SEQ ID NO: 143730 - RNA, 22 nt, Human
cuccaugaauuugagcuuugug

SEQ ID NO: 143731 - RNA, 22 nt, Human
acaaagucuuuuacaacaguca

SEQ ID NO: 143732 - RNA, 22 nt, Human
gcucugugcaguucagggacac

SEQ ID NO: 143733 - RNA, 22 nt, Human
uuauuucauguaaaauuuaugu

SEQ ID NO: 143734 - RNA, 22 nt, Human
ugguccuggggaucugcaguga

SEQ ID NO: 143735 - RNA, 23 nt, Human
uugucugugcuuuuccaguugcu

SEQ ID NO: 143736 - RNA, 22 nt, Human
agagcugcaggguggacccagg

SEQ ID NO: 143737 - RNA, 22 nt, Human
ccuccuggcccugggccuggaa

SEQ ID NO: 143738 - RNA, 22 nt, Human
ugugugugacaaccuaguucag

SEQ ID NO: 143739 - RNA, 22 nt, Human
cuggagcugcuguccuugggug

SEQ ID NO: 143740 - RNA, 21 nt, Human
ucccagggccaggugccauca

SEQ ID NO: 143741 - RNA, 22 nt, Human
ggagcugugcagugacuacaga

SEQ ID NO: 143742 - RNA, 22 nt, Human
aauauguucaaaauagaucacu

SEQ ID NO: 143743 - RNA, 22 nt, Human
aaagcaaugaugguagacacgu

SEQ ID NO: 143744 - RNA, 22 nt, Human
acagccugagaguggagcuggc

SEQ ID NO: 143745 - RNA, 22 nt, Human
gaggaggcuaagugggcucugg

SEQ ID NO: 143746 - RNA, 22 nt, Human
gagggucccugcucagggccag

SEQ ID NO: 143747 - RNA, 22 nt, Human
uguauaugugcacaugugcuuc

SEQ ID NO: 143748 - RNA, 22 nt, Human
auguucuguuuuguaauucaua

SEQ ID NO: 143749 - RNA, 22 nt, Human
cucccagggccaucgagucacu

SEQ ID NO: 143750 - RNA, 22 nt, Human
aggcacugaauauccaguaaaa

SEQ ID NO: 143751 - RNA, 22 nt, Human
caggguggggcuggcuaucaaa

SEQ ID NO: 143752 - RNA, 22 nt, Human
aggcucauucuugccucugagc

SEQ ID NO: 143753 - RNA, 22 nt, Human
acagggccaggugagaggugcu

SEQ ID NO: 143754 - RNA, 22 nt, Human
uuacaguuuaguccaagccaga

SEQ ID NO: 143755 - RNA, 21 nt, Human
uucuccccagcgaauccucgg

SEQ ID NO: 143756 - RNA, 22 nt, Human
ugaugaauaaacuugagaguca

SEQ ID NO: 143757 - RNA, 22 nt, Human
ucauuucccuccuacaaagagg

SEQ ID NO: 143758 - RNA, 18 nt, Human
cucuguguuggugugaag

SEQ ID NO: 143759 - RNA, 22 nt, Human
uauaagaaacaaggcaaauuuu

SEQ ID NO: 143760 - RNA, 20 nt, Human
ccucucugaagaggucaucu

SEQ ID NO: 143761 - RNA, 22 nt, Human
guucuucagaggggaaagaacc

SEQ ID NO: 143762 - RNA, 22 nt, Human
caucagcaggcaacacucuugg

SEQ ID NO: 143763 - RNA, 22 nt, Human
ggcccaaggcccaggucgagcu

SEQ ID NO: 143764 - RNA, 22 nt, Human
ugaagcaguuacuggguguuaa

SEQ ID NO: 143765 - RNA, 22 nt, Human
gcucucuuuuuccagugguggu

SEQ ID NO: 143766 - RNA, 22 nt, Human
gcuggcuguguuccuucugcca

SEQ ID NO: 143767 - RNA, 22 nt, Human
ugggagaagcagcagccaagug

SEQ ID NO: 143768 - RNA, 22 nt, Human
uguaugcuuguguauaauauaa

SEQ ID NO: 143769 - RNA, 22 nt, Human
caguauaaugcccccugugggg

SEQ ID NO: 143770 - RNA, 22 nt, Human
uggcugagaaugggaugaugcc

SEQ ID NO: 143771 - RNA, 19 nt, Human
gccugcagaaaaggcaggg

SEQ ID NO: 143772 - RNA, 17 nt, Human
ggcuggagcagcucccc

SEQ ID NO: 143773 - RNA, 22 nt, Human
caguacuuaacuuauaggagag

SEQ ID NO: 143774 - RNA, 22 nt, Human
ugaaacagucuccagacuugga

SEQ ID NO: 143775 - RNA, 22 nt, Human
accugggagucacaccugagaa

SEQ ID NO: 143776 - RNA, 22 nt, Human
cccaggcagggacgugcucugg

SEQ ID NO: 143777 - RNA, 19 nt, Human
uggcuguggggaaaugcuu

SEQ ID NO: 143778 - RNA, 22 nt, Human
ugggcagacgcuguuggaaggc

SEQ ID NO: 143779 - RNA, 22 nt, Human
aucuuuuuacuaacacugcuua

SEQ ID NO: 143780 - RNA, 22 nt, Human
ugcaccugagaggucucugagg

SEQ ID NO: 143781 - RNA, 22 nt, Human
uuacaguagauacaaugaguaa

SEQ ID NO: 143782 - RNA, 22 nt, Human
cugaagaggacgcagcagcaag

SEQ ID NO: 143783 - RNA, 22 nt, Human
aggaguguggccagggcucugg

SEQ ID NO: 143784 - RNA, 22 nt, Human
cccaggccccagggcuugucag

SEQ ID NO: 143785 - RNA, 22 nt, Human
aagccagguguuuaggccagcg

SEQ ID NO: 143786 - RNA, 22 nt, Human
ugccacacauugucagguuagu

SEQ ID NO: 143787 - RNA, 17 nt, Human
aggccucccuccaggcc

SEQ ID NO: 143788 - RNA, 22 nt, Human
gcuggcaggguucucacugaaa

SEQ ID NO: 143789 - RNA, 22 nt, Human
aagcugccuuccaugugaggaa

SEQ ID NO: 143790 - RNA, 23 nt, Human
ucuauuacuuauuguacucugga

SEQ ID NO: 143791 - RNA, 22 nt, Human
agcuguguaggaucauaacacg

SEQ ID NO: 143792 - RNA, 23 nt, Human
cagggcugguagggaagagcgug

SEQ ID NO: 143793 - RNA, 22 nt, Human
acuuuacaagcuuauagccuag

SEQ ID NO: 143794 - RNA, 22 nt, Human
caucaaauggcaagugaaagcu

SEQ ID NO: 143795 - RNA, 19 nt, Human
auuugaaagcugugcuugc

SEQ ID NO: 143796 - RNA, 22 nt, Human
uuuuuaucuuguaugugucucu

SEQ ID NO: 143797 - RNA, 19 nt, Human
uggcuccugccugccuucu

SEQ ID NO: 143798 - RNA, 22 nt, Human
aucaggauagucuguaaauugu

SEQ ID NO: 143799 - RNA, 22 nt, Human
uuagaaacccagacucuuaggu

SEQ ID NO: 143800 - RNA, 22 nt, Human
uuugugugcuugguauugaaga

SEQ ID NO: 143801 - RNA, 22 nt, Human
gcugucgugugcaagugacaga

SEQ ID NO: 143802 - RNA, 22 nt, Human
ugugaggagaggcccagcuccc

SEQ ID NO: 143803 - RNA, 19 nt, Human
uucucuauuaugucuucuc

SEQ ID NO: 143804 - RNA, 22 nt, Human
ugcagaagcugcaggucagugg

SEQ ID NO: 143805 - RNA, 22 nt, Human
cagaugaggcaaccucauugcu

SEQ ID NO: 143806 - RNA, 22 nt, Human
ugggaugggaucucgcuguguc

SEQ ID NO: 143807 - RNA, 22 nt, Human
agcagccauuuaaaaugaauug

SEQ ID NO: 143808 - RNA, 22 nt, Human
uggcccugcugggucagagcug

SEQ ID NO: 143809 - RNA, 22 nt, Human
uauguucugacucuacauggga

SEQ ID NO: 143810 - RNA, 22 nt, Human
aagcgccaugguuccugcgcag

SEQ ID NO: 143811 - RNA, 22 nt, Human
cuuccugaacaaugccaucaau

SEQ ID NO: 143812 - RNA, 22 nt, Human
cccugccucugaagcugcucag

SEQ ID NO: 143813 - RNA, 22 nt, Human
uuacaguauuguuaaacucuuu

SEQ ID NO: 143814 - RNA, 20 nt, Human
augugucugccucuguguuc

SEQ ID NO: 143815 - RNA, 17 nt, Human
ucucuuucccuuucugc

SEQ ID NO: 143816 - RNA, 22 nt, Human
agggcagaaaccaccuugaugg

SEQ ID NO: 143817 - RNA, 22 nt, Human
gucacuggggccacaugcagaa

SEQ ID NO: 143818 - RNA, 22 nt, Human
cuaaaugcccuacaaugacugg

SEQ ID NO: 143819 - RNA, 22 nt, Human
ggccucugguucguggugaccu

SEQ ID NO: 143820 - RNA, 22 nt, Human
ugcaaucucggcacuuugggag

SEQ ID NO: 143821 - RNA, 22 nt, Human
gcaguauauacucuuugagggg

SEQ ID NO: 143822 - RNA, 22 nt, Human
ucacuuuuugauaucauucugc

SEQ ID NO: 143823 - RNA, 22 nt, Human
aggccucuucagggagcaugga

SEQ ID NO: 143824 - RNA, 22 nt, Human
ccugggucuugguucaugcucu

SEQ ID NO: 143825 - RNA, 22 nt, Human
cuggagagggagcccuggcagu

SEQ ID NO: 143826 - RNA, 22 nt, Human
gcuuuuucaaaugaaagcuggu

SEQ ID NO: 143827 - RNA, 22 nt, Human
gcucaagagagaugcaguucuu

SEQ ID NO: 143828 - RNA, 22 nt, Human
gggcugugaggugagaacuuac

SEQ ID NO: 143829 - RNA, 22 nt, Human
gcuguguuugacaguagcagac

SEQ ID NO: 143830 - RNA, 20 nt, Human
ccuguguggccagcugaggc

SEQ ID NO: 143831 - RNA, 22 nt, Human
cauagcaacagcaucaagucaa

SEQ ID NO: 143832 - RNA, 22 nt, Human
cccagcauuucugggcugcacu

SEQ ID NO: 143833 - RNA, 19 nt, Human
gcauaaaaugucaaugugu

SEQ ID NO: 143834 - RNA, 22 nt, Human
gcugucugcaucucuagagcuu

SEQ ID NO: 143835 - RNA, 22 nt, Human
uuucaaaauuuugcagugguaa

SEQ ID NO: 143836 - RNA, 22 nt, Human
uuugugaaaugaagucacaacu

SEQ ID NO: 143837 - RNA, 22 nt, Human
ugaaacauuugaugaucuuugg

SEQ ID NO: 143838 - RNA, 22 nt, Human
cucuguuuuucaauaguucuug

SEQ ID NO: 143839 - RNA, 22 nt, Human
uucuagaugauaaaccagcagc

SEQ ID NO: 143840 - RNA, 18 nt, Human
ugcuggcaacuacuauug

SEQ ID NO: 143841 - RNA, 22 nt, Human
uggcagagaauaaaucuugacu

SEQ ID NO: 143842 - RNA, 22 nt, Human
cugucacacugauaucaggcuu

SEQ ID NO: 143843 - RNA, 22 nt, Human
uucccaugccuggccccuaucc

SEQ ID NO: 143844 - RNA, 23 nt, Human
cuggcucuguagguggcauccuu

SEQ ID NO: 143845 - RNA, 23 nt, Human
cauguguaauuucugguugggug

SEQ ID NO: 143846 - RNA, 22 nt, Human
gugcucuggcuggucucccggu

SEQ ID NO: 143847 - RNA, 22 nt, Human
uccuucagauuccugcuucugg

SEQ ID NO: 143848 - RNA, 22 nt, Human
gagcucuggcagggcaggucug

SEQ ID NO: 143849 - RNA, 22 nt, Human
ugucucaggcccaagccaguaa

SEQ ID NO: 143850 - RNA, 21 nt, Human
gcucagaguauugcacuguuu

SEQ ID NO: 143851 - RNA, 22 nt, Human
uaacagaauccuguuauugcca

SEQ ID NO: 143852 - RNA, 22 nt, Human
ggcccacuugaaauggagcuca

SEQ ID NO: 143853 - RNA, 22 nt, Human
cagagcaggcccacugcccucc

SEQ ID NO: 143854 - RNA, 20 nt, Human
aggcagacaaggagucuguu

SEQ ID NO: 143855 - RNA, 22 nt, Human
ggcucuggugaggguaggagau

SEQ ID NO: 143856 - RNA, 22 nt, Human
acaggcugccuaccaaguauca

SEQ ID NO: 143857 - RNA, 22 nt, Human
uaugugaauacagcaguggaug

SEQ ID NO: 143858 - RNA, 22 nt, Human
guguaugcaauugagucauaga

SEQ ID NO: 143859 - RNA, 22 nt, Human
uggcuguguuaccacuucaugu

SEQ ID NO: 143860 - RNA, 22 nt, Human
guguuuccucuagaagccaugg

SEQ ID NO: 143861 - RNA, 19 nt, Human
uguuuuguuaaagcagucc

SEQ ID NO: 143862 - RNA, 22 nt, Human
ucucagucuuugcaaggaugcu

SEQ ID NO: 143863 - RNA, 22 nt, Human
cuggcugcuggccugaggaugc

SEQ ID NO: 143864 - RNA, 22 nt, Human
cugggagucaccaggagcaagg

SEQ ID NO: 143865 - RNA, 22 nt, Human
uuucaaaccuacuuguauguuu

SEQ ID NO: 143866 - RNA, 22 nt, Human
ucugagagcuguagaagccuau

SEQ ID NO: 143867 - RNA, 22 nt, Human
cuaggaggcgggggcugcagua

SEQ ID NO: 143868 - RNA, 22 nt, Human
ucugggugcccuuugcucuguu

SEQ ID NO: 143869 - RNA, 22 nt, Human
uguggccuggaaggggcugcuc

SEQ ID NO: 143870 - RNA, 22 nt, Human
ugaaaaggguagaucccuaagu

SEQ ID NO: 143871 - RNA, 22 nt, Human
acagugaugagggaauuuugug

SEQ ID NO: 143872 - RNA, 22 nt, Human
cugccacuuacuaggcauggug

SEQ ID NO: 143873 - RNA, 22 nt, Human
gaggacagcuuagggcuuccug

SEQ ID NO: 143874 - RNA, 22 nt, Human
uguguauguguauacacuauau

SEQ ID NO: 143875 - RNA, 22 nt, Human
ucagagguaagggcugagagga

SEQ ID NO: 143876 - RNA, 22 nt, Human
cccuggagggauuucucaauca

SEQ ID NO: 143877 - RNA, 22 nt, Human
aucuacaggauuuuacagaguu

SEQ ID NO: 143878 - RNA, 22 nt, Human
auagcuguuagauuggggucga

SEQ ID NO: 143879 - RNA, 22 nt, Human
uauuuugacgauuuuaugcaaa

SEQ ID NO: 143880 - RNA, 22 nt, Human
gccucugcccauccaccaucag

SEQ ID NO: 143881 - RNA, 22 nt, Human
uuucacuagaacguucuuguuu

SEQ ID NO: 143882 - RNA, 22 nt, Human
cuagccugggauuugaacuuau

SEQ ID NO: 143883 - RNA, 22 nt, Human
gauauuuucagucuccuuucaa

SEQ ID NO: 143884 - RNA, 22 nt, Human
gcagggaccugccacugcuguc

SEQ ID NO: 143885 - RNA, 22 nt, Human
uugaaagugccaaguccuagug

SEQ ID NO: 143886 - RNA, 22 nt, Human
ccuggcagcuccuccccggcgg

SEQ ID NO: 143887 - RNA, 22 nt, Human
ugugaugucagugguaucaaag

SEQ ID NO: 143888 - RNA, 22 nt, Human
uggcuuccaaaggaaugggccu

SEQ ID NO: 143889 - RNA, 22 nt, Human
ucuccucugcgcggcagugccc

SEQ ID NO: 143890 - RNA, 22 nt, Human
ccugagacaugaaccaggcucc

SEQ ID NO: 143891 - RNA, 22 nt, Human
aggguggagggagucccugagc

SEQ ID NO: 143892 - RNA, 22 nt, Human
caugcuuugggucagaaaugcc

SEQ ID NO: 143893 - RNA, 22 nt, Human
gcugccagcucacucuccugag

SEQ ID NO: 143894 - RNA, 22 nt, Human
ggcugcuggcauugagguaggu

SEQ ID NO: 143895 - RNA, 22 nt, Human
aggcacuguacuagguacaggg

SEQ ID NO: 143896 - RNA, 22 nt, Human
gucugcugcagagcauggcuuu

SEQ ID NO: 143897 - RNA, 22 nt, Human
ggccaggagcaagccaggcucu

SEQ ID NO: 143898 - RNA, 21 nt, Human
uucugggaaaugagcuggggc

SEQ ID NO: 143899 - RNA, 22 nt, Human
ggcccaucucuugcucuggguu

SEQ ID NO: 143900 - RNA, 22 nt, Human
agcuccuccugugccaggccag

SEQ ID NO: 143901 - RNA, 22 nt, Human
cuuugcaauagaggcacacaug

SEQ ID NO: 143902 - RNA, 22 nt, Human
aucaaaguccaucagaagguag

SEQ ID NO: 143903 - RNA, 22 nt, Human
uauguacacauacacuuguaau

SEQ ID NO: 143904 - RNA, 18 nt, Human
aggcuucccaggcaggcc

SEQ ID NO: 143905 - RNA, 22 nt, Human
aucuggcuuuuacugaauugcu

SEQ ID NO: 143906 - RNA, 22 nt, Human
caggcagccugagggaucuggg

SEQ ID NO: 143907 - RNA, 18 nt, Human
agaaggagcuaugggcag

SEQ ID NO: 143908 - RNA, 21 nt, Human
ggcagcccgcccucuccuggc

SEQ ID NO: 143909 - RNA, 22 nt, Human
auuuuuccaugauacuuaucug

SEQ ID NO: 143910 - RNA, 20 nt, Human
aauaaaagaagccuucaccc

SEQ ID NO: 143911 - RNA, 22 nt, Human
cucucuuugauguauaaauaau

SEQ ID NO: 143912 - RNA, 22 nt, Human
cuggcaggaaguuagaugguaa

SEQ ID NO: 143913 - RNA, 22 nt, Human
gccugucucuuggaacuuggua

SEQ ID NO: 143914 - RNA, 23 nt, Human
ugagcugguauuguccaucucca

SEQ ID NO: 143915 - RNA, 22 nt, Human
gguggcuggaggagcugaugga

SEQ ID NO: 143916 - RNA, 22 nt, Human
uggcucuguugugcugagccag

SEQ ID NO: 143917 - RNA, 22 nt, Human
gcaaaugcucuccuuggucagg

SEQ ID NO: 143918 - RNA, 22 nt, Human
ccaaaugugccuguuucaacaa

SEQ ID NO: 143919 - RNA, 22 nt, Human
cuuggcagagggcugggcucag

SEQ ID NO: 143920 - RNA, 22 nt, Human
acugcaucugaaacauggguca

SEQ ID NO: 143921 - RNA, 22 nt, Human
cuguauguuucuaugaauguga

SEQ ID NO: 143922 - RNA, 22 nt, Human
ccuuucucuuugcugaucaugu

SEQ ID NO: 143923 - RNA, 22 nt, Human
aggccaaguagcuagcauugaa

SEQ ID NO: 143924 - RNA, 22 nt, Human
ucuuaaaaguaugccaauugga

SEQ ID NO: 143925 - RNA, 23 nt, Human
aacaauagguuuuggcagaauag

SEQ ID NO: 143926 - RNA, 22 nt, Human
ucaguuuugauuccugguucuc

SEQ ID NO: 143927 - RNA, 22 nt, Human
uauugacaauuugugaaacuau

SEQ ID NO: 143928 - RNA, 22 nt, Human
accccaagacaguagaagagaa

SEQ ID NO: 143929 - RNA, 22 nt, Human
uucucuguaguugccuggugga

SEQ ID NO: 143930 - RNA, 23 nt, Human
cuggggcuuucaaaucugggcag

SEQ ID NO: 143931 - RNA, 21 nt, Human
caugaagccgguucccuguuu

SEQ ID NO: 143932 - RNA, 21 nt, Human
aagagcugucaggaaggcugc

SEQ ID NO: 143933 - RNA, 22 nt, Human
acucugccccgaguucugggaa

SEQ ID NO: 143934 - RNA, 22 nt, Human
gugccuggcacacagaaggcaa

SEQ ID NO: 143935 - RNA, 22 nt, Human
auggggcucugcggcugcuccc

SEQ ID NO: 143936 - RNA, 18 nt, Human
uggcucuggacuugcucc

SEQ ID NO: 143937 - RNA, 22 nt, Human
cagagcaguccuugucaaucag

SEQ ID NO: 143938 - RNA, 22 nt, Human
gcagagccagaauggccaggac

SEQ ID NO: 143939 - RNA, 22 nt, Human
acagugauuucauccuucuggg

SEQ ID NO: 143940 - RNA, 22 nt, Human
uuccuguaugucagugaagagc

SEQ ID NO: 143941 - RNA, 22 nt, Human
gagagcugcaagguagggcggg

SEQ ID NO: 143942 - RNA, 22 nt, Human
ccagagacgucggucagggcgc

SEQ ID NO: 143943 - RNA, 22 nt, Human
ucuuuacaaucuaagcauaguu

SEQ ID NO: 143944 - RNA, 22 nt, Human
acagguggaggcuuuaggaggu

SEQ ID NO: 143945 - RNA, 22 nt, Human
agucauauauuuuguuugugca

SEQ ID NO: 143946 - RNA, 22 nt, Human
cugggccucaaucucagaguuu

SEQ ID NO: 143947 - RNA, 22 nt, Human
cugugucugaauaacucugugu

SEQ ID NO: 143948 - RNA, 22 nt, Human
auauuuuggcaaaugucuagau

SEQ ID NO: 143949 - RNA, 22 nt, Human
gaaguacaguuuuaucuagcca

SEQ ID NO: 143950 - RNA, 22 nt, Human
ugcagaaguauuccaggcccca

SEQ ID NO: 143951 - RNA, 22 nt, Human
ucagggcauggcugcacuuggc

SEQ ID NO: 143952 - RNA, 22 nt, Human
cagcacuggggggauucggagc

SEQ ID NO: 143953 - RNA, 22 nt, Human
caggcagauuugcugcccucca

SEQ ID NO: 143954 - RNA, 22 nt, Human
uuuucauuguaaaucaggaaac

SEQ ID NO: 143955 - RNA, 22 nt, Human
gcuucauuacugacagucugug

SEQ ID NO: 143956 - RNA, 22 nt, Human
cugccugcuucugagccagagg

SEQ ID NO: 143957 - RNA, 22 nt, Human
aagcagccucauuugugguaag

SEQ ID NO: 143958 - RNA, 22 nt, Human
ccuuuuauauggcucaucacag

SEQ ID NO: 143959 - RNA, 22 nt, Human
gagcugccugaacaagcagcag

SEQ ID NO: 143960 - RNA, 22 nt, Human
caugcacuuaccugaaauucaa

SEQ ID NO: 143961 - RNA, 22 nt, Human
uuuaacucugucauucucuuua

SEQ ID NO: 143962 - RNA, 22 nt, Human
agcagcaggcuguguggacuga

SEQ ID NO: 143963 - RNA, 22 nt, Human
auucuucagaauaucuggcacu

SEQ ID NO: 143964 - RNA, 22 nt, Human
aguauauugguguuauuccuca

SEQ ID NO: 143965 - RNA, 22 nt, Human
ucuuugcaugcauuuucccuua

SEQ ID NO: 143966 - RNA, 22 nt, Human
ucaagagauugaauaauaacug

SEQ ID NO: 143967 - RNA, 22 nt, Human
gguggguauaguuagggccucu

SEQ ID NO: 143968 - RNA, 22 nt, Human
aggcugggcaccguuuugaucc

SEQ ID NO: 143969 - RNA, 22 nt, Human
uguguguauaugcauuuaucua

SEQ ID NO: 143970 - RNA, 22 nt, Human
uuccaagagcuuuaauuguuga

SEQ ID NO: 143971 - RNA, 22 nt, Human
auucaguaggucuagaauaaga

SEQ ID NO: 143972 - RNA, 22 nt, Human
ugggauaguggccaggaccccc

SEQ ID NO: 143973 - RNA, 22 nt, Human
uuugcauugcauuaaguauucu

SEQ ID NO: 143974 - RNA, 22 nt, Human
cugucucucuaggacacugggg

SEQ ID NO: 143975 - RNA, 22 nt, Human
gccuuggcugaugugcgaauga

SEQ ID NO: 143976 - RNA, 22 nt, Human
gcuggugcauuagcugcaguuc

SEQ ID NO: 143977 - RNA, 22 nt, Human
gagggucccgagcccugucaga

SEQ ID NO: 143978 - RNA, 22 nt, Human
gggcugcacguauucugcucac

SEQ ID NO: 143979 - RNA, 22 nt, Human
aaggagugcaugacucagagua

SEQ ID NO: 143980 - RNA, 19 nt, Human
gguaaaagugagcuucagg

SEQ ID NO: 143981 - RNA, 22 nt, Human
guguggcuaccucagaggagca

SEQ ID NO: 143982 - RNA, 22 nt, Human
aaaagguagauucuccuucuau

SEQ ID NO: 143983 - RNA, 22 nt, Human
ccccagcucagugcagggacau

SEQ ID NO: 143984 - RNA, 19 nt, Human
agcaccugugagagccugg

SEQ ID NO: 143985 - RNA, 22 nt, Human
uccucuggcccagcugccucug

SEQ ID NO: 143986 - RNA, 22 nt, Human
agaacuuaggaacaacagcuua

SEQ ID NO: 143987 - RNA, 22 nt, Human
auuuuacuuugugaauauugac

SEQ ID NO: 143988 - RNA, 22 nt, Human
caguacuuggucaaggaagcag

SEQ ID NO: 143989 - RNA, 22 nt, Human
gagagguccauuccccugucag

SEQ ID NO: 143990 - RNA, 22 nt, Human
uccucugcuggaagggcaagag

SEQ ID NO: 143991 - RNA, 22 nt, Human
uggccugggccugccggugcaa

SEQ ID NO: 143992 - RNA, 22 nt, Human
ucucucuaggcaucuauuuuca

SEQ ID NO: 143993 - RNA, 22 nt, Human
gcuuuacauguuucccuuuaag

SEQ ID NO: 143994 - RNA, 22 nt, Human
agcagugggggaguguuaguuu

SEQ ID NO: 143995 - RNA, 22 nt, Human
cugggggcaagcagacagcugu

SEQ ID NO: 143996 - RNA, 22 nt, Human
ccagcccucacugaggccucuc

SEQ ID NO: 143997 - RNA, 22 nt, Human
uuaaagggccgauuuccaggcc

SEQ ID NO: 143998 - RNA, 22 nt, Human
gagcuuugcuggaagccugggg

SEQ ID NO: 143999 - RNA, 22 nt, Human
cuucccuuggugaacagagcau

SEQ ID NO: 144000 - RNA, 22 nt, Human
aucauucuagcuguuguguuga

SEQ ID NO: 144001 - RNA, 22 nt, Human
aaaucaguuaagaugaggccau

SEQ ID NO: 144002 - RNA, 22 nt, Human
acauguggucaaucuguguagg

SEQ ID NO: 144003 - RNA, 22 nt, Human
gcagcuuggauuucuguaguuu

SEQ ID NO: 144004 - RNA, 15 nt, Human
cagucccagggaccc

SEQ ID NO: 144005 - RNA, 22 nt, Human
uuauacagcauugcuagugaug

SEQ ID NO: 144006 - RNA, 22 nt, Human
guuuuuauauccuguggagugu

SEQ ID NO: 144007 - RNA, 22 nt, Human
acuauacauugaauguuaaggu

SEQ ID NO: 144008 - RNA, 20 nt, Human
aggcacuggauuucuuauau

SEQ ID NO: 144009 - RNA, 22 nt, Human
ucagaggacgcacuaggguugu

SEQ ID NO: 144010 - RNA, 22 nt, Human
uguauguaaaggucuucauguu

SEQ ID NO: 144011 - RNA, 20 nt, Human
ugaaaaggucaggagacaug

SEQ ID NO: 144012 - RNA, 22 nt, Human
acagaauauuuggcaugcgucu

SEQ ID NO: 144013 - RNA, 20 nt, Human
ccagagcagccacugaaguu

SEQ ID NO: 144014 - RNA, 19 nt, Human
cugucaggggcuggauguu

SEQ ID NO: 144015 - RNA, 22 nt, Human
ccaggccuuccaguacgcagaa

SEQ ID NO: 144016 - RNA, 22 nt, Human
cagaggccaccuguggccacug

SEQ ID NO: 144017 - RNA, 22 nt, Human
ggaugcaggaguugaagaagga

SEQ ID NO: 144018 - RNA, 22 nt, Human
ugcuucucccaaccagggccug

SEQ ID NO: 144019 - RNA, 22 nt, Human
ggccuucacgugaccuggcgug

SEQ ID NO: 144020 - RNA, 22 nt, Human
uacauguaguucacugguggca

SEQ ID NO: 144021 - RNA, 22 nt, Human
cugugucccaguaccuugggua

SEQ ID NO: 144022 - RNA, 20 nt, Human
cccucugcuacacugggagc

SEQ ID NO: 144023 - RNA, 22 nt, Human
ucacacguccuugcuacuccuc

SEQ ID NO: 144024 - RNA, 22 nt, Human
uuucaaauagaaucuuuccaaa

SEQ ID NO: 144025 - RNA, 22 nt, Human
ggcugggcucgcugauuggcug

SEQ ID NO: 144026 - RNA, 21 nt, Human
uguuacaguccaaauguuugu

SEQ ID NO: 144027 - RNA, 22 nt, Human
uucaguuucagucuugcaaaaa

SEQ ID NO: 144028 - RNA, 23 nt, Human
aaucuggcugauguuuuuucucu

SEQ ID NO: 144029 - RNA, 22 nt, Human
gacaguauccagguggugaaga

SEQ ID NO: 144030 - RNA, 22 nt, Human
aaaguucaugguguuauagaaa

SEQ ID NO: 144031 - RNA, 22 nt, Human
cuguaugugaaaaugucaagug

SEQ ID NO: 144032 - RNA, 22 nt, Human
aacaguaucuacgggaacuauu

SEQ ID NO: 144033 - RNA, 22 nt, Human
ucucagagagcuguguuuuccu

SEQ ID NO: 144034 - RNA, 22 nt, Human
cugcugggcuccucaugugacu

SEQ ID NO: 144035 - RNA, 22 nt, Human
uucuuucagaacacaagugauu

SEQ ID NO: 144036 - RNA, 22 nt, Human
cagcucuguaaauuccuucauc

SEQ ID NO: 144037 - RNA, 22 nt, Human
aucccaugagaccacguuggcu

SEQ ID NO: 144038 - RNA, 22 nt, Human
aaguguagauuauggagugucu

SEQ ID NO: 144039 - RNA, 22 nt, Human
guguguggaaaguuuuccaugg

SEQ ID NO: 144040 - RNA, 22 nt, Human
gaggaaccaaucugugauauuc

SEQ ID NO: 144041 - RNA, 22 nt, Human
agggaaagguagugaggucaca

SEQ ID NO: 144042 - RNA, 22 nt, Human
aguuauuacucuuuaacauauu

SEQ ID NO: 144043 - RNA, 22 nt, Human
gcacccagaggucagcagugcu

SEQ ID NO: 144044 - RNA, 22 nt, Human
gugucccaauguucaggacggc

SEQ ID NO: 144045 - RNA, 22 nt, Human
uguggccaccagagcugcuauu

SEQ ID NO: 144046 - RNA, 22 nt, Human
accagagcuggcagaguaucaa

SEQ ID NO: 144047 - RNA, 22 nt, Human
gaggccuggucuaugagauguu

SEQ ID NO: 144048 - RNA, 22 nt, Human
aguauaaugaaaugugucagua

SEQ ID NO: 144049 - RNA, 22 nt, Human
cagggccauuggcguggcuguc

SEQ ID NO: 144050 - RNA, 22 nt, Human
ucucaagaucucaagauggccc

SEQ ID NO: 144051 - RNA, 22 nt, Human
gcugagucuugagcacugagca

SEQ ID NO: 144052 - RNA, 22 nt, Human
ggaggcugcugccucacguggg

SEQ ID NO: 144053 - RNA, 23 nt, Human
uugcauguagcccaugaguaacu

SEQ ID NO: 144054 - RNA, 22 nt, Human
agcagcauuuaaguuucuucua

SEQ ID NO: 144055 - RNA, 22 nt, Human
ucagaggguggcugggagcauc

SEQ ID NO: 144056 - RNA, 22 nt, Human
guguggcuagaagugucuuguu

SEQ ID NO: 144057 - RNA, 22 nt, Human
ccuuccaggugcaggcaagccu

SEQ ID NO: 144058 - RNA, 22 nt, Human
uguguacagcaggauuucucaa

SEQ ID NO: 144059 - RNA, 21 nt, Human
auccauccaucuuggccuaac

SEQ ID NO: 144060 - RNA, 22 nt, Human
uggguggcggccugguucugag

SEQ ID NO: 144061 - RNA, 22 nt, Human
gucaggauuauaauccccaugg

SEQ ID NO: 144062 - RNA, 22 nt, Human
acaaggaggucuggggggcccu

SEQ ID NO: 144063 - RNA, 22 nt, Human
gcuguauuccugcacuguauag

SEQ ID NO: 144064 - RNA, 22 nt, Human
gaagcccuauccucuccuggga

SEQ ID NO: 144065 - RNA, 22 nt, Human
gggugggccugucuggccaugu

SEQ ID NO: 144066 - RNA, 22 nt, Human
gggccaggucggugaaugguca

SEQ ID NO: 144067 - RNA, 22 nt, Human
gccaccagugggggccugggca

SEQ ID NO: 144068 - RNA, 22 nt, Human
ccugagggaggguauaggcugu

SEQ ID NO: 144069 - RNA, 22 nt, Human
aggcugcuuccuuacguggcug

SEQ ID NO: 144070 - RNA, 22 nt, Human
aguguguagcaauaugcuggca

SEQ ID NO: 144071 - RNA, 22 nt, Human
gcagacagcauguugggcuauu

SEQ ID NO: 144072 - RNA, 22 nt, Human
agagugaaguucaucgugcagc

SEQ ID NO: 144073 - RNA, 22 nt, Human
acaaagcuagagaagagaauug

SEQ ID NO: 144074 - RNA, 22 nt, Human
auaugcauaugucaaaacuuau

SEQ ID NO: 144075 - RNA, 22 nt, Human
ucagcagggccuccuugugcag

SEQ ID NO: 144076 - RNA, 22 nt, Human
ggcuccugauaggagaaugcgg

SEQ ID NO: 144077 - RNA, 22 nt, Human
gcaggaugagugaguacauuua

SEQ ID NO: 144078 - RNA, 22 nt, Human
ucccaggacaggccacauggaa

SEQ ID NO: 144079 - RNA, 22 nt, Human
caggcuggaguuaccuuuaggg

SEQ ID NO: 144080 - RNA, 22 nt, Human
cagaccuggaaaacaggcuugc

SEQ ID NO: 144081 - RNA, 22 nt, Human
agagcucaagacgcucacagua

SEQ ID NO: 144082 - RNA, 22 nt, Human
ccuccuggugggcgcuucuggc

SEQ ID NO: 144083 - RNA, 22 nt, Human
gugcugcucacaucuggaggua

SEQ ID NO: 144084 - RNA, 22 nt, Human
auacaguagggaccaugucuga

SEQ ID NO: 144085 - RNA, 22 nt, Human
agucaauucuuuucaacucaag

SEQ ID NO: 144086 - RNA, 23 nt, Human
gggagccaggaccucgcgcccca

SEQ ID NO: 144087 - RNA, 22 nt, Human
uccucccacauaggacaauggg

SEQ ID NO: 144088 - RNA, 20 nt, Human
gaggcucugggcauggcgcc

SEQ ID NO: 144089 - RNA, 22 nt, Human
gacagcaggagaucaugauaga

SEQ ID NO: 144090 - RNA, 22 nt, Human
caagagcugcaaauagcgugac

SEQ ID NO: 144091 - RNA, 22 nt, Human
cagagccuaaaacgacuccacu

SEQ ID NO: 144092 - RNA, 22 nt, Human
ccucacagggccaggccccuca

SEQ ID NO: 144093 - RNA, 22 nt, Human
ccagagccccugagcuucccug

SEQ ID NO: 144094 - RNA, 23 nt, Human
uggcucagcuaguuuuccauuuc

SEQ ID NO: 144095 - RNA, 22 nt, Human
gagcagcugcagugcagacccu

SEQ ID NO: 144096 - RNA, 22 nt, Human
gaaaauguuuguccggagcuga

SEQ ID NO: 144097 - RNA, 22 nt, Human
caucucuugccaaaguuugacc

SEQ ID NO: 144098 - RNA, 22 nt, Human
uucauuuuauaaacccugcuga

SEQ ID NO: 144099 - RNA, 22 nt, Human
agcagcaugaugacagagucuc

SEQ ID NO: 144100 - RNA, 19 nt, Human
ugccuggacaaaugugggg

SEQ ID NO: 144101 - RNA, 22 nt, Human
aggcccuguccauggugcugaa

SEQ ID NO: 144102 - RNA, 22 nt, Human
auguaucagauaaagcaugugg

SEQ ID NO: 144103 - RNA, 22 nt, Human
aguggcuguaggcuaugagaga

SEQ ID NO: 144104 - RNA, 22 nt, Human
uguguuugaguccucacagugc

SEQ ID NO: 144105 - RNA, 22 nt, Human
cuggaagguucuuugugugccu

SEQ ID NO: 144106 - RNA, 22 nt, Human
gaggagguuccggguggagaag

SEQ ID NO: 144107 - RNA, 22 nt, Human
ugaagcaggugaauggaugucg

SEQ ID NO: 144108 - RNA, 21 nt, Human
uggcucugcucagagcagucc

SEQ ID NO: 144109 - RNA, 22 nt, Human
ggagcagagcucuucaucugca

SEQ ID NO: 144110 - RNA, 22 nt, Human
gcaggagucacugacuuggucc

SEQ ID NO: 144111 - RNA, 22 nt, Human
cuuuacaaagcaauuuugucuc

SEQ ID NO: 144112 - RNA, 22 nt, Human
ugcccaaguguuuggcugaguc

SEQ ID NO: 144113 - RNA, 22 nt, Human
gggccccaaaaugccaggcucu

SEQ ID NO: 144114 - RNA, 22 nt, Human
caguuucuacgacuuaagcaca

SEQ ID NO: 144115 - RNA, 22 nt, Human
uuuccuaugauauucuaugugu

SEQ ID NO: 144116 - RNA, 22 nt, Human
cagugcauaaucuaaauggggg

SEQ ID NO: 144117 - RNA, 22 nt, Human
ugcaggcaggggaugagcagcc

SEQ ID NO: 144118 - RNA, 22 nt, Human
gugccaggugcuaagcugugcu

SEQ ID NO: 144119 - RNA, 22 nt, Human
uggcuguagaacaguggauauu

SEQ ID NO: 144120 - RNA, 20 nt, Human
agagaauucccuuuggagau

SEQ ID NO: 144121 - RNA, 22 nt, Human
ugccugugcccuuugcugggag

SEQ ID NO: 144122 - RNA, 21 nt, Human
gagacagcccagugccagggc

SEQ ID NO: 144123 - RNA, 22 nt, Human
uucugcuccaccacuuccagca

SEQ ID NO: 144124 - RNA, 22 nt, Human
gccuggugcuaugagggccagc

SEQ ID NO: 144125 - RNA, 22 nt, Human
aggcuggcccuacuggcugccu

SEQ ID NO: 144126 - RNA, 19 nt, Human
uggcagggagugauauuag

SEQ ID NO: 144127 - RNA, 18 nt, Human
ccucagggagagagacgc

SEQ ID NO: 144128 - RNA, 22 nt, Human
gggcuggagccagcuguggcug

SEQ ID NO: 144129 - RNA, 21 nt, Human
aaauacagaaacuuguuuuca

SEQ ID NO: 144130 - RNA, 22 nt, Human
cacagguggcuccaaguuagag

SEQ ID NO: 144131 - RNA, 22 nt, Human
cauuuguaguuaaaaaugucuc

SEQ ID NO: 144132 - RNA, 22 nt, Human
aacccuggggcagcugcuaggg

SEQ ID NO: 144133 - RNA, 22 nt, Human
guuaacuuucaggugcauguuu

SEQ ID NO: 144134 - RNA, 22 nt, Human
cuuuacuguucuucugugggaa

SEQ ID NO: 144135 - RNA, 22 nt, Human
auucuucuugagucuuggacuc

SEQ ID NO: 144136 - RNA, 22 nt, Human
ugcuggcuacugauggcaggcc

SEQ ID NO: 144137 - RNA, 22 nt, Human
cuccagggaugagacagaguag

SEQ ID NO: 144138 - RNA, 22 nt, Human
auuacagugccaccucgugguc

SEQ ID NO: 144139 - RNA, 22 nt, Human
ccagcugcagguguuccagaug

SEQ ID NO: 144140 - RNA, 22 nt, Human
aggagugcaaauaguccagaga

SEQ ID NO: 144141 - RNA, 22 nt, Human
gggugggaucuguggagccuca

SEQ ID NO: 144142 - RNA, 22 nt, Human
gugcauuucucauacacuaaau

SEQ ID NO: 144143 - RNA, 22 nt, Human
aggcugugggaauggcugcuug

SEQ ID NO: 144144 - RNA, 22 nt, Human
gaagcagcuuucuggugaggag

SEQ ID NO: 144145 - RNA, 21 nt, Human
gagugucuaauccaggcuguc

SEQ ID NO: 144146 - RNA, 22 nt, Human
ucccagagaaagucaaggucuu

SEQ ID NO: 144147 - RNA, 22 nt, Human
uauuuccagcaguaagaagaca

SEQ ID NO: 144148 - RNA, 22 nt, Human
cacugcuuuaaggcugaguaac

SEQ ID NO: 144149 - RNA, 22 nt, Human
uggcacugaccccaggccugug

SEQ ID NO: 144150 - RNA, 22 nt, Human
agagugaagguugacacuucac

SEQ ID NO: 144151 - RNA, 22 nt, Human
ggagaaggaagaaagcuacuau

SEQ ID NO: 144152 - RNA, 22 nt, Human
uuccugugaagccgguggucuc

SEQ ID NO: 144153 - RNA, 22 nt, Human
ggcucugcuucagaaggcucau

SEQ ID NO: 144154 - RNA, 22 nt, Human
ccagccaguccagcauuggugu

SEQ ID NO: 144155 - RNA, 22 nt, Human
agcagcauuccuggcuucuauc

SEQ ID NO: 144156 - RNA, 22 nt, Human
gggcuccaacggugagcaugga

SEQ ID NO: 144157 - RNA, 22 nt, Human
aagccagguguugugguaagag

SEQ ID NO: 144158 - RNA, 22 nt, Human
cuugcuuuguccagaaauucag

SEQ ID NO: 144159 - RNA, 21 nt, Human
cagaaguaaggguaacuucuc

SEQ ID NO: 144160 - RNA, 22 nt, Human
guacuuccagccaagugagaca

SEQ ID NO: 144161 - RNA, 22 nt, Human
aaggcaguaaaaucuaccuugc

SEQ ID NO: 144162 - RNA, 22 nt, Human
acagggcccuugccagcacaag

SEQ ID NO: 144163 - RNA, 22 nt, Human
cauucugugauucuaaaucccu

SEQ ID NO: 144164 - RNA, 22 nt, Human
aucaggaugcugucaguuacca

SEQ ID NO: 144165 - RNA, 22 nt, Human
uauauuguaggugcuauuugaa

SEQ ID NO: 144166 - RNA, 22 nt, Human
uuauuuuguagcucugaucuuu

SEQ ID NO: 144167 - RNA, 22 nt, Human
acauuucuauagugcaucuguu

SEQ ID NO: 144168 - RNA, 22 nt, Human
cagaaguaagauuacugugaga

SEQ ID NO: 144169 - RNA, 22 nt, Human
ugucauaaaacacaagcuguug

SEQ ID NO: 144170 - RNA, 17 nt, Human
aggugcagaggcagagc

SEQ ID NO: 144171 - RNA, 22 nt, Human
uccuuuuuaagucguuguggua

SEQ ID NO: 144172 - RNA, 22 nt, Human
gcagggcaugggcccugucugc

SEQ ID NO: 144173 - RNA, 22 nt, Human
cuggaaggcucugcugccuguc

SEQ ID NO: 144174 - RNA, 22 nt, Human
auguccuuccauuuugaucugu

SEQ ID NO: 144175 - RNA, 22 nt, Human
ggugugugguccucucacuuag

SEQ ID NO: 144176 - RNA, 15 nt, Human
aggcacugugggacc

SEQ ID NO: 144177 - RNA, 22 nt, Human
cuguuuauacgacagguggagg

SEQ ID NO: 144178 - RNA, 22 nt, Human
guuuuauaggugaaauauuacu

SEQ ID NO: 144179 - RNA, 22 nt, Human
caggcagggagcuggaaaggau

SEQ ID NO: 144180 - RNA, 22 nt, Human
aaucaguucuacaucuuaucca

SEQ ID NO: 144181 - RNA, 22 nt, Human
ggcuucuuccugugaacauguu

SEQ ID NO: 144182 - RNA, 22 nt, Human
agcaggugcauggcgagcgcgg

SEQ ID NO: 144183 - RNA, 22 nt, Human
acagagcugggaucugaaccca

SEQ ID NO: 144184 - RNA, 22 nt, Human
uggcuggggagccccgacuccc

SEQ ID NO: 144185 - RNA, 22 nt, Human
ugggugugccauauuccauuuc

SEQ ID NO: 144186 - RNA, 22 nt, Human
uguggccucaaggcugcccuca

SEQ ID NO: 144187 - RNA, 22 nt, Human
aggaugggccugggauaugcuu

SEQ ID NO: 144188 - RNA, 22 nt, Human
agugcacagcgugauguauugg

SEQ ID NO: 144189 - RNA, 22 nt, Human
gucaggaugagggaugaggagu

SEQ ID NO: 144190 - RNA, 21 nt, Human
gcagcaguguucuagaauacu

SEQ ID NO: 144191 - RNA, 22 nt, Human
ugugucagagguagagauggca

SEQ ID NO: 144192 - RNA, 20 nt, Human
accauaauguuaauuacaaa

SEQ ID NO: 144193 - RNA, 22 nt, Human
uguugaagauaaaguucucauu

SEQ ID NO: 144194 - RNA, 22 nt, Human
uucuucuucauuucugacgaug

SEQ ID NO: 144195 - RNA, 19 nt, Human
ucugccucuggucaggcuc

SEQ ID NO: 144196 - RNA, 22 nt, Human
ucugucugcgcuugcccuggug

SEQ ID NO: 144197 - RNA, 22 nt, Human
ggccugucucacccccgggugc

SEQ ID NO: 144198 - RNA, 22 nt, Human
agauggagaaugacaauuaagg

SEQ ID NO: 144199 - RNA, 20 nt, Human
uucuucucuaguuaucuuca

SEQ ID NO: 144200 - RNA, 22 nt, Human
acuccuggguugcaguccucaa

SEQ ID NO: 144201 - RNA, 22 nt, Human
uugcagggaccugcagaaagcu

SEQ ID NO: 144202 - RNA, 20 nt, Human
gcagagcuguucugugggga

SEQ ID NO: 144203 - RNA, 22 nt, Human
gcucuguguugucagaggcacc

SEQ ID NO: 144204 - RNA, 20 nt, Human
uccugagauuuaagggguuc

SEQ ID NO: 144205 - RNA, 22 nt, Human
uggcucuggcgugaagcccaga

SEQ ID NO: 144206 - RNA, 22 nt, Human
auuuugcuacaguugguggaaa

SEQ ID NO: 144207 - RNA, 22 nt, Human
ccagcugcuugggaaaaugucu

SEQ ID NO: 144208 - RNA, 22 nt, Human
agagugauucuaguuagggaau

SEQ ID NO: 144209 - RNA, 22 nt, Human
ugaaagguguccaauauuucuc

SEQ ID NO: 144210 - RNA, 22 nt, Human
uggccugccuucgcugagcuga

SEQ ID NO: 144211 - RNA, 22 nt, Human
uaguaacagauuuauacagucu

SEQ ID NO: 144212 - RNA, 22 nt, Human
ucugggagacguguguugucag

SEQ ID NO: 144213 - RNA, 22 nt, Human
ucccacugcuuugcucugcuca

SEQ ID NO: 144214 - RNA, 22 nt, Human
aagugagauuauauguacggga

SEQ ID NO: 144215 - RNA, 22 nt, Human
ucaucacucauuggacaacaga

SEQ ID NO: 144216 - RNA, 22 nt, Human
agcccucauggaacagcuccua

SEQ ID NO: 144217 - RNA, 22 nt, Human
ucccagagcucugacaccagcu

SEQ ID NO: 144218 - RNA, 22 nt, Human
acagagcuuaauucaggagcuu

SEQ ID NO: 144219 - RNA, 22 nt, Human
gugucauguagaaauugaugaa

SEQ ID NO: 144220 - RNA, 22 nt, Human
aaggcacuacgcugcuggggcg

SEQ ID NO: 144221 - RNA, 22 nt, Human
ggucagggcucuuccaguggcu

SEQ ID NO: 144222 - RNA, 22 nt, Human
ccagcuccugggucuuagucag

SEQ ID NO: 144223 - RNA, 21 nt, Human
ugcagagauaucugaagcaga

SEQ ID NO: 144224 - RNA, 22 nt, Human
uaaggcacccauguucauacag

SEQ ID NO: 144225 - RNA, 22 nt, Human
caccagcuacagacuacugugu

SEQ ID NO: 144226 - RNA, 22 nt, Human
uucaaaggcaggauagcagcug

SEQ ID NO: 144227 - RNA, 22 nt, Human
uucauugucucuguuugccuuc

SEQ ID NO: 144228 - RNA, 22 nt, Human
agaaauguuguggguuuuguua

SEQ ID NO: 144229 - RNA, 22 nt, Human
caaaagcaguucuaucugaguu

SEQ ID NO: 144230 - RNA, 22 nt, Human
aaaggccaauaaagacaagcug

SEQ ID NO: 144231 - RNA, 22 nt, Human
augaaaacuuuagccucauuag

SEQ ID NO: 144232 - RNA, 22 nt, Human
auucugauaucuuauucuagcu

SEQ ID NO: 144233 - RNA, 22 nt, Human
cuggugucugcucccucacagc

SEQ ID NO: 144234 - RNA, 22 nt, Human
acuguguggaaauuugugaggg

SEQ ID NO: 144235 - RNA, 22 nt, Human
uggcucugcugaaccuagugca

SEQ ID NO: 144236 - RNA, 22 nt, Human
ucugggcagcagcagcuaguag

SEQ ID NO: 144237 - RNA, 22 nt, Human
cuggcagcugugugaagaacug

SEQ ID NO: 144238 - RNA, 18 nt, Human
caaagcucacguuccauc

SEQ ID NO: 144239 - RNA, 22 nt, Human
ggugggcaggcgaggcccaggu

SEQ ID NO: 144240 - RNA, 22 nt, Human
gugugugugcaucucuuuuauu

SEQ ID NO: 144241 - RNA, 22 nt, Human
ccagggcugcugugggacucca

SEQ ID NO: 144242 - RNA, 19 nt, Human
ccagcagguucauuucagg

SEQ ID NO: 144243 - RNA, 20 nt, Human
agagccuggaaaaagacauc

SEQ ID NO: 144244 - RNA, 22 nt, Human
aaggcacuagcagaauuaguga

SEQ ID NO: 144245 - RNA, 22 nt, Human
gugccugggguugagcuaugaa

SEQ ID NO: 144246 - RNA, 22 nt, Human
aggggagccccugguccuggug

SEQ ID NO: 144247 - RNA, 22 nt, Human
agcugcucugauaaaccuacuu

SEQ ID NO: 144248 - RNA, 22 nt, Human
acugcaggagacacagcugcug

SEQ ID NO: 144249 - RNA, 22 nt, Human
cagagggcucaguccugcugga

SEQ ID NO: 144250 - RNA, 22 nt, Human
uacauggguagguuaagucaua

SEQ ID NO: 144251 - RNA, 20 nt, Human
agugucuggugcagggccuc

SEQ ID NO: 144252 - RNA, 22 nt, Human
uagaaaagauaacauucugugc

SEQ ID NO: 144253 - RNA, 22 nt, Human
agccagcugccuuucacaucug

SEQ ID NO: 144254 - RNA, 22 nt, Human
uagacacaagagaaggguauaa

SEQ ID NO: 144255 - RNA, 22 nt, Human
cuuguacauugauuucugcauu

SEQ ID NO: 144256 - RNA, 22 nt, Human
uccucacagucaacacuuugag

SEQ ID NO: 144257 - RNA, 22 nt, Human
acagugauuauuaguugguggu

SEQ ID NO: 144258 - RNA, 22 nt, Human
ucucagagggaaaggccaauuu

SEQ ID NO: 144259 - RNA, 22 nt, Human
agcacagguacggagaugcuac

SEQ ID NO: 144260 - RNA, 22 nt, Human
gauauuuucgcagggagaauuc

SEQ ID NO: 144261 - RNA, 22 nt, Human
agcauggggcaaugcaugugcu

SEQ ID NO: 144262 - RNA, 22 nt, Human
cacaguggauugggugaugccc

SEQ ID NO: 144263 - RNA, 22 nt, Human
ggagccagggaagcugcuuccu

SEQ ID NO: 144264 - RNA, 22 nt, Human
gguuugcauucugaaaggcuca

SEQ ID NO: 144265 - RNA, 22 nt, Human
uagaaaauagggccuguggagc

SEQ ID NO: 144266 - RNA, 22 nt, Human
uuucaugagauuccuccacauc

SEQ ID NO: 144267 - RNA, 22 nt, Human
aggcuggggaauugaauuugcu

SEQ ID NO: 144268 - RNA, 22 nt, Human
ccaggacuucgaggcuacagug

SEQ ID NO: 144269 - RNA, 22 nt, Human
agcuuccuuggcgcugaggccu

SEQ ID NO: 144270 - RNA, 22 nt, Human
agccaaggacacggagccuccu

SEQ ID NO: 144271 - RNA, 22 nt, Human
aagagcugcccaaggugaacag

SEQ ID NO: 144272 - RNA, 22 nt, Human
caggaggcaucauggagcggac

SEQ ID NO: 144273 - RNA, 22 nt, Human
ggcucugccugcccagcagcac

SEQ ID NO: 144274 - RNA, 22 nt, Human
agggcccuccccgcucagggca

SEQ ID NO: 144275 - RNA, 22 nt, Human
uucacaggaggguggaugcaug

SEQ ID NO: 144276 - RNA, 22 nt, Human
ccaugagcuuccuauauagggu

SEQ ID NO: 144277 - RNA, 22 nt, Human
ccucagggccaucucugucccu

SEQ ID NO: 144278 - RNA, 22 nt, Human
uucaaucauuagaaucucaggc

SEQ ID NO: 144279 - RNA, 22 nt, Human
augcacaagaggcuagaaaaga

SEQ ID NO: 144280 - RNA, 20 nt, Human
ccuaggcaugcugagucucc

SEQ ID NO: 144281 - RNA, 22 nt, Human
agagcagcacguuguccccaca

SEQ ID NO: 144282 - RNA, 22 nt, Human
gaaaggccauuucugaggguuu

SEQ ID NO: 144283 - RNA, 22 nt, Human
gcagauggugggggaggaguac

SEQ ID NO: 144284 - RNA, 22 nt, Human
gccagcagguggagagaucaag

SEQ ID NO: 144285 - RNA, 22 nt, Human
ugcugaggucaccuugcugcua

SEQ ID NO: 144286 - RNA, 22 nt, Human
ccuggccugcucggcucuuaag

SEQ ID NO: 144287 - RNA, 22 nt, Human
auggcugugugcuucuccccau

SEQ ID NO: 144288 - RNA, 22 nt, Human
ugaggccacuuccccacagccc

SEQ ID NO: 144289 - RNA, 22 nt, Human
gcccauggacacccaagugcca

SEQ ID NO: 144290 - RNA, 22 nt, Human
cuggcaggcagacuucugcaag

SEQ ID NO: 144291 - RNA, 22 nt, Human
aggcucaguuugguuuccauug

SEQ ID NO: 144292 - RNA, 22 nt, Human
ucaccuuagcuagaggaagaga

SEQ ID NO: 144293 - RNA, 22 nt, Human
agaggucagaacaggaaagugu

SEQ ID NO: 144294 - RNA, 22 nt, Human
uugcagggcaggaccauggaca

SEQ ID NO: 144295 - RNA, 23 nt, Human
acuauaaaguuguucugauuuac

SEQ ID NO: 144296 - RNA, 21 nt, Human
acagcaagccuucacaugagu

SEQ ID NO: 144297 - RNA, 22 nt, Human
cucccaggcacagggaggagcc

SEQ ID NO: 144298 - RNA, 22 nt, Human
auccuucaaggggcugacagcu

SEQ ID NO: 144299 - RNA, 19 nt, Human
aguagcagaaagugcagug

SEQ ID NO: 144300 - RNA, 22 nt, Human
gcugcccagcaggccccagggg

SEQ ID NO: 144301 - RNA, 17 nt, Human
ccaggugggaggugggg

SEQ ID NO: 144302 - RNA, 22 nt, Human
uaugcauaauuggauaaguaga

SEQ ID NO: 144303 - RNA, 22 nt, Human
gcagggcugcugaaacuuguuu

SEQ ID NO: 144304 - RNA, 21 nt, Human
agaggccuuacaggauagacc

SEQ ID NO: 144305 - RNA, 19 nt, Human
ccuuggaguuccaggugga

SEQ ID NO: 144306 - RNA, 22 nt, Human
uuagugucuucuucauccucug

SEQ ID NO: 144307 - RNA, 22 nt, Human
acugaaauacugcucuuggauu

SEQ ID NO: 144308 - RNA, 22 nt, Human
agcucccaggcagucaugagga

SEQ ID NO: 144309 - RNA, 22 nt, Human
ucauccaguucacauggugagu

SEQ ID NO: 144310 - RNA, 22 nt, Human
acauuuaaugauccuacuguga

SEQ ID NO: 144311 - RNA, 22 nt, Human
ugggccuccaauuccagcggga

SEQ ID NO: 144312 - RNA, 22 nt, Human
acacugaauauacaaugaauau

SEQ ID NO: 144313 - RNA, 22 nt, Human
uguggcugacuccuggucccca

SEQ ID NO: 144314 - RNA, 22 nt, Human
uuucagaucauuuuuuaaguac

SEQ ID NO: 144315 - RNA, 22 nt, Human
aggccuggccccaguugcuagg

SEQ ID NO: 144316 - RNA, 22 nt, Human
caggguggggaaauagcgcccu

SEQ ID NO: 144317 - RNA, 22 nt, Human
ugccuggaaggcccaugggaag

SEQ ID NO: 144318 - RNA, 22 nt, Human
uuuaacauguaauugcugcuuu

SEQ ID NO: 144319 - RNA, 22 nt, Human
ucugcugucuuuucugggugag

SEQ ID NO: 144320 - RNA, 22 nt, Human
auguuucaccagcaaauuaccu

SEQ ID NO: 144321 - RNA, 22 nt, Human
cugagcugggaguggauagugg

SEQ ID NO: 144322 - RNA, 22 nt, Human
aacguuuuaucgugugcucuuc

SEQ ID NO: 144323 - RNA, 22 nt, Human
ucaguucugcuagaaaaacagu

SEQ ID NO: 144324 - RNA, 22 nt, Human
gauauuuugagaaauccuauga

SEQ ID NO: 144325 - RNA, 22 nt, Human
cagugauggauauggagaaguc

SEQ ID NO: 144326 - RNA, 22 nt, Human
aggcuguguucugcccucuccc

SEQ ID NO: 144327 - RNA, 22 nt, Human
uuaacaguaaagaauugugcaa

SEQ ID NO: 144328 - RNA, 22 nt, Human
ucagaacauuuaaaaagugguu

SEQ ID NO: 144329 - RNA, 20 nt, Human
gcacugaagguuccagggga

SEQ ID NO: 144330 - RNA, 22 nt, Human
ccacugucugcaggccucagca

SEQ ID NO: 144331 - RNA, 22 nt, Human
cagagagagucaaaucuuugcu

SEQ ID NO: 144332 - RNA, 22 nt, Human
uucuuacuaguauguuucagca

SEQ ID NO: 144333 - RNA, 22 nt, Human
ugccagcacuucuggcugucug

SEQ ID NO: 144334 - RNA, 23 nt, Human
gcauugucuccccacuucugggc

SEQ ID NO: 144335 - RNA, 22 nt, Human
agaagcaguuauuuuuugcaca

SEQ ID NO: 144336 - RNA, 22 nt, Human
ucucagaguuuagagcugagcc

SEQ ID NO: 144337 - RNA, 22 nt, Human
gccuggaguggacuuggccccu

SEQ ID NO: 144338 - RNA, 22 nt, Human
ucauggauggccgggaggugau

SEQ ID NO: 144339 - RNA, 22 nt, Human
agggcagcagcuccuccuagcu

SEQ ID NO: 144340 - RNA, 22 nt, Human
guugaaagaugucuugguuccc

SEQ ID NO: 144341 - RNA, 22 nt, Human
uuacaguuacugguacuguuaa

SEQ ID NO: 144342 - RNA, 22 nt, Human
uccucagacacccugcuggcuu

SEQ ID NO: 144343 - RNA, 22 nt, Human
uuuucuuuaaucugguggggug

SEQ ID NO: 144344 - RNA, 22 nt, Human
cuuguccccagcagguugguuu

SEQ ID NO: 144345 - RNA, 22 nt, Human
accagccugucugagucguggg

SEQ ID NO: 144346 - RNA, 23 nt, Human
uggcucagggucucuuaugaagu

SEQ ID NO: 144347 - RNA, 22 nt, Human
aggcugugagagguggcuccca

SEQ ID NO: 144348 - RNA, 22 nt, Human
cacaccuguaauaccagcuacu

SEQ ID NO: 144349 - RNA, 22 nt, Human
uggccaggcagguagaacggcc

SEQ ID NO: 144350 - RNA, 22 nt, Human
uggagggcucuuucaccuggua

SEQ ID NO: 144351 - RNA, 22 nt, Human
aacaugaaguuuucuauaguga

SEQ ID NO: 144352 - RNA, 23 nt, Human
ucucagaggauuccugggccuug

SEQ ID NO: 144353 - RNA, 22 nt, Human
ugauuuccugugcgcccuuagg

SEQ ID NO: 144354 - RNA, 22 nt, Human
gcacacaggcaguuuccagcca

SEQ ID NO: 144355 - RNA, 22 nt, Human
agggcagagacaugcuuccuga

SEQ ID NO: 144356 - RNA, 22 nt, Human
ugccagcuccgaggagcugcag

SEQ ID NO: 144357 - RNA, 20 nt, Human
uauaacaguguugggugugu

SEQ ID NO: 144358 - RNA, 22 nt, Human
uuacagauggcaguuucuugag

SEQ ID NO: 144359 - RNA, 21 nt, Human
gugugcugauacauuggagaa

SEQ ID NO: 144360 - RNA, 22 nt, Human
aaguuugcauagauuaagcauu

SEQ ID NO: 144361 - RNA, 22 nt, Human
acuuugcaaugggcagaaccca

SEQ ID NO: 144362 - RNA, 22 nt, Human
uugcucugacuggagugcagug

SEQ ID NO: 144363 - RNA, 22 nt, Human
ugugcucuggaguugccuucac

SEQ ID NO: 144364 - RNA, 22 nt, Human
aagauuauggcagauaacaauu

SEQ ID NO: 144365 - RNA, 22 nt, Human
gaaugcacucacccaucacuca

SEQ ID NO: 144366 - RNA, 22 nt, Human
ggcccugagcugaaguacugug

SEQ ID NO: 144367 - RNA, 22 nt, Human
acagaauugauggaaaucucag

SEQ ID NO: 144368 - RNA, 22 nt, Human
gccauuuucugucuuguuuauu

SEQ ID NO: 144369 - RNA, 22 nt, Human
uuguggcucgugagauguuagg

SEQ ID NO: 144370 - RNA, 22 nt, Human
ucuguggccuguguccaagugc

SEQ ID NO: 144371 - RNA, 23 nt, Human
gcugcagcuguggauguucucag

SEQ ID NO: 144372 - RNA, 22 nt, Human
gcuugaaaauucauagguauuu

SEQ ID NO: 144373 - RNA, 22 nt, Human
agggcuggcuaggugcguuccc

SEQ ID NO: 144374 - RNA, 22 nt, Human
caagccugucucaccagugcua

SEQ ID NO: 144375 - RNA, 22 nt, Human
accauguguuuuacacauggua

SEQ ID NO: 144376 - RNA, 20 nt, Human
cuguggcucaugcaucugcc

SEQ ID NO: 144377 - RNA, 22 nt, Human
aaggcucuuggagugaaugcag

SEQ ID NO: 144378 - RNA, 22 nt, Human
uggccagguugggcuuugcagc

SEQ ID NO: 144379 - RNA, 22 nt, Human
gcuggccaggugcuuugguucu

SEQ ID NO: 144380 - RNA, 22 nt, Human
accucuggccuucaggcaucau

SEQ ID NO: 144381 - RNA, 22 nt, Human
agaggcugagaaacccucuucu

SEQ ID NO: 144382 - RNA, 22 nt, Human
cugggccugggaggccaggucu

SEQ ID NO: 144383 - RNA, 22 nt, Human
cugaggccucucuccugggcuu

SEQ ID NO: 144384 - RNA, 16 nt, Human
gggagggaguuggugg

SEQ ID NO: 144385 - RNA, 22 nt, Human
ggguccagcuacaucagggugg

SEQ ID NO: 144386 - RNA, 22 nt, Human
cugugucucuccuuacaagacu

SEQ ID NO: 144387 - RNA, 22 nt, Human
cagagcagcagagcuuccaugg

SEQ ID NO: 144388 - RNA, 17 nt, Human
auuuccucagggcugag

SEQ ID NO: 144389 - RNA, 22 nt, Human
cucccuggaggugagcuggcac

SEQ ID NO: 144390 - RNA, 22 nt, Human
cuguuacauagcuuuucuuaac

SEQ ID NO: 144391 - RNA, 22 nt, Human
gccagguggcugagugacugag

SEQ ID NO: 144392 - RNA, 22 nt, Human
uuauuuucuccucagaaagugg

SEQ ID NO: 144393 - RNA, 22 nt, Human
gagauguacaauguguauuaau

SEQ ID NO: 144394 - RNA, 22 nt, Human
agugugaccuuauuuggaaaca

SEQ ID NO: 144395 - RNA, 21 nt, Human
cagaggggcuagccuggcugc

SEQ ID NO: 144396 - RNA, 22 nt, Human
cugaggugcuagggucccugcu

SEQ ID NO: 144397 - RNA, 22 nt, Human
cucagggacguuagaggacagg

SEQ ID NO: 144398 - RNA, 23 nt, Human
ugcugggguaguuuguggcacag

SEQ ID NO: 144399 - RNA, 20 nt, Human
agacccuguguccuguggcc

SEQ ID NO: 144400 - RNA, 17 nt, Human
aguguguaacuugugua

SEQ ID NO: 144401 - RNA, 22 nt, Human
uccagucaagcuugagaauuuc

SEQ ID NO: 144402 - RNA, 22 nt, Human
agccuggcuguaaccucauggu

SEQ ID NO: 144403 - RNA, 22 nt, Human
gccugagagacccauggggcaa

SEQ ID NO: 144404 - RNA, 22 nt, Human
accuggcacuacaggcaccugu

SEQ ID NO: 144405 - RNA, 22 nt, Human
gcaggggaguggcaggcccgga

SEQ ID NO: 144406 - RNA, 22 nt, Human
gucaggauuauuuuauuaaaag

SEQ ID NO: 144407 - RNA, 19 nt, Human
caaggguugggucugucau

SEQ ID NO: 144408 - RNA, 22 nt, Human
agcauauugucuuuggugucuc

SEQ ID NO: 144409 - RNA, 22 nt, Human
gcugcucuggcucugcaguguc

SEQ ID NO: 144410 - RNA, 22 nt, Human
guggcccaggcuuggcgcuggc

SEQ ID NO: 144411 - RNA, 22 nt, Human
gccugugacucgucuugggcca

SEQ ID NO: 144412 - RNA, 22 nt, Human
cagucccacuagugccaauacc

SEQ ID NO: 144413 - RNA, 22 nt, Human
ugcauuauacuuuuagaaauuu

SEQ ID NO: 144414 - RNA, 22 nt, Human
ugcauguguuugccacagugag

SEQ ID NO: 144415 - RNA, 18 nt, Human
guguggcugagaugaggc

SEQ ID NO: 144416 - RNA, 22 nt, Human
gugcuuuccauccucccugcug

SEQ ID NO: 144417 - RNA, 19 nt, Human
agcaaauauaauaguguuc

SEQ ID NO: 144418 - RNA, 22 nt, Human
uuguggcucaucuucagcuccc

SEQ ID NO: 144419 - RNA, 22 nt, Human
uggaguucauccaugacagcuu

SEQ ID NO: 144420 - RNA, 22 nt, Human
aaugccaguguguugauuccag

SEQ ID NO: 144421 - RNA, 22 nt, Human
caggaugggauguagugggccc

SEQ ID NO: 144422 - RNA, 22 nt, Human
cagccugcagggcugccuguug

SEQ ID NO: 144423 - RNA, 22 nt, Human
gguggggccugcuccagcggcc

SEQ ID NO: 144424 - RNA, 22 nt, Human
acauucuagaagucuuugcaau

SEQ ID NO: 144425 - RNA, 22 nt, Human
aggaggccgggauucuggagau

SEQ ID NO: 144426 - RNA, 22 nt, Human
guguacauauugagucugcuga

SEQ ID NO: 144427 - RNA, 22 nt, Human
ugcugucugcaacaguacuaca

SEQ ID NO: 144428 - RNA, 22 nt, Human
agacagaacagaauaauuguug

SEQ ID NO: 144429 - RNA, 22 nt, Human
agaaaugcucuuccugaccaga

SEQ ID NO: 144430 - RNA, 22 nt, Human
acacaggggaaaguggagcuga

SEQ ID NO: 144431 - RNA, 22 nt, Human
gaaaauguuagcuucauaguca

SEQ ID NO: 144432 - RNA, 19 nt, Human
agcagagcccugaagaucc

SEQ ID NO: 144433 - RNA, 22 nt, Human
cauaauauacuacauugaugaa

SEQ ID NO: 144434 - RNA, 22 nt, Human
agcaggguuuggggauuggcac

SEQ ID NO: 144435 - RNA, 22 nt, Human
cacauuugaaggaauuagcauu

SEQ ID NO: 144436 - RNA, 22 nt, Human
agagcugggacuuggacucaau

SEQ ID NO: 144437 - RNA, 19 nt, Human
ucugaggguccagaugcau

SEQ ID NO: 144438 - RNA, 20 nt, Human
gccugccucagcuagcugag

SEQ ID NO: 144439 - RNA, 22 nt, Human
aaucauaauuguauacauucau

SEQ ID NO: 144440 - RNA, 22 nt, Human
augaaggcaguuaaacgucauc

SEQ ID NO: 144441 - RNA, 22 nt, Human
aucaggauagugguuaccuggg

SEQ ID NO: 144442 - RNA, 22 nt, Human
cugggcuggcgcauccgacacg

SEQ ID NO: 144443 - RNA, 22 nt, Human
ccagggcagcagaauuggggca

SEQ ID NO: 144444 - RNA, 22 nt, Human
ggcuggguacagggcagugugc

SEQ ID NO: 144445 - RNA, 22 nt, Human
aaaugcacagaggccagagagg

SEQ ID NO: 144446 - RNA, 22 nt, Human
ccagcucucagcgggagacuca

SEQ ID NO: 144447 - RNA, 22 nt, Human
gaggaaccacucugagaagcca

SEQ ID NO: 144448 - RNA, 19 nt, Human
gcugcuggcucuggcugga

SEQ ID NO: 144449 - RNA, 22 nt, Human
agugucugccaacugcaugguc

SEQ ID NO: 144450 - RNA, 22 nt, Human
ccagaagaccccguccaccucc

SEQ ID NO: 144451 - RNA, 22 nt, Human
ugccugggagugaccaagacuc

SEQ ID NO: 144452 - RNA, 22 nt, Human
gcugugagcugccugugucaca

SEQ ID NO: 144453 - RNA, 22 nt, Human
ugagguggcuagggaggcacuc

SEQ ID NO: 144454 - RNA, 22 nt, Human
aagaacaguguccugggacucg

SEQ ID NO: 144455 - RNA, 22 nt, Human
cuggcagguccagcuggacuca

SEQ ID NO: 144456 - RNA, 22 nt, Human
ggacuucuaagugccagacacu

SEQ ID NO: 144457 - RNA, 22 nt, Human
gcagagccuugcgucaugugcc

SEQ ID NO: 144458 - RNA, 22 nt, Human
cuggaagaggaagccagcugga

SEQ ID NO: 144459 - RNA, 23 nt, Human
ugcuucucugcuugacaguucug

SEQ ID NO: 144460 - RNA, 22 nt, Human
gcagagcccuggggguauggug

SEQ ID NO: 144461 - RNA, 22 nt, Human
uuuuauguaauaaacuguacac

SEQ ID NO: 144462 - RNA, 22 nt, Human
cuguggcuucuagguccccgau

SEQ ID NO: 144463 - RNA, 18 nt, Human
auccuugaugagaggucu

SEQ ID NO: 144464 - RNA, 22 nt, Human
auugaggcagcauaguucaggg

SEQ ID NO: 144465 - RNA, 20 nt, Human
aggcacuggggauagguaag

SEQ ID NO: 144466 - RNA, 22 nt, Human
aucuggcugcugugcuuaagcu

SEQ ID NO: 144467 - RNA, 22 nt, Human
cuacauuuugugauuaugaaau

SEQ ID NO: 144468 - RNA, 22 nt, Human
ucugggaacugagcuccccuag

SEQ ID NO: 144469 - RNA, 22 nt, Human
gagugaaaaaggaagggccaua

SEQ ID NO: 144470 - RNA, 22 nt, Human
ugugccugucacccucagagag

SEQ ID NO: 144471 - RNA, 22 nt, Human
agcaaggcagucagcuggcugg

SEQ ID NO: 144472 - RNA, 22 nt, Human
agauauuuugugugauguuuca

SEQ ID NO: 144473 - RNA, 21 nt, Human
cugguguagcacucaggugcu

SEQ ID NO: 144474 - RNA, 22 nt, Human
ccuuuacacauggaaugggucu

SEQ ID NO: 144475 - RNA, 21 nt, Human
uagcacuucgcuguaauuggg

SEQ ID NO: 144476 - RNA, 22 nt, Human
agaguguuuuucugucaaggac

SEQ ID NO: 144477 - RNA, 22 nt, Human
accagcagaguugaggaggaca

SEQ ID NO: 144478 - RNA, 22 nt, Human
aaugggagguaguaugggaggu

SEQ ID NO: 144479 - RNA, 22 nt, Human
ccagcaggagaugccugugucu

SEQ ID NO: 144480 - RNA, 22 nt, Human
ucagggcaccaaaaaagaugcc

SEQ ID NO: 144481 - RNA, 22 nt, Human
auugucuuuggugcuuccagga

SEQ ID NO: 144482 - RNA, 22 nt, Human
ucuucucccaucuccaggcagg

SEQ ID NO: 144483 - RNA, 22 nt, Human
uuccaguucccaugaggauuaa

SEQ ID NO: 144484 - RNA, 22 nt, Human
gccagagcugagacacgagucc

SEQ ID NO: 144485 - RNA, 22 nt, Human
uuuucucaggugcuuaucuaag

SEQ ID NO: 144486 - RNA, 22 nt, Human
cuugugcaauugacauugaauc

SEQ ID NO: 144487 - RNA, 22 nt, Human
agagcuguucagcagccagguu

SEQ ID NO: 144488 - RNA, 22 nt, Human
uacaguagacaauguuaguaug

SEQ ID NO: 144489 - RNA, 20 nt, Human
uucuuuacgaccuuucugca

SEQ ID NO: 144490 - RNA, 22 nt, Human
cuggaguuagaguagacacuga

SEQ ID NO: 144491 - RNA, 22 nt, Human
cuggcagcucugagucccuucu

SEQ ID NO: 144492 - RNA, 22 nt, Human
cuggggccacaacggcgcacgc

SEQ ID NO: 144493 - RNA, 22 nt, Human
aggcccugcccagugccacaag

SEQ ID NO: 144494 - RNA, 22 nt, Human
uucugcucuuggcuuugcuggu

SEQ ID NO: 144495 - RNA, 22 nt, Human
uaaggcacccgugagcugccag

SEQ ID NO: 144496 - RNA, 22 nt, Human
aagcucugcucagcagacuagg

SEQ ID NO: 144497 - RNA, 22 nt, Human
auguguauauuuauuguaguuu

SEQ ID NO: 144498 - RNA, 22 nt, Human
uuuccuucaucaucugagagcu

SEQ ID NO: 144499 - RNA, 22 nt, Human
uacaaacuuguuuuaaguaagu

SEQ ID NO: 144500 - RNA, 22 nt, Human
uuccgcuggggccgccuggcgg

SEQ ID NO: 144501 - RNA, 22 nt, Human
cugucccagauguucucagcac

SEQ ID NO: 144502 - RNA, 22 nt, Human
cugccaggacugacgucuucag

SEQ ID NO: 144503 - RNA, 22 nt, Human
uucugcucuaauguacaccagc

SEQ ID NO: 144504 - RNA, 22 nt, Human
gugggcuggacccuccugcucc

SEQ ID NO: 144505 - RNA, 22 nt, Human
ugaagcaacuggacaaguuggc

SEQ ID NO: 144506 - RNA, 22 nt, Human
gugagcaggauuucauggugua

SEQ ID NO: 144507 - RNA, 21 nt, Human
uuuauguacuucauagaguag

SEQ ID NO: 144508 - RNA, 19 nt, Human
ggcucucccuugagagagc

SEQ ID NO: 144509 - RNA, 22 nt, Human
cugcuggggucagagcacuggg

SEQ ID NO: 144510 - RNA, 22 nt, Human
ggaggccauaguuugggaguca

SEQ ID NO: 144511 - RNA, 22 nt, Human
ccagaggaaaaauaucucccua

SEQ ID NO: 144512 - RNA, 22 nt, Human
caggggcuuaagugacagaagg

SEQ ID NO: 144513 - RNA, 22 nt, Human
ucucagagaugucaagagucua

SEQ ID NO: 144514 - RNA, 22 nt, Human
gagaggaguaggcugauggugc

SEQ ID NO: 144515 - RNA, 22 nt, Human
caguccuggggaccaggcugag

SEQ ID NO: 144516 - RNA, 22 nt, Human
aggaccugacuggcuccugcuu

SEQ ID NO: 144517 - RNA, 22 nt, Human
uaacagaaaagaacugaguuug

SEQ ID NO: 144518 - RNA, 22 nt, Human
aagggcagccugacucacgguc

SEQ ID NO: 144519 - RNA, 22 nt, Human
ucuacuuuucccuauacaguuu

SEQ ID NO: 144520 - RNA, 22 nt, Human
uuguuacaucuuauguaagugg

SEQ ID NO: 144521 - RNA, 21 nt, Human
agagccugagaucuuccagca

SEQ ID NO: 144522 - RNA, 22 nt, Human
uuagaaagaacuuuagauauca

SEQ ID NO: 144523 - RNA, 22 nt, Human
agcucccagcuccuuugagaga

SEQ ID NO: 144524 - RNA, 22 nt, Human
ggaugcuggggaccaaucucug

SEQ ID NO: 144525 - RNA, 22 nt, Human
cugccuggcauggagaagagaa

SEQ ID NO: 144526 - RNA, 22 nt, Human
cugcucucuguuccccuggauc

SEQ ID NO: 144527 - RNA, 22 nt, Human
ggagggcugccagguggagcgg

SEQ ID NO: 144528 - RNA, 18 nt, Human
gguggcuggggacggaca

SEQ ID NO: 144529 - RNA, 22 nt, Human
aaaauacuguggaguguugaaa

SEQ ID NO: 144530 - RNA, 22 nt, Human
gagaaggggugauguggguaau

SEQ ID NO: 144531 - RNA, 22 nt, Human
ggccugugagccuuaguuuaua

SEQ ID NO: 144532 - RNA, 17 nt, Human
gagauggguggaucacc

SEQ ID NO: 144533 - RNA, 22 nt, Human
aaaagacauaugugggcauucu

SEQ ID NO: 144534 - RNA, 22 nt, Human
ggcuucuccagguacugagcau

SEQ ID NO: 144535 - RNA, 23 nt, Human
acagacaacacugaugagagaaa

SEQ ID NO: 144536 - RNA, 21 nt, Human
gaacauuuggguuguuucuac

SEQ ID NO: 144537 - RNA, 22 nt, Human
auccugggcagugugucacucu

SEQ ID NO: 144538 - RNA, 22 nt, Human
agcagagcggggccuccggaag

SEQ ID NO: 144539 - RNA, 22 nt, Human
uuucccaguucccugcucuaua

SEQ ID NO: 144540 - RNA, 22 nt, Human
agucauaugacccuucacaaac

SEQ ID NO: 144541 - RNA, 22 nt, Human
cuguguuugacaggcggucucc

SEQ ID NO: 144542 - RNA, 21 nt, Human
gcaggaugcaucuuggugucu

SEQ ID NO: 144543 - RNA, 22 nt, Human
gccagaaacauacacaucacuu

SEQ ID NO: 144544 - RNA, 23 nt, Human
uuauuuugucagaagggacuuuu

SEQ ID NO: 144545 - RNA, 22 nt, Human
aguggccagugcugcucugggg

SEQ ID NO: 144546 - RNA, 22 nt, Human
ugaagguggcauaggagagaug

SEQ ID NO: 144547 - RNA, 22 nt, Human
aaggcacuuaacgugggaggau

SEQ ID NO: 144548 - RNA, 22 nt, Human
caggccuggguucaaaucccuu

SEQ ID NO: 144549 - RNA, 22 nt, Human
gcugcagcagcugcaggguugu

SEQ ID NO: 144550 - RNA, 22 nt, Human
gcagacaggcccaguggaggga

SEQ ID NO: 144551 - RNA, 22 nt, Human
uucuggagagaaaccuuacaaa

SEQ ID NO: 144552 - RNA, 23 nt, Human
ggcucugugcuaauugcugaaaa

SEQ ID NO: 144553 - RNA, 20 nt, Human
ccuggaagagcuccccaggc

SEQ ID NO: 144554 - RNA, 18 nt, Human
uggcagggaggaaauaua

SEQ ID NO: 144555 - RNA, 20 nt, Human
gucucagaauggauuugcau

SEQ ID NO: 144556 - RNA, 22 nt, Human
gcagccacacuguuacagaaug

SEQ ID NO: 144557 - RNA, 22 nt, Human
aaugaugguuucaucacuugaa

SEQ ID NO: 144558 - RNA, 22 nt, Human
agcugcccccagggcugugcuu

SEQ ID NO: 144559 - RNA, 22 nt, Human
ucauuuguacuugugugcuugu

SEQ ID NO: 144560 - RNA, 22 nt, Human
aaaagaggagugguuuaugaca

SEQ ID NO: 144561 - RNA, 22 nt, Human
ugcauuccuccaccuccugcac

SEQ ID NO: 144562 - RNA, 22 nt, Human
aagaugauguuguguuuucacu

SEQ ID NO: 144563 - RNA, 22 nt, Human
ucucacuuuccagacuuuucaa

SEQ ID NO: 144564 - RNA, 22 nt, Human
gaauucuuuucuuucugaaagu

SEQ ID NO: 144565 - RNA, 22 nt, Human
gcagcacauauaaacaaagaga

SEQ ID NO: 144566 - RNA, 22 nt, Human
ccugcaggggagagacuucuag

SEQ ID NO: 144567 - RNA, 22 nt, Human
uuccucaucugugcaccucacu

SEQ ID NO: 144568 - RNA, 22 nt, Human
cagauaaaggcuuacuaguagu

SEQ ID NO: 144569 - RNA, 22 nt, Human
cugggaggcggagguuguagug

SEQ ID NO: 144570 - RNA, 22 nt, Human
ucugagggugggagaaggagcu

SEQ ID NO: 144571 - RNA, 19 nt, Human
ugcuuccucaccaucuccc

SEQ ID NO: 144572 - RNA, 22 nt, Human
agguggggaggagugucucuuu

SEQ ID NO: 144573 - RNA, 22 nt, Human
ccagcagcucccucaggguccg

SEQ ID NO: 144574 - RNA, 22 nt, Human
agcauuuaguuaguaaauguuu

SEQ ID NO: 144575 - RNA, 22 nt, Human
agggccugcucuaucacucuca

SEQ ID NO: 144576 - RNA, 22 nt, Human
ucacuuauaaaaugcaagaucu

SEQ ID NO: 144577 - RNA, 22 nt, Human
uguauuuucugaagauaaucaa

SEQ ID NO: 144578 - RNA, 20 nt, Human
ugcagagcuggcuggcuccu

SEQ ID NO: 144579 - RNA, 22 nt, Human
agaggaugguugaggaagaccu

SEQ ID NO: 144580 - RNA, 22 nt, Human
cuguggcugaguuccuuauguu

SEQ ID NO: 144581 - RNA, 22 nt, Human
aggcagaaaauagucauccaaa

SEQ ID NO: 144582 - RNA, 22 nt, Human
ccagcagguguagggcucaugg

SEQ ID NO: 144583 - RNA, 22 nt, Human
gcccagaguucaaggcugcagu

SEQ ID NO: 144584 - RNA, 19 nt, Human
uuugcagugguuccuuugu

SEQ ID NO: 144585 - RNA, 22 nt, Human
ccucagaggugaacaucagugc

SEQ ID NO: 144586 - RNA, 22 nt, Human
auuucacucuuaauugcuuccu

SEQ ID NO: 144587 - RNA, 22 nt, Human
uauuucuguaacucagggucug

SEQ ID NO: 144588 - RNA, 22 nt, Human
gggcuguguuaggugcgguuac

SEQ ID NO: 144589 - RNA, 22 nt, Human
auucuuggagcagucaaagaag

SEQ ID NO: 144590 - RNA, 19 nt, Human
ggccaggcugacugugguc

SEQ ID NO: 144591 - RNA, 22 nt, Human
cuggguguucaggagcugggcu

SEQ ID NO: 144592 - RNA, 22 nt, Human
ggagacagugguagggccuaag

SEQ ID NO: 144593 - RNA, 22 nt, Human
gaugccugcauuucaggagagu

SEQ ID NO: 144594 - RNA, 22 nt, Human
uuucaucuauuugcuuugugaa

SEQ ID NO: 144595 - RNA, 22 nt, Human
aacagcuuugcuucuggagaca

SEQ ID NO: 144596 - RNA, 22 nt, Human
aaauguuucuacuugugagcau

SEQ ID NO: 144597 - RNA, 22 nt, Human
ugugucuggauagguaauggau

SEQ ID NO: 144598 - RNA, 22 nt, Human
agagcuggacgucugagcccua

SEQ ID NO: 144599 - RNA, 22 nt, Human
cagagccccccuucugaucaca

SEQ ID NO: 144600 - RNA, 22 nt, Human
aguguugucaaacggcucagca

SEQ ID NO: 144601 - RNA, 22 nt, Human
uuugaaagggacaaagucacug

SEQ ID NO: 144602 - RNA, 22 nt, Human
gagguucacaggcuaucacagu

SEQ ID NO: 144603 - RNA, 22 nt, Human
ggugaggggagagugaaagaaa

SEQ ID NO: 144604 - RNA, 22 nt, Human
cagggccagcgcccaggcccag

SEQ ID NO: 144605 - RNA, 22 nt, Human
ucagaagcaaacaucacucuag

SEQ ID NO: 144606 - RNA, 22 nt, Human
cacaugcauaaggauaauuacu

SEQ ID NO: 144607 - RNA, 22 nt, Human
ugucccucauugacgcugugcc

SEQ ID NO: 144608 - RNA, 22 nt, Human
gaacccaggcuuuugaggcugu

SEQ ID NO: 144609 - RNA, 22 nt, Human
cagagguauugcaaaagccuag

SEQ ID NO: 144610 - RNA, 22 nt, Human
cggcuggguucggcugcaggcc

SEQ ID NO: 144611 - RNA, 22 nt, Human
cagggccuccuaaggcaucuaa

SEQ ID NO: 144612 - RNA, 22 nt, Human
ucccagaguucaaugggaaggu

SEQ ID NO: 144613 - RNA, 22 nt, Human
ccagcagaggggcggagugcag

SEQ ID NO: 144614 - RNA, 22 nt, Human
uggaggugagugugguacagca

SEQ ID NO: 144615 - RNA, 22 nt, Human
ggccugcugacccaaguccugu

SEQ ID NO: 144616 - RNA, 22 nt, Human
uguguagcuuucuucugugggg

SEQ ID NO: 144617 - RNA, 23 nt, Human
ugacacauuuccuuuccacugca

SEQ ID NO: 144618 - RNA, 22 nt, Human
ugucauuuaguccucugugugu

SEQ ID NO: 144619 - RNA, 22 nt, Human
ucaugcacaugugucaccauca

SEQ ID NO: 144620 - RNA, 22 nt, Human
uuuucaucucugcuuuguaccu

SEQ ID NO: 144621 - RNA, 22 nt, Human
uacugcauaacuggcauguggg

SEQ ID NO: 144622 - RNA, 22 nt, Human
auucaaguggcugcuauguuaa

SEQ ID NO: 144623 - RNA, 20 nt, Human
agcuucuucugucuaauuuu

SEQ ID NO: 144624 - RNA, 22 nt, Human
gggcacagcugcuacccagugc

SEQ ID NO: 144625 - RNA, 22 nt, Human
uggcucaggcuugaaaauagau

SEQ ID NO: 144626 - RNA, 19 nt, Human
aguguguacugaaagcacu

SEQ ID NO: 144627 - RNA, 22 nt, Human
uugacacaguuuucucauuaag

SEQ ID NO: 144628 - RNA, 23 nt, Human
uggagcugggcucagacccuggg

SEQ ID NO: 144629 - RNA, 22 nt, Human
aaguucuacuguggguaaaaug

SEQ ID NO: 144630 - RNA, 22 nt, Human
cugcauuagucaugcuuugcag

SEQ ID NO: 144631 - RNA, 22 nt, Human
gcucugcuggaaguucucugga

SEQ ID NO: 144632 - RNA, 22 nt, Human
cucaaggacuuauucaugccug

SEQ ID NO: 144633 - RNA, 22 nt, Human
ucaggggaaaucucucagcgaa

SEQ ID NO: 144634 - RNA, 22 nt, Human
acacacaacucauuguguaaua

SEQ ID NO: 144635 - RNA, 19 nt, Human
cauaauacaguggaucuga

SEQ ID NO: 144636 - RNA, 22 nt, Human
uuuccagugaauuagucuguuu

SEQ ID NO: 144637 - RNA, 22 nt, Human
auggaagguccuacagagcgca

SEQ ID NO: 144638 - RNA, 22 nt, Human
acauuucuugaugccucuguga

SEQ ID NO: 144639 - RNA, 22 nt, Human
agucucagaguaccugagggac

SEQ ID NO: 144640 - RNA, 22 nt, Human
agaaaucucaguaucucaggga

SEQ ID NO: 144641 - RNA, 22 nt, Human
uuuacagugagagcuuagugag

SEQ ID NO: 144642 - RNA, 22 nt, Human
uacagcuaggcaaaaaugacau

SEQ ID NO: 144643 - RNA, 22 nt, Human
ccagcagagggucuuggccauu

SEQ ID NO: 144644 - RNA, 22 nt, Human
gugucaugggagucagaaguga

SEQ ID NO: 144645 - RNA, 22 nt, Human
uuacauguacugguuugacuua

SEQ ID NO: 144646 - RNA, 22 nt, Human
caaaggcaacauauacuuguuu

SEQ ID NO: 144647 - RNA, 22 nt, Human
ugcagcugguuuagaacuagau

SEQ ID NO: 144648 - RNA, 20 nt, Human
gggaguggugguagccugug

SEQ ID NO: 144649 - RNA, 22 nt, Human
uuuaucuuuggaucuucagaaa

SEQ ID NO: 144650 - RNA, 22 nt, Human
ggagccuguggcugcuugaagc

SEQ ID NO: 144651 - RNA, 22 nt, Human
ggccugaggcgucccagcugug

SEQ ID NO: 144652 - RNA, 22 nt, Human
uuguguguacugguuaugggca

SEQ ID NO: 144653 - RNA, 22 nt, Human
agggccagggaagcuguauuuu

SEQ ID NO: 144654 - RNA, 21 nt, Human
aacugcuggucuuuucugucu

SEQ ID NO: 144655 - RNA, 18 nt, Human
ccugcagcccaggaggcc

SEQ ID NO: 144656 - RNA, 22 nt, Human
aggagaguucacacuggucaga

SEQ ID NO: 144657 - RNA, 22 nt, Human
agcuucuggaagccuggcagca

SEQ ID NO: 144658 - RNA, 22 nt, Human
cuguccuccggccaccuacagu

SEQ ID NO: 144659 - RNA, 22 nt, Human
caaggccaguccauuuuggaag

SEQ ID NO: 144660 - RNA, 22 nt, Human
auaucuuuuagagcaagcuugu

SEQ ID NO: 144661 - RNA, 22 nt, Human
cugggcacauuuugacuagugu

SEQ ID NO: 144662 - RNA, 22 nt, Human
gaugccuccaaaugagggcaga

SEQ ID NO: 144663 - RNA, 22 nt, Human
cuauuuucugucucuauagagu

SEQ ID NO: 144664 - RNA, 22 nt, Human
aguggcagagcaggugcuggaa

SEQ ID NO: 144665 - RNA, 22 nt, Human
ggagcuguuggcagcuaucuug

SEQ ID NO: 144666 - RNA, 21 nt, Human
agaaauguaucauucuuuucc

SEQ ID NO: 144667 - RNA, 22 nt, Human
agacagcauggagcugauaaca

SEQ ID NO: 144668 - RNA, 22 nt, Human
ccagcucuuuuggcugagugag

SEQ ID NO: 144669 - RNA, 23 nt, Human
uuacaguaggaguuggaaaacca

SEQ ID NO: 144670 - RNA, 22 nt, Human
gcacagcaauuucuauaagcuc

SEQ ID NO: 144671 - RNA, 22 nt, Human
auucacagggacaaugggagag

SEQ ID NO: 144672 - RNA, 23 nt, Human
uuugaaaguaucaacucgccuga

SEQ ID NO: 144673 - RNA, 22 nt, Human
ucaggcagcuccaggaauggua

SEQ ID NO: 144674 - RNA, 20 nt, Human
cugcugugugugccucagcc

SEQ ID NO: 144675 - RNA, 22 nt, Human
aggagaaagacuggacagccaa

SEQ ID NO: 144676 - RNA, 22 nt, Human
acagcagcuaaaggugucuccu

SEQ ID NO: 144677 - RNA, 22 nt, Human
ugucuguaagguguuuauguua

SEQ ID NO: 144678 - RNA, 22 nt, Human
cucuggagggaggcugagcugg

SEQ ID NO: 144679 - RNA, 22 nt, Human
gaugguuugguaaaaguauguu

SEQ ID NO: 144680 - RNA, 22 nt, Human
ucagccugcuccaagugcugcc

SEQ ID NO: 144681 - RNA, 22 nt, Human
gcuguguaggauccuguuguau

SEQ ID NO: 144682 - RNA, 22 nt, Human
auauauuuugcggucacguggc

SEQ ID NO: 144683 - RNA, 22 nt, Human
cgcugccaggucaccaggggua

SEQ ID NO: 144684 - RNA, 22 nt, Human
acagguggcuuauuggcugauu

SEQ ID NO: 144685 - RNA, 22 nt, Human
uaaggccauuauggugggcccg

SEQ ID NO: 144686 - RNA, 22 nt, Human
aggagcugcuuaaaugguuggu

SEQ ID NO: 144687 - RNA, 17 nt, Human
agaugcuggccacaugu

SEQ ID NO: 144688 - RNA, 22 nt, Human
acuuugugcccaacagaaagaa

SEQ ID NO: 144689 - RNA, 22 nt, Human
cugcagcugucucuacugggca

SEQ ID NO: 144690 - RNA, 22 nt, Human
ggagucagccugucagagugua

SEQ ID NO: 144691 - RNA, 22 nt, Human
aaaauuauagaucuagugccug

SEQ ID NO: 144692 - RNA, 22 nt, Human
ggcugcuguuucagagacuguu

SEQ ID NO: 144693 - RNA, 22 nt, Human
uugcauugaaaauauauuuuaa

SEQ ID NO: 144694 - RNA, 22 nt, Human
uaaggcauucucaugcugugaa

SEQ ID NO: 144695 - RNA, 22 nt, Human
caguacuuuucaaccaguauga

SEQ ID NO: 144696 - RNA, 22 nt, Human
ugucucagggcagcagcagggg

SEQ ID NO: 144697 - RNA, 20 nt, Human
caagcccucuuuagccugcc

SEQ ID NO: 144698 - RNA, 22 nt, Human
ucugcuuuagugcaaagucuua

SEQ ID NO: 144699 - RNA, 22 nt, Human
uuuaacagaugugaaauuuuca

SEQ ID NO: 144700 - RNA, 22 nt, Human
gagcugcccugagcuuugcaug

SEQ ID NO: 144701 - RNA, 22 nt, Human
ugcuccagugagcuggccaucc

SEQ ID NO: 144702 - RNA, 22 nt, Human
acugggaggcaucuggagcuga

SEQ ID NO: 144703 - RNA, 22 nt, Human
gagccaaggguugccauggaga

SEQ ID NO: 144704 - RNA, 22 nt, Human
ccugccagauccccugagcuga

SEQ ID NO: 144705 - RNA, 22 nt, Human
uaugaagauauaucugaucucu

SEQ ID NO: 144706 - RNA, 22 nt, Human
agcugccacagagccuggccag

SEQ ID NO: 144707 - RNA, 22 nt, Human
ggggggugcugaucaguggagc

SEQ ID NO: 144708 - RNA, 21 nt, Human
gcccagcaaggugagaaggcc

SEQ ID NO: 144709 - RNA, 22 nt, Human
uucaauucaauucuaaauauau

SEQ ID NO: 144710 - RNA, 23 nt, Human
uuacuuuugcaccaaccuaauau

SEQ ID NO: 144711 - RNA, 22 nt, Human
ucccagccuuucuuuucugcug

SEQ ID NO: 144712 - RNA, 22 nt, Human
ucucucugagcccugcuuuuuc

SEQ ID NO: 144713 - RNA, 22 nt, Human
uuauuauugugaccugagaaug

SEQ ID NO: 144714 - RNA, 23 nt, Human
ucucaggacacacaugucuauca

SEQ ID NO: 144715 - RNA, 22 nt, Human
gccuggccgcuccgagcuccgc

SEQ ID NO: 144716 - RNA, 22 nt, Human
gcucugagaggugcagcaguaa

SEQ ID NO: 144717 - RNA, 22 nt, Human
cagaagccugccucagaugcac

SEQ ID NO: 144718 - RNA, 22 nt, Human
agucucugggcaugguugugac

SEQ ID NO: 144719 - RNA, 22 nt, Human
ggcagggugccuggcuccuguu

SEQ ID NO: 144720 - RNA, 22 nt, Human
uugguuuacuaggauucaaauu

SEQ ID NO: 144721 - RNA, 22 nt, Human
cagagguacaagcuaaguuggg

SEQ ID NO: 144722 - RNA, 22 nt, Human
acaagagacaagagguucuucu

SEQ ID NO: 144723 - RNA, 22 nt, Human
agguaaggcuguaagcuaagcc

SEQ ID NO: 144724 - RNA, 22 nt, Human
cacagggcagaggguccguggc

SEQ ID NO: 144725 - RNA, 22 nt, Human
aguuucuaccgguacauucagg

SEQ ID NO: 144726 - RNA, 22 nt, Human
gcagaagucagaccaucugaau

SEQ ID NO: 144727 - RNA, 22 nt, Human
agcuuuauauuuaaugaauucu

SEQ ID NO: 144728 - RNA, 22 nt, Human
cucacaggcaucucaucaggcu

SEQ ID NO: 144729 - RNA, 22 nt, Human
cugucuguuuuaccuucuccag

SEQ ID NO: 144730 - RNA, 22 nt, Human
uuucauaaugucacagucaaaa

SEQ ID NO: 144731 - RNA, 22 nt, Human
gcagaggggaagcugaggaauu

SEQ ID NO: 144732 - RNA, 22 nt, Human
ucucuggaguauaaccagggau

SEQ ID NO: 144733 - RNA, 22 nt, Human
ccaaaguccacaguuuacauua

SEQ ID NO: 144734 - RNA, 22 nt, Human
ucagccagugccuugaucuugc

SEQ ID NO: 144735 - RNA, 22 nt, Human
ugagcugucugaauggugagga

SEQ ID NO: 144736 - RNA, 22 nt, Human
aguaucaucuccauuucacuga

SEQ ID NO: 144737 - RNA, 22 nt, Human
ucggagcuguagaugaaacccu

SEQ ID NO: 144738 - RNA, 22 nt, Human
ugucugucugcaagccagaaag

SEQ ID NO: 144739 - RNA, 22 nt, Human
aggugccaauuuucagugaaca

SEQ ID NO: 144740 - RNA, 22 nt, Human
cuggcuccacucccugccugac

SEQ ID NO: 144741 - RNA, 22 nt, Human
cuauuucaaggcccagauauga

SEQ ID NO: 144742 - RNA, 22 nt, Human
augaacacauguacacauuucu

SEQ ID NO: 144743 - RNA, 22 nt, Human
uuucuucagccuucacaaccug

SEQ ID NO: 144744 - RNA, 22 nt, Human
uuuucagugguaucuuuguaaa

SEQ ID NO: 144745 - RNA, 22 nt, Human
gcugcuguugauuuaguccaau

SEQ ID NO: 144746 - RNA, 22 nt, Human
uugucucuacagagaguaguag

SEQ ID NO: 144747 - RNA, 22 nt, Human
uggcugugguuuaucccaguuc

SEQ ID NO: 144748 - RNA, 19 nt, Human
ggcucagggcgcugccgcc

SEQ ID NO: 144749 - RNA, 22 nt, Human
cugccagcucgccacaaugaca

SEQ ID NO: 144750 - RNA, 23 nt, Human
aggcugcagaagaauagggucau

SEQ ID NO: 144751 - RNA, 22 nt, Human
ucagauggguuuugaaggaugu

SEQ ID NO: 144752 - RNA, 22 nt, Human
gcauacagagaggauguggcau

SEQ ID NO: 144753 - RNA, 22 nt, Human
guuacacaggaaaacauuagca

SEQ ID NO: 144754 - RNA, 22 nt, Human
guccuggguccccgcaggucag

SEQ ID NO: 144755 - RNA, 22 nt, Human
aucauucuaguccuuauggucu

SEQ ID NO: 144756 - RNA, 18 nt, Human
gucaccuggaucagauua

SEQ ID NO: 144757 - RNA, 22 nt, Human
cagagccaggccugcccucuuu

SEQ ID NO: 144758 - RNA, 22 nt, Human
ucaggauaaaauguaauggcaa

SEQ ID NO: 144759 - RNA, 22 nt, Human
cccuggagguggagguugcagg

SEQ ID NO: 144760 - RNA, 23 nt, Human
cuggccuccgacacuggccaaga

SEQ ID NO: 144761 - RNA, 22 nt, Human
uccauugucuuugguccuagcc

SEQ ID NO: 144762 - RNA, 22 nt, Human
ccuggaaggugaugguacagca

SEQ ID NO: 144763 - RNA, 22 nt, Human
ccuggcaggcuggggacagugc

SEQ ID NO: 144764 - RNA, 22 nt, Human
gaugcacuugccccuccucaga

SEQ ID NO: 144765 - RNA, 22 nt, Human
cuggagcucuccagagccccgu

SEQ ID NO: 144766 - RNA, 21 nt, Human
gcugccaccgcgugcuccagg

SEQ ID NO: 144767 - RNA, 22 nt, Human
acagcagagugugagauagcca

SEQ ID NO: 144768 - RNA, 22 nt, Human
uggcuuccuccagagcaggagg

SEQ ID NO: 144769 - RNA, 22 nt, Human
aguguuucuggcaaaugaaagu

SEQ ID NO: 144770 - RNA, 22 nt, Human
cuuaacauccugcauuuuucuu

SEQ ID NO: 144771 - RNA, 18 nt, Human
uuugcaaaggaaguaugg

SEQ ID NO: 144772 - RNA, 22 nt, Human
agaaauguauagugaauuuuuc

SEQ ID NO: 144773 - RNA, 19 nt, Human
ggcuggcaagugacagugu

SEQ ID NO: 144774 - RNA, 22 nt, Human
auuucccagcuuugaucaguuu

SEQ ID NO: 144775 - RNA, 22 nt, Human
cagcaagauuuuuaaagcaagg

SEQ ID NO: 144776 - RNA, 19 nt, Human
ucuuuucacgcauuuugaa

SEQ ID NO: 144777 - RNA, 22 nt, Human
uggccucuuacgacauagccuu

SEQ ID NO: 144778 - RNA, 22 nt, Human
aaaaugcaugagaaugugcucg

SEQ ID NO: 144779 - RNA, 22 nt, Human
ucucagagccuaacuaaccuaa

SEQ ID NO: 144780 - RNA, 22 nt, Human
gcuggcugaggucuagcucuuu

SEQ ID NO: 144781 - RNA, 22 nt, Human
cagagccagcccacuguucccg

SEQ ID NO: 144782 - RNA, 22 nt, Human
cugcugcugagagcucagccug

SEQ ID NO: 144783 - RNA, 22 nt, Human
cuuuacugccaugcauuuauaa

SEQ ID NO: 144784 - RNA, 22 nt, Human
aggcacuguggguguggccgga

SEQ ID NO: 144785 - RNA, 22 nt, Human
ccaggcugcucacaagcugccc

SEQ ID NO: 144786 - RNA, 22 nt, Human
uggcagcaauuagcuagagcug

SEQ ID NO: 144787 - RNA, 22 nt, Human
uugcauuguaggauguuagaag

SEQ ID NO: 144788 - RNA, 22 nt, Human
aguguuccuugcuuucccagag

SEQ ID NO: 144789 - RNA, 21 nt, Human
agcagccauuucacagagacu

SEQ ID NO: 144790 - RNA, 22 nt, Human
ugggcaggauaauaucucaugu

SEQ ID NO: 144791 - RNA, 22 nt, Human
ccacuugugaaauaaucaaaua

SEQ ID NO: 144792 - RNA, 22 nt, Human
gccaggcuggucuugaacuccu

SEQ ID NO: 144793 - RNA, 22 nt, Human
agccagugcaacagcagugaag

SEQ ID NO: 144794 - RNA, 22 nt, Human
auguggcuagggaauaaaauau

SEQ ID NO: 144795 - RNA, 22 nt, Human
ccuggagggcgccgcacagucc

SEQ ID NO: 144796 - RNA, 22 nt, Human
uccaugagggacacuggaugcu

SEQ ID NO: 144797 - RNA, 22 nt, Human
auguggcucacauagcuggaaa

SEQ ID NO: 144798 - RNA, 22 nt, Human
cacagguguucuugcagugaaa

SEQ ID NO: 144799 - RNA, 22 nt, Human
uggaaagaauuccuaugguuca

SEQ ID NO: 144800 - RNA, 22 nt, Human
uugcugaagugaagguauguuu

SEQ ID NO: 144801 - RNA, 22 nt, Human
ggugugccuggggcuuagcugc

SEQ ID NO: 144802 - RNA, 22 nt, Human
ggccuggaaugcuuuccuacca

SEQ ID NO: 144803 - RNA, 22 nt, Human
gccagagccacuuuugggugau

SEQ ID NO: 144804 - RNA, 22 nt, Human
agccacagcgaaccucucuucc

SEQ ID NO: 144805 - RNA, 22 nt, Human
guggauggauugaggcaguggg

SEQ ID NO: 144806 - RNA, 22 nt, Human
ccugucuguaucgguucagagu

SEQ ID NO: 144807 - RNA, 22 nt, Human
guggccuuuccugaagaaauga

SEQ ID NO: 144808 - RNA, 22 nt, Human
cuuuuuauagcuauguccuaug

SEQ ID NO: 144809 - RNA, 22 nt, Human
gggcugcuuauacugaugauaa

SEQ ID NO: 144810 - RNA, 22 nt, Human
uggccuggcccugaggcccugu

SEQ ID NO: 144811 - RNA, 22 nt, Human
ugccucugggugaccaaggagc

SEQ ID NO: 144812 - RNA, 22 nt, Human
cugugaguaaugaccugucuug

SEQ ID NO: 144813 - RNA, 22 nt, Human
uggcacugccuggcagggcccc

SEQ ID NO: 144814 - RNA, 22 nt, Human
cagcaggcugcgauugcucauu

SEQ ID NO: 144815 - RNA, 22 nt, Human
accagguggccccagcgugguu

SEQ ID NO: 144816 - RNA, 22 nt, Human
ugccagggcugcuacuggcuga

SEQ ID NO: 144817 - RNA, 22 nt, Human
ggcugagggccagggcuagucu

SEQ ID NO: 144818 - RNA, 22 nt, Human
aaguaaaagcuuuaccaugcgc

SEQ ID NO: 144819 - RNA, 22 nt, Human
uacagggguaacaguggggaau

SEQ ID NO: 144820 - RNA, 22 nt, Human
auauuuguuagagucuaugugu

SEQ ID NO: 144821 - RNA, 22 nt, Human
gagagcugucagcguagcaccg

SEQ ID NO: 144822 - RNA, 22 nt, Human
uaguuuuuucaacaaauggugc

SEQ ID NO: 144823 - RNA, 22 nt, Human
aacagaaaucauuuagggcucu

SEQ ID NO: 144824 - RNA, 22 nt, Human
ucugaggcuucagacuguacug

SEQ ID NO: 144825 - RNA, 22 nt, Human
agcugucuccagauacaggauu

SEQ ID NO: 144826 - RNA, 22 nt, Human
uccagugguacauggagacacu

SEQ ID NO: 144827 - RNA, 22 nt, Human
ucuccuggucaccucagaaguc

SEQ ID NO: 144828 - RNA, 22 nt, Human
cacuguaucuuuuccaaagucu

SEQ ID NO: 144829 - RNA, 22 nt, Human
uaaaugcaaugugcuuuaccag

SEQ ID NO: 144830 - RNA, 22 nt, Human
cuuauguauaauguuccacaua

SEQ ID NO: 144831 - RNA, 22 nt, Human
gcucuguguaaauguagggucc

SEQ ID NO: 144832 - RNA, 23 nt, Human
cccuggagcuagucugagcagag

SEQ ID NO: 144833 - RNA, 20 nt, Human
cugccaugauugauagagug

SEQ ID NO: 144834 - RNA, 20 nt, Human
gugugugcuccaugcaugcu

SEQ ID NO: 144835 - RNA, 22 nt, Human
uaagaacagugacagccaacau

SEQ ID NO: 144836 - RNA, 23 nt, Human
guggagccacaucacaggcuccu

SEQ ID NO: 144837 - RNA, 20 nt, Human
gcccaagguccagaaggggg

SEQ ID NO: 144838 - RNA, 22 nt, Human
cugggaggacaacuuggagcuc

SEQ ID NO: 144839 - RNA, 22 nt, Human
caaggccaguuucuccuaguca

SEQ ID NO: 144840 - RNA, 22 nt, Human
uaugcacacauguaugcaugug

SEQ ID NO: 144841 - RNA, 22 nt, Human
uggcagaguaggauggcccugu

SEQ ID NO: 144842 - RNA, 22 nt, Human
uauuuugucuucugcucaucac

SEQ ID NO: 144843 - RNA, 22 nt, Human
gugggccucuugaggguggcua

SEQ ID NO: 144844 - RNA, 22 nt, Human
ggaaggagggcggcaaugauga

SEQ ID NO: 144845 - RNA, 22 nt, Human
cagagugaaaacugagcucaaa

SEQ ID NO: 144846 - RNA, 22 nt, Human
uuuuuuaucuaugguaguacca

SEQ ID NO: 144847 - RNA, 22 nt, Human
auacaugucaucauauguuugu

SEQ ID NO: 144848 - RNA, 21 nt, Human
ugguuugcggccaaaguuaaa

SEQ ID NO: 144849 - RNA, 22 nt, Human
aggcuguggcccuggucuagca

SEQ ID NO: 144850 - RNA, 22 nt, Human
uccagagccuauauguucaacu

SEQ ID NO: 144851 - RNA, 22 nt, Human
ugggcagagaucuggaucaaac

SEQ ID NO: 144852 - RNA, 22 nt, Human
uaguuucuggguuggcuucuac

SEQ ID NO: 144853 - RNA, 22 nt, Human
ugguggccuugauggcaucugc

SEQ ID NO: 144854 - RNA, 22 nt, Human
gggcagcagcaggaggucucug

SEQ ID NO: 144855 - RNA, 22 nt, Human
agcagugggugacagagcugag

SEQ ID NO: 144856 - RNA, 20 nt, Human
uacauucaaaacaaacucug

SEQ ID NO: 144857 - RNA, 22 nt, Human
uccucuggggucagggcacuac

SEQ ID NO: 144858 - RNA, 22 nt, Human
acaguuucuccauuuacaccuu

SEQ ID NO: 144859 - RNA, 22 nt, Human
uaugaaacauucauacaaauaa

SEQ ID NO: 144860 - RNA, 22 nt, Human
ggagcacuauaauagagauuuu

SEQ ID NO: 144861 - RNA, 22 nt, Human
uacuguauuugauaagugaagu

SEQ ID NO: 144862 - RNA, 22 nt, Human
ggcugcugggaauaugccagcu

SEQ ID NO: 144863 - RNA, 22 nt, Human
ugucuguguccaaauuuccucu

SEQ ID NO: 144864 - RNA, 22 nt, Human
cuggccuuggugcuugcagaca

SEQ ID NO: 144865 - RNA, 23 nt, Human
aaaguugauuugcaguuuaagag

SEQ ID NO: 144866 - RNA, 22 nt, Human
ugaugggaggugcugcaggacc

SEQ ID NO: 144867 - RNA, 22 nt, Human
cuccagggaggucugcaggacu

SEQ ID NO: 144868 - RNA, 22 nt, Human
cagggcagugaagaacacacgu

SEQ ID NO: 144869 - RNA, 22 nt, Human
uucacaggaauguaggggucuu

SEQ ID NO: 144870 - RNA, 22 nt, Human
aaacauuugcaacucgguuugg

SEQ ID NO: 144871 - RNA, 22 nt, Human
agucucugcaugaugcagcaca

SEQ ID NO: 144872 - RNA, 22 nt, Human
guuugcauguauuaagucaaua

SEQ ID NO: 144873 - RNA, 21 nt, Human
uuguaugcauacauacacaca

SEQ ID NO: 144874 - RNA, 23 nt, Human
uugauuucaaaugcagagaacac

SEQ ID NO: 144875 - RNA, 22 nt, Human
cucugagagcggucuguggcuu

SEQ ID NO: 144876 - RNA, 22 nt, Human
acuuuucucccuccugccuuca

SEQ ID NO: 144877 - RNA, 22 nt, Human
uacauaguuccauuuacaggaa

SEQ ID NO: 144878 - RNA, 22 nt, Human
aacaaauggaacacaaaucuuu

SEQ ID NO: 144879 - RNA, 22 nt, Human
ucugagaguccaucuccaagcc

SEQ ID NO: 144880 - RNA, 22 nt, Human
cugagaggaugcugcaguggag

SEQ ID NO: 144881 - RNA, 22 nt, Human
aggcugugggugauuuacugug

SEQ ID NO: 144882 - RNA, 22 nt, Human
agaacagcagcacgucaagcug

SEQ ID NO: 144883 - RNA, 22 nt, Human
uggcucugcgucuguucguggg

SEQ ID NO: 144884 - RNA, 22 nt, Human
caaaugcaugagaaauaagagg

SEQ ID NO: 144885 - RNA, 22 nt, Human
cccaggaguuugaguucagcau

SEQ ID NO: 144886 - RNA, 19 nt, Human
cagaguacaccagauagga

SEQ ID NO: 144887 - RNA, 18 nt, Human
acaaaggucugcaagacc

SEQ ID NO: 144888 - RNA, 22 nt, Human
cucugugccucaguuuucuucu

SEQ ID NO: 144889 - RNA, 22 nt, Human
gcugccuuuugcuccucccacc

SEQ ID NO: 144890 - RNA, 22 nt, Human
cugggcaguuuuacaucauugc

SEQ ID NO: 144891 - RNA, 22 nt, Human
aggagagaauguuccaggcuug

SEQ ID NO: 144892 - RNA, 20 nt, Human
gagauuuccaaucaugccca

SEQ ID NO: 144893 - RNA, 22 nt, Human
gcuggccugaccagccacaggc

SEQ ID NO: 144894 - RNA, 22 nt, Human
uguguuccuucgucuucccuuc

SEQ ID NO: 144895 - RNA, 22 nt, Human
uugcugaauugaauccuuuggu

SEQ ID NO: 144896 - RNA, 22 nt, Human
guuauguacuuuuuaaaucuug

SEQ ID NO: 144897 - RNA, 22 nt, Human
augaaacacacacgcgcauacu

SEQ ID NO: 144898 - RNA, 22 nt, Human
ucuggcucugacacuacuguua

SEQ ID NO: 144899 - RNA, 22 nt, Human
agucucugagguucagaugccu

SEQ ID NO: 144900 - RNA, 21 nt, Human
ucuuuucucagcuuugugguu

SEQ ID NO: 144901 - RNA, 22 nt, Human
acuuucucaggaauucacagac

SEQ ID NO: 144902 - RNA, 22 nt, Human
ucagcagucacauguuguccca

SEQ ID NO: 144903 - RNA, 22 nt, Human
agcuggguggagggcccacggu

SEQ ID NO: 144904 - RNA, 22 nt, Human
cuggcuguuucaaauguauaga

SEQ ID NO: 144905 - RNA, 22 nt, Human
auuacaguagcaaaagaccgga

SEQ ID NO: 144906 - RNA, 22 nt, Human
cacagcagagggagccauugaa

SEQ ID NO: 144907 - RNA, 22 nt, Human
auuuacagacguggauuagugc

SEQ ID NO: 144908 - RNA, 20 nt, Human
ccuggcuuugcaucugugau

SEQ ID NO: 144909 - RNA, 21 nt, Human
uuugcauuuuacaugugggga

SEQ ID NO: 144910 - RNA, 22 nt, Human
agcugcccuggcggagcugcuc

SEQ ID NO: 144911 - RNA, 22 nt, Human
agcagaaccacagcacuguuga

SEQ ID NO: 144912 - RNA, 22 nt, Human
agguccagcuguugcagccucc

SEQ ID NO: 144913 - RNA, 17 nt, Human
uccuucagggccucaca

SEQ ID NO: 144914 - RNA, 22 nt, Human
uuagcaguuuccauuuugguca

SEQ ID NO: 144915 - RNA, 22 nt, Human
gucucucugcuaggccuccagu

SEQ ID NO: 144916 - RNA, 22 nt, Human
auacaacuuuacaugcaauucc

SEQ ID NO: 144917 - RNA, 22 nt, Human
acauagcuuaaaugagaagaua

SEQ ID NO: 144918 - RNA, 23 nt, Human
agagcuuucuaaaauguaaaucu

SEQ ID NO: 144919 - RNA, 22 nt, Human
gggugacauuucccaaugagcc

SEQ ID NO: 144920 - RNA, 22 nt, Human
ugccuaggaaaccucaugcuuc

SEQ ID NO: 144921 - RNA, 22 nt, Human
gcugcccauuccacuggauggu

SEQ ID NO: 144922 - RNA, 22 nt, Human
ucuagaaaaaaacugcugugga

SEQ ID NO: 144923 - RNA, 22 nt, Human
augugugguuuaagaauugaau

SEQ ID NO: 144924 - RNA, 22 nt, Human
ucacuucacacccacuaucaug

SEQ ID NO: 144925 - RNA, 22 nt, Human
aaagauuuaugaaguucaauua

SEQ ID NO: 144926 - RNA, 22 nt, Human
guggccugccgugugguauggg

SEQ ID NO: 144927 - RNA, 22 nt, Human
agggcugcugaggaagccuugc

SEQ ID NO: 144928 - RNA, 20 nt, Human
aauguauauuuuaugccagg

SEQ ID NO: 144929 - RNA, 19 nt, Human
cccaaggcccugggcaggc

SEQ ID NO: 144930 - RNA, 22 nt, Human
uugcauugaugucuauacgcug

SEQ ID NO: 144931 - RNA, 22 nt, Human
ugagagugauugguucgaaugu

SEQ ID NO: 144932 - RNA, 22 nt, Human
cccaaggcauggcaugguggca

SEQ ID NO: 144933 - RNA, 22 nt, Human
ugucauuuucuaaucuguuguc

SEQ ID NO: 144934 - RNA, 22 nt, Human
aucaaaguuucccagaaguugu

SEQ ID NO: 144935 - RNA, 22 nt, Human
ugacagaaagaauaugucaauc

SEQ ID NO: 144936 - RNA, 22 nt, Human
agagccugaggccaggaaaaug

SEQ ID NO: 144937 - RNA, 22 nt, Human
cccucccaagcacucugacaua

SEQ ID NO: 144938 - RNA, 22 nt, Human
cagagcagaaaccugggugauu

SEQ ID NO: 144939 - RNA, 22 nt, Human
auuucugauaaacguaagcugc

SEQ ID NO: 144940 - RNA, 22 nt, Human
acuuuacaaacuccucacuguu

SEQ ID NO: 144941 - RNA, 22 nt, Human
cagcugccugcaacacaagcuu

SEQ ID NO: 144942 - RNA, 22 nt, Human
ugaggggagaagcagcagccug

SEQ ID NO: 144943 - RNA, 22 nt, Human
gucuguggaguugcuugcugga

SEQ ID NO: 144944 - RNA, 22 nt, Human
uugaaguuguaguucagugaag

SEQ ID NO: 144945 - RNA, 22 nt, Human
ccugggcaaaugccagagacaa

SEQ ID NO: 144946 - RNA, 22 nt, Human
gcugugcagccaagugccucug

SEQ ID NO: 144947 - RNA, 22 nt, Human
gcaggcuggaggcuguucuggg

SEQ ID NO: 144948 - RNA, 22 nt, Human
gucucccacuuucuggccucuu

SEQ ID NO: 144949 - RNA, 22 nt, Human
aauaugcauuaacuguguacau

SEQ ID NO: 144950 - RNA, 19 nt, Human
uccuucagucagaucuggg

SEQ ID NO: 144951 - RNA, 22 nt, Human
aggccuagaggaauggccaggg

SEQ ID NO: 144952 - RNA, 22 nt, Human
agaagcugccuacaugaccagc

SEQ ID NO: 144953 - RNA, 22 nt, Human
ucuuuccucugagcuccuguag

SEQ ID NO: 144954 - RNA, 22 nt, Human
ucagcuccucaugcaggggaua

SEQ ID NO: 144955 - RNA, 22 nt, Human
uuucacaaugcaauccuacuuc

SEQ ID NO: 144956 - RNA, 22 nt, Human
aaauguauugcauaggauauuu

SEQ ID NO: 144957 - RNA, 22 nt, Human
cccagcagccuggauguucuuu

SEQ ID NO: 144958 - RNA, 22 nt, Human
uauuucugucagccagauaugg

SEQ ID NO: 144959 - RNA, 22 nt, Human
caagagcugugaccucauucac

SEQ ID NO: 144960 - RNA, 22 nt, Human
ccugggagguggagguugcagu

SEQ ID NO: 144961 - RNA, 22 nt, Human
ggcugcugguggaaugguaggc

SEQ ID NO: 144962 - RNA, 22 nt, Human
cuacagacccaccuuggaagaa

SEQ ID NO: 144963 - RNA, 20 nt, Human
gagauggacagaugaagggg

SEQ ID NO: 144964 - RNA, 16 nt, Human
cuguggcucccagguu

SEQ ID NO: 144965 - RNA, 22 nt, Human
gagcccuggcagucugggaugg

SEQ ID NO: 144966 - RNA, 22 nt, Human
cagggcugagaauuuagagaca

SEQ ID NO: 144967 - RNA, 22 nt, Human
gggacuucauagcuaggcacuu

SEQ ID NO: 144968 - RNA, 22 nt, Human
cucuccagccacagaagcugcu

SEQ ID NO: 144969 - RNA, 22 nt, Human
uugauuuuuccagcuucuagag

SEQ ID NO: 144970 - RNA, 22 nt, Human
aagauguaucaguuaagucuuc

SEQ ID NO: 144971 - RNA, 22 nt, Human
ugggauggcauccugggccuug

SEQ ID NO: 144972 - RNA, 22 nt, Human
gcucaggauuucauccaugugu

SEQ ID NO: 144973 - RNA, 22 nt, Human
gccuugcuuugcuucuggacag

SEQ ID NO: 144974 - RNA, 22 nt, Human
gaggucaauaauaugugcuuua

SEQ ID NO: 144975 - RNA, 22 nt, Human
uucacauuggugauauguuucu

SEQ ID NO: 144976 - RNA, 22 nt, Human
uacaauauguggccuuuuguga

SEQ ID NO: 144977 - RNA, 22 nt, Human
uaggagaggugaauggcacacu

SEQ ID NO: 144978 - RNA, 22 nt, Human
gaguggggucugggcaucaguc

SEQ ID NO: 144979 - RNA, 18 nt, Human
cccacggugcuguagggc

SEQ ID NO: 144980 - RNA, 22 nt, Human
ccaagaugaucuuuacaguguu

SEQ ID NO: 144981 - RNA, 22 nt, Human
gggugaggagcugccagucaug

SEQ ID NO: 144982 - RNA, 22 nt, Human
ucagaggauugccucagcgagc

SEQ ID NO: 144983 - RNA, 19 nt, Human
ugagcuggcugagccucuc

SEQ ID NO: 144984 - RNA, 22 nt, Human
acaaaguccugguguauggcca

SEQ ID NO: 144985 - RNA, 18 nt, Human
acauuucucucugcguga

SEQ ID NO: 144986 - RNA, 22 nt, Human
uggccuuccuggugacucauga

SEQ ID NO: 144987 - RNA, 22 nt, Human
gccugccucaaaaucccaguuc

SEQ ID NO: 144988 - RNA, 22 nt, Human
agaggccacuuugccugugaug

SEQ ID NO: 144989 - RNA, 22 nt, Human
ggaaggaggggcaaagcaguuc

SEQ ID NO: 144990 - RNA, 22 nt, Human
cucugugggggagaggcagcug

SEQ ID NO: 144991 - RNA, 22 nt, Human
aucugcuugaaugagcaacagg

SEQ ID NO: 144992 - RNA, 22 nt, Human
auggcuguguuagaugcuaagu

SEQ ID NO: 144993 - RNA, 22 nt, Human
augggaggaugcucgggugcuc

SEQ ID NO: 144994 - RNA, 22 nt, Human
auggauaagucaaagaguaucc

SEQ ID NO: 144995 - RNA, 22 nt, Human
aggcccaguuauccuacuuguu

SEQ ID NO: 144996 - RNA, 22 nt, Human
gucucagaccacccucuuuggc

SEQ ID NO: 144997 - RNA, 22 nt, Human
gcagaaggucuggcacuucagg

SEQ ID NO: 144998 - RNA, 21 nt, Human
acagaacuguauagugauaaa

SEQ ID NO: 144999 - RNA, 22 nt, Human
auggcugugugacugaguucua

SEQ ID NO: 145000 - RNA, 22 nt, Human
ugucccagggaaggcccagcac

SEQ ID NO: 145001 - RNA, 22 nt, Human
gacaggguacgggcuaggcaca

SEQ ID NO: 145002 - RNA, 22 nt, Human
uaaaaguggauaagcuguagga

SEQ ID NO: 145003 - RNA, 22 nt, Human
uccagcagggaauuaguagucu

SEQ ID NO: 145004 - RNA, 22 nt, Human
ccagucccgcaugguccagaau

SEQ ID NO: 145005 - RNA, 22 nt, Human
aaucaguuaaauauugaguaca

SEQ ID NO: 145006 - RNA, 23 nt, Human
aggauccugguacaggagcagag

SEQ ID NO: 145007 - RNA, 22 nt, Human
uacuguaugaauuauguuauuu

SEQ ID NO: 145008 - RNA, 22 nt, Human
aauucuagcauugugaaaauau

SEQ ID NO: 145009 - RNA, 22 nt, Human
guguccacggcugagaaugauu

SEQ ID NO: 145010 - RNA, 22 nt, Human
ccucuccaguuuuaacgugacc

SEQ ID NO: 145011 - RNA, 22 nt, Human
gggcccagcgugguuccaucug

SEQ ID NO: 145012 - RNA, 17 nt, Human
uucucuuccuggauagu

SEQ ID NO: 145013 - RNA, 22 nt, Human
gucucagagagcuacucucuua

SEQ ID NO: 145014 - RNA, 22 nt, Human
gcagagccaggagagacccuug

SEQ ID NO: 145015 - RNA, 22 nt, Human
cuggacuuuggcccaucugcca

SEQ ID NO: 145016 - RNA, 23 nt, Human
ugggggugcacgggccacaucuu

SEQ ID NO: 145017 - RNA, 22 nt, Human
gagagcugugguuugaccaggc

SEQ ID NO: 145018 - RNA, 22 nt, Human
ggcugccugccuccaagccggg

SEQ ID NO: 145019 - RNA, 19 nt, Human
caagugaagccugggaugg

SEQ ID NO: 145020 - RNA, 20 nt, Human
caccaggcgcucugagaaca

SEQ ID NO: 145021 - RNA, 22 nt, Human
cuuccucaugugcaaugcaagc

SEQ ID NO: 145022 - RNA, 22 nt, Human
uggcucagcugacucggcuucu

SEQ ID NO: 145023 - RNA, 22 nt, Human
augaaggauggcuggcugcccu

SEQ ID NO: 145024 - RNA, 19 nt, Human
ugaagcaggcagagaagau

SEQ ID NO: 145025 - RNA, 22 nt, Human
gggcugcugcccaggaggcacc

SEQ ID NO: 145026 - RNA, 22 nt, Human
ggucccaguugcccaggucagg

SEQ ID NO: 145027 - RNA, 22 nt, Human
uaggagcuaaaauauuuuauau

SEQ ID NO: 145028 - RNA, 22 nt, Human
auguguaugcaugcacuaagau

SEQ ID NO: 145029 - RNA, 20 nt, Human
ggcugccuccuuccuuuccu

SEQ ID NO: 145030 - RNA, 22 nt, Human
ucagggcagccuaaggcaccuc

SEQ ID NO: 145031 - RNA, 22 nt, Human
aucagcaaucaaauugcagagu

SEQ ID NO: 145032 - RNA, 22 nt, Human
acacugaagagcacuuucaaag

SEQ ID NO: 145033 - RNA, 22 nt, Human
aguguccaacucagcuugucaa

SEQ ID NO: 145034 - RNA, 22 nt, Human
gguccuggaaauugacggaaag

SEQ ID NO: 145035 - RNA, 22 nt, Human
accuuucaaaguggcuaucacu

SEQ ID NO: 145036 - RNA, 18 nt, Human
aggccugggaagcugagg

SEQ ID NO: 145037 - RNA, 22 nt, Human
cuguggcucagcacggggucag

SEQ ID NO: 145038 - RNA, 22 nt, Human
guuacagucaggagauauuuug

SEQ ID NO: 145039 - RNA, 22 nt, Human
ucccuggccauuccucuaggcc

SEQ ID NO: 145040 - RNA, 21 nt, Human
cacugcagccuugaccugggc

SEQ ID NO: 145041 - RNA, 22 nt, Human
gcuggcuugauaguuucugcuu

SEQ ID NO: 145042 - RNA, 22 nt, Human
ugagcaguaggucugaauagug

SEQ ID NO: 145043 - RNA, 18 nt, Human
acaaauguagugucuuaa

SEQ ID NO: 145044 - RNA, 22 nt, Human
gcugccugaucauacaccaggg

SEQ ID NO: 145045 - RNA, 22 nt, Human
uauuauuaaauggcagaauuuu

SEQ ID NO: 145046 - RNA, 22 nt, Human
uuuuaaguuaauauaauugagg

SEQ ID NO: 145047 - RNA, 22 nt, Human
ggccauggaccccgagcugacc

SEQ ID NO: 145048 - RNA, 22 nt, Human
agugaaauagcauuuaugaagc

SEQ ID NO: 145049 - RNA, 22 nt, Human
aggucauuuccuuagaggcaga

SEQ ID NO: 145050 - RNA, 22 nt, Human
ugugcugugggacucaggcucc

SEQ ID NO: 145051 - RNA, 22 nt, Human
ccagcagaagcucccgcugggu

SEQ ID NO: 145052 - RNA, 22 nt, Human
cuacccaggcuggagugcagua

SEQ ID NO: 145053 - RNA, 22 nt, Human
ccucugcucccuggugucugag

SEQ ID NO: 145054 - RNA, 22 nt, Human
acagaauagucagcuguaggcc

SEQ ID NO: 145055 - RNA, 19 nt, Human
agggcugcucuggccuggg

SEQ ID NO: 145056 - RNA, 22 nt, Human
cagagccaugguaugggcuugu

SEQ ID NO: 145057 - RNA, 22 nt, Human
acugucaccaucagagcgggaa

SEQ ID NO: 145058 - RNA, 21 nt, Human
gcugucucuggcuccugggaa

SEQ ID NO: 145059 - RNA, 22 nt, Human
aagucauuaucucuucuaaucu

SEQ ID NO: 145060 - RNA, 17 nt, Human
ugccagccugucccagg

SEQ ID NO: 145061 - RNA, 19 nt, Human
gcugggugaggucguugga

SEQ ID NO: 145062 - RNA, 22 nt, Human
uguuuacaaggaguuuauauug

SEQ ID NO: 145063 - RNA, 22 nt, Human
ucuucucaguuucucuaggaug

SEQ ID NO: 145064 - RNA, 23 nt, Human
gugauuucagggaacagaaucag

SEQ ID NO: 145065 - RNA, 22 nt, Human
ugcagaagcagagccgguggcc

SEQ ID NO: 145066 - RNA, 22 nt, Human
acaaaguuugugguauuccaag

SEQ ID NO: 145067 - RNA, 22 nt, Human
cagcugccacaccucuuucucu

SEQ ID NO: 145068 - RNA, 21 nt, Human
agcuggugucagagcucuggg

SEQ ID NO: 145069 - RNA, 22 nt, Human
acagaauugaaaguauaaucug

SEQ ID NO: 145070 - RNA, 21 nt, Human
acaugucucuaaucucaguga

SEQ ID NO: 145071 - RNA, 22 nt, Human
ucugggaauuuauuggcacuuu

SEQ ID NO: 145072 - RNA, 22 nt, Human
cauuuucagcacccaucugaaa

SEQ ID NO: 145073 - RNA, 22 nt, Human
agccccaguaagggagggccug

SEQ ID NO: 145074 - RNA, 22 nt, Human
gucccuggggaaucagcuggag

SEQ ID NO: 145075 - RNA, 21 nt, Human
ccaggguccagcugccauggu

SEQ ID NO: 145076 - RNA, 20 nt, Human
ucugcccaccccggcuccca

SEQ ID NO: 145077 - RNA, 22 nt, Human
ccacccagccagaugcaggaag

SEQ ID NO: 145078 - RNA, 22 nt, Human
guuugcauuccaauuuagggga

SEQ ID NO: 145079 - RNA, 22 nt, Human
uugauuaaacaggcauauucaa

SEQ ID NO: 145080 - RNA, 22 nt, Human
aaaaaugucauuauggaacuga

SEQ ID NO: 145081 - RNA, 22 nt, Human
cugggcagugguggcccuuccc

SEQ ID NO: 145082 - RNA, 22 nt, Human
uucacagacauugcagacugaa

SEQ ID NO: 145083 - RNA, 22 nt, Human
gcuuuacauaaacauuuauuau

SEQ ID NO: 145084 - RNA, 22 nt, Human
cugucaggggcggguggagcgg

SEQ ID NO: 145085 - RNA, 22 nt, Human
gaacagcugcuagagaucugug

SEQ ID NO: 145086 - RNA, 22 nt, Human
cauggccugccuccuccuggug

SEQ ID NO: 145087 - RNA, 22 nt, Human
uuuauuugucuugccauuuagu

SEQ ID NO: 145088 - RNA, 22 nt, Human
uggcucuggggacaguaagucc

SEQ ID NO: 145089 - RNA, 22 nt, Human
cagcugccccauaaaucacagu

SEQ ID NO: 145090 - RNA, 22 nt, Human
caggcacugugcaagggucucg

SEQ ID NO: 145091 - RNA, 22 nt, Human
uuaucacuuaugagcuuuuugc

SEQ ID NO: 145092 - RNA, 22 nt, Human
cucacuguuuaauagcuggauc

SEQ ID NO: 145093 - RNA, 22 nt, Human
cucagaaucugccaaguucagg

SEQ ID NO: 145094 - RNA, 17 nt, Human
uguuccauuugaccacc

SEQ ID NO: 145095 - RNA, 22 nt, Human
acguuuucuagagaauaugcag

SEQ ID NO: 145096 - RNA, 22 nt, Human
ggccuugggcagacacgucaca

SEQ ID NO: 145097 - RNA, 22 nt, Human
uugcuuccaguccaagucuguu

SEQ ID NO: 145098 - RNA, 22 nt, Human
gagagugucgggggccccagga

SEQ ID NO: 145099 - RNA, 22 nt, Human
acucucucacagcuuggcugau

SEQ ID NO: 145100 - RNA, 22 nt, Human
agaaauguuacaguuguuauuu

SEQ ID NO: 145101 - RNA, 22 nt, Human
gcuggcugcgucaucacagggc

SEQ ID NO: 145102 - RNA, 22 nt, Human
acagccuggacuggcucucugc

SEQ ID NO: 145103 - RNA, 22 nt, Human
aaauacagaguugcuuaaaagc

SEQ ID NO: 145104 - RNA, 21 nt, Human
aggcuguccuuugccagcccu

SEQ ID NO: 145105 - RNA, 22 nt, Human
acauuuacagugcuagacaauc

SEQ ID NO: 145106 - RNA, 22 nt, Human
gaguuauuaauggcugaguuug

SEQ ID NO: 145107 - RNA, 22 nt, Human
cagggacaauggcagagccuga

SEQ ID NO: 145108 - RNA, 22 nt, Human
acugaaagauaaaucaguuagc

SEQ ID NO: 145109 - RNA, 22 nt, Human
cugcucuggucucuucauguuu

SEQ ID NO: 145110 - RNA, 22 nt, Human
ccugccagcccgcguucaugcc

SEQ ID NO: 145111 - RNA, 22 nt, Human
uggaggaaaauuacuggggucu

SEQ ID NO: 145112 - RNA, 22 nt, Human
ugcugucaguuggcaggaugag

SEQ ID NO: 145113 - RNA, 22 nt, Human
caggauggccccggggcugugc

SEQ ID NO: 145114 - RNA, 22 nt, Human
augggaggcagacacuaaguuc

SEQ ID NO: 145115 - RNA, 22 nt, Human
uguuuaaucuauaaaauggaga

SEQ ID NO: 145116 - RNA, 22 nt, Human
aaaugcacaggagaaccaauuc

SEQ ID NO: 145117 - RNA, 22 nt, Human
agcccagaggcugggcgugcau

SEQ ID NO: 145118 - RNA, 22 nt, Human
uuucauugcagagucugugugc

SEQ ID NO: 145119 - RNA, 22 nt, Human
auuucacucauucauguuacuu

SEQ ID NO: 145120 - RNA, 22 nt, Human
ugugcagggaagggcaugcuau

SEQ ID NO: 145121 - RNA, 22 nt, Human
gugucccaggccucuggaauua

SEQ ID NO: 145122 - RNA, 22 nt, Human
aagcugccuugcugaggagaaa

SEQ ID NO: 145123 - RNA, 22 nt, Human
caucagcacuaugauuaaagua

SEQ ID NO: 145124 - RNA, 22 nt, Human
uacacuuuuuacuacagauucu

SEQ ID NO: 145125 - RNA, 21 nt, Human
cuaacuuugaguccuggcccc

SEQ ID NO: 145126 - RNA, 22 nt, Human
cccaggaggcagagcuugcagu

SEQ ID NO: 145127 - RNA, 22 nt, Human
aggccagguuccucaaucuuga

SEQ ID NO: 145128 - RNA, 22 nt, Human
cagccagaaccuaggaugagcu

SEQ ID NO: 145129 - RNA, 23 nt, Human
aucucucuuuauucuuggggaua

SEQ ID NO: 145130 - RNA, 23 nt, Human
ggcuggcccggggcugcuccuga

SEQ ID NO: 145131 - RNA, 22 nt, Human
cuuuacagauaggaacuacuca

SEQ ID NO: 145132 - RNA, 22 nt, Human
caguaguaguuaaacuguguau

SEQ ID NO: 145133 - RNA, 22 nt, Human
uuucaguguaucuuccaaaagc

SEQ ID NO: 145134 - RNA, 22 nt, Human
ugauuuccacgugcacccaggu

SEQ ID NO: 145135 - RNA, 21 nt, Human
ccagcagcucaaggaucucuu

SEQ ID NO: 145136 - RNA, 21 nt, Human
cucuugugucagagccagagg

SEQ ID NO: 145137 - RNA, 22 nt, Human
aagagcauauuaauaguggaga

SEQ ID NO: 145138 - RNA, 22 nt, Human
cucacugacgaggaagcugaga

SEQ ID NO: 145139 - RNA, 22 nt, Human
cugucuccuccacugcauggga

SEQ ID NO: 145140 - RNA, 22 nt, Human
cuggagccggaccagggacggu

SEQ ID NO: 145141 - RNA, 22 nt, Human
gggacuggcacagggcugggag

SEQ ID NO: 145142 - RNA, 22 nt, Human
uaccaguaauaguaugugagau

SEQ ID NO: 145143 - RNA, 22 nt, Human
ccuggaaguuggagguugcagu

SEQ ID NO: 145144 - RNA, 22 nt, Human
uuuauguaauuucauaggugug

SEQ ID NO: 145145 - RNA, 22 nt, Human
aguguuucccaguaggaugaaa

SEQ ID NO: 145146 - RNA, 23 nt, Human
ucacagggcacuggcugggguug

SEQ ID NO: 145147 - RNA, 22 nt, Human
uauaguaaaauuuucauuuaug

SEQ ID NO: 145148 - RNA, 18 nt, Human
auuucucuggggugauuc

SEQ ID NO: 145149 - RNA, 19 nt, Human
acauuuaaauucagaucuc

SEQ ID NO: 145150 - RNA, 22 nt, Human
gcugcucugcuguguaagcagg

SEQ ID NO: 145151 - RNA, 22 nt, Human
ggugaagggccuuaggagacag

SEQ ID NO: 145152 - RNA, 22 nt, Human
caguauaugcucuuucaucaaa

SEQ ID NO: 145153 - RNA, 22 nt, Human
gugacagaguuuuagaucucau

SEQ ID NO: 145154 - RNA, 22 nt, Human
auaaggcacacauagauagggu

SEQ ID NO: 145155 - RNA, 22 nt, Human
uuaugcuaagugcaacaagcca

SEQ ID NO: 145156 - RNA, 19 nt, Human
ucgagucaagacacuaggc

SEQ ID NO: 145157 - RNA, 22 nt, Human
gauucugagcugguguuuuacg

SEQ ID NO: 145158 - RNA, 22 nt, Human
ucacaguaucagguggagugga

SEQ ID NO: 145159 - RNA, 22 nt, Human
ccaaagagcuagaauuauaggc

SEQ ID NO: 145160 - RNA, 22 nt, Human
agguacagggugaaaguuuaug

SEQ ID NO: 145161 - RNA, 22 nt, Human
guccuggcccacuggcaggcug

SEQ ID NO: 145162 - RNA, 22 nt, Human
cuggcagccaagugggauacuc

SEQ ID NO: 145163 - RNA, 22 nt, Human
ucuucuuccucauuuauacaua

SEQ ID NO: 145164 - RNA, 17 nt, Human
cagugcagagcccuuuc

SEQ ID NO: 145165 - RNA, 22 nt, Human
uacaguaguaucuucauuuguu

SEQ ID NO: 145166 - RNA, 22 nt, Human
ucccaggauguuggcggcaggu

SEQ ID NO: 145167 - RNA, 20 nt, Human
gccugagcuauugccaggau

SEQ ID NO: 145168 - RNA, 22 nt, Human
caggaacacaaugagucucaaa

SEQ ID NO: 145169 - RNA, 22 nt, Human
agagaugaaaaguggagacugg

SEQ ID NO: 145170 - RNA, 22 nt, Human
agcauuuauuucuuagaaauug

SEQ ID NO: 145171 - RNA, 20 nt, Human
aaucagaaagugugagcucu

SEQ ID NO: 145172 - RNA, 22 nt, Human
gaugcacagugacccugccagu

SEQ ID NO: 145173 - RNA, 22 nt, Human
caggagaagguuuggagugcag

SEQ ID NO: 145174 - RNA, 22 nt, Human
ucugcucuaguugcuuccugcc

SEQ ID NO: 145175 - RNA, 20 nt, Human
cuucuucaguaguuuguucu

SEQ ID NO: 145176 - RNA, 22 nt, Human
gcucaggaaggcucaaccagga

SEQ ID NO: 145177 - RNA, 22 nt, Human
auuauuuuaugugcggccugau

SEQ ID NO: 145178 - RNA, 22 nt, Human
uuuagcuucaguucuagcuucu

SEQ ID NO: 145179 - RNA, 22 nt, Human
uguacacaauucuuaacauaca

SEQ ID NO: 145180 - RNA, 22 nt, Human
uggcucaguuaggucagaaaca

SEQ ID NO: 145181 - RNA, 22 nt, Human
ccucccuggccagagcagcagc

SEQ ID NO: 145182 - RNA, 22 nt, Human
acacagggcugcgccugacccc

SEQ ID NO: 145183 - RNA, 22 nt, Human
ucucagagauuuauggaaaacu

SEQ ID NO: 145184 - RNA, 22 nt, Human
ugaaggcccuaucuccauauac

SEQ ID NO: 145185 - RNA, 22 nt, Human
aguggaccagaagacugaagcu

SEQ ID NO: 145186 - RNA, 22 nt, Human
aaaaaaucagaucuuugguuaa

SEQ ID NO: 145187 - RNA, 22 nt, Human
gcucuggguagccacugccugg

SEQ ID NO: 145188 - RNA, 22 nt, Human
cucaggauauugggcuggagca

SEQ ID NO: 145189 - RNA, 22 nt, Human
gccagcagccacagaagucacu

SEQ ID NO: 145190 - RNA, 22 nt, Human
aaugggagagaacacaaagucc

SEQ ID NO: 145191 - RNA, 18 nt, Human
cuccagggaacucaguca

SEQ ID NO: 145192 - RNA, 22 nt, Human
gugguaauuuaauccuacacug

SEQ ID NO: 145193 - RNA, 21 nt, Human
acagaugggaugagcacacug

SEQ ID NO: 145194 - RNA, 19 nt, Human
uucacaauuaugaaauuag

SEQ ID NO: 145195 - RNA, 22 nt, Human
ggugccagccuagugcaguggu

SEQ ID NO: 145196 - RNA, 22 nt, Human
auggggcugggauucuccucgg

SEQ ID NO: 145197 - RNA, 20 nt, Human
gcagagccucacugcaaggg

SEQ ID NO: 145198 - RNA, 22 nt, Human
ucauuauuuuggacuggagugu

SEQ ID NO: 145199 - RNA, 22 nt, Human
acagcagcaauagcagugacau

SEQ ID NO: 145200 - RNA, 22 nt, Human
uugcaccaaaugaguuaaaauu

SEQ ID NO: 145201 - RNA, 22 nt, Human
gagcucccuggagguucagaua

SEQ ID NO: 145202 - RNA, 19 nt, Human
uguagcaguuuaaaacaac

SEQ ID NO: 145203 - RNA, 22 nt, Human
ucuggcuccacaccucacugca

SEQ ID NO: 145204 - RNA, 22 nt, Human
uuuucuauucauugucuauggu

SEQ ID NO: 145205 - RNA, 19 nt, Human
aacuagaaagguuuugaga

SEQ ID NO: 145206 - RNA, 22 nt, Human
uuccuuccgggcaccaggcacu

SEQ ID NO: 145207 - RNA, 22 nt, Human
cucaggaugucggugacuauug

SEQ ID NO: 145208 - RNA, 22 nt, Human
uacaguaggauuuucagggucu

SEQ ID NO: 145209 - RNA, 22 nt, Human
ggcugcuucucacucauuugca

SEQ ID NO: 145210 - RNA, 22 nt, Human
gaggccuggaccagccacagag

SEQ ID NO: 145211 - RNA, 22 nt, Human
gcagggacgccagggacagcaa

SEQ ID NO: 145212 - RNA, 22 nt, Human
auggacagugugaagcagauag

SEQ ID NO: 145213 - RNA, 22 nt, Human
gggccugggaacuugcauuuag

SEQ ID NO: 145214 - RNA, 22 nt, Human
gagcagugacuggagcaugaga

SEQ ID NO: 145215 - RNA, 22 nt, Human
uuugcuauaaaagggucacacg

SEQ ID NO: 145216 - RNA, 22 nt, Human
uucucucuguggucccauuuug

SEQ ID NO: 145217 - RNA, 22 nt, Human
ucucagggcgcagugaggcagu

SEQ ID NO: 145218 - RNA, 22 nt, Human
ggcagagaugugggucagaauc

SEQ ID NO: 145219 - RNA, 22 nt, Human
ucucacuggguauaaaugagua

SEQ ID NO: 145220 - RNA, 22 nt, Human
gccagcucagugccaggccccu

SEQ ID NO: 145221 - RNA, 22 nt, Human
gcagaggcuccauuuuacagau

SEQ ID NO: 145222 - RNA, 19 nt, Human
aauguaguguuaugucaac

SEQ ID NO: 145223 - RNA, 22 nt, Human
acugcagccuuugggcucauaa

SEQ ID NO: 145224 - RNA, 22 nt, Human
cucugcugcccaggccugcuag

SEQ ID NO: 145225 - RNA, 22 nt, Human
ugcuucaggaagaaacgccagg

SEQ ID NO: 145226 - RNA, 22 nt, Human
cuggggcugcgguggaggagcc

SEQ ID NO: 145227 - RNA, 22 nt, Human
ugcugccuuagcagccaggcaa

SEQ ID NO: 145228 - RNA, 22 nt, Human
ccaagggcugcugaggugucca

SEQ ID NO: 145229 - RNA, 22 nt, Human
guggcuugaccaucccugcuac

SEQ ID NO: 145230 - RNA, 22 nt, Human
aaucauucuuauuucacagcaa

SEQ ID NO: 145231 - RNA, 22 nt, Human
cuggcugugugcccccggcacc

SEQ ID NO: 145232 - RNA, 22 nt, Human
ccugccaggccagugagcuucc

SEQ ID NO: 145233 - RNA, 22 nt, Human
uagagcuauuuagagcauuuua

SEQ ID NO: 145234 - RNA, 22 nt, Human
uggcucucagcucccagcagcc

SEQ ID NO: 145235 - RNA, 22 nt, Human
uucuaacuccacuucccacucc

SEQ ID NO: 145236 - RNA, 22 nt, Human
uagugaaauuuaugcacagcua

SEQ ID NO: 145237 - RNA, 22 nt, Human
uccugccucuugccuucuucac

SEQ ID NO: 145238 - RNA, 22 nt, Human
ggaggccaaggagggcggauca

SEQ ID NO: 145239 - RNA, 19 nt, Human
uauauauuuugggguugug

SEQ ID NO: 145240 - RNA, 22 nt, Human
uucuucaaccaucuacauaaac

SEQ ID NO: 145241 - RNA, 22 nt, Human
cugcugucuuuauuucacugcu

SEQ ID NO: 145242 - RNA, 22 nt, Human
ggcuucuccccuuugagucuuc

SEQ ID NO: 145243 - RNA, 22 nt, Human
aacagacagaaaaaugugaucu

SEQ ID NO: 145244 - RNA, 22 nt, Human
ucagugugaguaccaugcucag

SEQ ID NO: 145245 - RNA, 20 nt, Human
aggaacuggaagggaggaaa

SEQ ID NO: 145246 - RNA, 22 nt, Human
ugugguggcuauucuggucuca

SEQ ID NO: 145247 - RNA, 20 nt, Human
caccacagaauuggggacag

SEQ ID NO: 145248 - RNA, 22 nt, Human
gcugucucauacaaggcccugc

SEQ ID NO: 145249 - RNA, 20 nt, Human
uccaugaguuagagacuaua

SEQ ID NO: 145250 - RNA, 22 nt, Human
uaguggcugcagggcuguuuga

SEQ ID NO: 145251 - RNA, 21 nt, Human
uccauaagagaccaucuccua

SEQ ID NO: 145252 - RNA, 22 nt, Human
ugaaggccucugguacaugcca

SEQ ID NO: 145253 - RNA, 23 nt, Human
ccuucagaagaaguaacaggggc

SEQ ID NO: 145254 - RNA, 22 nt, Human
cuggcuggccggaggcaucccu

SEQ ID NO: 145255 - RNA, 22 nt, Human
cugggccagauccagccucaca

SEQ ID NO: 145256 - RNA, 22 nt, Human
ugcugccuucuaggcgugcccu

SEQ ID NO: 145257 - RNA, 22 nt, Human
uucuuaacuggaaaaugucaga

SEQ ID NO: 145258 - RNA, 22 nt, Human
ugggccagcaauugcugcucag

SEQ ID NO: 145259 - RNA, 22 nt, Human
uacacuaugggcuuuguguaau

SEQ ID NO: 145260 - RNA, 22 nt, Human
ucacaugcuugaggaaagaaaa

SEQ ID NO: 145261 - RNA, 22 nt, Human
auuuacagaagcauguaauagc

SEQ ID NO: 145262 - RNA, 22 nt, Human
caggcugucugaauggaggccc

SEQ ID NO: 145263 - RNA, 22 nt, Human
aaaugcuguguuuuaacauaga

SEQ ID NO: 145264 - RNA, 22 nt, Human
cuggccuggggccucagcugcu

SEQ ID NO: 145265 - RNA, 22 nt, Human
aauggcugggaguguauuuugg

SEQ ID NO: 145266 - RNA, 22 nt, Human
gugcauuugacgaauacucacu

SEQ ID NO: 145267 - RNA, 22 nt, Human
uuauuacacugaaagaauugcg

SEQ ID NO: 145268 - RNA, 22 nt, Human
agucccagcuucccccaugcag

SEQ ID NO: 145269 - RNA, 22 nt, Human
gaccauuucuaggaaucagacu

SEQ ID NO: 145270 - RNA, 20 nt, Human
cagccuccacucacucagcu

SEQ ID NO: 145271 - RNA, 22 nt, Human
agagccaggcaggcaauguuga

SEQ ID NO: 145272 - RNA, 22 nt, Human
ugaggccaaugacccugggcag

SEQ ID NO: 145273 - RNA, 22 nt, Human
cgggcuggcugcagcugcugga

SEQ ID NO: 145274 - RNA, 22 nt, Human
agauacauuguucuaagcauug

SEQ ID NO: 145275 - RNA, 21 nt, Human
gcacagugccaggcacacagu

SEQ ID NO: 145276 - RNA, 22 nt, Human
uuaacagacauauauauuugua

SEQ ID NO: 145277 - RNA, 22 nt, Human
uuugaaugcaggacauacagaa

SEQ ID NO: 145278 - RNA, 22 nt, Human
cugagcugcucccgcugcagcg

SEQ ID NO: 145279 - RNA, 22 nt, Human
gagagcuggccagcuucaguau

SEQ ID NO: 145280 - RNA, 22 nt, Human
cucucuuucugaaugaggacua

SEQ ID NO: 145281 - RNA, 22 nt, Human
caggugaccuuuguccuaaguu

SEQ ID NO: 145282 - RNA, 22 nt, Human
gggcuggcucccagguguugaa

SEQ ID NO: 145283 - RNA, 22 nt, Human
uuuaaauuuguguuuagagggu

SEQ ID NO: 145284 - RNA, 22 nt, Human
ugggggugaaagucuggacagu

SEQ ID NO: 145285 - RNA, 22 nt, Human
ugacagaaugugacucucagau

SEQ ID NO: 145286 - RNA, 22 nt, Human
cuggagccccaggcugugcaga

SEQ ID NO: 145287 - RNA, 22 nt, Human
uccagggagauggcagaggcug

SEQ ID NO: 145288 - RNA, 22 nt, Human
ggcugccuugacccuggcuccg

SEQ ID NO: 145289 - RNA, 22 nt, Human
cagccugcauuuguaucuguau

SEQ ID NO: 145290 - RNA, 22 nt, Human
cccuggaguccggagcucaccu

SEQ ID NO: 145291 - RNA, 20 nt, Human
ggaagcagagaacuguuuuc

SEQ ID NO: 145292 - RNA, 22 nt, Human
agaacagcaguuaugguucauu

SEQ ID NO: 145293 - RNA, 22 nt, Human
agggcugggcugcuuguuguca

SEQ ID NO: 145294 - RNA, 22 nt, Human
cagucacauugcccugcauuua

SEQ ID NO: 145295 - RNA, 22 nt, Human
agcagagccagaauuggaccag

SEQ ID NO: 145296 - RNA, 22 nt, Human
agcucccugagaugccacagca

SEQ ID NO: 145297 - RNA, 22 nt, Human
cgcuggggcuuuuugcuugaga

SEQ ID NO: 145298 - RNA, 22 nt, Human
aaggccugggaggccucucuuc

SEQ ID NO: 145299 - RNA, 22 nt, Human
ccugccugggcucacuugccag

SEQ ID NO: 145300 - RNA, 22 nt, Human
aagugacaccucuucccuuucc

SEQ ID NO: 145301 - RNA, 22 nt, Human
caaugauggcuaggcagcugcu

SEQ ID NO: 145302 - RNA, 22 nt, Human
uaacuuugaagggaauuuuacu

SEQ ID NO: 145303 - RNA, 22 nt, Human
gggccucugugcagaggggccu

SEQ ID NO: 145304 - RNA, 18 nt, Human
aucucccauuggccaagg

SEQ ID NO: 145305 - RNA, 22 nt, Human
ccauuguaaagaguauacuuug

SEQ ID NO: 145306 - RNA, 19 nt, Human
ucaaagucugagucacuuu

SEQ ID NO: 145307 - RNA, 22 nt, Human
gaagcagccacggggagacaga

SEQ ID NO: 145308 - RNA, 18 nt, Human
gaagggagcuggaaugca

SEQ ID NO: 145309 - RNA, 22 nt, Human
ugugauauuugaguauugucaa

SEQ ID NO: 145310 - RNA, 20 nt, Human
uguguguguacuucuaaaua

SEQ ID NO: 145311 - RNA, 22 nt, Human
gaguaagagcuggcuuuggugu

SEQ ID NO: 145312 - RNA, 22 nt, Human
ucauuuaauagcuuuugucuuu

SEQ ID NO: 145313 - RNA, 22 nt, Human
gguggccucucaugcaagguag

SEQ ID NO: 145314 - RNA, 17 nt, Human
uuugaaaggaugucagu

SEQ ID NO: 145315 - RNA, 22 nt, Human
acaaagucacaauaauuaaccu

SEQ ID NO: 145316 - RNA, 22 nt, Human
uggucuguucaagguggcugau

SEQ ID NO: 145317 - RNA, 22 nt, Human
cacaguauuuguuuuucugagu

SEQ ID NO: 145318 - RNA, 22 nt, Human
uaacagaaaggcucaggugcuc

SEQ ID NO: 145319 - RNA, 22 nt, Human
uaaggccaccguuauagaacca

SEQ ID NO: 145320 - RNA, 18 nt, Human
agcagcugugccacacug

SEQ ID NO: 145321 - RNA, 22 nt, Human
cauugcacaucugagaagagau

SEQ ID NO: 145322 - RNA, 22 nt, Human
gucuggagccacccuaagcauu

SEQ ID NO: 145323 - RNA, 19 nt, Human
acauuuagaauguacuugc

SEQ ID NO: 145324 - RNA, 23 nt, Human
caacuuuuggcuacaugcuuagc

SEQ ID NO: 145325 - RNA, 22 nt, Human
aaacuuuuauaaagcugcagau

SEQ ID NO: 145326 - RNA, 22 nt, Human
gugcuuccugccuggugccuuu

SEQ ID NO: 145327 - RNA, 22 nt, Human
uuauuuugguaaauguuugccu

SEQ ID NO: 145328 - RNA, 22 nt, Human
uuagaaaggagcuuauuucuuu

SEQ ID NO: 145329 - RNA, 22 nt, Human
aagauuuccuggauguaauucc

SEQ ID NO: 145330 - RNA, 20 nt, Human
aagggcagagggaacagacu

SEQ ID NO: 145331 - RNA, 22 nt, Human
auguggcucagcaggcucccgu

SEQ ID NO: 145332 - RNA, 22 nt, Human
ccugucaguugcugucagggau

SEQ ID NO: 145333 - RNA, 22 nt, Human
ccuggcaguuuugcccaggauu

SEQ ID NO: 145334 - RNA, 22 nt, Human
agccucugucaagcuuuucaaa

SEQ ID NO: 145335 - RNA, 22 nt, Human
cagguggagcugacugagggca

SEQ ID NO: 145336 - RNA, 22 nt, Human
gcgaaaaauguguaaauauguu

SEQ ID NO: 145337 - RNA, 22 nt, Human
uuucacauuagauaugucauuu

SEQ ID NO: 145338 - RNA, 22 nt, Human
caguuaaaggcccaauaucugg

SEQ ID NO: 145339 - RNA, 22 nt, Human
uuguaaaugaccuuuucuaauu

SEQ ID NO: 145340 - RNA, 22 nt, Human
uuucucuccccaaguggaauug

SEQ ID NO: 145341 - RNA, 22 nt, Human
gcucuggacuggggccugagaa

SEQ ID NO: 145342 - RNA, 22 nt, Human
uuugcauuacuugacuuuaguu

SEQ ID NO: 145343 - RNA, 22 nt, Human
cagcuggaucccugcagaacuu

SEQ ID NO: 145344 - RNA, 22 nt, Human
agcuucuugaccaagccuguaa

SEQ ID NO: 145345 - RNA, 22 nt, Human
auuauauaggacuugcccuucc

SEQ ID NO: 145346 - RNA, 22 nt, Human
cuguacaggagacgucugugca

SEQ ID NO: 145347 - RNA, 22 nt, Human
gccucugcccuccugggacugc

SEQ ID NO: 145348 - RNA, 22 nt, Human
cagggcaggaauuugacauugc

SEQ ID NO: 145349 - RNA, 22 nt, Human
guggcucucgccagccugcggg

SEQ ID NO: 145350 - RNA, 22 nt, Human
cccacucccugcacgccugccg

SEQ ID NO: 145351 - RNA, 22 nt, Human
agugugugccuuuggauaccug

SEQ ID NO: 145352 - RNA, 22 nt, Human
gcugcuccgucugagcucuggu

SEQ ID NO: 145353 - RNA, 22 nt, Human
ucugcgugaauuugcauugugg

SEQ ID NO: 145354 - RNA, 22 nt, Human
agcucccagaagccagagucgg

SEQ ID NO: 145355 - RNA, 22 nt, Human
gcuuagucaauuauaaauaggc

SEQ ID NO: 145356 - RNA, 19 nt, Human
ucauuuacgguuuugauga

SEQ ID NO: 145357 - RNA, 22 nt, Human
aacuuuuacaaauugucaucau

SEQ ID NO: 145358 - RNA, 22 nt, Human
uuuuugcaccaaccuaauagaa

SEQ ID NO: 145359 - RNA, 22 nt, Human
ucaggagaaucagggcuguccu

SEQ ID NO: 145360 - RNA, 22 nt, Human
agccuucaaccuagcuagagca

SEQ ID NO: 145361 - RNA, 21 nt, Human
ugccagcauguaggcuaguug

SEQ ID NO: 145362 - RNA, 22 nt, Human
cugcuuccaugcaauggcaguc

SEQ ID NO: 145363 - RNA, 22 nt, Human
gccacguugccacccgggugac

SEQ ID NO: 145364 - RNA, 22 nt, Human
gucaccagucccagcuccugaa

SEQ ID NO: 145365 - RNA, 22 nt, Human
ugcugggggcuuucuggauacc

SEQ ID NO: 145366 - RNA, 21 nt, Human
agaagccuggguggagguggg

SEQ ID NO: 145367 - RNA, 22 nt, Human
gugcuguaucagaaucugcucu

SEQ ID NO: 145368 - RNA, 22 nt, Human
ugugugacacauugauaugugc

SEQ ID NO: 145369 - RNA, 22 nt, Human
ucacauuuuccuugguaucugu

SEQ ID NO: 145370 - RNA, 22 nt, Human
ccacagggcacagacaggaagc

SEQ ID NO: 145371 - RNA, 22 nt, Human
uuacaguuagguguguaguggu

SEQ ID NO: 145372 - RNA, 22 nt, Human
agggccuggugaccuggguccu

SEQ ID NO: 145373 - RNA, 22 nt, Human
gcucugggauuaccagccuuag

SEQ ID NO: 145374 - RNA, 22 nt, Human
ugcccagcacugugccagucac

SEQ ID NO: 145375 - RNA, 22 nt, Human
gcugccaauccagcugugggag

SEQ ID NO: 145376 - RNA, 22 nt, Human
uggcagcuccggguaggggcug

SEQ ID NO: 145377 - RNA, 22 nt, Human
ugggcucugcugcguaccaguu

SEQ ID NO: 145378 - RNA, 22 nt, Human
ugggcugcccaagguggccaug

SEQ ID NO: 145379 - RNA, 22 nt, Human
cugagaggugacagcgugcugg

SEQ ID NO: 145380 - RNA, 22 nt, Human
ccuggcagcgugccgagcugcg

SEQ ID NO: 145381 - RNA, 20 nt, Human
cucucucuccauucccaggg

SEQ ID NO: 145382 - RNA, 22 nt, Human
gaaaugcaaauucucucucgcu

SEQ ID NO: 145383 - RNA, 22 nt, Human
ugauuucaaguagugacaugcu

SEQ ID NO: 145384 - RNA, 19 nt, Human
ugcagaagacacaguggug

SEQ ID NO: 145385 - RNA, 22 nt, Human
uccagggccaagucauggaacc

SEQ ID NO: 145386 - RNA, 22 nt, Human
cuguagccaguuuggccucacc

SEQ ID NO: 145387 - RNA, 22 nt, Human
uuucacaaguaaaguccuaagu

SEQ ID NO: 145388 - RNA, 21 nt, Human
uauuugcugccaucuuugagg

SEQ ID NO: 145389 - RNA, 22 nt, Human
aguuuauagcccagauucaugg

SEQ ID NO: 145390 - RNA, 22 nt, Human
uggcagggugggcuucagcccc

SEQ ID NO: 145391 - RNA, 22 nt, Human
uuuuuccuuggaugugucucuc

SEQ ID NO: 145392 - RNA, 22 nt, Human
aguagaaagaaggcacugggcc

SEQ ID NO: 145393 - RNA, 22 nt, Human
ggaaaaggccacagggacacau

SEQ ID NO: 145394 - RNA, 22 nt, Human
uuucucuguucucuaacuguaa

SEQ ID NO: 145395 - RNA, 22 nt, Human
ucaaaccaccuuguuacugggg

SEQ ID NO: 145396 - RNA, 22 nt, Human
gccuucaguagugucagcugua

SEQ ID NO: 145397 - RNA, 22 nt, Human
auugaaagaguuuucugcugca

SEQ ID NO: 145398 - RNA, 22 nt, Human
ucuuggagaauggcagagaagc

SEQ ID NO: 145399 - RNA, 22 nt, Human
uagauuuuacuucugucauuac

SEQ ID NO: 145400 - RNA, 22 nt, Human
ccucccaccauuuagagagagc

SEQ ID NO: 145401 - RNA, 22 nt, Human
cagagcugcaaaugccccuccg

SEQ ID NO: 145402 - RNA, 22 nt, Human
cccugagcccauaguugacauu

SEQ ID NO: 145403 - RNA, 21 nt, Human
aggauauuaggugauuugggu

SEQ ID NO: 145404 - RNA, 22 nt, Human
ugcugccauggucgcugguguc

SEQ ID NO: 145405 - RNA, 22 nt, Human
uugaaagacuucuccugugaaa

SEQ ID NO: 145406 - RNA, 22 nt, Human
aagagcuggucacagguccauu

SEQ ID NO: 145407 - RNA, 22 nt, Human
aaauuauaggugccaccuugga

SEQ ID NO: 145408 - RNA, 22 nt, Human
ucauauuuggggguguguguuu

SEQ ID NO: 145409 - RNA, 22 nt, Human
uaauacuuaccuugcagagucu

SEQ ID NO: 145410 - RNA, 22 nt, Human
ugcugccacaaauucagcugcc

SEQ ID NO: 145411 - RNA, 22 nt, Human
caggccagguggcaggcaaaac

SEQ ID NO: 145412 - RNA, 19 nt, Human
caguuuaugcuuuggggac

SEQ ID NO: 145413 - RNA, 22 nt, Human
gagcagugguugaacagaggca

SEQ ID NO: 145414 - RNA, 22 nt, Human
uggggacaggagacuuacagcu

SEQ ID NO: 145415 - RNA, 22 nt, Human
guuucucugucuguuacauugg

SEQ ID NO: 145416 - RNA, 22 nt, Human
guaaaguucuacuagaaucaac

SEQ ID NO: 145417 - RNA, 22 nt, Human
uauuucagucacuucuucucug

SEQ ID NO: 145418 - RNA, 22 nt, Human
aaacuuuaagacaguccucaag

SEQ ID NO: 145419 - RNA, 22 nt, Human
ggccucuguuuggagccaggau

SEQ ID NO: 145420 - RNA, 22 nt, Human
ccuccugggacaggcuggcaca

SEQ ID NO: 145421 - RNA, 22 nt, Human
gaggggcugggcagucccugga

SEQ ID NO: 145422 - RNA, 22 nt, Human
ugccagccagguucugaggcua

SEQ ID NO: 145423 - RNA, 22 nt, Human
uggcucuggugcgggcuccugc

SEQ ID NO: 145424 - RNA, 22 nt, Human
uccacuuuagcaaugauugaau

SEQ ID NO: 145425 - RNA, 20 nt, Human
uauuuugcaauuaugguuca

SEQ ID NO: 145426 - RNA, 22 nt, Human
cuguggcuaauaauuaguauuu

SEQ ID NO: 145427 - RNA, 22 nt, Human
auguaucaacaaauuguacagu

SEQ ID NO: 145428 - RNA, 22 nt, Human
ugcucuggggagcuccucugcg

SEQ ID NO: 145429 - RNA, 22 nt, Human
aggcacugacagauucuguguc

SEQ ID NO: 145430 - RNA, 17 nt, Human
uucaagauauugaaaug

SEQ ID NO: 145431 - RNA, 22 nt, Human
cuggcuguggucacagguaacu

SEQ ID NO: 145432 - RNA, 22 nt, Human
ucugucaccgagggcauccaaa

SEQ ID NO: 145433 - RNA, 22 nt, Human
accagagaaaacacagcaggcu

SEQ ID NO: 145434 - RNA, 22 nt, Human
acagccuguguaccagcuggga

SEQ ID NO: 145435 - RNA, 22 nt, Human
cagccagggagcaaagaguuga

SEQ ID NO: 145436 - RNA, 22 nt, Human
uccugccugcaaucccagcacu

SEQ ID NO: 145437 - RNA, 22 nt, Human
gagugucugaauuagagcacaa

SEQ ID NO: 145438 - RNA, 22 nt, Human
cccagagcugagucugauauau

SEQ ID NO: 145439 - RNA, 17 nt, Human
gcagugaaaagagauca

SEQ ID NO: 145440 - RNA, 20 nt, Human
cagcucugggaaagaggcca

SEQ ID NO: 145441 - RNA, 22 nt, Human
aaauguuuugcucccauguggu

SEQ ID NO: 145442 - RNA, 22 nt, Human
caggagcccguugcuccggcgg

SEQ ID NO: 145443 - RNA, 20 nt, Human
ugcccagcaagagugcaguu

SEQ ID NO: 145444 - RNA, 22 nt, Human
ccacagaguuacaaaacaguca

SEQ ID NO: 145445 - RNA, 22 nt, Human
cuauuuuccgcagcaggaagua

SEQ ID NO: 145446 - RNA, 22 nt, Human
cuaauacacccuauugcuuguu

SEQ ID NO: 145447 - RNA, 22 nt, Human
agucagugaaggcauugcucaa

SEQ ID NO: 145448 - RNA, 22 nt, Human
cuggcagcuuagcacucugguu

SEQ ID NO: 145449 - RNA, 22 nt, Human
uucauuacugcgguagucacac

SEQ ID NO: 145450 - RNA, 22 nt, Human
acaugcauucucuaaaagcaaa

SEQ ID NO: 145451 - RNA, 22 nt, Human
guacauuuugagguuaaaacaa

SEQ ID NO: 145452 - RNA, 22 nt, Human
auuuuuucccaguuagccagga

SEQ ID NO: 145453 - RNA, 22 nt, Human
acaggcuuacaggcugcaagua

SEQ ID NO: 145454 - RNA, 22 nt, Human
ugaagcagagaauuugacaguc

SEQ ID NO: 145455 - RNA, 22 nt, Human
ucagcaauccucccacaggugg

SEQ ID NO: 145456 - RNA, 22 nt, Human
aucagcaaggcaaucacugcag

SEQ ID NO: 145457 - RNA, 22 nt, Human
agaugcugugucuguucccuug

SEQ ID NO: 145458 - RNA, 21 nt, Human
agagaagggacucuuccaguc

SEQ ID NO: 145459 - RNA, 22 nt, Human
aaaucaguuggaacacaagcag

SEQ ID NO: 145460 - RNA, 22 nt, Human
uuuuaucaaucauuaagacauu

SEQ ID NO: 145461 - RNA, 22 nt, Human
aguuuuucuccccuggcuucau

SEQ ID NO: 145462 - RNA, 22 nt, Human
ucugcagauuuaucagcagcug

SEQ ID NO: 145463 - RNA, 22 nt, Human
ugggcagaggacagggaagauc

SEQ ID NO: 145464 - RNA, 20 nt, Human
agugucugggccucaggccc

SEQ ID NO: 145465 - RNA, 22 nt, Human
guacaaaguggaccugauagua

SEQ ID NO: 145466 - RNA, 22 nt, Human
uaugcacauuaucuaauccauu

SEQ ID NO: 145467 - RNA, 22 nt, Human
auuugucuuugagugcccugcu

SEQ ID NO: 145468 - RNA, 22 nt, Human
ucccccacucuaaaggagccuu

SEQ ID NO: 145469 - RNA, 22 nt, Human
uuucucugccaguuauuuuccu

SEQ ID NO: 145470 - RNA, 22 nt, Human
cucagagcccaggguacacccg

SEQ ID NO: 145471 - RNA, 22 nt, Human
ccagcagcuguggcuuugccuc

SEQ ID NO: 145472 - RNA, 22 nt, Human
cagggcugugcccaucuucccc

SEQ ID NO: 145473 - RNA, 22 nt, Human
ucagggcaagauugguuaauaa

SEQ ID NO: 145474 - RNA, 19 nt, Human
gcagccaggugcucuaccu

SEQ ID NO: 145475 - RNA, 22 nt, Human
gagguggccucaagcagucuuc

SEQ ID NO: 145476 - RNA, 21 nt, Human
ucucuggaguuagcagagaga

SEQ ID NO: 145477 - RNA, 22 nt, Human
cccuggaguccuggcaguugau

SEQ ID NO: 145478 - RNA, 22 nt, Human
ucgagucauguucucccauuaa

SEQ ID NO: 145479 - RNA, 22 nt, Human
ucagggcacaggccuguggguu

SEQ ID NO: 145480 - RNA, 22 nt, Human
ucugagccaauuucugugucca

SEQ ID NO: 145481 - RNA, 22 nt, Human
gccugcagaggugcugcuagcu

SEQ ID NO: 145482 - RNA, 22 nt, Human
aaaguuacuaucacaaugaaau

SEQ ID NO: 145483 - RNA, 21 nt, Human
ucugggugcuaguguuugcuu

SEQ ID NO: 145484 - RNA, 22 nt, Human
caugggcuacagaagcaugcug

SEQ ID NO: 145485 - RNA, 22 nt, Human
cugcccugccuggccagugugg

SEQ ID NO: 145486 - RNA, 22 nt, Human
cuacauuaaauuggcuuacuua

SEQ ID NO: 145487 - RNA, 22 nt, Human
ccagcucccugaagccuggucu

SEQ ID NO: 145488 - RNA, 22 nt, Human
uagacagauuuaaaggaaugga

SEQ ID NO: 145489 - RNA, 22 nt, Human
uuuccuaggagauugaucacau

SEQ ID NO: 145490 - RNA, 22 nt, Human
ucugagaguagagcugccucuu

SEQ ID NO: 145491 - RNA, 22 nt, Human
cgucuuccucuuacgaugcgcu

SEQ ID NO: 145492 - RNA, 22 nt, Human
aggagcugucagagugccagag

SEQ ID NO: 145493 - RNA, 22 nt, Human
aaugauggauuuagacaagcug

SEQ ID NO: 145494 - RNA, 22 nt, Human
agcugccaaguuggaguagcaa

SEQ ID NO: 145495 - RNA, 22 nt, Human
uggcucaguaaucgagucuccu

SEQ ID NO: 145496 - RNA, 22 nt, Human
uguuaacuuccuccuccucugc

SEQ ID NO: 145497 - RNA, 20 nt, Human
aucuggcucagauccugcag

SEQ ID NO: 145498 - RNA, 22 nt, Human
aaaggccaccaacaugaagcau

SEQ ID NO: 145499 - RNA, 22 nt, Human
ucuuucagaaacuuugucugcg

SEQ ID NO: 145500 - RNA, 22 nt, Human
cccagccugugacagccguccu

SEQ ID NO: 145501 - RNA, 22 nt, Human
uggaggcaccacuggcugcccg

SEQ ID NO: 145502 - RNA, 22 nt, Human
aagucacacuagacaacugagg

SEQ ID NO: 145503 - RNA, 22 nt, Human
acuguauaguauuuauucuuag

SEQ ID NO: 145504 - RNA, 22 nt, Human
ugcaauaaguuguguuaucacu

SEQ ID NO: 145505 - RNA, 22 nt, Human
gugcuuucugcaugguuccuac

SEQ ID NO: 145506 - RNA, 22 nt, Human
uccugccuuagagcaaggaaaa

SEQ ID NO: 145507 - RNA, 22 nt, Human
caggaaaaaugccaggagucag

SEQ ID NO: 145508 - RNA, 22 nt, Human
uuagccauuuuauacaagugua

SEQ ID NO: 145509 - RNA, 22 nt, Human
ggugggcaggucacucugccuc

SEQ ID NO: 145510 - RNA, 22 nt, Human
gaaugugucacccugucccaug

SEQ ID NO: 145511 - RNA, 17 nt, Human
ugcauguccuuuguucc

SEQ ID NO: 145512 - RNA, 22 nt, Human
gcugagcuagcuaucucagucu

SEQ ID NO: 145513 - RNA, 22 nt, Human
gcagauggcucagacacugggg

SEQ ID NO: 145514 - RNA, 22 nt, Human
aguguuucucagaagggccuau

SEQ ID NO: 145515 - RNA, 22 nt, Human
acuuguuugccuaaaauuuuga

SEQ ID NO: 145516 - RNA, 22 nt, Human
cuuauguaaaacggaaagggaa

SEQ ID NO: 145517 - RNA, 22 nt, Human
acauuucucuugaugucucuau

SEQ ID NO: 145518 - RNA, 22 nt, Human
ggcucugcaugugagugggugg

SEQ ID NO: 145519 - RNA, 22 nt, Human
aggccagcucacccuggcuccu

SEQ ID NO: 145520 - RNA, 22 nt, Human
uggcagggccugcucaucaucc

SEQ ID NO: 145521 - RNA, 22 nt, Human
agauuucaaugugagcauuagu

SEQ ID NO: 145522 - RNA, 22 nt, Human
auuuucuucucucccuggcugc

SEQ ID NO: 145523 - RNA, 22 nt, Human
ccugauggagcccugcugcaug

SEQ ID NO: 145524 - RNA, 22 nt, Human
ugugaaagauacuaggcagagg

SEQ ID NO: 145525 - RNA, 22 nt, Human
uuacagcuagccaauuauuuag

SEQ ID NO: 145526 - RNA, 22 nt, Human
uuugaaagggaaauaaacuccu

SEQ ID NO: 145527 - RNA, 22 nt, Human
uagaaauguuagauguauugag

SEQ ID NO: 145528 - RNA, 22 nt, Human
guguguauuuaaaggauaguug

SEQ ID NO: 145529 - RNA, 22 nt, Human
aggagucagauaugggaaaguu

SEQ ID NO: 145530 - RNA, 22 nt, Human
cagugcauagauccugaggccu

SEQ ID NO: 145531 - RNA, 22 nt, Human
uaaggcaccauaauauauuuaa

SEQ ID NO: 145532 - RNA, 20 nt, Human
ugaaggccagcagcauaggg

SEQ ID NO: 145533 - RNA, 22 nt, Human
uucaggaugaaagugugcaaca

SEQ ID NO: 145534 - RNA, 22 nt, Human
uucuuaacucaaauauauaucc

SEQ ID NO: 145535 - RNA, 22 nt, Human
ccugccugcguccucugagggc

SEQ ID NO: 145536 - RNA, 22 nt, Human
uugaacagcuguuacauuguua

SEQ ID NO: 145537 - RNA, 22 nt, Human
ugucacauugaauaugauuuau

SEQ ID NO: 145538 - RNA, 22 nt, Human
ugacaauacagagagagcaaaa

SEQ ID NO: 145539 - RNA, 22 nt, Human
auguguguguuuaauccucaaa

SEQ ID NO: 145540 - RNA, 22 nt, Human
cugccuggcuaaacucaagucg

SEQ ID NO: 145541 - RNA, 22 nt, Human
auacaaagacaaaucucaaucu

SEQ ID NO: 145542 - RNA, 22 nt, Human
uuugaaagcuacuuucggguca

SEQ ID NO: 145543 - RNA, 22 nt, Human
uacaaagcuguauagccugguc

SEQ ID NO: 145544 - RNA, 22 nt, Human
ccagccuggguguuagaagaca

SEQ ID NO: 145545 - RNA, 22 nt, Human
uccuggguccauggcagccgaa

SEQ ID NO: 145546 - RNA, 22 nt, Human
gcucuggcuacuguggcuaccg

SEQ ID NO: 145547 - RNA, 22 nt, Human
cagaagcagugagagaugugca

SEQ ID NO: 145548 - RNA, 22 nt, Human
uagaaaagaauuuuauuugaua

SEQ ID NO: 145549 - RNA, 22 nt, Human
aucuucaaagcacaucguuugu

SEQ ID NO: 145550 - RNA, 22 nt, Human
ucucucauaagaugaguacuua

SEQ ID NO: 145551 - RNA, 22 nt, Human
caaggaaaacagaugaucaaca

SEQ ID NO: 145552 - RNA, 22 nt, Human
uggcucagucauggaugaguaa

SEQ ID NO: 145553 - RNA, 23 nt, Human
uggcuucugccccauucucucca

SEQ ID NO: 145554 - RNA, 22 nt, Human
agcagggcuugccgcuuguccu

SEQ ID NO: 145555 - RNA, 22 nt, Human
agagccaggaugucuucugggg

SEQ ID NO: 145556 - RNA, 22 nt, Human
cagggccugcuuccuucuuguu

SEQ ID NO: 145557 - RNA, 22 nt, Human
ugcugccagagagacagggacu

SEQ ID NO: 145558 - RNA, 22 nt, Human
cucuggaguucuucaagcuacu

SEQ ID NO: 145559 - RNA, 22 nt, Human
ugccaggcccugugcuggaugc

SEQ ID NO: 145560 - RNA, 22 nt, Human
gcaggccuuggcaaugagccug

SEQ ID NO: 145561 - RNA, 22 nt, Human
uucaggauuguguuuuuccuga

SEQ ID NO: 145562 - RNA, 22 nt, Human
uucauucuuauuugugaucugg

SEQ ID NO: 145563 - RNA, 22 nt, Human
uucuuccucagcagggcugccu

SEQ ID NO: 145564 - RNA, 22 nt, Human
aggccugggcaagaaggggcgu

SEQ ID NO: 145565 - RNA, 22 nt, Human
ggcuugcuucuuguccaggaau

SEQ ID NO: 145566 - RNA, 22 nt, Human
agcuggguguguaucagauaaa

SEQ ID NO: 145567 - RNA, 22 nt, Human
gcuuccugauauucauacuguu

SEQ ID NO: 145568 - RNA, 22 nt, Human
agccuauuccaggaugagcuca

SEQ ID NO: 145569 - RNA, 22 nt, Human
gcucugagagugggugauucug

SEQ ID NO: 145570 - RNA, 23 nt, Human
aaguucaagucacagccugucuu

SEQ ID NO: 145571 - RNA, 22 nt, Human
gagaggccaccugacgagcagu

SEQ ID NO: 145572 - RNA, 22 nt, Human
auuucauugaaguuaauucuuc

SEQ ID NO: 145573 - RNA, 22 nt, Human
caaggaaacaugaaaugcauug

SEQ ID NO: 145574 - RNA, 22 nt, Human
cugcagagaauuguggggcuuc

SEQ ID NO: 145575 - RNA, 19 nt, Human
guauauuuauauggcugua

SEQ ID NO: 145576 - RNA, 22 nt, Human
aauguguauacuggcaauuaag

SEQ ID NO: 145577 - RNA, 22 nt, Human
ccucaggggcuuuucguuguug

SEQ ID NO: 145578 - RNA, 22 nt, Human
ugugacaucgcugugucuguuu

SEQ ID NO: 145579 - RNA, 22 nt, Human
uuuuccuacugauaaacaguua

SEQ ID NO: 145580 - RNA, 22 nt, Human
gaugguuuaugauagaugggaa

SEQ ID NO: 145581 - RNA, 22 nt, Human
cccagcugcaccucuauggccu

SEQ ID NO: 145582 - RNA, 19 nt, Human
cucucacucgccacauccu

SEQ ID NO: 145583 - RNA, 22 nt, Human
uuagccauauagaaaaagagcu

SEQ ID NO: 145584 - RNA, 22 nt, Human
gcaguccucucauuggccuccu

SEQ ID NO: 145585 - RNA, 22 nt, Human
ucuggcucauacaagccugcaa

SEQ ID NO: 145586 - RNA, 22 nt, Human
uuacauauugucuauuguucaa

SEQ ID NO: 145587 - RNA, 23 nt, Human
uaauucacauauacauugcuuca

SEQ ID NO: 145588 - RNA, 22 nt, Human
aaggcccuaauagagcacauau

SEQ ID NO: 145589 - RNA, 22 nt, Human
cugugccuaagaugcaugucuc

SEQ ID NO: 145590 - RNA, 22 nt, Human
cccaggaggcagagguugcagu

SEQ ID NO: 145591 - RNA, 22 nt, Human
agcaccuucacaggcucucagg

SEQ ID NO: 145592 - RNA, 22 nt, Human
ccugggcuggaguacagcagug

SEQ ID NO: 145593 - RNA, 22 nt, Human
uuauggcauauuccucauugua

SEQ ID NO: 145594 - RNA, 22 nt, Human
ugauugaagaggugaggaaguu

SEQ ID NO: 145595 - RNA, 22 nt, Human
uuuucuguuacaaaguacagcg

SEQ ID NO: 145596 - RNA, 22 nt, Human
cagcucaaguuucccaggucag

SEQ ID NO: 145597 - RNA, 22 nt, Human
uuuucauuuacauuagggaaga

SEQ ID NO: 145598 - RNA, 22 nt, Human
uggccuggcagagcaaggccug

SEQ ID NO: 145599 - RNA, 22 nt, Human
aaaaguguccagauuaugaaga

SEQ ID NO: 145600 - RNA, 22 nt, Human
ucucagaguaauucuuuaaggu

SEQ ID NO: 145601 - RNA, 21 nt, Human
ucauuuuuauugcuaccuugc

SEQ ID NO: 145602 - RNA, 22 nt, Human
acucuuuuaugcauuccuucag

SEQ ID NO: 145603 - RNA, 22 nt, Human
ggcuguguccuguaugauuauu

SEQ ID NO: 145604 - RNA, 22 nt, Human
uggcagagcaaaaagauagaau

SEQ ID NO: 145605 - RNA, 22 nt, Human
cccugcagaccaaugccauaga

SEQ ID NO: 145606 - RNA, 22 nt, Human
agguggagacccagagaaggcg

SEQ ID NO: 145607 - RNA, 22 nt, Human
ccagggcugagcugugaccaug

SEQ ID NO: 145608 - RNA, 22 nt, Human
ggcagcaguccauggcccaagg

SEQ ID NO: 145609 - RNA, 19 nt, Human
uuuaaagugacugguauuu

SEQ ID NO: 145610 - RNA, 22 nt, Human
guuuacaguacucacuugcauu

SEQ ID NO: 145611 - RNA, 22 nt, Human
agaauuguugggguaauaaaag

SEQ ID NO: 145612 - RNA, 22 nt, Human
ggcaaaaaccauaauuacuuuu

SEQ ID NO: 145613 - RNA, 22 nt, Human
uuuaagaugguauuuuauaaag

SEQ ID NO: 145614 - RNA, 21 nt, Human
ucagcagcuuuugcagucccu

SEQ ID NO: 145615 - RNA, 22 nt, Human
agccucucuuucugguggcuaa

SEQ ID NO: 145616 - RNA, 22 nt, Human
agccugguguggggcugcagag

SEQ ID NO: 145617 - RNA, 22 nt, Human
uugggguguuggauggagcaag

SEQ ID NO: 145618 - RNA, 22 nt, Human
acaggagugaaucuggcacuua

SEQ ID NO: 145619 - RNA, 22 nt, Human
ucucuuucuauaugugagucuu

SEQ ID NO: 145620 - RNA, 22 nt, Human
cuguccuuacugcuucuggcuu

SEQ ID NO: 145621 - RNA, 22 nt, Human
aagggcugcuguagaagcagag

SEQ ID NO: 145622 - RNA, 22 nt, Human
guggcccucugauagggucagg

SEQ ID NO: 145623 - RNA, 22 nt, Human
auuugcuucugugaaaucaagu

SEQ ID NO: 145624 - RNA, 22 nt, Human
gcagggcugggugggagacaga

SEQ ID NO: 145625 - RNA, 22 nt, Human
cuggagccaugucuugacugcu

SEQ ID NO: 145626 - RNA, 22 nt, Human
uuggcugaagguuaagugcugg

SEQ ID NO: 145627 - RNA, 22 nt, Human
ccauaagguuuggggccaugca

SEQ ID NO: 145628 - RNA, 22 nt, Human
auuuagaaauuccaaaaguauu

SEQ ID NO: 145629 - RNA, 22 nt, Human
cuggcugguuacuauuucuggu

SEQ ID NO: 145630 - RNA, 22 nt, Human
gcuguguaccuacuaacugcuu

SEQ ID NO: 145631 - RNA, 22 nt, Human
aaguucaagagugacauauuag

SEQ ID NO: 145632 - RNA, 17 nt, Human
aagacagaagccaugag

SEQ ID NO: 145633 - RNA, 20 nt, Human
agauggugaaggccagggag

SEQ ID NO: 145634 - RNA, 22 nt, Human
aagauaaacucuugauuucuga

SEQ ID NO: 145635 - RNA, 22 nt, Human
auucaaguucuucugucuuugc

SEQ ID NO: 145636 - RNA, 22 nt, Human
caccaucagcagcaggugucaa

SEQ ID NO: 145637 - RNA, 22 nt, Human
auucucuguucaaggaugguga

SEQ ID NO: 145638 - RNA, 22 nt, Human
aacuuuucacaggcuagcucuu

SEQ ID NO: 145639 - RNA, 20 nt, Human
aaagucuuaugguuaauuuu

SEQ ID NO: 145640 - RNA, 22 nt, Human
agcugcugcggaaagaugccac

SEQ ID NO: 145641 - RNA, 22 nt, Human
cuuucacacacauacauuugga

SEQ ID NO: 145642 - RNA, 22 nt, Human
ugggcuggcugaacuucaaccu

SEQ ID NO: 145643 - RNA, 22 nt, Human
agggcugcaccggggcuucgcg

SEQ ID NO: 145644 - RNA, 22 nt, Human
ugcuggggcucugaccacucca

SEQ ID NO: 145645 - RNA, 22 nt, Human
gugggccuugcagggugcaggg

SEQ ID NO: 145646 - RNA, 22 nt, Human
aaacagaaauuuccucaugcuc

SEQ ID NO: 145647 - RNA, 22 nt, Human
auuuuucucuccacuccauuaa

SEQ ID NO: 145648 - RNA, 22 nt, Human
auuuucugguugagguuuaaca

SEQ ID NO: 145649 - RNA, 22 nt, Human
uuaagucauuucugauuauaga

SEQ ID NO: 145650 - RNA, 21 nt, Human
gugucaugguugacuuuggca

SEQ ID NO: 145651 - RNA, 22 nt, Human
aucacugucgucaucugagauu

SEQ ID NO: 145652 - RNA, 22 nt, Human
cagcucugggugacaggagggc

SEQ ID NO: 145653 - RNA, 22 nt, Human
gagccaggcaccuucuguguug

SEQ ID NO: 145654 - RNA, 22 nt, Human
agcagcauuaugauauaucuua

SEQ ID NO: 145655 - RNA, 22 nt, Human
uuuuucucuaugccaggggccu

SEQ ID NO: 145656 - RNA, 22 nt, Human
ccauggcauuuuaugugucuua

SEQ ID NO: 145657 - RNA, 20 nt, Human
uaggcagagcugugcagccu

SEQ ID NO: 145658 - RNA, 22 nt, Human
gucagaggaauggaugagugau

SEQ ID NO: 145659 - RNA, 17 nt, Human
aauagcugcucagagag

SEQ ID NO: 145660 - RNA, 22 nt, Human
cccuggagcugcuugcauguug

SEQ ID NO: 145661 - RNA, 22 nt, Human
uaugugugcuuuuuccaugcau

SEQ ID NO: 145662 - RNA, 22 nt, Human
ucugcagcgugcaggcuggugc

SEQ ID NO: 145663 - RNA, 22 nt, Human
caggacagagcccagacugugu

SEQ ID NO: 145664 - RNA, 22 nt, Human
auugcagcuggucaggguaauu

SEQ ID NO: 145665 - RNA, 22 nt, Human
uugauacagcagccugugaucc

SEQ ID NO: 145666 - RNA, 22 nt, Human
uuuucauuuuuguagaugcaag

SEQ ID NO: 145667 - RNA, 22 nt, Human
gagaggagucccuaucacaguu

SEQ ID NO: 145668 - RNA, 22 nt, Human
guccucugggagccuugagccu

SEQ ID NO: 145669 - RNA, 22 nt, Human
cugggcugucccaaccccaucc

SEQ ID NO: 145670 - RNA, 22 nt, Human
gcuggccauagaagccaaagag

SEQ ID NO: 145671 - RNA, 22 nt, Human
cucuggagugcagccugguggc

SEQ ID NO: 145672 - RNA, 22 nt, Human
uuagaaaauuugcuucuuugga

SEQ ID NO: 145673 - RNA, 20 nt, Human
uuguuucugcuauuuucuaa

SEQ ID NO: 145674 - RNA, 23 nt, Human
uugcuucugugcaauucaguacu

SEQ ID NO: 145675 - RNA, 22 nt, Human
uaaagguaacaugaacugcuuu

SEQ ID NO: 145676 - RNA, 22 nt, Human
uuucuguuaggcaucauuuuaa

SEQ ID NO: 145677 - RNA, 19 nt, Human
aucagcaagguaggaugug

SEQ ID NO: 145678 - RNA, 22 nt, Human
ucuuuauuuuaugcuugugcaa

SEQ ID NO: 145679 - RNA, 22 nt, Human
aaugcacauaaauauggucuua

SEQ ID NO: 145680 - RNA, 22 nt, Human
gauauuuuugcagacaccuggg

SEQ ID NO: 145681 - RNA, 22 nt, Human
uuucaguuacugcuauaucauu

SEQ ID NO: 145682 - RNA, 22 nt, Human
uggaggaaucagggcuuaggcu

SEQ ID NO: 145683 - RNA, 22 nt, Human
uccucuggggcgugguccugga

SEQ ID NO: 145684 - RNA, 20 nt, Human
cuuggccuacuuagcuuugu

SEQ ID NO: 145685 - RNA, 22 nt, Human
cggcagcaaaggaagccagguc

SEQ ID NO: 145686 - RNA, 21 nt, Human
ucucuggaauuagaccauguu

SEQ ID NO: 145687 - RNA, 22 nt, Human
gccugccuguuggcugaggugc

SEQ ID NO: 145688 - RNA, 22 nt, Human
acacaggggcucggcugggugc

SEQ ID NO: 145689 - RNA, 22 nt, Human
aggcuguggugggcuuugagcc

SEQ ID NO: 145690 - RNA, 22 nt, Human
ccagagucuuuauauuccugaa

SEQ ID NO: 145691 - RNA, 22 nt, Human
gcagggucugaggccacagagg

SEQ ID NO: 145692 - RNA, 22 nt, Human
aaggcccuggcaggaagcagga

SEQ ID NO: 145693 - RNA, 22 nt, Human
cagucccagacccagaaggugg

SEQ ID NO: 145694 - RNA, 22 nt, Human
ccuuuuucccuggagggacagc

SEQ ID NO: 145695 - RNA, 22 nt, Human
aauacaguaauuuugaugaguu

SEQ ID NO: 145696 - RNA, 22 nt, Human
uuacaggaggugcuagguguuu

SEQ ID NO: 145697 - RNA, 22 nt, Human
ucuguggcacgauugcacugca

SEQ ID NO: 145698 - RNA, 19 nt, Human
ucugcuggcagaauucccu

SEQ ID NO: 145699 - RNA, 22 nt, Human
caggggcucuaaugcaugauca

SEQ ID NO: 145700 - RNA, 22 nt, Human
uguguguauguuuacuuuuccu

SEQ ID NO: 145701 - RNA, 22 nt, Human
uuacgaguuugcaauuuuaaau

SEQ ID NO: 145702 - RNA, 22 nt, Human
ggcagggcuugucucugugaug

SEQ ID NO: 145703 - RNA, 22 nt, Human
uuuuacaguuccaugcaaagcg

SEQ ID NO: 145704 - RNA, 22 nt, Human
uguggcuggucuccgagcgucg

SEQ ID NO: 145705 - RNA, 17 nt, Human
gucugggcuuuagagac

SEQ ID NO: 145706 - RNA, 19 nt, Human
cccucaggucugagcaguc

SEQ ID NO: 145707 - RNA, 22 nt, Human
uuccuccacgugacaggagcca

SEQ ID NO: 145708 - RNA, 22 nt, Human
ucuccuuuaagauuuccucagg

SEQ ID NO: 145709 - RNA, 22 nt, Human
uaaaguucuggugagagguaag

SEQ ID NO: 145710 - RNA, 22 nt, Human
cugggccuagaggaagcugaca

SEQ ID NO: 145711 - RNA, 22 nt, Human
cuucacagucacccugcugugu

SEQ ID NO: 145712 - RNA, 22 nt, Human
ucuuccaagguugcacacuauc

SEQ ID NO: 145713 - RNA, 23 nt, Human
aagaauaaaugacauuaaaggug

SEQ ID NO: 145714 - RNA, 22 nt, Human
ggcucagaaacuaaaggcgcug

SEQ ID NO: 145715 - RNA, 21 nt, Human
ugcucaugcaaugcaugucca

SEQ ID NO: 145716 - RNA, 22 nt, Human
ucuuagaaaugaaguucuuucu

SEQ ID NO: 145717 - RNA, 19 nt, Human
uguuuacauguuucuucag

SEQ ID NO: 145718 - RNA, 22 nt, Human
gaggaggcuggcgccgccugcc

SEQ ID NO: 145719 - RNA, 22 nt, Human
agggcagcuaaggugcugacug

SEQ ID NO: 145720 - RNA, 22 nt, Human
guauguguugaauucagggguc

SEQ ID NO: 145721 - RNA, 22 nt, Human
cagguggaucucuaaggacuga

SEQ ID NO: 145722 - RNA, 22 nt, Human
ucucaguguguuuucucucaga

SEQ ID NO: 145723 - RNA, 22 nt, Human
gagauuucuuuugaugccuguc

SEQ ID NO: 145724 - RNA, 22 nt, Human
uuaaaguaaucugugugaauuu

SEQ ID NO: 145725 - RNA, 22 nt, Human
uuguccuuggaugaagcuggga

SEQ ID NO: 145726 - RNA, 22 nt, Human
cugccuguuuucugauagauuu

SEQ ID NO: 145727 - RNA, 22 nt, Human
acaaaugugucuaauugugccu

SEQ ID NO: 145728 - RNA, 22 nt, Human
gcauguguggaggagaugugcu

SEQ ID NO: 145729 - RNA, 19 nt, Human
guggccagggcaggggcug

SEQ ID NO: 145730 - RNA, 22 nt, Human
uugcagcugcaguaaauguuca

SEQ ID NO: 145731 - RNA, 19 nt, Human
agcuggagauuggagggca

SEQ ID NO: 145732 - RNA, 22 nt, Human
gcaggcugugaggcucagaugg

SEQ ID NO: 145733 - RNA, 22 nt, Human
gcagcugccuauucagggcuug

SEQ ID NO: 145734 - RNA, 22 nt, Human
gcagccaggaaagcuggacccu

SEQ ID NO: 145735 - RNA, 22 nt, Human
uuggccuuguuaaggaggcccu

SEQ ID NO: 145736 - RNA, 22 nt, Human
ggcugucugugguggagcguug

SEQ ID NO: 145737 - RNA, 22 nt, Human
agccacagagagggagcugcaa

SEQ ID NO: 145738 - RNA, 22 nt, Human
uuugaaagcaggugugggaggg

SEQ ID NO: 145739 - RNA, 22 nt, Human
ucuucacagaugcauauacuuc

SEQ ID NO: 145740 - RNA, 22 nt, Human
cugaaggaagcagaagcgaggu

SEQ ID NO: 145741 - RNA, 22 nt, Human
acagggcagguggcuacugguc

SEQ ID NO: 145742 - RNA, 18 nt, Human
ugacagaaccuggagccu

SEQ ID NO: 145743 - RNA, 22 nt, Human
ucagaguguuuuacuaaacaag

SEQ ID NO: 145744 - RNA, 22 nt, Human
aaaagguuuugaguacaaauau

SEQ ID NO: 145745 - RNA, 22 nt, Human
aaguucaaggaagccuccaguu

SEQ ID NO: 145746 - RNA, 22 nt, Human
cugucuuuuacuaucauuuacu

SEQ ID NO: 145747 - RNA, 22 nt, Human
aagagagaacucccuucgccag

SEQ ID NO: 145748 - RNA, 22 nt, Human
uauuuuguuaauaauccagucc

SEQ ID NO: 145749 - RNA, 22 nt, Human
uugcaccauuucacuuccauua

SEQ ID NO: 145750 - RNA, 22 nt, Human
gucccagggaugcagacaugag

SEQ ID NO: 145751 - RNA, 19 nt, Human
ccuggguccacucagacua

SEQ ID NO: 145752 - RNA, 22 nt, Human
auuuucucuuuguauaugcuag

SEQ ID NO: 145753 - RNA, 22 nt, Human
cuucuugcaauuuucaucuuau

SEQ ID NO: 145754 - RNA, 22 nt, Human
ugaguucucacccauucuucuu

SEQ ID NO: 145755 - RNA, 22 nt, Human
guguacaugagaaaucaacuuu

SEQ ID NO: 145756 - RNA, 23 nt, Human
ucuuuuuaagagaucuagugacg

SEQ ID NO: 145757 - RNA, 22 nt, Human
cuggcugugaaauggcaguguc

SEQ ID NO: 145758 - RNA, 22 nt, Human
guggcuguucuugccccaugcu

SEQ ID NO: 145759 - RNA, 22 nt, Human
agccucuggcccuagacugcuu

SEQ ID NO: 145760 - RNA, 22 nt, Human
ggcaccugcucaucuggacuca

SEQ ID NO: 145761 - RNA, 22 nt, Human
gccugaaguuucaugccucuau

SEQ ID NO: 145762 - RNA, 22 nt, Human
ccugucugcggaggaguggaag

SEQ ID NO: 145763 - RNA, 23 nt, Human
aguuuguaaagaaauauuugcac

SEQ ID NO: 145764 - RNA, 22 nt, Human
ugggcuccucgucacucgcugu

SEQ ID NO: 145765 - RNA, 22 nt, Human
gugcucacugugagacguccug

SEQ ID NO: 145766 - RNA, 22 nt, Human
ugaggaggucagagucuggcug

SEQ ID NO: 145767 - RNA, 22 nt, Human
gcuggccugggcagaggcuaug

SEQ ID NO: 145768 - RNA, 22 nt, Human
gugccuggagcuaauguguaua

SEQ ID NO: 145769 - RNA, 21 nt, Human
aggggacagaguagcuccagg

SEQ ID NO: 145770 - RNA, 19 nt, Human
ccagagcccgccagauggg

SEQ ID NO: 145771 - RNA, 22 nt, Human
ugcaucuuacguuuugaaaggg

SEQ ID NO: 145772 - RNA, 22 nt, Human
agguaaagacugcaaggagaau

SEQ ID NO: 145773 - RNA, 23 nt, Human
uucuuucaagaaguucacagugc

SEQ ID NO: 145774 - RNA, 22 nt, Human
ccagcuugaagaugugcugguu

SEQ ID NO: 145775 - RNA, 22 nt, Human
gagaaagcuucuuucccacagg

SEQ ID NO: 145776 - RNA, 22 nt, Human
ccucagggacuccaugcugcag

SEQ ID NO: 145777 - RNA, 22 nt, Human
acacuuuguuguggcauauacg

SEQ ID NO: 145778 - RNA, 22 nt, Human
gggaagggagggaccucagucu

SEQ ID NO: 145779 - RNA, 22 nt, Human
ugccucugaggaagauuguguu

SEQ ID NO: 145780 - RNA, 22 nt, Human
caaauaucuuuggcaaagagaa

SEQ ID NO: 145781 - RNA, 22 nt, Human
gaggucaggggagaggcugaug

SEQ ID NO: 145782 - RNA, 22 nt, Human
ugaagcagcuucuuucugucaa

SEQ ID NO: 145783 - RNA, 22 nt, Human
ucuggcucuaacuaggcaucag

SEQ ID NO: 145784 - RNA, 22 nt, Human
cagcuuccaucuccacugcccu

SEQ ID NO: 145785 - RNA, 22 nt, Human
ccagguggugaaagugggcccu

SEQ ID NO: 145786 - RNA, 22 nt, Human
uugaauaggacucagcagugau

SEQ ID NO: 145787 - RNA, 22 nt, Human
gaggugggagggcagucccuaa

SEQ ID NO: 145788 - RNA, 19 nt, Human
guggccucggagcgcgcgg

SEQ ID NO: 145789 - RNA, 22 nt, Human
agaaaugggccuugggacacaa

SEQ ID NO: 145790 - RNA, 22 nt, Human
cagggugccaaagaacaaauau

SEQ ID NO: 145791 - RNA, 22 nt, Human
uuugcagugucagcuucugugu

SEQ ID NO: 145792 - RNA, 22 nt, Human
cugcugugugaccauggacagg

SEQ ID NO: 145793 - RNA, 16 nt, Human
agaggccuugaggaag

SEQ ID NO: 145794 - RNA, 22 nt, Human
gcucugcucuaacauuccugac

SEQ ID NO: 145795 - RNA, 22 nt, Human
guaacacagaaaugaaauucca

SEQ ID NO: 145796 - RNA, 22 nt, Human
ugagccugggagauggaggcug

SEQ ID NO: 145797 - RNA, 22 nt, Human
cugguacaaaaugcugauauca

SEQ ID NO: 145798 - RNA, 20 nt, Human
cugccuggaggccucuaccu

SEQ ID NO: 145799 - RNA, 22 nt, Human
gcuccugggcucuaccuugcua

SEQ ID NO: 145800 - RNA, 22 nt, Human
gggaaauugucaacacucucaa

SEQ ID NO: 145801 - RNA, 22 nt, Human
ccugucacgaugacugcacucu

SEQ ID NO: 145802 - RNA, 22 nt, Human
aagagagagcauucuucuguua

SEQ ID NO: 145803 - RNA, 22 nt, Human
gcugagagugagcacuggauau

SEQ ID NO: 145804 - RNA, 22 nt, Human
uggcucuguucgccaucaggag

SEQ ID NO: 145805 - RNA, 22 nt, Human
ugcauuguugaauauuucauag

SEQ ID NO: 145806 - RNA, 22 nt, Human
uguguggcaagcuguaugcuag

SEQ ID NO: 145807 - RNA, 22 nt, Human
ucacaucuuauuagaguaucuc

SEQ ID NO: 145808 - RNA, 22 nt, Human
gccuguguggaugcgccggugc

SEQ ID NO: 145809 - RNA, 22 nt, Human
ggagucaggagcaggcugggcu

SEQ ID NO: 145810 - RNA, 22 nt, Human
agcagcaucugguucugaugug

SEQ ID NO: 145811 - RNA, 22 nt, Human
gcugcaggagcuggagcugugg

SEQ ID NO: 145812 - RNA, 22 nt, Human
ccugccuggcugucagcagagc

SEQ ID NO: 145813 - RNA, 18 nt, Human
uguuccaaggaaggaauc

SEQ ID NO: 145814 - RNA, 22 nt, Human
gcucccugaaaagaacaaaguc

SEQ ID NO: 145815 - RNA, 22 nt, Human
gugugucuuucauuucaugagg

SEQ ID NO: 145816 - RNA, 22 nt, Human
agggccugggguagcuuacugc

SEQ ID NO: 145817 - RNA, 22 nt, Human
uucuucaguuugguaaauguaa

SEQ ID NO: 145818 - RNA, 22 nt, Human
ccaaggagcucauauucuuguu

SEQ ID NO: 145819 - RNA, 21 nt, Human
agcucagccgggcacaguggc

SEQ ID NO: 145820 - RNA, 22 nt, Human
ccuggaggagcgcugaccagcu

SEQ ID NO: 145821 - RNA, 22 nt, Human
ccagggcacguugggacaguac

SEQ ID NO: 145822 - RNA, 22 nt, Human
uggcuagcccuuguggggagag

SEQ ID NO: 145823 - RNA, 22 nt, Human
guguguauguagaacuauguau

SEQ ID NO: 145824 - RNA, 23 nt, Human
agacccagagacuggcucugcuc

SEQ ID NO: 145825 - RNA, 22 nt, Human
cagccagccucucaaccaugca

SEQ ID NO: 145826 - RNA, 22 nt, Human
ugggggugacuaucucgggaau

SEQ ID NO: 145827 - RNA, 22 nt, Human
acaggcuuuuuuagaaugacau

SEQ ID NO: 145828 - RNA, 22 nt, Human
gaagcagcagcuggggacaguu

SEQ ID NO: 145829 - RNA, 22 nt, Human
gcguaaggccucuggucucgga

SEQ ID NO: 145830 - RNA, 22 nt, Human
uggccucugugggagcugagca

SEQ ID NO: 145831 - RNA, 22 nt, Human
cuuacagugaucaacacaaaga

SEQ ID NO: 145832 - RNA, 22 nt, Human
ggggccuguagagcuucaggga

SEQ ID NO: 145833 - RNA, 20 nt, Human
cagcaggaaaagugccucag

SEQ ID NO: 145834 - RNA, 20 nt, Human
cucuccucacccgugucagg

SEQ ID NO: 145835 - RNA, 17 nt, Human
aucucucuaaggcaggc

SEQ ID NO: 145836 - RNA, 22 nt, Human
gcagcauuuguggaaugggccc

SEQ ID NO: 145837 - RNA, 22 nt, Human
ucugccagaaguucugagagua

SEQ ID NO: 145838 - RNA, 22 nt, Human
ucaaacuguuuacagugagaua

SEQ ID NO: 145839 - RNA, 22 nt, Human
ugcucugcaagcaggagcaaga

SEQ ID NO: 145840 - RNA, 22 nt, Human
cagaaaaccugacucuagaacu

SEQ ID NO: 145841 - RNA, 22 nt, Human
guaacugaggcagcuuuuaaga

SEQ ID NO: 145842 - RNA, 18 nt, Human
ugggcugccuggccucug

SEQ ID NO: 145843 - RNA, 22 nt, Human
guuuucucuguguuuggaugau

SEQ ID NO: 145844 - RNA, 21 nt, Human
ugugugugcaggcacacacac

SEQ ID NO: 145845 - RNA, 22 nt, Human
acuuugcagggcuugauaucca

SEQ ID NO: 145846 - RNA, 22 nt, Human
aaaugucuguuagucauaucau

SEQ ID NO: 145847 - RNA, 22 nt, Human
gccugcagccucaagggcugag

SEQ ID NO: 145848 - RNA, 22 nt, Human
ccuccuuuccuguuuuccugag

SEQ ID NO: 145849 - RNA, 20 nt, Human
auuuggcaugaaguauugau

SEQ ID NO: 145850 - RNA, 22 nt, Human
gagguacagaguguuccaaugu

SEQ ID NO: 145851 - RNA, 19 nt, Human
gccacuccugaugcugccc

SEQ ID NO: 145852 - RNA, 22 nt, Human
gaaaccucuuagccucucuuug

SEQ ID NO: 145853 - RNA, 22 nt, Human
uuugacagagcucuuagucucu

SEQ ID NO: 145854 - RNA, 22 nt, Human
aaaugcagguaguauuuauuuu

SEQ ID NO: 145855 - RNA, 22 nt, Human
agggagaaugaccaagguauau

SEQ ID NO: 145856 - RNA, 22 nt, Human
cucugagcuccuggaagcgugc

SEQ ID NO: 145857 - RNA, 17 nt, Human
gguguauggggagggaa

SEQ ID NO: 145858 - RNA, 18 nt, Human
ccagagcuggcuccucgc

SEQ ID NO: 145859 - RNA, 22 nt, Human
uucuucaaauagcagggaguca

SEQ ID NO: 145860 - RNA, 22 nt, Human
gaaaguuuauagguuauauaau

SEQ ID NO: 145861 - RNA, 22 nt, Human
gcccucucuucugcagccucca

SEQ ID NO: 145862 - RNA, 23 nt, Human
ugggcaucuccucugugccaggc

SEQ ID NO: 145863 - RNA, 22 nt, Human
gggccuggggugacguaccccu

SEQ ID NO: 145864 - RNA, 22 nt, Human
gcacagggcccugugcguaggu

SEQ ID NO: 145865 - RNA, 22 nt, Human
cuucuucaagagaaugggagac

SEQ ID NO: 145866 - RNA, 22 nt, Human
acacagggucuagaguuaggcc

SEQ ID NO: 145867 - RNA, 22 nt, Human
augaguaaaaccacuauuuaca

SEQ ID NO: 145868 - RNA, 20 nt, Human
ggcagcaggaguuuccucuu

SEQ ID NO: 145869 - RNA, 22 nt, Human
auaugugugaugcauggacuaa

SEQ ID NO: 145870 - RNA, 22 nt, Human
acacugaauguuuaagaacuug

SEQ ID NO: 145871 - RNA, 22 nt, Human
cuggagcuaggaaguccaagau

SEQ ID NO: 145872 - RNA, 22 nt, Human
acacaggaagucagcacugaug

SEQ ID NO: 145873 - RNA, 21 nt, Human
ugccaggccugagcugggguc

SEQ ID NO: 145874 - RNA, 22 nt, Human
gaggcugcuuugaugacaggag

SEQ ID NO: 145875 - RNA, 22 nt, Human
aggccuccuggcuccaggccuu

SEQ ID NO: 145876 - RNA, 21 nt, Human
cccagggaagccgcagucacc

SEQ ID NO: 145877 - RNA, 22 nt, Human
aaccauuugcaguuacugagac

SEQ ID NO: 145878 - RNA, 20 nt, Human
agcugguuaucuuaauucuu

SEQ ID NO: 145879 - RNA, 22 nt, Human
ucugggaaugaauaagaccugu

SEQ ID NO: 145880 - RNA, 22 nt, Human
acagagcucccagccaucuccu

SEQ ID NO: 145881 - RNA, 22 nt, Human
aucacauugccagugauuaccc

SEQ ID NO: 145882 - RNA, 22 nt, Human
ggcugagcaauuuugaugacau

SEQ ID NO: 145883 - RNA, 22 nt, Human
uuucauuuugguuaugccauaa

SEQ ID NO: 145884 - RNA, 22 nt, Human
uccucagggaagaugagccuca

SEQ ID NO: 145885 - RNA, 22 nt, Human
gcagccacuuugcaaccaagag

SEQ ID NO: 145886 - RNA, 22 nt, Human
gccacacugcuucuuugagccu

SEQ ID NO: 145887 - RNA, 23 nt, Human
agcccagcagagaaccuaggucc

SEQ ID NO: 145888 - RNA, 22 nt, Human
aacaaauguaaaaugcagaugc

SEQ ID NO: 145889 - RNA, 22 nt, Human
uuucacauguggaaugccaggu

SEQ ID NO: 145890 - RNA, 22 nt, Human
cugcugagcccuggcacaggug

SEQ ID NO: 145891 - RNA, 22 nt, Human
gugcaggggaucagguugcagc

SEQ ID NO: 145892 - RNA, 22 nt, Human
acagaauacuacagacugguua

SEQ ID NO: 145893 - RNA, 22 nt, Human
ggcugccauaacugauaccaua

SEQ ID NO: 145894 - RNA, 22 nt, Human
ucagugcuucggcgagcaccua

SEQ ID NO: 145895 - RNA, 22 nt, Human
aggcacugugcagucccaagca

SEQ ID NO: 145896 - RNA, 22 nt, Human
aagaacagguucuagaaccauu

SEQ ID NO: 145897 - RNA, 22 nt, Human
cuggcucagugccuucagaagu

SEQ ID NO: 145898 - RNA, 22 nt, Human
aaggccagaguacuagaggcug

SEQ ID NO: 145899 - RNA, 22 nt, Human
uuucuucagccacuccaaacug

SEQ ID NO: 145900 - RNA, 22 nt, Human
gcuucucuggccugcagggcau

SEQ ID NO: 145901 - RNA, 22 nt, Human
auuugcuuucagguauaaaagg

SEQ ID NO: 145902 - RNA, 22 nt, Human
gggcucugcgcucagcuccagc

SEQ ID NO: 145903 - RNA, 22 nt, Human
cuggccugggagcugcuagcgu

SEQ ID NO: 145904 - RNA, 22 nt, Human
agcagcucugagaggccagcac

SEQ ID NO: 145905 - RNA, 22 nt, Human
acauuucuuucuauucaguagc

SEQ ID NO: 145906 - RNA, 22 nt, Human
gggcuuggcacaugggcucagc

SEQ ID NO: 145907 - RNA, 22 nt, Human
uguggccuuauuuguauggggg

SEQ ID NO: 145908 - RNA, 22 nt, Human
gcagggacugugaucucacaga

SEQ ID NO: 145909 - RNA, 22 nt, Human
gcugucagugaggugagacaug

SEQ ID NO: 145910 - RNA, 22 nt, Human
ggcacugacacuagcauggcac

SEQ ID NO: 145911 - RNA, 22 nt, Human
gccugccuggagcuugagguga

SEQ ID NO: 145912 - RNA, 22 nt, Human
ucaggugggaccugcuaggaca

SEQ ID NO: 145913 - RNA, 22 nt, Human
ucucuugugguuuuguaguuga

SEQ ID NO: 145914 - RNA, 22 nt, Human
auugaaaggcaaaguaggaagc

SEQ ID NO: 145915 - RNA, 22 nt, Human
ucccagcagucagagcuaugug

SEQ ID NO: 145916 - RNA, 22 nt, Human
uuauacuaaaacgcauugaauu

SEQ ID NO: 145917 - RNA, 22 nt, Human
ucaguuuucucaucuguaauuu

SEQ ID NO: 145918 - RNA, 22 nt, Human
cauugaaaaacguugacugagu

SEQ ID NO: 145919 - RNA, 22 nt, Human
caagacaagaucuaagcaugcu

SEQ ID NO: 145920 - RNA, 21 nt, Human
ccuucuccacagggucuccgg

SEQ ID NO: 145921 - RNA, 22 nt, Human
cauugaaaccuaacauaggcug

SEQ ID NO: 145922 - RNA, 22 nt, Human
gcacagggcaacaggucuguua

SEQ ID NO: 145923 - RNA, 22 nt, Human
cagugcugggcagaggagagcg

SEQ ID NO: 145924 - RNA, 22 nt, Human
ugucucugugacuccuuccgcc

SEQ ID NO: 145925 - RNA, 22 nt, Human
ugugaguaauaaagucauuuuu

SEQ ID NO: 145926 - RNA, 22 nt, Human
ucaucucaaaacccaaggggca

SEQ ID NO: 145927 - RNA, 22 nt, Human
caguuuauauucuagugcuguu

SEQ ID NO: 145928 - RNA, 22 nt, Human
aauuucucacucucuugaucac

SEQ ID NO: 145929 - RNA, 23 nt, Human
agaauuguaaauagaauauaccu

SEQ ID NO: 145930 - RNA, 22 nt, Human
aguuuuauuccaaugugcagca

SEQ ID NO: 145931 - RNA, 22 nt, Human
ucauccaguaccauggaaggca

SEQ ID NO: 145932 - RNA, 23 nt, Human
agaggcaggaguggcuugcccgg

SEQ ID NO: 145933 - RNA, 22 nt, Human
gcuggagcuugagaggacaggg

SEQ ID NO: 145934 - RNA, 22 nt, Human
aggcacugacaauucuggacug

SEQ ID NO: 145935 - RNA, 22 nt, Human
uggcauguaguaggugcuauaa

SEQ ID NO: 145936 - RNA, 20 nt, Human
accuugaacccgccagccau

SEQ ID NO: 145937 - RNA, 22 nt, Human
ggggcagagagaaggaagcuug

SEQ ID NO: 145938 - RNA, 22 nt, Human
ugcuuccuucccguucuucucc

SEQ ID NO: 145939 - RNA, 22 nt, Human
uacuuuucaagcagcugguuau

SEQ ID NO: 145940 - RNA, 22 nt, Human
aucagcaagcaugguuaggugu

SEQ ID NO: 145941 - RNA, 22 nt, Human
gaagcagcuagcccacuaguca

SEQ ID NO: 145942 - RNA, 22 nt, Human
guucuucaaagugacaacuaaa

SEQ ID NO: 145943 - RNA, 22 nt, Human
cucuucuugucucugguuagaa

SEQ ID NO: 145944 - RNA, 21 nt, Human
uggcugcuggcccucucucca

SEQ ID NO: 145945 - RNA, 22 nt, Human
ugugugaaggagccacuguuca

SEQ ID NO: 145946 - RNA, 22 nt, Human
caugagcugcugggagccuguc

SEQ ID NO: 145947 - RNA, 22 nt, Human
caguggccaugguggcaggggu

SEQ ID NO: 145948 - RNA, 22 nt, Human
gcaccugcaggaugagccaggg

SEQ ID NO: 145949 - RNA, 22 nt, Human
auuacaguucuacacauccuuu

SEQ ID NO: 145950 - RNA, 20 nt, Human
cugagcccccagccugcagg

SEQ ID NO: 145951 - RNA, 22 nt, Human
agggccuggaacugugggcagg

SEQ ID NO: 145952 - RNA, 22 nt, Human
uggagacugugcuaagggaguu

SEQ ID NO: 145953 - RNA, 22 nt, Human
ucugggugaugaaaugcacugu

SEQ ID NO: 145954 - RNA, 22 nt, Human
agcagggcuuugcagacuuggg

SEQ ID NO: 145955 - RNA, 22 nt, Human
auacauuagcucauaugauuaa

SEQ ID NO: 145956 - RNA, 22 nt, Human
cagcugcccugccuugcccuua

SEQ ID NO: 145957 - RNA, 22 nt, Human
ucaggcugguggucagauggcu

SEQ ID NO: 145958 - RNA, 20 nt, Human
acauguacuaaugaauacag

SEQ ID NO: 145959 - RNA, 18 nt, Human
acagaaauagcugugccu

SEQ ID NO: 145960 - RNA, 22 nt, Human
ggugaagggugucauggcauuu

SEQ ID NO: 145961 - RNA, 22 nt, Human
cauugcuuugugcauauuuaaa

SEQ ID NO: 145962 - RNA, 22 nt, Human
cacucaggguacaauggagggc

SEQ ID NO: 145963 - RNA, 22 nt, Human
gguucacauauugagaguauuc

SEQ ID NO: 145964 - RNA, 22 nt, Human
agccuggagguaaugaggaaac

SEQ ID NO: 145965 - RNA, 22 nt, Human
ggcagcuguggacgucgucauu

SEQ ID NO: 145966 - RNA, 22 nt, Human
cugggcuccuaaccauccaggu

SEQ ID NO: 145967 - RNA, 22 nt, Human
uaaaaugaucucucauguucuu

SEQ ID NO: 145968 - RNA, 22 nt, Human
ggguggaggagaacaggcccca

SEQ ID NO: 145969 - RNA, 22 nt, Human
aggucaaguuuagauagaguua

SEQ ID NO: 145970 - RNA, 22 nt, Human
ugagggaguuggguguauagga

SEQ ID NO: 145971 - RNA, 18 nt, Human
uugagggaggggcagagu

SEQ ID NO: 145972 - RNA, 22 nt, Human
ggaggugaggccguagggugug

SEQ ID NO: 145973 - RNA, 22 nt, Human
ccaggcucugcgcuggacaugg

SEQ ID NO: 145974 - RNA, 22 nt, Human
cagagcugucauuugccaguga

SEQ ID NO: 145975 - RNA, 22 nt, Human
uccaugaggaccaaauucguag

SEQ ID NO: 145976 - RNA, 22 nt, Human
gaggcugcggggaggagccugc

SEQ ID NO: 145977 - RNA, 22 nt, Human
cuuguacauagagaagaagccu

SEQ ID NO: 145978 - RNA, 22 nt, Human
cugccucugguuuuggucccug

SEQ ID NO: 145979 - RNA, 18 nt, Human
acagaggcagacauguau

SEQ ID NO: 145980 - RNA, 22 nt, Human
auuuuucucuuuccacugagau

SEQ ID NO: 145981 - RNA, 22 nt, Human
ugucucugugagaucugacgau

SEQ ID NO: 145982 - RNA, 22 nt, Human
gaguauauaauuaauuggucug

SEQ ID NO: 145983 - RNA, 22 nt, Human
ucaaagucuaucuguaauuacu

SEQ ID NO: 145984 - RNA, 22 nt, Human
cagagugagggccugcaccugc

SEQ ID NO: 145985 - RNA, 22 nt, Human
aguaaauuucugcauguguacu

SEQ ID NO: 145986 - RNA, 23 nt, Human
agaagcagcuucuggaguaucgg

SEQ ID NO: 145987 - RNA, 22 nt, Human
gugcugcagagucucgugccgc

SEQ ID NO: 145988 - RNA, 22 nt, Human
gggucccaggaaggagcagugu

SEQ ID NO: 145989 - RNA, 22 nt, Human
gacaugcaacaauuuggcauuu

SEQ ID NO: 145990 - RNA, 22 nt, Human
uuuaucagaggcuauguuucau

SEQ ID NO: 145991 - RNA, 22 nt, Human
cucugcaugccuugcucagaca

SEQ ID NO: 145992 - RNA, 22 nt, Human
accacuguaucuccagcacauu

SEQ ID NO: 145993 - RNA, 23 nt, Human
ugugucugaggauauaugugcau

SEQ ID NO: 145994 - RNA, 22 nt, Human
uaaggucauggugaauaauaag

SEQ ID NO: 145995 - RNA, 22 nt, Human
uuuucaguuccaucucugcucu

SEQ ID NO: 145996 - RNA, 22 nt, Human
ccugggcauaaaucacuccaag

SEQ ID NO: 145997 - RNA, 22 nt, Human
ucuggcucugaauucacuucug

SEQ ID NO: 145998 - RNA, 22 nt, Human
gagagcuguaauagucaugucu

SEQ ID NO: 145999 - RNA, 22 nt, Human
cuacuucuaaguacauggugau

SEQ ID NO: 146000 - RNA, 22 nt, Human
cagaggcugggaccucaggcau

SEQ ID NO: 146001 - RNA, 22 nt, Human
uuuauucaucaucuguucauau

SEQ ID NO: 146002 - RNA, 22 nt, Human
cucuuuccaggguaccccaggu

SEQ ID NO: 146003 - RNA, 22 nt, Human
uuacauuuuaguuaaccuguga

SEQ ID NO: 146004 - RNA, 22 nt, Human
ugggcugcuucuauuggugguc

SEQ ID NO: 146005 - RNA, 22 nt, Human
cugggcagccucacacaauguu

SEQ ID NO: 146006 - RNA, 22 nt, Human
ugcacccucaucagucaaaugg

SEQ ID NO: 146007 - RNA, 22 nt, Human
acagaacugggaaaugcacaua

SEQ ID NO: 146008 - RNA, 17 nt, Human
gcuuccucaugcaguuc

SEQ ID NO: 146009 - RNA, 22 nt, Human
uguauuuuuaggaaugcgcuau

SEQ ID NO: 146010 - RNA, 22 nt, Human
auggggcuguucucugcccugc

SEQ ID NO: 146011 - RNA, 22 nt, Human
ugccugucagggggagugggaa

SEQ ID NO: 146012 - RNA, 22 nt, Human
aagggcagcugacagaugcuua

SEQ ID NO: 146013 - RNA, 22 nt, Human
ugguacacauguccaaggucag

SEQ ID NO: 146014 - RNA, 22 nt, Human
uuaagucacuuaucuaaagaca

SEQ ID NO: 146015 - RNA, 17 nt, Human
acacagccagguucucc

SEQ ID NO: 146016 - RNA, 22 nt, Human
gaucuucuauguaaugaagugu

SEQ ID NO: 146017 - RNA, 22 nt, Human
gcaggcaguugcaguuuucuag

SEQ ID NO: 146018 - RNA, 17 nt, Human
ggaaaaggaugauacag

SEQ ID NO: 146019 - RNA, 22 nt, Human
guggcaugaaagcaucugugau

SEQ ID NO: 146020 - RNA, 22 nt, Human
cugcccugagggccuguguguu

SEQ ID NO: 146021 - RNA, 20 nt, Human
acauugauuauguuuguaga

SEQ ID NO: 146022 - RNA, 22 nt, Human
gcaggggaguggaugauggauu

SEQ ID NO: 146023 - RNA, 22 nt, Human
aucucagacauguuguccauga

SEQ ID NO: 146024 - RNA, 22 nt, Human
ucucaggagccacagcgggagu

SEQ ID NO: 146025 - RNA, 22 nt, Human
aacagaauaguugauguacagu

SEQ ID NO: 146026 - RNA, 22 nt, Human
ggcuccuggggaggugagcuug

SEQ ID NO: 146027 - RNA, 22 nt, Human
uaaguucagaguucucauuugu

SEQ ID NO: 146028 - RNA, 21 nt, Human
aucuuuauuacgcagagaaga

SEQ ID NO: 146029 - RNA, 22 nt, Human
caggaaccuaaugaaggcucac

SEQ ID NO: 146030 - RNA, 23 nt, Human
aagcugccuucgcaguuggucug

SEQ ID NO: 146031 - RNA, 22 nt, Human
ucaugugucugccaguguuuau

SEQ ID NO: 146032 - RNA, 22 nt, Human
gcacccagcccagggcgugaug

SEQ ID NO: 146033 - RNA, 22 nt, Human
augugucuucuguggguuugaa

SEQ ID NO: 146034 - RNA, 22 nt, Human
gggcuguggagccgcgagggcu

SEQ ID NO: 146035 - RNA, 22 nt, Human
guauaguuugcgauuugugguu

SEQ ID NO: 146036 - RNA, 22 nt, Human
ugaaggaaagagggaacauccc

SEQ ID NO: 146037 - RNA, 22 nt, Human
gcaggccuccccugcuggagcu

SEQ ID NO: 146038 - RNA, 22 nt, Human
agugauggagcuuccucugcua

SEQ ID NO: 146039 - RNA, 22 nt, Human
uguggguggagugauauuagcu

SEQ ID NO: 146040 - RNA, 22 nt, Human
auuuguacaaauuuauguuagu

SEQ ID NO: 146041 - RNA, 22 nt, Human
ugagccuggguggucgaggcug

SEQ ID NO: 146042 - RNA, 22 nt, Human
ggaggccuugaggccaggagcu

SEQ ID NO: 146043 - RNA, 22 nt, Human
uauacaguuaaguuucuucagu

SEQ ID NO: 146044 - RNA, 22 nt, Human
aagauggaguaguguaaugguu

SEQ ID NO: 146045 - RNA, 22 nt, Human
acugagcugcuugaagugaacu

SEQ ID NO: 146046 - RNA, 22 nt, Human
accucugccacuuucuaacucu

SEQ ID NO: 146047 - RNA, 22 nt, Human
uccuucagaaaaccucagucuu

SEQ ID NO: 146048 - RNA, 20 nt, Human
uggcccuguuuucuccaggc

SEQ ID NO: 146049 - RNA, 22 nt, Human
aaagauuugaaauuaggcauca

SEQ ID NO: 146050 - RNA, 23 nt, Human
gugcaugugucuuuacaguagca

SEQ ID NO: 146051 - RNA, 22 nt, Human
cuguguaucucugugggacaga

SEQ ID NO: 146052 - RNA, 22 nt, Human
uucauuccuucccuaagcaacu

SEQ ID NO: 146053 - RNA, 22 nt, Human
cuuauguaugcuacuuuguggu

SEQ ID NO: 146054 - RNA, 22 nt, Human
uccagccaacugccuagggagc

SEQ ID NO: 146055 - RNA, 22 nt, Human
agcagacaacccagaugaccca

SEQ ID NO: 146056 - RNA, 22 nt, Human
acauacauauguuuaaaugcau

SEQ ID NO: 146057 - RNA, 22 nt, Human
uguguaugcauacacacauaga

SEQ ID NO: 146058 - RNA, 22 nt, Human
acuuauuagacaucuucauugu

SEQ ID NO: 146059 - RNA, 19 nt, Human
ugaagcaauaccauuuuug

SEQ ID NO: 146060 - RNA, 22 nt, Human
ccagggccaguaagauuggcau

SEQ ID NO: 146061 - RNA, 22 nt, Human
gggcuccagcccgggaccaggu

SEQ ID NO: 146062 - RNA, 22 nt, Human
uggccugguaccacauagauuu

SEQ ID NO: 146063 - RNA, 22 nt, Human
cagagagcuuagugugcugcau

SEQ ID NO: 146064 - RNA, 22 nt, Human
aucaguuuauacuuauaaaucu

SEQ ID NO: 146065 - RNA, 22 nt, Human
agcaggagcugugggaagaugg

SEQ ID NO: 146066 - RNA, 22 nt, Human
ggguguccugugccaagcuggg

SEQ ID NO: 146067 - RNA, 22 nt, Human
gcucagagaugucugcugccuu

SEQ ID NO: 146068 - RNA, 20 nt, Human
cccugagacaaaggaggggc

SEQ ID NO: 146069 - RNA, 22 nt, Human
uaaguggaagguuauaugcuaa

SEQ ID NO: 146070 - RNA, 22 nt, Human
acauuuaaauaugccuuauauu

SEQ ID NO: 146071 - RNA, 22 nt, Human
uuuucucuauauugucugugaa

SEQ ID NO: 146072 - RNA, 22 nt, Human
gcuggccauggggagugaggag

SEQ ID NO: 146073 - RNA, 22 nt, Human
ccaaagugcugggguuacaggc

SEQ ID NO: 146074 - RNA, 22 nt, Human
cagcccugccauggagccuccu

SEQ ID NO: 146075 - RNA, 22 nt, Human
gagcccaggcagagguugcagu

SEQ ID NO: 146076 - RNA, 22 nt, Human
cauuuguaauacugacuugcag

SEQ ID NO: 146077 - RNA, 22 nt, Human
cccagccagccucuucccauau

SEQ ID NO: 146078 - RNA, 22 nt, Human
cacaguauucacugggcagauu

SEQ ID NO: 146079 - RNA, 20 nt, Human
ggcucuggaaucuggugggc

SEQ ID NO: 146080 - RNA, 23 nt, Human
ucucucuuagcuaugcuuauggc

SEQ ID NO: 146081 - RNA, 22 nt, Human
agcuuaggaggaugaugaacau

SEQ ID NO: 146082 - RNA, 18 nt, Human
aaguaacagaagagcaca

SEQ ID NO: 146083 - RNA, 22 nt, Human
aagagguaaccauagcaaccac

SEQ ID NO: 146084 - RNA, 22 nt, Human
agguggccggugccagccgggc

SEQ ID NO: 146085 - RNA, 22 nt, Human
uugaggagcaggaugggaggcu

SEQ ID NO: 146086 - RNA, 22 nt, Human
cagagcugggcauggugaaagg

SEQ ID NO: 146087 - RNA, 22 nt, Human
agcuucuggaaggcaaggcuug

SEQ ID NO: 146088 - RNA, 22 nt, Human
aguacauuuauuaaugguaaaa

SEQ ID NO: 146089 - RNA, 22 nt, Human
ucagccagguaauguggagaug

SEQ ID NO: 146090 - RNA, 22 nt, Human
uccuggaggggacagcaugggc

SEQ ID NO: 146091 - RNA, 22 nt, Human
cuuuacaccaagcagaucuuuc

SEQ ID NO: 146092 - RNA, 22 nt, Human
aggggccuggacauggacgcgc

SEQ ID NO: 146093 - RNA, 22 nt, Human
uacagucaacauugaugaugau

SEQ ID NO: 146094 - RNA, 22 nt, Human
ggcuggcacucuguccaguguc

SEQ ID NO: 146095 - RNA, 22 nt, Human
auguaucaugcaggguccauga

SEQ ID NO: 146096 - RNA, 22 nt, Human
caggaaaggugugucaugaugg

SEQ ID NO: 146097 - RNA, 21 nt, Human
ugcagcugacacugguaugcc

SEQ ID NO: 146098 - RNA, 22 nt, Human
acaggcugcugggcuccgugcu

SEQ ID NO: 146099 - RNA, 22 nt, Human
ccccagccuuccaugggaauug

SEQ ID NO: 146100 - RNA, 22 nt, Human
cugagccagcgggcucacuuuu

SEQ ID NO: 146101 - RNA, 21 nt, Human
cucacaggaugcaguguuacu

SEQ ID NO: 146102 - RNA, 22 nt, Human
cagcaggcccaggugcugguga

SEQ ID NO: 146103 - RNA, 22 nt, Human
uggcagcagacaaaaggccauu

SEQ ID NO: 146104 - RNA, 18 nt, Human
gucacuguguuucugagc

SEQ ID NO: 146105 - RNA, 22 nt, Human
acuuucuccagaaaaccaagga

SEQ ID NO: 146106 - RNA, 22 nt, Human
uccuggaggcaaaugaagacuc

SEQ ID NO: 146107 - RNA, 22 nt, Human
aaaaauguuaucuacuguccga

SEQ ID NO: 146108 - RNA, 20 nt, Human
ugagugauggaggcggguca

SEQ ID NO: 146109 - RNA, 22 nt, Human
ggcaggaggugaguggcgggug

SEQ ID NO: 146110 - RNA, 22 nt, Human
uuucucugugggcuuuaugcau

SEQ ID NO: 146111 - RNA, 22 nt, Human
cugccucuauucacugaggcag

SEQ ID NO: 146112 - RNA, 22 nt, Human
ccucugccugcacaucauccug

SEQ ID NO: 146113 - RNA, 19 nt, Human
ggcugccuggagcgagggc

SEQ ID NO: 146114 - RNA, 22 nt, Human
uauagaagagacaugugcauag

SEQ ID NO: 146115 - RNA, 22 nt, Human
cuuuccaagaaugcagauaccu

SEQ ID NO: 146116 - RNA, 19 nt, Human
agcauccagucaugggauc

SEQ ID NO: 146117 - RNA, 19 nt, Human
gcugcucugggucucaucu

SEQ ID NO: 146118 - RNA, 22 nt, Human
acacaaauuguaggauaauugc

SEQ ID NO: 146119 - RNA, 22 nt, Human
ucuuuucuugcauuauugcacu

SEQ ID NO: 146120 - RNA, 22 nt, Human
ccugagcugaacuaagcaguuu

SEQ ID NO: 146121 - RNA, 23 nt, Human
uuucuguuggguauauauccaag

SEQ ID NO: 146122 - RNA, 22 nt, Human
ugaguguggggaaugucaugag

SEQ ID NO: 146123 - RNA, 22 nt, Human
agccagacauggcuccugcucc

SEQ ID NO: 146124 - RNA, 22 nt, Human
agggacacaugugauuauuuau

SEQ ID NO: 146125 - RNA, 22 nt, Human
cagcagcuuugccaagucagcc

SEQ ID NO: 146126 - RNA, 22 nt, Human
gugcauuuggugacucucaccc

SEQ ID NO: 146127 - RNA, 20 nt, Human
ucuguagucuguggcaagac

SEQ ID NO: 146128 - RNA, 22 nt, Human
gcauuuguguucuuccuagagc

SEQ ID NO: 146129 - RNA, 22 nt, Human
cugggccuggcguuccaggcug

SEQ ID NO: 146130 - RNA, 22 nt, Human
caggacaguauaggcuuuagga

SEQ ID NO: 146131 - RNA, 22 nt, Human
cuggcucuucagugcuugguuc

SEQ ID NO: 146132 - RNA, 22 nt, Human
ccagggucucugcugccugaga

SEQ ID NO: 146133 - RNA, 22 nt, Human
agggagaacaguugcagcagac

SEQ ID NO: 146134 - RNA, 22 nt, Human
ggaggccaugaggcucuaggug

SEQ ID NO: 146135 - RNA, 22 nt, Human
acccucccauuuccauguagca

SEQ ID NO: 146136 - RNA, 22 nt, Human
ugccugggccuucccaccucug

SEQ ID NO: 146137 - RNA, 22 nt, Human
uuaaagaguaaucauaggucaa

SEQ ID NO: 146138 - RNA, 22 nt, Human
uuguaacuugugauuauaaucu

SEQ ID NO: 146139 - RNA, 22 nt, Human
acuucauuguaauauuauagca

SEQ ID NO: 146140 - RNA, 22 nt, Human
ccugggucacucaggcaggcgg

SEQ ID NO: 146141 - RNA, 22 nt, Human
caagauggacauaaggagagaa

SEQ ID NO: 146142 - RNA, 22 nt, Human
ccucccacauccuagcucugcu

SEQ ID NO: 146143 - RNA, 22 nt, Human
cugcucugacccuuucaccuuc

SEQ ID NO: 146144 - RNA, 22 nt, Human
ugcccagcugucaaaguagaua

SEQ ID NO: 146145 - RNA, 22 nt, Human
aggguauguuuuuaucuacugu

SEQ ID NO: 146146 - RNA, 23 nt, Human
ucuuuacauacugaugaguucuc

SEQ ID NO: 146147 - RNA, 22 nt, Human
auguuucugaaguuuacagaua

SEQ ID NO: 146148 - RNA, 22 nt, Human
acugugugcuggacaugauguu

SEQ ID NO: 146149 - RNA, 22 nt, Human
ugugcccauuccacuugaguac

SEQ ID NO: 146150 - RNA, 17 nt, Human
ucagcaaagacaaagga

SEQ ID NO: 146151 - RNA, 22 nt, Human
auuuucaucgcuagguuggccu

SEQ ID NO: 146152 - RNA, 22 nt, Human
aggucagaagugccagggaauu

SEQ ID NO: 146153 - RNA, 22 nt, Human
aggucauuccagccauuccccu

SEQ ID NO: 146154 - RNA, 22 nt, Human
gggcucucaugaguguguggua

SEQ ID NO: 146155 - RNA, 22 nt, Human
caagagcucccagaccugggca

SEQ ID NO: 146156 - RNA, 22 nt, Human
cagcagguauguuuguucagca

SEQ ID NO: 146157 - RNA, 22 nt, Human
cuuguuuaagccgcuguuaagc

SEQ ID NO: 146158 - RNA, 22 nt, Human
ucucagagaccugaacucccug

SEQ ID NO: 146159 - RNA, 22 nt, Human
caugcacaacauacucaagagg

SEQ ID NO: 146160 - RNA, 22 nt, Human
gaggggcagaaugugaucaggg

SEQ ID NO: 146161 - RNA, 23 nt, Human
augcucugggcugugggaccugc

SEQ ID NO: 146162 - RNA, 22 nt, Human
cccuggaggagcuuagagcuug

SEQ ID NO: 146163 - RNA, 22 nt, Human
cugcuuugaaaauaaacuuguc

SEQ ID NO: 146164 - RNA, 21 nt, Human
ucugucugguuuuagaguggc

SEQ ID NO: 146165 - RNA, 18 nt, Human
agucuucugauccauuuu

SEQ ID NO: 146166 - RNA, 22 nt, Human
uaugcauauagaugcacacaca

SEQ ID NO: 146167 - RNA, 22 nt, Human
ucacagcaaaagugugcagagc

SEQ ID NO: 146168 - RNA, 22 nt, Human
cucagaaguucagccuagagua

SEQ ID NO: 146169 - RNA, 22 nt, Human
ggccuggaagaggacagagaaa

SEQ ID NO: 146170 - RNA, 21 nt, Human
uucaaagagugggcauuguca

SEQ ID NO: 146171 - RNA, 22 nt, Human
ucugagaguacgggcugcgcgc

SEQ ID NO: 146172 - RNA, 22 nt, Human
cagcugccuaugaccuagccuc

SEQ ID NO: 146173 - RNA, 22 nt, Human
uccuggauucugcccugaaggc

SEQ ID NO: 146174 - RNA, 22 nt, Human
guauccuuugcggaaauuucua

SEQ ID NO: 146175 - RNA, 22 nt, Human
auggcagggcagccucucagag

SEQ ID NO: 146176 - RNA, 22 nt, Human
cauggcaggaggcugcuggcag

SEQ ID NO: 146177 - RNA, 22 nt, Human
ucugcuguacuuuuggucuguu

SEQ ID NO: 146178 - RNA, 22 nt, Human
uuuccaagacuccaguucuccc

SEQ ID NO: 146179 - RNA, 22 nt, Human
auuaucuauguagaaugauuuu

SEQ ID NO: 146180 - RNA, 22 nt, Human
ugaggcuguucuaccagggcca

SEQ ID NO: 146181 - RNA, 22 nt, Human
gccucugcucggacuuugccuc

SEQ ID NO: 146182 - RNA, 22 nt, Human
gccaggcuggccagcaccuucu

SEQ ID NO: 146183 - RNA, 22 nt, Human
uaugcacauucacacaaaaaug

SEQ ID NO: 146184 - RNA, 22 nt, Human
ccagagcccagggucaugcagg

SEQ ID NO: 146185 - RNA, 22 nt, Human
ucacuuagauggggaucaucac

SEQ ID NO: 146186 - RNA, 22 nt, Human
gcccucugcacagcucugagca

SEQ ID NO: 146187 - RNA, 22 nt, Human
aggaaacuccccuacaucucaa

SEQ ID NO: 146188 - RNA, 21 nt, Human
ucucugguuggaguugugcca

SEQ ID NO: 146189 - RNA, 22 nt, Human
ugucucagaggcaggaagagcc

SEQ ID NO: 146190 - RNA, 22 nt, Human
uuuuccucugagcuuugaauaa

SEQ ID NO: 146191 - RNA, 22 nt, Human
acugcuuuagaccuagagcucu

SEQ ID NO: 146192 - RNA, 22 nt, Human
caauaauauccugugcuguuug

SEQ ID NO: 146193 - RNA, 22 nt, Human
agcagccaauuggaggaugaag

SEQ ID NO: 146194 - RNA, 22 nt, Human
agcagcuggggccugugacgau

SEQ ID NO: 146195 - RNA, 22 nt, Human
aggggccucgcaggaccgcucc

SEQ ID NO: 146196 - RNA, 22 nt, Human
acacaugcauaagccuucccuu

SEQ ID NO: 146197 - RNA, 22 nt, Human
acacagggggcauucuaggagu

SEQ ID NO: 146198 - RNA, 22 nt, Human
gagguacaugaggauacacagg

SEQ ID NO: 146199 - RNA, 22 nt, Human
aaagacacacagugcuucaguu

SEQ ID NO: 146200 - RNA, 22 nt, Human
accugccuaucagcugccugcu

SEQ ID NO: 146201 - RNA, 22 nt, Human
uucacagggccacuggcaggag

SEQ ID NO: 146202 - RNA, 22 nt, Human
ugauacagucagcucacaauug

SEQ ID NO: 146203 - RNA, 22 nt, Human
aguauugugacucaaguauucu

SEQ ID NO: 146204 - RNA, 22 nt, Human
aauuaacagagggcuuauuacu

SEQ ID NO: 146205 - RNA, 22 nt, Human
cugcccugacugaccuuuugaa

SEQ ID NO: 146206 - RNA, 22 nt, Human
cucagaguccccaguggguuug

SEQ ID NO: 146207 - RNA, 22 nt, Human
caguacuugggggguucuaagu

SEQ ID NO: 146208 - RNA, 22 nt, Human
uuccaguuaaggaagcuauucu

SEQ ID NO: 146209 - RNA, 22 nt, Human
gcucaggagcucuugguggcgc

SEQ ID NO: 146210 - RNA, 22 nt, Human
ugcaggugccucuugagcuugu

SEQ ID NO: 146211 - RNA, 22 nt, Human
cccacaggcuagggguagggca

SEQ ID NO: 146212 - RNA, 22 nt, Human
cuucacagagucccugauuguu

SEQ ID NO: 146213 - RNA, 22 nt, Human
cugugagcuggguggccaggac

SEQ ID NO: 146214 - RNA, 22 nt, Human
agugaccaacaaugcugagaag

SEQ ID NO: 146215 - RNA, 22 nt, Human
cauuuacuguugaaucccuagc

SEQ ID NO: 146216 - RNA, 22 nt, Human
cagaacugggcagggagcagag

SEQ ID NO: 146217 - RNA, 22 nt, Human
uacugccuggagcauuggugcu

SEQ ID NO: 146218 - RNA, 22 nt, Human
gagguuagaggucagugcaguc

SEQ ID NO: 146219 - RNA, 22 nt, Human
ucugggaagcugguccuguucu

SEQ ID NO: 146220 - RNA, 22 nt, Human
uacaguagucgucuuauuuuga

SEQ ID NO: 146221 - RNA, 22 nt, Human
ugggcugcccugaugguccuca

SEQ ID NO: 146222 - RNA, 22 nt, Human
ggagaagggacagacucagcuu

SEQ ID NO: 146223 - RNA, 22 nt, Human
cuggccagcauuuuugcuuuag

SEQ ID NO: 146224 - RNA, 22 nt, Human
acucugaggagugacuagaggu

SEQ ID NO: 146225 - RNA, 22 nt, Human
aggcccagggcugcucucugaa

SEQ ID NO: 146226 - RNA, 22 nt, Human
uggcccugaggggcugugcccc

SEQ ID NO: 146227 - RNA, 22 nt, Human
uucagugucaauuuuuaaauau

SEQ ID NO: 146228 - RNA, 22 nt, Human
gagccuccuccuggugugccga

SEQ ID NO: 146229 - RNA, 22 nt, Human
gagguggguguaucacagguca

SEQ ID NO: 146230 - RNA, 22 nt, Human
uauaacaguuuaggugguguca

SEQ ID NO: 146231 - RNA, 22 nt, Human
ucugccuggauuuuggaaagcu

SEQ ID NO: 146232 - RNA, 23 nt, Human
agggcugaugccauugcagcucu

SEQ ID NO: 146233 - RNA, 22 nt, Human
agggaggagaauggacuccuuc

SEQ ID NO: 146234 - RNA, 22 nt, Human
auacaagacucagcacagacgg

SEQ ID NO: 146235 - RNA, 22 nt, Human
ucacagugagccaugucagaga

SEQ ID NO: 146236 - RNA, 22 nt, Human
ggcagcagggucuagauugaug

SEQ ID NO: 146237 - RNA, 22 nt, Human
uguccucuaauuggccucuugc

SEQ ID NO: 146238 - RNA, 22 nt, Human
caggauggucuucauuuggcuc

SEQ ID NO: 146239 - RNA, 22 nt, Human
uaacauuugcugucuccuaugu

SEQ ID NO: 146240 - RNA, 22 nt, Human
ggcaguggguggaucucaggga

SEQ ID NO: 146241 - RNA, 22 nt, Human
gaaaugcauggaucuuggcaga

SEQ ID NO: 146242 - RNA, 22 nt, Human
ugcacacaguucucaggaaaga

SEQ ID NO: 146243 - RNA, 22 nt, Human
aaagauuucagaagccugugcc

SEQ ID NO: 146244 - RNA, 22 nt, Human
agcagcuuacauguggccuauc

SEQ ID NO: 146245 - RNA, 22 nt, Human
uaaugcacagaauugacauggg

SEQ ID NO: 146246 - RNA, 22 nt, Human
ccagccagcugcccuuggggcc

SEQ ID NO: 146247 - RNA, 22 nt, Human
agcagaacauuuucagggcugu

SEQ ID NO: 146248 - RNA, 22 nt, Human
acaggccacaguggagucucug

SEQ ID NO: 146249 - RNA, 22 nt, Human
aucuggcuuacgaagcacuggu

SEQ ID NO: 146250 - RNA, 22 nt, Human
aguacauauaguaauuuagcca

SEQ ID NO: 146251 - RNA, 22 nt, Human
cuggcucccguuguccuugaag

SEQ ID NO: 146252 - RNA, 22 nt, Human
agguaagggucacaguucauau

SEQ ID NO: 146253 - RNA, 21 nt, Human
ugucagaaauaagcaugugau

SEQ ID NO: 146254 - RNA, 22 nt, Human
gaaaagcuaggccaguucagcu

SEQ ID NO: 146255 - RNA, 22 nt, Human
gccugggaacucugaucuccug

SEQ ID NO: 146256 - RNA, 22 nt, Human
gggugggagucuggcccucaaa

SEQ ID NO: 146257 - RNA, 22 nt, Human
cuucuguguuaaaugagucuuu

SEQ ID NO: 146258 - RNA, 22 nt, Human
ggccccacgggggaguccuagu

SEQ ID NO: 146259 - RNA, 22 nt, Human
uaacacugguauuucauuuagu

SEQ ID NO: 146260 - RNA, 22 nt, Human
auccagggauaaaaguaagguu

SEQ ID NO: 146261 - RNA, 20 nt, Human
ccucaagcagacugacagcu

SEQ ID NO: 146262 - RNA, 22 nt, Human
uauugaaauucuucauguccuc

SEQ ID NO: 146263 - RNA, 22 nt, Human
cuggccacuggagguggcaccc

SEQ ID NO: 146264 - RNA, 18 nt, Human
gucuggaggucaggagcu

SEQ ID NO: 146265 - RNA, 18 nt, Human
ucugagggugcgggagcu

SEQ ID NO: 146266 - RNA, 22 nt, Human
gggcacugugcuaggugcugag

SEQ ID NO: 146267 - RNA, 23 nt, Human
aggcagagccaaggucaaaaccc

SEQ ID NO: 146268 - RNA, 23 nt, Human
uuuuaauuuggacauaagaagau

SEQ ID NO: 146269 - RNA, 22 nt, Human
gcaugguggccuuaggguagcc

SEQ ID NO: 146270 - RNA, 22 nt, Human
acaggcucucagccaguuggca

SEQ ID NO: 146271 - RNA, 22 nt, Human
ggcuggguuauuuauggccaag

SEQ ID NO: 146272 - RNA, 22 nt, Human
ccugaggggcugcaggccagcu

SEQ ID NO: 146273 - RNA, 22 nt, Human
ggcucagacucccaggcccucu

SEQ ID NO: 146274 - RNA, 22 nt, Human
agccuggaccaggggccucaga

SEQ ID NO: 146275 - RNA, 18 nt, Human
agcagagcccaugcauuc

SEQ ID NO: 146276 - RNA, 22 nt, Human
gaagccccaaacccucgccauc

SEQ ID NO: 146277 - RNA, 22 nt, Human
gggcucugggauucagagcaag

SEQ ID NO: 146278 - RNA, 22 nt, Human
ccugggcauucuuugaguucuc

SEQ ID NO: 146279 - RNA, 22 nt, Human
gccugagaaggauaggaagcga

SEQ ID NO: 146280 - RNA, 22 nt, Human
acagggcagugucuugaaaaau

SEQ ID NO: 146281 - RNA, 22 nt, Human
gaaauuauugcuagagacugca

SEQ ID NO: 146282 - RNA, 22 nt, Human
agugacucacuagcucucagug

SEQ ID NO: 146283 - RNA, 22 nt, Human
ucuguuuaggcaaaauagcuac

SEQ ID NO: 146284 - RNA, 22 nt, Human
ugggcucuccuggaggacaaca

SEQ ID NO: 146285 - RNA, 22 nt, Human
caggcugcagugcaguggcuau

SEQ ID NO: 146286 - RNA, 20 nt, Human
cccuggccuguuucaugccc

SEQ ID NO: 146287 - RNA, 22 nt, Human
agagugggccucugagucccag

SEQ ID NO: 146288 - RNA, 22 nt, Human
ugaaggaaaugacggcagaaga

SEQ ID NO: 146289 - RNA, 21 nt, Human
aaagugguaaggauuauuuug

SEQ ID NO: 146290 - RNA, 22 nt, Human
cugucaccuguucacugcagca

SEQ ID NO: 146291 - RNA, 22 nt, Human
ccacagggacuguuaaaacccu

SEQ ID NO: 146292 - RNA, 22 nt, Human
gcuguccucugaucucuggagg

SEQ ID NO: 146293 - RNA, 23 nt, Human
uucaagauacgguuuccaggcug

SEQ ID NO: 146294 - RNA, 22 nt, Human
gaggaagcagggcuuggcugag

SEQ ID NO: 146295 - RNA, 19 nt, Human
agcuggggcgguguguguu

SEQ ID NO: 146296 - RNA, 22 nt, Human
agaggccagggacacugcucaa

SEQ ID NO: 146297 - RNA, 22 nt, Human
auuucacucucccugccacuua

SEQ ID NO: 146298 - RNA, 22 nt, Human
ggccuuggugccauggccaguu

SEQ ID NO: 146299 - RNA, 23 nt, Human
cccuggccuuggggcacaggcug

SEQ ID NO: 146300 - RNA, 22 nt, Human
uguccugggaaugggaugcagu

SEQ ID NO: 146301 - RNA, 21 nt, Human
uaagaacauuaucuucuuccu

SEQ ID NO: 146302 - RNA, 20 nt, Human
cccagccccuaccuguugcc

SEQ ID NO: 146303 - RNA, 22 nt, Human
ugguaaaguguacugaauauga

SEQ ID NO: 146304 - RNA, 22 nt, Human
gaaggccauuuuuagguagaau

SEQ ID NO: 146305 - RNA, 19 nt, Human
ggaggccuggguauuugcc

SEQ ID NO: 146306 - RNA, 22 nt, Human
gccuuccuuuuaccaccagcca

SEQ ID NO: 146307 - RNA, 22 nt, Human
ugggcacuguagcuggugcugg

SEQ ID NO: 146308 - RNA, 22 nt, Human
cuucugugagucaguguuucug

SEQ ID NO: 146309 - RNA, 22 nt, Human
ugugugaccuggggugagauag

SEQ ID NO: 146310 - RNA, 22 nt, Human
guacauuuuacuuuguuugaau

SEQ ID NO: 146311 - RNA, 22 nt, Human
gggcaguggguggcugcagccu

SEQ ID NO: 146312 - RNA, 22 nt, Human
uggcugugucccuguccagagu

SEQ ID NO: 146313 - RNA, 22 nt, Human
aguauauaguggcgcuguaugc

SEQ ID NO: 146314 - RNA, 21 nt, Human
gcauguguggugugcuccaca

SEQ ID NO: 146315 - RNA, 17 nt, Human
uaucucuucaaguuuca

SEQ ID NO: 146316 - RNA, 22 nt, Human
ggcagcugagcauggcuaccuu

SEQ ID NO: 146317 - RNA, 22 nt, Human
ucagagugcagggaguagcagc

SEQ ID NO: 146318 - RNA, 22 nt, Human
agaggcccucucucuccugaug

SEQ ID NO: 146319 - RNA, 22 nt, Human
gcacagaagagcuuuggaauga

SEQ ID NO: 146320 - RNA, 22 nt, Human
uccugggcugugugccacucug

SEQ ID NO: 146321 - RNA, 22 nt, Human
acaguauauuuucuugauuguu

SEQ ID NO: 146322 - RNA, 22 nt, Human
gugcugucguggaacugggcug

SEQ ID NO: 146323 - RNA, 22 nt, Human
aggagcuguuuuguucagcaaa

SEQ ID NO: 146324 - RNA, 22 nt, Human
agagccuggcucccagcuaccg

SEQ ID NO: 146325 - RNA, 19 nt, Human
cccagagcauccugaacuu

SEQ ID NO: 146326 - RNA, 22 nt, Human
ggaugcaggacggcauggaugu

SEQ ID NO: 146327 - RNA, 22 nt, Human
agccaggggauucaucagggac

SEQ ID NO: 146328 - RNA, 22 nt, Human
aaugcugcaagaggugaaaaga

SEQ ID NO: 146329 - RNA, 22 nt, Human
ucugcaggccucgacaaggcca

SEQ ID NO: 146330 - RNA, 22 nt, Human
ccuauugacaauucucuucucc

SEQ ID NO: 146331 - RNA, 22 nt, Human
gccugucaauuuuguguacaau

SEQ ID NO: 146332 - RNA, 22 nt, Human
gcugguccacucccuggaggcu

SEQ ID NO: 146333 - RNA, 22 nt, Human
acuguuuaggaggcuuauaugc

SEQ ID NO: 146334 - RNA, 22 nt, Human
aaagaacagauguguggugcau

SEQ ID NO: 146335 - RNA, 21 nt, Human
gggcagaggggccuccugggu

SEQ ID NO: 146336 - RNA, 22 nt, Human
ccaggccuccugugaguggacc

SEQ ID NO: 146337 - RNA, 22 nt, Human
cagaagaaaguggggagacaag

SEQ ID NO: 146338 - RNA, 22 nt, Human
ugacagggcuagaggcaaugca

SEQ ID NO: 146339 - RNA, 22 nt, Human
ggucccugguucccucugagcu

SEQ ID NO: 146340 - RNA, 22 nt, Human
cugaggcuggggaagggaagug

SEQ ID NO: 146341 - RNA, 22 nt, Human
aggcucugcagaccccagcugu

SEQ ID NO: 146342 - RNA, 22 nt, Human
aaugaugguuaaacacuggagg

SEQ ID NO: 146343 - RNA, 22 nt, Human
ccuguggcacaugcagggauuc

SEQ ID NO: 146344 - RNA, 22 nt, Human
aaaacuaaauacgcuuugccuc

SEQ ID NO: 146345 - RNA, 22 nt, Human
ggaaccaggaguuacacgaguu

SEQ ID NO: 146346 - RNA, 22 nt, Human
aaggagagagcuuugcuggaac

SEQ ID NO: 146347 - RNA, 22 nt, Human
acuggacagaggaaauauggag

SEQ ID NO: 146348 - RNA, 22 nt, Human
auugucgcuuauuuaggugcuu

SEQ ID NO: 146349 - RNA, 22 nt, Human
ucagcugccuuucccaugcuag

SEQ ID NO: 146350 - RNA, 22 nt, Human
ccuggccucagacagagggugg

SEQ ID NO: 146351 - RNA, 19 nt, Human
ucaaagcaagcauguucug

SEQ ID NO: 146352 - RNA, 18 nt, Human
gucuguguggcuugggga

SEQ ID NO: 146353 - RNA, 22 nt, Human
cuauuacauuucuggacauuca

SEQ ID NO: 146354 - RNA, 22 nt, Human
aaauugcaaaaguacuuuuagg

SEQ ID NO: 146355 - RNA, 22 nt, Human
acagcuggcaggggggcaugaa

SEQ ID NO: 146356 - RNA, 22 nt, Human
ccucuggggguccucagagucu

SEQ ID NO: 146357 - RNA, 22 nt, Human
agaaacuucagcuauucuuuug

SEQ ID NO: 146358 - RNA, 22 nt, Human
cuguccugcaguugggggcagg

SEQ ID NO: 146359 - RNA, 22 nt, Human
gcuuuacauuuuggaaagguga

SEQ ID NO: 146360 - RNA, 22 nt, Human
cuguagccagaagcagaaggcc

SEQ ID NO: 146361 - RNA, 22 nt, Human
gcuuuacaacaaauugaauaug

SEQ ID NO: 146362 - RNA, 22 nt, Human
uguauguauacacugaucauca

SEQ ID NO: 146363 - RNA, 22 nt, Human
uugaagcaaauucugugcagua

SEQ ID NO: 146364 - RNA, 22 nt, Human
gcugucucggggcuuucuccug

SEQ ID NO: 146365 - RNA, 22 nt, Human
uuccuguguguugguggcagaa

SEQ ID NO: 146366 - RNA, 22 nt, Human
uagcugcccaucuuuccuuuag

SEQ ID NO: 146367 - RNA, 23 nt, Human
cucugcaggagagugggcagggc

SEQ ID NO: 146368 - RNA, 22 nt, Human
cagagaaacucagauagcugau

SEQ ID NO: 146369 - RNA, 22 nt, Human
guaacaaaguuucuaggugcug

SEQ ID NO: 146370 - RNA, 22 nt, Human
ccugccuggagcugagugugga

SEQ ID NO: 146371 - RNA, 21 nt, Human
uauuucuuugacucucucccu

SEQ ID NO: 146372 - RNA, 22 nt, Human
cacaguaucccucuuucucccc

SEQ ID NO: 146373 - RNA, 22 nt, Human
uauguguauaccuauacaugug

SEQ ID NO: 146374 - RNA, 19 nt, Human
acagggcagcaauaggaua

SEQ ID NO: 146375 - RNA, 22 nt, Human
gcagcaaucuucacagugucau

SEQ ID NO: 146376 - RNA, 22 nt, Human
gcccugcugucuucagaguaua

SEQ ID NO: 146377 - RNA, 18 nt, Human
gguggccuugacuucucu

SEQ ID NO: 146378 - RNA, 19 nt, Human
agauggggaagagugugag

SEQ ID NO: 146379 - RNA, 20 nt, Human
uauuugaaauggccaagugu

SEQ ID NO: 146380 - RNA, 20 nt, Human
uuugaacuuuguacucuguu

SEQ ID NO: 146381 - RNA, 22 nt, Human
ccuggagcuuggucacgcugcg

SEQ ID NO: 146382 - RNA, 21 nt, Human
uggcccuggccacggcugcca

SEQ ID NO: 146383 - RNA, 22 nt, Human
uuucaaacauaucuucauuacu

SEQ ID NO: 146384 - RNA, 22 nt, Human
agagugaaggccagguuacagu

SEQ ID NO: 146385 - RNA, 22 nt, Human
ugucccaguuuugcagguuaga

SEQ ID NO: 146386 - RNA, 22 nt, Human
uagaaauccccagucucauagu

SEQ ID NO: 146387 - RNA, 18 nt, Human
cuuucagauggauaugcu

SEQ ID NO: 146388 - RNA, 22 nt, Human
cccucaggagaugucagcugga

SEQ ID NO: 146389 - RNA, 21 nt, Human
ucccugcuuucuggcccaguc

SEQ ID NO: 146390 - RNA, 22 nt, Human
gaagagcuuagacagaaucaaa

SEQ ID NO: 146391 - RNA, 22 nt, Human
cuggagcauccaugcccagggu

SEQ ID NO: 146392 - RNA, 22 nt, Human
gagacauggcaaaagcacuggu

SEQ ID NO: 146393 - RNA, 22 nt, Human
cugaaggauuagagagcacuua

SEQ ID NO: 146394 - RNA, 22 nt, Human
uuugaaaguucuucugacacua

SEQ ID NO: 146395 - RNA, 22 nt, Human
gggcugccaagccugccugccu

SEQ ID NO: 146396 - RNA, 22 nt, Human
cagucccaucucccagguggcu

SEQ ID NO: 146397 - RNA, 22 nt, Human
gccuccuggccuuugcuccuca

SEQ ID NO: 146398 - RNA, 22 nt, Human
uggcucagugacauuccuccca

SEQ ID NO: 146399 - RNA, 22 nt, Human
gggcacuggaaggcucucaggc

SEQ ID NO: 146400 - RNA, 22 nt, Human
gcagacuggucuucagccuugg

SEQ ID NO: 146401 - RNA, 22 nt, Human
uuccaaagaaauugaccaagac

SEQ ID NO: 146402 - RNA, 20 nt, Human
cccagggaccugagcuccau

SEQ ID NO: 146403 - RNA, 22 nt, Human
agaccaugggcucugaagagca

SEQ ID NO: 146404 - RNA, 20 nt, Human
ugcuccaucuaaagugauua

SEQ ID NO: 146405 - RNA, 22 nt, Human
uuucuucugagaucagggagaa

SEQ ID NO: 146406 - RNA, 22 nt, Human
uguaugccuuuuucuguuguaa

SEQ ID NO: 146407 - RNA, 22 nt, Human
auguguguaaacaaguauaauu

SEQ ID NO: 146408 - RNA, 22 nt, Human
gugcagugaaaaaagaaugucc

SEQ ID NO: 146409 - RNA, 17 nt, Human
ggugaguguccaggugg

SEQ ID NO: 146410 - RNA, 22 nt, Human
uccuuccuggggucucugcugc

SEQ ID NO: 146411 - RNA, 22 nt, Human
cagcucugcugggaggaugcag

SEQ ID NO: 146412 - RNA, 22 nt, Human
ugcugcacucaccaacagauaa

SEQ ID NO: 146413 - RNA, 22 nt, Human
uggcagggucuugcuguguugc

SEQ ID NO: 146414 - RNA, 22 nt, Human
cagagcugcucaugguggccag

SEQ ID NO: 146415 - RNA, 22 nt, Human
cagggcuggcuguggcaaucuc

SEQ ID NO: 146416 - RNA, 22 nt, Human
uguuaaauguuccuuuacugga

SEQ ID NO: 146417 - RNA, 23 nt, Human
cccagcagagaugaggagggguc

SEQ ID NO: 146418 - RNA, 22 nt, Human
ggcagcugggucacaccgaucu

SEQ ID NO: 146419 - RNA, 22 nt, Human
cuguccuguggaccugaggacg

SEQ ID NO: 146420 - RNA, 22 nt, Human
guccagggaaauagcgacaggg

SEQ ID NO: 146421 - RNA, 22 nt, Human
ucgugucagaucagagguuccu

SEQ ID NO: 146422 - RNA, 22 nt, Human
cuguccuggagggcauaggacg

SEQ ID NO: 146423 - RNA, 22 nt, Human
uggagccaaggccaguucucag

SEQ ID NO: 146424 - RNA, 22 nt, Human
ccagugcacagccaggcaggug

SEQ ID NO: 146425 - RNA, 22 nt, Human
agccuggagcuugaguuaugag

SEQ ID NO: 146426 - RNA, 22 nt, Human
aggaccaacauagcagcagugg

SEQ ID NO: 146427 - RNA, 22 nt, Human
acuguacuguguauuguagaau

SEQ ID NO: 146428 - RNA, 22 nt, Human
gccuggagccucagcaaggagg

SEQ ID NO: 146429 - RNA, 22 nt, Human
uccugccuucauacugcuguau

SEQ ID NO: 146430 - RNA, 22 nt, Human
uucauucuugggaucagagagu

SEQ ID NO: 146431 - RNA, 22 nt, Human
uugacuuuaaagcuuugucucu

SEQ ID NO: 146432 - RNA, 22 nt, Human
gcuguggcuccaauggugagcc

SEQ ID NO: 146433 - RNA, 22 nt, Human
ggcagcuguaagaugagugaau

SEQ ID NO: 146434 - RNA, 22 nt, Human
caguaaauaguggagauguggg

SEQ ID NO: 146435 - RNA, 22 nt, Human
cucugugauuuugugagccaga

SEQ ID NO: 146436 - RNA, 22 nt, Human
agcccaaggcuucccugcuggc

SEQ ID NO: 146437 - RNA, 22 nt, Human
ggagcuguucaggacugcuuca

SEQ ID NO: 146438 - RNA, 22 nt, Human
aacuguuuggaacucuuccaca

SEQ ID NO: 146439 - RNA, 22 nt, Human
ugggggugugccagggaccucc

SEQ ID NO: 146440 - RNA, 22 nt, Human
cucaggaggaggaaguucauug

SEQ ID NO: 146441 - RNA, 22 nt, Human
caggagugaaaugaggcccagg

SEQ ID NO: 146442 - RNA, 18 nt, Human
agugugugcccuuucagg

SEQ ID NO: 146443 - RNA, 22 nt, Human
agagccaggaucuguuuugggg

SEQ ID NO: 146444 - RNA, 21 nt, Human
gagugcagcaagguagagucu

SEQ ID NO: 146445 - RNA, 22 nt, Human
ucccagagaagagcuggaugga

SEQ ID NO: 146446 - RNA, 22 nt, Human
gagcacagccaaaguaagaagg

SEQ ID NO: 146447 - RNA, 22 nt, Human
cauuuguacagaacagcuuuau

SEQ ID NO: 146448 - RNA, 22 nt, Human
gcccucugcuggccucaccucg

SEQ ID NO: 146449 - RNA, 22 nt, Human
uaauuuacuugcaaauaacaau

SEQ ID NO: 146450 - RNA, 22 nt, Human
ggcucaggagaggggcuaaaag

SEQ ID NO: 146451 - RNA, 21 nt, Human
gccauuguuuucuaccuggag

SEQ ID NO: 146452 - RNA, 22 nt, Human
ugaaggcccagccacagaaugg

SEQ ID NO: 146453 - RNA, 22 nt, Human
caagaacaguuugccaaauugg

SEQ ID NO: 146454 - RNA, 22 nt, Human
gcccugugcgacucuagagguu

SEQ ID NO: 146455 - RNA, 22 nt, Human
uccugggccuguacuccauccg

SEQ ID NO: 146456 - RNA, 22 nt, Human
ugggcuggcguggagaguuuag

SEQ ID NO: 146457 - RNA, 23 nt, Human
gcccaugcuguugggcccgagca

SEQ ID NO: 146458 - RNA, 22 nt, Human
cacagagagcuacgugcagcgu

SEQ ID NO: 146459 - RNA, 22 nt, Human
gccuggagaccugcuccucuac

SEQ ID NO: 146460 - RNA, 22 nt, Human
agcacagauucugaagaguccu

SEQ ID NO: 146461 - RNA, 22 nt, Human
gugucaugggguuuguuauaca

SEQ ID NO: 146462 - RNA, 22 nt, Human
gguucacacuaagcuuaagugg

SEQ ID NO: 146463 - RNA, 22 nt, Human
aaggcacuugcccagagcugca

SEQ ID NO: 146464 - RNA, 22 nt, Human
cucuugggagugcucuggagaa

SEQ ID NO: 146465 - RNA, 22 nt, Human
aggagagagaacacuugggucc

SEQ ID NO: 146466 - RNA, 22 nt, Human
uuauuuauucauucugucuguc

SEQ ID NO: 146467 - RNA, 22 nt, Human
cagcccuggaacagcugacuca

SEQ ID NO: 146468 - RNA, 23 nt, Human
acacaaggguaacugccagccau

SEQ ID NO: 146469 - RNA, 21 nt, Human
agagaagaggacuuucucaca

SEQ ID NO: 146470 - RNA, 22 nt, Human
acacuaaugagaaaggaauuaa

SEQ ID NO: 146471 - RNA, 19 nt, Human
uagucuuuauucuuaauuu

SEQ ID NO: 146472 - RNA, 22 nt, Human
agccuucauaaucuugggcuuu

SEQ ID NO: 146473 - RNA, 22 nt, Human
cuguacaucccgagagccagua

SEQ ID NO: 146474 - RNA, 19 nt, Human
ucucucuguacauuagaua

SEQ ID NO: 146475 - RNA, 22 nt, Human
uaaaacuuaacuauccagauua

SEQ ID NO: 146476 - RNA, 21 nt, Human
auugaaagucaacaaucaguu

SEQ ID NO: 146477 - RNA, 22 nt, Human
ucacaggguaucugggauggau

SEQ ID NO: 146478 - RNA, 22 nt, Human
cagggcugcuggccgugcccuc

SEQ ID NO: 146479 - RNA, 22 nt, Human
cuggggcugcggacgggagccc

SEQ ID NO: 146480 - RNA, 22 nt, Human
aguggcuguuccaggugaggac

SEQ ID NO: 146481 - RNA, 22 nt, Human
guccuggggauuauagaguguu

SEQ ID NO: 146482 - RNA, 22 nt, Human
ggagccagagggaugcaguuga

SEQ ID NO: 146483 - RNA, 22 nt, Human
uguucaauccccagguccugaa

SEQ ID NO: 146484 - RNA, 22 nt, Human
cacagcuuaugccacugauugg

SEQ ID NO: 146485 - RNA, 21 nt, Human
aaagaacaggcagauguucuu

SEQ ID NO: 146486 - RNA, 19 nt, Human
cuuauacagauuuucucau

SEQ ID NO: 146487 - RNA, 22 nt, Human
auucaagagcccauguuuccug

SEQ ID NO: 146488 - RNA, 22 nt, Human
uacuaucucuucuaacuucaga

SEQ ID NO: 146489 - RNA, 22 nt, Human
gagacugcauuguccaaggguu

SEQ ID NO: 146490 - RNA, 22 nt, Human
auacuguuuugugacuuaucuu

SEQ ID NO: 146491 - RNA, 22 nt, Human
uacugugugacccuggguaggu

SEQ ID NO: 146492 - RNA, 22 nt, Human
ugcagcugauuaaagggcagac

SEQ ID NO: 146493 - RNA, 23 nt, Human
uuguuuuuagagguggcaugaga

SEQ ID NO: 146494 - RNA, 22 nt, Human
cuggcuggcaaguagaacacaa

SEQ ID NO: 146495 - RNA, 22 nt, Human
uccugccuaccuugcggaggug

SEQ ID NO: 146496 - RNA, 22 nt, Human
ucucaggccccugaguuucucu

SEQ ID NO: 146497 - RNA, 22 nt, Human
gguggagcuggaccaggagagg

SEQ ID NO: 146498 - RNA, 22 nt, Human
uguaggccuauguccagcaauu

SEQ ID NO: 146499 - RNA, 22 nt, Human
cacacaugaaucccuaguaccu

SEQ ID NO: 146500 - RNA, 22 nt, Human
agagcccucucauuggcuuauu

SEQ ID NO: 146501 - RNA, 22 nt, Human
uccugagauguggagcuccaug

SEQ ID NO: 146502 - RNA, 22 nt, Human
agauuuccugcacugccuuuga

SEQ ID NO: 146503 - RNA, 22 nt, Human
agcugcugagccaggcugaugu

SEQ ID NO: 146504 - RNA, 22 nt, Human
agugcagugguuaggagccagg

SEQ ID NO: 146505 - RNA, 22 nt, Human
auagaaauggcagcuggugcua

SEQ ID NO: 146506 - RNA, 22 nt, Human
cauuagaagaacaguuauauua

SEQ ID NO: 146507 - RNA, 22 nt, Human
cagccagguaugggcgugcggg

SEQ ID NO: 146508 - RNA, 22 nt, Human
aauaacaggcucaucagaugcu

SEQ ID NO: 146509 - RNA, 22 nt, Human
aggcugccuguuccaaucuccu

SEQ ID NO: 146510 - RNA, 22 nt, Human
uuucuucucacccaggacagag

SEQ ID NO: 146511 - RNA, 22 nt, Human
ccagggcaauaggaacacuuuu

SEQ ID NO: 146512 - RNA, 22 nt, Human
auauuuucacagaacuugcaaa

SEQ ID NO: 146513 - RNA, 22 nt, Human
gucuucaauagagccucaauuu

SEQ ID NO: 146514 - RNA, 20 nt, Human
cucuuuacaugucucuuccu

SEQ ID NO: 146515 - RNA, 17 nt, Human
uuucuccuuccaucuca

SEQ ID NO: 146516 - RNA, 22 nt, Human
ccucucuuggccgcagucuucu

SEQ ID NO: 146517 - RNA, 22 nt, Human
uucuacagaauaaauguuuaca

SEQ ID NO: 146518 - RNA, 22 nt, Human
cuccagggagcugcgggagcca

SEQ ID NO: 146519 - RNA, 22 nt, Human
ccagggcaacgcugucucagag

SEQ ID NO: 146520 - RNA, 22 nt, Human
auuaaaagcuucccaagaguua

SEQ ID NO: 146521 - RNA, 22 nt, Human
auguuucuaaaacuugcauggc

SEQ ID NO: 146522 - RNA, 22 nt, Human
uuucacaggaugcuguuuuaua

SEQ ID NO: 146523 - RNA, 22 nt, Human
uccaguucuaggucacucucug

SEQ ID NO: 146524 - RNA, 21 nt, Human
uuacuuuugcagcaaccuaau

SEQ ID NO: 146525 - RNA, 22 nt, Human
ugcuggggagugauugaccauc

SEQ ID NO: 146526 - RNA, 22 nt, Human
gcaguggggcgcugggaguugg

SEQ ID NO: 146527 - RNA, 22 nt, Human
gggcuguguaucaguuaucuau

SEQ ID NO: 146528 - RNA, 22 nt, Human
ugugugcacugccuuuugugga

SEQ ID NO: 146529 - RNA, 22 nt, Human
agagugaaguaauuguuaggau

SEQ ID NO: 146530 - RNA, 21 nt, Human
cagaggccucaugcucugugc

SEQ ID NO: 146531 - RNA, 22 nt, Human
agggaaaggcugaugcuguggg

SEQ ID NO: 146532 - RNA, 22 nt, Human
aaacuguaagagaauaaacuac

SEQ ID NO: 146533 - RNA, 22 nt, Human
cagcucugugggagcguaugug

SEQ ID NO: 146534 - RNA, 19 nt, Human
caguggccuggaggucucu

SEQ ID NO: 146535 - RNA, 22 nt, Human
gaggugggaugugugugcuacu

SEQ ID NO: 146536 - RNA, 22 nt, Human
ucagagucucccccaguuuggg

SEQ ID NO: 146537 - RNA, 22 nt, Human
ugugucccuuggaaccucagcu

SEQ ID NO: 146538 - RNA, 22 nt, Human
agcugccugggcuuguacaccu

SEQ ID NO: 146539 - RNA, 22 nt, Human
ucauuuacaugucuuucucuga

SEQ ID NO: 146540 - RNA, 22 nt, Human
ucaggggacagccagcuggagg

SEQ ID NO: 146541 - RNA, 22 nt, Human
ucagaagccggaagugcuccuc

SEQ ID NO: 146542 - RNA, 22 nt, Human
gcucugcugaagccccuugcau

SEQ ID NO: 146543 - RNA, 22 nt, Human
aagcagaauuucccacuaguug

SEQ ID NO: 146544 - RNA, 22 nt, Human
cugucuguuucugauucaaccu

SEQ ID NO: 146545 - RNA, 22 nt, Human
ucuuuccaaguaauacuuccca

SEQ ID NO: 146546 - RNA, 21 nt, Human
uggcucaguugcugggcacag

SEQ ID NO: 146547 - RNA, 21 nt, Human
uccagggaacuucucaggaau

SEQ ID NO: 146548 - RNA, 22 nt, Human
augaaauaucuugaagaaauuc

SEQ ID NO: 146549 - RNA, 22 nt, Human
ccagccaggcauugcaaacuga

SEQ ID NO: 146550 - RNA, 20 nt, Human
cuucuucauuaacccuacug

SEQ ID NO: 146551 - RNA, 22 nt, Human
gcagaggcaaucagguaugugg

SEQ ID NO: 146552 - RNA, 22 nt, Human
aggcuguggaugcuuaacaaau

SEQ ID NO: 146553 - RNA, 22 nt, Human
guguuccauguuugagguaguu

SEQ ID NO: 146554 - RNA, 22 nt, Human
ccagcagggcagugcccuggac

SEQ ID NO: 146555 - RNA, 22 nt, Human
ggccugagcagacagcaugaug

SEQ ID NO: 146556 - RNA, 22 nt, Human
uaugugugcauguauacauuaa

SEQ ID NO: 146557 - RNA, 22 nt, Human
agugacagcugggaaggugaaa

SEQ ID NO: 146558 - RNA, 18 nt, Human
uccucucuuuccccaggg

SEQ ID NO: 146559 - RNA, 22 nt, Human
gccuggagcagacgugucccgg

SEQ ID NO: 146560 - RNA, 22 nt, Human
aaauguguuugauaggaauauu

SEQ ID NO: 146561 - RNA, 18 nt, Human
agucucagcggaggagua

SEQ ID NO: 146562 - RNA, 22 nt, Human
aagcccagaugugagaacugag

SEQ ID NO: 146563 - RNA, 22 nt, Human
ccucuccuugcacccgucccgc

SEQ ID NO: 146564 - RNA, 22 nt, Human
cuggaagguuccucccagcucc

SEQ ID NO: 146565 - RNA, 19 nt, Human
cagcucaguuugauucucu

SEQ ID NO: 146566 - RNA, 23 nt, Human
uuuuccagaaucgacucuguaga

SEQ ID NO: 146567 - RNA, 23 nt, Human
agcagccauagggaagcaauaca

SEQ ID NO: 146568 - RNA, 23 nt, Human
uggccugcagaguuucugcuggg

SEQ ID NO: 146569 - RNA, 22 nt, Human
ggcuucccaaggagccaggaug

SEQ ID NO: 146570 - RNA, 22 nt, Human
cuugaaguugcaaaacauuaau

SEQ ID NO: 146571 - RNA, 22 nt, Human
gagacagcagggccagggccug

SEQ ID NO: 146572 - RNA, 22 nt, Human
uucuuuugggaauuacguaugc

SEQ ID NO: 146573 - RNA, 19 nt, Human
ucccuuccugucgggcucc

SEQ ID NO: 146574 - RNA, 22 nt, Human
aggagcugagggagcgcccuug

SEQ ID NO: 146575 - RNA, 22 nt, Human
aggcugaggcagguggaucauu

SEQ ID NO: 146576 - RNA, 22 nt, Human
uucucuuugacauuauucaggu

SEQ ID NO: 146577 - RNA, 22 nt, Human
ccacagcaugcaggccugacac

SEQ ID NO: 146578 - RNA, 22 nt, Human
ggcuuccuuucacuacccucag

SEQ ID NO: 146579 - RNA, 20 nt, Human
gcauugaguauagacagaug

SEQ ID NO: 146580 - RNA, 22 nt, Human
aaggacagaaacagauugcugg

SEQ ID NO: 146581 - RNA, 22 nt, Human
uggacucagugcugccauuccc

SEQ ID NO: 146582 - RNA, 22 nt, Human
cagccccucacagagcuguccu

SEQ ID NO: 146583 - RNA, 22 nt, Human
uuucuagggcucuugucuucug

SEQ ID NO: 146584 - RNA, 22 nt, Human
agauacaucauuuauaccuuca

SEQ ID NO: 146585 - RNA, 22 nt, Human
acaaaugcagcauaaagugaac

SEQ ID NO: 146586 - RNA, 22 nt, Human
agggagcugcucugcuuccgug

SEQ ID NO: 146587 - RNA, 22 nt, Human
gcagcugccccgacugugaguc

SEQ ID NO: 146588 - RNA, 16 nt, Human
uguuagcugugcauua

SEQ ID NO: 146589 - RNA, 22 nt, Human
caaaugcauaguuuauaagaag

SEQ ID NO: 146590 - RNA, 20 nt, Human
aaggcacuaugucugcuagc

SEQ ID NO: 146591 - RNA, 18 nt, Human
ccuggcuuccaucuuggu

SEQ ID NO: 146592 - RNA, 22 nt, Human
aaagauuauggcauugaaauac

SEQ ID NO: 146593 - RNA, 22 nt, Human
uacacacagaggccaugggauu

SEQ ID NO: 146594 - RNA, 22 nt, Human
ccaggaugacccccacuuuccu

SEQ ID NO: 146595 - RNA, 22 nt, Human
cgcuguguuuacaucauugcug

SEQ ID NO: 146596 - RNA, 22 nt, Human
aggcacagcacaccuggccccc

SEQ ID NO: 146597 - RNA, 22 nt, Human
gcagcugccgugagcucacgcc

SEQ ID NO: 146598 - RNA, 22 nt, Human
uuugugugcgucuggccugggg

SEQ ID NO: 146599 - RNA, 22 nt, Human
accucugcaguagggcugugcc

SEQ ID NO: 146600 - RNA, 22 nt, Human
aggagccaggaaaccugcucug

SEQ ID NO: 146601 - RNA, 22 nt, Human
ucugaggcuauguucaggcuaa

SEQ ID NO: 146602 - RNA, 22 nt, Human
gugcuguaacaacagagugucu

SEQ ID NO: 146603 - RNA, 22 nt, Human
augaaacaugagaaauggagag

SEQ ID NO: 146604 - RNA, 22 nt, Human
ucugagugagggugugagauau

SEQ ID NO: 146605 - RNA, 20 nt, Human
cuucaggacccauccucccc

SEQ ID NO: 146606 - RNA, 18 nt, Human
cagaugagaugcaaucuc

SEQ ID NO: 146607 - RNA, 22 nt, Human
ucucugguuauuaacuaacucc

SEQ ID NO: 146608 - RNA, 22 nt, Human
ugaguguguauuauguaucagg

SEQ ID NO: 146609 - RNA, 22 nt, Human
agggacacacuccaguguuauu

SEQ ID NO: 146610 - RNA, 22 nt, Human
gugggugugguucguuuaagac

SEQ ID NO: 146611 - RNA, 22 nt, Human
auguggcuaguccaauuaauga

SEQ ID NO: 146612 - RNA, 22 nt, Human
uuacuuuggauggucaagaaag

SEQ ID NO: 146613 - RNA, 22 nt, Human
acuuuauuuccuauugcaucca

SEQ ID NO: 146614 - RNA, 22 nt, Human
uagaguauauaggccuuugugu

SEQ ID NO: 146615 - RNA, 22 nt, Human
guuucucuuugaagccuggcug

SEQ ID NO: 146616 - RNA, 22 nt, Human
aaacagaaggguagguaaacau

SEQ ID NO: 146617 - RNA, 22 nt, Human
cuucucucccuggcacucagac

SEQ ID NO: 146618 - RNA, 22 nt, Human
ugucaugccaggaaauaguccc

SEQ ID NO: 146619 - RNA, 22 nt, Human
agggggcccuugcaggugagcg

SEQ ID NO: 146620 - RNA, 22 nt, Human
cuggagggugagccucaucucu

SEQ ID NO: 146621 - RNA, 21 nt, Human
uccucugcagugagguggccu

SEQ ID NO: 146622 - RNA, 22 nt, Human
acaguaaagccuucugguugac

SEQ ID NO: 146623 - RNA, 22 nt, Human
ugcucuucggggccacugcuug

SEQ ID NO: 146624 - RNA, 22 nt, Human
gucccugcccuccugggacuca

SEQ ID NO: 146625 - RNA, 22 nt, Human
agagccuggaccugagcuacaa

SEQ ID NO: 146626 - RNA, 22 nt, Human
gcucccagggaccgcagggcag

SEQ ID NO: 146627 - RNA, 22 nt, Human
ccucagggucugaggagaccgu

SEQ ID NO: 146628 - RNA, 22 nt, Human
ggcuggagauaugucuggaaca

SEQ ID NO: 146629 - RNA, 22 nt, Human
ggcuggaaguccaagaucaagg

SEQ ID NO: 146630 - RNA, 22 nt, Human
ucagagcuuuggagaccaggaa

SEQ ID NO: 146631 - RNA, 22 nt, Human
agggccugacacccuugccagc

SEQ ID NO: 146632 - RNA, 22 nt, Human
cagcuuugauucuuucugccau

SEQ ID NO: 146633 - RNA, 22 nt, Human
cuggcuguggauuaucacaggc

SEQ ID NO: 146634 - RNA, 22 nt, Human
gggacugggagauccuccuggc

SEQ ID NO: 146635 - RNA, 22 nt, Human
caggccugaguguggaagucuu

SEQ ID NO: 146636 - RNA, 22 nt, Human
ucaaaaguuucacauagagaua

SEQ ID NO: 146637 - RNA, 21 nt, Human
ucuugaaaauuguagcaguuu

SEQ ID NO: 146638 - RNA, 22 nt, Human
cagcugccacaggacuuucuga

SEQ ID NO: 146639 - RNA, 22 nt, Human
cccagcucucugcucuuagccu

SEQ ID NO: 146640 - RNA, 22 nt, Human
accaucagagcacaguccgugc

SEQ ID NO: 146641 - RNA, 22 nt, Human
agcagcugccagagagaguucc

SEQ ID NO: 146642 - RNA, 22 nt, Human
caugcuuuaccaaagcagugau

SEQ ID NO: 146643 - RNA, 22 nt, Human
ggacugugaggucugggugagg

SEQ ID NO: 146644 - RNA, 22 nt, Human
cauguacauucuguagauggag

SEQ ID NO: 146645 - RNA, 21 nt, Human
aggccucuucauggccaugau

SEQ ID NO: 146646 - RNA, 22 nt, Human
auauuucuccaaauguuuucaa

SEQ ID NO: 146647 - RNA, 22 nt, Human
auaaaacuuauuagaauugugu

SEQ ID NO: 146648 - RNA, 22 nt, Human
aucuaagaguuaacaucaagaa

SEQ ID NO: 146649 - RNA, 22 nt, Human
uaggcaggugugcacugcccac

SEQ ID NO: 146650 - RNA, 22 nt, Human
auucucuguagauggcuugaga

SEQ ID NO: 146651 - RNA, 22 nt, Human
uaacguuugauaacuucuguuc

SEQ ID NO: 146652 - RNA, 22 nt, Human
cacauuucucuaccucacacaa

SEQ ID NO: 146653 - RNA, 22 nt, Human
gggaguggauuauguggaccca

SEQ ID NO: 146654 - RNA, 22 nt, Human
agcucccagucuccucuccaug

SEQ ID NO: 146655 - RNA, 22 nt, Human
agcugcuccuuuccugcaggcg

SEQ ID NO: 146656 - RNA, 22 nt, Human
uuuuaagaugcuaguauuucag

SEQ ID NO: 146657 - RNA, 22 nt, Human
acagagcauauaaagugcuuug

SEQ ID NO: 146658 - RNA, 22 nt, Human
uuccauauuuguguggcaaaag

SEQ ID NO: 146659 - RNA, 22 nt, Human
ggaggccacgguuuagcaccga

SEQ ID NO: 146660 - RNA, 20 nt, Human
gccuggaggcaaugggaaga

SEQ ID NO: 146661 - RNA, 22 nt, Human
caguggucugugcuucuguaca

SEQ ID NO: 146662 - RNA, 21 nt, Human
guggcccugccgcagugucca

SEQ ID NO: 146663 - RNA, 22 nt, Human
aucuggcucccuuggaauccgu

SEQ ID NO: 146664 - RNA, 22 nt, Human
uucucuccuacccaguauccau

SEQ ID NO: 146665 - RNA, 22 nt, Human
caagagcucagaaacccuugcu

SEQ ID NO: 146666 - RNA, 22 nt, Human
uaaaauagcaugugcagugaaa

SEQ ID NO: 146667 - RNA, 22 nt, Human
aauaaacugcucaauugcauca

SEQ ID NO: 146668 - RNA, 22 nt, Human
ggcagcugauuagcaucaagga

SEQ ID NO: 146669 - RNA, 22 nt, Human
uuauauuucugguagccuucag

SEQ ID NO: 146670 - RNA, 22 nt, Human
gcacugaaugccaaaguguagg

SEQ ID NO: 146671 - RNA, 22 nt, Human
cccugcagaaccacagacaaac

SEQ ID NO: 146672 - RNA, 22 nt, Human
caauagcagcuucugaaugcaa

SEQ ID NO: 146673 - RNA, 22 nt, Human
ugggcagaguagcucagaagaa

SEQ ID NO: 146674 - RNA, 22 nt, Human
cuacaguaugaaaccuuuacuc

SEQ ID NO: 146675 - RNA, 22 nt, Human
agggccagaggcaccuugcagc

SEQ ID NO: 146676 - RNA, 22 nt, Human
gccaggcuggaaagaacagaca

SEQ ID NO: 146677 - RNA, 22 nt, Human
cagguacacucccuugugcuga

SEQ ID NO: 146678 - RNA, 22 nt, Human
ggagugacucucggggccacua

SEQ ID NO: 146679 - RNA, 22 nt, Human
ggccucucauguccugggcuuc

SEQ ID NO: 146680 - RNA, 22 nt, Human
auacaucuaugccuuucugaca

SEQ ID NO: 146681 - RNA, 22 nt, Human
gucagcugucuccccagagugg

SEQ ID NO: 146682 - RNA, 22 nt, Human
gucugcccucacgccagcuggg

SEQ ID NO: 146683 - RNA, 22 nt, Human
caguuucuguuuuaaauagcag

SEQ ID NO: 146684 - RNA, 22 nt, Human
ugugcccauuacacagaggcau

SEQ ID NO: 146685 - RNA, 21 nt, Human
ggucagggggugccuccaggu

SEQ ID NO: 146686 - RNA, 22 nt, Human
uuauuugccagaauuucucuug

SEQ ID NO: 146687 - RNA, 22 nt, Human
acuuuucugcagaugaucucuu

SEQ ID NO: 146688 - RNA, 23 nt, Human
uuuauccaacucuguaaucucuc

SEQ ID NO: 146689 - RNA, 22 nt, Human
uagggcagcugcaucaggcacu

SEQ ID NO: 146690 - RNA, 22 nt, Human
agggccagagucuguguagaua

SEQ ID NO: 146691 - RNA, 23 nt, Human
uccagcagccaagaaggguagaa

SEQ ID NO: 146692 - RNA, 22 nt, Human
acugugugacuguuauuacugu

SEQ ID NO: 146693 - RNA, 18 nt, Human
ggccugaggauuucagca

SEQ ID NO: 146694 - RNA, 22 nt, Human
gagagcuggauucuggauaggu

SEQ ID NO: 146695 - RNA, 22 nt, Human
uugauacaggcucuauuucauc

SEQ ID NO: 146696 - RNA, 22 nt, Human
caggacagguguucuagaucag

SEQ ID NO: 146697 - RNA, 22 nt, Human
cuggagcuggcuuccuuccacu

SEQ ID NO: 146698 - RNA, 20 nt, Human
gcuguggcaaagcuuugugu

SEQ ID NO: 146699 - RNA, 22 nt, Human
guccugucccccaaggcugugg

SEQ ID NO: 146700 - RNA, 22 nt, Human
ucugugacuugcgggaggagaa

SEQ ID NO: 146701 - RNA, 22 nt, Human
uuuguguguauauccuuccaga

SEQ ID NO: 146702 - RNA, 23 nt, Human
ugucccagagggagggauaggcu

SEQ ID NO: 146703 - RNA, 22 nt, Human
auaagguaugaaaaguaaaugg

SEQ ID NO: 146704 - RNA, 22 nt, Human
cugugucuccuuggugggauau

SEQ ID NO: 146705 - RNA, 22 nt, Human
ggcugcagauagccagccacca

SEQ ID NO: 146706 - RNA, 22 nt, Human
ucaguuuuuguuugccagauag

SEQ ID NO: 146707 - RNA, 22 nt, Human
gaguuauuuguagggauuauau

SEQ ID NO: 146708 - RNA, 22 nt, Human
uaacacacugaaggugagaugg

SEQ ID NO: 146709 - RNA, 22 nt, Human
caggaacaauguaagucucauu

SEQ ID NO: 146710 - RNA, 22 nt, Human
ccuguggcucucuuuggagguc

SEQ ID NO: 146711 - RNA, 22 nt, Human
uggcucugcagcagugugcgug

SEQ ID NO: 146712 - RNA, 22 nt, Human
ccuggaagauucaccacuacca

SEQ ID NO: 146713 - RNA, 22 nt, Human
acaaauauuuacugaauccacu

SEQ ID NO: 146714 - RNA, 22 nt, Human
uacaguauagaauguguauuaa

SEQ ID NO: 146715 - RNA, 22 nt, Human
gucuugaucuccugaccuugug

SEQ ID NO: 146716 - RNA, 22 nt, Human
uuuagaaauucaucuauggccu

SEQ ID NO: 146717 - RNA, 22 nt, Human
uucauucugggcucuaaggaac

SEQ ID NO: 146718 - RNA, 22 nt, Human
gaaggaaaucugugauuuaugc

SEQ ID NO: 146719 - RNA, 19 nt, Human
ugcagccacgugagagacu

SEQ ID NO: 146720 - RNA, 22 nt, Human
caagaugggcaccccagcaccu

SEQ ID NO: 146721 - RNA, 22 nt, Human
uguguauuucuggaacagacua

SEQ ID NO: 146722 - RNA, 22 nt, Human
ucaguguccggagccugagugc

SEQ ID NO: 146723 - RNA, 19 nt, Human
ugcagcucagggcaggggc

SEQ ID NO: 146724 - RNA, 23 nt, Human
ugucuggcucauggugggucuca

SEQ ID NO: 146725 - RNA, 22 nt, Human
uugauguacagaauuguucaca

SEQ ID NO: 146726 - RNA, 19 nt, Human
ucaguauauaauuacacca

SEQ ID NO: 146727 - RNA, 22 nt, Human
ggcaggagcucuccaguuugcc

SEQ ID NO: 146728 - RNA, 22 nt, Human
cagccuccugggacacucaccg

SEQ ID NO: 146729 - RNA, 22 nt, Human
ccugugugauuggaagcugaga

SEQ ID NO: 146730 - RNA, 22 nt, Human
ugucccauggacacaacuucuu

SEQ ID NO: 146731 - RNA, 20 nt, Human
aagaaacuugaaaguacaag

SEQ ID NO: 146732 - RNA, 21 nt, Human
ugcuucucuagaucaacuacu

SEQ ID NO: 146733 - RNA, 22 nt, Human
gccuggagaagauggaacuagc

SEQ ID NO: 146734 - RNA, 22 nt, Human
guggcugcucgggcuccggccc

SEQ ID NO: 146735 - RNA, 18 nt, Human
aguggucuguuauaucau

SEQ ID NO: 146736 - RNA, 22 nt, Human
aggggcuguggaaaccaacucu

SEQ ID NO: 146737 - RNA, 22 nt, Human
ugugaaggagaugaagggagug

SEQ ID NO: 146738 - RNA, 22 nt, Human
aguggugcugcgcgcggagcuc

SEQ ID NO: 146739 - RNA, 22 nt, Human
cugaagagcucuccuguccccu

SEQ ID NO: 146740 - RNA, 23 nt, Human
uauguguaaggagaaggagugag

SEQ ID NO: 146741 - RNA, 22 nt, Human
cacaggagcuguggggcagugu

SEQ ID NO: 146742 - RNA, 22 nt, Human
ccagguggcuucugcccgaugu

SEQ ID NO: 146743 - RNA, 22 nt, Human
acacagccgugaaucugcuucu

SEQ ID NO: 146744 - RNA, 21 nt, Human
ugcaugcuauguuuuuauuuc

SEQ ID NO: 146745 - RNA, 22 nt, Human
cagagcugacccaaggauugaa

SEQ ID NO: 146746 - RNA, 22 nt, Human
agcgggugcugugucagcccuc

SEQ ID NO: 146747 - RNA, 23 nt, Human
aggcccugccugucccucuuuuu

SEQ ID NO: 146748 - RNA, 22 nt, Human
uguguacucaauugagccauuu

SEQ ID NO: 146749 - RNA, 22 nt, Human
gcugugauguggagggugcuga

SEQ ID NO: 146750 - RNA, 22 nt, Human
uguauauugccugagucuuucc

SEQ ID NO: 146751 - RNA, 22 nt, Human
gggaguggguuuggccuaggcc

SEQ ID NO: 146752 - RNA, 22 nt, Human
uuaaacaguguuucaugugggg

SEQ ID NO: 146753 - RNA, 22 nt, Human
uucucuacuugagauuuuaaug

SEQ ID NO: 146754 - RNA, 22 nt, Human
augcaguacauacaaacacuga

SEQ ID NO: 146755 - RNA, 22 nt, Human
cacugcaguaacucuaggacug

SEQ ID NO: 146756 - RNA, 22 nt, Human
auuguaaguagaaauguuaugg

SEQ ID NO: 146757 - RNA, 22 nt, Human
uaacagaagagcaggcagcccu

SEQ ID NO: 146758 - RNA, 23 nt, Human
aucucucugguggucacagucag

SEQ ID NO: 146759 - RNA, 22 nt, Human
acuuuguauaagacaauaaaga

SEQ ID NO: 146760 - RNA, 22 nt, Human
uucagugugugauaccugcugu

SEQ ID NO: 146761 - RNA, 22 nt, Human
auggggugagacuaggauuaaa

SEQ ID NO: 146762 - RNA, 22 nt, Human
uggcugggccgggccuugugcc

SEQ ID NO: 146763 - RNA, 21 nt, Human
ucagggcagcugcucuucaga

SEQ ID NO: 146764 - RNA, 22 nt, Human
gaguggggcccacugcugggug

SEQ ID NO: 146765 - RNA, 22 nt, Human
ccagcuggcaggagagucaggg

SEQ ID NO: 146766 - RNA, 22 nt, Human
agcagcauaucagagaaaguca

SEQ ID NO: 146767 - RNA, 22 nt, Human
ccagucccagcucugccaugcu

SEQ ID NO: 146768 - RNA, 22 nt, Human
gauggcagucaaccaggugagg

SEQ ID NO: 146769 - RNA, 22 nt, Human
uauguucugucuguacagauuu

SEQ ID NO: 146770 - RNA, 22 nt, Human
acugggccggugcagaguaguu

SEQ ID NO: 146771 - RNA, 22 nt, Human
cugggcuguucugccccugggu

SEQ ID NO: 146772 - RNA, 22 nt, Human
uuucacagcagugugcugcuuu

SEQ ID NO: 146773 - RNA, 22 nt, Human
uugaccauaccuccaggcaguu

SEQ ID NO: 146774 - RNA, 20 nt, Human
ccagacagcaccugccuggu

SEQ ID NO: 146775 - RNA, 22 nt, Human
guggaaugaauagauuugcauu

SEQ ID NO: 146776 - RNA, 22 nt, Human
uuucaauguaacauuuccaggc

SEQ ID NO: 146777 - RNA, 22 nt, Human
guggcuguauagccaagucaga

SEQ ID NO: 146778 - RNA, 22 nt, Human
acaugcuuucuagguccuucug

SEQ ID NO: 146779 - RNA, 19 nt, Human
ugagaaggcaguggggagc

SEQ ID NO: 146780 - RNA, 22 nt, Human
acagaacugcaggaggaaaagc

SEQ ID NO: 146781 - RNA, 22 nt, Human
agggcagacuaggauggaagug

SEQ ID NO: 146782 - RNA, 22 nt, Human
agaugcugucacacacacuguu

SEQ ID NO: 146783 - RNA, 22 nt, Human
ucugcucugggccagcuauuaa

SEQ ID NO: 146784 - RNA, 17 nt, Human
auguggcuaagcugcug

SEQ ID NO: 146785 - RNA, 21 nt, Human
uucuucuuggacuguuuuggc

SEQ ID NO: 146786 - RNA, 22 nt, Human
gucaggaucaaauugaaguuau

SEQ ID NO: 146787 - RNA, 22 nt, Human
agcuggccuccgggugccuggg

SEQ ID NO: 146788 - RNA, 22 nt, Human
gcagggacaccuuugugaagcu

SEQ ID NO: 146789 - RNA, 22 nt, Human
acaggcugcccgcuccccaccu

SEQ ID NO: 146790 - RNA, 22 nt, Human
cagggagcuggcuggcgugagu

SEQ ID NO: 146791 - RNA, 22 nt, Human
ccuguccuccaagagcacaucu

SEQ ID NO: 146792 - RNA, 22 nt, Human
uguuuguucccucucuuuccug

SEQ ID NO: 146793 - RNA, 22 nt, Human
ucaguuuucucaucugugaaau

SEQ ID NO: 146794 - RNA, 22 nt, Human
ggcaguggguuccccaaggcac

SEQ ID NO: 146795 - RNA, 23 nt, Human
gggaccagcuagggcugugaccu

SEQ ID NO: 146796 - RNA, 22 nt, Human
cugcucugagaggcucuuccua

SEQ ID NO: 146797 - RNA, 22 nt, Human
accagagcuggcucugagcacc

SEQ ID NO: 146798 - RNA, 22 nt, Human
uucuucugaaacagugacagac

SEQ ID NO: 146799 - RNA, 21 nt, Human
uguggcugacacccuuuggga

SEQ ID NO: 146800 - RNA, 22 nt, Human
uuuacauggaauauugucuugu

SEQ ID NO: 146801 - RNA, 22 nt, Human
ucuucacaggagccugccugcc

SEQ ID NO: 146802 - RNA, 22 nt, Human
uguguauagaugcaugcauaua

SEQ ID NO: 146803 - RNA, 22 nt, Human
ucaaggaggugcuuggcuucac

SEQ ID NO: 146804 - RNA, 22 nt, Human
aguggggacuuaugccagcauu

SEQ ID NO: 146805 - RNA, 22 nt, Human
ucuuugcaugugcuucuuggcc

SEQ ID NO: 146806 - RNA, 22 nt, Human
ggcccagcugugcuuccagccc

SEQ ID NO: 146807 - RNA, 22 nt, Human
gcagagccaggagcccaggauc

SEQ ID NO: 146808 - RNA, 19 nt, Human
uggcugggcgugccuccgu

SEQ ID NO: 146809 - RNA, 22 nt, Human
uuuaacuuaaucugcuugauga

SEQ ID NO: 146810 - RNA, 22 nt, Human
gaggcaggguguugauuacaga

SEQ ID NO: 146811 - RNA, 22 nt, Human
cugggcugugguguggcccaaa

SEQ ID NO: 146812 - RNA, 22 nt, Human
accaguccgcggagcuccgggg

SEQ ID NO: 146813 - RNA, 22 nt, Human
agccacagugcaagagagaaaa

SEQ ID NO: 146814 - RNA, 22 nt, Human
ucauuuccucaaauucaagguu

SEQ ID NO: 146815 - RNA, 22 nt, Human
cagcccagcacuaaguagauuu

SEQ ID NO: 146816 - RNA, 22 nt, Human
ccugagccugaguggugcaggg

SEQ ID NO: 146817 - RNA, 22 nt, Human
agcacuuuccuggcaaaugugg

SEQ ID NO: 146818 - RNA, 22 nt, Human
cucaacagcucugccauacucc

SEQ ID NO: 146819 - RNA, 22 nt, Human
uuagccauuaaauuacaaggug

SEQ ID NO: 146820 - RNA, 19 nt, Human
ccucugccagcccgccucu

SEQ ID NO: 146821 - RNA, 22 nt, Human
auguaugcauguauguaucgcu

SEQ ID NO: 146822 - RNA, 20 nt, Human
ggucccugcccucugucauc

SEQ ID NO: 146823 - RNA, 22 nt, Human
uucuuuuacauuaagauuucag

SEQ ID NO: 146824 - RNA, 22 nt, Human
ucccagccggugccuggguccc

SEQ ID NO: 146825 - RNA, 22 nt, Human
aggcuggcuggcaggggacaca

SEQ ID NO: 146826 - RNA, 22 nt, Human
cucucuauggaugcaguuuuuc

SEQ ID NO: 146827 - RNA, 19 nt, Human
ucaguuuuagucaucaguu

SEQ ID NO: 146828 - RNA, 22 nt, Human
cccugaggggaguggugaggug

SEQ ID NO: 146829 - RNA, 22 nt, Human
cagggcagccaggccccguggg

SEQ ID NO: 146830 - RNA, 18 nt, Human
ccuggagcuccacagcaa

SEQ ID NO: 146831 - RNA, 22 nt, Human
ccgggcgggggcucucgucacc

SEQ ID NO: 146832 - RNA, 22 nt, Human
ccagaggugccacagaaagagc

SEQ ID NO: 146833 - RNA, 22 nt, Human
cacugagaggucucauuuccaa

SEQ ID NO: 146834 - RNA, 22 nt, Human
ugcuguguaaaaggugauugaa

SEQ ID NO: 146835 - RNA, 22 nt, Human
uugaaaggugcugugugcugau

SEQ ID NO: 146836 - RNA, 22 nt, Human
uauauuugcuaaaugugugcaa

SEQ ID NO: 146837 - RNA, 22 nt, Human
uucuucuugaaacuuuagguug

SEQ ID NO: 146838 - RNA, 22 nt, Human
cugguuuagcuguaagguuccc

SEQ ID NO: 146839 - RNA, 22 nt, Human
gcucccaggaagagaagggcca

SEQ ID NO: 146840 - RNA, 22 nt, Human
gcuggggagcuagaccucagca

SEQ ID NO: 146841 - RNA, 22 nt, Human
auuccaguuggguucuaauaca

SEQ ID NO: 146842 - RNA, 22 nt, Human
uggcagcugucuguggggucuc

SEQ ID NO: 146843 - RNA, 22 nt, Human
agguuuucagcuguauccugag

SEQ ID NO: 146844 - RNA, 21 nt, Human
agcagcugcaguuucuaucug

SEQ ID NO: 146845 - RNA, 22 nt, Human
uauuacagcuuugauuaucugg

SEQ ID NO: 146846 - RNA, 22 nt, Human
aauugcuaaagauuauguuuuc

SEQ ID NO: 146847 - RNA, 20 nt, Human
gcccuggagccuuguccugg

SEQ ID NO: 146848 - RNA, 22 nt, Human
acccuggggguggccagugcca

SEQ ID NO: 146849 - RNA, 19 nt, Human
ucagugugugggagguggu

SEQ ID NO: 146850 - RNA, 22 nt, Human
cugccucuguugggcauggucu

SEQ ID NO: 146851 - RNA, 22 nt, Human
uggcucagcuuuccccaucugg

SEQ ID NO: 146852 - RNA, 23 nt, Human
cccagcagauuguaaagugucca

SEQ ID NO: 146853 - RNA, 22 nt, Human
gagccucguggcggccacugcg

SEQ ID NO: 146854 - RNA, 22 nt, Human
uuuacuguguccaucugugacu

SEQ ID NO: 146855 - RNA, 22 nt, Human
cucagaguucuccugggaggug

SEQ ID NO: 146856 - RNA, 22 nt, Human
uuucucugcugccugugucgau

SEQ ID NO: 146857 - RNA, 22 nt, Human
auuuaaaugcuuaagaggguuu

SEQ ID NO: 146858 - RNA, 22 nt, Human
aggcugcucugcgaagucagcu

SEQ ID NO: 146859 - RNA, 22 nt, Human
caguggguggcuaaguggcuga

SEQ ID NO: 146860 - RNA, 22 nt, Human
cugggccagggaggugucugua

SEQ ID NO: 146861 - RNA, 19 nt, Human
gugauuucuuuccacaagc

SEQ ID NO: 146862 - RNA, 22 nt, Human
agcaauauuucagcuagcaggu

SEQ ID NO: 146863 - RNA, 21 nt, Human
agggccugugcucuccagguc

SEQ ID NO: 146864 - RNA, 22 nt, Human
uguguguaauguuucucucuuc

SEQ ID NO: 146865 - RNA, 22 nt, Human
ucagagccaaucauggugcauu

SEQ ID NO: 146866 - RNA, 22 nt, Human
ccaucagcaugggagcaugggc

SEQ ID NO: 146867 - RNA, 22 nt, Human
ccucauggccuugagcugaggg

SEQ ID NO: 146868 - RNA, 22 nt, Human
ugccaggaggaggugggacaga

SEQ ID NO: 146869 - RNA, 18 nt, Human
uaguuucuaauggccuuu

SEQ ID NO: 146870 - RNA, 22 nt, Human
ggagagcaggguccugagauac

SEQ ID NO: 146871 - RNA, 22 nt, Human
uaaccuuugaccuugcuugugc

SEQ ID NO: 146872 - RNA, 22 nt, Human
ucccagagugagccaggggcag

SEQ ID NO: 146873 - RNA, 22 nt, Human
accucugccaagaugugcuccc

SEQ ID NO: 146874 - RNA, 20 nt, Human
cacguuuuuccacuagcaaa

SEQ ID NO: 146875 - RNA, 22 nt, Human
acugcuuuucuaagauucugug

SEQ ID NO: 146876 - RNA, 22 nt, Human
agugaaauugcuguaagaggaa

SEQ ID NO: 146877 - RNA, 22 nt, Human
gcuggaaggcuaggcucaguug

SEQ ID NO: 146878 - RNA, 22 nt, Human
uauuugucuaagaggcugacag

SEQ ID NO: 146879 - RNA, 22 nt, Human
uggaaagucucuuuugacugua

SEQ ID NO: 146880 - RNA, 22 nt, Human
acacagggcggaaagcaugaga

SEQ ID NO: 146881 - RNA, 22 nt, Human
gcaccacaucaaugaggggagc

SEQ ID NO: 146882 - RNA, 22 nt, Human
gaagcccagggcguggccgggc

SEQ ID NO: 146883 - RNA, 22 nt, Human
cccagggcccuggacagcuaca

SEQ ID NO: 146884 - RNA, 22 nt, Human
gaggcugcaggcaaugcugccc

SEQ ID NO: 146885 - RNA, 22 nt, Human
cccuucccuucugggagaucca

SEQ ID NO: 146886 - RNA, 22 nt, Human
uccaugagaacccuuggagaua

SEQ ID NO: 146887 - RNA, 22 nt, Human
cucuggagcauuucaccuacau

SEQ ID NO: 146888 - RNA, 19 nt, Human
cucugccucccuccugggu

SEQ ID NO: 146889 - RNA, 22 nt, Human
ugccacccagccaggaguggga

SEQ ID NO: 146890 - RNA, 22 nt, Human
ucaguuuugaaaacauugaaug

SEQ ID NO: 146891 - RNA, 22 nt, Human
gcugaagcugcagcaggaggaa

SEQ ID NO: 146892 - RNA, 20 nt, Human
ugcagggcugccucccagcu

SEQ ID NO: 146893 - RNA, 22 nt, Human
gccuggaguacuccuugaagug

SEQ ID NO: 146894 - RNA, 22 nt, Human
cugcccuguuuggacagcccgg

SEQ ID NO: 146895 - RNA, 22 nt, Human
cuggggcugcagcgaucuucau

SEQ ID NO: 146896 - RNA, 22 nt, Human
cugugucuaaucaggucaguca

SEQ ID NO: 146897 - RNA, 22 nt, Human
ccagggugagaaaaggcuggau

SEQ ID NO: 146898 - RNA, 22 nt, Human
gcacugcagguggguggagagg

SEQ ID NO: 146899 - RNA, 22 nt, Human
uugcauaaagauuuuauugcau

SEQ ID NO: 146900 - RNA, 22 nt, Human
ccuggacucaggcugugggcac

SEQ ID NO: 146901 - RNA, 22 nt, Human
ucuccugugcacccucccugug

SEQ ID NO: 146902 - RNA, 22 nt, Human
gccuggcuccuaagagcacaac

SEQ ID NO: 146903 - RNA, 22 nt, Human
cccagcagaccgcugugauggc

SEQ ID NO: 146904 - RNA, 22 nt, Human
gcugggaagugcaagaucaagg

SEQ ID NO: 146905 - RNA, 23 nt, Human
caguacuuaguguagcguuaauu

SEQ ID NO: 146906 - RNA, 23 nt, Human
uaagaacagacaagcauuuacau

SEQ ID NO: 146907 - RNA, 22 nt, Human
uguggccuccuguuccugggua

SEQ ID NO: 146908 - RNA, 19 nt, Human
caguggagauuggaggagg

SEQ ID NO: 146909 - RNA, 22 nt, Human
uauugucuaggaauuguuuaaa

SEQ ID NO: 146910 - RNA, 22 nt, Human
ucucagaguuccucuggagucc

SEQ ID NO: 146911 - RNA, 21 nt, Human
agcagcaucagccucaccuga

SEQ ID NO: 146912 - RNA, 22 nt, Human
aggcagaggaaggguggauuug

SEQ ID NO: 146913 - RNA, 22 nt, Human
cuaacuuuuugauucuugggga

SEQ ID NO: 146914 - RNA, 22 nt, Human
ucugccuguucaagucuucuag

SEQ ID NO: 146915 - RNA, 22 nt, Human
gggauggcucaaaggagucagg

SEQ ID NO: 146916 - RNA, 22 nt, Human
agcaggaaggggaugaugggca

SEQ ID NO: 146917 - RNA, 22 nt, Human
gcucuccacugaccacggggca

SEQ ID NO: 146918 - RNA, 22 nt, Human
uuguggaaauacagacuccaag

SEQ ID NO: 146919 - RNA, 21 nt, Human
gagcucucaggcaagaagcag

SEQ ID NO: 146920 - RNA, 22 nt, Human
ugcuuucaaaggcuuucuagau

SEQ ID NO: 146921 - RNA, 23 nt, Human
cuguggcugaguccuguuggagu

SEQ ID NO: 146922 - RNA, 22 nt, Human
uuuuuaguagagguggguuuca

SEQ ID NO: 146923 - RNA, 19 nt, Human
acaagggcaggcaagguga

SEQ ID NO: 146924 - RNA, 22 nt, Human
ucaucucuccccagugucuuua

SEQ ID NO: 146925 - RNA, 21 nt, Human
aggcagcucaggcccagagag

SEQ ID NO: 146926 - RNA, 22 nt, Human
gucauuguguggacauggagaa

SEQ ID NO: 146927 - RNA, 22 nt, Human
ucagcagcagcucagcauguuu

SEQ ID NO: 146928 - RNA, 23 nt, Human
ugcauuauccucucugaagacca

SEQ ID NO: 146929 - RNA, 22 nt, Human
uuugaaagccuggcuuuucucu

SEQ ID NO: 146930 - RNA, 22 nt, Human
uuuaaucaggcaaagcauaaua

SEQ ID NO: 146931 - RNA, 22 nt, Human
auagugguuggauaugucagag

SEQ ID NO: 146932 - RNA, 22 nt, Human
agcagggccaacaguaaacacc

SEQ ID NO: 146933 - RNA, 22 nt, Human
uugauagguuuuauguauaguu

SEQ ID NO: 146934 - RNA, 22 nt, Human
uugcauugugauuacagaggug

SEQ ID NO: 146935 - RNA, 22 nt, Human
gacagggcauggugcagaguuc

SEQ ID NO: 146936 - RNA, 22 nt, Human
ggcaguggcuccucucuacucc

SEQ ID NO: 146937 - RNA, 22 nt, Human
uauuggugggggcagagagaga

SEQ ID NO: 146938 - RNA, 22 nt, Human
cuguagcaaguuauucaauaaa

SEQ ID NO: 146939 - RNA, 22 nt, Human
ucagaggacaagcucccuggug

SEQ ID NO: 146940 - RNA, 22 nt, Human
auugcacaaacacagucagacu

SEQ ID NO: 146941 - RNA, 22 nt, Human
cccucugaccuccugccacagu

SEQ ID NO: 146942 - RNA, 22 nt, Human
cagcuugcaguacuuguuuuug

SEQ ID NO: 146943 - RNA, 22 nt, Human
aucaguuuuuauuaauguagcu

SEQ ID NO: 146944 - RNA, 18 nt, Human
ucugucuguacaaguauc

SEQ ID NO: 146945 - RNA, 22 nt, Human
caaaauguucuggcaccuuuaa

SEQ ID NO: 146946 - RNA, 22 nt, Human
cugugcauugucuugucuguag

SEQ ID NO: 146947 - RNA, 22 nt, Human
ugugugucugcacauguauaau

SEQ ID NO: 146948 - RNA, 22 nt, Human
uguaacaguaagccugugagcu

SEQ ID NO: 146949 - RNA, 22 nt, Human
guaucuuuccacaucuucagua

SEQ ID NO: 146950 - RNA, 18 nt, Human
gcagcugacacuggaguu

SEQ ID NO: 146951 - RNA, 22 nt, Human
caguacuugggaaugcugggga

SEQ ID NO: 146952 - RNA, 22 nt, Human
ggaggccaaggcagguggaucg

SEQ ID NO: 146953 - RNA, 22 nt, Human
auuuugaaaccaaguuauuucc

SEQ ID NO: 146954 - RNA, 22 nt, Human
aagggcagcuauuaucgucauc

SEQ ID NO: 146955 - RNA, 22 nt, Human
auguaucagaaauagcauuggc

SEQ ID NO: 146956 - RNA, 22 nt, Human
aacagaacccgagugugaaucu

SEQ ID NO: 146957 - RNA, 21 nt, Human
ucuuugcaucaguuguuuucu

SEQ ID NO: 146958 - RNA, 22 nt, Human
cccccaaggccaggcugagacc

SEQ ID NO: 146959 - RNA, 22 nt, Human
accacugcccauggugaaaacu

SEQ ID NO: 146960 - RNA, 21 nt, Human
agcagccauggaugguaugua

SEQ ID NO: 146961 - RNA, 22 nt, Human
caaaugcuggcccugcuacuua

SEQ ID NO: 146962 - RNA, 22 nt, Human
caaagugcuggaauuacaggug

SEQ ID NO: 146963 - RNA, 22 nt, Human
gagccagccgcaagagcuguga

SEQ ID NO: 146964 - RNA, 22 nt, Human
gcugaagggagugcugagucug

SEQ ID NO: 146965 - RNA, 22 nt, Human
aucauaaagugcuaucugauug

SEQ ID NO: 146966 - RNA, 22 nt, Human
cagggugcagugucgcugcuag

SEQ ID NO: 146967 - RNA, 20 nt, Human
aguaccuuuuguauguuacc

SEQ ID NO: 146968 - RNA, 22 nt, Human
ugggagcucagaaagggagguc

SEQ ID NO: 146969 - RNA, 22 nt, Human
caggcagcguccugcuuccugu

SEQ ID NO: 146970 - RNA, 18 nt, Human
ggagccagucugucucug

SEQ ID NO: 146971 - RNA, 22 nt, Human
cagcugaauucuucagacucca

SEQ ID NO: 146972 - RNA, 22 nt, Human
cugugauguuagcucuguguua

SEQ ID NO: 146973 - RNA, 22 nt, Human
ggcauggcuggguucuggugag

SEQ ID NO: 146974 - RNA, 22 nt, Human
ugguggcuucugaggauggcga

SEQ ID NO: 146975 - RNA, 22 nt, Human
acaaaguuauucuuucagagga

SEQ ID NO: 146976 - RNA, 16 nt, Human
agcagggcgggaagga

SEQ ID NO: 146977 - RNA, 22 nt, Human
guggagcccugccuugcucaug

SEQ ID NO: 146978 - RNA, 22 nt, Human
ucaggaucaggggccuuuccuu

SEQ ID NO: 146979 - RNA, 22 nt, Human
cuuguaauuauaauguacuguu

SEQ ID NO: 146980 - RNA, 22 nt, Human
uggcucagcaagacauugaccu

SEQ ID NO: 146981 - RNA, 22 nt, Human
gguggcaggcccugagcauccc

SEQ ID NO: 146982 - RNA, 19 nt, Human
uagcagcugccaaaggaga

SEQ ID NO: 146983 - RNA, 22 nt, Human
ccucugggugggaggccgggcg

SEQ ID NO: 146984 - RNA, 22 nt, Human
ucucauugguauauacaugugu

SEQ ID NO: 146985 - RNA, 17 nt, Human
ccagagcuacugagacu

SEQ ID NO: 146986 - RNA, 19 nt, Human
ggagccuggagcacgugcc

SEQ ID NO: 146987 - RNA, 17 nt, Human
augugucugaguguccu

SEQ ID NO: 146988 - RNA, 22 nt, Human
cuggcagcuucaggacacucgg

SEQ ID NO: 146989 - RNA, 22 nt, Human
ugcucccaggcucuguggucug

SEQ ID NO: 146990 - RNA, 22 nt, Human
ccccagcugcauacuugccaag

SEQ ID NO: 146991 - RNA, 22 nt, Human
ccugggagagccaucuguggcc

SEQ ID NO: 146992 - RNA, 22 nt, Human
uucucuguggauugggugagag

SEQ ID NO: 146993 - RNA, 22 nt, Human
gcagcuggggccacacuuaggc

SEQ ID NO: 146994 - RNA, 22 nt, Human
ggcacugaaccaggacacaagc

SEQ ID NO: 146995 - RNA, 22 nt, Human
aggaagcccuugucauuucugu

SEQ ID NO: 146996 - RNA, 17 nt, Human
cugucugcgcaugaggu

SEQ ID NO: 146997 - RNA, 22 nt, Human
aggcagcccacaggacacagga

SEQ ID NO: 146998 - RNA, 22 nt, Human
cacaaugcguacauauaucaaa

SEQ ID NO: 146999 - RNA, 22 nt, Human
gucccaggugggcuccaccucu

SEQ ID NO: 147000 - RNA, 22 nt, Human
ggcgcuggccacgguggcucug

SEQ ID NO: 147001 - RNA, 22 nt, Human
guuuucugauuagcaaaucuga

SEQ ID NO: 147002 - RNA, 22 nt, Human
ugacagaaauaguucuuaauuu

SEQ ID NO: 147003 - RNA, 22 nt, Human
gugcauuggugcgccacuucac

SEQ ID NO: 147004 - RNA, 22 nt, Human
uguguauucagcaagcgaaaca

SEQ ID NO: 147005 - RNA, 22 nt, Human
uucaugugaauauauuugucuu

SEQ ID NO: 147006 - RNA, 22 nt, Human
ccucaggaaaugaauaaauggc

SEQ ID NO: 147007 - RNA, 22 nt, Human
gugcugucaauugcuuucagua

SEQ ID NO: 147008 - RNA, 22 nt, Human
ucagaagcaggagugugcacaa

SEQ ID NO: 147009 - RNA, 22 nt, Human
aucuggcuuggguguggguagc

SEQ ID NO: 147010 - RNA, 22 nt, Human
cuggcuguaagcguguuuccua

SEQ ID NO: 147011 - RNA, 22 nt, Human
ugggcagaauugugguaguuaa

SEQ ID NO: 147012 - RNA, 22 nt, Human
uauuuugagguauuuuugagcu

SEQ ID NO: 147013 - RNA, 22 nt, Human
uccauuuuucaugacuccucaa

SEQ ID NO: 147014 - RNA, 22 nt, Human
ugccugcugcuaagcucuuugu

SEQ ID NO: 147015 - RNA, 22 nt, Human
cuccaggagcugugucuuucuu

SEQ ID NO: 147016 - RNA, 22 nt, Human
ucaggcuggaaugcaguggggc

SEQ ID NO: 147017 - RNA, 22 nt, Human
ccuggccuuaagggcagggagc

SEQ ID NO: 147018 - RNA, 22 nt, Human
cucaggaugcaggucacaggac

SEQ ID NO: 147019 - RNA, 18 nt, Human
cuuguucuucucuuggcg

SEQ ID NO: 147020 - RNA, 22 nt, Human
uagagaaauaagcuuugccuug

SEQ ID NO: 147021 - RNA, 22 nt, Human
cacaauuuccuugcuucacuuu

SEQ ID NO: 147022 - RNA, 22 nt, Human
ugcucuggagggugaagcuuuu

SEQ ID NO: 147023 - RNA, 22 nt, Human
ggaugcugggagacagcaggca

SEQ ID NO: 147024 - RNA, 22 nt, Human
ccagcugacgaugccuggucuc

SEQ ID NO: 147025 - RNA, 22 nt, Human
ugacacauuaaaugcucacaaa

SEQ ID NO: 147026 - RNA, 22 nt, Human
cuguacaggugaggagggggcu

SEQ ID NO: 147027 - RNA, 22 nt, Human
uguguugguagaucugaggucu

SEQ ID NO: 147028 - RNA, 22 nt, Human
uagaaacauguucuguucuguu

SEQ ID NO: 147029 - RNA, 22 nt, Human
caggaugguggcaugaucagaa

SEQ ID NO: 147030 - RNA, 22 nt, Human
uccagggaagagcagaggcuac

SEQ ID NO: 147031 - RNA, 22 nt, Human
aucaggaucugggagccugaaa

SEQ ID NO: 147032 - RNA, 22 nt, Human
aaguguguugacugaauugggg

SEQ ID NO: 147033 - RNA, 22 nt, Human
agcagccagugggagugauaca

SEQ ID NO: 147034 - RNA, 22 nt, Human
uugaauaguguuuucaguauac

SEQ ID NO: 147035 - RNA, 22 nt, Human
ugguggcuguugcagaacugag

SEQ ID NO: 147036 - RNA, 22 nt, Human
caggauagaaaggccauggagu

SEQ ID NO: 147037 - RNA, 22 nt, Human
gcagaacauuucacaguaucuu

SEQ ID NO: 147038 - RNA, 22 nt, Human
ucaucacauaugucaugauuug

SEQ ID NO: 147039 - RNA, 22 nt, Human
cagagccacugucugccaggca

SEQ ID NO: 147040 - RNA, 22 nt, Human
gauuucaauccagcuuucuucu

SEQ ID NO: 147041 - RNA, 22 nt, Human
ucaucuucuauuaauagggaga

SEQ ID NO: 147042 - RNA, 22 nt, Human
aaugcacagcguuccaugcuug

SEQ ID NO: 147043 - RNA, 22 nt, Human
aagggcaggagaagacggauau

SEQ ID NO: 147044 - RNA, 22 nt, Human
acacugaauaauugagaguuga

SEQ ID NO: 147045 - RNA, 22 nt, Human
uuuccucugcugccauugcccc

SEQ ID NO: 147046 - RNA, 22 nt, Human
uauuuccauguuagaacuaagu

SEQ ID NO: 147047 - RNA, 22 nt, Human
ugccugugggugaugauuugau

SEQ ID NO: 147048 - RNA, 22 nt, Human
ugaggcaguucuuacuuguauu

SEQ ID NO: 147049 - RNA, 22 nt, Human
cugcccugucugcagccuggcu

SEQ ID NO: 147050 - RNA, 22 nt, Human
cugagggcaugaacauuccaua

SEQ ID NO: 147051 - RNA, 22 nt, Human
accagagauggggcuucucugu

SEQ ID NO: 147052 - RNA, 22 nt, Human
caguggguaggaaaggcucuuc

SEQ ID NO: 147053 - RNA, 22 nt, Human
acagucuugagcaucagccaga

SEQ ID NO: 147054 - RNA, 22 nt, Human
ugaaaucuuagccauucugccu

SEQ ID NO: 147055 - RNA, 22 nt, Human
cuaucuuuuguucauuuugagu

SEQ ID NO: 147056 - RNA, 20 nt, Human
ucuguagucuaugaggcuua

SEQ ID NO: 147057 - RNA, 22 nt, Human
gcaggggaguccacucuaugca

SEQ ID NO: 147058 - RNA, 22 nt, Human
ucucugucugagccuggcagac

SEQ ID NO: 147059 - RNA, 22 nt, Human
cacauccuucagcugagcccag

SEQ ID NO: 147060 - RNA, 23 nt, Human
auuuacagguuaaaugaaaucag

SEQ ID NO: 147061 - RNA, 22 nt, Human
ugcucccaaacgaccuacugug

SEQ ID NO: 147062 - RNA, 22 nt, Human
cuucacauguuggaguccuuug

SEQ ID NO: 147063 - RNA, 22 nt, Human
ccuggccucgugcucacggcuc

SEQ ID NO: 147064 - RNA, 22 nt, Human
ucucccaggcugcccuguggac

SEQ ID NO: 147065 - RNA, 22 nt, Human
acguuuucagccuuaauguaga

SEQ ID NO: 147066 - RNA, 22 nt, Human
ucaggaugaccacgagccucua

SEQ ID NO: 147067 - RNA, 22 nt, Human
ucucugugacauuucugagccu

SEQ ID NO: 147068 - RNA, 20 nt, Human
gaggaaaagcugccaggccu

SEQ ID NO: 147069 - RNA, 20 nt, Human
cugggcagguguuugaucuc

SEQ ID NO: 147070 - RNA, 22 nt, Human
agagugggugaucucuguuguc

SEQ ID NO: 147071 - RNA, 22 nt, Human
agcagagcgccugcucagaggg

SEQ ID NO: 147072 - RNA, 22 nt, Human
aaaguucagugccuucuauaca

SEQ ID NO: 147073 - RNA, 22 nt, Human
ugcccugucuaagcugucagua

SEQ ID NO: 147074 - RNA, 22 nt, Human
ccagcacugcucucagacugag

SEQ ID NO: 147075 - RNA, 22 nt, Human
gcugagagcggccagcugggaa

SEQ ID NO: 147076 - RNA, 22 nt, Human
ucaaugauuagaguuuagugug

SEQ ID NO: 147077 - RNA, 22 nt, Human
uguggccagcagguggcugugu

SEQ ID NO: 147078 - RNA, 22 nt, Human
acaguauacauugauuaggacc

SEQ ID NO: 147079 - RNA, 22 nt, Human
aaagcaguauauugguaguugu

SEQ ID NO: 147080 - RNA, 22 nt, Human
cagcugaggucaaagaagcagg

SEQ ID NO: 147081 - RNA, 19 nt, Human
uacauuuguguacacuugu

SEQ ID NO: 147082 - RNA, 22 nt, Human
acuggagcccguggaggcgcag

SEQ ID NO: 147083 - RNA, 22 nt, Human
uguuauugagguuacuuauaag

SEQ ID NO: 147084 - RNA, 22 nt, Human
cccucagcuccacccucagcag

SEQ ID NO: 147085 - RNA, 22 nt, Human
agcagcuucuuucacuccugga

SEQ ID NO: 147086 - RNA, 22 nt, Human
agacucaagcagauaggaauua

SEQ ID NO: 147087 - RNA, 22 nt, Human
aaaauacacauacuaggggaaa

SEQ ID NO: 147088 - RNA, 22 nt, Human
ggcugaugggcaugagcuguca

SEQ ID NO: 147089 - RNA, 22 nt, Human
ucccagaguuuccuguguccca

SEQ ID NO: 147090 - RNA, 22 nt, Human
cacagcauaaugaaauauacuu

SEQ ID NO: 147091 - RNA, 22 nt, Human
ugucuuuagccagcagucuucu

SEQ ID NO: 147092 - RNA, 22 nt, Human
guauuugauagauuucaaagga

SEQ ID NO: 147093 - RNA, 22 nt, Human
ccuguguggccaggcuggaguc

SEQ ID NO: 147094 - RNA, 22 nt, Human
agcugcccuucucuugcccuug

SEQ ID NO: 147095 - RNA, 22 nt, Human
uccaggaggaggaaggcugcca

SEQ ID NO: 147096 - RNA, 22 nt, Human
guucucucagccuuuguuauua

SEQ ID NO: 147097 - RNA, 22 nt, Human
uggcagagaacacggcugaucu

SEQ ID NO: 147098 - RNA, 22 nt, Human
augcagcugugggcaagaaaug

SEQ ID NO: 147099 - RNA, 22 nt, Human
cugucauuuaagacauucugga

SEQ ID NO: 147100 - RNA, 22 nt, Human
ucaaagucauggcuaguaauga

SEQ ID NO: 147101 - RNA, 22 nt, Human
cuggcuguaacauuuugccaua

SEQ ID NO: 147102 - RNA, 22 nt, Human
aagagcuggcucuugcagcagc

SEQ ID NO: 147103 - RNA, 22 nt, Human
caggcuugauuauucagacaau

SEQ ID NO: 147104 - RNA, 22 nt, Human
ucucagggccucccucuguuuc

SEQ ID NO: 147105 - RNA, 22 nt, Human
uucuucugugaggugugugccu

SEQ ID NO: 147106 - RNA, 22 nt, Human
gccccaccuugagagcagaaac

SEQ ID NO: 147107 - RNA, 22 nt, Human
ccuggcaggcaagaggaaggga

SEQ ID NO: 147108 - RNA, 22 nt, Human
gcuggcagaauuucuucuugcu

SEQ ID NO: 147109 - RNA, 22 nt, Human
aggcaggggagcuggaagggua

SEQ ID NO: 147110 - RNA, 22 nt, Human
ccuggcagaaagaguuacaccu

SEQ ID NO: 147111 - RNA, 22 nt, Human
agacacagucugucuggaggag

SEQ ID NO: 147112 - RNA, 20 nt, Human
uggccucugagaugccacgg

SEQ ID NO: 147113 - RNA, 22 nt, Human
uggcagggugccaguugcgagu

SEQ ID NO: 147114 - RNA, 20 nt, Human
agggcugagaagggacuagc

SEQ ID NO: 147115 - RNA, 22 nt, Human
uccaggcuaauuuugcauuguu

SEQ ID NO: 147116 - RNA, 22 nt, Human
ucuggcagagucagugcacaca

SEQ ID NO: 147117 - RNA, 22 nt, Human
cccuuccuugugacuggugggg

SEQ ID NO: 147118 - RNA, 22 nt, Human
cuccuggcaggcugagugaaau

SEQ ID NO: 147119 - RNA, 19 nt, Human
guccucucaacaacccggg

SEQ ID NO: 147120 - RNA, 20 nt, Human
aagagucuuuacugagcuaa

SEQ ID NO: 147121 - RNA, 20 nt, Human
acaaagacuggaaaagcaag

SEQ ID NO: 147122 - RNA, 22 nt, Human
ugccugccaugcagaaagcuga

SEQ ID NO: 147123 - RNA, 22 nt, Human
acuggcagcuguaggaugcaug

SEQ ID NO: 147124 - RNA, 19 nt, Human
acuggcagggcugcggugg

SEQ ID NO: 147125 - RNA, 22 nt, Human
aggccacaguacuuugcagacc

SEQ ID NO: 147126 - RNA, 22 nt, Human
agaggccuccgaaaggugggcu

SEQ ID NO: 147127 - RNA, 22 nt, Human
aaagagucuggcacuguaccag

SEQ ID NO: 147128 - RNA, 22 nt, Human
gcagccucaaacuccccagcuc

SEQ ID NO: 147129 - RNA, 22 nt, Human
aggaggcugaacuagggucugg

SEQ ID NO: 147130 - RNA, 22 nt, Human
gccuccuggaagucacauguuu

SEQ ID NO: 147131 - RNA, 22 nt, Human
uggcagugguaccggcucucag

SEQ ID NO: 147132 - RNA, 22 nt, Human
cagguuggggacuuaggaugac

SEQ ID NO: 147133 - RNA, 22 nt, Human
acuggcagagacccugauggcc

SEQ ID NO: 147134 - RNA, 22 nt, Human
agggacucccugggccgacacg

SEQ ID NO: 147135 - RNA, 22 nt, Human
gaggcacagucccgaggcaagg

SEQ ID NO: 147136 - RNA, 20 nt, Human
gcuggcagaugucuugagau

SEQ ID NO: 147137 - RNA, 22 nt, Human
cucucuccuuagcugcagacca

SEQ ID NO: 147138 - RNA, 22 nt, Human
gagauggccagugccaggacaa

SEQ ID NO: 147139 - RNA, 22 nt, Human
ggcagagguagcuggaaccagg

SEQ ID NO: 147140 - RNA, 22 nt, Human
ucuggcagcgaagcguguacuu

SEQ ID NO: 147141 - RNA, 22 nt, Human
uggcaguggcucagagugcaga

SEQ ID NO: 147142 - RNA, 22 nt, Human
guccuggcccaggaguacacau

SEQ ID NO: 147143 - RNA, 22 nt, Human
ucuggcaggcaaucggcucugg

SEQ ID NO: 147144 - RNA, 22 nt, Human
gguucccggaucuccgaguccc

SEQ ID NO: 147145 - RNA, 22 nt, Human
gucaggacucugacccgucccg

SEQ ID NO: 147146 - RNA, 22 nt, Human
cuccaggccauggcugcggagg

SEQ ID NO: 147147 - RNA, 22 nt, Human
ggagcugaaccccaucgugcug

SEQ ID NO: 147148 - RNA, 20 nt, Human
ugccuggccuuucucugccc

SEQ ID NO: 147149 - RNA, 22 nt, Human
uggcacucacucucagagucug

SEQ ID NO: 147150 - RNA, 22 nt, Human
gggccccuugcugcucugcugg

SEQ ID NO: 147151 - RNA, 22 nt, Human
agagggugcuggagagacauug

SEQ ID NO: 147152 - RNA, 22 nt, Human
aggagcugcagauucugccuug

SEQ ID NO: 147153 - RNA, 21 nt, Human
ucuggcaggaagacggauggg

SEQ ID NO: 147154 - RNA, 22 nt, Human
gaaagacuuccuuugagaguac

SEQ ID NO: 147155 - RNA, 22 nt, Human
uccugcagccacugcaggcaga

SEQ ID NO: 147156 - RNA, 22 nt, Human
cuggcaugaaauggcaucucau

SEQ ID NO: 147157 - RNA, 18 nt, Human
uccuggcagucagagagg

SEQ ID NO: 147158 - RNA, 19 nt, Human
ccagucccauacaggagau

SEQ ID NO: 147159 - RNA, 22 nt, Human
ugaccaggauacugcagggaug

SEQ ID NO: 147160 - RNA, 22 nt, Human
ccagcccuuagauaaaccuggc

SEQ ID NO: 147161 - RNA, 22 nt, Human
ucuugggauagugucucauggc

SEQ ID NO: 147162 - RNA, 18 nt, Human
cuccuggcugauggugag

SEQ ID NO: 147163 - RNA, 22 nt, Human
cuggccucauagccaagcugug

SEQ ID NO: 147164 - RNA, 22 nt, Human
uccuggcagggucuaggucuag

SEQ ID NO: 147165 - RNA, 22 nt, Human
guccuggcugguucuguggggc

SEQ ID NO: 147166 - RNA, 22 nt, Human
ccuccagcgcgauccacuccgg

SEQ ID NO: 147167 - RNA, 22 nt, Human
ugccugccucuggcagcccugc

SEQ ID NO: 147168 - RNA, 17 nt, Human
gcccacccuuaggagcu

SEQ ID NO: 147169 - RNA, 22 nt, Human
cugccucuauaggaguccacca

SEQ ID NO: 147170 - RNA, 22 nt, Human
aaagaucaaguaggcauggccu

SEQ ID NO: 147171 - RNA, 22 nt, Human
acuggcagguccaucgcccuuu

SEQ ID NO: 147172 - RNA, 22 nt, Human
uggcaguagauccagucucucu

SEQ ID NO: 147173 - RNA, 21 nt, Human
agaugcugaugcugcaggucc

SEQ ID NO: 147174 - RNA, 21 nt, Human
cccuugccugcacuccucggc

SEQ ID NO: 147175 - RNA, 22 nt, Human
uccuggcagaaauggggcugug

SEQ ID NO: 147176 - RNA, 22 nt, Human
gguguugggcucacugguccuu

SEQ ID NO: 147177 - RNA, 22 nt, Human
ccuggcagguggagguugcagu

SEQ ID NO: 147178 - RNA, 22 nt, Human
uccaggcaaaaaccaacuacag

SEQ ID NO: 147179 - RNA, 22 nt, Human
gacucugggcugagccagggcc

SEQ ID NO: 147180 - RNA, 22 nt, Human
ggggcugagucagugggaagag

SEQ ID NO: 147181 - RNA, 22 nt, Human
ugccucucuaacccaugcccaa

SEQ ID NO: 147182 - RNA, 22 nt, Human
ggagcugaggcugaggccucac

SEQ ID NO: 147183 - RNA, 22 nt, Human
uugggaaguuuaaugacagacu

SEQ ID NO: 147184 - RNA, 22 nt, Human
ucuggcaguaauaggggagaga

SEQ ID NO: 147185 - RNA, 22 nt, Human
uuggaacaugccgggguccagg

SEQ ID NO: 147186 - RNA, 22 nt, Human
agucuagggugggguccacagg

SEQ ID NO: 147187 - RNA, 22 nt, Human
ccuggcagcagcacaugccuuc

SEQ ID NO: 147188 - RNA, 22 nt, Human
aggaggcugggcacaguggccu

SEQ ID NO: 147189 - RNA, 19 nt, Human
agaggccucagcagcuggc

SEQ ID NO: 147190 - RNA, 22 nt, Human
cccgagugucuacucacuccca

SEQ ID NO: 147191 - RNA, 22 nt, Human
agagcacagaagaauaggugcu

SEQ ID NO: 147192 - RNA, 22 nt, Human
cccagcccaucucaaaggucua

SEQ ID NO: 147193 - RNA, 22 nt, Human
uggcagugggaauggacaaaca

SEQ ID NO: 147194 - RNA, 22 nt, Human
ggaggacaggggcugcagcaca

SEQ ID NO: 147195 - RNA, 20 nt, Human
aaaagagugcuucaacugcu

SEQ ID NO: 147196 - RNA, 22 nt, Human
ugccagccagggaagcucaccc

SEQ ID NO: 147197 - RNA, 22 nt, Human
ggagagaauuccauggacaugu

SEQ ID NO: 147198 - RNA, 22 nt, Human
cuccuggcacugucuugaccca

SEQ ID NO: 147199 - RNA, 22 nt, Human
ggagacucggguucuagccuug

SEQ ID NO: 147200 - RNA, 22 nt, Human
gcuggcagguaaagccccgggg

SEQ ID NO: 147201 - RNA, 23 nt, Human
ugagggacaugguggcuucugag

SEQ ID NO: 147202 - RNA, 22 nt, Human
ggccucucugagagcagacguu

SEQ ID NO: 147203 - RNA, 22 nt, Human
ucuggcagagauauccauccca

SEQ ID NO: 147204 - RNA, 22 nt, Human
ccuggcagcauugguagagauu

SEQ ID NO: 147205 - RNA, 22 nt, Human
aacaaaagccgaaguagguguc

SEQ ID NO: 147206 - RNA, 22 nt, Human
agggagacacaugaggaaguca

SEQ ID NO: 147207 - RNA, 22 nt, Human
gucacaggcaguaacuaggacc

SEQ ID NO: 147208 - RNA, 22 nt, Human
cccaggccagaacuugguugcu

SEQ ID NO: 147209 - RNA, 22 nt, Human
gccuggcacucaaucaucugcu

SEQ ID NO: 147210 - RNA, 22 nt, Human
agggccccauagucacugcccg

SEQ ID NO: 147211 - RNA, 22 nt, Human
caugagauaauuuuucuccagu

SEQ ID NO: 147212 - RNA, 22 nt, Human
gagaaagauuguccuucagggg

SEQ ID NO: 147213 - RNA, 22 nt, Human
ccuggcagacugugagggcagg

SEQ ID NO: 147214 - RNA, 22 nt, Human
agaggccugugugcuccagugg

SEQ ID NO: 147215 - RNA, 22 nt, Human
aggccuccagccacaugccagu

SEQ ID NO: 147216 - RNA, 21 nt, Human
agagucugagugugcaagggc

SEQ ID NO: 147217 - RNA, 22 nt, Human
ucaggagcucuucccuggugug

SEQ ID NO: 147218 - RNA, 22 nt, Human
gcuggcagcuggaaguugggcu

SEQ ID NO: 147219 - RNA, 22 nt, Human
acuggcagaggauagcacuaau

SEQ ID NO: 147220 - RNA, 22 nt, Human
uugggaucucaaauccagcuau

SEQ ID NO: 147221 - RNA, 21 nt, Human
uccacccucucugcucccagu

SEQ ID NO: 147222 - RNA, 22 nt, Human
gccucaggccgcccugcugcuc

SEQ ID NO: 147223 - RNA, 20 nt, Human
cccagccccuaccuguugcc

SEQ ID NO: 147224 - RNA, 22 nt, Human
gggccccuuguaucucuggcuc

SEQ ID NO: 147225 - RNA, 22 nt, Human
ucuggcagaagugcugucagua

SEQ ID NO: 147226 - RNA, 22 nt, Human
ccaggcccaggguacugaccaa

SEQ ID NO: 147227 - RNA, 22 nt, Human
uacaaaaggaagagggaucuua

SEQ ID NO: 147228 - RNA, 22 nt, Human
augacugcucugggcucccaug

SEQ ID NO: 147229 - RNA, 22 nt, Human
ccuggcaguuuugcccaggauu

SEQ ID NO: 147230 - RNA, 22 nt, Human
ucccaccccuugacucuuuaag

SEQ ID NO: 147231 - RNA, 22 nt, Human
cugccugccuuggccuccagga

SEQ ID NO: 147232 - RNA, 22 nt, Human
gucuggaaggaggagauggagc

SEQ ID NO: 147233 - RNA, 19 nt, Human
guccuggcgccgccacacc

SEQ ID NO: 147234 - RNA, 22 nt, Human
gaggagcugagccacguccugg

SEQ ID NO: 147235 - RNA, 22 nt, Human
agugccccaugggugccugggg

SEQ ID NO: 147236 - RNA, 17 nt, Human
ugccagccugucccagg

SEQ ID NO: 147237 - RNA, 22 nt, Human
gccuccggagucacagugucuu

SEQ ID NO: 147238 - RNA, 22 nt, Human
ccugccuguacuagagacccag

SEQ ID NO: 147239 - RNA, 22 nt, Human
uccuggcagcccgcaggugcug

SEQ ID NO: 147240 - RNA, 22 nt, Human
ggcaagagggcagauggagugc

SEQ ID NO: 147241 - RNA, 20 nt, Human
agaggcuuccuugggaggag

SEQ ID NO: 147242 - RNA, 22 nt, Human
aggcaguguguagcuggaagag

SEQ ID NO: 147243 - RNA, 22 nt, Human
gcuggcagucccaucagcuggg

SEQ ID NO: 147244 - RNA, 22 nt, Human
uauuacagaaucaggcauaacu

SEQ ID NO: 147245 - RNA, 22 nt, Human
cugcaggagcaaagccucugcu

SEQ ID NO: 147246 - RNA, 22 nt, Human
cccagccugugacagccguccu

SEQ ID NO: 147247 - RNA, 22 nt, Human
ggccucucaugcccagagccaa

SEQ ID NO: 147248 - RNA, 22 nt, Human
ggcacagggggcugaggacuag

SEQ ID NO: 147249 - RNA, 22 nt, Human
gcuggcagguccaagauagagc

SEQ ID NO: 147250 - RNA, 19 nt, Human
gcuggcagauguggccgug

SEQ ID NO: 147251 - RNA, 22 nt, Human
cccuuccucccaggcuucugug

SEQ ID NO: 147252 - RNA, 22 nt, Human
guccuggcaccucacuggcuac

SEQ ID NO: 147253 - RNA, 22 nt, Human
uguuggaauuaggauacagagg

SEQ ID NO: 147254 - RNA, 22 nt, Human
ccucucccgggugccgcugggc

SEQ ID NO: 147255 - RNA, 22 nt, Human
gcuggcagcauuagacccuggg

SEQ ID NO: 147256 - RNA, 22 nt, Human
guccacagagggcugggcaggc

SEQ ID NO: 147257 - RNA, 22 nt, Human
guggcaguuuugacaucacaaa

SEQ ID NO: 147258 - RNA, 22 nt, Human
caggaguggugugagggacucc

SEQ ID NO: 147259 - RNA, 22 nt, Human
gagaggcuggcagugccagguu

SEQ ID NO: 147260 - RNA, 22 nt, Human
uccacccugcuuuugucuuuga

SEQ ID NO: 147261 - RNA, 22 nt, Human
acuggcaguuugagaaugcauu

SEQ ID NO: 147262 - RNA, 19 nt, Human
ccuuccuccccagggccau

SEQ ID NO: 147263 - RNA, 22 nt, Human
ccuggcagguagcauugaggag

SEQ ID NO: 147264 - RNA, 22 nt, Human
cccuggcagagggggcaggugc

SEQ ID NO: 147265 - RNA, 22 nt, Human
ucuggcagcuauccucuggcca

SEQ ID NO: 147266 - RNA, 22 nt, Human
uuccuggccuaagguaggugac

SEQ ID NO: 147267 - RNA, 22 nt, Human
uggccugccacugccacgccac

SEQ ID NO: 147268 - RNA, 22 nt, Human
ggcaaggggucaggcugagaca

SEQ ID NO: 147269 - RNA, 22 nt, Human
accugccuaucagcugccugcu

SEQ ID NO: 147270 - RNA, 22 nt, Human
uccuggcauugugcagggugug

SEQ ID NO: 147271 - RNA, 22 nt, Human
accugccuucucaaggacauga

SEQ ID NO: 147272 - RNA, 22 nt, Human
cuugggaaugcuaacagaugac

SEQ ID NO: 147273 - RNA, 22 nt, Human
cccuuccuugauuuuaacugga

SEQ ID NO: 147274 - RNA, 22 nt, Human
acaggugguagaguggaaagag

SEQ ID NO: 147275 - RNA, 22 nt, Human
uccaggcuugagaccaggcucu

SEQ ID NO: 147276 - RNA, 20 nt, Human
aaagagcccuuggagcaggc

SEQ ID NO: 147277 - RNA, 22 nt, Human
uggucucugcaggccaggcuca

SEQ ID NO: 147278 - RNA, 22 nt, Human
cucuccagaauaugccgccgug

SEQ ID NO: 147279 - RNA, 22 nt, Human
ucuggcagaucuucccacguuu

SEQ ID NO: 147280 - RNA, 22 nt, Human
uggaaagagguagaggaucugg

SEQ ID NO: 147281 - RNA, 22 nt, Human
cuugccucccucagcucacagc

SEQ ID NO: 147282 - RNA, 22 nt, Human
aaaaagucugcaaaggagguug

SEQ ID NO: 147283 - RNA, 22 nt, Human
gguggcagaggugcaucagccc

SEQ ID NO: 147284 - RNA, 22 nt, Human
cugccugcugcccuccagagcc

SEQ ID NO: 147285 - RNA, 22 nt, Human
ccucccuucaguagagcccaau

SEQ ID NO: 147286 - RNA, 17 nt, Human
uugggagagaaagguau

SEQ ID NO: 147287 - RNA, 22 nt, Human
aggggugugcauccuggaggau

SEQ ID NO: 147288 - RNA, 22 nt, Human
gcuggcagagagcuggugagga

SEQ ID NO: 147289 - RNA, 22 nt, Human
ggagaagaggagcuggaagccu

SEQ ID NO: 147290 - RNA, 20 nt, Human
gagucacagaagaagcugaa

SEQ ID NO: 147291 - RNA, 22 nt, Human
aaagaucaauagauaaagcuac

SEQ ID NO: 147292 - RNA, 22 nt, Human
gccuggcacaggaauuaggagg

SEQ ID NO: 147293 - RNA, 22 nt, Human
gcuggcagacugggggcagaac

SEQ ID NO: 147294 - RNA, 22 nt, Human
uccuggcagagggcggccucga

SEQ ID NO: 147295 - RNA, 22 nt, Human
gcuggcaguaaaggguuuggca

SEQ ID NO: 147296 - RNA, 22 nt, Human
cccagccuuccacccuggacua

SEQ ID NO: 147297 - RNA, 21 nt, Human
ucuggcaggcacgggcccagc

SEQ ID NO: 147298 - RNA, 21 nt, Human
ucuggcagcaguuuguugagu

SEQ ID NO: 147299 - RNA, 22 nt, Human
uccccaccuaagauacccaucu

SEQ ID NO: 147300 - RNA, 22 nt, Human
gcuggcagaagagcugguucaa

SEQ ID NO: 147301 - RNA, 22 nt, Human
gccuccggaguugcagugucuu

SEQ ID NO: 147302 - RNA, 22 nt, Human
aggaagaaccuaagaaagucuc

SEQ ID NO: 147303 - RNA, 22 nt, Human
uuccuggcgccacggagccggu

SEQ ID NO: 147304 - RNA, 22 nt, Human
aaagaucacgucccaggacucg

SEQ ID NO: 147305 - RNA, 22 nt, Human
cuggcagguuuggugucuggug

SEQ ID NO: 147306 - RNA, 22 nt, Human
gaagagaaaggcaaggaguuuu

SEQ ID NO: 147307 - RNA, 18 nt, Human
gccugcucugcucucccc

SEQ ID NO: 147308 - RNA, 22 nt, Human
cuggcagucugguggaaggccu

SEQ ID NO: 147309 - RNA, 22 nt, Human
gccuggcacaguagggacccaa

SEQ ID NO: 147310 - RNA, 22 nt, Human
ccuggcagcuccguggccuucc

SEQ ID NO: 147311 - RNA, 22 nt, Human
cuccaggccccuggccuucugc

SEQ ID NO: 147312 - RNA, 17 nt, Human
gccuucucugcccucac

SEQ ID NO: 147313 - RNA, 22 nt, Human
acuggcagcagcagcccuuggg

SEQ ID NO: 147314 - RNA, 22 nt, Human
cuccaggcucguccaagaucga

SEQ ID NO: 147315 - RNA, 22 nt, Human
uugggaagaauggaggugguua

SEQ ID NO: 147316 - RNA, 22 nt, Human
uuccuggccaagcagaguggaa

SEQ ID NO: 147317 - RNA, 22 nt, Human
gugggagaaauuagcucuaguu

SEQ ID NO: 147318 - RNA, 22 nt, Human
ggagucugcucccagacaugau

SEQ ID NO: 147319 - RNA, 22 nt, Human
cuggcaguauuaagagaaguga

SEQ ID NO: 147320 - RNA, 22 nt, Human
gugugggaaggcuaggaugcug

SEQ ID NO: 147321 - RNA, 22 nt, Human
agaaagaggaugcagaucucau

SEQ ID NO: 147322 - RNA, 22 nt, Human
gagaaagaugaagaguggcguu

SEQ ID NO: 147323 - RNA, 22 nt, Human
ugggagaaacugucucucccac

SEQ ID NO: 147324 - RNA, 22 nt, Human
ucuggcagcucaguucaggucu

SEQ ID NO: 147325 - RNA, 22 nt, Human
cuccuggcuuucccagaccagg

SEQ ID NO: 147326 - RNA, 22 nt, Human
aagagcacuaacagagcugaua

SEQ ID NO: 147327 - RNA, 22 nt, Human
ucccugccuccuggcagugcca

SEQ ID NO: 147328 - RNA, 22 nt, Human
ggaggacacuggcucugccuuc

SEQ ID NO: 147329 - RNA, 22 nt, Human
gccuccuguuaugccaugugcc

SEQ ID NO: 147330 - RNA, 22 nt, Human
gaggcugcuuugaugacaggag

SEQ ID NO: 147331 - RNA, 22 nt, Human
uccuucccaggugucgccgccu

SEQ ID NO: 147332 - RNA, 18 nt, Human
aggaaagaaaggcaggug

SEQ ID NO: 147333 - RNA, 22 nt, Human
cucaccccacuaccccuuggug

SEQ ID NO: 147334 - RNA, 22 nt, Human
aaagaaucagaagucucaaaca

SEQ ID NO: 147335 - RNA, 22 nt, Human
cucuccagccuuuagcccacgc

SEQ ID NO: 147336 - RNA, 22 nt, Human
cccugccuugggguccacaccg

SEQ ID NO: 147337 - RNA, 22 nt, Human
aggcugcuucagcugcagggag

SEQ ID NO: 147338 - RNA, 21 nt, Human
aaagagcccgcugagagguuc

SEQ ID NO: 147339 - RNA, 19 nt, Human
uccuggcacaguggaacca

SEQ ID NO: 147340 - RNA, 22 nt, Human
acagguggggcacuuggagccu

SEQ ID NO: 147341 - RNA, 23 nt, Human
uccaggagcaugcuggcuggcga

SEQ ID NO: 147342 - RNA, 22 nt, Human
acuggcagaacgugaugcgggu

SEQ ID NO: 147343 - RNA, 21 nt, Human
uccugccuuaguccagagcag

SEQ ID NO: 147344 - RNA, 22 nt, Human
gguggcauaagaacacuaaaga

SEQ ID NO: 147345 - RNA, 22 nt, Human
cccuuccugggugucccggagu

SEQ ID NO: 147346 - RNA, 22 nt, Human
ucuggcagaggaaggaggccug

SEQ ID NO: 147347 - RNA, 22 nt, Human
ccuccuggcuuuucccauugaa

SEQ ID NO: 147348 - RNA, 22 nt, Human
uggaaagaggaagugcccagca

SEQ ID NO: 147349 - RNA, 22 nt, Human
gaggcacauauauacagagccc

SEQ ID NO: 147350 - RNA, 19 nt, Human
uccuggcauuuguaggaaa

SEQ ID NO: 147351 - RNA, 22 nt, Human
uccuggcaguaauuugauguug

SEQ ID NO: 147352 - RNA, 22 nt, Human
cagguugguauucaucuccaca

SEQ ID NO: 147353 - RNA, 22 nt, Human
ccuggcagggcugcaguaaugg

SEQ ID NO: 147354 - RNA, 22 nt, Human
cucucugggcccaguuggcacc

SEQ ID NO: 147355 - RNA, 22 nt, Human
cuccuggcacucaguguggaag

SEQ ID NO: 147356 - RNA, 22 nt, Human
gcccucucuucugcagccucca

SEQ ID NO: 147357 - RNA, 22 nt, Human
gcuggcaggauagaagucuaau

SEQ ID NO: 147358 - RNA, 22 nt, Human
uccaggcucuaggcugcucucc

SEQ ID NO: 147359 - RNA, 22 nt, Human
agcacaggcuuuggugugaggg

SEQ ID NO: 147360 - RNA, 19 nt, Human
gggagcugaggucuuuggu

SEQ ID NO: 147361 - RNA, 22 nt, Human
gaggagcucaugaaagcggugu

SEQ ID NO: 147362 - RNA, 22 nt, Human
gccacagguacuaugggagaga

SEQ ID NO: 147363 - RNA, 22 nt, Human
ucaggcccuuugcugcugcccc

SEQ ID NO: 147364 - RNA, 22 nt, Human
aguugggaguuauagacucuau

SEQ ID NO: 147365 - RNA, 22 nt, Human
gcuugggaagggcccuguguac

SEQ ID NO: 147366 - RNA, 22 nt, Human
uuggagagauuuaggucucagu

SEQ ID NO: 147367 - RNA, 22 nt, Human
uccaggcuuuuucaugcugucu

SEQ ID NO: 147368 - RNA, 22 nt, Human
gcacucuccuggcugccacagu

SEQ ID NO: 147369 - RNA, 22 nt, Human
ggugccaggcuguagucagggu

SEQ ID NO: 147370 - RNA, 22 nt, Human
aaaagagugacugauaaguaua

SEQ ID NO: 147371 - RNA, 22 nt, Human
ucaggcccagagucacggaucc

SEQ ID NO: 147372 - RNA, 22 nt, Human
ucuggcagagugauaggauaag

SEQ ID NO: 147373 - RNA, 22 nt, Human
uggcaucuccgacagucuugau

SEQ ID NO: 147374 - RNA, 22 nt, Human
gcaguguuuguguucucacaug

SEQ ID NO: 147375 - RNA, 20 nt, Human
ccuggcaggcggguuacuua

SEQ ID NO: 147376 - RNA, 18 nt, Human
gacaaaaguacagacaga

SEQ ID NO: 147377 - RNA, 22 nt, Human
cuccugaggacuucuauugggu

SEQ ID NO: 147378 - RNA, 22 nt, Human
gcagggacagggcagggccuuu

SEQ ID NO: 147379 - RNA, 22 nt, Human
ucuggcaguuccuuguugauau

SEQ ID NO: 147380 - RNA, 22 nt, Human
ucuggcaggguguguauuuaca

SEQ ID NO: 147381 - RNA, 22 nt, Human
aggcaguggagcuggaauaggc

SEQ ID NO: 147382 - RNA, 22 nt, Human
aggcuggauuuauggggacuuc

SEQ ID NO: 147383 - RNA, 22 nt, Human
ccucagcugcuucccuggagcc

SEQ ID NO: 147384 - RNA, 22 nt, Human
caggucccugcgccccggccuc

SEQ ID NO: 147385 - RNA, 22 nt, Human
uccuggcacuuugggggcucgc

SEQ ID NO: 147386 - RNA, 22 nt, Human
cagugggggggccaugcugcag

SEQ ID NO: 147387 - RNA, 22 nt, Human
agccagggucucucgcucuguu

SEQ ID NO: 147388 - RNA, 22 nt, Human
aggguagggcccggagacagac

SEQ ID NO: 147389 - RNA, 22 nt, Human
ccuggcagcgugccgagcugcg

SEQ ID NO: 147390 - RNA, 22 nt, Human
ccuggcagucaggggaguccuu

SEQ ID NO: 147391 - RNA, 22 nt, Human
aggcacaggaggugguaagaag

SEQ ID NO: 147392 - RNA, 22 nt, Human
uggccucugggaaagcagauuc

SEQ ID NO: 147393 - RNA, 22 nt, Human
aggaggcuuuugcaggugccac

SEQ ID NO: 147394 - RNA, 22 nt, Human
aggacaagcuaaaggacuuccu

SEQ ID NO: 147395 - RNA, 22 nt, Human
uucuuucaauagcuggcauaug

SEQ ID NO: 147396 - RNA, 22 nt, Human
cagguggguguaugaaugcaaa

SEQ ID NO: 147397 - RNA, 22 nt, Human
ccaggcccugcuccucacacca

SEQ ID NO: 147398 - RNA, 22 nt, Human
uccaggcuagguuuacaggaca

SEQ ID NO: 147399 - RNA, 22 nt, Human
ucuggcaggaccaugaagcgua

SEQ ID NO: 147400 - RNA, 22 nt, Human
acuggcagccacaacuggcagg

SEQ ID NO: 147401 - RNA, 23 nt, Human
cauccaggagcugagucugacug

SEQ ID NO: 147402 - RNA, 22 nt, Human
aguguggcaggaaugacuagaa

SEQ ID NO: 147403 - RNA, 22 nt, Human
aggaagaacagauaauggacgc

SEQ ID NO: 147404 - RNA, 22 nt, Human
ccaggcuguaagagugauguug

SEQ ID NO: 147405 - RNA, 22 nt, Human
ccuggcaggacuguuguaagaa

SEQ ID NO: 147406 - RNA, 22 nt, Human
ccuggcagcuaagugcuuugag

SEQ ID NO: 147407 - RNA, 22 nt, Human
cucugagcagaggccguggcua

SEQ ID NO: 147408 - RNA, 22 nt, Human
gagaaagauguaggcugggagg

SEQ ID NO: 147409 - RNA, 23 nt, Human
aguguugguugggaagccaagca

SEQ ID NO: 147410 - RNA, 22 nt, Human
cagccaggauggagaacuguug

SEQ ID NO: 147411 - RNA, 22 nt, Human
ccuccccaugacccggugcugg

SEQ ID NO: 147412 - RNA, 22 nt, Human
gguuccuucugaggucccugua

SEQ ID NO: 147413 - RNA, 22 nt, Human
ccaggccucuggcugcuuaguc

SEQ ID NO: 147414 - RNA, 22 nt, Human
uggcagugucuuaucaggagug

SEQ ID NO: 147415 - RNA, 22 nt, Human
cccagcccacgguccugggugg

SEQ ID NO: 147416 - RNA, 22 nt, Human
ucuggcagcucuccucggcgga

SEQ ID NO: 147417 - RNA, 22 nt, Human
uccugccuguuuaccuguacuu

SEQ ID NO: 147418 - RNA, 22 nt, Human
gcacaggaugauggguugaggg

SEQ ID NO: 147419 - RNA, 22 nt, Human
cuggccucuguguucaccauag

SEQ ID NO: 147420 - RNA, 22 nt, Human
guggcagugaaggucauagcau

SEQ ID NO: 147421 - RNA, 22 nt, Human
aaagagucguguuccagguuug

SEQ ID NO: 147422 - RNA, 22 nt, Human
gcuggcagugugaaugacaagc

SEQ ID NO: 147423 - RNA, 22 nt, Human
ucuggcaggccuugucaaucug

SEQ ID NO: 147424 - RNA, 22 nt, Human
uccaaggcuccggcccuggcgu

SEQ ID NO: 147425 - RNA, 22 nt, Human
agggcugaagggaggugcucau

SEQ ID NO: 147426 - RNA, 22 nt, Human
uuccuggcucacagcagugggg

SEQ ID NO: 147427 - RNA, 22 nt, Human
ccucuccuugcacccgucccgc

SEQ ID NO: 147428 - RNA, 22 nt, Human
uggccucugugggagcugagca

SEQ ID NO: 147429 - RNA, 22 nt, Human
auggccugaugcaccuguccca

SEQ ID NO: 147430 - RNA, 22 nt, Human
gaggagcugcagggggagucua

SEQ ID NO: 147431 - RNA, 22 nt, Human
aggaaagauggaaggaggauaa

SEQ ID NO: 147432 - RNA, 22 nt, Human
auccaggccccaagaccccgac

SEQ ID NO: 147433 - RNA, 22 nt, Human
cuuggcagagggcugggcucag

SEQ ID NO: 147434 - RNA, 17 nt, Human
cccaggccgccgggagc

SEQ ID NO: 147435 - RNA, 22 nt, Human
cccagccucuguuugcuccucu

SEQ ID NO: 147436 - RNA, 22 nt, Human
ucccagccaggcucuaccacuu

SEQ ID NO: 147437 - RNA, 22 nt, Human
gauggccuuguuuucucccuuc

SEQ ID NO: 147438 - RNA, 22 nt, Human
gcuggcagccaagugaagaggg

SEQ ID NO: 147439 - RNA, 18 nt, Human
ccuagccuccaagcucau

SEQ ID NO: 147440 - RNA, 22 nt, Human
ccacccuaacaauccuuacugu

SEQ ID NO: 147441 - RNA, 22 nt, Human
gccagguugcugacgacgaucu

SEQ ID NO: 147442 - RNA, 22 nt, Human
cuggcacgcccacguaggcacu

SEQ ID NO: 147443 - RNA, 22 nt, Human
cccugccucugaagcugcucag

SEQ ID NO: 147444 - RNA, 22 nt, Human
cuggcaguuggcauuggcaucu

SEQ ID NO: 147445 - RNA, 22 nt, Human
ucuggcagaaggcagaaauuca

SEQ ID NO: 147446 - RNA, 22 nt, Human
guugggaagcagauggaugagc

SEQ ID NO: 147447 - RNA, 21 nt, Human
ccuggcagaagccugauaugc

SEQ ID NO: 147448 - RNA, 22 nt, Human
ccuggcaguggugaagaagagg

SEQ ID NO: 147449 - RNA, 21 nt, Human
gggagggauggaaaugauguu

SEQ ID NO: 147450 - RNA, 22 nt, Human
uccaggaggaggaaggcugcca

SEQ ID NO: 147451 - RNA, 22 nt, Human
ccagugcccagcugcccaggca

SEQ ID NO: 147452 - RNA, 22 nt, Human
ccauucauacaauuuuguucua

SEQ ID NO: 147453 - RNA, 22 nt, Human
uacaaaaguaauuacgguuuuu

SEQ ID NO: 147454 - RNA, 22 nt, Human
agaggcuuggaggugcaagguu

SEQ ID NO: 147455 - RNA, 22 nt, Human
uccugagcccuguaggacccug

SEQ ID NO: 147456 - RNA, 22 nt, Human
uguggggaagaguaugacuugg

SEQ ID NO: 147457 - RNA, 22 nt, Human
ccagccucacuggcaucaccua

SEQ ID NO: 147458 - RNA, 22 nt, Human
gaggggcuggguagggcaaccc

SEQ ID NO: 147459 - RNA, 22 nt, Human
guccuggcccacuggcaggcug

SEQ ID NO: 147460 - RNA, 22 nt, Human
ugggacucacucuuuuggccag

SEQ ID NO: 147461 - RNA, 22 nt, Human
gaggcugcggggaggagccugc

SEQ ID NO: 147462 - RNA, 22 nt, Human
aggaggcuguggagcacuccau

SEQ ID NO: 147463 - RNA, 22 nt, Human
uuccuggcagaggccccgacag

SEQ ID NO: 147464 - RNA, 19 nt, Human
uggcagguagugagcaguc

SEQ ID NO: 147465 - RNA, 20 nt, Human
cugcuccacccggcucucag

SEQ ID NO: 147466 - RNA, 22 nt, Human
accugccuauggagccacaugg

SEQ ID NO: 147467 - RNA, 22 nt, Human
gaggagcuguucccucaccucu

SEQ ID NO: 147468 - RNA, 22 nt, Human
ucuccugggaggacaaggaagg

SEQ ID NO: 147469 - RNA, 22 nt, Human
aggccccaaagcagugcaagua

SEQ ID NO: 147470 - RNA, 22 nt, Human
caggcuggagugcaauggcaca

SEQ ID NO: 147471 - RNA, 22 nt, Human
uucaguuccauuucaggugggu

SEQ ID NO: 147472 - RNA, 22 nt, Human
agguagggaagaaggcaugaaa

SEQ ID NO: 147473 - RNA, 22 nt, Human
acagguggcuuauuggcugauu

SEQ ID NO: 147474 - RNA, 22 nt, Human
ggugccagaguggcccaggggc

SEQ ID NO: 147475 - RNA, 22 nt, Human
gcuggcagggacagcugcgugu

SEQ ID NO: 147476 - RNA, 22 nt, Human
uucauugcaguucuucagguua

SEQ ID NO: 147477 - RNA, 22 nt, Human
auggccuggggauuccugagca

SEQ ID NO: 147478 - RNA, 22 nt, Human
ccuggcagcgccgaagcuggcc

SEQ ID NO: 147479 - RNA, 22 nt, Human
cccaggccuggucugggccagu

SEQ ID NO: 147480 - RNA, 22 nt, Human
cuguccagcuuggcuccugggg

SEQ ID NO: 147481 - RNA, 21 nt, Human
ccuagccucuuacccagcuuu

SEQ ID NO: 147482 - RNA, 22 nt, Human
ccuggcaguucaucaaauggca

SEQ ID NO: 147483 - RNA, 22 nt, Human
uccaggcuccccugcgugcucc

SEQ ID NO: 147484 - RNA, 22 nt, Human
gccuggcaauggccucaggaag

SEQ ID NO: 147485 - RNA, 22 nt, Human
cuuacaaauacacuuaggagag

SEQ ID NO: 147486 - RNA, 22 nt, Human
acaagagcauugcagguguguu

SEQ ID NO: 147487 - RNA, 22 nt, Human
cagguuggucggcaaguacaca

SEQ ID NO: 147488 - RNA, 22 nt, Human
aggaggcugcaacccugaggcc

SEQ ID NO: 147489 - RNA, 22 nt, Human
ggugccagugggucucaggaua

SEQ ID NO: 147490 - RNA, 22 nt, Human
gccgggaccaaggccacggagc

SEQ ID NO: 147491 - RNA, 22 nt, Human
cccugagcucaggcccuugggg

SEQ ID NO: 147492 - RNA, 22 nt, Human
uuccaggcaugucagacauagg

SEQ ID NO: 147493 - RNA, 22 nt, Human
agcacagggacaaugccaggug

SEQ ID NO: 147494 - RNA, 22 nt, Human
gcuggcagagcucugggcuggg

SEQ ID NO: 147495 - RNA, 22 nt, Human
cugccugcucuauccaggccug

SEQ ID NO: 147496 - RNA, 22 nt, Human
ggagcugaguucuucagccggg

SEQ ID NO: 147497 - RNA, 22 nt, Human
ggcugaguugagaggauuacuu

SEQ ID NO: 147498 - RNA, 22 nt, Human
ucuggcagugagcaacuugaca

SEQ ID NO: 147499 - RNA, 22 nt, Human
ggccucucagggcagagacccu

SEQ ID NO: 147500 - RNA, 22 nt, Human
guggcagugggaugcuaucagg

SEQ ID NO: 147501 - RNA, 22 nt, Human
ucuggcaguugccgcuucaguc

SEQ ID NO: 147502 - RNA, 22 nt, Human
uggcaguggauaggggagcggu

SEQ ID NO: 147503 - RNA, 22 nt, Human
ucccugcccucagugcacccgg

SEQ ID NO: 147504 - RNA, 22 nt, Human
gcuccaggaggaugaccuuccu

SEQ ID NO: 147505 - RNA, 22 nt, Human
gauggccuggguccccuuccgg

SEQ ID NO: 147506 - RNA, 23 nt, Human
uugggaaauaguuaagacaugag

SEQ ID NO: 147507 - RNA, 22 nt, Human
guuaggaacacuggagccuaaa

SEQ ID NO: 147508 - RNA, 22 nt, Human
ccuggcagccucagccaauucu

SEQ ID NO: 147509 - RNA, 22 nt, Human
caggauggucucgaucuccuga

SEQ ID NO: 147510 - RNA, 22 nt, Human
gagggugucugcguaacuggca

SEQ ID NO: 147511 - RNA, 22 nt, Human
uccugagcacagagacaaggaa

SEQ ID NO: 147512 - RNA, 22 nt, Human
uccugugccaucucuagagacu

SEQ ID NO: 147513 - RNA, 22 nt, Human
ccuggcagcuccuccccggcgg

SEQ ID NO: 147514 - RNA, 19 nt, Human
acuggcagcuguagucugu

SEQ ID NO: 147515 - RNA, 22 nt, Human
aaaagagucuuaggcagucaua

SEQ ID NO: 147516 - RNA, 22 nt, Human
uccaggcucccucaggaugcac

SEQ ID NO: 147517 - RNA, 22 nt, Human
ccccacccucgcuccauuucgg

SEQ ID NO: 147518 - RNA, 22 nt, Human
ucuggcaggacaugcugaccau

SEQ ID NO: 147519 - RNA, 17 nt, Human
ugcuggcaacauacaaa

SEQ ID NO: 147520 - RNA, 22 nt, Human
gaaaagaguccugugugaggag

SEQ ID NO: 147521 - RNA, 23 nt, Human
uuggagagggugaguagugucag

SEQ ID NO: 147522 - RNA, 22 nt, Human
gacuguggggggcggacacaag

SEQ ID NO: 147523 - RNA, 22 nt, Human
ucaggauggagggaagcacaga

SEQ ID NO: 147524 - RNA, 22 nt, Human
auccaggcgaaugcagaaggcc

SEQ ID NO: 147525 - RNA, 22 nt, Human
acaggugguaaaauggacuguc

SEQ ID NO: 147526 - RNA, 22 nt, Human
cuuggcaguuucggaaggauga

SEQ ID NO: 147527 - RNA, 22 nt, Human
acuggcagagguuggacaccau

SEQ ID NO: 147528 - RNA, 22 nt, Human
cggcuggugucgggcacagcaa

SEQ ID NO: 147529 - RNA, 22 nt, Human
uggccuccccuaacagccucuu

SEQ ID NO: 147530 - RNA, 22 nt, Human
acuccugggugcugaccagcgu

SEQ ID NO: 147531 - RNA, 22 nt, Human
ggagccugaaaagucugcauuu

SEQ ID NO: 147532 - RNA, 22 nt, Human
uccuggcagugcuuguuuugga

SEQ ID NO: 147533 - RNA, 22 nt, Human
acagguggccccgagggagugg

SEQ ID NO: 147534 - RNA, 22 nt, Human
cacaaaaguaggaggcaggcgg

SEQ ID NO: 147535 - RNA, 20 nt, Human
gcuccaggucagagaggacg

SEQ ID NO: 147536 - RNA, 22 nt, Human
cagaaagaccugggcucaagag

SEQ ID NO: 147537 - RNA, 22 nt, Human
cuggcaggagcauucacagagg

SEQ ID NO: 147538 - RNA, 23 nt, Human
ccuggcagcaaacgaggagguua

SEQ ID NO: 147539 - RNA, 22 nt, Human
ccuggcagcaggugggcccgug

SEQ ID NO: 147540 - RNA, 22 nt, Human
ccuggcagcuguuuggcuuggc

SEQ ID NO: 147541 - RNA, 22 nt, Human
agucacaguuucccugagagag

SEQ ID NO: 147542 - RNA, 22 nt, Human
ucuggcaggauaucgaagugaa

SEQ ID NO: 147543 - RNA, 22 nt, Human
uggcaggaaaguaacagagcac

SEQ ID NO: 147544 - RNA, 22 nt, Human
ccuucucucugaagaccccaaa

SEQ ID NO: 147545 - RNA, 22 nt, Human
ucuggcagguucccauguuaug

SEQ ID NO: 147546 - RNA, 22 nt, Human
cuuggcaggguggaggaugcag

SEQ ID NO: 147547 - RNA, 18 nt, Human
uccugccugugccccagg

SEQ ID NO: 147548 - RNA, 22 nt, Human
cugccugcaggacaccucgcua

SEQ ID NO: 147549 - RNA, 22 nt, Human
uccuggcauccgugggucugug

SEQ ID NO: 147550 - RNA, 22 nt, Human
uuccaggcucccuuggaggugu

SEQ ID NO: 147551 - RNA, 22 nt, Human
ugcacaggugagacucaggaag

SEQ ID NO: 147552 - RNA, 22 nt, Human
uccugagcuacaguaguaugau

SEQ ID NO: 147553 - RNA, 22 nt, Human
gcuggcaggguucucacugaaa

SEQ ID NO: 147554 - RNA, 22 nt, Human
gaaagaagcuuuagauggcuau

SEQ ID NO: 147555 - RNA, 22 nt, Human
gcuccaggugucccagguaaaa

SEQ ID NO: 147556 - RNA, 23 nt, Human
uccuuccuuugagaggcuccauc

SEQ ID NO: 147557 - RNA, 22 nt, Human
guugggaaggcaagaaguagaa

SEQ ID NO: 147558 - RNA, 22 nt, Human
agaggcuucucggauggggcag

SEQ ID NO: 147559 - RNA, 22 nt, Human
acuggcagaacuggugauuguc

SEQ ID NO: 147560 - RNA, 22 nt, Human
ccugccucccagagguccucua

SEQ ID NO: 147561 - RNA, 22 nt, Human
ucccuccccacuucugagcuuu

SEQ ID NO: 147562 - RNA, 20 nt, Human
ucccucccuccagcucuggg

SEQ ID NO: 147563 - RNA, 22 nt, Human
ugagggacucccggcccugcca

SEQ ID NO: 147564 - RNA, 22 nt, Human
gcuggcaggagaaacggggugc

SEQ ID NO: 147565 - RNA, 19 nt, Human
acuggcaguuucugcaugg

SEQ ID NO: 147566 - RNA, 22 nt, Human
uuccaggcuauccggugaaggg

SEQ ID NO: 147567 - RNA, 22 nt, Human
uuggaaaguuuuuacugaagac

SEQ ID NO: 147568 - RNA, 22 nt, Human
acuggcaguagagggagcgcau

SEQ ID NO: 147569 - RNA, 22 nt, Human
ccuggcagcccagagcgccgcu

SEQ ID NO: 147570 - RNA, 22 nt, Human
ugcuggcacguggaccaggaga

SEQ ID NO: 147571 - RNA, 22 nt, Human
cccagccuacucugccauagca

SEQ ID NO: 147572 - RNA, 22 nt, Human
guugggaaggugaacaugaugc

SEQ ID NO: 147573 - RNA, 22 nt, Human
acccacccuacuagcagugucc

SEQ ID NO: 147574 - RNA, 22 nt, Human
gcugcgccggaucccacguucc

SEQ ID NO: 147575 - RNA, 22 nt, Human
ucuuuuucugcacacguguccc

SEQ ID NO: 147576 - RNA, 22 nt, Human
ugcacaggaggcuguggagaag

SEQ ID NO: 147577 - RNA, 22 nt, Human
guggcagucgcugacagauaca

SEQ ID NO: 147578 - RNA, 18 nt, Human
ggcagggaaaagauaggg

SEQ ID NO: 147579 - RNA, 23 nt, Human
acuccccagucucuucuugccaa

SEQ ID NO: 147580 - RNA, 22 nt, Human
cccugagcgugaggaggaagua

SEQ ID NO: 147581 - RNA, 22 nt, Human
ucccagccacaguuuccaccug

SEQ ID NO: 147582 - RNA, 22 nt, Human
cugccugcucaccagggcucug

SEQ ID NO: 147583 - RNA, 18 nt, Human
acucugcggaggccccag

SEQ ID NO: 147584 - RNA, 22 nt, Human
ccugaccuauuuuucucagcug

SEQ ID NO: 147585 - RNA, 22 nt, Human
acuggcagugucguuuacauga

SEQ ID NO: 147586 - RNA, 22 nt, Human
gaggagcugggacccugucauc

SEQ ID NO: 147587 - RNA, 22 nt, Human
cugcaggacgaccgccucaucu

SEQ ID NO: 147588 - RNA, 22 nt, Human
ccagguccuguuuucaccacag

SEQ ID NO: 147589 - RNA, 22 nt, Human
uuccaggcuucucuggggcguc

SEQ ID NO: 147590 - RNA, 22 nt, Human
ccagcccuugcugaaggguggc

SEQ ID NO: 147591 - RNA, 22 nt, Human
gcuccaggagagggaagcagau

SEQ ID NO: 147592 - RNA, 22 nt, Human
uccugagccugacaaucaccau

SEQ ID NO: 147593 - RNA, 17 nt, Human
uuaagguggaucagcac

SEQ ID NO: 147594 - RNA, 22 nt, Human
ucuggcagcagcaucaguggcu

SEQ ID NO: 147595 - RNA, 22 nt, Human
uuccugccccugagagcuccca

SEQ ID NO: 147596 - RNA, 22 nt, Human
uuccuggccccaccccuggaga

SEQ ID NO: 147597 - RNA, 18 nt, Human
cuccuccacagccccugc

SEQ ID NO: 147598 - RNA, 22 nt, Human
gcuccaggcagcauaguggaug

SEQ ID NO: 147599 - RNA, 22 nt, Human
ucuggcagcaagauaacaaugg

SEQ ID NO: 147600 - RNA, 22 nt, Human
uccugagcaacacagcuaagug

SEQ ID NO: 147601 - RNA, 22 nt, Human
ccuggcaggcuggggacagugc

SEQ ID NO: 147602 - RNA, 22 nt, Human
cugccugcuuaccaugcaucag

SEQ ID NO: 147603 - RNA, 22 nt, Human
gcuggcaguuuccucaccgagg

SEQ ID NO: 147604 - RNA, 22 nt, Human
cuccuggcucgcccccagcuga

SEQ ID NO: 147605 - RNA, 22 nt, Human
ucuggcagugaagucaugaggu

SEQ ID NO: 147606 - RNA, 22 nt, Human
acuggcaggcugcuggccggcg

SEQ ID NO: 147607 - RNA, 22 nt, Human
gaugccuggcacccagcaagga

SEQ ID NO: 147608 - RNA, 22 nt, Human
gagagaaaagggggaauugauu

SEQ ID NO: 147609 - RNA, 22 nt, Human
ccuggcugguggcagcgacaag

SEQ ID NO: 147610 - RNA, 22 nt, Human
acagguggaggcuuuaggaggu

SEQ ID NO: 147611 - RNA, 22 nt, Human
gccuggcaggggccugggagug

SEQ ID NO: 147612 - RNA, 22 nt, Human
ucccagccuuucuuuucugcug

SEQ ID NO: 147613 - RNA, 22 nt, Human
ccacaaaacugugugucaaaga

SEQ ID NO: 147614 - RNA, 19 nt, Human
ugccuggcaccagcuccac

SEQ ID NO: 147615 - RNA, 22 nt, Human
ccccacccaccuaagagaaacu

SEQ ID NO: 147616 - RNA, 21 nt, Human
aggcugcuggcucaggguccu

SEQ ID NO: 147617 - RNA, 22 nt, Human
uuccaggcugaugggccacagg

SEQ ID NO: 147618 - RNA, 22 nt, Human
ccagcccugccagagagagcug

SEQ ID NO: 147619 - RNA, 22 nt, Human
ccuggcagguuacaaccaguua

SEQ ID NO: 147620 - RNA, 22 nt, Human
ucccaccccggucaagggcuga

SEQ ID NO: 147621 - RNA, 22 nt, Human
uccugagcugccgcaucagcag

SEQ ID NO: 147622 - RNA, 22 nt, Human
agcacaggaacauggagauggg

SEQ ID NO: 147623 - RNA, 22 nt, Human
caccagggccccaggcugugcc

SEQ ID NO: 147624 - RNA, 21 nt, Human
agugccaguagguauggagga

SEQ ID NO: 147625 - RNA, 22 nt, Human
agcacaggaccaaggaagcugu

SEQ ID NO: 147626 - RNA, 22 nt, Human
cccacccucaagggugucuaua

SEQ ID NO: 147627 - RNA, 22 nt, Human
ccagcccugucaccaacuggag

SEQ ID NO: 147628 - RNA, 22 nt, Human
caggacaaagcccuuugagaaa

SEQ ID NO: 147629 - RNA, 22 nt, Human
auccuggcccagguguggaggg

SEQ ID NO: 147630 - RNA, 22 nt, Human
cugccugccacguucagcugua

SEQ ID NO: 147631 - RNA, 22 nt, Human
cugagcagugguucuugagcgc

SEQ ID NO: 147632 - RNA, 22 nt, Human
gcuggcaggagccuuucccuuu

SEQ ID NO: 147633 - RNA, 18 nt, Human
ccuggcagccaugcgcgc

SEQ ID NO: 147634 - RNA, 22 nt, Human
ccaggcugggcggggaaccugg

SEQ ID NO: 147635 - RNA, 22 nt, Human
uccuggcacccuuggguuggag

SEQ ID NO: 147636 - RNA, 17 nt, Human
agccugccccaugcugc

SEQ ID NO: 147637 - RNA, 22 nt, Human
caggagggcccgagacucuucc

SEQ ID NO: 147638 - RNA, 22 nt, Human
ccuggcagguggcgcccucggc

SEQ ID NO: 147639 - RNA, 22 nt, Human
gaggagcucugcuccauccuuc

SEQ ID NO: 147640 - RNA, 22 nt, Human
gagccugaugaaacaggcagac

SEQ ID NO: 147641 - RNA, 22 nt, Human
gcuggcagggugguugagagag

SEQ ID NO: 147642 - RNA, 22 nt, Human
gagaaagacguaggcugggagg

SEQ ID NO: 147643 - RNA, 22 nt, Human
gaggagcuggcagcgucuccgc

SEQ ID NO: 147644 - RNA, 22 nt, Human
ccuggcagacagcacugaagcu

SEQ ID NO: 147645 - RNA, 22 nt, Human
acagaguccuagcugcaaagaa

SEQ ID NO: 147646 - RNA, 19 nt, Human
ucuggcagguaauuaggga

SEQ ID NO: 147647 - RNA, 19 nt, Human
gcuggcagaauuuugaacc

SEQ ID NO: 147648 - RNA, 22 nt, Human
ucuggcaguggaugagggcagc

SEQ ID NO: 147649 - RNA, 22 nt, Human
aagagccagcuagugaagaggc

SEQ ID NO: 147650 - RNA, 22 nt, Human
cuccugaggaaaagcuugguca

SEQ ID NO: 147651 - RNA, 22 nt, Human
ucccugccugacagcacccacc

SEQ ID NO: 147652 - RNA, 22 nt, Human
agggcugacaaauggcagugac

SEQ ID NO: 147653 - RNA, 22 nt, Human
acuggcagagggaaaaccauuc

SEQ ID NO: 147654 - RNA, 22 nt, Human
ugcuccagugccugccccacag

SEQ ID NO: 147655 - RNA, 22 nt, Human
gacaaaaguguuuugaacaagg

SEQ ID NO: 147656 - RNA, 22 nt, Human
acuggcagggggagccccgaga

SEQ ID NO: 147657 - RNA, 22 nt, Human
ucuggcaguuugagaaaggcua

SEQ ID NO: 147658 - RNA, 22 nt, Human
ccuggcagaauauuaaagugca

SEQ ID NO: 147659 - RNA, 22 nt, Human
uuccuggcauagagagggcaca

SEQ ID NO: 147660 - RNA, 22 nt, Human
gagacacacauucuggagagaa

SEQ ID NO: 147661 - RNA, 22 nt, Human
aagaggucauaccagauaaggg

SEQ ID NO: 147662 - RNA, 22 nt, Human
agacacagcugcaggagguggg

SEQ ID NO: 147663 - RNA, 22 nt, Human
ugguaagaacccaucagagaag

SEQ ID NO: 147664 - RNA, 22 nt, Human
uccucuccaugucucacgccac

SEQ ID NO: 147665 - RNA, 22 nt, Human
uccacccugcuuucuuaucucc

SEQ ID NO: 147666 - RNA, 22 nt, Human
ucccacccccuccaaggaggaa

SEQ ID NO: 147667 - RNA, 22 nt, Human
aagugccaucauagcauggcug

SEQ ID NO: 147668 - RNA, 22 nt, Human
ugccugacugcugccaccacua

SEQ ID NO: 147669 - RNA, 19 nt, Human
ccuugccugucccugcagc

SEQ ID NO: 147670 - RNA, 22 nt, Human
ccucucagcgauuccucuugga

SEQ ID NO: 147671 - RNA, 22 nt, Human
uccuggcaaagauguugguguu

SEQ ID NO: 147672 - RNA, 22 nt, Human
uccaggcaagggaggagcaugg

SEQ ID NO: 147673 - RNA, 22 nt, Human
ucccuccuggccgucaccgcug

SEQ ID NO: 147674 - RNA, 22 nt, Human
agacaagaaacugggagucucu

SEQ ID NO: 147675 - RNA, 22 nt, Human
gucacaggccuggaugaggggc

SEQ ID NO: 147676 - RNA, 22 nt, Human
gccuggcauauaguaguugugc

SEQ ID NO: 147677 - RNA, 22 nt, Human
ccugccuucagcccugaagucu

SEQ ID NO: 147678 - RNA, 22 nt, Human
cuggcaguuugccaggagcucg

SEQ ID NO: 147679 - RNA, 22 nt, Human
ucuggcagugauuucugugauc

SEQ ID NO: 147680 - RNA, 21 nt, Human
ucacguggucacaugagcuuu

SEQ ID NO: 147681 - RNA, 22 nt, Human
ucuggcagggucagggcccagg

SEQ ID NO: 147682 - RNA, 22 nt, Human
gccuggcaaggcccuguugacu

SEQ ID NO: 147683 - RNA, 22 nt, Human
gacugccucaguuucccugcag

SEQ ID NO: 147684 - RNA, 22 nt, Human
agggcugacagugaggagucaa

SEQ ID NO: 147685 - RNA, 20 nt, Human
ucuggcaggugaacgagcug

SEQ ID NO: 147686 - RNA, 22 nt, Human
gaccugccugagcugccucugc

SEQ ID NO: 147687 - RNA, 22 nt, Human
aguguugggucuuuagaauuua

SEQ ID NO: 147688 - RNA, 22 nt, Human
auggccugcagugcugccacag

SEQ ID NO: 147689 - RNA, 23 nt, Human
gcccacccucagcguccucacgg

SEQ ID NO: 147690 - RNA, 19 nt, Human
cagcccucuuaccacugug

SEQ ID NO: 147691 - RNA, 22 nt, Human
ucuggcagcaagucuguuucuc

SEQ ID NO: 147692 - RNA, 22 nt, Human
accugccucagugcagcuggau

SEQ ID NO: 147693 - RNA, 22 nt, Human
ccucugccaccucccacgaggc

SEQ ID NO: 147694 - RNA, 22 nt, Human
ucuggcagggguucugcacuug

SEQ ID NO: 147695 - RNA, 18 nt, Human
acaggcugugggaauggu

SEQ ID NO: 147696 - RNA, 22 nt, Human
aagucguggcaggcuugcacga

SEQ ID NO: 147697 - RNA, 22 nt, Human
ugacaggaggcuugaggccagg

SEQ ID NO: 147698 - RNA, 22 nt, Human
ucccacccauccugcaucucuu

SEQ ID NO: 147699 - RNA, 23 nt, Human
uuccaggcagagcagggauuaga

SEQ ID NO: 147700 - RNA, 22 nt, Human
gcuggcagagacaagaagacua

SEQ ID NO: 147701 - RNA, 22 nt, Human
gaggacucugggcguguauggg

SEQ ID NO: 147702 - RNA, 22 nt, Human
ucuggcaggucaaucauucuuu

SEQ ID NO: 147703 - RNA, 22 nt, Human
ggagcugaaggggugggcucag

SEQ ID NO: 147704 - RNA, 22 nt, Human
agcagguugugauacacucaga

SEQ ID NO: 147705 - RNA, 22 nt, Human
gcuggcaggagaccauacccua

SEQ ID NO: 147706 - RNA, 22 nt, Human
uccaggccauugacugcauccu

SEQ ID NO: 147707 - RNA, 22 nt, Human
agggaagaagcugguaguaggu

SEQ ID NO: 147708 - RNA, 22 nt, Human
cagggacaauggcagagccuga

SEQ ID NO: 147709 - RNA, 22 nt, Human
cccagccuuugcuuccugguuc

SEQ ID NO: 147710 - RNA, 22 nt, Human
gaggcuguuaggagggacucug

SEQ ID NO: 147711 - RNA, 22 nt, Human
acuggcagaauugaauaguugu

SEQ ID NO: 147712 - RNA, 22 nt, Human
uugggaagaaacauguccauca

SEQ ID NO: 147713 - RNA, 22 nt, Human
gcuggcaggauaacuucuaagc

SEQ ID NO: 147714 - RNA, 22 nt, Human
ucccagccuuccagucugguuu

SEQ ID NO: 147715 - RNA, 20 nt, Human
acuggcagccugccugcugu

SEQ ID NO: 147716 - RNA, 22 nt, Human
gccuggcaggccuguuggggcu

SEQ ID NO: 147717 - RNA, 22 nt, Human
acuggcaguggcagcagaaaga

SEQ ID NO: 147718 - RNA, 22 nt, Human
gcuggcaguguauuguuagcug

SEQ ID NO: 147719 - RNA, 22 nt, Human
cuccuggcaguuccccuuguca

SEQ ID NO: 147720 - RNA, 22 nt, Human
ggccucagagaaggcugugcgg

SEQ ID NO: 147721 - RNA, 22 nt, Human
uuccaggccgggcaggaaacac

SEQ ID NO: 147722 - RNA, 21 nt, Human
ucuggcaguggucuuucaaau

SEQ ID NO: 147723 - RNA, 22 nt, Human
cugagccagggccacacaugga

SEQ ID NO: 147724 - RNA, 22 nt, Human
cccacccugggaagcuaggcag

SEQ ID NO: 147725 - RNA, 17 nt, Human
uccaggcagcaacugag

SEQ ID NO: 147726 - RNA, 22 nt, Human
aaagagucaaaggcaugucucu

SEQ ID NO: 147727 - RNA, 22 nt, Human
ucaggcccuucucccaggacuc

SEQ ID NO: 147728 - RNA, 22 nt, Human
ccuggcaggccccuccuggauu

SEQ ID NO: 147729 - RNA, 22 nt, Colorado tick fever virus
ucgcaaggugaggcaguucaug

SEQ ID NO: 147730 - RNA, 22 nt, Colorado tick fever virus
cauuuguauugcacaauguacu

SEQ ID NO: 147731 - RNA, 22 nt, Human
ugccuaggcuggaaugcagugg

SEQ ID NO: 147732 - RNA, 19 nt, Human
acccucuccccacuggguc

SEQ ID NO: 147733 - RNA, 22 nt, Human
caugcaugccgggcugacagag

SEQ ID NO: 147734 - RNA, 22 nt, Human
gaacugcauugugguauauguu

SEQ ID NO: 147735 - RNA, 22 nt, Human
acugccaguuguuuuguccagu

SEQ ID NO: 147736 - RNA, 22 nt, Human
uaugcuagauggaaaaauauug

SEQ ID NO: 147737 - RNA, 20 nt, Human
ucccuggggcccuacuuccu

SEQ ID NO: 147738 - RNA, 22 nt, Human
uugaguuuccugacagcgaagg

SEQ ID NO: 147739 - RNA, 22 nt, Human
gccgugcgugcgcaggugcugu

SEQ ID NO: 147740 - RNA, 22 nt, Human
acuucacagauauuuauuuggu

SEQ ID NO: 147741 - RNA, 23 nt, Human
gcauccagagcucaguccccuuu

SEQ ID NO: 147742 - RNA, 22 nt, Human
cccacucccugcacgccugccg

SEQ ID NO: 147743 - RNA, 22 nt, Human
ugcauccuguucuagguuuggg

SEQ ID NO: 147744 - RNA, 22 nt, Human
aaggcucccucuucucgagugu

SEQ ID NO: 147745 - RNA, 22 nt, Human
caauuaccaguaauugagguuu

SEQ ID NO: 147746 - RNA, 22 nt, Human
uaagccugcaugaaccaugaga

SEQ ID NO: 147747 - RNA, 22 nt, Human
acagccaggaauucuggagaag

SEQ ID NO: 147748 - RNA, 19 nt, Human
uccugcccaccagccaggg

SEQ ID NO: 147749 - RNA, 22 nt, Human
aagcagcacagcaaugacucua

SEQ ID NO: 147750 - RNA, 22 nt, Human
cuccaaaggauaaaagcagagu

SEQ ID NO: 147751 - RNA, 22 nt, Human
ccagacuggggcuccuugaggg

SEQ ID NO: 147752 - RNA, 22 nt, Human
gacacugcacuuggggcccaca

SEQ ID NO: 147753 - RNA, 22 nt, Human
cugaagcugggcacuuccuuuu

SEQ ID NO: 147754 - RNA, 21 nt, Human
ccacaauucuaguuacauaug

SEQ ID NO: 147755 - RNA, 20 nt, Human
gacuucaauuucuaucuuuu

SEQ ID NO: 147756 - RNA, 22 nt, Human
uuuagcaaggagaaauaauccu

SEQ ID NO: 147757 - RNA, 22 nt, Human
uugcaaauaauagccugaaacu

SEQ ID NO: 147758 - RNA, 22 nt, Human
cugcagggcccaaggucaacgg

SEQ ID NO: 147759 - RNA, 22 nt, Human
ccagcagcucccucaggguccg

SEQ ID NO: 147760 - RNA, 22 nt, Human
ugguccucacccuacccagcug

SEQ ID NO: 147761 - RNA, 22 nt, Human
ccugcacuaccuggggcugcug

SEQ ID NO: 147762 - RNA, 22 nt, Human
uugaagcauuugcuauagcauu

SEQ ID NO: 147763 - RNA, 22 nt, Human
gugcaaagcuuaacauucugca

SEQ ID NO: 147764 - RNA, 22 nt, Human
gucaucaucaggcagaugcugc

SEQ ID NO: 147765 - RNA, 22 nt, Human
cccugcacagccuggcucucuu

SEQ ID NO: 147766 - RNA, 18 nt, Human
ggccucagccuggccgga

SEQ ID NO: 147767 - RNA, 22 nt, Human
ccugggaaggugaggcccugga

SEQ ID NO: 147768 - RNA, 22 nt, Human
cagggagaggccucuguugccc

SEQ ID NO: 147769 - RNA, 22 nt, Human
ucccaggauguuuauggcuggu

SEQ ID NO: 147770 - RNA, 22 nt, Human
cugcuucacccugccugagaac

SEQ ID NO: 147771 - RNA, 22 nt, Human
ucaccggugacccucggcucgc

SEQ ID NO: 147772 - RNA, 22 nt, Human
cacuuuuaacaggagaauuccc

SEQ ID NO: 147773 - RNA, 22 nt, Human
aaaugcacugaauauuccaaau

SEQ ID NO: 147774 - RNA, 22 nt, Human
acugcauuugguaaagucaaga

SEQ ID NO: 147775 - RNA, 22 nt, Human
auccuucaaaaggaauagcagg

SEQ ID NO: 147776 - RNA, 22 nt, Human
ucauccugaagaaccugcuucc

SEQ ID NO: 147777 - RNA, 22 nt, Human
ugccucugcugcauauucaccu

SEQ ID NO: 147778 - RNA, 22 nt, Human
gcaaggagcaccuuucuggaac

SEQ ID NO: 147779 - RNA, 22 nt, Human
cugcagaugguauuguucuggu

SEQ ID NO: 147780 - RNA, 22 nt, Human
ugcaugacaauugccgucaagu

SEQ ID NO: 147781 - RNA, 22 nt, Human
caagcagauauuuuagucaaga

SEQ ID NO: 147782 - RNA, 22 nt, Human
auccucagagaacgaacacaau

SEQ ID NO: 147783 - RNA, 22 nt, Human
cugaugcucuggauguagucaa

SEQ ID NO: 147784 - RNA, 22 nt, Human
ucaaaaugccgagugcccaggu

SEQ ID NO: 147785 - RNA, 22 nt, Human
uuacccagugaagccgaggcag

SEQ ID NO: 147786 - RNA, 22 nt, Human
ugcccugcagacccugcagugu

SEQ ID NO: 147787 - RNA, 22 nt, Human
gauuuucauuauagcuaguuuc

SEQ ID NO: 147788 - RNA, 22 nt, Human
ggcacugggugagggucacugg

SEQ ID NO: 147789 - RNA, 22 nt, Human
auugaagacuugguauccgugg

SEQ ID NO: 147790 - RNA, 22 nt, Human
ucauuccuccagcgggagucca

SEQ ID NO: 147791 - RNA, 22 nt, Human
uccuugcagcaggaacccacuu

SEQ ID NO: 147792 - RNA, 22 nt, Human
cacucacccgguccuucccagu

SEQ ID NO: 147793 - RNA, 22 nt, Human
ccagcagcgauagggugagugc

SEQ ID NO: 147794 - RNA, 22 nt, Human
uucagcacuggacagcgagucu

SEQ ID NO: 147795 - RNA, 22 nt, Human
cugcucaauuccggcacgcugg

SEQ ID NO: 147796 - RNA, 22 nt, Human
gccuggcaaggcccuguugacu

SEQ ID NO: 147797 - RNA, 22 nt, Human
uacagcgaaaauuuagcuugau

SEQ ID NO: 147798 - RNA, 22 nt, Human
cggcagagcccugagucagccu

SEQ ID NO: 147799 - RNA, 20 nt, Human
uugcaaagugaauagcaauu

SEQ ID NO: 147800 - RNA, 21 nt, Human
uaaggaagagcauuuuagguc

SEQ ID NO: 147801 - RNA, 22 nt, Human
ucugcucagccgaucugcuccg

SEQ ID NO: 147802 - RNA, 21 nt, Human
uaagcuaaacauucaguuaac

SEQ ID NO: 147803 - RNA, 22 nt, Human
gcgcugccucugcucuccccac

SEQ ID NO: 147804 - RNA, 22 nt, Human
guuaacaacacugugagugcug

SEQ ID NO: 147805 - RNA, 22 nt, Human
cagucauuaugggaguuaaucc

SEQ ID NO: 147806 - RNA, 22 nt, Human
ugacagcccaccucacaggauu

SEQ ID NO: 147807 - RNA, 22 nt, Human
acugcauuaucaccaagaugua

SEQ ID NO: 147808 - RNA, 22 nt, Human
aagagagaacucccuucgccag

SEQ ID NO: 147809 - RNA, 21 nt, Human
uuuaaggccagcaggagguga

SEQ ID NO: 147810 - RNA, 22 nt, Human
agccagcauauauauaguugaa

SEQ ID NO: 147811 - RNA, 22 nt, Human
cugcagggcagggccuccuggc

SEQ ID NO: 147812 - RNA, 22 nt, Human
ggcagucuuucccuugagcucu

SEQ ID NO: 147813 - RNA, 22 nt, Human
cugcauaucaaauuacuccugg

SEQ ID NO: 147814 - RNA, 22 nt, Human
cgccguccccuaggaaagagcu

SEQ ID NO: 147815 - RNA, 22 nt, Human
aagguccuguagccacagagcc

SEQ ID NO: 147816 - RNA, 22 nt, Human
accuuuaugaaacagcugucgu

SEQ ID NO: 147817 - RNA, 22 nt, Human
aagcuggccuguaccugcugag

SEQ ID NO: 147818 - RNA, 22 nt, Human
ggcacagcugaugcagacacac

SEQ ID NO: 147819 - RNA, 22 nt, Human
cucacucaguuuuuaguucauc

SEQ ID NO: 147820 - RNA, 22 nt, Human
uuucacaugguacugccuguuu

SEQ ID NO: 147821 - RNA, 22 nt, Human
aaaugccucauuuucucucacu

SEQ ID NO: 147822 - RNA, 22 nt, Human
uacaccagauuauuuauaacau

SEQ ID NO: 147823 - RNA, 21 nt, Human
ugcaaugcauugacagcagca

SEQ ID NO: 147824 - RNA, 22 nt, Human
cagagcugucauuugccaguga

SEQ ID NO: 147825 - RNA, 22 nt, Human
uauucacagcugccgcacucag

SEQ ID NO: 147826 - RNA, 22 nt, Human
uacauuccaaaggaaacuggcu

SEQ ID NO: 147827 - RNA, 22 nt, Human
aaagcuauuuuauugcagcucu

SEQ ID NO: 147828 - RNA, 22 nt, Human
uccucagcaaacacuucacucu

SEQ ID NO: 147829 - RNA, 18 nt, Human
uauaaacacacuuagguu

SEQ ID NO: 147830 - RNA, 22 nt, Human
uguguacauguaucaacuaucg

SEQ ID NO: 147831 - RNA, 22 nt, Human
ccagcagccaccuucucgaaau

SEQ ID NO: 147832 - RNA, 20 nt, Human
augcacccucagggucccug

SEQ ID NO: 147833 - RNA, 22 nt, Human
ugcacccacuuagcugaaguuc

SEQ ID NO: 147834 - RNA, 22 nt, Human
agcagccuugugacuccggggu

SEQ ID NO: 147835 - RNA, 22 nt, Human
cgucauuuguaaaugaucaaga

SEQ ID NO: 147836 - RNA, 22 nt, Human
uccgggagcugaacgucuugcg

SEQ ID NO: 147837 - RNA, 22 nt, Human
uugauguaauacuuugcaacca

SEQ ID NO: 147838 - RNA, 22 nt, Human
caugcauuucuaccaaggaaua

SEQ ID NO: 147839 - RNA, 23 nt, Human
acauuacacgcaguaauugcccc

SEQ ID NO: 147840 - RNA, 22 nt, Human
auugucgucaauggacacauag

SEQ ID NO: 147841 - RNA, 22 nt, Human
cuauucaguugugggcaacaau

SEQ ID NO: 147842 - RNA, 21 nt, Human
acaaauuguuuauauaggaag

SEQ ID NO: 147843 - RNA, 22 nt, Human
cacggccacugcagcaccccag

SEQ ID NO: 147844 - RNA, 22 nt, Human
auugugcaccuacugugugcag

SEQ ID NO: 147845 - RNA, 23 nt, Human
auagaccauugucucacacuuca

SEQ ID NO: 147846 - RNA, 22 nt, Human
caaugcagauaccuuccagaga

SEQ ID NO: 147847 - RNA, 21 nt, Human
ucacuagugccuucugucauu

SEQ ID NO: 147848 - RNA, 22 nt, Human
uucuccagcucaucagggaggg

SEQ ID NO: 147849 - RNA, 22 nt, Human
ugcaaauucuuuacucugugau

SEQ ID NO: 147850 - RNA, 22 nt, Human
cugcaucaguggauaugauggu

SEQ ID NO: 147851 - RNA, 22 nt, Human
gcagccuccgcacugcgagucc

SEQ ID NO: 147852 - RNA, 22 nt, Human
agugccucugcagguccgaguu

SEQ ID NO: 147853 - RNA, 22 nt, Human
agacagcacuuuuguauggggg

SEQ ID NO: 147854 - RNA, 19 nt, Human
ugguucuccuuccacaguc

SEQ ID NO: 147855 - RNA, 22 nt, Human
gagcagcaggccagguugcagg

SEQ ID NO: 147856 - RNA, 22 nt, Human
caucugcaggggaagccaguuu

SEQ ID NO: 147857 - RNA, 22 nt, Human
ugucuucauuccccaugaaguc

SEQ ID NO: 147858 - RNA, 22 nt, Human
cugcaccgugucucgggcugcc

SEQ ID NO: 147859 - RNA, 22 nt, Human
uucacagcuaagagcuaaguaa

SEQ ID NO: 147860 - RNA, 22 nt, Human
augagugcuuagagaguaaucc

SEQ ID NO: 147861 - RNA, 22 nt, Human
gcuaagggauaggcugccuccu

SEQ ID NO: 147862 - RNA, 22 nt, Human
ggcaauuacguauuagucaugu

SEQ ID NO: 147863 - RNA, 23 nt, Human
aagaaugcuucugaagagcugcc

SEQ ID NO: 147864 - RNA, 22 nt, Human
ucauuguuucugcuuuucauga

SEQ ID NO: 147865 - RNA, 22 nt, Human
guucuccaggggcuguucaucu

SEQ ID NO: 147866 - RNA, 21 nt, Human
acuguauuguuuucaaggauc

SEQ ID NO: 147867 - RNA, 22 nt, Human
agacugugagaagauggcugcg

SEQ ID NO: 147868 - RNA, 23 nt, Human
aacugcaagguugcugggaagua

SEQ ID NO: 147869 - RNA, 22 nt, Human
uacugcaaaccauuuacaguag

SEQ ID NO: 147870 - RNA, 22 nt, Human
cugagcagaagggugcacgugc

SEQ ID NO: 147871 - RNA, 22 nt, Human
acuugcaucuuagagacucacc

SEQ ID NO: 147872 - RNA, 22 nt, Human
uacccacugucauauucagggu

SEQ ID NO: 147873 - RNA, 22 nt, Human
ggacagacuuuacagccccggg

SEQ ID NO: 147874 - RNA, 22 nt, Human
gcugcaagugcauguugcaacu

SEQ ID NO: 147875 - RNA, 22 nt, Human
acagacacaggcguggagucgc

SEQ ID NO: 147876 - RNA, 22 nt, Human
agcaggcauuugauauauauuu

SEQ ID NO: 147877 - RNA, 22 nt, Human
acacacagaaggaagccccacu

SEQ ID NO: 147878 - RNA, 22 nt, Human
uuucagacaggcucagagccgu

SEQ ID NO: 147879 - RNA, 22 nt, Human
gcacccagggcaggaagugagg

SEQ ID NO: 147880 - RNA, 22 nt, Human
ccaucuucucuugaaccuccuu

SEQ ID NO: 147881 - RNA, 19 nt, Human
aacuacagcgcacuguccu

SEQ ID NO: 147882 - RNA, 22 nt, Human
aauggagugguucuugcccucu

SEQ ID NO: 147883 - RNA, 22 nt, Human
gucgaucaccucguccuccgug

SEQ ID NO: 147884 - RNA, 22 nt, Human
gaaugcacacgugugugcaugc

SEQ ID NO: 147885 - RNA, 22 nt, Human
auggaguugagcucuguugucc

SEQ ID NO: 147886 - RNA, 22 nt, Human
aagugauuucugccugcauguu

SEQ ID NO: 147887 - RNA, 23 nt, Human
uguguucagucaaggaucagagu

SEQ ID NO: 147888 - RNA, 22 nt, Human
acuggauucucuuacacagaug

SEQ ID NO: 147889 - RNA, 22 nt, Human
agccccaggcccggacgccucu

SEQ ID NO: 147890 - RNA, 22 nt, Human
gugauuuucuccuccuagaagu

SEQ ID NO: 147891 - RNA, 22 nt, Human
aaggcuccagugaaugcuggca

SEQ ID NO: 147892 - RNA, 22 nt, Human
ccugggcaaaugccagagacaa

SEQ ID NO: 147893 - RNA, 22 nt, Human
cacaccuuaggccugagcgcuu

SEQ ID NO: 147894 - RNA, 22 nt, Human
acaccuuuuauucgccaggcac

SEQ ID NO: 147895 - RNA, 22 nt, Human
ucccgggcaggucgagcgagcc

SEQ ID NO: 147896 - RNA, 22 nt, Human
aggucccugcagcagacugcca

SEQ ID NO: 147897 - RNA, 22 nt, Human
cagccuuugggucagaagauuc

SEQ ID NO: 147898 - RNA, 22 nt, Human
agaauguaagaaugcaaagauu

SEQ ID NO: 147899 - RNA, 22 nt, Human
uugaugcugucuuucagaauca

SEQ ID NO: 147900 - RNA, 21 nt, Human
acccugcuuuaugccguccuc

SEQ ID NO: 147901 - RNA, 22 nt, Human
auggaguucugccagcgcugcu

SEQ ID NO: 147902 - RNA, 22 nt, Human
ggaaugcacuagacugugaaac

SEQ ID NO: 147903 - RNA, 22 nt, Human
uucaaaccuaucuaagaaauag

SEQ ID NO: 147904 - RNA, 22 nt, Human
ucaugcaccucuccaugucccc

SEQ ID NO: 147905 - RNA, 22 nt, Human
aauugcuuuacaagccguuuaa

SEQ ID NO: 147906 - RNA, 22 nt, Human
guguuuggucagacguccgggg

SEQ ID NO: 147907 - RNA, 23 nt, Human
agccucuuguggauggucagcga

SEQ ID NO: 147908 - RNA, 22 nt, Human
acaugcauaaacuacuucuuau

SEQ ID NO: 147909 - RNA, 22 nt, Human
agcugaacgugcuucugcagca

SEQ ID NO: 147910 - RNA, 22 nt, Human
agcuccugaaaagcgcuugcuu

SEQ ID NO: 147911 - RNA, 22 nt, Human
guucuucagauuccauuucagu

SEQ ID NO: 147912 - RNA, 22 nt, Human
cuccugcagcccucagcagcca

SEQ ID NO: 147913 - RNA, 22 nt, Human
cugcaguucuucuccucaaggc

SEQ ID NO: 147914 - RNA, 22 nt, Human
aaggauuuuuggaaugagaugg

SEQ ID NO: 147915 - RNA, 22 nt, Human
cugaaacuauggggaggggagc

SEQ ID NO: 147916 - RNA, 22 nt, Human
gcaagcagcccagaacagcucu

SEQ ID NO: 147917 - RNA, 22 nt, Human
ugcauuugcaauggguacacaa

SEQ ID NO: 147918 - RNA, 22 nt, Human
gucuugcacuuaccuaagaacu

SEQ ID NO: 147919 - RNA, 22 nt, Human
agcuccugaaaauccagacugg

SEQ ID NO: 147920 - RNA, 22 nt, Human
caugugaauuccaaagcuaggu

SEQ ID NO: 147921 - RNA, 22 nt, Human
gagcugcauagcugggauccuc

SEQ ID NO: 147922 - RNA, 22 nt, Human
aagcagccagccaucaugcccg

SEQ ID NO: 147923 - RNA, 21 nt, Human
agagacugucacugcaguacc

SEQ ID NO: 147924 - RNA, 22 nt, Human
cucaucuggcuucaguaacagu

SEQ ID NO: 147925 - RNA, 22 nt, Human
gcuagggagacuugugucauca

SEQ ID NO: 147926 - RNA, 22 nt, Human
ugcugggauuacagucaugagc

SEQ ID NO: 147927 - RNA, 22 nt, Human
auuuccuauacaguuguccaua

SEQ ID NO: 147928 - RNA, 22 nt, Human
gccagcagcucuugggcgggca

SEQ ID NO: 147929 - RNA, 22 nt, Human
gggagacaaaggugagguucuu

SEQ ID NO: 147930 - RNA, 22 nt, Human
acccugccucugcuuccuguag

SEQ ID NO: 147931 - RNA, 19 nt, Human
cugggacaaugaaagcauc

SEQ ID NO: 147932 - RNA, 22 nt, Human
ucaugucccguugcuggcugcc

SEQ ID NO: 147933 - RNA, 21 nt, Human
acugaacuuguguucuagagg

SEQ ID NO: 147934 - RNA, 22 nt, Human
acugagcaggguuccgcaugga

SEQ ID NO: 147935 - RNA, 22 nt, Human
uguggaauguccucagcauccu

SEQ ID NO: 147936 - RNA, 22 nt, Human
ugcaauuagcguauuaguuuau

SEQ ID NO: 147937 - RNA, 22 nt, Human
gccagccccagacauccuaucg

SEQ ID NO: 147938 - RNA, 22 nt, Human
ugaucagcaucuucccagcucg

SEQ ID NO: 147939 - RNA, 22 nt, Human
ccuggaaaaugccacuuucaca

SEQ ID NO: 147940 - RNA, 22 nt, Human
uuucuacauuuguaaccagauu

SEQ ID NO: 147941 - RNA, 22 nt, Human
ucccacacagcccgcucaccgg

SEQ ID NO: 147942 - RNA, 22 nt, Human
ggagacucaccccgcauucuag

SEQ ID NO: 147943 - RNA, 22 nt, Human
cccgggaggaggaaguugcagu

SEQ ID NO: 147944 - RNA, 22 nt, Human
ucuucacaguccuggucagugg

SEQ ID NO: 147945 - RNA, 21 nt, Human
cugcacugugauuuaaaaugu

SEQ ID NO: 147946 - RNA, 22 nt, Human
agggacuauuuacccaucucac

SEQ ID NO: 147947 - RNA, 22 nt, Human
ugcaaggcacccacucugcuuu

SEQ ID NO: 147948 - RNA, 22 nt, Human
caggccuugaaggccugcggga

SEQ ID NO: 147949 - RNA, 22 nt, Human
accuccuccaaggagccauagg

SEQ ID NO: 147950 - RNA, 22 nt, Human
cagacugaaaaucccugguagu

SEQ ID NO: 147951 - RNA, 22 nt, Human
ucccugccuccuggcagugcca

SEQ ID NO: 147952 - RNA, 22 nt, Human
cugaccaguccuuagcaccugg

SEQ ID NO: 147953 - RNA, 22 nt, Human
ugaggauggaaugcugugcaag

SEQ ID NO: 147954 - RNA, 21 nt, Human
agaugcagugacccacugggg

SEQ ID NO: 147955 - RNA, 20 nt, Human
caucaacaccuugucagccu

SEQ ID NO: 147956 - RNA, 22 nt, Human
acugcauucuuuaucccacaac

SEQ ID NO: 147957 - RNA, 22 nt, Human
uuugacaggaauucucucuagg

SEQ ID NO: 147958 - RNA, 22 nt, Human
ugauuuacaguagugucuaaac

SEQ ID NO: 147959 - RNA, 23 nt, Human
uuguucuuggaucuuccugaagc

SEQ ID NO: 147960 - RNA, 22 nt, Human
cccgaccucgcaaagcgcacuc

SEQ ID NO: 147961 - RNA, 22 nt, Human
ugucuucuaccuugacagcauu

SEQ ID NO: 147962 - RNA, 22 nt, Human
caagggcagcagccucaagcgg

SEQ ID NO: 147963 - RNA, 22 nt, Human
ccugggacgacucuguacccuu

SEQ ID NO: 147964 - RNA, 22 nt, Human
aaccccgcucaggcugggugag

SEQ ID NO: 147965 - RNA, 22 nt, Human
cugcacagucauuuccucucaa

SEQ ID NO: 147966 - RNA, 22 nt, Human
cugaggaucuaauuauuggguc

SEQ ID NO: 147967 - RNA, 22 nt, Human
gccagcagcgagaguuuaaccu

SEQ ID NO: 147968 - RNA, 21 nt, Human
gccugggaagagaaagguaag

SEQ ID NO: 147969 - RNA, 22 nt, Human
ucugcacccugugguccucuag

SEQ ID NO: 147970 - RNA, 22 nt, Human
uuucacauacaguguauaguag

SEQ ID NO: 147971 - RNA, 22 nt, Human
cucccucaggccuuagcccugc

SEQ ID NO: 147972 - RNA, 19 nt, Human
gggccucacccacaccucc

SEQ ID NO: 147973 - RNA, 22 nt, Human
uuccugcaggccauagagccug

SEQ ID NO: 147974 - RNA, 21 nt, Human
ccuuugaguguguuugaagua

SEQ ID NO: 147975 - RNA, 22 nt, Human
ugagcaccaggcaccacagcuc

SEQ ID NO: 147976 - RNA, 21 nt, Human
agccugcaauguagguaccgg

SEQ ID NO: 147977 - RNA, 20 nt, Human
ccacccuguccggggcggag

SEQ ID NO: 147978 - RNA, 22 nt, Human
caacuuuagaccccaaguagcu

SEQ ID NO: 147979 - RNA, 22 nt, Human
aaucuguugucaggaauccaca

SEQ ID NO: 147980 - RNA, 22 nt, Human
aaauugaauuugggaaacauug

SEQ ID NO: 147981 - RNA, 22 nt, Human
cugagcaucauggcagaaucuu

SEQ ID NO: 147982 - RNA, 22 nt, Human
cagacuuaccuaaggucacaca

SEQ ID NO: 147983 - RNA, 22 nt, Human
uggaagggguuacgcagcagga

SEQ ID NO: 147984 - RNA, 22 nt, Human
ccacugauucugccaggucucu

SEQ ID NO: 147985 - RNA, 22 nt, Human
gguagggaaggucucccacauu

SEQ ID NO: 147986 - RNA, 19 nt, Human
ugaggauugagguccagua

SEQ ID NO: 147987 - RNA, 23 nt, Human
agaagcagcuucuggaguaucgg

SEQ ID NO: 147988 - RNA, 23 nt, Human
uggagaauucagucuuuguuuug

SEQ ID NO: 147989 - RNA, 22 nt, Human
agauuucaauggauauugcaag

SEQ ID NO: 147990 - RNA, 22 nt, Human
gagcugcagcggcugacgcaac

SEQ ID NO: 147991 - RNA, 22 nt, Human
cacaucauguuaauucauuaca

SEQ ID NO: 147992 - RNA, 22 nt, Human
ucacagcugggguuuuggcagc

SEQ ID NO: 147993 - RNA, 23 nt, Human
ugacacccucauugugugucgca

SEQ ID NO: 147994 - RNA, 22 nt, Human
cucugccagccaaagucaucac

SEQ ID NO: 147995 - RNA, 22 nt, Human
aagcacagggacucaggaccgg

SEQ ID NO: 147996 - RNA, 23 nt, Human
acucguggaauucucugcgaucg

SEQ ID NO: 147997 - RNA, 21 nt, Human
caagacauaugaguacucugg

SEQ ID NO: 147998 - RNA, 22 nt, Human
agucuuagaacuacagugccua

SEQ ID NO: 147999 - RNA, 22 nt, Human
augcaacuacccccaggauuuu

SEQ ID NO: 148000 - RNA, 22 nt, Human
agaagugaguugugacuauggg

SEQ ID NO: 148001 - RNA, 19 nt, Human
acugcagggaggaggugug

SEQ ID NO: 148002 - RNA, 22 nt, Human
ccagaacagaccugccugaccu

SEQ ID NO: 148003 - RNA, 22 nt, Human
uacugcauuaucaaggggaagg

SEQ ID NO: 148004 - RNA, 22 nt, Human
cugugaauguuauaucucaaug

SEQ ID NO: 148005 - RNA, 20 nt, Human
acagaugaggaugcggaggc

SEQ ID NO: 148006 - RNA, 22 nt, Human
aaugcaaugcagcaccuccuug

SEQ ID NO: 148007 - RNA, 22 nt, Human
auccaggcgaaugcagaaggcc

SEQ ID NO: 148008 - RNA, 22 nt, Human
aucaucaucuaaauugugucgc

SEQ ID NO: 148009 - RNA, 22 nt, Human
ugcaugguguaauucuaaugcu

SEQ ID NO: 148010 - RNA, 22 nt, Human
ccaggccuguguuguguggagg

SEQ ID NO: 148011 - RNA, 22 nt, Human
gagcagcagcugggccagguuc

SEQ ID NO: 148012 - RNA, 21 nt, Human
aucuuaaaaggucuuaacuuu

SEQ ID NO: 148013 - RNA, 19 nt, Human
gggaaugauggaagacuuc

SEQ ID NO: 148014 - RNA, 22 nt, Human
ugcaugcagcuggucgggcgcc

SEQ ID NO: 148015 - RNA, 22 nt, Human
agggagcugcucugcuuccgug

SEQ ID NO: 148016 - RNA, 22 nt, Human
caucagucugaaagccagggag

SEQ ID NO: 148017 - RNA, 22 nt, Human
augccaucaaugacagaguuag

SEQ ID NO: 148018 - RNA, 22 nt, Human
aaagcagaacugagagagcugg

SEQ ID NO: 148019 - RNA, 22 nt, Human
cugagcaugcuacaugcagcac

SEQ ID NO: 148020 - RNA, 22 nt, Human
auauacacuguuucaguugaag

SEQ ID NO: 148021 - RNA, 23 nt, Human
caaaaugcuaugugcccaaugca

SEQ ID NO: 148022 - RNA, 22 nt, Human
gaugugucccuuucaacucaga

SEQ ID NO: 148023 - RNA, 22 nt, Human
cugcugucuuuauuucacugcu

SEQ ID NO: 148024 - RNA, 22 nt, Human
accugguaaccugccugacuaa

SEQ ID NO: 148025 - RNA, 22 nt, Human
acugcacuccagcccgagcaac

SEQ ID NO: 148026 - RNA, 22 nt, Human
cagcugccuguauuguccucau

SEQ ID NO: 148027 - RNA, 22 nt, Human
cugaaggacacgugaggagcca

SEQ ID NO: 148028 - RNA, 22 nt, Human
ugaagcuagaauguccauauuu

SEQ ID NO: 148029 - RNA, 22 nt, Human
aacccuggggcugcucugccug

SEQ ID NO: 148030 - RNA, 22 nt, Human
ccagaaugugugaaauuugaug

SEQ ID NO: 148031 - RNA, 22 nt, Human
gugcgccagcucaaggggaggc

SEQ ID NO: 148032 - RNA, 22 nt, Human
cuucaugcugauauccucgaug

SEQ ID NO: 148033 - RNA, 21 nt, Human
gcaauucgcuaugaugguggc

SEQ ID NO: 148034 - RNA, 22 nt, Human
caaugcacauggacaucaggcu

SEQ ID NO: 148035 - RNA, 22 nt, Human
aaucacagccacaaccuggggg

SEQ ID NO: 148036 - RNA, 22 nt, Human
ggcgaggugucugccaucaagc

SEQ ID NO: 148037 - RNA, 22 nt, Human
ugugcucagucuuuggcuggga

SEQ ID NO: 148038 - RNA, 22 nt, Human
ugcaagagcccaaacuauauac

SEQ ID NO: 148039 - RNA, 22 nt, Human
augcauugaggaugacaugagu

SEQ ID NO: 148040 - RNA, 22 nt, Human
aaaugcacaauaaaguaaaggc

SEQ ID NO: 148041 - RNA, 22 nt, Human
cagggagaucuuggcuccuggu

SEQ ID NO: 148042 - RNA, 22 nt, Human
cgcugauaaacgucacguuccc

SEQ ID NO: 148043 - RNA, 22 nt, Human
ggagcugaaggggugggcucag

SEQ ID NO: 148044 - RNA, 22 nt, Human
cacauacuuguguguacauaug

SEQ ID NO: 148045 - RNA, 22 nt, Human
acuggcagcuguaggaugcaug

SEQ ID NO: 148046 - RNA, 22 nt, Human
acacacaugguauuguucagaa

SEQ ID NO: 148047 - RNA, 22 nt, Human
gagaaagauguaggcugggagg

SEQ ID NO: 148048 - RNA, 22 nt, Human
cggcuggugucgggcacagcaa

SEQ ID NO: 148049 - RNA, 22 nt, Human
aggagcugcagauucugccuug

SEQ ID NO: 148050 - RNA, 22 nt, Human
uccacccugcuuucuuaucucc

SEQ ID NO: 148051 - RNA, 22 nt, Human
agucacaguuucccugagagag

SEQ ID NO: 148052 - RNA, 22 nt, Human
ccacauacaaauggggugcugu

SEQ ID NO: 148053 - RNA, 22 nt, Human
cccagccuuugcuuccugguuc

SEQ ID NO: 148054 - RNA, 22 nt, Human
uggcaguagauccagucucucu

SEQ ID NO: 148055 - RNA, 22 nt, Human
gccuccggagucacagugucuu

SEQ ID NO: 148056 - RNA, 22 nt, Human
aaagagucaaaggcaugucucu

SEQ ID NO: 148057 - RNA, 22 nt, Human
gucacaggccuggaugaggggc

SEQ ID NO: 148058 - RNA, 22 nt, Human
uccaggcuuuuucaugcugucu

SEQ ID NO: 148059 - RNA, 22 nt, Human
ccuugcucaagcuagugacggg

SEQ ID NO: 148060 - RNA, 22 nt, Human
auggcagaccuccuggccacaa

SEQ ID NO: 148061 - RNA, 22 nt, Human
cuggcaguuugccaggagcucg

SEQ ID NO: 148062 - RNA, 22 nt, Human
ucuggcagcgaagcguguacuu

SEQ ID NO: 148063 - RNA, 22 nt, Human
uccaggcucccucaggaugcac

SEQ ID NO: 148064 - RNA, 22 nt, Human
cacaucccuggaguuacccagu

SEQ ID NO: 148065 - RNA, 22 nt, Human
acagaguccuagcugcaaagaa

SEQ ID NO: 148066 - RNA, 22 nt, Human
ucuggcagggucagggcccagg

SEQ ID NO: 148067 - RNA, 22 nt, Human
acuggcagugucguuuacauga

SEQ ID NO: 148068 - RNA, 22 nt, Human
auggcagagggauugaacagcu

SEQ ID NO: 148069 - RNA, 22 nt, Human
uggcgucucucauaaguaugug

SEQ ID NO: 148070 - RNA, 18 nt, Human
ccuggcagccaugcgcgc

SEQ ID NO: 148071 - RNA, 22 nt, Human
gccuccuguuaugccaugugcc

SEQ ID NO: 148072 - RNA, 22 nt, Human
cagccaagaaccacagacccag

SEQ ID NO: 148073 - RNA, 22 nt, Human
uucuuucaauagcuggcauaug

SEQ ID NO: 148074 - RNA, 19 nt, Human
cugagagaugcuucacaca

SEQ ID NO: 148075 - RNA, 22 nt, Human
cagucacauagguauacacaua

SEQ ID NO: 148076 - RNA, 22 nt, Human
ucaucacaauuuuaugacccuc

SEQ ID NO: 148077 - RNA, 22 nt, Human
ccaggcccaggguacugaccaa

SEQ ID NO: 148078 - RNA, 22 nt, Human
ucccacaggaaaguagacauug

SEQ ID NO: 148079 - RNA, 22 nt, Human
ucacacacauggauaguauuuu

SEQ ID NO: 148080 - RNA, 22 nt, Human
acugagagucaagauagcaugg

SEQ ID NO: 148081 - RNA, 22 nt, Human
ccaggcccugcuccucacacca

SEQ ID NO: 148082 - RNA, 22 nt, Human
guacacacaaucucuggucagu

SEQ ID NO: 148083 - RNA, 22 nt, Human
gccacauagaggaggauauuaa

SEQ ID NO: 148084 - RNA, 22 nt, Human
agacaagaaacugggagucucu

SEQ ID NO: 148085 - RNA, 22 nt, Human
ucccacacuacacgguuguugg

SEQ ID NO: 148086 - RNA, 22 nt, Human
cugagccagggccacacaugga

SEQ ID NO: 148087 - RNA, 22 nt, Human
aggguagggcccggagacagac

SEQ ID NO: 148088 - RNA, 22 nt, Human
ucuuuuucugcacacguguccc

SEQ ID NO: 148089 - RNA, 22 nt, Human
cagguggguguaugaaugcaaa

SEQ ID NO: 148090 - RNA, 22 nt, Human
cccagccuacucugccauagca

SEQ ID NO: 148091 - RNA, 22 nt, Human
acaucugaggagaccagccucu

SEQ ID NO: 148092 - RNA, 22 nt, Human
aaagagucuggcacuguaccag

SEQ ID NO: 148093 - RNA, 22 nt, Human
ucaggcccuuugcugcugcccc

SEQ ID NO: 148094 - RNA, 22 nt, Human
gcuggcagggugguugagagag

SEQ ID NO: 148095 - RNA, 22 nt, Human
cuccucuggguccugguggcca

SEQ ID NO: 148096 - RNA, 22 nt, Human
ugcucuguauucuauggcaguu

SEQ ID NO: 148097 - RNA, 22 nt, Human
gcacacaguagggauucaauga

SEQ ID NO: 148098 - RNA, 22 nt, Human
acacacuggcccccaguacuga

SEQ ID NO: 148099 - RNA, 22 nt, Human
acuccugggugcugaccagcgu

SEQ ID NO: 148100 - RNA, 22 nt, Human
cccaggccuggucugggccagu

SEQ ID NO: 148101 - RNA, 18 nt, Human
acacacacaccuguguau

SEQ ID NO: 148102 - RNA, 22 nt, Human
ucacacagcugacagagccuuu

SEQ ID NO: 148103 - RNA, 22 nt, Human
cacccacauuccaucacucugc

SEQ ID NO: 148104 - RNA, 22 nt, Human
acagacuggccugucucgcacc

SEQ ID NO: 148105 - RNA, 22 nt, Human
gcugcuaagcguuucuguucca

SEQ ID NO: 148106 - RNA, 19 nt, Human
ccuugccugucccugcagc

SEQ ID NO: 148107 - RNA, 22 nt, Human
gcccacacagcagauccuuugg

SEQ ID NO: 148108 - RNA, 21 nt, Human
ucuggcaggcacgggcccagc

SEQ ID NO: 148109 - RNA, 22 nt, Human
ccagguccuguuuucaccacag

SEQ ID NO: 148110 - RNA, 22 nt, Human
gcuggcagugugaaugacaagc

SEQ ID NO: 148111 - RNA, 22 nt, Human
cucugagcagaggccguggcua

SEQ ID NO: 148112 - RNA, 22 nt, Human
gcccacacaccagcucaggagg

SEQ ID NO: 148113 - RNA, 22 nt, Human
aggccuccagccacaugccagu

SEQ ID NO: 148114 - RNA, 20 nt, Human
acuggcagccugccugcugu

SEQ ID NO: 148115 - RNA, 21 nt, Human
acacagaggcaucaucacuuu

SEQ ID NO: 148116 - RNA, 22 nt, Human
agagucccagggacacuccaga

SEQ ID NO: 148117 - RNA, 22 nt, Human
ucccacaugugaauccucaggu

SEQ ID NO: 148118 - RNA, 22 nt, Human
guccucuguguaggcugcagac

SEQ ID NO: 148119 - RNA, 22 nt, Human
aagagccagcuagugaagaggc

SEQ ID NO: 148120 - RNA, 22 nt, Human
gaccugccugagcugccucugc

SEQ ID NO: 148121 - RNA, 22 nt, Human
cacauacauacguauguauaca

SEQ ID NO: 148122 - RNA, 19 nt, Human
ccuuccuccccagggccau

SEQ ID NO: 148123 - RNA, 22 nt, Human
ugagagucucagaccuccuggu

SEQ ID NO: 148124 - RNA, 22 nt, Human
uccaggcuaauuuugcauuguu

SEQ ID NO: 148125 - RNA, 22 nt, Human
uccaaggcuccggcccuggcgu

SEQ ID NO: 148126 - RNA, 22 nt, Human
acuggcaggcugcuggccggcg

SEQ ID NO: 148127 - RNA, 22 nt, Human
agaggccggccgagcccauggg

SEQ ID NO: 148128 - RNA, 22 nt, Human
aauggcagaggcaaagauggua

SEQ ID NO: 148129 - RNA, 22 nt, Human
cccugccucugaagcugcucag

SEQ ID NO: 148130 - RNA, 20 nt, Human
ucuggcaggugaacgagcug

SEQ ID NO: 148131 - RNA, 22 nt, Human
cacauacugagaaucacaccca

SEQ ID NO: 148132 - RNA, 22 nt, Human
cuuggcaguuucggaaggauga

SEQ ID NO: 148133 - RNA, 22 nt, Human
cccacacucugagaaaugcuga

SEQ ID NO: 148134 - RNA, 22 nt, Human
uggcaucuccgacagucuugau

SEQ ID NO: 148135 - RNA, 22 nt, Human
acacacacaagcagguugugga

SEQ ID NO: 148136 - RNA, 22 nt, Human
guggcagugaaggucauagcau

SEQ ID NO: 148137 - RNA, 22 nt, Human
uauucccauuccacuuaucaag

SEQ ID NO: 148138 - RNA, 22 nt, Human
uggcagagucaucacaucugga

SEQ ID NO: 148139 - RNA, 22 nt, Human
ccuccccaugacccggugcugg

SEQ ID NO: 148140 - RNA, 22 nt, Human
ucacauacacuaggauauuuuu

SEQ ID NO: 148141 - RNA, 22 nt, Human
gagggugucugcguaacuggca

SEQ ID NO: 148142 - RNA, 22 nt, Human
gacacagaauuuacucccgaua

SEQ ID NO: 148143 - RNA, 22 nt, Human
uucccacaguguugaauccucu

SEQ ID NO: 148144 - RNA, 22 nt, Human
gcacacacuguuuuccucacau

SEQ ID NO: 148145 - RNA, 22 nt, Human
gcuggcagcauuagacccuggg

SEQ ID NO: 148146 - RNA, 22 nt, Human
cugccugccuuggccuccagga

SEQ ID NO: 148147 - RNA, 19 nt, Human
gugggacagacauuacaua

SEQ ID NO: 148148 - RNA, 22 nt, Human
ucuggcagcuauccucuggcca

SEQ ID NO: 148149 - RNA, 22 nt, Human
acccacacaucucuaauucagu

SEQ ID NO: 148150 - RNA, 22 nt, Human
ccuggcagguggagguugcagu

SEQ ID NO: 148151 - RNA, 22 nt, Human
uacacacagaggccaugggauu

SEQ ID NO: 148152 - RNA, 22 nt, Human
uccugagcuacaguaguaugau

SEQ ID NO: 148153 - RNA, 20 nt, Human
accccacagaguccauugca

SEQ ID NO: 148154 - RNA, 22 nt, Human
ccugccucccagagguccucua

SEQ ID NO: 148155 - RNA, 22 nt, Human
ccuggcaguucaucaaauggca

SEQ ID NO: 148156 - RNA, 20 nt, Human
agaggcuuccuugggaggag

SEQ ID NO: 148157 - RNA, 18 nt, Human
cccacacagcaguagcuc

SEQ ID NO: 148158 - RNA, 22 nt, Human
cacauaagaaaugaauaugaga

SEQ ID NO: 148159 - RNA, 22 nt, Human
uccccacagcagaagaucugag

SEQ ID NO: 148160 - RNA, 22 nt, Human
gcuggcaggagaccauacccua

SEQ ID NO: 148161 - RNA, 22 nt, Human
gucacacagggccuccaaauca

SEQ ID NO: 148162 - RNA, 22 nt, Human
gcacauacccacugucaagcac

SEQ ID NO: 148163 - RNA, 21 nt, Human
agagucugagugugcaagggc

SEQ ID NO: 148164 - RNA, 22 nt, Human
ucuggcagaggaaggaggccug

SEQ ID NO: 148165 - RNA, 22 nt, Human
cacaaaaguaggaggcaggcgg

SEQ ID NO: 148166 - RNA, 22 nt, Human
agggaagaagcugguaguaggu

SEQ ID NO: 148167 - RNA, 22 nt, Human
uugggaagaauggaggugguua

SEQ ID NO: 148168 - RNA, 22 nt, Human
agcacaggcuuuggugugaggg

SEQ ID NO: 148169 - RNA, 22 nt, Human
ccuggcaggccccuccuggauu

SEQ ID NO: 148170 - RNA, 22 nt, Human
aggccccaaagcagugcaagua

SEQ ID NO: 148171 - RNA, 22 nt, Human
acaucacagagcccagauaaag

SEQ ID NO: 148172 - RNA, 22 nt, Human
ucuggcaggguguguauuuaca

SEQ ID NO: 148173 - RNA, 20 nt, Human
ugccuggccuuucucugccc

SEQ ID NO: 148174 - RNA, 22 nt, Human
gcccagccuccaagcuccaagg

SEQ ID NO: 148175 - RNA, 22 nt, Human
gcuccaggugucccagguaaaa

SEQ ID NO: 148176 - RNA, 22 nt, Human
uggaaagagguagaggaucugg

SEQ ID NO: 148177 - RNA, 22 nt, Human
gagaaagaugaagaguggcguu

SEQ ID NO: 148178 - RNA, 21 nt, Human
uccugccuuaguccagagcag

SEQ ID NO: 148179 - RNA, 18 nt, Human
cuccuggcugauggugag

SEQ ID NO: 148180 - RNA, 22 nt, Human
cacauacauucauguuacucua

SEQ ID NO: 148181 - RNA, 22 nt, Human
uuccaggcaugucagacauagg

SEQ ID NO: 148182 - RNA, 22 nt, Human
gacucugggcugagccagggcc

SEQ ID NO: 148183 - RNA, 21 nt, Human
ucacacacguuuccaagggca

SEQ ID NO: 148184 - RNA, 22 nt, Human
ccccacccaccuaagagaaacu

SEQ ID NO: 148185 - RNA, 22 nt, Human
gcuggcaguaaaggguuuggca

SEQ ID NO: 148186 - RNA, 23 nt, Human
uugggaaauaguuaagacaugag

SEQ ID NO: 148187 - RNA, 22 nt, Human
cuccaggcucguccaagaucga

SEQ ID NO: 148188 - RNA, 22 nt, Human
guccucuguuagaaaugugcuu

SEQ ID NO: 148189 - RNA, 20 nt, Human
cccacacccuucccacuugg

SEQ ID NO: 148190 - RNA, 22 nt, Human
auggcagacgaggcagcagggg

SEQ ID NO: 148191 - RNA, 23 nt, Human
aguguugguugggaagccaagca

SEQ ID NO: 148192 - RNA, 22 nt, Human
uacaaaaguaauuacgguuuuu

SEQ ID NO: 148193 - RNA, 22 nt, Human
uccccaccuaagauacccaucu

SEQ ID NO: 148194 - RNA, 22 nt, Human
gcacacaugcaugcacaggagu

SEQ ID NO: 148195 - RNA, 22 nt, Human
uguaaagaaagacgcagaguua

SEQ ID NO: 148196 - RNA, 22 nt, Human
ugccugccaugcagaaagcuga

SEQ ID NO: 148197 - RNA, 22 nt, Human
ccugaccuauuuuucucagcug

SEQ ID NO: 148198 - RNA, 22 nt, Human
acaauucugaugguuucccagu

SEQ ID NO: 148199 - RNA, 22 nt, Human
cugccugcugcccuccagagcc

SEQ ID NO: 148200 - RNA, 22 nt, Human
cuguccagcuuggcuccugggg

SEQ ID NO: 148201 - RNA, 22 nt, Human
gaggagcuggcagcgucuccgc

SEQ ID NO: 148202 - RNA, 22 nt, Human
cuuggcagagggcugggcucag

SEQ ID NO: 148203 - RNA, 22 nt, Human
ccccacccucgcuccauuucgg

SEQ ID NO: 148204 - RNA, 22 nt, Human
ugccucucuaacccaugcccaa

SEQ ID NO: 148205 - RNA, 22 nt, Human
guccucugggcuuugagcaguc

SEQ ID NO: 148206 - RNA, 22 nt, Human
aggaggcugaacuagggucugg

SEQ ID NO: 148207 - RNA, 22 nt, Human
acacagaugcauuacacaucua

SEQ ID NO: 148208 - RNA, 20 nt, Human
aagagucuuuacugagcuaa

SEQ ID NO: 148209 - RNA, 22 nt, Human
cacuguccaugcuugcuaaccc

SEQ ID NO: 148210 - RNA, 22 nt, Human
aacacauaggcagagcaugaca

SEQ ID NO: 148211 - RNA, 22 nt, Human
auacacacugcuauccuuuuuu

SEQ ID NO: 148212 - RNA, 22 nt, Human
agaggcuucucggauggggcag

SEQ ID NO: 148213 - RNA, 22 nt, Human
ccuggcagcuguuuggcuuggc

SEQ ID NO: 148214 - RNA, 20 nt, Human
aaaagagugcuucaacugcu

SEQ ID NO: 148215 - RNA, 22 nt, Human
aucucccagccacagcauucuu

SEQ ID NO: 148216 - RNA, 22 nt, Human
ucuggcagagauauccauccca

SEQ ID NO: 148217 - RNA, 23 nt, Human
ucacauaauccuucauccacagg

SEQ ID NO: 148218 - RNA, 21 nt, Human
uccuguaagcuuggguggcuc

SEQ ID NO: 148219 - RNA, 22 nt, Human
ccuggcagcauugguagagauu

SEQ ID NO: 148220 - RNA, 22 nt, Human
uggcagugggaauggacaaaca

SEQ ID NO: 148221 - RNA, 20 nt, Human
ucccucccuccagcucuggg

SEQ ID NO: 148222 - RNA, 22 nt, Human
caggaguggugugagggacucc

SEQ ID NO: 148223 - RNA, 22 nt, Human
caggauggucucgaucuccuga

SEQ ID NO: 148224 - RNA, 22 nt, Human
uuccacauuccuuacauucaua

SEQ ID NO: 148225 - RNA, 22 nt, Human
gugugggaaggcuaggaugcug

SEQ ID NO: 148226 - RNA, 18 nt, Human
gacacauccccaggccuc

SEQ ID NO: 148227 - RNA, 22 nt, Human
uugggaagaaacauguccauca

SEQ ID NO: 148228 - RNA, 22 nt, Human
gacccauauaggacccuccaaa

SEQ ID NO: 148229 - RNA, 22 nt, Human
guggcagugggaugcuaucagg

SEQ ID NO: 148230 - RNA, 22 nt, Human
cccacacacuggcugcugccaa

SEQ ID NO: 148231 - RNA, 22 nt, Human
gacacagauaucucugagauua

SEQ ID NO: 148232 - RNA, 23 nt, Human
acacugucucauggauagacugc

SEQ ID NO: 148233 - RNA, 22 nt, Human
ucuggcagagugauaggauaag

SEQ ID NO: 148234 - RNA, 18 nt, Human
uguagagccagguuugcc

SEQ ID NO: 148235 - RNA, 22 nt, Human
ccuggcaguuuugcccaggauu

SEQ ID NO: 148236 - RNA, 22 nt, Human
agagggugcuggagagacauug

SEQ ID NO: 148237 - RNA, 22 nt, Human
cacaauguauauguauaucaaa

SEQ ID NO: 148238 - RNA, 17 nt, Human
gcccacccuuaggagcu

SEQ ID NO: 148239 - RNA, 22 nt, Human
ccugccuguacuagagacccag

SEQ ID NO: 148240 - RNA, 22 nt, Human
ggagagaauuccauggacaugu

SEQ ID NO: 148241 - RNA, 22 nt, Human
gcuggcagucccaucagcuggg

SEQ ID NO: 148242 - RNA, 22 nt, Human
gugggagaaauuagcucuaguu

SEQ ID NO: 148243 - RNA, 22 nt, Human
uacacacuuacuggagaugaag

SEQ ID NO: 148244 - RNA, 22 nt, Human
ucuggcaggauaucgaagugaa

SEQ ID NO: 148245 - RNA, 22 nt, Human
ucuggcaggucaaucauucuuu

SEQ ID NO: 148246 - RNA, 22 nt, Human
cccccaaaguuugcacggauaa

SEQ ID NO: 148247 - RNA, 22 nt, Human
uguaaacagccccauggagagc

SEQ ID NO: 148248 - RNA, 22 nt, Human
cccuggcagagggggcaggugc

SEQ ID NO: 148249 - RNA, 22 nt, Human
gccuggcacaguagggacccaa

SEQ ID NO: 148250 - RNA, 22 nt, Human
ucacacauuucucaaguguagg

SEQ ID NO: 148251 - RNA, 22 nt, Human
acuggcagaggauagcacuaau

SEQ ID NO: 148252 - RNA, 22 nt, Human
acacagaguuugacacauggga

SEQ ID NO: 148253 - RNA, 22 nt, Human
ucccugccugacagcacccacc

SEQ ID NO: 148254 - RNA, 22 nt, Human
ucuggcagcaagauaacaaugg

SEQ ID NO: 148255 - RNA, 22 nt, Human
gaggggcuggguagggcaaccc

SEQ ID NO: 148256 - RNA, 22 nt, Human
gaggcugcggggaggagccugc

SEQ ID NO: 148257 - RNA, 22 nt, Human
cugccugcaggacaccucgcua

SEQ ID NO: 148258 - RNA, 23 nt, Human
ggacacauuuauuucagaauuca

SEQ ID NO: 148259 - RNA, 22 nt, Human
ucaucacauguguagucauccc

SEQ ID NO: 148260 - RNA, 22 nt, Human
gcacucuccuggcugccacagu

SEQ ID NO: 148261 - RNA, 22 nt, Human
gaggcugcuuugaugacaggag

SEQ ID NO: 148262 - RNA, 22 nt, Human
cugccugccacguucagcugua

SEQ ID NO: 148263 - RNA, 22 nt, Human
ucccugccuccuggcagugcca

SEQ ID NO: 148264 - RNA, 22 nt, Human
auccuggcccagguguggaggg

SEQ ID NO: 148265 - RNA, 22 nt, Human
acaggugguaaaauggacuguc

SEQ ID NO: 148266 - RNA, 22 nt, Human
uggcacaguccugggugccugc

SEQ ID NO: 148267 - RNA, 22 nt, Human
ucaggagcucuucccuggugug

SEQ ID NO: 148268 - RNA, 22 nt, Human
aagucguggcaggcuugcacga

SEQ ID NO: 148269 - RNA, 22 nt, Human
gaaagaagcuuuagauggcuau

SEQ ID NO: 148270 - RNA, 20 nt, Human
cugcuccacccggcucucag

SEQ ID NO: 148271 - RNA, 22 nt, Human
cuggccuggggggacacauccc

SEQ ID NO: 148272 - RNA, 22 nt, Human
aggcuggauuuauggggacuuc

SEQ ID NO: 148273 - RNA, 22 nt, Human
cagucccaugagcccagaacau

SEQ ID NO: 148274 - RNA, 22 nt, Human
acagguggcuuauuggcugauu

SEQ ID NO: 148275 - RNA, 19 nt, Human
uccuggcacaguggaacca

SEQ ID NO: 148276 - RNA, 22 nt, Human
gucuggaaggaggagauggagc

SEQ ID NO: 148277 - RNA, 22 nt, Human
caauacugaguuuacauucauc

SEQ ID NO: 148278 - RNA, 22 nt, Human
ccacacagucaguuuccaagaa

SEQ ID NO: 148279 - RNA, 22 nt, Human
uuccuggcauagagagggcaca

SEQ ID NO: 148280 - RNA, 22 nt, Human
uccuggcauccgugggucugug

SEQ ID NO: 148281 - RNA, 22 nt, Human
aggaggcugcaacccugaggcc

SEQ ID NO: 148282 - RNA, 22 nt, Human
aguguugggucuuuagaauuua

SEQ ID NO: 148283 - RNA, 22 nt, Human
ccucucagcgauuccucuugga

SEQ ID NO: 148284 - RNA, 19 nt, Human
ccacacagugugcaauuua

SEQ ID NO: 148285 - RNA, 22 nt, Human
uccuggcagcccgcaggugcug

SEQ ID NO: 148286 - RNA, 22 nt, Human
gcuggcagaagagcugguucaa

SEQ ID NO: 148287 - RNA, 22 nt, Human
cuggcacgcccacguaggcacu

SEQ ID NO: 148288 - RNA, 22 nt, Human
agaggcuuggaggugcaagguu

SEQ ID NO: 148289 - RNA, 22 nt, Human
aggaggcuuuugcaggugccac

SEQ ID NO: 148290 - RNA, 19 nt, Human
gcuggcagauguggccgug

SEQ ID NO: 148291 - RNA, 22 nt, Human
ccucuccuugcacccgucccgc

SEQ ID NO: 148292 - RNA, 22 nt, Human
cagugggggggccaugcugcag

SEQ ID NO: 148293 - RNA, 22 nt, Human
gccuggcaggccuguuggggcu

SEQ ID NO: 148294 - RNA, 22 nt, Human
gacacagacaguuagagguaau

SEQ ID NO: 148295 - RNA, 22 nt, Human
ugaguagagaauucagcuaagg

SEQ ID NO: 148296 - RNA, 22 nt, Human
acuggcagaauugaauaguugu

SEQ ID NO: 148297 - RNA, 22 nt, Human
aucacaauguacguuaaaaugu

SEQ ID NO: 148298 - RNA, 22 nt, Human
gcuggcagagcucugggcuggg

SEQ ID NO: 148299 - RNA, 22 nt, Human
cugagggucaacuugauuguau

SEQ ID NO: 148300 - RNA, 19 nt, Human
gcuggcagaauuuugaacc

SEQ ID NO: 148301 - RNA, 23 nt, Human
uaaauuaccuuuccagugcaggg

SEQ ID NO: 148302 - RNA, 22 nt, Human
uucccacagagauuacauugaa

SEQ ID NO: 148303 - RNA, 17 nt, Human
agccugccccaugcugc

SEQ ID NO: 148304 - RNA, 22 nt, Human
agacacagcugcaggagguggg

SEQ ID NO: 148305 - RNA, 22 nt, Human
cugccugcucuauccaggccug

SEQ ID NO: 148306 - RNA, 22 nt, Human
uccuggcaguaauuugauguug

SEQ ID NO: 148307 - RNA, 22 nt, Human
cuucccacuaguaucacagagc

SEQ ID NO: 148308 - RNA, 22 nt, Human
aggcaggggagcuggaagggua

SEQ ID NO: 148309 - RNA, 22 nt, Human
gacuguggggggcggacacaag

SEQ ID NO: 148310 - RNA, 20 nt, Human
acaaagacuggaaaagcaag

SEQ ID NO: 148311 - RNA, 22 nt, Human
ucuggcagugaagucaugaggu

SEQ ID NO: 148312 - RNA, 22 nt, Human
acacaucuuagacugaaauaug

SEQ ID NO: 148313 - RNA, 22 nt, Human
auacauucaaaggaaggauaga

SEQ ID NO: 148314 - RNA, 22 nt, Human
guuaggaacacuggagccuaaa

SEQ ID NO: 148315 - RNA, 22 nt, Human
gaggagcugggacccugucauc

SEQ ID NO: 148316 - RNA, 22 nt, Human
guccuggcccaggaguacacau

SEQ ID NO: 148317 - RNA, 22 nt, Human
cagaaagaccugggcucaagag

SEQ ID NO: 148318 - RNA, 22 nt, Human
agugccccaugggugccugggg

SEQ ID NO: 148319 - RNA, 22 nt, Human
aaagaaucagaagucucaaaca

SEQ ID NO: 148320 - RNA, 22 nt, Human
ccacaaaacugugugucaaaga

SEQ ID NO: 148321 - RNA, 22 nt, Human
agaggccugugugcuccagugg

SEQ ID NO: 148322 - RNA, 22 nt, Human
cuggccucauagccaagcugug

SEQ ID NO: 148323 - RNA, 22 nt, Human
uuccuggccccaccccuggaga

SEQ ID NO: 148324 - RNA, 22 nt, Human
gcccucucuucugcagccucca

SEQ ID NO: 148325 - RNA, 22 nt, Human
uggcaggaaaguaacagagcac

SEQ ID NO: 148326 - RNA, 22 nt, Human
cucuccagaauaugccgccgug

SEQ ID NO: 148327 - RNA, 21 nt, Human
uucucuccauaugcccagccc

SEQ ID NO: 148328 - RNA, 22 nt, Human
uccugccuguuuaccuguacuu

SEQ ID NO: 148329 - RNA, 22 nt, Human
uccugagcccuguaggacccug

SEQ ID NO: 148330 - RNA, 22 nt, Human
ugccugccucuggcagcccugc

SEQ ID NO: 148331 - RNA, 22 nt, Human
aggacaagcuaaaggacuuccu

SEQ ID NO: 148332 - RNA, 22 nt, Human
agggacucccugggccgacacg

SEQ ID NO: 148333 - RNA, 22 nt, Human
acacaucagaaauaugaaugag

SEQ ID NO: 148334 - RNA, 20 nt, Human
uuccacaucuuugcacaugc

SEQ ID NO: 148335 - RNA, 22 nt, Human
ucccacccauccugcaucucuu

SEQ ID NO: 148336 - RNA, 22 nt, Human
cucucugggcccaguuggcacc

SEQ ID NO: 148337 - RNA, 22 nt, Human
uccugagcacagagacaaggaa

SEQ ID NO: 148338 - RNA, 22 nt, Human
acaaauccagugaacuccagug

SEQ ID NO: 148339 - RNA, 22 nt, Human
ccuggcagcuccguggccuucc

SEQ ID NO: 148340 - RNA, 19 nt, Human
ucuggcagguaauuaggga

SEQ ID NO: 148341 - RNA, 22 nt, Human
ugcuggcacguggaccaggaga

SEQ ID NO: 148342 - RNA, 22 nt, Human
acacauaagccuaaucaucucc

SEQ ID NO: 148343 - RNA, 22 nt, Human
gcagccucaaacuccccagcuc

SEQ ID NO: 148344 - RNA, 22 nt, Human
ggcugaguugagaggauuacuu

SEQ ID NO: 148345 - RNA, 22 nt, Human
ccacacagauaaguguuuucua

SEQ ID NO: 148346 - RNA, 22 nt, Human
cccugagcucaggcccuugggg

SEQ ID NO: 148347 - RNA, 22 nt, Human
gacccggcuccaggcccagcag

SEQ ID NO: 148348 - RNA, 22 nt, Human
gacacagaaggucacauguuca

SEQ ID NO: 148349 - RNA, 22 nt, Human
acauaaugagcucuuuauaaau

SEQ ID NO: 148350 - RNA, 22 nt, Human
guugggaaggcaagaaguagaa

SEQ ID NO: 148351 - RNA, 22 nt, Human
auggcagauggcuggagcaggu

SEQ ID NO: 148352 - RNA, 22 nt, Human
ucaucacauaugucaugauuug

SEQ ID NO: 148353 - RNA, 23 nt, Human
gcccacccucagcguccucacgg

SEQ ID NO: 148354 - RNA, 22 nt, Human
auagggccuaaaaaguauugcu

SEQ ID NO: 148355 - RNA, 22 nt, Human
uccccacacagauacagaguag

SEQ ID NO: 148356 - RNA, 17 nt, Human
uugggagagaaagguau

SEQ ID NO: 148357 - RNA, 22 nt, Human
acacaucucaggggacacucuc

SEQ ID NO: 148358 - RNA, 22 nt, Human
cccacacaaaucauggggagaa

SEQ ID NO: 148359 - RNA, 22 nt, Human
cccagccugugacagccguccu

SEQ ID NO: 148360 - RNA, 22 nt, Human
aaauacugcugcuauuccuuuu

SEQ ID NO: 148361 - RNA, 17 nt, Human
uccaggcagcaacugag

SEQ ID NO: 148362 - RNA, 22 nt, Human
gcuggcagagagcuggugagga

SEQ ID NO: 148363 - RNA, 22 nt, Human
agagcacagaagaauaggugcu

SEQ ID NO: 148364 - RNA, 22 nt, Human
uggcagagagacucuccuugau

SEQ ID NO: 148365 - RNA, 22 nt, Human
uauucccagccucuuucuaucu

SEQ ID NO: 148366 - RNA, 22 nt, Human
uccacacacauuucuaugugca

SEQ ID NO: 148367 - RNA, 22 nt, Human
uccccaccccagaacuacuagg

SEQ ID NO: 148368 - RNA, 22 nt, Human
caggcuggagugcaauggcaca

SEQ ID NO: 148369 - RNA, 22 nt, Human
gguggcauaagaacacuaaaga

SEQ ID NO: 148370 - RNA, 22 nt, Human
agggccccauagucacugcccg

SEQ ID NO: 148371 - RNA, 22 nt, Human
uccacccugcuuuugucuuuga

SEQ ID NO: 148372 - RNA, 22 nt, Human
gccccaccuugagagcagaaac

SEQ ID NO: 148373 - RNA, 22 nt, Human
gacugccucaguuucccugcag

SEQ ID NO: 148374 - RNA, 22 nt, Human
gucacaggcaguaacuaggacc

SEQ ID NO: 148375 - RNA, 22 nt, Human
gguggcagaggugcaucagccc

SEQ ID NO: 148376 - RNA, 22 nt, Human
ggccucucagggcagagacccu

SEQ ID NO: 148377 - RNA, 22 nt, Human
cuggccucagagggucauggug

SEQ ID NO: 148378 - RNA, 22 nt, Human
gcuggcagguccaagauagagc

SEQ ID NO: 148379 - RNA, 22 nt, Human
uuggagagauuuaggucucagu

SEQ ID NO: 148380 - RNA, 22 nt, Human
uggucucugcaggccaggcuca

SEQ ID NO: 148381 - RNA, 22 nt, Human
cccuuccuugugacuggugggg

SEQ ID NO: 148382 - RNA, 22 nt, Human
ugguaagaacccaucagagaag

SEQ ID NO: 148383 - RNA, 22 nt, Human
ccuggcaggcuggggacagugc

SEQ ID NO: 148384 - RNA, 22 nt, Human
ggcaaggggucaggcugagaca

SEQ ID NO: 148385 - RNA, 22 nt, Human
gaugccuggcacccagcaagga

SEQ ID NO: 148386 - RNA, 21 nt, Human
cagcccagcccauugacagug

SEQ ID NO: 148387 - RNA, 22 nt, Human
cacacagaaccgcucgccacuu

SEQ ID NO: 148388 - RNA, 22 nt, Human
gcuggcaggguucucacugaaa

SEQ ID NO: 148389 - RNA, 22 nt, Human
cccaggccagaacuugguugcu

SEQ ID NO: 148390 - RNA, 22 nt, Human
cccacccugggaagcuaggcag

SEQ ID NO: 148391 - RNA, 22 nt, Human
cccagcccccgagugucuggaa

SEQ ID NO: 148392 - RNA, 20 nt, Human
ccccacacuauugagcacuu

SEQ ID NO: 148393 - RNA, 22 nt, Human
gccuggcauauaguaguugugc

SEQ ID NO: 148394 - RNA, 22 nt, Human
gccagguugcugacgacgaucu

SEQ ID NO: 148395 - RNA, 22 nt, Human
ggagccugaaaagucugcauuu

SEQ ID NO: 148396 - RNA, 22 nt, Human
uuccaggcugaugggccacagg

SEQ ID NO: 148397 - RNA, 22 nt, Human
cacauuccuggugcucagcagc

SEQ ID NO: 148398 - RNA, 22 nt, Human
gagagaaaagggggaauugauu

SEQ ID NO: 148399 - RNA, 22 nt, Human
ccauucauacaauuuuguucua

SEQ ID NO: 148400 - RNA, 22 nt, Human
uacacaucacuguaucuuucag

SEQ ID NO: 148401 - RNA, 22 nt, Human
cagcccaggccgacaguuccuc

SEQ ID NO: 148402 - RNA, 22 nt, Human
ucuggcagaaggcagaaauuca

SEQ ID NO: 148403 - RNA, 22 nt, Human
cugcaggacgaccgccucaucu

SEQ ID NO: 148404 - RNA, 22 nt, Human
uccaggcucuaggcugcucucc

SEQ ID NO: 148405 - RNA, 22 nt, Human
guugggaaggugaacaugaugc

SEQ ID NO: 148406 - RNA, 22 nt, Human
ggugccagaguggcccaggggc

SEQ ID NO: 148407 - RNA, 22 nt, Human
cccagcccacgguccugggugg

SEQ ID NO: 148408 - RNA, 22 nt, Human
ucacacagcuccuuuccuuagu

SEQ ID NO: 148409 - RNA, 22 nt, Human
auuccacacaguaauacucaau

SEQ ID NO: 148410 - RNA, 22 nt, Human
uccuggcagggucuaggucuag

SEQ ID NO: 148411 - RNA, 22 nt, Human
ccacaucauggauacaguuaug

SEQ ID NO: 148412 - RNA, 18 nt, Human
uccugccugugccccagg

SEQ ID NO: 148413 - RNA, 21 nt, Human
ucuggcaguggucuuucaaau

SEQ ID NO: 148414 - RNA, 22 nt, Human
uccugagcaacacagcuaagug

SEQ ID NO: 148415 - RNA, 22 nt, Human
caccagggccccaggcugugcc

SEQ ID NO: 148416 - RNA, 22 nt, Human
ccucagcugcuucccuggagcc

SEQ ID NO: 148417 - RNA, 22 nt, Human
uacacagaaccugguguacagu

SEQ ID NO: 148418 - RNA, 22 nt, Human
uccuggcagugcuuguuuugga

SEQ ID NO: 148419 - RNA, 22 nt, Human
guccucugagggggcugcacgc

SEQ ID NO: 148420 - RNA, 22 nt, Human
aaaaagucugcaaaggagguug

SEQ ID NO: 148421 - RNA, 22 nt, Human
ugagggacucccggcccugcca

SEQ ID NO: 148422 - RNA, 22 nt, Human
acaguucccgucuugcacagcu

SEQ ID NO: 148423 - RNA, 22 nt, Human
guccucuguuuccaucugacuu

SEQ ID NO: 148424 - RNA, 22 nt, Human
cugccugcucaccagggcucug

SEQ ID NO: 148425 - RNA, 22 nt, Human
guccucugauuucuagguauau

SEQ ID NO: 148426 - RNA, 22 nt, Human
ccccacacucuuuacauucaua

SEQ ID NO: 148427 - RNA, 22 nt, Human
gauggcagguaguggucucauc

SEQ ID NO: 148428 - RNA, 22 nt, Human
auccaggcgaaugcagaaggcc

SEQ ID NO: 148429 - RNA, 22 nt, Human
cagguugguauucaucuccaca

SEQ ID NO: 148430 - RNA, 22 nt, Human
uuggaacaugccgggguccagg

SEQ ID NO: 148431 - RNA, 22 nt, Human
ugguccuggaagguccugaggg

SEQ ID NO: 148432 - RNA, 22 nt, Human
gagaaagacguaggcugggagg

SEQ ID NO: 148433 - RNA, 22 nt, Human
ucccagccacaguuuccaccug

SEQ ID NO: 148434 - RNA, 22 nt, Human
ccuggcaggacuguuguaagaa

SEQ ID NO: 148435 - RNA, 19 nt, Human
acuggcaguuucugcaugg

SEQ ID NO: 148436 - RNA, 22 nt, Human
uccaggcaaaaaccaacuacag

SEQ ID NO: 148437 - RNA, 22 nt, Human
cacacaucuuaucccaguuauu

SEQ ID NO: 148438 - RNA, 22 nt, Human
gaggagcugcagggggagucua

SEQ ID NO: 148439 - RNA, 22 nt, Human
ggagcugaaccccaucgugcug

SEQ ID NO: 148440 - RNA, 22 nt, Human
caaauacuacgauucuugcagu

SEQ ID NO: 148441 - RNA, 22 nt, Human
cuccugaggacuucuauugggu

SEQ ID NO: 148442 - RNA, 19 nt, Human
acauucccaucagcaaugu

SEQ ID NO: 148443 - RNA, 23 nt, Human
ccuggcagcaaacgaggagguua

SEQ ID NO: 148444 - RNA, 22 nt, Human
ggcccagccucagacaugcccu

SEQ ID NO: 148445 - RNA, 22 nt, Human
acuggcagaacgugaugcgggu

SEQ ID NO: 148446 - RNA, 22 nt, Human
gccuggcacaggaauuaggagg

SEQ ID NO: 148447 - RNA, 22 nt, Human
cuugccucccucagcucacagc

SEQ ID NO: 148448 - RNA, 22 nt, Human
ccuggcagccucagccaauucu

SEQ ID NO: 148449 - RNA, 22 nt, Human
ucuggcaggcaaucggcucugg

SEQ ID NO: 148450 - RNA, 18 nt, Human
ccuagccuccaagcucau

SEQ ID NO: 148451 - RNA, 22 nt, Human
gacaaaaguguuuugaacaagg

SEQ ID NO: 148452 - RNA, 22 nt, Human
ccuggcagguuacaaccaguua

SEQ ID NO: 148453 - RNA, 22 nt, Human
uggccugccacugccacgccac

SEQ ID NO: 148454 - RNA, 22 nt, Human
acacacucaauugcauaagcac

SEQ ID NO: 148455 - RNA, 17 nt, Human
cccaggccgccgggagc

SEQ ID NO: 148456 - RNA, 22 nt, Human
gcuggcaggagaaacggggugc

SEQ ID NO: 148457 - RNA, 22 nt, Human
ccacacagggggaugaguuauu

SEQ ID NO: 148458 - RNA, 22 nt, Human
gcuggcagaauuucuucuugcu

SEQ ID NO: 148459 - RNA, 22 nt, Human
ucuggcaggacaugcugaccau

SEQ ID NO: 148460 - RNA, 22 nt, Human
uggccuccccuaacagccucuu

SEQ ID NO: 148461 - RNA, 22 nt, Human
guccuggcccacuggcaggcug

SEQ ID NO: 148462 - RNA, 22 nt, Human
accugccuucucaaggacauga

SEQ ID NO: 148463 - RNA, 22 nt, Human
cagguuggucggcaaguacaca

SEQ ID NO: 148464 - RNA, 23 nt, Human
uguaaacaucacccccuggaguu

SEQ ID NO: 148465 - RNA, 21 nt, Human
ccagcccagcugugucccagc

SEQ ID NO: 148466 - RNA, 17 nt, Human
ugccagccugucccagg

SEQ ID NO: 148467 - RNA, 22 nt, Human
ucaggauggagggaagcacaga

SEQ ID NO: 148468 - RNA, 22 nt, Human
ggcacagagcuuugucccaguu

SEQ ID NO: 148469 - RNA, 22 nt, Human
aggcaguggagcuggaauaggc

SEQ ID NO: 148470 - RNA, 22 nt, Human
gaaaagaguccugugugaggag

SEQ ID NO: 148471 - RNA, 22 nt, Human
gccgggaccaaggccacggagc

SEQ ID NO: 148472 - RNA, 22 nt, Human
agcacagggacaaugccaggug

SEQ ID NO: 148473 - RNA, 22 nt, Human
aggcaguguguagcuggaagag

SEQ ID NO: 148474 - RNA, 22 nt, Human
gcacauaaagggcaugggaggu

SEQ ID NO: 148475 - RNA, 22 nt, Human
uggcaguggauaggggagcggu

SEQ ID NO: 148476 - RNA, 21 nt, Human
aacacauccagaguauuugac

SEQ ID NO: 148477 - RNA, 22 nt, Human
gcacacaggggaguucucagaa

SEQ ID NO: 148478 - RNA, 22 nt, Human
aagagagaacucccuucgccag

SEQ ID NO: 148479 - RNA, 23 nt, Human
cauccaggagcugagucugacug

SEQ ID NO: 148480 - RNA, 22 nt, Human
cuccaggccccuggccuucugc

SEQ ID NO: 148481 - RNA, 20 nt, Human
uucaugggagcaaagaggcc

SEQ ID NO: 148482 - RNA, 22 nt, Human
cuccuggcacucaguguggaag

SEQ ID NO: 148483 - RNA, 19 nt, Human
acacauuugcacaauccac

SEQ ID NO: 148484 - RNA, 23 nt, Human
uccuuccuuugagaggcuccauc

SEQ ID NO: 148485 - RNA, 22 nt, Human
ccuggcuccugccucugcaggg

SEQ ID NO: 148486 - RNA, 22 nt, Human
gagacaucauaaugaaguuucc

SEQ ID NO: 148487 - RNA, 19 nt, Human
acuggcagcuguagucugu

SEQ ID NO: 148488 - RNA, 22 nt, Human
acacauaagaaacuacaaagag

SEQ ID NO: 148489 - RNA, 22 nt, Human
caggucccugcgccccggccuc

SEQ ID NO: 148490 - RNA, 22 nt, Human
ccuggcagcuccuccccggcgg

SEQ ID NO: 148491 - RNA, 22 nt, Human
acaagagcauugcagguguguu

SEQ ID NO: 148492 - RNA, 18 nt, Human
cuccuccacagccccugc

SEQ ID NO: 148493 - RNA, 22 nt, Human
ccaggcugggcggggaaccugg

SEQ ID NO: 148494 - RNA, 22 nt, Human
agcccagcuuugaaccauauca

SEQ ID NO: 148495 - RNA, 17 nt, Human
ugcuggcaacauacaaa

SEQ ID NO: 148496 - RNA, 22 nt, Human
ucccacaccugucuauuccuag

SEQ ID NO: 148497 - RNA, 22 nt, Human
gcagggacagggcagggccuuu

SEQ ID NO: 148498 - RNA, 22 nt, Human
uugggaucucaaauccagcuau

SEQ ID NO: 148499 - RNA, 22 nt, Human
uuccuggcgccacggagccggu

SEQ ID NO: 148500 - RNA, 20 nt, Human
gcuggcagaugucuugagau

SEQ ID NO: 148501 - RNA, 22 nt, Human
guacacacuguuugaucauuuc

SEQ ID NO: 148502 - RNA, 22 nt, Human
ccagugcccagcugcccaggca

SEQ ID NO: 148503 - RNA, 22 nt, Human
ggccucagagaaggcugugcgg

SEQ ID NO: 148504 - RNA, 22 nt, Human
acuggcagccacaacuggcagg

SEQ ID NO: 148505 - RNA, 22 nt, Human
guccucuguagggcugggccac

SEQ ID NO: 148506 - RNA, 22 nt, Human
ucuggcagcucaguucaggucu

SEQ ID NO: 148507 - RNA, 22 nt, Human
gaggagcugagccacguccugg

SEQ ID NO: 148508 - RNA, 22 nt, Human
ugaccaggauacugcagggaug

SEQ ID NO: 148509 - RNA, 22 nt, Human
cccacccugggcuacacaucca

SEQ ID NO: 148510 - RNA, 22 nt, Human
ucccacauaugcaauccugaau

SEQ ID NO: 148511 - RNA, 22 nt, Human
ccacagaccuuggcuuccaccu

SEQ ID NO: 148512 - RNA, 19 nt, Human
uggcagguagugagcaguc

SEQ ID NO: 148513 - RNA, 22 nt, Human
gccuggcaggggccugggagug

SEQ ID NO: 148514 - RNA, 22 nt, Human
cccugccuugggguccacaccg

SEQ ID NO: 148515 - RNA, 22 nt, Human
acugccaaugguaguuugaugg

SEQ ID NO: 148516 - RNA, 22 nt, Human
acuggcagggggagccccgaga

SEQ ID NO: 148517 - RNA, 22 nt, Human
cuccugaggaaaagcuugguca

SEQ ID NO: 148518 - RNA, 22 nt, Human
uauguaaaguagauggcaggua

SEQ ID NO: 148519 - RNA, 22 nt, Human
auggccugaugcaccuguccca

SEQ ID NO: 148520 - RNA, 22 nt, Human
acuggcagagggaaaaccauuc

SEQ ID NO: 148521 - RNA, 23 nt, Human
uccaggagcaugcuggcuggcga

SEQ ID NO: 148522 - RNA, 22 nt, Human
cuggcagucugguggaaggccu

SEQ ID NO: 148523 - RNA, 21 nt, Human
ucuggcagcaguuuguugagu

SEQ ID NO: 148524 - RNA, 22 nt, Human
uccaggcuccccugcgugcucc

SEQ ID NO: 148525 - RNA, 22 nt, Human
guccucugaaagaugaaccaug

SEQ ID NO: 148526 - RNA, 18 nt, Human
ggccucuggacuggcagc

SEQ ID NO: 148527 - RNA, 22 nt, Human
ccuggcagguagcauugaggag

SEQ ID NO: 148528 - RNA, 22 nt, Human
cacauacaaggcacacuggagg

SEQ ID NO: 148529 - RNA, 22 nt, Human
cuccucuguauugauugggacu

SEQ ID NO: 148530 - RNA, 22 nt, Human
gcuggcaggagccuuucccuuu

SEQ ID NO: 148531 - RNA, 22 nt, Human
aucacagagauugcuuuuaaaa

SEQ ID NO: 148532 - RNA, 22 nt, Human
gaggagcucugcuccauccuuc

SEQ ID NO: 148533 - RNA, 22 nt, Human
ccacccuaacaauccuuacugu

SEQ ID NO: 148534 - RNA, 22 nt, Human
uacugacacaaagccaaucccu

SEQ ID NO: 148535 - RNA, 19 nt, Human
acuggcagggcugcggugg

SEQ ID NO: 148536 - RNA, 22 nt, Human
gcacauacugcaaagauuacua

SEQ ID NO: 148537 - RNA, 22 nt, Human
gcuccaggagagggaagcagau

SEQ ID NO: 148538 - RNA, 22 nt, Human
gccuccuggaagucacauguuu

SEQ ID NO: 148539 - RNA, 22 nt, Human
gcuggcaguuuccucaccgagg

SEQ ID NO: 148540 - RNA, 22 nt, Human
cccagcaugcacgcugacacuc

SEQ ID NO: 148541 - RNA, 22 nt, Human
aggaggcugggcacaguggccu

SEQ ID NO: 148542 - RNA, 22 nt, Human
ucuggcagugagcaacuugaca

SEQ ID NO: 148543 - RNA, 22 nt, Human
guccucugacucagccuuggga

SEQ ID NO: 148544 - RNA, 22 nt, Human
cugccucuauaggaguccacca

SEQ ID NO: 148545 - RNA, 19 nt, Human
guccucucaacaacccggg

SEQ ID NO: 148546 - RNA, 22 nt, Human
gccuccggaguugcagugucuu

SEQ ID NO: 148547 - RNA, 22 nt, Human
cuuacacagucuggcacuucuu

SEQ ID NO: 148548 - RNA, 21 nt, Human
agugccaguagguauggagga

SEQ ID NO: 148549 - RNA, 22 nt, Human
caugagauaauuuuucuccagu

SEQ ID NO: 148550 - RNA, 22 nt, Human
ucuccacacuuucucucccagg

SEQ ID NO: 148551 - RNA, 22 nt, Human
gucaggacucugacccgucccg

SEQ ID NO: 148552 - RNA, 22 nt, Human
ucccacacuugaaacaaggcug

SEQ ID NO: 148553 - RNA, 22 nt, Human
uccuggcacccuuggguuggag

SEQ ID NO: 148554 - RNA, 22 nt, Human
gcuggcagacugggggcagaac

SEQ ID NO: 148555 - RNA, 22 nt, Human
uccaggaggaggaaggcugcca

SEQ ID NO: 148556 - RNA, 22 nt, Human
gcuggcaguguauuguuagcug

SEQ ID NO: 148557 - RNA, 22 nt, Human
aaagagucguguuccagguuug

SEQ ID NO: 148558 - RNA, 22 nt, Human
uggcagugucuuaucaggagug

SEQ ID NO: 148559 - RNA, 22 nt, Human
uacaaaaggaagagggaucuua

SEQ ID NO: 148560 - RNA, 22 nt, Human
guccucuggagguuuuuaggug

SEQ ID NO: 148561 - RNA, 22 nt, Human
acacacagaaggaagccccacu

SEQ ID NO: 148562 - RNA, 22 nt, Human
ccuucucucugaagaccccaaa

SEQ ID NO: 148563 - RNA, 22 nt, Human
agcacugugauuuauaacauuu

SEQ ID NO: 148564 - RNA, 22 nt, Human
ucccacauuacccugacugaca

SEQ ID NO: 148565 - RNA, 21 nt, Human
cccuugccugcacuccucggc

SEQ ID NO: 148566 - RNA, 22 nt, Human
ccuggcagucaggggaguccuu

SEQ ID NO: 148567 - RNA, 22 nt, Human
aacacagaucaaaauauuuccu

SEQ ID NO: 148568 - RNA, 22 nt, Human
cuccuggcuuucccagaccagg

SEQ ID NO: 148569 - RNA, 22 nt, Human
ucccuccccacuucugagcuuu

SEQ ID NO: 148570 - RNA, 22 nt, Human
ccuggcagacugugagggcagg

SEQ ID NO: 148571 - RNA, 22 nt, Human
uuccuggccaagcagaguggaa

SEQ ID NO: 148572 - RNA, 22 nt, Human
ggccucucugagagcagacguu

SEQ ID NO: 148573 - RNA, 22 nt, Human
acuggcaguagagggagcgcau

SEQ ID NO: 148574 - RNA, 22 nt, Human
accugccuaucagcugccugcu

SEQ ID NO: 148575 - RNA, 22 nt, Human
acacacuguugcucauccaggc

SEQ ID NO: 148576 - RNA, 21 nt, Human
ccacucaugacuccacucacc

SEQ ID NO: 148577 - RNA, 22 nt, Human
ccccacaccugccgggcagcag

SEQ ID NO: 148578 - RNA, 22 nt, Human
gcccacaccauuuauucuuugu

SEQ ID NO: 148579 - RNA, 22 nt, Human
ggaggacaggggcugcagcaca

SEQ ID NO: 148580 - RNA, 22 nt, Human
acacacaugccuuuccuaagua

SEQ ID NO: 148581 - RNA, 21 nt, Human
uccccacauuucuaaacagac

SEQ ID NO: 148582 - RNA, 22 nt, Human
cuggcaguuggcauuggcaucu

SEQ ID NO: 148583 - RNA, 22 nt, Human
aggggugugcauccuggaggau

SEQ ID NO: 148584 - RNA, 22 nt, Human
acacacagguaaaggagccugg

SEQ ID NO: 148585 - RNA, 22 nt, Human
guggcaguuuugacaucacaaa

SEQ ID NO: 148586 - RNA, 22 nt, Human
ucauggcacuuagcacaguccu

SEQ ID NO: 148587 - RNA, 22 nt, Human
ugguccugccccgugcacagag

SEQ ID NO: 148588 - RNA, 22 nt, Human
gcuggcaggauagaagucuaau

SEQ ID NO: 148589 - RNA, 22 nt, Human
auggccuggggauuccugagca

SEQ ID NO: 148590 - RNA, 22 nt, Human
aucccacaccccuacaacauau

SEQ ID NO: 148591 - RNA, 22 nt, Human
cccagcccaucucaaaggucua

SEQ ID NO: 148592 - RNA, 22 nt, Human
uuccaggcucccuuggaggugu

SEQ ID NO: 148593 - RNA, 22 nt, Human
ccauacacacaccaaauuugua

SEQ ID NO: 148594 - RNA, 18 nt, Human
acucugcggaggccccag

SEQ ID NO: 148595 - RNA, 22 nt, Human
uccuggcagaaauggggcugug

SEQ ID NO: 148596 - RNA, 22 nt, Human
augacugcucugggcucccaug

SEQ ID NO: 148597 - RNA, 22 nt, Human
gguucccggaucuccgaguccc

SEQ ID NO: 148598 - RNA, 22 nt, Human
uguaaacauauguauguaugua

SEQ ID NO: 148599 - RNA, 22 nt, Human
guacacacuauuuaaaguguuu

SEQ ID NO: 148600 - RNA, 22 nt, Human
acagguccucaagucagcuggg

SEQ ID NO: 148601 - RNA, 22 nt, Human
cuggccucuguguucaccauag

SEQ ID NO: 148602 - RNA, 22 nt, Human
cagccaggauggagaacuguug

SEQ ID NO: 148603 - RNA, 22 nt, Human
gcuggcagggacagcugcgugu

SEQ ID NO: 148604 - RNA, 22 nt, Human
gaggagcucaugaaagcggugu

SEQ ID NO: 148605 - RNA, 22 nt, Human
ucuggcaguuugagaaaggcua

SEQ ID NO: 148606 - RNA, 22 nt, Human
cagggacaauggcagagccuga

SEQ ID NO: 148607 - RNA, 22 nt, Human
ucuggcaggaccaugaagcgua

SEQ ID NO: 148608 - RNA, 21 nt, Human
ccuggcagaagccugauaugc

SEQ ID NO: 148609 - RNA, 22 nt, Human
cccacacacauuuaugauagga

SEQ ID NO: 148610 - RNA, 21 nt, Human
cacacagugaucuauccacau

SEQ ID NO: 148611 - RNA, 22 nt, Human
ggugccaggcuguagucagggu

SEQ ID NO: 148612 - RNA, 22 nt, Human
guugggaagcagauggaugagc

SEQ ID NO: 148613 - RNA, 22 nt, Human
aguugggaguuauagacucuau

SEQ ID NO: 148614 - RNA, 22 nt, Human
aguguggcaggaaugacuagaa

SEQ ID NO: 148615 - RNA, 22 nt, Human
agggcugaagggaggugcucau

SEQ ID NO: 148616 - RNA, 22 nt, Human
cucagccccaauucuccccauu

SEQ ID NO: 148617 - RNA, 22 nt, Human
caggacaaagcccuuugagaaa

SEQ ID NO: 148618 - RNA, 22 nt, Human
ggggcugagucagugggaagag

SEQ ID NO: 148619 - RNA, 22 nt, Human
uguuggaauuaggauacagagg

SEQ ID NO: 148620 - RNA, 23 nt, Human
uuggagagggugaguagugucag

SEQ ID NO: 148621 - RNA, 22 nt, Human
uccugagccugacaaucaccau

SEQ ID NO: 148622 - RNA, 22 nt, Human
uuuaaauuuagaagaaacacug

SEQ ID NO: 148623 - RNA, 22 nt, Human
cccgagugucuacucacuccca

SEQ ID NO: 148624 - RNA, 22 nt, Human
acccacaccuccguauaucacu

SEQ ID NO: 148625 - RNA, 22 nt, Human
ucacacacauaaucuaagauua

SEQ ID NO: 148626 - RNA, 22 nt, Human
gcugcgccggaucccacguucc

SEQ ID NO: 148627 - RNA, 15 nt, Human
cacacagacagcuug

SEQ ID NO: 148628 - RNA, 19 nt, Human
ccagcccacagugacuuuc

SEQ ID NO: 148629 - RNA, 22 nt, Human
uacauuccuguuagcaucuaag

SEQ ID NO: 148630 - RNA, 22 nt, Human
uccuggcagagggcggccucga

SEQ ID NO: 148631 - RNA, 22 nt, Human
ucuggcagaagugcugucagua

SEQ ID NO: 148632 - RNA, 22 nt, Human
cucucuccuuagcugcagacca

SEQ ID NO: 148633 - RNA, 22 nt, Human
ugcacaggugagacucaggaag

SEQ ID NO: 148634 - RNA, 22 nt, Human
ccagccucacuggcaucaccua

SEQ ID NO: 148635 - RNA, 22 nt, Human
cccacccucaagggugucuaua

SEQ ID NO: 148636 - RNA, 22 nt, Human
ucuggcaguugccgcuucaguc

SEQ ID NO: 148637 - RNA, 22 nt, Human
uuccuggcagaggccccgacag

SEQ ID NO: 148638 - RNA, 22 nt, Human
accugccucagugcagcuggau

SEQ ID NO: 148639 - RNA, 22 nt, Human
gagaggcuggcagugccagguu

SEQ ID NO: 148640 - RNA, 22 nt, Human
uuccaggccgggcaggaaacac

SEQ ID NO: 148641 - RNA, 22 nt, Human
ugacaggaggcuugaggccagg

SEQ ID NO: 148642 - RNA, 22 nt, Human
acacacagcgccuaccaugugc

SEQ ID NO: 148643 - RNA, 22 nt, Human
accugccuauggagccacaugg

SEQ ID NO: 148644 - RNA, 22 nt, Human
gggacaauggaggccucucucc

SEQ ID NO: 148645 - RNA, 22 nt, Human
ugcagagaaaacuccuggguac

SEQ ID NO: 148646 - RNA, 23 nt, Human
acauacauggagauaaagugaug

SEQ ID NO: 148647 - RNA, 19 nt, Human
cagcccucuuaccacugug

SEQ ID NO: 148648 - RNA, 22 nt, Human
cacaacuuuaggaaccacauuc

SEQ ID NO: 148649 - RNA, 22 nt, Human
acacacuuuaaauuaaaccucu

SEQ ID NO: 148650 - RNA, 22 nt, Human
cuggcagguuuggugucuggug

SEQ ID NO: 148651 - RNA, 22 nt, Human
uggcacagggcuuggucgcuca

SEQ ID NO: 148652 - RNA, 22 nt, Human
auccaggccccaagaccccgac

SEQ ID NO: 148653 - RNA, 22 nt, Human
cuguccuccagacgacaguccc

SEQ ID NO: 148654 - RNA, 22 nt, Human
ucccugcccucagugcacccgg

SEQ ID NO: 148655 - RNA, 22 nt, Human
aagugccaucauagcauggcug

SEQ ID NO: 148656 - RNA, 22 nt, Human
agcacaggaccaaggaagcugu

SEQ ID NO: 148657 - RNA, 22 nt, Human
guccucugaaguugugcaaugc

SEQ ID NO: 148658 - RNA, 22 nt, Human
uggcagagaacacacaugauuc

SEQ ID NO: 148659 - RNA, 20 nt, Human
uggccucugagaugccacgg

SEQ ID NO: 148660 - RNA, 22 nt, Human
cagcacagugaccagacccacu

SEQ ID NO: 148661 - RNA, 22 nt, Human
gcuccaggcagcauaguggaug

SEQ ID NO: 148662 - RNA, 21 nt, Human
aggcugcuggcucaggguccu

SEQ ID NO: 148663 - RNA, 22 nt, Human
cacacugucagguaaauaacac

SEQ ID NO: 148664 - RNA, 22 nt, Human
cccuuccugggugucccggagu

SEQ ID NO: 148665 - RNA, 22 nt, Human
aucacagagcucccuuccacug

SEQ ID NO: 148666 - RNA, 22 nt, Human
cccuuccucccaggcuucugug

SEQ ID NO: 148667 - RNA, 22 nt, Human
cauucccacguguucuuugcuu

SEQ ID NO: 148668 - RNA, 22 nt, Human
ccaggcuguaagagugauguug

SEQ ID NO: 148669 - RNA, 22 nt, Human
agacacagucugucuggaggag

SEQ ID NO: 148670 - RNA, 22 nt, Human
ccuccuggcuuuucccauugaa

SEQ ID NO: 148671 - RNA, 22 nt, Human
cacacaucaaccuagacauugu

SEQ ID NO: 148672 - RNA, 22 nt, Human
ccucugccaccucccacgaggc

SEQ ID NO: 148673 - RNA, 22 nt, Human
cuccuggcaguuccccuuguca

SEQ ID NO: 148674 - RNA, 22 nt, Human
acccacccuacuagcagugucc

SEQ ID NO: 148675 - RNA, 22 nt, Human
acaucacacgccuuccaggagg

SEQ ID NO: 148676 - RNA, 22 nt, Human
cccugagcgugaggaggaagua

SEQ ID NO: 148677 - RNA, 22 nt, Human
cacacagacagcucucugaaga

SEQ ID NO: 148678 - RNA, 22 nt, Human
ccagcccuugcugaaggguggc

SEQ ID NO: 148679 - RNA, 22 nt, Human
uccaggccauugacugcauccu

SEQ ID NO: 148680 - RNA, 22 nt, Human
acaucacaguaguuaagccaga

SEQ ID NO: 148681 - RNA, 22 nt, Human
uguaaacauaccagagccaagu

SEQ ID NO: 148682 - RNA, 22 nt, Human
gagaccucuugguaucgcuagg

SEQ ID NO: 148683 - RNA, 22 nt, Human
ucuggcagaucuucccacguuu

SEQ ID NO: 148684 - RNA, 23 nt, Human
acuccccagucucuucuugccaa

SEQ ID NO: 148685 - RNA, 22 nt, Human
agaggccuccgaaaggugggcu

SEQ ID NO: 148686 - RNA, 22 nt, Human
aaagaucaauagauaaagcuac

SEQ ID NO: 148687 - RNA, 22 nt, Human
agcagguugugauacacucaga

SEQ ID NO: 148688 - RNA, 22 nt, Human
cagguuggggacuuaggaugac

SEQ ID NO: 148689 - RNA, 22 nt, Human
ccacacuaaacugcucaaacca

SEQ ID NO: 148690 - RNA, 22 nt, Human
ugcuccagugccugccccacag

SEQ ID NO: 148691 - RNA, 19 nt, Human
gggagcugaggucuuuggu

SEQ ID NO: 148692 - RNA, 22 nt, Human
cacacacugacaccuuaucuug

SEQ ID NO: 148693 - RNA, 22 nt, Human
ucuggcaguggaugagggcagc

SEQ ID NO: 148694 - RNA, 22 nt, Human
ccuggcagcaggugggcccgug

SEQ ID NO: 148695 - RNA, 22 nt, Human
ucacacacauuugcugucugau

SEQ ID NO: 148696 - RNA, 22 nt, Human
uccaggcuagguuuacaggaca

SEQ ID NO: 148697 - RNA, 22 nt, Human
gguuccuucugaggucccugua

SEQ ID NO: 148698 - RNA, 19 nt, Human
ccagucccauacaggagau

SEQ ID NO: 148699 - RNA, 22 nt, Human
gcuccaggaggaugaccuuccu

SEQ ID NO: 148700 - RNA, 22 nt, Human
auccucuguggauuacaccuag

SEQ ID NO: 148701 - RNA, 22 nt, Human
gagacacacauucuggagagaa

SEQ ID NO: 148702 - RNA, 22 nt, Human
ucuggcaggccuugucaaucug

SEQ ID NO: 148703 - RNA, 20 nt, Human
aaagagcccuuggagcaggc

SEQ ID NO: 148704 - RNA, 22 nt, Human
ucacauaaauuuaccagaugau

SEQ ID NO: 148705 - RNA, 22 nt, Human
uccccacacuuucacuccuggc

SEQ ID NO: 148706 - RNA, 22 nt, Human
ccuggcagaauauuaaagugca

SEQ ID NO: 148707 - RNA, 22 nt, Human
ccuggcagcgccgaagcuggcc

SEQ ID NO: 148708 - RNA, 18 nt, Human
acaggcugugggaauggu

SEQ ID NO: 148709 - RNA, 22 nt, Human
cacacacuggagcaaggagaug

SEQ ID NO: 148710 - RNA, 22 nt, Human
cuaugagaagaaaacaagauua

SEQ ID NO: 148711 - RNA, 22 nt, Human
auuccacagcuacaucaaucua

SEQ ID NO: 148712 - RNA, 22 nt, Human
gcacacacaugugaguacaugc

SEQ ID NO: 148713 - RNA, 22 nt, Human
gagauggccagugccaggacaa

SEQ ID NO: 148714 - RNA, 22 nt, Human
gcuugggaagggcccuguguac

SEQ ID NO: 148715 - RNA, 22 nt, Human
aagaggucauaccagauaaggg

SEQ ID NO: 148716 - RNA, 22 nt, Human
uggcagagcccagacuccaguc

SEQ ID NO: 148717 - RNA, 22 nt, Human
ccuccagcgcgauccacuccgg

SEQ ID NO: 148718 - RNA, 22 nt, Human
gccuggcaaggcccuguugacu

SEQ ID NO: 148719 - RNA, 22 nt, Human
agacacauaggaccacacugug

SEQ ID NO: 148720 - RNA, 22 nt, Human
guccucugcuucaugcccugau

SEQ ID NO: 148721 - RNA, 22 nt, Human
gacacauagaucuaucucacuc

SEQ ID NO: 148722 - RNA, 22 nt, Human
cuuacaaauacacuuaggagag

SEQ ID NO: 148723 - RNA, 22 nt, Human
cuccuggcacugucuugaccca

SEQ ID NO: 148724 - RNA, 22 nt, Human
uuccagcccgcgacuuguucag

SEQ ID NO: 148725 - RNA, 22 nt, Human
cacacaguaggcacucauuaau

SEQ ID NO: 148726 - RNA, 22 nt, Human
uccuggcacuuugggggcucgc

SEQ ID NO: 148727 - RNA, 22 nt, Human
gaggcacagucccgaggcaagg

SEQ ID NO: 148728 - RNA, 22 nt, Human
cugcaggagcaaagccucugcu

SEQ ID NO: 148729 - RNA, 22 nt, Human
ggcacagggggcugaggacuag

SEQ ID NO: 148730 - RNA, 22 nt, Human
cucaucaccacauauaacaaag

SEQ ID NO: 148731 - RNA, 22 nt, Human
guccucuggaagaugaguucuu

SEQ ID NO: 148732 - RNA, 22 nt, Human
ugccagccagggaagcucaccc

SEQ ID NO: 148733 - RNA, 22 nt, Human
acacacagaguuuauacaggca

SEQ ID NO: 148734 - RNA, 22 nt, Human
ccagcccugucaccaacuggag

SEQ ID NO: 148735 - RNA, 22 nt, Human
uccaggcaagggaggagcaugg

SEQ ID NO: 148736 - RNA, 22 nt, Human
auguuggagucguaaggcaugg

SEQ ID NO: 148737 - RNA, 22 nt, Human
ucccaccccggucaagggcuga

SEQ ID NO: 148738 - RNA, 22 nt, Human
ugagagucuguuccucuugcag

SEQ ID NO: 148739 - RNA, 20 nt, Human
ccuggcaggcggguuacuua

SEQ ID NO: 148740 - RNA, 22 nt, Human
ggagucugcucccagacaugau

SEQ ID NO: 148741 - RNA, 22 nt, Human
uuccuggcucacagcagugggg

SEQ ID NO: 148742 - RNA, 22 nt, Human
aaaagagucuuaggcagucaua

SEQ ID NO: 148743 - RNA, 22 nt, Human
ccuggcagaaagaguuacaccu

SEQ ID NO: 148744 - RNA, 22 nt, Human
gcacacauucggauucuuaacc

SEQ ID NO: 148745 - RNA, 22 nt, Human
cagcccagccuugucucuuuau

SEQ ID NO: 148746 - RNA, 22 nt, Human
ucccagccuuucuuuucugcug

SEQ ID NO: 148747 - RNA, 23 nt, Human
uuccaggcagagcagggauuaga

SEQ ID NO: 148748 - RNA, 22 nt, Human
ccuggcaggcaagaggaaggga

SEQ ID NO: 148749 - RNA, 22 nt, Human
ucaggcccagagucacggaucc

SEQ ID NO: 148750 - RNA, 22 nt, Human
uugggaaguuuaaugacagacu

SEQ ID NO: 148751 - RNA, 19 nt, Human
ugccuggcaccagcuccac

SEQ ID NO: 148752 - RNA, 22 nt, Human
aaagaucaaguaggcauggccu

SEQ ID NO: 148753 - RNA, 22 nt, Human
agccagggucucucgcucuguu

SEQ ID NO: 148754 - RNA, 22 nt, Human
ccuggcagggcugcaguaaugg

SEQ ID NO: 148755 - RNA, 22 nt, Human
gagccugaugaaacaggcagac

SEQ ID NO: 148756 - RNA, 22 nt, Human
auacaugacucacacauucugc

SEQ ID NO: 148757 - RNA, 22 nt, Human
gcacauaacugaccacaucuaa

SEQ ID NO: 148758 - RNA, 18 nt, Human
gacaaaaguacagacaga

SEQ ID NO: 148759 - RNA, 22 nt, Human
gguguugggcucacugguccuu

SEQ ID NO: 148760 - RNA, 22 nt, Human
uacacacaugcauuugccuuau

SEQ ID NO: 148761 - RNA, 22 nt, Human
ucccagccuggacccugccagu

SEQ ID NO: 148762 - RNA, 22 nt, Human
ugcacaggaggcuguggagaag

SEQ ID NO: 148763 - RNA, 22 nt, Human
ccaccccaaaugaagaccucuc

SEQ ID NO: 148764 - RNA, 22 nt, Human
uccuggcaaagauguugguguu

SEQ ID NO: 148765 - RNA, 22 nt, Human
uggaaagaggaagugcccagca

SEQ ID NO: 148766 - RNA, 22 nt, Human
ggcccagcgaggccaccuacag

SEQ ID NO: 148767 - RNA, 22 nt, Human
ccagcccugccagagagagcug

SEQ ID NO: 148768 - RNA, 22 nt, Human
acacucuguaaugucacacucc

SEQ ID NO: 148769 - RNA, 22 nt, Human
aggaaagauggaaggaggauaa

SEQ ID NO: 148770 - RNA, 22 nt, Human
uggcagggugccaguugcgagu

SEQ ID NO: 148771 - RNA, 22 nt, Human
uacacaucucugucaguaguga

SEQ ID NO: 148772 - RNA, 22 nt, Human
acuggcagaacuggugauuguc

SEQ ID NO: 148773 - RNA, 22 nt, Human
uuccagccaugguuucccuaug

SEQ ID NO: 148774 - RNA, 22 nt, Human
cacuguccaauagauacauaau

SEQ ID NO: 148775 - RNA, 22 nt, Human
agaaagaggaugcagaucucau

SEQ ID NO: 148776 - RNA, 23 nt, Human
ugagggacaugguggcuucugag

SEQ ID NO: 148777 - RNA, 22 nt, Human
guccucugcccaggucaagguu

SEQ ID NO: 148778 - RNA, 22 nt, Human
aaagaucacgucccaggacucg

SEQ ID NO: 148779 - RNA, 22 nt, Human
cccagccucuguuugcuccucu

SEQ ID NO: 148780 - RNA, 22 nt, Human
aacaaaagccgaaguagguguc

SEQ ID NO: 148781 - RNA, 22 nt, Human
cgcauacauagaaacacacaga

SEQ ID NO: 148782 - RNA, 22 nt, Human
uggcaguggcucagagugcaga

SEQ ID NO: 148783 - RNA, 22 nt, Human
gccacagguacuaugggagaga

SEQ ID NO: 148784 - RNA, 22 nt, Human
cuugggaaugcuaacagaugac

SEQ ID NO: 148785 - RNA, 22 nt, Human
cugagcagugguucuugagcgc

SEQ ID NO: 148786 - RNA, 21 nt, Human
ccuagccucuuacccagcuuu

SEQ ID NO: 148787 - RNA, 22 nt, Human
ccaggccucuggcugcuuaguc

SEQ ID NO: 148788 - RNA, 22 nt, Human
ugcagagagaccccugggccag

SEQ ID NO: 148789 - RNA, 22 nt, Human
ucuggcagcagcaucaguggcu

SEQ ID NO: 148790 - RNA, 22 nt, Human
cacagagacagaagcacuuaug

SEQ ID NO: 148791 - RNA, 22 nt, Human
gcuggcaggauaacuucuaagc

SEQ ID NO: 148792 - RNA, 22 nt, Human
uacacagacucuucaauucaga

SEQ ID NO: 148793 - RNA, 22 nt, Human
ccuggcagcccagagcgccgcu

SEQ ID NO: 148794 - RNA, 22 nt, Human
cuccaggccauggcugcggagg

SEQ ID NO: 148795 - RNA, 17 nt, Human
uuaagguggaucagcac

SEQ ID NO: 148796 - RNA, 22 nt, Human
cuuccucuagccuaguaaugcc

SEQ ID NO: 148797 - RNA, 22 nt, Human
ucuggcagguucccauguuaug

SEQ ID NO: 148798 - RNA, 22 nt, Human
acuggcagagguuggacaccau

SEQ ID NO: 148799 - RNA, 22 nt, Human
acagguggaggcuuuaggaggu

SEQ ID NO: 148800 - RNA, 22 nt, Human
caucacagguccugaugacauu

SEQ ID NO: 148801 - RNA, 22 nt, Human
ucacacaugcuaagccagagau

SEQ ID NO: 148802 - RNA, 22 nt, Human
acaggugguagaguggaaagag

SEQ ID NO: 148803 - RNA, 22 nt, Human
gagaaagauuguccuucagggg

SEQ ID NO: 148804 - RNA, 22 nt, Human
cccuuccuugauuuuaacugga

SEQ ID NO: 148805 - RNA, 22 nt, Human
ucccacccccuccaaggaggaa

SEQ ID NO: 148806 - RNA, 22 nt, Human
uggcagagaacacggcugaucu

SEQ ID NO: 148807 - RNA, 22 nt, Human
ccuggcagcgugccgagcugcg

SEQ ID NO: 148808 - RNA, 22 nt, Human
uggcagugguaccggcucucag

SEQ ID NO: 148809 - RNA, 22 nt, Human
cuggcaggagcauucacagagg

SEQ ID NO: 148810 - RNA, 22 nt, Human
uaaaggguagguuuuacuguaa

SEQ ID NO: 148811 - RNA, 22 nt, Human
cacugucccuguuuccuggaaa

SEQ ID NO: 148812 - RNA, 22 nt, Human
guccucugggcagcugccccac

SEQ ID NO: 148813 - RNA, 22 nt, Human
gggccccuugcugcucugcugg

SEQ ID NO: 148814 - RNA, 22 nt, Human
uuccuggccuaagguaggugac

SEQ ID NO: 148815 - RNA, 22 nt, Human
uacacagauaugugaucaauca

SEQ ID NO: 148816 - RNA, 22 nt, Human
cagcccaggucucucuuccagu

SEQ ID NO: 148817 - RNA, 21 nt, Human
ucacguggucacaugagcuuu

SEQ ID NO: 148818 - RNA, 20 nt, Human
ucacacaugguaagcuauga

SEQ ID NO: 148819 - RNA, 22 nt, Human
ggugccagugggucucaggaua

SEQ ID NO: 148820 - RNA, 22 nt, Human
cacacacuguuaauguaggagu

SEQ ID NO: 148821 - RNA, 22 nt, Human
aggcugcuucagcugcagggag

SEQ ID NO: 148822 - RNA, 22 nt, Human
gcuggcagguaaagccccgggg

SEQ ID NO: 148823 - RNA, 22 nt, Human
uauuacagaaucaggcauaacu

SEQ ID NO: 148824 - RNA, 16 nt, Human
gcacacacaucaauga

SEQ ID NO: 148825 - RNA, 22 nt, Human
ggagcugaggcugaggccucac

SEQ ID NO: 148826 - RNA, 22 nt, Human
cacacagaugguaagggaggga

SEQ ID NO: 148827 - RNA, 22 nt, Human
cacaauuuuaauacacagucaa

SEQ ID NO: 148828 - RNA, 22 nt, Human
ucuggcaguaauaggggagaga

SEQ ID NO: 148829 - RNA, 20 nt, Human
gagucacagaagaagcugaa

SEQ ID NO: 148830 - RNA, 22 nt, Human
uagacacaucuucauccacaau

SEQ ID NO: 148831 - RNA, 22 nt, Human
ugggagaaacugucucucccac

SEQ ID NO: 148832 - RNA, 21 nt, Human
ucuggcaggaagacggauggg

SEQ ID NO: 148833 - RNA, 22 nt, Human
cuccuggcaggcugagugaaau

SEQ ID NO: 148834 - RNA, 22 nt, Human
acaugacuuuucucuuccagag

SEQ ID NO: 148835 - RNA, 22 nt, Human
ugcagagagauccucaggguuu

SEQ ID NO: 148836 - RNA, 22 nt, Human
aagagagagugcgcucacagaa

SEQ ID NO: 148837 - RNA, 21 nt, Human
aaagagcccgcugagagguuc

SEQ ID NO: 148838 - RNA, 21 nt, Human
acacacugaguuuuccacugu

SEQ ID NO: 148839 - RNA, 22 nt, Human
auccccacgauauagccaaagc

SEQ ID NO: 148840 - RNA, 18 nt, Human
ggcagggaaaagauaggg

SEQ ID NO: 148841 - RNA, 22 nt, Human
guccucuggccuuucccaggac

SEQ ID NO: 148842 - RNA, 22 nt, Human
cccagccuuccacccuggacua

SEQ ID NO: 148843 - RNA, 22 nt, Human
auaauggccgggggcugaaugc

SEQ ID NO: 148844 - RNA, 22 nt, Human
aacacauauuuauauaugcaca

SEQ ID NO: 148845 - RNA, 22 nt, Human
ggcagagguagcuggaaccagg

SEQ ID NO: 148846 - RNA, 22 nt, Human
cacacacaguuuuguauucugu

SEQ ID NO: 148847 - RNA, 22 nt, Human
uccugagcugccgcaucagcag

SEQ ID NO: 148848 - RNA, 21 nt, Human
gggcagaggggccuccugggu

SEQ ID NO: 148849 - RNA, 22 nt, Human
ccugccuucagcccugaagucu

SEQ ID NO: 148850 - RNA, 22 nt, Human
aggaagaaccuaagaaagucuc

SEQ ID NO: 148851 - RNA, 22 nt, Human
uacacaucccagacucccagga

SEQ ID NO: 148852 - RNA, 22 nt, Human
ccuggcagcagcacaugccuuc

SEQ ID NO: 148853 - RNA, 22 nt, Human
ucacauacugaaaguccaguga

SEQ ID NO: 148854 - RNA, 21 nt, Human
agaugcugaugcugcaggucc

SEQ ID NO: 148855 - RNA, 22 nt, Human
gcuggcagccaagugaagaggg

SEQ ID NO: 148856 - RNA, 22 nt, Human
uagauacaggcucucugagccu

SEQ ID NO: 148857 - RNA, 22 nt, Human
ccagcccuuagauaaaccuggc

SEQ ID NO: 148858 - RNA, 22 nt, Human
auggccugcagugcugccacag

SEQ ID NO: 148859 - RNA, 22 nt, Human
ucuccugggaggacaaggaagg

SEQ ID NO: 148860 - RNA, 22 nt, Human
cauuacaaccccaaauuacaaa

SEQ ID NO: 148861 - RNA, 22 nt, Human
uuguaaacugcugcaggagugc

SEQ ID NO: 148862 - RNA, 22 nt, Human
ucuugggauagugucucauggc

SEQ ID NO: 148863 - RNA, 22 nt, Human
guccuggcaccucacuggcuac

SEQ ID NO: 148864 - RNA, 22 nt, Human
uccuggcauugugcagggugug

SEQ ID NO: 148865 - RNA, 21 nt, Human
uccacccucucugcucccagu

SEQ ID NO: 148866 - RNA, 22 nt, Human
cccacacauuuuucacuuaccg

SEQ ID NO: 148867 - RNA, 22 nt, Human
ggcagugagaggucuccugguc

SEQ ID NO: 148868 - RNA, 22 nt, Human
acagguggccccgagggagugg

SEQ ID NO: 148869 - RNA, 22 nt, Human
ccucccuucaguagagcccaau

SEQ ID NO: 148870 - RNA, 22 nt, Human
ggccucucaugcccagagccaa

SEQ ID NO: 148871 - RNA, 22 nt, Human
ucccagccaggcucuaccacuu

SEQ ID NO: 148872 - RNA, 22 nt, Human
agguagggaagaaggcaugaaa

SEQ ID NO: 148873 - RNA, 20 nt, Human
cacaacuguccacaugcucc

SEQ ID NO: 148874 - RNA, 22 nt, Human
cugccugcuuaccaugcaucag

SEQ ID NO: 148875 - RNA, 22 nt, Human
ugcagagaagaggacaguucua

SEQ ID NO: 148876 - RNA, 20 nt, Human
auacacaugcagacagaugc

SEQ ID NO: 148877 - RNA, 22 nt, Human
acacacaugcaugcuugccauu

SEQ ID NO: 148878 - RNA, 22 nt, Human
uguggggaagaguaugacuugg

SEQ ID NO: 148879 - RNA, 20 nt, Human
gauacacagcacagagggcc

SEQ ID NO: 148880 - RNA, 22 nt, Human
acagguggggcacuuggagccu

SEQ ID NO: 148881 - RNA, 22 nt, Human
acuggcagguccaucgcccuuu

SEQ ID NO: 148882 - RNA, 22 nt, Human
cacacacucuuccuggcaccua

SEQ ID NO: 148883 - RNA, 22 nt, Human
cucuccagccuuuagcccacgc

SEQ ID NO: 148884 - RNA, 22 nt, Human
gcacacaguauaugcucauuaa

SEQ ID NO: 148885 - RNA, 22 nt, Human
cacccacauggaaauucacagu

SEQ ID NO: 148886 - RNA, 22 nt, Human
cagcccaaagccccaggcuaga

SEQ ID NO: 148887 - RNA, 22 nt, Human
aggccacaguacuuugcagacc

SEQ ID NO: 148888 - RNA, 22 nt, Human
uccugugccaucucuagagacu

SEQ ID NO: 148889 - RNA, 19 nt, Human
uccuggcauuuguaggaaa

SEQ ID NO: 148890 - RNA, 22 nt, Human
cugagagaucaagccacaggau

SEQ ID NO: 148891 - RNA, 21 nt, Human
acacacucugagucuucuauu

SEQ ID NO: 148892 - RNA, 22 nt, Human
uccccacaucucugcaucaggc

SEQ ID NO: 148893 - RNA, 22 nt, Human
ucccacacagcccgcucaccgg

SEQ ID NO: 148894 - RNA, 22 nt, Human
ccucucccgggugccgcugggc

SEQ ID NO: 148895 - RNA, 22 nt, Human
ggaggacacuggcucugccuuc

SEQ ID NO: 148896 - RNA, 22 nt, Human
gcacacagcuagauuaccauuc

SEQ ID NO: 148897 - RNA, 22 nt, Human
uccaggcuugagaccaggcucu

SEQ ID NO: 148898 - RNA, 22 nt, Human
uuggaaaguuuuuacugaagac

SEQ ID NO: 148899 - RNA, 22 nt, Human
agcacaggaacauggagauggg

SEQ ID NO: 148900 - RNA, 22 nt, Human
uccuucccaggugucgccgccu

SEQ ID NO: 148901 - RNA, 22 nt, Human
cuggcaguauuaagagaaguga

SEQ ID NO: 148902 - RNA, 22 nt, Human
ucccuccuggccgucaccgcug

SEQ ID NO: 148903 - RNA, 22 nt, Human
guccucugucccuggggcacgg

SEQ ID NO: 148904 - RNA, 22 nt, Human
guccuggcugguucuguggggc

SEQ ID NO: 148905 - RNA, 22 nt, Human
uggccucugugggagcugagca

SEQ ID NO: 148906 - RNA, 22 nt, Human
aggcacaggaggugguaagaag

SEQ ID NO: 148907 - RNA, 22 nt, Human
uacacauccauguuuugacuuu

SEQ ID NO: 148908 - RNA, 22 nt, Human
gcacacaggcaguuuccagcca

SEQ ID NO: 148909 - RNA, 22 nt, Human
acauacacaugaauauauuuuu

SEQ ID NO: 148910 - RNA, 22 nt, Human
aaaagagugacugauaaguaua

SEQ ID NO: 148911 - RNA, 22 nt, Human
acuggcaguggcagcagaaaga

SEQ ID NO: 148912 - RNA, 22 nt, Human
ugccugacugcugccaccacua

SEQ ID NO: 148913 - RNA, 18 nt, Human
aggaaagaaaggcaggug

SEQ ID NO: 148914 - RNA, 22 nt, Human
acacaucaugccaaguuucacc

SEQ ID NO: 148915 - RNA, 22 nt, Human
aggaggcuguggagcacuccau

SEQ ID NO: 148916 - RNA, 22 nt, Human
ucuggcagagucagugcacaca

SEQ ID NO: 148917 - RNA, 22 nt, Human
ccuggcagguggcgcccucggc

SEQ ID NO: 148918 - RNA, 22 nt, Human
cucaccccacuaccccuuggug

SEQ ID NO: 148919 - RNA, 22 nt, Human
acuggcaguuugagaaugcauu

SEQ ID NO: 148920 - RNA, 22 nt, Human
acacauacauggggaagaugag

SEQ ID NO: 148921 - RNA, 22 nt, Human
gauggccuggguccccuuccgg

SEQ ID NO: 148922 - RNA, 22 nt, Human
uucauugcaguucuucagguua

SEQ ID NO: 148923 - RNA, 22 nt, Human
gaggacucugggcguguauggg

SEQ ID NO: 148924 - RNA, 22 nt, Human
ccuggcagacagcacugaagcu

SEQ ID NO: 148925 - RNA, 17 nt, Human
ccauacugacauauuga

SEQ ID NO: 148926 - RNA, 22 nt, Human
acauacacaagcguacaugaac

SEQ ID NO: 148927 - RNA, 22 nt, Human
uucaguuccauuucaggugggu

SEQ ID NO: 148928 - RNA, 22 nt, Human
gacacauaugcguauaguuuag

SEQ ID NO: 148929 - RNA, 21 nt, Human
gggagggauggaaaugauguu

SEQ ID NO: 148930 - RNA, 22 nt, Human
uccucuccaugucucacgccac

SEQ ID NO: 148931 - RNA, 22 nt, Human
ccuggcaguggugaagaagagg

SEQ ID NO: 148932 - RNA, 22 nt, Human
uggccucugggaaagcagauuc

SEQ ID NO: 148933 - RNA, 22 nt, Human
ggagaagaggagcuggaagccu

SEQ ID NO: 148934 - RNA, 22 nt, Human
cacacauuucagaugcuacaau

SEQ ID NO: 148935 - RNA, 22 nt, Human
ucaggcccuucucccaggacuc

SEQ ID NO: 148936 - RNA, 22 nt, Human
ucuggcaguuccuuguugauau

SEQ ID NO: 148937 - RNA, 21 nt, Human
ugacugaggcuucuucacaca

SEQ ID NO: 148938 - RNA, 22 nt, Human
gaagagaaaggcaaggaguuuu

SEQ ID NO: 148939 - RNA, 17 nt, Human
gcaucacagauaacacg

SEQ ID NO: 148940 - RNA, 22 nt, Human
guggcagucgcugacagauaca

SEQ ID NO: 148941 - RNA, 22 nt, Human
uuccaggcuucucuggggcguc

SEQ ID NO: 148942 - RNA, 22 nt, Human
gcuggcagcuggaaguugggcu

SEQ ID NO: 148943 - RNA, 22 nt, Human
uaagaacaguagaacaguaggu

SEQ ID NO: 148944 - RNA, 17 nt, Human
gccuucucugcccucac

SEQ ID NO: 148945 - RNA, 22 nt, Human
gauggccuuguuuucucccuuc

SEQ ID NO: 148946 - RNA, 20 nt, Human
gcuccaggucagagaggacg

SEQ ID NO: 148947 - RNA, 22 nt, Human
uacacagauuucaguaucauca

SEQ ID NO: 148948 - RNA, 22 nt, Human
cauacauuuauacacaucuaug

SEQ ID NO: 148949 - RNA, 22 nt, Human
gacacagagcucacagucuccu

SEQ ID NO: 148950 - RNA, 22 nt, Human
gcuggcagagacaagaagacua

SEQ ID NO: 148951 - RNA, 22 nt, Human
ggagcugaguucuucagccggg

SEQ ID NO: 148952 - RNA, 19 nt, Human
agaggccucagcagcuggc

SEQ ID NO: 148953 - RNA, 22 nt, Human
acacucacccucccacugccug

SEQ ID NO: 148954 - RNA, 20 nt, Human
cccagccccuaccuguugcc

SEQ ID NO: 148955 - RNA, 22 nt, Human
gacacuucaccuuucccagccu

SEQ ID NO: 148956 - RNA, 22 nt, Human
uuccugccccugagagcuccca

SEQ ID NO: 148957 - RNA, 22 nt, Human
gccuggcacucaaucaucugcu

SEQ ID NO: 148958 - RNA, 20 nt, Human
agggcugagaagggacuagc

SEQ ID NO: 148959 - RNA, 22 nt, Human
acuggcagagacccugauggcc

SEQ ID NO: 148960 - RNA, 22 nt, Human
uacacaacugacaaccauucug

SEQ ID NO: 148961 - RNA, 22 nt, Human
ucuggcagcucuccucggcgga

SEQ ID NO: 148962 - RNA, 22 nt, Human
gaggcuguuaggagggacucug

SEQ ID NO: 148963 - RNA, 22 nt, Human
ccuggcagcuaagugcuuugag

SEQ ID NO: 148964 - RNA, 22 nt, Human
acacauuugcauaauaccucau

SEQ ID NO: 148965 - RNA, 22 nt, Human
gaggcacauauauacagagccc

SEQ ID NO: 148966 - RNA, 22 nt, Human
guccucuggugaaagcauuccc

SEQ ID NO: 148967 - RNA, 22 nt, Human
uuccaggcuauccggugaaggg

SEQ ID NO: 148968 - RNA, 22 nt, Human
agggagacacaugaggaaguca

SEQ ID NO: 148969 - RNA, 22 nt, Human
ucccagccuuccagucugguuu

SEQ ID NO: 148970 - RNA, 22 nt, Human
cuuggcaggguggaggaugcag

SEQ ID NO: 148971 - RNA, 22 nt, Human
ggagacucggguucuagccuug

SEQ ID NO: 148972 - RNA, 22 nt, Human
guccucugggagccuugagccu

SEQ ID NO: 148973 - RNA, 22 nt, Human
gacacagagggcaccagauaug

SEQ ID NO: 148974 - RNA, 22 nt, Human
uggcacucacucucagagucug

SEQ ID NO: 148975 - RNA, 23 nt, Human
guccucuggagagaaaggcagua

SEQ ID NO: 148976 - RNA, 22 nt, Human
caggagggcccgagacucuucc

SEQ ID NO: 148977 - RNA, 22 nt, Human
gccuggcaauggccucaggaag

SEQ ID NO: 148978 - RNA, 22 nt, Human
gcacaggaugauggguugaggg

SEQ ID NO: 148979 - RNA, 22 nt, Human
ucacacaugaguaaauacaggg

SEQ ID NO: 148980 - RNA, 22 nt, Human
aggacacacagaauacaaaucc

SEQ ID NO: 148981 - RNA, 22 nt, Human
agucuagggugggguccacagg

SEQ ID NO: 148982 - RNA, 22 nt, Human
cagacagagucuucccaucagu

SEQ ID NO: 148983 - RNA, 22 nt, Human
aaauuacagaucaccaaugcau

SEQ ID NO: 148984 - RNA, 22 nt, Human
uggcagagagagugcagucgac

SEQ ID NO: 148985 - RNA, 22 nt, Human
ugggacucacucuuuuggccag

SEQ ID NO: 148986 - RNA, 22 nt, Human
ucuggcagcaagucuguuucuc

SEQ ID NO: 148987 - RNA, 22 nt, Human
ucccaccccuugacucuuuaag

SEQ ID NO: 148988 - RNA, 22 nt, Human
agggcugacaaauggcagugac

SEQ ID NO: 148989 - RNA, 22 nt, Human
ggcaagagggcagauggagugc

SEQ ID NO: 148990 - RNA, 22 nt, Human
gcaguguuuguguucucacaug

SEQ ID NO: 148991 - RNA, 22 nt, Human
gccucaggccgcccugcugcuc

SEQ ID NO: 148992 - RNA, 22 nt, Human
gaaagacuuccuuugagaguac

SEQ ID NO: 148993 - RNA, 22 nt, Human
agcccaggucuggcccagccug

SEQ ID NO: 148994 - RNA, 22 nt, Human
agggcugacagugaggagucaa

SEQ ID NO: 148995 - RNA, 22 nt, Human
acacacuguaaggacuaucacu

SEQ ID NO: 148996 - RNA, 22 nt, Human
gaggagcuguucccucaccucu

SEQ ID NO: 148997 - RNA, 22 nt, Human
ucuggcagugauuucugugauc

SEQ ID NO: 148998 - RNA, 22 nt, Human
gggccccuuguaucucuggcuc

SEQ ID NO: 148999 - RNA, 22 nt, Human
uccugcagccacugcaggcaga

SEQ ID NO: 149000 - RNA, 22 nt, Human
caucacagaaauaaacauaccu

SEQ ID NO: 149001 - RNA, 22 nt, Human
guccacagagggcugggcaggc

SEQ ID NO: 149002 - RNA, 18 nt, Human
gccugcucugcucucccc

SEQ ID NO: 149003 - RNA, 22 nt, Human
cuggcaugaaauggcaucucau

SEQ ID NO: 149004 - RNA, 22 nt, Human
cuccuggcucgcccccagcuga

SEQ ID NO: 149005 - RNA, 22 nt, Human
gccccacagccugcggucucag

SEQ ID NO: 149006 - RNA, 22 nt, Human
ccuucuucuguguggcccaaga

SEQ ID NO: 149007 - RNA, 19 nt, Human
guccuggcgccgccacacc

SEQ ID NO: 149008 - RNA, 18 nt, Human
uccuggcagucagagagg

SEQ ID NO: 149009 - RNA, 22 nt, Human
ccaucacaguccccaucgugau

SEQ ID NO: 149010 - RNA, 22 nt, Human
ucuggcagggguucugcacuug

SEQ ID NO: 149011 - RNA, 22 nt, Human
aagagcacuaacagagcugaua

SEQ ID NO: 149012 - RNA, 21 nt, Human
acauacauaccuuaccaccuu

SEQ ID NO: 149013 - RNA, 22 nt, Human
acaucccacagaaacauacaua

SEQ ID NO: 149014 - RNA, 22 nt, Human
uucccacauucuuuacauucau

SEQ ID NO: 149015 - RNA, 16 nt, Human
ucacauacuuccuugc

SEQ ID NO: 149016 - RNA, 22 nt, Human
aggaagaacagauaauggacgc

SEQ ID NO: 149017 - RNA, 22 nt, Human
guacacacuauguauuguacac

SEQ ID NO: 149018 - RNA, 22 nt, Human
acuggcagcagcagcccuuggg

SEQ ID NO: 149019 - RNA, 22 nt, Human
ccuggcugguggcagcgacaag

SEQ ID NO: 149020 - RNA, 21 nt, Human
guacacacagguggaugggcu

SEQ ID NO: 149021 - RNA, 22 nt, Dengue virus
gcuuccuccauuucagcugcca

SEQ ID NO: 149022 - RNA, 22 nt, Human
uuucauaauacuguacaugaaa

SEQ ID NO: 149023 - RNA, 22 nt, Human
guuucacagucugcagaauuuu

SEQ ID NO: 149024 - RNA, 22 nt, Human
ugcaggcucacccuggagcuga

SEQ ID NO: 149025 - RNA, 22 nt, Human
guguaugagccuccagcugggc

SEQ ID NO: 149026 - RNA, 22 nt, Human
gauaauauuagaagauacaaau

SEQ ID NO: 149027 - RNA, 22 nt, Human
acacaucagaaauaugaaugag

SEQ ID NO: 149028 - RNA, 20 nt, Human
uuccacaucuuugcacaugc

SEQ ID NO: 149029 - RNA, 22 nt, Human
ugcaggcuuuagccccauggcu

SEQ ID NO: 149030 - RNA, 22 nt, Human
uuugcaauuugugcugcaaaug

SEQ ID NO: 149031 - RNA, 22 nt, Human
cugcaggacgaccgccucaucu

SEQ ID NO: 149032 - RNA, 22 nt, Human
cuggggacuugcagacacaauu

SEQ ID NO: 149033 - RNA, 22 nt, Human
cugccugcuuaccaugcaucag

SEQ ID NO: 149034 - RNA, 17 nt, Human
aggcauggucuggggug

SEQ ID NO: 149035 - RNA, 22 nt, Human
gccuccuguuaugccaugugcc

SEQ ID NO: 149036 - RNA, 22 nt, Human
cuucugggcagaaguuuugaga

SEQ ID NO: 149037 - RNA, 22 nt, Human
cuucugggcauucagcugcaca

SEQ ID NO: 149038 - RNA, 22 nt, Human
ugggcucagucugcuugguccu

SEQ ID NO: 149039 - RNA, 20 nt, Human
ccccacacuauugagcacuu

SEQ ID NO: 149040 - RNA, 22 nt, Human
ugcaggcuccaugaggacaggc

SEQ ID NO: 149041 - RNA, 22 nt, Human
cccacacauuuuucacuuaccg

SEQ ID NO: 149042 - RNA, 22 nt, Human
gcacacaugcaugcacaggagu

SEQ ID NO: 149043 - RNA, 22 nt, Human
ugugaagauuuggcaugcagaa

SEQ ID NO: 149044 - RNA, 22 nt, Human
ugcagagaaaacuccuggguac

SEQ ID NO: 149045 - RNA, 22 nt, Human
gccacauagaggaggauauuaa

SEQ ID NO: 149046 - RNA, 22 nt, Human
aguaugaagaugaugaaaaaua

SEQ ID NO: 149047 - RNA, 22 nt, Human
cuguaugaggaucagacuggac

SEQ ID NO: 149048 - RNA, 22 nt, Human
uguaaacauaccagagccaagu

SEQ ID NO: 149049 - RNA, 22 nt, Human
aagcuuccugaaugcucauuua

SEQ ID NO: 149050 - RNA, 22 nt, Human
cagccucuugcacuuugaaggc

SEQ ID NO: 149051 - RNA, 16 nt, Human
uguaugaacgucucca

SEQ ID NO: 149052 - RNA, 22 nt, Human
ucaggcucugagcugaugcuaa

SEQ ID NO: 149053 - RNA, 22 nt, Human
uggggaccagauuagaccaugg

SEQ ID NO: 149054 - RNA, 22 nt, Human
ucuguucauguugggcuuuucc

SEQ ID NO: 149055 - RNA, 22 nt, Human
ggcaggcuccagagcccucucc

SEQ ID NO: 149056 - RNA, 22 nt, Human
aaauuucaguuaccuuuacguu

SEQ ID NO: 149057 - RNA, 22 nt, Human
gccaagcuguuuuucagagacg

SEQ ID NO: 149058 - RNA, 22 nt, Human
uuucacauggaagcucucgaga

SEQ ID NO: 149059 - RNA, 22 nt, Human
cuguggcucauucuugguggca

SEQ ID NO: 149060 - RNA, 22 nt, Human
ucugggcugcuaugaggcagag

SEQ ID NO: 149061 - RNA, 22 nt, Human
uacauuccuucguuuagagauu

SEQ ID NO: 149062 - RNA, 22 nt, Human
aaucuucacagagaaaauuagg

SEQ ID NO: 149063 - RNA, 22 nt, Human
uccaggccauugacugcauccu

SEQ ID NO: 149064 - RNA, 22 nt, Human
cagcccucaucucagcuucuuu

SEQ ID NO: 149065 - RNA, 22 nt, Human
guggagcaggacuagcugagaa

SEQ ID NO: 149066 - RNA, 22 nt, Human
auuuaaauuuucugauggagag

SEQ ID NO: 149067 - RNA, 22 nt, Human
cuggggacucauucagagcaua

SEQ ID NO: 149068 - RNA, 22 nt, Human
ugcaggcuggcagauaucucau

SEQ ID NO: 149069 - RNA, 22 nt, Human
cacccacauggaaauucacagu

SEQ ID NO: 149070 - RNA, 22 nt, Human
uuccaaguugagcgauuuuccu

SEQ ID NO: 149071 - RNA, 20 nt, Human
aacuuguucuaccuguuuca

SEQ ID NO: 149072 - RNA, 22 nt, Human
ggcccaaacggguccagugaaa

SEQ ID NO: 149073 - RNA, 22 nt, Human
cugcagccuccuccagcuacgu

SEQ ID NO: 149074 - RNA, 22 nt, Human
auucacaugugcuucuuaucac

SEQ ID NO: 149075 - RNA, 22 nt, Human
aacuuucaggcaaugaauauuu

SEQ ID NO: 149076 - RNA, 22 nt, Human
auguaauaggguaacauaacau

SEQ ID NO: 149077 - RNA, 19 nt, Human
cuccaagugccaaggacag

SEQ ID NO: 149078 - RNA, 22 nt, Human
uuuaccaguguuaaacaccagc

SEQ ID NO: 149079 - RNA, 21 nt, Human
ucuguucaaggaacuacggau

SEQ ID NO: 149080 - RNA, 22 nt, Human
gaugaagccccaguguaaguaa

SEQ ID NO: 149081 - RNA, 20 nt, Human
ccugggcuccaggagccccg

SEQ ID NO: 149082 - RNA, 22 nt, Human
agcaggcugaugggcaugcuug

SEQ ID NO: 149083 - RNA, 22 nt, Human
gugggcuuugcuggauccuucc

SEQ ID NO: 149084 - RNA, 21 nt, Human
uggaccuguccuucucgcugu

SEQ ID NO: 149085 - RNA, 17 nt, Human
uccaggcagcaacugag

SEQ ID NO: 149086 - RNA, 22 nt, Human
gagggugucugcguaacuggca

SEQ ID NO: 149087 - RNA, 22 nt, Human
gaaauauuguacuggagauguu

SEQ ID NO: 149088 - RNA, 22 nt, Human
ccacuguaguuaugaugaaguu

SEQ ID NO: 149089 - RNA, 22 nt, Human
uuccaaguccagccaggccaaa

SEQ ID NO: 149090 - RNA, 22 nt, Human
uuugaaucugauauggcagcau

SEQ ID NO: 149091 - RNA, 22 nt, Human
uacacacagaggccaugggauu

SEQ ID NO: 149092 - RNA, 22 nt, Human
agacaugucaccaauucuuacu

SEQ ID NO: 149093 - RNA, 22 nt, Human
gccaaaguaccuagcccucugc

SEQ ID NO: 149094 - RNA, 22 nt, Human
gccuggcacucaaucaucugcu

SEQ ID NO: 149095 - RNA, 22 nt, Human
gcaguguuuguguucucacaug

SEQ ID NO: 149096 - RNA, 22 nt, Human
ucucuuucuauugcaccaugcu

SEQ ID NO: 149097 - RNA, 22 nt, Human
uggcagagaacacacaugauuc

SEQ ID NO: 149098 - RNA, 22 nt, Human
gguggccaggccagcucuggcc

SEQ ID NO: 149099 - RNA, 22 nt, Human
auuuggaaacaauuauauucuu

SEQ ID NO: 149100 - RNA, 22 nt, Human
ccugggcuuucaaaaccagccu

SEQ ID NO: 149101 - RNA, 22 nt, Human
gguaugaauucacuacuuccaa

SEQ ID NO: 149102 - RNA, 22 nt, Human
uccaggcuuuuucaugcugucu

SEQ ID NO: 149103 - RNA, 22 nt, Human
uuggagguuugaaaauaugugu

SEQ ID NO: 149104 - RNA, 22 nt, Human
ugcacagcuggcucuccuuuuc

SEQ ID NO: 149105 - RNA, 22 nt, Human
uggccucugugggagcugagca

SEQ ID NO: 149106 - RNA, 22 nt, Human
uaggaagcugagcagcauuccu

SEQ ID NO: 149107 - RNA, 22 nt, Human
gcuucugggcaccugaacagga

SEQ ID NO: 149108 - RNA, 22 nt, Human
uguaaagguaggugcaaaauga

SEQ ID NO: 149109 - RNA, 22 nt, Human
cccugccucugaagcugcucag

SEQ ID NO: 149110 - RNA, 22 nt, Human
uucauagugauuguucagauag

SEQ ID NO: 149111 - RNA, 22 nt, Human
auuccacacaguaauacucaau

SEQ ID NO: 149112 - RNA, 22 nt, Human
aguaugaaucuuucagaccgua

SEQ ID NO: 149113 - RNA, 22 nt, Human
ggcaggcugcuugggucauguc

SEQ ID NO: 149114 - RNA, 22 nt, Human
gaaauuuauuaucuacaucauu

SEQ ID NO: 149115 - RNA, 22 nt, Human
ucacauacacuaggauauuuuu

SEQ ID NO: 149116 - RNA, 22 nt, Human
cucagccccaauucuccccauu

SEQ ID NO: 149117 - RNA, 23 nt, Human
uuccaagugcuuuacuuaauccu

SEQ ID NO: 149118 - RNA, 22 nt, Human
acacaucuuagacugaaauaug

SEQ ID NO: 149119 - RNA, 22 nt, Human
gcuguucacagacucugcucug

SEQ ID NO: 149120 - RNA, 20 nt, Human
ucacuguaauugccuacauu

SEQ ID NO: 149121 - RNA, 22 nt, Human
ggcaggcuuucagcaucaaguc

SEQ ID NO: 149122 - RNA, 22 nt, Human
cauuuugugcuagacacuaugg

SEQ ID NO: 149123 - RNA, 22 nt, Human
aggcuuuguaccuggggucuua

SEQ ID NO: 149124 - RNA, 22 nt, Human
ccuguucaagggaugauugacc

SEQ ID NO: 149125 - RNA, 22 nt, Human
cauauuuauagaucuggcauuu

SEQ ID NO: 149126 - RNA, 19 nt, Human
uccuggcauuuguaggaaa

SEQ ID NO: 149127 - RNA, 23 nt, Human
ucugggcugagacuuggaagguc

SEQ ID NO: 149128 - RNA, 22 nt, Human
aggaggcugggcacaguggccu

SEQ ID NO: 149129 - RNA, 22 nt, Human
cucccaagcugugcugaacugu

SEQ ID NO: 149130 - RNA, 22 nt, Human
cccagccucuguuugcuccucu

SEQ ID NO: 149131 - RNA, 22 nt, Human
cguguggucccggcaaggcaag

SEQ ID NO: 149132 - RNA, 22 nt, Human
ggcuuugggcccucaagucucc

SEQ ID NO: 149133 - RNA, 22 nt, Human
gggcugacaccacccaggcgca

SEQ ID NO: 149134 - RNA, 22 nt, Human
gaccugccugagcugccucugc

SEQ ID NO: 149135 - RNA, 22 nt, Human
ugaagccaaucugccaggcaga

SEQ ID NO: 149136 - RNA, 22 nt, Human
uccaggcucuaggcugcucucc

SEQ ID NO: 149137 - RNA, 22 nt, Human
aggcuggauuuauggggacuuc

SEQ ID NO: 149138 - RNA, 22 nt, Human
agcaggcuccaggcuggccauc

SEQ ID NO: 149139 - RNA, 22 nt, Human
ccaggcugggcggggaaccugg

SEQ ID NO: 149140 - RNA, 22 nt, Human
aguguggcaggaaugacuagaa

SEQ ID NO: 149141 - RNA, 22 nt, Human
uuccaggauggcaauaaugaau

SEQ ID NO: 149142 - RNA, 22 nt, Human
cuggggaccgagcaagcucugg

SEQ ID NO: 149143 - RNA, 19 nt, Human
gucuucugaauguggcugc

SEQ ID NO: 149144 - RNA, 22 nt, Human
auagggccuaaaaaguauugcu

SEQ ID NO: 149145 - RNA, 18 nt, Human
acacacacaccuguguau

SEQ ID NO: 149146 - RNA, 22 nt, Human
acacucuguaaugucacacucc

SEQ ID NO: 149147 - RNA, 22 nt, Human
gccugcaguucugugcuaggca

SEQ ID NO: 149148 - RNA, 22 nt, Human
ugggcugaguggcagccagagu

SEQ ID NO: 149149 - RNA, 23 nt, Human
aguaugaauucauuguuuuaguu

SEQ ID NO: 149150 - RNA, 20 nt, Human
ucuggcaggugaacgagcug

SEQ ID NO: 149151 - RNA, 22 nt, Human
uuccagcccgcgacuuguucag

SEQ ID NO: 149152 - RNA, 22 nt, Human
accuggagaaagccucucccug

SEQ ID NO: 149153 - RNA, 22 nt, Human
ucuuugaaaagggagauagaaa

SEQ ID NO: 149154 - RNA, 22 nt, Human
cagggggugcaggcccugugac

SEQ ID NO: 149155 - RNA, 22 nt, Human
ugggcuucauaauugguccuag

SEQ ID NO: 149156 - RNA, 22 nt, Human
gcugggcucugucaugccuucc

SEQ ID NO: 149157 - RNA, 20 nt, Human
gagucacagaagaagcugaa

SEQ ID NO: 149158 - RNA, 22 nt, Human
agacacagcugcaggagguggg

SEQ ID NO: 149159 - RNA, 22 nt, Human
cccagccuuccacccuggacua

SEQ ID NO: 149160 - RNA, 22 nt, Human
gcuggcagucccaucagcuggg

SEQ ID NO: 149161 - RNA, 22 nt, Human
uucaugaaaguguaucuugugg

SEQ ID NO: 149162 - RNA, 22 nt, Human
cagguuggucggcaaguacaca

SEQ ID NO: 149163 - RNA, 22 nt, Human
uggcagugggaauggacaaaca

SEQ ID NO: 149164 - RNA, 22 nt, Human
gcuggcagguccaagauagagc

SEQ ID NO: 149165 - RNA, 22 nt, Human
guauucauauuaaacauaucaa

SEQ ID NO: 149166 - RNA, 22 nt, Human
uggcaguggauaggggagcggu

SEQ ID NO: 149167 - RNA, 22 nt, Human
uccaagcuugcuuuagccacag

SEQ ID NO: 149168 - RNA, 22 nt, Human
aauggcagaggcaaagauggua

SEQ ID NO: 149169 - RNA, 22 nt, Human
uccccaccuaagauacccaucu

SEQ ID NO: 149170 - RNA, 22 nt, Human
ucccacccauccugcaucucuu

SEQ ID NO: 149171 - RNA, 22 nt, Human
agggcccaggacagcaucaggg

SEQ ID NO: 149172 - RNA, 22 nt, Human
uuucuguaaggacuuaaugcaa

SEQ ID NO: 149173 - RNA, 22 nt, Human
acaggugguagaguggaaagag

SEQ ID NO: 149174 - RNA, 22 nt, Human
uugggaagaaacauguccauca

SEQ ID NO: 149175 - RNA, 22 nt, Human
aguauucuggaauucuauguga

SEQ ID NO: 149176 - RNA, 20 nt, Human
auacacaugcagacagaugc

SEQ ID NO: 149177 - RNA, 22 nt, Human
uuccuggccccaccccuggaga

SEQ ID NO: 149178 - RNA, 23 nt, Human
cugcagagaacugagggacagcc

SEQ ID NO: 149179 - RNA, 22 nt, Human
ugggcugagaguaccuuauaaa

SEQ ID NO: 149180 - RNA, 22 nt, Human
aggcaguguguagcuggaagag

SEQ ID NO: 149181 - RNA, 22 nt, Human
ugcuucugaacucagcaugugg

SEQ ID NO: 149182 - RNA, 22 nt, Human
uccaagcuguauguuccuagag

SEQ ID NO: 149183 - RNA, 22 nt, Human
guucugggaagguggaccuguu

SEQ ID NO: 149184 - RNA, 22 nt, Human
uuuauuuaaagucguguguuaa

SEQ ID NO: 149185 - RNA, 22 nt, Human
cugggcuggauaauucuuugcu

SEQ ID NO: 149186 - RNA, 22 nt, Human
uccaaauucuagggccuugguu

SEQ ID NO: 149187 - RNA, 22 nt, Human
uccaagcucucuaugccaugau

SEQ ID NO: 149188 - RNA, 22 nt, Human
cuggcaguuggcauuggcaucu

SEQ ID NO: 149189 - RNA, 22 nt, Human
uguaggcugaagaugaagugga

SEQ ID NO: 149190 - RNA, 22 nt, Human
uauuccaagcacagcaacccag

SEQ ID NO: 149191 - RNA, 22 nt, Human
cccagcccacgguccugggugg

SEQ ID NO: 149192 - RNA, 21 nt, Human
uccccacauuucuaaacagac

SEQ ID NO: 149193 - RNA, 22 nt, Human
cagccaggauggagaacuguug

SEQ ID NO: 149194 - RNA, 22 nt, Human
gcuggcagcauuagacccuggg

SEQ ID NO: 149195 - RNA, 22 nt, Human
cccagccugugacagccguccu

SEQ ID NO: 149196 - RNA, 22 nt, Human
ccuggcugguggcagcgacaag

SEQ ID NO: 149197 - RNA, 18 nt, Human
ggccucagccuggccgga

SEQ ID NO: 149198 - RNA, 22 nt, Human
ucaggcucaaagggccggauga

SEQ ID NO: 149199 - RNA, 22 nt, Human
ugggcugaguguggaacuaguu

SEQ ID NO: 149200 - RNA, 22 nt, Human
auuccacagcuacaucaaucua

SEQ ID NO: 149201 - RNA, 22 nt, Human
cugggcuguucugccccugggu

SEQ ID NO: 149202 - RNA, 22 nt, Human
aacacagaucaaaauauuuccu

SEQ ID NO: 149203 - RNA, 17 nt, Human
ugaaacaccaagacugu

SEQ ID NO: 149204 - RNA, 22 nt, Human
cagaugaggggcauauaacaau

SEQ ID NO: 149205 - RNA, 22 nt, Human
cucucugggcccaguuggcacc

SEQ ID NO: 149206 - RNA, 22 nt, Human
ccuggcagcuccuccccggcgg

SEQ ID NO: 149207 - RNA, 22 nt, Human
cuugggcucugugggccuuagu

SEQ ID NO: 149208 - RNA, 22 nt, Human
ucccugcccucagugcacccgg

SEQ ID NO: 149209 - RNA, 22 nt, Human
uucaugaauggaaucaaugcuc

SEQ ID NO: 149210 - RNA, 22 nt, Human
gagccugaugaaacaggcagac

SEQ ID NO: 149211 - RNA, 22 nt, Human
ggcaggcuguucaccugcuuuu

SEQ ID NO: 149212 - RNA, 22 nt, Human
ggcugcagggcagcuggugugg

SEQ ID NO: 149213 - RNA, 22 nt, Human
ucacacacauaaucuaagauua

SEQ ID NO: 149214 - RNA, 22 nt, Human
uuccuggcauagagagggcaca

SEQ ID NO: 149215 - RNA, 22 nt, Human
auccaggcgaaugcagaaggcc

SEQ ID NO: 149216 - RNA, 22 nt, Human
ucuuuuucugcacacguguccc

SEQ ID NO: 149217 - RNA, 22 nt, Human
cuccugaggacuucuauugggu

SEQ ID NO: 149218 - RNA, 22 nt, Human
agagggugcuggagagacauug

SEQ ID NO: 149219 - RNA, 22 nt, Human
uggcagggccuaccccaauauc

SEQ ID NO: 149220 - RNA, 22 nt, Human
uggaaagagguagaggaucugg

SEQ ID NO: 149221 - RNA, 22 nt, Human
auaugaagaaucuaggauaggc

SEQ ID NO: 149222 - RNA, 22 nt, Human
ugcaggcucaccugccagggcc

SEQ ID NO: 149223 - RNA, 22 nt, Human
aaggccacacuugcuggccagc

SEQ ID NO: 149224 - RNA, 22 nt, Human
gcuggcaggauaacuucuaagc

SEQ ID NO: 149225 - RNA, 22 nt, Human
uggcgucucucauaaguaugug

SEQ ID NO: 149226 - RNA, 22 nt, Human
ccuguucaaguugcagggcugg

SEQ ID NO: 149227 - RNA, 22 nt, Human
gcuggcagggugguugagagag

SEQ ID NO: 149228 - RNA, 19 nt, Human
ugcuucuggaaugcaaggc

SEQ ID NO: 149229 - RNA, 22 nt, Human
ucuccaggccuuucccaucuua

SEQ ID NO: 149230 - RNA, 22 nt, Human
gggcugacaaucucuuuacuua

SEQ ID NO: 149231 - RNA, 22 nt, Human
acagcucuguugccagaucugc

SEQ ID NO: 149232 - RNA, 23 nt, Human
uugggcuggcucucgaugccucu

SEQ ID NO: 149233 - RNA, 22 nt, Human
ucugcagauuuaucagcagcug

SEQ ID NO: 149234 - RNA, 22 nt, Human
cccacacaaaucauggggagaa

SEQ ID NO: 149235 - RNA, 22 nt, Human
guccucugggagccuugagccu

SEQ ID NO: 149236 - RNA, 22 nt, Human
uucauuccuucuguaccuugcc

SEQ ID NO: 149237 - RNA, 22 nt, Human
augggcuggcagccugaacagc

SEQ ID NO: 149238 - RNA, 20 nt, Human
accccacagaguccauugca

SEQ ID NO: 149239 - RNA, 22 nt, Human
uuccacauuccuuacauucaua

SEQ ID NO: 149240 - RNA, 22 nt, Human
ggcaggcuagcacugauguccu

SEQ ID NO: 149241 - RNA, 22 nt, Human
uacaaaaguaauuacgguuuuu

SEQ ID NO: 149242 - RNA, 22 nt, Human
ucuggggaugagguccagugau

SEQ ID NO: 149243 - RNA, 22 nt, Human
ugcagagagaccccugggccag

SEQ ID NO: 149244 - RNA, 22 nt, Human
cugggcugucaguuuuguuuua

SEQ ID NO: 149245 - RNA, 22 nt, Human
uggacuggaaugcugauccucu

SEQ ID NO: 149246 - RNA, 22 nt, Human
gcaggcuccaggccggccccuu

SEQ ID NO: 149247 - RNA, 22 nt, Human
acagaccaaguuuccagcaggu

SEQ ID NO: 149248 - RNA, 22 nt, Human
aggccuccagccacaugccagu

SEQ ID NO: 149249 - RNA, 22 nt, Human
acaggcucgugcgcgcacgugu

SEQ ID NO: 149250 - RNA, 22 nt, Human
cagguugguauucaucuccaca

SEQ ID NO: 149251 - RNA, 22 nt, Human
acuguucauuuguccuguaucu

SEQ ID NO: 149252 - RNA, 22 nt, Human
ucacauacugaaaguccaguga

SEQ ID NO: 149253 - RNA, 22 nt, Human
ggcaagagggcagauggagugc

SEQ ID NO: 149254 - RNA, 22 nt, Human
gaaauauuacaguggaggggau

SEQ ID NO: 149255 - RNA, 22 nt, Human
ucuguucagcugccucagggua

SEQ ID NO: 149256 - RNA, 22 nt, Human
gggaccugaggcccugcuccac

SEQ ID NO: 149257 - RNA, 22 nt, Human
ugguuccuucugcauuuucagc

SEQ ID NO: 149258 - RNA, 19 nt, Human
cccucuugcacaaagcaaa

SEQ ID NO: 149259 - RNA, 22 nt, Human
acuggcagaggauagcacuaau

SEQ ID NO: 149260 - RNA, 22 nt, Human
guccuggcccacuggcaggcug

SEQ ID NO: 149261 - RNA, 22 nt, Human
ugcuucugcugauauuuuguga

SEQ ID NO: 149262 - RNA, 22 nt, Human
cccaguuucaacuuuccagugg

SEQ ID NO: 149263 - RNA, 22 nt, Human
aaaagagugacugauaaguaua

SEQ ID NO: 149264 - RNA, 22 nt, Human
cguaugaaauuuuugacauuug

SEQ ID NO: 149265 - RNA, 22 nt, Human
ccuggcagcgugccgagcugcg

SEQ ID NO: 149266 - RNA, 22 nt, Human
cauaauauacuacauugaugaa

SEQ ID NO: 149267 - RNA, 17 nt, Human
ugcuggcaacauacaaa

SEQ ID NO: 149268 - RNA, 19 nt, Human
acuggcaguuucugcaugg

SEQ ID NO: 149269 - RNA, 22 nt, Human
guccucugcccaggucaagguu

SEQ ID NO: 149270 - RNA, 22 nt, Human
ccaggcucugacauagauggga

SEQ ID NO: 149271 - RNA, 22 nt, Human
cuccaggguuccccgauccacu

SEQ ID NO: 149272 - RNA, 22 nt, Human
uggggacccggacuccuggguc

SEQ ID NO: 149273 - RNA, 22 nt, Human
auuguugggucucacuccuaga

SEQ ID NO: 149274 - RNA, 22 nt, Human
ucaggcucugccaccuagauua

SEQ ID NO: 149275 - RNA, 22 nt, Human
ugcuucugacugggucaguuga

SEQ ID NO: 149276 - RNA, 20 nt, Human
acaaagacuggaaaagcaag

SEQ ID NO: 149277 - RNA, 22 nt, Human
ccagcccuugcugaaggguggc

SEQ ID NO: 149278 - RNA, 22 nt, Human
cuucaaaugugauuuuaauaac

SEQ ID NO: 149279 - RNA, 22 nt, Human
cuuggcaguuucggaaggauga

SEQ ID NO: 149280 - RNA, 22 nt, Human
gcugcgccggaucccacguucc

SEQ ID NO: 149281 - RNA, 22 nt, Human
ccagcccugucaccaacuggag

SEQ ID NO: 149282 - RNA, 22 nt, Human
aucuguucuucaaaauauuaca

SEQ ID NO: 149283 - RNA, 22 nt, Human
ccccacaccugccgggcagcag

SEQ ID NO: 149284 - RNA, 22 nt, Human
cuuguuaaaaugcagauuccaa

SEQ ID NO: 149285 - RNA, 22 nt, Human
cuggcaguauuaagagaaguga

SEQ ID NO: 149286 - RNA, 22 nt, Human
ucaaauauuggcuauuucacau

SEQ ID NO: 149287 - RNA, 22 nt, Human
cuauaauuaugcucaaaaugua

SEQ ID NO: 149288 - RNA, 22 nt, Human
uauauuuaaauccagguugaaa

SEQ ID NO: 149289 - RNA, 22 nt, Human
uuauuuaaaauguagguuggga

SEQ ID NO: 149290 - RNA, 22 nt, Human
ugcuucuggggacaggcugccu

SEQ ID NO: 149291 - RNA, 22 nt, Human
gagaaagaugaagaguggcguu

SEQ ID NO: 149292 - RNA, 22 nt, Human
accaagcucucuucccggcucu

SEQ ID NO: 149293 - RNA, 22 nt, Human
gcaggcucuucuuucugcccag

SEQ ID NO: 149294 - RNA, 22 nt, Human
gaagucuucauucucucugaga

SEQ ID NO: 149295 - RNA, 22 nt, Human
ugggacucacucuuuuggccag

SEQ ID NO: 149296 - RNA, 19 nt, Human
auguaugaggucuucugcu

SEQ ID NO: 149297 - RNA, 18 nt, Human
acaggcugugggaauggu

SEQ ID NO: 149298 - RNA, 22 nt, Human
auuucauagauuguaaaucccu

SEQ ID NO: 149299 - RNA, 22 nt, Human
cagcucaggcucuccaugcucc

SEQ ID NO: 149300 - RNA, 22 nt, Human
uuccaagugucagaucagauuu

SEQ ID NO: 149301 - RNA, 22 nt, Human
augaaaacggaccagagcuauu

SEQ ID NO: 149302 - RNA, 22 nt, Human
ccugggcugaagucaagugugg

SEQ ID NO: 149303 - RNA, 22 nt, Human
gacacagaauuuacucccgaua

SEQ ID NO: 149304 - RNA, 19 nt, Human
gggguggcuggggcuccag

SEQ ID NO: 149305 - RNA, 22 nt, Human
uuguaugaauguauccuaauuu

SEQ ID NO: 149306 - RNA, 22 nt, Human
uaauucagggccagaaucccca

SEQ ID NO: 149307 - RNA, 22 nt, Human
ucccagccuuucuuuucugcug

SEQ ID NO: 149308 - RNA, 22 nt, Human
aagucguggcaggcuugcacga

SEQ ID NO: 149309 - RNA, 22 nt, Human
ucuggcagaagugcugucagua

SEQ ID NO: 149310 - RNA, 22 nt, Human
ucuugauuacaaauaacaucau

SEQ ID NO: 149311 - RNA, 22 nt, Human
gcuggcaggguucucacugaaa

SEQ ID NO: 149312 - RNA, 20 nt, Human
agcuuugguuaagccagugg

SEQ ID NO: 149313 - RNA, 22 nt, Human
gaggguggggaauagacugcua

SEQ ID NO: 149314 - RNA, 20 nt, Human
cccagccccuaccuguugcc

SEQ ID NO: 149315 - RNA, 22 nt, Human
guccucuguagggcugggccac

SEQ ID NO: 149316 - RNA, 22 nt, Human
uuccaagugggggaagcugagu

SEQ ID NO: 149317 - RNA, 22 nt, Human
cagaaagaccugggcucaagag

SEQ ID NO: 149318 - RNA, 22 nt, Human
gagaaagauuguccuucagggg

SEQ ID NO: 149319 - RNA, 22 nt, Human
caugaagcacagcucucuuuuu

SEQ ID NO: 149320 - RNA, 21 nt, Human
uccagcucuuauguucaugaa

SEQ ID NO: 149321 - RNA, 23 nt, Human
aguguugguugggaagccaagca

SEQ ID NO: 149322 - RNA, 22 nt, Human
gcuaggagauugagcucugaag

SEQ ID NO: 149323 - RNA, 22 nt, Human
gccagaagggguggauccaggc

SEQ ID NO: 149324 - RNA, 23 nt, Human
ucugcagacgcuguucuauuguc

SEQ ID NO: 149325 - RNA, 22 nt, Human
ggggcugaaccuggaggugguc

SEQ ID NO: 149326 - RNA, 22 nt, Human
guccuggcaccucacuggcuac

SEQ ID NO: 149327 - RNA, 22 nt, Human
gacugccucaguuucccugcag

SEQ ID NO: 149328 - RNA, 22 nt, Human
uggcaggaaaguaacagagcac

SEQ ID NO: 149329 - RNA, 22 nt, Human
uauuugaaggcauacauuuuga

SEQ ID NO: 149330 - RNA, 22 nt, Human
ugggcuucugauguugagugcu

SEQ ID NO: 149331 - RNA, 22 nt, Human
guggcagguggagccuccugca

SEQ ID NO: 149332 - RNA, 22 nt, Human
ucuggcaguugccgcuucaguc

SEQ ID NO: 149333 - RNA, 22 nt, Human
guggccagcaagugcugccucu

SEQ ID NO: 149334 - RNA, 22 nt, Human
uauuuagaugcauuuggauugc

SEQ ID NO: 149335 - RNA, 22 nt, Human
agccagggucucucgcucuguu

SEQ ID NO: 149336 - RNA, 22 nt, Human
uuguaugaguaugguguauagg

SEQ ID NO: 149337 - RNA, 23 nt, Human
ugcaggcuaggaagagagccuuc

SEQ ID NO: 149338 - RNA, 22 nt, Human
cccaaguuaauuuguagcugaa

SEQ ID NO: 149339 - RNA, 22 nt, Human
uaaaagcucuucuguugaguua

SEQ ID NO: 149340 - RNA, 22 nt, Human
uggaacacaagucauugagggg

SEQ ID NO: 149341 - RNA, 19 nt, Human
agaggccucagcagcuggc

SEQ ID NO: 149342 - RNA, 22 nt, Human
ucuccugcucagaacagccuca

SEQ ID NO: 149343 - RNA, 22 nt, Human
ucuccacacuuucucucccagg

SEQ ID NO: 149344 - RNA, 22 nt, Human
acaauucugaugguuucccagu

SEQ ID NO: 149345 - RNA, 22 nt, Human
uuuaauauucugcauucuccuu

SEQ ID NO: 149346 - RNA, 22 nt, Human
acaugacuuuucucuuccagag

SEQ ID NO: 149347 - RNA, 22 nt, Human
aaaauucugucauuaaauugug

SEQ ID NO: 149348 - RNA, 23 nt, Human
cuucacaaucaaaaucaguucug

SEQ ID NO: 149349 - RNA, 23 nt, Human
ccuggcagcaaacgaggagguua

SEQ ID NO: 149350 - RNA, 22 nt, Human
aacccaggagacagguugcagu

SEQ ID NO: 149351 - RNA, 22 nt, Human
acugggcugccugguucuucua

SEQ ID NO: 149352 - RNA, 22 nt, Human
augggcugugggacccuggacc

SEQ ID NO: 149353 - RNA, 22 nt, Human
ccaggcucaccuggagccccug

SEQ ID NO: 149354 - RNA, 22 nt, Human
ccuggcagcaggugggcccgug

SEQ ID NO: 149355 - RNA, 22 nt, Human
aucuccagauugugaucaucag

SEQ ID NO: 149356 - RNA, 22 nt, Human
uuccugggugguccugguagag

SEQ ID NO: 149357 - RNA, 22 nt, Human
cccuuccuugauuuuaacugga

SEQ ID NO: 149358 - RNA, 22 nt, Human
ggggaccuuuccauuucugaga

SEQ ID NO: 149359 - RNA, 22 nt, Human
ugcacaggaggcuguggagaag

SEQ ID NO: 149360 - RNA, 22 nt, Human
augugagggaaaucagucagaa

SEQ ID NO: 149361 - RNA, 22 nt, Human
ucaugaauauugaaugcuucau

SEQ ID NO: 149362 - RNA, 22 nt, Human
gcacacagcuagauuaccauuc

SEQ ID NO: 149363 - RNA, 22 nt, Human
agacaagaaacugggagucucu

SEQ ID NO: 149364 - RNA, 22 nt, Human
gacacagaaggucacauguuca

SEQ ID NO: 149365 - RNA, 22 nt, Human
cuccucuggguccugguggcca

SEQ ID NO: 149366 - RNA, 22 nt, Human
agcaggcuacuccuguguucgu

SEQ ID NO: 149367 - RNA, 22 nt, Human
cuggggaccagugucuguuugu

SEQ ID NO: 149368 - RNA, 23 nt, Human
gcccacccucagcguccucacgg

SEQ ID NO: 149369 - RNA, 18 nt, Human
gacaaaaguacagacaga

SEQ ID NO: 149370 - RNA, 17 nt, Human
ucugcagaggcaaaccu

SEQ ID NO: 149371 - RNA, 22 nt, Human
gcuucugguagaauucaauaga

SEQ ID NO: 149372 - RNA, 22 nt, Human
ccuguucauuuuuugacucugc

SEQ ID NO: 149373 - RNA, 22 nt, Human
ccaggaccuggagcucuaugaa

SEQ ID NO: 149374 - RNA, 18 nt, Human
uaaauauauuucccccuu

SEQ ID NO: 149375 - RNA, 22 nt, Human
agaugaaaauacgugacuuuaa

SEQ ID NO: 149376 - RNA, 22 nt, Human
ugggccagcugaagugccgccc

SEQ ID NO: 149377 - RNA, 22 nt, Human
cuuccuccgaagaaguugcugg

SEQ ID NO: 149378 - RNA, 17 nt, Human
ccaggcuccaucacugu

SEQ ID NO: 149379 - RNA, 21 nt, Human
gcccccuggacuccucaucca

SEQ ID NO: 149380 - RNA, 21 nt, Human
ucuggcagcaguuuguugagu

SEQ ID NO: 149381 - RNA, 22 nt, Human
uccugugccaucucuagagacu

SEQ ID NO: 149382 - RNA, 22 nt, Human
ucugggcugguugugcuugcuu

SEQ ID NO: 149383 - RNA, 22 nt, Human
ugcaggcuggaggagggacuaa

SEQ ID NO: 149384 - RNA, 22 nt, Human
aggagcugcagauucugccuug

SEQ ID NO: 149385 - RNA, 22 nt, Human
gcuugggaagggcccuguguac

SEQ ID NO: 149386 - RNA, 22 nt, Human
gugggcuuuugacagugccugg

SEQ ID NO: 149387 - RNA, 22 nt, Human
gcuguucacggaggaggauggg

SEQ ID NO: 149388 - RNA, 22 nt, Human
cuacauuaaauuggcuuacuua

SEQ ID NO: 149389 - RNA, 18 nt, Human
ccuggcagccaugcgcgc

SEQ ID NO: 149390 - RNA, 22 nt, Human
uacacagauaugugaucaauca

SEQ ID NO: 149391 - RNA, 22 nt, Human
gccaggggugcccacccaagga

SEQ ID NO: 149392 - RNA, 22 nt, Human
cacacugucagguaaauaacac

SEQ ID NO: 149393 - RNA, 22 nt, Human
auaugaaaauguuuuagcugua

SEQ ID NO: 149394 - RNA, 22 nt, Human
ugcuucugcauucaauguugga

SEQ ID NO: 149395 - RNA, 22 nt, Human
gguaugaaaugauuccauguua

SEQ ID NO: 149396 - RNA, 22 nt, Human
ggagcugaaccccaucgugcug

SEQ ID NO: 149397 - RNA, 20 nt, Human
acuguucaagggccuggugg

SEQ ID NO: 149398 - RNA, 22 nt, Human
ugagugugcagggaaguggcgg

SEQ ID NO: 149399 - RNA, 22 nt, Human
agcaggugggcaugaaagcuga

SEQ ID NO: 149400 - RNA, 22 nt, Human
auguuggagucguaaggcaugg

SEQ ID NO: 149401 - RNA, 23 nt, Human
uuuauauuccuaaugucuugagc

SEQ ID NO: 149402 - RNA, 22 nt, Human
agcaggcuugguccccagccuc

SEQ ID NO: 149403 - RNA, 22 nt, Human
uguaugaauauguuggggaggu

SEQ ID NO: 149404 - RNA, 22 nt, Human
gagauggccagugccaggacaa

SEQ ID NO: 149405 - RNA, 22 nt, Human
ucuggcaggacaugcugaccau

SEQ ID NO: 149406 - RNA, 22 nt, Human
cauuacaaccccaaauuacaaa

SEQ ID NO: 149407 - RNA, 22 nt, Human
ccauucauacaauuuuguucua

SEQ ID NO: 149408 - RNA, 22 nt, Human
aguaugaaaguuaaucaauuua

SEQ ID NO: 149409 - RNA, 22 nt, Human
cuggggcuggugaggcaggcuc

SEQ ID NO: 149410 - RNA, 22 nt, Human
ucacuguaaaguaauacuguca

SEQ ID NO: 149411 - RNA, 22 nt, Human
agagacaggguuuugucguguu

SEQ ID NO: 149412 - RNA, 22 nt, Human
uucuucaaagaugucuguugga

SEQ ID NO: 149413 - RNA, 22 nt, Human
uuuacagaaugucaauuucuau

SEQ ID NO: 149414 - RNA, 22 nt, Human
caggucuuuucuacugguggag

SEQ ID NO: 149415 - RNA, 20 nt, Human
acugugaaugcugaauuagc

SEQ ID NO: 149416 - RNA, 22 nt, Human
gaagagaaaggcaaggaguuuu

SEQ ID NO: 149417 - RNA, 22 nt, Human
cuuccucccggcccaugcucug

SEQ ID NO: 149418 - RNA, 22 nt, Human
ggagcugaaggggugggcucag

SEQ ID NO: 149419 - RNA, 17 nt, Human
ugcaggcuguuauagcc

SEQ ID NO: 149420 - RNA, 22 nt, Human
guccucuggugaaagcauuccc

SEQ ID NO: 149421 - RNA, 22 nt, Human
gucacaggccuggaugaggggc

SEQ ID NO: 149422 - RNA, 22 nt, Human
gaggagcugagccacguccugg

SEQ ID NO: 149423 - RNA, 22 nt, Human
gccuggcacaguagggacccaa

SEQ ID NO: 149424 - RNA, 22 nt, Human
gagagaaaagggggaauugauu

SEQ ID NO: 149425 - RNA, 22 nt, Human
auauuauucuagcucuugugug

SEQ ID NO: 149426 - RNA, 22 nt, Human
agaggcuuggaggugcaagguu

SEQ ID NO: 149427 - RNA, 22 nt, Human
uguaugaaguuacugagccucu

SEQ ID NO: 149428 - RNA, 22 nt, Human
uccugagcuacaguaguaugau

SEQ ID NO: 149429 - RNA, 22 nt, Human
uuguaugaucaaaagaaaugua

SEQ ID NO: 149430 - RNA, 20 nt, Human
ucuggggaugaggucuagga

SEQ ID NO: 149431 - RNA, 22 nt, Human
cuggcagucugguggaaggccu

SEQ ID NO: 149432 - RNA, 22 nt, Human
aauuucagaacccaaauuagcg

SEQ ID NO: 149433 - RNA, 22 nt, Human
cuccuggcuuucccagaccagg

SEQ ID NO: 149434 - RNA, 22 nt, Human
aggcugcuucagcugcagggag

SEQ ID NO: 149435 - RNA, 22 nt, Human
cuuacaaauacacuuaggagag

SEQ ID NO: 149436 - RNA, 23 nt, Human
agcuuuggugaugugacagauaa

SEQ ID NO: 149437 - RNA, 22 nt, Human
ccacacagggggaugaguuauu

SEQ ID NO: 149438 - RNA, 22 nt, Human
ucccugccugacagcacccacc

SEQ ID NO: 149439 - RNA, 16 nt, Human
gcacacacaucaauga

SEQ ID NO: 149440 - RNA, 22 nt, Human
gaggcacauauauacagagccc

SEQ ID NO: 149441 - RNA, 22 nt, Human
ucugggcuuggauuggcucugc

SEQ ID NO: 149442 - RNA, 22 nt, Human
uuuaagaaguuauguuauaaau

SEQ ID NO: 149443 - RNA, 22 nt, Human
agggaccugcucacugccuggc

SEQ ID NO: 149444 - RNA, 22 nt, Human
cugccugcucaccagggcucug

SEQ ID NO: 149445 - RNA, 17 nt, Human
ucugggcuucagugguc

SEQ ID NO: 149446 - RNA, 22 nt, Human
ccccacccaccuaagagaaacu

SEQ ID NO: 149447 - RNA, 22 nt, Human
uccccacagcagaagaucugag

SEQ ID NO: 149448 - RNA, 22 nt, Human
ccuggggaccugccucagcccu

SEQ ID NO: 149449 - RNA, 22 nt, Human
caucacagaaauaaacauaccu

SEQ ID NO: 149450 - RNA, 22 nt, Human
ucuccaagcagggcugcaaggc

SEQ ID NO: 149451 - RNA, 20 nt, Human
ucccucccuccagcucuggg

SEQ ID NO: 149452 - RNA, 22 nt, Human
uggaacacuuuguugaaaugca

SEQ ID NO: 149453 - RNA, 22 nt, Human
uaaaggguagguuuuacuguaa

SEQ ID NO: 149454 - RNA, 22 nt, Human
aauauucaaguuauucuuucuu

SEQ ID NO: 149455 - RNA, 22 nt, Human
uccuguuuaucugugugacucg

SEQ ID NO: 149456 - RNA, 22 nt, Human
acagcucuguguauugucaucu

SEQ ID NO: 149457 - RNA, 22 nt, Human
uggcagagagacucuccuugau

SEQ ID NO: 149458 - RNA, 22 nt, Human
cuucccacuaguaucacagagc

SEQ ID NO: 149459 - RNA, 22 nt, Human
ggagucugcucccagacaugau

SEQ ID NO: 149460 - RNA, 22 nt, Human
acuggcaguagagggagcgcau

SEQ ID NO: 149461 - RNA, 22 nt, Human
ccacauacaaauggggugcugu

SEQ ID NO: 149462 - RNA, 22 nt, Human
cuggccucauagccaagcugug

SEQ ID NO: 149463 - RNA, 22 nt, Human
uacaaaaggaagagggaucuua

SEQ ID NO: 149464 - RNA, 22 nt, Human
ugcuucaaguugaaauauucuu

SEQ ID NO: 149465 - RNA, 22 nt, Human
acauacacaugaauauauuuuu

SEQ ID NO: 149466 - RNA, 18 nt, Human
gaguguggcacugggccc

SEQ ID NO: 149467 - RNA, 22 nt, Human
auuucuguauccugcugucaga

SEQ ID NO: 149468 - RNA, 22 nt, Human
agcaggcuuuccacagaaggag

SEQ ID NO: 149469 - RNA, 19 nt, Human
ugccuggcaccagcuccac

SEQ ID NO: 149470 - RNA, 22 nt, Human
guuaaccaaggcaccaagugua

SEQ ID NO: 149471 - RNA, 22 nt, Human
cuuccucccccacacacucacu

SEQ ID NO: 149472 - RNA, 22 nt, Human
gaggggcuggguagggcaaccc

SEQ ID NO: 149473 - RNA, 22 nt, Human
gacucugggcugagccagggcc

SEQ ID NO: 149474 - RNA, 22 nt, Human
agcaggcuaaucuugcugaaca

SEQ ID NO: 149475 - RNA, 22 nt, Human
uuucaaaugcaugucuuuccuc

SEQ ID NO: 149476 - RNA, 19 nt, Human
uggaccugugcccauggcu

SEQ ID NO: 149477 - RNA, 22 nt, Human
ggggaccuucccagagcaguug

SEQ ID NO: 149478 - RNA, 22 nt, Human
guacacacaaucucuggucagu

SEQ ID NO: 149479 - RNA, 22 nt, Human
ucuaggagaaccaucagggagg

SEQ ID NO: 149480 - RNA, 22 nt, Human
aguaaaauuucugcugaggaga

SEQ ID NO: 149481 - RNA, 22 nt, Human
guccucuggagguuuuuaggug

SEQ ID NO: 149482 - RNA, 22 nt, Human
agggcugacagugaggagucaa

SEQ ID NO: 149483 - RNA, 22 nt, Human
ugacaggaggcuugaggccagg

SEQ ID NO: 149484 - RNA, 21 nt, Human
acugggcuagccugacuucug

SEQ ID NO: 149485 - RNA, 22 nt, Human
ugaaccacaugcaaagugaaua

SEQ ID NO: 149486 - RNA, 22 nt, Human
ugcaggcugugucauuuaguga

SEQ ID NO: 149487 - RNA, 18 nt, Human
ucuggaacaacuucaugu

SEQ ID NO: 149488 - RNA, 22 nt, Human
acuggggagugguuuugggaag

SEQ ID NO: 149489 - RNA, 22 nt, Human
gcaggcucagagcagauuagca

SEQ ID NO: 149490 - RNA, 22 nt, Human
cuggcaugaaauggcaucucau

SEQ ID NO: 149491 - RNA, 22 nt, Human
uuuaaaaucagaugggaguugg

SEQ ID NO: 149492 - RNA, 22 nt, Human
cuguaugauuccauuucuauaa

SEQ ID NO: 149493 - RNA, 22 nt, Human
uuccuggcagaggccccgacag

SEQ ID NO: 149494 - RNA, 22 nt, Human
ccugggcuuugagggcaggaug

SEQ ID NO: 149495 - RNA, 22 nt, Human
gcacacauucggauucuuaacc

SEQ ID NO: 149496 - RNA, 22 nt, Human
uccugagcugccgcaucagcag

SEQ ID NO: 149497 - RNA, 22 nt, Human
gggaccuggcgagggucacaca

SEQ ID NO: 149498 - RNA, 22 nt, Human
ccugggcucaggcuugggcagc

SEQ ID NO: 149499 - RNA, 21 nt, Human
ccuagccucuuacccagcuuu

SEQ ID NO: 149500 - RNA, 23 nt, Human
uggccagguagaggagguaguga

SEQ ID NO: 149501 - RNA, 22 nt, Human
ccucugugucuugguuucaaga

SEQ ID NO: 149502 - RNA, 22 nt, Human
caucuucagguucauggucaua

SEQ ID NO: 149503 - RNA, 22 nt, Human
ccugggcucgcgcacuucaccc

SEQ ID NO: 149504 - RNA, 22 nt, Human
gggcugacucaaccuugcaaag

SEQ ID NO: 149505 - RNA, 22 nt, Human
ugcaggcuccaggugcacauau

SEQ ID NO: 149506 - RNA, 22 nt, Human
cucagcucugacaggaggcauc

SEQ ID NO: 149507 - RNA, 22 nt, Human
agagucccagggacacuccaga

SEQ ID NO: 149508 - RNA, 22 nt, Human
aucacaauguacguuaaaaugu

SEQ ID NO: 149509 - RNA, 22 nt, Human
ucaggcccagagucacggaucc

SEQ ID NO: 149510 - RNA, 21 nt, Human
ucuggcaggaagacggauggg

SEQ ID NO: 149511 - RNA, 22 nt, Human
uuccagccaugguuucccuaug

SEQ ID NO: 149512 - RNA, 22 nt, Human
aaucuucacagaaaaaugucug

SEQ ID NO: 149513 - RNA, 20 nt, Human
agaggcuuccuugggaggag

SEQ ID NO: 149514 - RNA, 22 nt, Human
uuccagaagccuccauauuacu

SEQ ID NO: 149515 - RNA, 22 nt, Human
ucuaggaguaaugagcuagcac

SEQ ID NO: 149516 - RNA, 22 nt, Human
ucuguucaguugauguaguuuu

SEQ ID NO: 149517 - RNA, 22 nt, Human
cugggcugaaaguguuccuuga

SEQ ID NO: 149518 - RNA, 22 nt, Human
uuguaugaccacaaucugacgu

SEQ ID NO: 149519 - RNA, 22 nt, Human
gccaagcuuggaaggaucaugg

SEQ ID NO: 149520 - RNA, 22 nt, Human
cagcucuuugaguauuccauuu

SEQ ID NO: 149521 - RNA, 22 nt, Human
ccaggcccugcuccucacacca

SEQ ID NO: 149522 - RNA, 22 nt, Human
aauauuucuguagcuauguucu

SEQ ID NO: 149523 - RNA, 22 nt, Human
aguaugaauacagauuuucucu

SEQ ID NO: 149524 - RNA, 22 nt, Human
acuguucaagcaaaugacauug

SEQ ID NO: 149525 - RNA, 22 nt, Human
aaucuucauuuugacaagauuc

SEQ ID NO: 149526 - RNA, 22 nt, Human
gccucaggccgcccugcugcuc

SEQ ID NO: 149527 - RNA, 22 nt, Human
aucacuguuaucuagaagcaca

SEQ ID NO: 149528 - RNA, 22 nt, Human
ugggcugagcagugaagcucau

SEQ ID NO: 149529 - RNA, 19 nt, Human
ggcggguggacuggagccc

SEQ ID NO: 149530 - RNA, 22 nt, Human
gcuccaagguauccaccagggu

SEQ ID NO: 149531 - RNA, 22 nt, Human
aucucccagccacagcauucuu

SEQ ID NO: 149532 - RNA, 22 nt, Human
ugggcugaggggccuugaugac

SEQ ID NO: 149533 - RNA, 22 nt, Human
ccuggcaggacuguuguaagaa

SEQ ID NO: 149534 - RNA, 22 nt, Human
ccagcccugaacccugcugcau

SEQ ID NO: 149535 - RNA, 22 nt, Human
guccucugagggggcugcacgc

SEQ ID NO: 149536 - RNA, 23 nt, Human
cagugugacgaggugaggcaggc

SEQ ID NO: 149537 - RNA, 22 nt, Human
cacacaguaggcacucauuaau

SEQ ID NO: 149538 - RNA, 22 nt, Human
auugguggugaggacaugccag

SEQ ID NO: 149539 - RNA, 22 nt, Human
gccuggaagugugucgugggaa

SEQ ID NO: 149540 - RNA, 22 nt, Human
uuuauuuauccuucuggauugc

SEQ ID NO: 149541 - RNA, 22 nt, Human
auuucuguugcuuauaaauuac

SEQ ID NO: 149542 - RNA, 22 nt, Human
uuccagcuaacucacaucccuu

SEQ ID NO: 149543 - RNA, 22 nt, Human
ggagcugaggcugaggccucac

SEQ ID NO: 149544 - RNA, 22 nt, Human
auggcuagcaccgcguugcugg

SEQ ID NO: 149545 - RNA, 22 nt, Human
aauguugagcuugaaaguaggu

SEQ ID NO: 149546 - RNA, 22 nt, Human
ucuguucaagacugaggugaca

SEQ ID NO: 149547 - RNA, 22 nt, Human
guguaugauuucaaauggcuag

SEQ ID NO: 149548 - RNA, 22 nt, Human
uccugcagccacugcaggcaga

SEQ ID NO: 149549 - RNA, 22 nt, Human
ucucuucauagugacacccauc

SEQ ID NO: 149550 - RNA, 22 nt, Human
auggcagagggauugaacagcu

SEQ ID NO: 149551 - RNA, 22 nt, Human
uggucucugcaggccaggcuca

SEQ ID NO: 149552 - RNA, 22 nt, Human
uugaauucauuucucauugagu

SEQ ID NO: 149553 - RNA, 22 nt, Human
ccacaucauggauacaguuaug

SEQ ID NO: 149554 - RNA, 22 nt, Human
guuacucuuccccggggucugg

SEQ ID NO: 149555 - RNA, 22 nt, Human
uccuggcacccuuggguuggag

SEQ ID NO: 149556 - RNA, 22 nt, Human
uucuuguauauaaaaaucauuu

SEQ ID NO: 149557 - RNA, 22 nt, Human
ccagauagaaaagaaggcagga

SEQ ID NO: 149558 - RNA, 22 nt, Human
aggcuguguggaugagucuuac

SEQ ID NO: 149559 - RNA, 22 nt, Human
acaucacagagcccagauaaag

SEQ ID NO: 149560 - RNA, 22 nt, Human
ccagcccuuagauaaaccuggc

SEQ ID NO: 149561 - RNA, 22 nt, Human
ucccacacuugaaacaaggcug

SEQ ID NO: 149562 - RNA, 22 nt, Human
gugggcuucccuuaagccagag

SEQ ID NO: 149563 - RNA, 22 nt, Human
ugggcucucaaagugcggcuug

SEQ ID NO: 149564 - RNA, 22 nt, Human
uuccaaguuaggcgagcuggug

SEQ ID NO: 149565 - RNA, 22 nt, Human
agaagcuuccuacauuguucuu

SEQ ID NO: 149566 - RNA, 22 nt, Human
cugagggagcugcuggccuugg

SEQ ID NO: 149567 - RNA, 20 nt, Human
ugccuggccuuucucugccc

SEQ ID NO: 149568 - RNA, 22 nt, Human
aauuuagauugauaaacaugga

SEQ ID NO: 149569 - RNA, 22 nt, Human
aaggcucuggguuucauaggug

SEQ ID NO: 149570 - RNA, 22 nt, Human
aaaaagucugcaaaggagguug

SEQ ID NO: 149571 - RNA, 22 nt, Human
ucuggggagugccuaaguggaa

SEQ ID NO: 149572 - RNA, 22 nt, Human
ugccugccaugcagaaagcuga

SEQ ID NO: 149573 - RNA, 22 nt, Human
caugaagcauguuuugucauga

SEQ ID NO: 149574 - RNA, 22 nt, Human
uacacagauuucaguaucauca

SEQ ID NO: 149575 - RNA, 22 nt, Human
ggcucugcagugacuugagggg

SEQ ID NO: 149576 - RNA, 22 nt, Human
uguaaacagccccauggagagc

SEQ ID NO: 149577 - RNA, 22 nt, Human
aggaagaaccuaagaaagucuc

SEQ ID NO: 149578 - RNA, 22 nt, Human
agcagguguauauaaggcugag

SEQ ID NO: 149579 - RNA, 22 nt, Human
ucccagccuggacccugccagu

SEQ ID NO: 149580 - RNA, 22 nt, Human
ucacacaugaguaaauacaggg

SEQ ID NO: 149581 - RNA, 22 nt, Human
uaugaagcuuugaaaagcuuac

SEQ ID NO: 149582 - RNA, 22 nt, Human
uuuaaagugcugcuccuauccu

SEQ ID NO: 149583 - RNA, 22 nt, Human
ccucccuucaguagagcccaau

SEQ ID NO: 149584 - RNA, 22 nt, Human
uacauugaauuuuuuagcaugu

SEQ ID NO: 149585 - RNA, 22 nt, Human
cugggagggguagccaauccua

SEQ ID NO: 149586 - RNA, 22 nt, Human
cagaaaauaaaguuucuacgca

SEQ ID NO: 149587 - RNA, 22 nt, Human
auccuggcccagguguggaggg

SEQ ID NO: 149588 - RNA, 22 nt, Human
cagcucugagacugaggcuaug

SEQ ID NO: 149589 - RNA, 22 nt, Human
gggccccuuguaucucuggcuc

SEQ ID NO: 149590 - RNA, 22 nt, Human
ccuguucacgguguguuguuag

SEQ ID NO: 149591 - RNA, 22 nt, Human
gccuggcaaggcccuguugacu

SEQ ID NO: 149592 - RNA, 22 nt, Human
ggccucaggguugggcccauua

SEQ ID NO: 149593 - RNA, 22 nt, Human
ggcacagggggcugaggacuag

SEQ ID NO: 149594 - RNA, 22 nt, Human
guccucugaaguugugcaaugc

SEQ ID NO: 149595 - RNA, 22 nt, Human
aggaggcugcaacccugaggcc

SEQ ID NO: 149596 - RNA, 22 nt, Human
uauuccagguuucuuguuguau

SEQ ID NO: 149597 - RNA, 22 nt, Human
ccaucacaguccccaucgugau

SEQ ID NO: 149598 - RNA, 22 nt, Human
aauauaaugcuguuuuaugcca

SEQ ID NO: 149599 - RNA, 18 nt, Human
auccuugaugagaggucu

SEQ ID NO: 149600 - RNA, 22 nt, Human
ugucuucaucuccaugcacaga

SEQ ID NO: 149601 - RNA, 22 nt, Human
gaaauauuucucuugagccccu

SEQ ID NO: 149602 - RNA, 22 nt, Human
cuguaugaguugggaauagaau

SEQ ID NO: 149603 - RNA, 22 nt, Human
cacacaucaaccuagacauugu

SEQ ID NO: 149604 - RNA, 22 nt, Human
ugcuggcacguggaccaggaga

SEQ ID NO: 149605 - RNA, 22 nt, Human
uccaggcaagggaggagcaugg

SEQ ID NO: 149606 - RNA, 22 nt, Human
auuuggaaaugcaucucuugag

SEQ ID NO: 149607 - RNA, 22 nt, Human
gcacacacuguuuuccucacau

SEQ ID NO: 149608 - RNA, 22 nt, Human
acaguucccgucuugcacagcu

SEQ ID NO: 149609 - RNA, 22 nt, Human
ugaagcacaggcauacacaacc

SEQ ID NO: 149610 - RNA, 22 nt, Human
aguaugaacggaaggccuggga

SEQ ID NO: 149611 - RNA, 22 nt, Human
ucuguggaaauuuccugaggca

SEQ ID NO: 149612 - RNA, 22 nt, Human
cuccaaguauguuaaaaucuaa

SEQ ID NO: 149613 - RNA, 22 nt, Human
cuguagaacgauccaggcauuu

SEQ ID NO: 149614 - RNA, 22 nt, Human
gucuggaaggaggagauggagc

SEQ ID NO: 149615 - RNA, 22 nt, Human
ccccacccucgcuccauuucgg

SEQ ID NO: 149616 - RNA, 16 nt, Human
ccugggcucuguugga

SEQ ID NO: 149617 - RNA, 21 nt, Human
ccaggcuccugaggcugguca

SEQ ID NO: 149618 - RNA, 22 nt, Human
cucuugcagauaccuugaagga

SEQ ID NO: 149619 - RNA, 21 nt, Human
ugcaggcuguuuaagaggcaa

SEQ ID NO: 149620 - RNA, 20 nt, Human
aaagagcccuuggagcaggc

SEQ ID NO: 149621 - RNA, 18 nt, Human
ggcagggaaaagauaggg

SEQ ID NO: 149622 - RNA, 22 nt, Human
ccacuguaaguuugaaaauaac

SEQ ID NO: 149623 - RNA, 22 nt, Human
guggcagggcuuugcuguucuu

SEQ ID NO: 149624 - RNA, 22 nt, Human
ggugccagaguggcccaggggc

SEQ ID NO: 149625 - RNA, 22 nt, Human
ccaggcucuaucccuccuucuu

SEQ ID NO: 149626 - RNA, 22 nt, Human
ccuugcucaagcuagugacggg

SEQ ID NO: 149627 - RNA, 22 nt, Human
cuaggaauccuuuuagaguugg

SEQ ID NO: 149628 - RNA, 23 nt, Human
aacagccaacuuuagcggguggc

SEQ ID NO: 149629 - RNA, 17 nt, Human
gccuucucugcccucac

SEQ ID NO: 149630 - RNA, 22 nt, Human
cagucccaugagcccagaacau

SEQ ID NO: 149631 - RNA, 22 nt, Human
uggcaggcaaguucagcuccac

SEQ ID NO: 149632 - RNA, 22 nt, Human
acacaucucaggggacacucuc

SEQ ID NO: 149633 - RNA, 22 nt, Human
uccaggcaaaaaccaacuacag

SEQ ID NO: 149634 - RNA, 22 nt, Human
agcaggcuuacuuucugauuag

SEQ ID NO: 149635 - RNA, 18 nt, Human
ccuagccuccaagcucau

SEQ ID NO: 149636 - RNA, 22 nt, Human
aauucuauguucuugaguaaga

SEQ ID NO: 149637 - RNA, 22 nt, Human
gagaccucuugguaucgcuagg

SEQ ID NO: 149638 - RNA, 20 nt, Human
cauuugaaucuccauucugc

SEQ ID NO: 149639 - RNA, 22 nt, Human
gcagccuccgcacugcgagucc

SEQ ID NO: 149640 - RNA, 22 nt, Human
ccugggcuccacuccaagagca

SEQ ID NO: 149641 - RNA, 22 nt, Human
ccuggcagacagcacugaagcu

SEQ ID NO: 149642 - RNA, 22 nt, Human
caggcccucgcccgcagcgacc

SEQ ID NO: 149643 - RNA, 22 nt, Human
gcaggcucccuugcagagcagg

SEQ ID NO: 149644 - RNA, 22 nt, Human
guggccagccccauggacaguu

SEQ ID NO: 149645 - RNA, 22 nt, Human
ucuggcaguuccuuguugauau

SEQ ID NO: 149646 - RNA, 22 nt, Human
gagguggcuccuucagggaaua

SEQ ID NO: 149647 - RNA, 22 nt, Human
uuccaggacuggguguuugaag

SEQ ID NO: 149648 - RNA, 22 nt, Human
agcucccauuaucuucugaaac

SEQ ID NO: 149649 - RNA, 22 nt, Human
acacacagcgccuaccaugugc

SEQ ID NO: 149650 - RNA, 22 nt, Human
ugggcugcuucuauuggugguc

SEQ ID NO: 149651 - RNA, 22 nt, Human
aucacagagauugcuuuuaaaa

SEQ ID NO: 149652 - RNA, 22 nt, Human
acacauaagccuaaucaucucc

SEQ ID NO: 149653 - RNA, 22 nt, Human
uacacaucucugucaguaguga

SEQ ID NO: 149654 - RNA, 22 nt, Human
auaaaauuugcuacuguuaaau

SEQ ID NO: 149655 - RNA, 20 nt, Human
acaaaauagguacuggguag

SEQ ID NO: 149656 - RNA, 22 nt, Human
ucacuguaccuuccauuucauu

SEQ ID NO: 149657 - RNA, 22 nt, Human
ccacacagucaguuuccaagaa

SEQ ID NO: 149658 - RNA, 22 nt, Human
gcugggcucaccaggccacuag

SEQ ID NO: 149659 - RNA, 21 nt, Human
auucagaguaauucaucuuua

SEQ ID NO: 149660 - RNA, 19 nt, Human
caggucuucuuggaggacu

SEQ ID NO: 149661 - RNA, 22 nt, Human
ugggcuuaggucggaggcggcc

SEQ ID NO: 149662 - RNA, 22 nt, Human
uuccauuuauucuuguccagau

SEQ ID NO: 149663 - RNA, 22 nt, Human
ugcuucugcaacuugaauguac

SEQ ID NO: 149664 - RNA, 22 nt, Human
acaggcucucagccaguuggca

SEQ ID NO: 149665 - RNA, 22 nt, Human
ggcugaguugagaggauuacuu

SEQ ID NO: 149666 - RNA, 19 nt, Human
gcugggcuuggguuuguag

SEQ ID NO: 149667 - RNA, 22 nt, Human
ugggcugaacuucaucugauga

SEQ ID NO: 149668 - RNA, 17 nt, Human
ucuguucaagugagagg

SEQ ID NO: 149669 - RNA, 22 nt, Human
gcacauaaagggcaugggaggu

SEQ ID NO: 149670 - RNA, 22 nt, Human
auaugagaauuggaaaauauca

SEQ ID NO: 149671 - RNA, 22 nt, Human
cccgagugucuacucacuccca

SEQ ID NO: 149672 - RNA, 22 nt, Human
gguggccugaauuagcucaggg

SEQ ID NO: 149673 - RNA, 22 nt, Human
ucuggcaggguguguauuuaca

SEQ ID NO: 149674 - RNA, 22 nt, Human
uuggcaggaauauugcagaggu

SEQ ID NO: 149675 - RNA, 22 nt, Human
gcuucuggugaggccucaggaa

SEQ ID NO: 149676 - RNA, 22 nt, Human
gucuucuguucugugaggcuuc

SEQ ID NO: 149677 - RNA, 19 nt, Human
cagcccucuuaccacugug

SEQ ID NO: 149678 - RNA, 22 nt, Human
gcaggcucacucuguuuggcuc

SEQ ID NO: 149679 - RNA, 22 nt, Human
acuggggagagucaugccagca

SEQ ID NO: 149680 - RNA, 22 nt, Human
gcacucuccuggcugccacagu

SEQ ID NO: 149681 - RNA, 22 nt, Human
uggccuccccuaacagccucuu

SEQ ID NO: 149682 - RNA, 22 nt, Human
ucuccugggaggacaaggaagg

SEQ ID NO: 149683 - RNA, 22 nt, Human
acacucacccucccacugccug

SEQ ID NO: 149684 - RNA, 22 nt, Human
ucccaccccggucaagggcuga

SEQ ID NO: 149685 - RNA, 22 nt, Human
gcccacacagcagauccuuugg

SEQ ID NO: 149686 - RNA, 23 nt, Human
uccaggagcaugcuggcuggcga

SEQ ID NO: 149687 - RNA, 22 nt, Human
ugguaagaacccaucagagaag

SEQ ID NO: 149688 - RNA, 22 nt, Human
gggaccuggggacuccuuguuc

SEQ ID NO: 149689 - RNA, 22 nt, Human
gcuucugggguucuggcaugcu

SEQ ID NO: 149690 - RNA, 22 nt, Human
guccucugcuucaugcccugau

SEQ ID NO: 149691 - RNA, 22 nt, Human
gcuucuggaggagcugggcuga

SEQ ID NO: 149692 - RNA, 22 nt, Human
auggccugaugcaccuguccca

SEQ ID NO: 149693 - RNA, 22 nt, Human
auggccugcagugcugccacag

SEQ ID NO: 149694 - RNA, 22 nt, Human
cgcaggcugcagccaagaagag

SEQ ID NO: 149695 - RNA, 22 nt, Human
cauuggaaugcauuugaagaga

SEQ ID NO: 149696 - RNA, 22 nt, Human
gauggccuggguccccuuccgg

SEQ ID NO: 149697 - RNA, 19 nt, Human
acacauuugcacaauccac

SEQ ID NO: 149698 - RNA, 22 nt, Human
cuguccuccagacgacaguccc

SEQ ID NO: 149699 - RNA, 22 nt, Human
ugcuucuguucuuucaccuacg

SEQ ID NO: 149700 - RNA, 22 nt, Human
gggcucucaugaguguguggua

SEQ ID NO: 149701 - RNA, 22 nt, Human
ccuggcaggccccuccuggauu

SEQ ID NO: 149702 - RNA, 22 nt, Human
gaugaaaaucuugagaugucga

SEQ ID NO: 149703 - RNA, 20 nt, Human
ggccucaguguccuuguuug

SEQ ID NO: 149704 - RNA, 22 nt, Human
uccuggcagaaauggggcugug

SEQ ID NO: 149705 - RNA, 22 nt, Human
uuucagaaaacuuaucaucagu

SEQ ID NO: 149706 - RNA, 22 nt, Human
uauuucagacacugaucuugca

SEQ ID NO: 149707 - RNA, 22 nt, Human
gcccacaccauuuauucuuugu

SEQ ID NO: 149708 - RNA, 22 nt, Human
ggccucagaaauagaguaaaau

SEQ ID NO: 149709 - RNA, 22 nt, Human
agcuuguuaaggaugcauauua

SEQ ID NO: 149710 - RNA, 22 nt, Human
auguaugagagauucuuuuauu

SEQ ID NO: 149711 - RNA, 22 nt, Human
aauucuugguccuaguguauaa

SEQ ID NO: 149712 - RNA, 23 nt, Human
uuccaggcagagcagggauuaga

SEQ ID NO: 149713 - RNA, 22 nt, Human
aagauuuaccacuuuauucaag

SEQ ID NO: 149714 - RNA, 22 nt, Human
agugaaccaggcugcgucccug

SEQ ID NO: 149715 - RNA, 22 nt, Human
gacacagacaguuagagguaau

SEQ ID NO: 149716 - RNA, 22 nt, Human
aggacacacagaauacaaaucc

SEQ ID NO: 149717 - RNA, 18 nt, Human
ugcaggcuguugaaacug

SEQ ID NO: 149718 - RNA, 22 nt, Human
cacacacuguuaauguaggagu

SEQ ID NO: 149719 - RNA, 22 nt, Human
ugaacaacugcaaaaaucucca

SEQ ID NO: 149720 - RNA, 22 nt, Human
ucuggcagaucuucccacguuu

SEQ ID NO: 149721 - RNA, 22 nt, Human
aguaaaauuguauuggaaaaca

SEQ ID NO: 149722 - RNA, 21 nt, Human
acacacugaguuuuccacugu

SEQ ID NO: 149723 - RNA, 22 nt, Human
ccugggcugggcgucucauggg

SEQ ID NO: 149724 - RNA, 22 nt, Human
guuuaagaaaauucauguuguu

SEQ ID NO: 149725 - RNA, 22 nt, Human
ccccuuccacagugcuuccuaa

SEQ ID NO: 149726 - RNA, 22 nt, Human
acugggcuagaguggaagcugg

SEQ ID NO: 149727 - RNA, 22 nt, Human
gggcugacagcacgccuucugu

SEQ ID NO: 149728 - RNA, 22 nt, Human
aucccacaccccuacaacauau

SEQ ID NO: 149729 - RNA, 22 nt, Human
gaagcacugcauuucaagauca

SEQ ID NO: 149730 - RNA, 22 nt, Human
ugcuucugggccugguguuccc

SEQ ID NO: 149731 - RNA, 17 nt, Human
agcaggcugcagaggcc

SEQ ID NO: 149732 - RNA, 22 nt, Human
gguggcauaagaacacuaaaga

SEQ ID NO: 149733 - RNA, 22 nt, Human
caagcuuguuucuccugggggu

SEQ ID NO: 149734 - RNA, 22 nt, Human
ucacacagcugacagagccuuu

SEQ ID NO: 149735 - RNA, 22 nt, Human
uacagccacaggugacucucau

SEQ ID NO: 149736 - RNA, 22 nt, Human
cugagccagggccacacaugga

SEQ ID NO: 149737 - RNA, 22 nt, Human
uuauuuaaaagugguaagauuc

SEQ ID NO: 149738 - RNA, 22 nt, Human
uucauacaguggcugcacucca

SEQ ID NO: 149739 - RNA, 22 nt, Human
aacacauaggcagagcaugaca

SEQ ID NO: 149740 - RNA, 22 nt, Human
cacauugcagcuucuuuuggcu

SEQ ID NO: 149741 - RNA, 19 nt, Human
gcuggcagaauuuugaacc

SEQ ID NO: 149742 - RNA, 22 nt, Human
aaagagucaaaggcaugucucu

SEQ ID NO: 149743 - RNA, 22 nt, Human
accugccuaucagcugccugcu

SEQ ID NO: 149744 - RNA, 22 nt, Human
acacacuuuaaauuaaaccucu

SEQ ID NO: 149745 - RNA, 22 nt, Human
ccugggcucaagcgaucuuguc

SEQ ID NO: 149746 - RNA, 22 nt, Human
accauugccuagaaaaauuccu

SEQ ID NO: 149747 - RNA, 22 nt, Human
acacagaugcauuacacaucua

SEQ ID NO: 149748 - RNA, 22 nt, Human
ucucuuaaaggucuucagcuga

SEQ ID NO: 149749 - RNA, 22 nt, Human
acaagaauuuacauguagugga

SEQ ID NO: 149750 - RNA, 22 nt, Human
uggcuagguagcuuucugcugu

SEQ ID NO: 149751 - RNA, 22 nt, Human
gcuggggaggcagcagagaaca

SEQ ID NO: 149752 - RNA, 19 nt, Human
ccugccugagcugucccuc

SEQ ID NO: 149753 - RNA, 22 nt, Human
aauguugaggauaucagaaaau

SEQ ID NO: 149754 - RNA, 22 nt, Human
ccuggcagccucagccaauucu

SEQ ID NO: 149755 - RNA, 22 nt, Human
gcaggcuccaacuggaggaguu

SEQ ID NO: 149756 - RNA, 22 nt, Human
caaauucacaugauugcuucug

SEQ ID NO: 149757 - RNA, 22 nt, Human
ucuguucagguuucagagaacu

SEQ ID NO: 149758 - RNA, 22 nt, Human
cuguggcugcguaggucuggca

SEQ ID NO: 149759 - RNA, 22 nt, Human
cuucugggauuuuugaagacuc

SEQ ID NO: 149760 - RNA, 22 nt, Human
cauuugaaugagauugcuguaa

SEQ ID NO: 149761 - RNA, 22 nt, Human
cuuggcagagggcugggcucag

SEQ ID NO: 149762 - RNA, 22 nt, Human
ucuguucaugaaauaucuuuuu

SEQ ID NO: 149763 - RNA, 22 nt, Human
ugccucucuaacccaugcccaa

SEQ ID NO: 149764 - RNA, 22 nt, Human
agcugccauggccugaauuuac

SEQ ID NO: 149765 - RNA, 22 nt, Human
uuguaugagcuccaggaacuca

SEQ ID NO: 149766 - RNA, 22 nt, Human
acaggcucacagucauuucauu

SEQ ID NO: 149767 - RNA, 22 nt, Human
caaauucagaaaauugguagag

SEQ ID NO: 149768 - RNA, 22 nt, Human
uccaaguccauuaugguggucu

SEQ ID NO: 149769 - RNA, 22 nt, Human
acuggcagaauugaauaguugu

SEQ ID NO: 149770 - RNA, 22 nt, Human
cuugaaucuggcuuugccacuu

SEQ ID NO: 149771 - RNA, 22 nt, Human
ucuggcagguucccauguuaug

SEQ ID NO: 149772 - RNA, 22 nt, Human
cccugagcgugaggaggaagua

SEQ ID NO: 149773 - RNA, 22 nt, Human
ucuguucauacagaguauagua

SEQ ID NO: 149774 - RNA, 22 nt, Human
ccaggcucagggcagacuuuca

SEQ ID NO: 149775 - RNA, 22 nt, Human
ccugggcucugaggagggaguc

SEQ ID NO: 149776 - RNA, 22 nt, Human
aagugugggaaguugcuaaaau

SEQ ID NO: 149777 - RNA, 19 nt, Human
acuggcagggcugcggugg

SEQ ID NO: 149778 - RNA, 22 nt, Human
uucccacaguguugaauccucu

SEQ ID NO: 149779 - RNA, 22 nt, Human
uccugagccugacaaucaccau

SEQ ID NO: 149780 - RNA, 22 nt, Human
gcacauacugcaaagauuacua

SEQ ID NO: 149781 - RNA, 22 nt, Human
uauuuagaaugcguguacgugu

SEQ ID NO: 149782 - RNA, 22 nt, Human
uucacaaaacacuauuuucugg

SEQ ID NO: 149783 - RNA, 22 nt, Human
uauucccauuccacuuaucaag

SEQ ID NO: 149784 - RNA, 22 nt, Human
uauuccuauggccacugcuacu

SEQ ID NO: 149785 - RNA, 22 nt, Human
augaccagccgagauaaacaga

SEQ ID NO: 149786 - RNA, 22 nt, Human
uggcagugguaccggcucucag

SEQ ID NO: 149787 - RNA, 22 nt, Human
gauggcagguaguggucucauc

SEQ ID NO: 149788 - RNA, 22 nt, Human
ggcaggcuugauauggggggac

SEQ ID NO: 149789 - RNA, 20 nt, Human
agccugccagcuggcccaga

SEQ ID NO: 149790 - RNA, 22 nt, Human
ucuggggaccauggcaucuaaa

SEQ ID NO: 149791 - RNA, 22 nt, Human
acugggcuguuuuuugagugga

SEQ ID NO: 149792 - RNA, 22 nt, Human
ucccagccaggcucuaccacuu

SEQ ID NO: 149793 - RNA, 22 nt, Human
acagguggccccgagggagugg

SEQ ID NO: 149794 - RNA, 22 nt, Human
ggggucccugcaccagcauguc

SEQ ID NO: 149795 - RNA, 22 nt, Human
gacacagagcucacagucuccu

SEQ ID NO: 149796 - RNA, 22 nt, Human
ugggcuuccuggagccugugcu

SEQ ID NO: 149797 - RNA, 20 nt, Human
gccucagccaacccaugggg

SEQ ID NO: 149798 - RNA, 22 nt, Human
cuugaauccaaaugggagauga

SEQ ID NO: 149799 - RNA, 20 nt, Human
agacaaaaugacuucaugca

SEQ ID NO: 149800 - RNA, 22 nt, Human
gggcugacauauuuggugcucu

SEQ ID NO: 149801 - RNA, 22 nt, Human
auugaaucugcacuaguauuuu

SEQ ID NO: 149802 - RNA, 22 nt, Human
aaaugcuacauacacaucaggg

SEQ ID NO: 149803 - RNA, 22 nt, Human
ugcuucuggcuuaucucgugcc

SEQ ID NO: 149804 - RNA, 22 nt, Human
uaugaaaagguggccaauguag

SEQ ID NO: 149805 - RNA, 22 nt, Human
cugccugcugcccuccagagcc

SEQ ID NO: 149806 - RNA, 22 nt, Human
gccuggcauauaguaguugugc

SEQ ID NO: 149807 - RNA, 22 nt, Human
gucaaauauacuaagagguaaa

SEQ ID NO: 149808 - RNA, 22 nt, Human
aauucuauaggcaagcuauuuu

SEQ ID NO: 149809 - RNA, 22 nt, Human
ugcuucuguauugaaauuguua

SEQ ID NO: 149810 - RNA, 22 nt, Human
aucacagagcucccuuccacug

SEQ ID NO: 149811 - RNA, 22 nt, Human
cuucuggguauuccagauaccu

SEQ ID NO: 149812 - RNA, 23 nt, Human
acuccccagucucuucuugccaa

SEQ ID NO: 149813 - RNA, 22 nt, Human
ugaaaucaauugcaauguuuau

SEQ ID NO: 149814 - RNA, 22 nt, Human
acagaguccuagcugcaaagaa

SEQ ID NO: 149815 - RNA, 22 nt, Human
uccaggaggaggaaggcugcca

SEQ ID NO: 149816 - RNA, 22 nt, Human
uuggagagauuuaggucucagu

SEQ ID NO: 149817 - RNA, 22 nt, Human
ugaagcuuuccuguggucagga

SEQ ID NO: 149818 - RNA, 22 nt, Human
uccccacacuuucacuccuggc

SEQ ID NO: 149819 - RNA, 22 nt, Human
gccaagcuuauaugaugcuuga

SEQ ID NO: 149820 - RNA, 23 nt, Human
ucuuuucaaugguucuuuaugug

SEQ ID NO: 149821 - RNA, 22 nt, Human
cuugggaggagaacaaagcucc

SEQ ID NO: 149822 - RNA, 22 nt, Human
aggcuccauaccaucuccggag

SEQ ID NO: 149823 - RNA, 22 nt, Human
guggccagccagggugcugaug

SEQ ID NO: 149824 - RNA, 23 nt, Human
acugggcuuaugaggaggcuugu

SEQ ID NO: 149825 - RNA, 21 nt, Human
acaggcucuggggaugcuggg

SEQ ID NO: 149826 - RNA, 22 nt, Human
aggugaguccugggcacaggua

SEQ ID NO: 149827 - RNA, 22 nt, Human
uaguuucagcuccuucauccug

SEQ ID NO: 149828 - RNA, 20 nt, Human
gcaggcuccgggcuugggag

SEQ ID NO: 149829 - RNA, 22 nt, Human
cuucuggguaauucuucuucau

SEQ ID NO: 149830 - RNA, 22 nt, Human
aaacagcuaauggccaggaaua

SEQ ID NO: 149831 - RNA, 19 nt, Human
ccuguucaugacucugucc

SEQ ID NO: 149832 - RNA, 22 nt, Human
agcaggcugcuggcguugaagu

SEQ ID NO: 149833 - RNA, 22 nt, Human
gccuccuggaagucacauguuu

SEQ ID NO: 149834 - RNA, 22 nt, Human
agaggcuucucggauggggcag

SEQ ID NO: 149835 - RNA, 22 nt, Human
cugcaggagcaaagccucugcu

SEQ ID NO: 149836 - RNA, 22 nt, Human
ggccucucugagagcagacguu

SEQ ID NO: 149837 - RNA, 22 nt, Human
ccucuccuugcacccgucccgc

SEQ ID NO: 149838 - RNA, 22 nt, Human
gagugaugucuguagugaagaa

SEQ ID NO: 149839 - RNA, 22 nt, Human
guuucaaauagguuucagcaaa

SEQ ID NO: 149840 - RNA, 22 nt, Human
ccugggcuguaccugugcgcgg

SEQ ID NO: 149841 - RNA, 22 nt, Human
gcuggcagaagagcugguucaa

SEQ ID NO: 149842 - RNA, 22 nt, Human
augaguugaagcuacaagaggc

SEQ ID NO: 149843 - RNA, 22 nt, Human
ggcaggcuccguguuccauucc

SEQ ID NO: 149844 - RNA, 22 nt, Human
uuccaggcuauccggugaaggg

SEQ ID NO: 149845 - RNA, 22 nt, Human
aacuuucagaauccuaugcauu

SEQ ID NO: 149846 - RNA, 22 nt, Human
ugcuucuggaguaacaggguga

SEQ ID NO: 149847 - RNA, 22 nt, Human
ccugggcuggaguacagcagug

SEQ ID NO: 149848 - RNA, 22 nt, Human
ucccuccuggccgucaccgcug

SEQ ID NO: 149849 - RNA, 22 nt, Human
ucuggcagcagcaucaguggcu

SEQ ID NO: 149850 - RNA, 22 nt, Human
guggccaggccgacugccaggc

SEQ ID NO: 149851 - RNA, 22 nt, Human
uuuccuaagguagugauaauuu

SEQ ID NO: 149852 - RNA, 22 nt, Human
gcucugagaggaugcugagcag

SEQ ID NO: 149853 - RNA, 22 nt, Human
gcuccaggagagggaagcagau

SEQ ID NO: 149854 - RNA, 19 nt, Human
gggaccugacuaauuggca

SEQ ID NO: 149855 - RNA, 22 nt, Human
acuccaggcaucugcuucugcu

SEQ ID NO: 149856 - RNA, 22 nt, Human
gggcugaccaaugccuugcuuu

SEQ ID NO: 149857 - RNA, 22 nt, Human
gaaagaagcuuuagauggcuau

SEQ ID NO: 149858 - RNA, 22 nt, Human
uccuggcagugcuuguuuugga

SEQ ID NO: 149859 - RNA, 22 nt, Human
uuggcuucuugugaaaucugag

SEQ ID NO: 149860 - RNA, 22 nt, Human
ggaggugggcuaaggacucucu

SEQ ID NO: 149861 - RNA, 22 nt, Human
ccuggcagucaggggaguccuu

SEQ ID NO: 149862 - RNA, 22 nt, Human
aauagauacuacuuagauguag

SEQ ID NO: 149863 - RNA, 19 nt, Human
guccuggcgccgccacacc

SEQ ID NO: 149864 - RNA, 22 nt, Human
cacacacugacaccuuaucuug

SEQ ID NO: 149865 - RNA, 22 nt, Human
uuugaacugauaaucuucuguu

SEQ ID NO: 149866 - RNA, 22 nt, Human
cugggcugcaggaguggggcaa

SEQ ID NO: 149867 - RNA, 19 nt, Human
guccucucaacaacccggg

SEQ ID NO: 149868 - RNA, 22 nt, Human
ucaucacaauuuuaugacccuc

SEQ ID NO: 149869 - RNA, 22 nt, Human
gcuggggagggcgucaaggcca

SEQ ID NO: 149870 - RNA, 22 nt, Human
cacauacuuguguguacauaug

SEQ ID NO: 149871 - RNA, 22 nt, Human
gcuccuggguguggcugccccu

SEQ ID NO: 149872 - RNA, 22 nt, Human
guccucugggcagcugccccac

SEQ ID NO: 149873 - RNA, 22 nt, Human
ccaucuccaaauaccaucacau

SEQ ID NO: 149874 - RNA, 22 nt, Human
uguaaagaaagacgcagaguua

SEQ ID NO: 149875 - RNA, 22 nt, Human
agcacaggaccaaggaagcugu

SEQ ID NO: 149876 - RNA, 22 nt, Human
uggcuaggaauccaugacucuc

SEQ ID NO: 149877 - RNA, 22 nt, Human
agcaggcuaggaaccucacugc

SEQ ID NO: 149878 - RNA, 20 nt, Human
ucuguucaaaucuuaguucc

SEQ ID NO: 149879 - RNA, 22 nt, Human
ugcucugcacaucccucacaaa

SEQ ID NO: 149880 - RNA, 22 nt, Human
ucuguucauaguaguguauaug

SEQ ID NO: 149881 - RNA, 22 nt, Human
cugccucuauaggaguccacca

SEQ ID NO: 149882 - RNA, 22 nt, Human
cacuguccaugcuugcuaaccc

SEQ ID NO: 149883 - RNA, 22 nt, Human
uggcagagagagugcagucgac

SEQ ID NO: 149884 - RNA, 22 nt, Human
ccuguucaaugcccuggcuuca

SEQ ID NO: 149885 - RNA, 22 nt, Human
cugggcuuugguacugugauua

SEQ ID NO: 149886 - RNA, 22 nt, Human
agaggcuuggccucaguucugu

SEQ ID NO: 149887 - RNA, 22 nt, Human
aacagcaugcuggguaacauug

SEQ ID NO: 149888 - RNA, 22 nt, Human
guuagaauaaaaggucagagag

SEQ ID NO: 149889 - RNA, 22 nt, Human
cacaauguauauguauaucaaa

SEQ ID NO: 149890 - RNA, 22 nt, Human
uuguaugaucccauuuagugaa

SEQ ID NO: 149891 - RNA, 22 nt, Human
cucuccagaauaugccgccgug

SEQ ID NO: 149892 - RNA, 22 nt, Human
cagcccaggccgacaguuccuc

SEQ ID NO: 149893 - RNA, 22 nt, Human
ggcuuugguagacacagauuga

SEQ ID NO: 149894 - RNA, 22 nt, Human
gcuucuggagucuucagaggaa

SEQ ID NO: 149895 - RNA, 22 nt, Human
auugacuuccauagcuaccugg

SEQ ID NO: 149896 - RNA, 22 nt, Human
ccuggcagguuacaaccaguua

SEQ ID NO: 149897 - RNA, 22 nt, Human
ucugggcuuuguaaugggaggu

SEQ ID NO: 149898 - RNA, 22 nt, Human
gccuggggaacuugauccuguc

SEQ ID NO: 149899 - RNA, 22 nt, Human
uuccaggaggagguacuagagg

SEQ ID NO: 149900 - RNA, 22 nt, Human
ccuccagcgcgauccacuccgg

SEQ ID NO: 149901 - RNA, 22 nt, Human
ggcugcaggcagaggcugucug

SEQ ID NO: 149902 - RNA, 22 nt, Human
acuggagcugagagcaugggua

SEQ ID NO: 149903 - RNA, 22 nt, Human
ggggaccuggccacccauccuu

SEQ ID NO: 149904 - RNA, 22 nt, Human
ucagcucuguguacaguuagca

SEQ ID NO: 149905 - RNA, 22 nt, Human
cuguaugaaauugucauuuuua

SEQ ID NO: 149906 - RNA, 23 nt, Human
uguggcugagaaauugacaacuu

SEQ ID NO: 149907 - RNA, 22 nt, Human
acaggugguaaaauggacuguc

SEQ ID NO: 149908 - RNA, 20 nt, Human
gcuccccuucucugggccuc

SEQ ID NO: 149909 - RNA, 22 nt, Human
gggcugacuccuauuggaugaa

SEQ ID NO: 149910 - RNA, 22 nt, Human
ucuggggcaguuacuggggccu

SEQ ID NO: 149911 - RNA, 22 nt, Human
ccugggcuugguuguugagaac

SEQ ID NO: 149912 - RNA, 22 nt, Human
gaggcugcggggaggagccugc

SEQ ID NO: 149913 - RNA, 22 nt, Human
aaugaagcaagcugcuguguuu

SEQ ID NO: 149914 - RNA, 22 nt, Human
gaggacucugggcguguauggg

SEQ ID NO: 149915 - RNA, 22 nt, Human
uccacacacauuucuaugugca

SEQ ID NO: 149916 - RNA, 22 nt, Human
cagcacaggucaguuuuuuaag

SEQ ID NO: 149917 - RNA, 22 nt, Human
ugaacacugccauauuuaagaa

SEQ ID NO: 149918 - RNA, 18 nt, Human
cccucuugcacaaagcaa

SEQ ID NO: 149919 - RNA, 17 nt, Human
cucugggcagccugggg

SEQ ID NO: 149920 - RNA, 22 nt, Human
gccccacagccugcggucucag

SEQ ID NO: 149921 - RNA, 22 nt, Human
ccagcucucaaggcucccuggg

SEQ ID NO: 149922 - RNA, 22 nt, Human
gcuggggagaauuggguuaucu

SEQ ID NO: 149923 - RNA, 22 nt, Human
gcucugagacaguagagauggc

SEQ ID NO: 149924 - RNA, 22 nt, Human
auguaugaugcuaggcucucag

SEQ ID NO: 149925 - RNA, 20 nt, Human
augggcugguuaggaagugu

SEQ ID NO: 149926 - RNA, 21 nt, Human
uccugccuuaguccagagcag

SEQ ID NO: 149927 - RNA, 22 nt, Human
ucaggauggagggaagcacaga

SEQ ID NO: 149928 - RNA, 22 nt, Human
cugaaccacuaauauuuugauu

SEQ ID NO: 149929 - RNA, 22 nt, Human
cacuggaauauggcguugaacc

SEQ ID NO: 149930 - RNA, 22 nt, Human
ccuggcagcagcacaugccuuc

SEQ ID NO: 149931 - RNA, 22 nt, Human
uccccaccccagaacuacuagg

SEQ ID NO: 149932 - RNA, 22 nt, Human
ggaggacacuggcucugccuuc

SEQ ID NO: 149933 - RNA, 22 nt, Human
gaaguuuauuucaaucuauuca

SEQ ID NO: 149934 - RNA, 22 nt, Human
ucugcagaaggaaucagcugag

SEQ ID NO: 149935 - RNA, 22 nt, Human
ccugggcuuucggcggcuuccu

SEQ ID NO: 149936 - RNA, 22 nt, Human
acacucucagcuuuucaacuua

SEQ ID NO: 149937 - RNA, 22 nt, Human
ccugggcucugucagaauuggg

SEQ ID NO: 149938 - RNA, 22 nt, Human
cucugguuucgcaggaaauaga

SEQ ID NO: 149939 - RNA, 22 nt, Human
uucugggggaauacagcuauga

SEQ ID NO: 149940 - RNA, 22 nt, Human
cauauucuuuaagcaaugcucu

SEQ ID NO: 149941 - RNA, 22 nt, Human
gggacccagguaauccugugcu

SEQ ID NO: 149942 - RNA, 22 nt, Human
uuaaaacugcaaauccuacuga

SEQ ID NO: 149943 - RNA, 22 nt, Human
acacacucaauugcauaagcac

SEQ ID NO: 149944 - RNA, 22 nt, Human
gggcaaaaccugggcaucauga

SEQ ID NO: 149945 - RNA, 22 nt, Human
acuccugggugcugaccagcgu

SEQ ID NO: 149946 - RNA, 22 nt, Human
cuuccucuagccuaguaaugcc

SEQ ID NO: 149947 - RNA, 22 nt, Human
ugucaaaaugacuuuacuacag

SEQ ID NO: 149948 - RNA, 22 nt, Human
uaauauuucuacccugcugccu

SEQ ID NO: 149949 - RNA, 22 nt, Human
uccaagcuuuccaugcccucac

SEQ ID NO: 149950 - RNA, 22 nt, Human
gcagcucucuggccugcccugg

SEQ ID NO: 149951 - RNA, 21 nt, Human
ucuggcaguggucuuucaaau

SEQ ID NO: 149952 - RNA, 22 nt, Human
ucuggcagugauuucugugauc

SEQ ID NO: 149953 - RNA, 22 nt, Human
ccuggcagcuccguggccuucc

SEQ ID NO: 149954 - RNA, 22 nt, Human
aagauuuagggccaguuuacau

SEQ ID NO: 149955 - RNA, 22 nt, Human
cacauuccuggugcucagcagc

SEQ ID NO: 149956 - RNA, 22 nt, Human
cccagcccccgagugucuggaa

SEQ ID NO: 149957 - RNA, 19 nt, Human
ccagucccauacaggagau

SEQ ID NO: 149958 - RNA, 22 nt, Human
acuggcagccacaacuggcagg

SEQ ID NO: 149959 - RNA, 22 nt, Human
cuucaguucuaaaguagaaugu

SEQ ID NO: 149960 - RNA, 22 nt, Human
agggcugaagggaggugcucau

SEQ ID NO: 149961 - RNA, 18 nt, Human
aguuccuuaaauuggugu

SEQ ID NO: 149962 - RNA, 21 nt, Human
ucuggggaagacaucuaggau

SEQ ID NO: 149963 - RNA, 22 nt, Human
guccucuguuagaaaugugcuu

SEQ ID NO: 149964 - RNA, 19 nt, Human
aaaugugaugguacaauuc

SEQ ID NO: 149965 - RNA, 22 nt, Human
uuccaggaggcacugacagagg

SEQ ID NO: 149966 - RNA, 22 nt, Human
ugcaggcugcagucucaggugg

SEQ ID NO: 149967 - RNA, 22 nt, Human
ugcuucugcuuuacuugguuca

SEQ ID NO: 149968 - RNA, 22 nt, Human
uucuuguauguaugcaaaauca

SEQ ID NO: 149969 - RNA, 22 nt, Human
ccacaaaacugugugucaaaga

SEQ ID NO: 149970 - RNA, 22 nt, Human
ggcggguguaaguaggacagcg

SEQ ID NO: 149971 - RNA, 17 nt, Human
gcuucuggagcuucugu

SEQ ID NO: 149972 - RNA, 22 nt, Human
acuguucaucucuuagaaagua

SEQ ID NO: 149973 - RNA, 22 nt, Human
ccuggcagggcugcaguaaugg

SEQ ID NO: 149974 - RNA, 22 nt, Human
aauaauuuuagcucagaguugu

SEQ ID NO: 149975 - RNA, 22 nt, Human
cuguggcuucugcuugggccuc

SEQ ID NO: 149976 - RNA, 22 nt, Human
ccuccuggcuuuucccauugaa

SEQ ID NO: 149977 - RNA, 22 nt, Human
ggcaggcucuuggccuuaugag

SEQ ID NO: 149978 - RNA, 22 nt, Human
guccucugacucagccuuggga

SEQ ID NO: 149979 - RNA, 22 nt, Human
uucauugcaguucuucagguua

SEQ ID NO: 149980 - RNA, 22 nt, Human
uggccagguugggcuuugcagc

SEQ ID NO: 149981 - RNA, 22 nt, Human
ucauggcacuuagcacaguccu

SEQ ID NO: 149982 - RNA, 22 nt, Human
guacacacuauguauuguacac

SEQ ID NO: 149983 - RNA, 22 nt, Human
ucuggcagagucagugcacaca

SEQ ID NO: 149984 - RNA, 22 nt, Human
gugugagggacagagaaagggg

SEQ ID NO: 149985 - RNA, 22 nt, Human
aaacagauaaugcuauaaaugg

SEQ ID NO: 149986 - RNA, 22 nt, Human
uacauucccccaauuaccaaug

SEQ ID NO: 149987 - RNA, 22 nt, Human
cuccaaguccgagggcucucaa

SEQ ID NO: 149988 - RNA, 22 nt, Human
cuggcaggagcauucacagagg

SEQ ID NO: 149989 - RNA, 22 nt, Human
uggcaguggcucagagugcaga

SEQ ID NO: 149990 - RNA, 22 nt, Human
cucucuggaagggggagcugau

SEQ ID NO: 149991 - RNA, 22 nt, Human
agaggccuccgaaaggugggcu

SEQ ID NO: 149992 - RNA, 22 nt, Human
uucucuuuuagaggcuccauga

SEQ ID NO: 149993 - RNA, 22 nt, Human
accugccuauggagccacaugg

SEQ ID NO: 149994 - RNA, 22 nt, Human
gcuggcaggauagaagucuaau

SEQ ID NO: 149995 - RNA, 22 nt, Human
acaggcucuggggcaggauggc

SEQ ID NO: 149996 - RNA, 22 nt, Human
gcuggcagcuggaaguugggcu

SEQ ID NO: 149997 - RNA, 22 nt, Human
ggcccagccucagacaugcccu

SEQ ID NO: 149998 - RNA, 22 nt, Human
ccaccccaaaugaagaccucuc

SEQ ID NO: 149999 - RNA, 22 nt, Human
guuugaaugcaguaugcauuuu

SEQ ID NO: 150000 - RNA, 22 nt, Human
aguaaaaucaccaucucuuugu

SEQ ID NO: 150001 - RNA, 16 nt, Human
gcagggguggguggag

SEQ ID NO: 150002 - RNA, 22 nt, Human
gaggagcuggcagcgucuccgc

SEQ ID NO: 150003 - RNA, 22 nt, Human
uggaaagaggaagugcccagca

SEQ ID NO: 150004 - RNA, 18 nt, Human
cuccagggaacucaguca

SEQ ID NO: 150005 - RNA, 22 nt, Human
ucuggcaggcaaucggcucugg

SEQ ID NO: 150006 - RNA, 22 nt, Human
cagacagagucuucccaucagu

SEQ ID NO: 150007 - RNA, 22 nt, Human
ggccucagagaaggcugugcgg

SEQ ID NO: 150008 - RNA, 22 nt, Human
caggucuguuuccaucagugcu

SEQ ID NO: 150009 - RNA, 22 nt, Human
auaaugaggauuugcauauuag

SEQ ID NO: 150010 - RNA, 22 nt, Human
agaauucugacaauagaauugg

SEQ ID NO: 150011 - RNA, 22 nt, Human
uuauuccauucaguucaacaag

SEQ ID NO: 150012 - RNA, 15 nt, Human
ccaggcucugcacuc

SEQ ID NO: 150013 - RNA, 22 nt, Human
uuccuggcucacagcagugggg

SEQ ID NO: 150014 - RNA, 22 nt, Human
gacaguuuuuaauccuuucaug

SEQ ID NO: 150015 - RNA, 22 nt, Human
ccauacacacaccaaauuugua

SEQ ID NO: 150016 - RNA, 22 nt, Human
uggccugccacugccacgccac

SEQ ID NO: 150017 - RNA, 22 nt, Human
ccuguucacccuccaugcacag

SEQ ID NO: 150018 - RNA, 22 nt, Human
uccuggcauccgugggucugug

SEQ ID NO: 150019 - RNA, 22 nt, Human
ccacccuaacaauccuuacugu

SEQ ID NO: 150020 - RNA, 22 nt, Human
gggcugcaaugcuucaguuguu

SEQ ID NO: 150021 - RNA, 22 nt, Human
ugagagcacacagaaauauuuu

SEQ ID NO: 150022 - RNA, 22 nt, Human
uggcacagggcuuggucgcuca

SEQ ID NO: 150023 - RNA, 22 nt, Human
acauuuaaauaccuauguuucu

SEQ ID NO: 150024 - RNA, 22 nt, Human
gcuggcagugugaaugacaagc

SEQ ID NO: 150025 - RNA, 22 nt, Human
gaauauuuucaguacagauggu

SEQ ID NO: 150026 - RNA, 23 nt, Human
ccagcccuccaccagcucuaggc

SEQ ID NO: 150027 - RNA, 22 nt, Human
gcuucuggcagugcagccacca

SEQ ID NO: 150028 - RNA, 22 nt, Human
cauguugaauggccuugauuuu

SEQ ID NO: 150029 - RNA, 22 nt, Human
ugcuucugggucccagccuggc

SEQ ID NO: 150030 - RNA, 22 nt, Human
ccagugcccagcugcccaggca

SEQ ID NO: 150031 - RNA, 22 nt, Human
ucuggcaguggaugagggcagc

SEQ ID NO: 150032 - RNA, 22 nt, Human
uuacauaacgguaugaaaaaug

SEQ ID NO: 150033 - RNA, 22 nt, Human
ccugggcugcaugauggcauuu

SEQ ID NO: 150034 - RNA, 22 nt, Human
acacauuugcauaauaccucau

SEQ ID NO: 150035 - RNA, 22 nt, Human
acacacaugccuuuccuaagua

SEQ ID NO: 150036 - RNA, 22 nt, Human
cuaugagaagaaaacaagauua

SEQ ID NO: 150037 - RNA, 20 nt, Human
ucacacaugguaagcuauga

SEQ ID NO: 150038 - RNA, 22 nt, Human
uuugaacuucuccauucugaug

SEQ ID NO: 150039 - RNA, 22 nt, Human
ucaucacauaugucaugauuug

SEQ ID NO: 150040 - RNA, 22 nt, Human
ccuggcagcauugguagagauu

SEQ ID NO: 150041 - RNA, 22 nt, Human
ccugggcugcucauggggauga

SEQ ID NO: 150042 - RNA, 22 nt, Human
auaugaagaauuccaauuugga

SEQ ID NO: 150043 - RNA, 22 nt, Human
auacacacugcuauccuuuuuu

SEQ ID NO: 150044 - RNA, 22 nt, Human
aggcuuuggaaucagaguucug

SEQ ID NO: 150045 - RNA, 22 nt, Human
uauauucaaugauuaguaucag

SEQ ID NO: 150046 - RNA, 21 nt, Human
caugaagccgguucccuguuu

SEQ ID NO: 150047 - RNA, 22 nt, Human
gccuccuggccuuugcuccuca

SEQ ID NO: 150048 - RNA, 21 nt, Human
aagaaguuuggauuuuguccu

SEQ ID NO: 150049 - RNA, 22 nt, Human
guugggaagcagauggaugagc

SEQ ID NO: 150050 - RNA, 23 nt, Human
cucccuggcccuugggagaccug

SEQ ID NO: 150051 - RNA, 22 nt, Human
gcuaggaaucggacccaggaag

SEQ ID NO: 150052 - RNA, 22 nt, Human
uaaguucauaagcuuauucuua

SEQ ID NO: 150053 - RNA, 22 nt, Human
uggcagagucaucacaucugga

SEQ ID NO: 150054 - RNA, 22 nt, Human
gaggggucacaugggcuggcuu

SEQ ID NO: 150055 - RNA, 22 nt, Human
ucuggcaguaauaggggagaga

SEQ ID NO: 150056 - RNA, 22 nt, Human
uuccuggccuaagguaggugac

SEQ ID NO: 150057 - RNA, 22 nt, Human
ucacuguagugagcagaauaua

SEQ ID NO: 150058 - RNA, 22 nt, Human
uaugaagcucucacuguguguc

SEQ ID NO: 150059 - RNA, 22 nt, Human
gcuggggagcaagaguagugag

SEQ ID NO: 150060 - RNA, 20 nt, Human
uauaaauucagagcuuuggu

SEQ ID NO: 150061 - RNA, 22 nt, Human
ccaggccucuggcugcuuaguc

SEQ ID NO: 150062 - RNA, 22 nt, Human
ucugggcuuuugcacuggccau

SEQ ID NO: 150063 - RNA, 22 nt, Human
uauuugaagauucuucugaugu

SEQ ID NO: 150064 - RNA, 22 nt, Human
aacacauauuuauauaugcaca

SEQ ID NO: 150065 - RNA, 22 nt, Human
cagucucuuuauccaccaagcc

SEQ ID NO: 150066 - RNA, 22 nt, Human
ccagguccuguuuucaccacag

SEQ ID NO: 150067 - RNA, 22 nt, Human
uucccacagagauuacauugaa

SEQ ID NO: 150068 - RNA, 22 nt, Human
acuuguucauugaguacauaug

SEQ ID NO: 150069 - RNA, 22 nt, Human
ggcuccaagucucagagugaag

SEQ ID NO: 150070 - RNA, 22 nt, Human
ucuggggaauguucauuucuga

SEQ ID NO: 150071 - RNA, 23 nt, Human
ggacacauuuauuucagaauuca

SEQ ID NO: 150072 - RNA, 22 nt, Human
uggccaggcuggucuggaacgc

SEQ ID NO: 150073 - RNA, 22 nt, Human
uccuucccaggugucgccgccu

SEQ ID NO: 150074 - RNA, 22 nt, Human
ccuuccagaguucagucugccc

SEQ ID NO: 150075 - RNA, 22 nt, Human
agccaccuucuccaaggccuag

SEQ ID NO: 150076 - RNA, 22 nt, Human
ccacuguagagauuugaaugcc

SEQ ID NO: 150077 - RNA, 22 nt, Human
ucccagccuuccagucugguuu

SEQ ID NO: 150078 - RNA, 21 nt, Human
ccacuguagacucauucugag

SEQ ID NO: 150079 - RNA, 22 nt, Human
gcucacagccggcuggcagggg

SEQ ID NO: 150080 - RNA, 22 nt, Human
caaauacuaaacauaagauuuu

SEQ ID NO: 150081 - RNA, 22 nt, Human
cagggcuccccagagagccucu

SEQ ID NO: 150082 - RNA, 22 nt, Human
augggcugggaauacacagggg

SEQ ID NO: 150083 - RNA, 22 nt, Human
ugggccaggcaugugaucagca

SEQ ID NO: 150084 - RNA, 22 nt, Human
uaauuucaccguugcuagaaau

SEQ ID NO: 150085 - RNA, 22 nt, Human
gucacacagggccuccaaauca

SEQ ID NO: 150086 - RNA, 22 nt, Human
gcugggcuucucaaugcugccu

SEQ ID NO: 150087 - RNA, 22 nt, Human
ugcuucugaguugcaggacuug

SEQ ID NO: 150088 - RNA, 22 nt, Human
auuucaguagaaaaucuugauu

SEQ ID NO: 150089 - RNA, 22 nt, Human
uggguaggaccagaaaugcacu

SEQ ID NO: 150090 - RNA, 22 nt, Human
guuuaagaggguuucauuccca

SEQ ID NO: 150091 - RNA, 22 nt, Human
gcugucugccgcaggcugccac

SEQ ID NO: 150092 - RNA, 20 nt, Human
aagauucauuguaauuaggg

SEQ ID NO: 150093 - RNA, 22 nt, Human
gcuccaggugucccagguaaaa

SEQ ID NO: 150094 - RNA, 22 nt, Human
ccugggcuuuggaacaguacuu

SEQ ID NO: 150095 - RNA, 22 nt, Human
gacacauagaucuaucucacuc

SEQ ID NO: 150096 - RNA, 22 nt, Human
ucccacacagcccgcucaccgg

SEQ ID NO: 150097 - RNA, 22 nt, Human
auauaguuggguuucauucuac

SEQ ID NO: 150098 - RNA, 22 nt, Human
ugcaggcucugugugugccugg

SEQ ID NO: 150099 - RNA, 22 nt, Human
aggcuuuggggcauucuguguu

SEQ ID NO: 150100 - RNA, 22 nt, Human
uccucuccaugucucacgccac

SEQ ID NO: 150101 - RNA, 22 nt, Human
auuucugugcaguaaaugguga

SEQ ID NO: 150102 - RNA, 22 nt, Human
auuugcauaauagugauuugua

SEQ ID NO: 150103 - RNA, 22 nt, Human
ugagagucuguuccucuugcag

SEQ ID NO: 150104 - RNA, 22 nt, Human
gggcugacgaaggccaugugug

SEQ ID NO: 150105 - RNA, 22 nt, Human
agcugccaaguuucucaguuua

SEQ ID NO: 150106 - RNA, 19 nt, Human
gcuggggaauggauauuga

SEQ ID NO: 150107 - RNA, 22 nt, Human
ugcaggcucucugcugccagau

SEQ ID NO: 150108 - RNA, 22 nt, Human
uuaagacaguguauuuguuuuc

SEQ ID NO: 150109 - RNA, 22 nt, Human
cuggaaagugucuccauccugg

SEQ ID NO: 150110 - RNA, 22 nt, Human
gagacagaguuucacucuuguu

SEQ ID NO: 150111 - RNA, 22 nt, Human
gcacacaguauaugcucauuaa

SEQ ID NO: 150112 - RNA, 22 nt, Human
cacagagacagaagcacuuaug

SEQ ID NO: 150113 - RNA, 22 nt, Human
cuucuggguguggagugaggac

SEQ ID NO: 150114 - RNA, 22 nt, Human
uuucagaaagcaucaucaaagu

SEQ ID NO: 150115 - RNA, 22 nt, Human
aaaucucaggccucuauuuacu

SEQ ID NO: 150116 - RNA, 22 nt, Human
gccaagcucaccuucugaugga

SEQ ID NO: 150117 - RNA, 22 nt, Human
uuccaggcugaugggccacagg

SEQ ID NO: 150118 - RNA, 20 nt, Human
agguuccuuuguggagaauu

SEQ ID NO: 150119 - RNA, 22 nt, Human
ucuggggagucaaagagaccug

SEQ ID NO: 150120 - RNA, 22 nt, Human
ucuggcagugagcaacuugaca

SEQ ID NO: 150121 - RNA, 22 nt, Human
guaugaaggcgagagcccacua

SEQ ID NO: 150122 - RNA, 21 nt, Human
gaugaagcaaucuuucuguug

SEQ ID NO: 150123 - RNA, 22 nt, Human
auuuccaguccuaaugaucugg

SEQ ID NO: 150124 - RNA, 22 nt, Human
caagcucugggauagcagagag

SEQ ID NO: 150125 - RNA, 22 nt, Human
cucuuaaagaauguuccagcug

SEQ ID NO: 150126 - RNA, 22 nt, Human
aauaucaguauauuguaucagu

SEQ ID NO: 150127 - RNA, 22 nt, Human
uucaauaucauuguuuagucuc

SEQ ID NO: 150128 - RNA, 22 nt, Human
uuccuaauggcaaaacauguuu

SEQ ID NO: 150129 - RNA, 22 nt, Human
ucaggcccuucucccaggacuc

SEQ ID NO: 150130 - RNA, 22 nt, Human
acacacacaagcagguugugga

SEQ ID NO: 150131 - RNA, 22 nt, Human
uuccaggaagauucaacaaaag

SEQ ID NO: 150132 - RNA, 22 nt, Human
uuccaggagacuuccagaaaua

SEQ ID NO: 150133 - RNA, 22 nt, Human
acuggcaguggcagcagaaaga

SEQ ID NO: 150134 - RNA, 22 nt, Human
ggagagaauuccauggacaugu

SEQ ID NO: 150135 - RNA, 22 nt, Human
guacacauuaugcuucucuaaa

SEQ ID NO: 150136 - RNA, 19 nt, Human
acauucccaucagcaaugu

SEQ ID NO: 150137 - RNA, 19 nt, Human
aaaagucuauucaauuaca

SEQ ID NO: 150138 - RNA, 22 nt, Human
cacacaucuuaucccaguuauu

SEQ ID NO: 150139 - RNA, 21 nt, Human
ggccucagccaccuggcucug

SEQ ID NO: 150140 - RNA, 22 nt, Human
cuuuccaaugcauuuccaaugu

SEQ ID NO: 150141 - RNA, 22 nt, Human
acacacuguaaggacuaucacu

SEQ ID NO: 150142 - RNA, 22 nt, Human
caggagggcccgagacucuucc

SEQ ID NO: 150143 - RNA, 22 nt, Human
ccuggcagaaagaguuacaccu

SEQ ID NO: 150144 - RNA, 22 nt, Human
gcccucucuucugcagccucca

SEQ ID NO: 150145 - RNA, 22 nt, Human
uaaguucaagucuuggauauaa

SEQ ID NO: 150146 - RNA, 22 nt, Human
cugggcugcuguccacuagggu

SEQ ID NO: 150147 - RNA, 22 nt, Human
ggggcugagaauucagucucgg

SEQ ID NO: 150148 - RNA, 22 nt, Human
ucccagaagugaaauuucuaga

SEQ ID NO: 150149 - RNA, 22 nt, Human
ccacacugucuaacaaggcaua

SEQ ID NO: 150150 - RNA, 22 nt, Human
ucaucacauguguagucauccc

SEQ ID NO: 150151 - RNA, 22 nt, Human
uccuggcagggucuaggucuag

SEQ ID NO: 150152 - RNA, 17 nt, Human
uuaagguggaucagcac

SEQ ID NO: 150153 - RNA, 22 nt, Human
ccucagcugcuucccuggagcc

SEQ ID NO: 150154 - RNA, 22 nt, Human
uugucaaguaaggcugacauuu

SEQ ID NO: 150155 - RNA, 22 nt, Human
aggugaguugguaggaaguuug

SEQ ID NO: 150156 - RNA, 22 nt, Human
gcacauaacugaccacaucuaa

SEQ ID NO: 150157 - RNA, 22 nt, Human
uugggaaguuuaaugacagacu

SEQ ID NO: 150158 - RNA, 18 nt, Human
uccugccugugccccagg

SEQ ID NO: 150159 - RNA, 22 nt, Human
uccaagaugguugguguggugg

SEQ ID NO: 150160 - RNA, 22 nt, Human
cugguggagggacaggcuuagc

SEQ ID NO: 150161 - RNA, 22 nt, Human
ugaccaggauacugcagggaug

SEQ ID NO: 150162 - RNA, 22 nt, Human
gacaauaaaaugaucuuacagu

SEQ ID NO: 150163 - RNA, 22 nt, Human
guacacacuguuugaucauuuc

SEQ ID NO: 150164 - RNA, 22 nt, Human
uuccuuccauagcaaaacaugc

SEQ ID NO: 150165 - RNA, 22 nt, Human
auguggcugguaguugacaacu

SEQ ID NO: 150166 - RNA, 19 nt, Human
uggcagguagugagcaguc

SEQ ID NO: 150167 - RNA, 22 nt, Human
acuguucaaguuuuaugcugga

SEQ ID NO: 150168 - RNA, 20 nt, Human
ccuggcaggcggguuacuua

SEQ ID NO: 150169 - RNA, 23 nt, Human
uccugcugaaagcuccagcuggc

SEQ ID NO: 150170 - RNA, 21 nt, Human
ccuguucacagaucuguaacu

SEQ ID NO: 150171 - RNA, 22 nt, Human
guccucuguuuccaucugacuu

SEQ ID NO: 150172 - RNA, 22 nt, Human
auacauucaaaggaaggauaga

SEQ ID NO: 150173 - RNA, 22 nt, Human
accugccucagugcagcuggau

SEQ ID NO: 150174 - RNA, 23 nt, Human
gcugacugugaaauucuggagcu

SEQ ID NO: 150175 - RNA, 22 nt, Human
acuggggaauggaacugggaau

SEQ ID NO: 150176 - RNA, 22 nt, Human
ggagugugggauggagcucagg

SEQ ID NO: 150177 - RNA, 21 nt, Human
ugcaggcuacuucugacucua

SEQ ID NO: 150178 - RNA, 20 nt, Human
gcucugaccauaucaagaca

SEQ ID NO: 150179 - RNA, 22 nt, Human
gaggguggccuuuagagcccau

SEQ ID NO: 150180 - RNA, 22 nt, Human
uguaauauuguagugacaguac

SEQ ID NO: 150181 - RNA, 22 nt, Human
aauucuagcauugugaaaauau

SEQ ID NO: 150182 - RNA, 22 nt, Human
agcaggcugagcacccaggggg

SEQ ID NO: 150183 - RNA, 22 nt, Human
acaagagcauugcagguguguu

SEQ ID NO: 150184 - RNA, 22 nt, Human
ugucaaaaauaagagagauugu

SEQ ID NO: 150185 - RNA, 22 nt, Human
gcuguucauuagaaauagaaug

SEQ ID NO: 150186 - RNA, 22 nt, Human
agauuccagaucccaaaaauga

SEQ ID NO: 150187 - RNA, 22 nt, Human
gggcuguaggagcuggaauggg

SEQ ID NO: 150188 - RNA, 22 nt, Human
uguuccaauaaggaguugaaau

SEQ ID NO: 150189 - RNA, 22 nt, Human
cccuuccuccucgccugucaga

SEQ ID NO: 150190 - RNA, 22 nt, Human
cucaucaccacauauaacaaag

SEQ ID NO: 150191 - RNA, 22 nt, Human
uccaggcuugagaccaggcucu

SEQ ID NO: 150192 - RNA, 21 nt, Human
ucuggcaggcacgggcccagc

SEQ ID NO: 150193 - RNA, 22 nt, Human
cugggcuuagcagcuccugguc

SEQ ID NO: 150194 - RNA, 22 nt, Human
auuuaagauugcguauucaugu

SEQ ID NO: 150195 - RNA, 22 nt, Human
ugcaggcuauaucuuauuugac

SEQ ID NO: 150196 - RNA, 22 nt, Human
aaaagagucuuaggcagucaua

SEQ ID NO: 150197 - RNA, 22 nt, Human
ccuguucaugaaacugcuuucc

SEQ ID NO: 150198 - RNA, 22 nt, Human
ccaggcucacagcaucccagga

SEQ ID NO: 150199 - RNA, 22 nt, Human
cugccuggccacaacccagggu

SEQ ID NO: 150200 - RNA, 22 nt, Human
ucuggcagcaagauaacaaugg

SEQ ID NO: 150201 - RNA, 22 nt, Human
aagagagaacucccuucgccag

SEQ ID NO: 150202 - RNA, 22 nt, Human
aaagaucaaguaggcauggccu

SEQ ID NO: 150203 - RNA, 23 nt, Human
uuggagagggugaguagugucag

SEQ ID NO: 150204 - RNA, 22 nt, Human
ugcaggcuauccuuugcugcaa

SEQ ID NO: 150205 - RNA, 22 nt, Human
cuccaggcucguccaagaucga

SEQ ID NO: 150206 - RNA, 22 nt, Human
gagcucagccugaggccuggcu

SEQ ID NO: 150207 - RNA, 22 nt, Human
caugaguuuuuuaguucaugca

SEQ ID NO: 150208 - RNA, 22 nt, Human
ccuggcaguucaucaaauggca

SEQ ID NO: 150209 - RNA, 22 nt, Human
ugcuucugcucagcuuccuacu

SEQ ID NO: 150210 - RNA, 22 nt, Human
gagggguccaggaggcacuuac

SEQ ID NO: 150211 - RNA, 22 nt, Human
gugaaaauaaggcugguucuug

SEQ ID NO: 150212 - RNA, 22 nt, Human
cugccugccuuggccuccagga

SEQ ID NO: 150213 - RNA, 22 nt, Human
ugggagaaacugucucucccac

SEQ ID NO: 150214 - RNA, 22 nt, Human
ucuucacagaugcauauacuuc

SEQ ID NO: 150215 - RNA, 22 nt, Human
uagauacaggcucucugagccu

SEQ ID NO: 150216 - RNA, 22 nt, Human
uccuggcaguaauuugauguug

SEQ ID NO: 150217 - RNA, 22 nt, Human
uuuaagagcuaguaugucauuu

SEQ ID NO: 150218 - RNA, 22 nt, Human
ugcucuguauucuauggcaguu

SEQ ID NO: 150219 - RNA, 22 nt, Human
gccuggcaggggccugggagug

SEQ ID NO: 150220 - RNA, 22 nt, Human
ucuguucauuugccucggcucu

SEQ ID NO: 150221 - RNA, 22 nt, Human
uggaacacugaucauugccuuu

SEQ ID NO: 150222 - RNA, 22 nt, Human
ccuguucacugcacaguuuccg

SEQ ID NO: 150223 - RNA, 22 nt, Human
cucugggcaaguuucuucauga

SEQ ID NO: 150224 - RNA, 22 nt, Human
acuggcagagguuggacaccau

SEQ ID NO: 150225 - RNA, 21 nt, Human
cuugggcuuguagauggugga

SEQ ID NO: 150226 - RNA, 22 nt, Human
uuucuguagugugguauguagg

SEQ ID NO: 150227 - RNA, 22 nt, Human
cugguggaggugccaggauuug

SEQ ID NO: 150228 - RNA, 21 nt, Human
uccuguaagcuuggguggcuc

SEQ ID NO: 150229 - RNA, 22 nt, Human
ucuuugaaguugaaguaguugg

SEQ ID NO: 150230 - RNA, 22 nt, Human
aggaaagauggaaggaggauaa

SEQ ID NO: 150231 - RNA, 22 nt, Human
cucugcagauucaucccuucac

SEQ ID NO: 150232 - RNA, 22 nt, Human
agcucccagcuccuuugagaga

SEQ ID NO: 150233 - RNA, 22 nt, Human
ccuggggagccgccugagcccc

SEQ ID NO: 150234 - RNA, 22 nt, Human
agcaggcugccuuccaaagccu

SEQ ID NO: 150235 - RNA, 22 nt, Human
uugggaagaauggaggugguua

SEQ ID NO: 150236 - RNA, 22 nt, Human
auuugaauggcuuaacacaacg

SEQ ID NO: 150237 - RNA, 22 nt, Human
ccugggcuuugcuggcaaggcc

SEQ ID NO: 150238 - RNA, 22 nt, Human
guccucugaaagaugaaccaug

SEQ ID NO: 150239 - RNA, 22 nt, Human
uucucuuuucaccaguugcuaa

SEQ ID NO: 150240 - RNA, 22 nt, Human
ucaggcucccugcugggcucug

SEQ ID NO: 150241 - RNA, 23 nt, Human
uggccaggguacuacacccaccc

SEQ ID NO: 150242 - RNA, 22 nt, Human
ucuaggagcuuaaaggaggcca

SEQ ID NO: 150243 - RNA, 17 nt, Human
gcaucacagauaacacg

SEQ ID NO: 150244 - RNA, 18 nt, Human
agcagguggcgucugcag

SEQ ID NO: 150245 - RNA, 22 nt, Human
acugggcuuaugcuguggagua

SEQ ID NO: 150246 - RNA, 22 nt, Human
uuccuggcgccacggagccggu

SEQ ID NO: 150247 - RNA, 22 nt, Human
aguugaauaauuagacauaucu

SEQ ID NO: 150248 - RNA, 22 nt, Human
uccaagcuacugaagguuuggg

SEQ ID NO: 150249 - RNA, 22 nt, Human
gaggcacagucccgaggcaagg

SEQ ID NO: 150250 - RNA, 20 nt, Human
ugggcugaggaucaggugcc

SEQ ID NO: 150251 - RNA, 22 nt, Human
acuguucauauucuuagaaauu

SEQ ID NO: 150252 - RNA, 22 nt, Human
uacacacuuacuggagaugaag

SEQ ID NO: 150253 - RNA, 22 nt, Human
uuccaaguguugagauuagagg

SEQ ID NO: 150254 - RNA, 22 nt, Human
gcagggguuuucugacuugagu

SEQ ID NO: 150255 - RNA, 22 nt, Human
ccuggcagguggagguugcagu

SEQ ID NO: 150256 - RNA, 22 nt, Human
ccucucccgggugccgcugggc

SEQ ID NO: 150257 - RNA, 22 nt, Human
uugaaucuauguauucagugua

SEQ ID NO: 150258 - RNA, 22 nt, Human
agcucugacugaagagaugcaa

SEQ ID NO: 150259 - RNA, 22 nt, Human
agggccccauagucacugcccg

SEQ ID NO: 150260 - RNA, 22 nt, Human
aaaaucuaaguagcgaguaagg

SEQ ID NO: 150261 - RNA, 22 nt, Human
acaaaauuguguuaaacuuuau

SEQ ID NO: 150262 - RNA, 22 nt, Human
ucuggcagaggaaggaggccug

SEQ ID NO: 150263 - RNA, 22 nt, Human
cccugagcucaggcccuugggg

SEQ ID NO: 150264 - RNA, 22 nt, Human
ggcaggcugggugucauggagu

SEQ ID NO: 150265 - RNA, 22 nt, Human
uccugagcccuguaggacccug

SEQ ID NO: 150266 - RNA, 22 nt, Human
uuaaauuauuucuagugaggug

SEQ ID NO: 150267 - RNA, 22 nt, Human
uauuuaauuagugauuguagag

SEQ ID NO: 150268 - RNA, 22 nt, Human
uuuaagacuuagauuuauuggg

SEQ ID NO: 150269 - RNA, 22 nt, Human
ccaggcucugcaaaaucaggcu

SEQ ID NO: 150270 - RNA, 22 nt, Human
guggcagugggaugcuaucagg

SEQ ID NO: 150271 - RNA, 22 nt, Human
aaugaagcaguuuucaucaagu

SEQ ID NO: 150272 - RNA, 22 nt, Human
uccugagcacagagacaaggaa

SEQ ID NO: 150273 - RNA, 22 nt, Human
gcaggcuccaaggccugggaga

SEQ ID NO: 150274 - RNA, 22 nt, Human
uucuuucaauagcuggcauaug

SEQ ID NO: 150275 - RNA, 22 nt, Human
ucaugaaucguggaaugauuua

SEQ ID NO: 150276 - RNA, 18 nt, Human
gaugaagcugcuggggau

SEQ ID NO: 150277 - RNA, 22 nt, Human
cuuacacagucuggcacuucuu

SEQ ID NO: 150278 - RNA, 22 nt, Human
uguuucaugauugcugucauuu

SEQ ID NO: 150279 - RNA, 22 nt, Human
ucuguucaucucaugggagaau

SEQ ID NO: 150280 - RNA, 22 nt, Human
agacacauaggaccacacugug

SEQ ID NO: 150281 - RNA, 22 nt, Human
gguggcagaggugcaucagccc

SEQ ID NO: 150282 - RNA, 22 nt, Human
ucccacauuacccugacugaca

SEQ ID NO: 150283 - RNA, 22 nt, Human
ggccucagugggccgcugcagg

SEQ ID NO: 150284 - RNA, 22 nt, Human
gaugaagcuaaaucuaagguuu

SEQ ID NO: 150285 - RNA, 22 nt, Human
aggccucugcuggaaagaguug

SEQ ID NO: 150286 - RNA, 20 nt, Human
aaaaucucccagaaacuuau

SEQ ID NO: 150287 - RNA, 22 nt, Human
uuaggaauauuuucugaguagu

SEQ ID NO: 150288 - RNA, 22 nt, Human
agcccaggucuggcccagccug

SEQ ID NO: 150289 - RNA, 22 nt, Human
gggcugacaaccaucugacaag

SEQ ID NO: 150290 - RNA, 22 nt, Human
caucacagguccugaugacauu

SEQ ID NO: 150291 - RNA, 22 nt, Human
uguccagguggccucugcugcu

SEQ ID NO: 150292 - RNA, 22 nt, Human
cagccaagaaccacagacccag

SEQ ID NO: 150293 - RNA, 22 nt, Human
ggcaaggggucaggcugagaca

SEQ ID NO: 150294 - RNA, 22 nt, Human
acuugaauuauauuucuagaga

SEQ ID NO: 150295 - RNA, 22 nt, Human
uuuaacacuaguuucuuuaacu

SEQ ID NO: 150296 - RNA, 18 nt, Human
cccacacagcaguagcuc

SEQ ID NO: 150297 - RNA, 22 nt, Human
uucaguuccauuucaggugggu

SEQ ID NO: 150298 - RNA, 22 nt, Human
ucagcucuguuuugaguggaac

SEQ ID NO: 150299 - RNA, 22 nt, Human
cccacacacuggcugcugccaa

SEQ ID NO: 150300 - RNA, 22 nt, Human
gacccauauaggacccuccaaa

SEQ ID NO: 150301 - RNA, 22 nt, Human
uuucaaauggagucgugaaaug

SEQ ID NO: 150302 - RNA, 22 nt, Human
uacauugacuuggauuguuaga

SEQ ID NO: 150303 - RNA, 22 nt, Human
aacagccacugauacugaauag

SEQ ID NO: 150304 - RNA, 22 nt, Human
gaaucauuuauuuuugacagca

SEQ ID NO: 150305 - RNA, 22 nt, Human
cagcacagugaccagacccacu

SEQ ID NO: 150306 - RNA, 22 nt, Human
cucucuccuuagcugcagacca

SEQ ID NO: 150307 - RNA, 22 nt, Human
cggcuggugucgggcacagcaa

SEQ ID NO: 150308 - RNA, 22 nt, Human
acuggggauuagggacucagug

SEQ ID NO: 150309 - RNA, 22 nt, Human
gacauguugaagaauauuugga

SEQ ID NO: 150310 - RNA, 22 nt, Human
agcugccagcaaguuucaaaca

SEQ ID NO: 150311 - RNA, 22 nt, Human
uccaggcucccucaggaugcac

SEQ ID NO: 150312 - RNA, 19 nt, Human
uuugaauccagcugguaac

SEQ ID NO: 150313 - RNA, 22 nt, Human
acacacaugguauuguucagaa

SEQ ID NO: 150314 - RNA, 22 nt, Human
cugggcugagccugggcugugu

SEQ ID NO: 150315 - RNA, 22 nt, Human
ccaggcucugugugggcuagag

SEQ ID NO: 150316 - RNA, 22 nt, Human
agcacugugauuuauaacauuu

SEQ ID NO: 150317 - RNA, 22 nt, Human
ucccacaccugucuauuccuag

SEQ ID NO: 150318 - RNA, 22 nt, Human
auacauauaugguacuuccugg

SEQ ID NO: 150319 - RNA, 22 nt, Human
cagucacauagguauacacaua

SEQ ID NO: 150320 - RNA, 22 nt, Human
ucuccaagaaaagaucucagcu

SEQ ID NO: 150321 - RNA, 22 nt, Human
gcugggcuguaguuugcugacc

SEQ ID NO: 150322 - RNA, 22 nt, Human
uggcagggugccaguugcgagu

SEQ ID NO: 150323 - RNA, 22 nt, Human
gcuggcaguuuccucaccgagg

SEQ ID NO: 150324 - RNA, 21 nt, Human
acuguucauuugaugaacugg

SEQ ID NO: 150325 - RNA, 22 nt, Human
guugggaaggcaagaaguagaa

SEQ ID NO: 150326 - RNA, 22 nt, Human
cuguucauggaaaaauaguugg

SEQ ID NO: 150327 - RNA, 22 nt, Human
uguaugaagacuucuucugugu

SEQ ID NO: 150328 - RNA, 22 nt, Human
ccuguucauuuguauuugucuu

SEQ ID NO: 150329 - RNA, 22 nt, Human
acacagaguuugacacauggga

SEQ ID NO: 150330 - RNA, 22 nt, Human
ccaggcccaggguacugaccaa

SEQ ID NO: 150331 - RNA, 22 nt, Human
ugggcuucuggaguggggcaga

SEQ ID NO: 150332 - RNA, 22 nt, Human
augggcugaaagaguaagcugu

SEQ ID NO: 150333 - RNA, 22 nt, Human
cgcaggcuuuagaaucugcuac

SEQ ID NO: 150334 - RNA, 22 nt, Human
aaagcucuuuuccaaguauuga

SEQ ID NO: 150335 - RNA, 22 nt, Human
aaugaagccagcugggaugcga

SEQ ID NO: 150336 - RNA, 22 nt, Human
guccucugucccuggggcacgg

SEQ ID NO: 150337 - RNA, 22 nt, Human
uuccaagugcccauauuucauc

SEQ ID NO: 150338 - RNA, 22 nt, Human
cuccuggcacucaguguggaag

SEQ ID NO: 150339 - RNA, 22 nt, Human
acugagagucaagauagcaugg

SEQ ID NO: 150340 - RNA, 22 nt, Human
acacauaagaaacuacaaagag

SEQ ID NO: 150341 - RNA, 17 nt, Human
gcccacccuuaggagcu

SEQ ID NO: 150342 - RNA, 22 nt, Human
uauuccuaagucccaacuacau

SEQ ID NO: 150343 - RNA, 22 nt, Human
ugccugacugcugccaccacua

SEQ ID NO: 150344 - RNA, 22 nt, Human
acacacagaguuuauacaggca

SEQ ID NO: 150345 - RNA, 22 nt, Human
acuggcaguuugagaaugcauu

SEQ ID NO: 150346 - RNA, 22 nt, Human
ccuguucaauauucuuccuugu

SEQ ID NO: 150347 - RNA, 22 nt, Human
acugggcuguaaagagaggcaa

SEQ ID NO: 150348 - RNA, 22 nt, Human
cuggccucuguguucaccauag

SEQ ID NO: 150349 - RNA, 22 nt, Human
uauuccagaugaaaucauucag

SEQ ID NO: 150350 - RNA, 22 nt, Human
acuguucacuagugaggguuga

SEQ ID NO: 150351 - RNA, 22 nt, Human
uucugggggccaggacaguggu

SEQ ID NO: 150352 - RNA, 23 nt, Human
acacugucucauggauagacugc

SEQ ID NO: 150353 - RNA, 22 nt, Human
uguaugaaagaacaagggcuua

SEQ ID NO: 150354 - RNA, 22 nt, Human
acacaucaugccaaguuucacc

SEQ ID NO: 150355 - RNA, 20 nt, Human
cugcuccacccggcucucag

SEQ ID NO: 150356 - RNA, 22 nt, Human
aggccccaaagcagugcaagua

SEQ ID NO: 150357 - RNA, 22 nt, Human
cauuugaaauucuuagaacaaa

SEQ ID NO: 150358 - RNA, 23 nt, Human
ugaaauauucuuuugcaugagcu

SEQ ID NO: 150359 - RNA, 22 nt, Human
gcagggacagggcagggccuuu

SEQ ID NO: 150360 - RNA, 22 nt, Human
aaauucuaugucaauguuuauu

SEQ ID NO: 150361 - RNA, 22 nt, Human
cugccugccacguucagcugua

SEQ ID NO: 150362 - RNA, 22 nt, Human
aaagagucguguuccagguuug

SEQ ID NO: 150363 - RNA, 22 nt, Human
aaugaagccagguagaagagaa

SEQ ID NO: 150364 - RNA, 20 nt, Human
cugaaccaaggcuuucucag

SEQ ID NO: 150365 - RNA, 22 nt, Human
ugugaaaagcaggcuacuuucu

SEQ ID NO: 150366 - RNA, 22 nt, Human
cacaucccuggaguuacccagu

SEQ ID NO: 150367 - RNA, 22 nt, Human
ugcuucugucucuuaugccuug

SEQ ID NO: 150368 - RNA, 22 nt, Human
uucuggggacauaacaguaagc

SEQ ID NO: 150369 - RNA, 22 nt, Human
uucuuguaauuuggagaaauga

SEQ ID NO: 150370 - RNA, 22 nt, Human
uccuggcacuuugggggcucgc

SEQ ID NO: 150371 - RNA, 22 nt, Human
ugagagucucagaccuccuggu

SEQ ID NO: 150372 - RNA, 22 nt, Human
ggggaccugggcuucaaggguu

SEQ ID NO: 150373 - RNA, 22 nt, Human
augggcugacaagacaugcaua

SEQ ID NO: 150374 - RNA, 22 nt, Human
ugggccagcaauugcugcucag

SEQ ID NO: 150375 - RNA, 22 nt, Human
cuccuggcaguuccccuuguca

SEQ ID NO: 150376 - RNA, 22 nt, Human
ccaggcuccgcauagaccccac

SEQ ID NO: 150377 - RNA, 22 nt, Human
uucaagauggcaccagugagug

SEQ ID NO: 150378 - RNA, 22 nt, Human
ucuguucaguuguaccuucccc

SEQ ID NO: 150379 - RNA, 22 nt, Human
ucccagccuccugacaguuuug

SEQ ID NO: 150380 - RNA, 22 nt, Human
cagcccaggucucucuuccagu

SEQ ID NO: 150381 - RNA, 22 nt, Human
auaauggccgggggcugaaugc

SEQ ID NO: 150382 - RNA, 23 nt, Human
cuguaugauguuaaguggaaagc

SEQ ID NO: 150383 - RNA, 21 nt, Human
ccugggcugugguuuggagac

SEQ ID NO: 150384 - RNA, 22 nt, Human
gucacaggcaguaacuaggacc

SEQ ID NO: 150385 - RNA, 22 nt, Human
cuuccaagaugaacagcaagcg

SEQ ID NO: 150386 - RNA, 22 nt, Human
acugggcuuauuucuugugaac

SEQ ID NO: 150387 - RNA, 22 nt, Human
cuucugggccauggccuuccuc

SEQ ID NO: 150388 - RNA, 22 nt, Human
uguaugaaucucauuuguuuaa

SEQ ID NO: 150389 - RNA, 22 nt, Human
guugggaaggugaacaugaugc

SEQ ID NO: 150390 - RNA, 22 nt, Human
uuccaagucuaaguuauaaauc

SEQ ID NO: 150391 - RNA, 22 nt, Human
aggaagaacagauaauggacgc

SEQ ID NO: 150392 - RNA, 21 nt, Human
aggucccagguuugggcagca

SEQ ID NO: 150393 - RNA, 22 nt, Human
uucuggggccaauugccacugc

SEQ ID NO: 150394 - RNA, 22 nt, Human
ggagaagaggagcuggaagccu

SEQ ID NO: 150395 - RNA, 22 nt, Human
auguaugaagcuuuguuuggga

SEQ ID NO: 150396 - RNA, 22 nt, Human
auggcagaccuccuggccacaa

SEQ ID NO: 150397 - RNA, 22 nt, Human
ucuggcaguuugagaaaggcua

SEQ ID NO: 150398 - RNA, 22 nt, Human
aaauauuugucugaggcgguug

SEQ ID NO: 150399 - RNA, 22 nt, Human
cuugggcucagacuugaggaca

SEQ ID NO: 150400 - RNA, 22 nt, Human
cacaauuuuaauacacagucaa

SEQ ID NO: 150401 - RNA, 22 nt, Human
cuguaugauauccaaauugaua

SEQ ID NO: 150402 - RNA, 18 nt, Human
gacacauccccaggccuc

SEQ ID NO: 150403 - RNA, 22 nt, Human
gaugaagccugacuucucggug

SEQ ID NO: 150404 - RNA, 22 nt, Human
cuguccagcuuggcuccugggg

SEQ ID NO: 150405 - RNA, 22 nt, Human
cugggcuuaggaccuggugcgg

SEQ ID NO: 150406 - RNA, 22 nt, Human
ucuggcagggucagggcccagg

SEQ ID NO: 150407 - RNA, 22 nt, Human
cccagcccaucucaaaggucua

SEQ ID NO: 150408 - RNA, 22 nt, Human
gcccacacaccagcucaggagg

SEQ ID NO: 150409 - RNA, 22 nt, Human
gucaggacucugacccgucccg

SEQ ID NO: 150410 - RNA, 22 nt, Human
ccugccugucuuuauccccugu

SEQ ID NO: 150411 - RNA, 20 nt, Human
uggccucugagaugccacgg

SEQ ID NO: 150412 - RNA, 22 nt, Human
acaaauccagugaacuccagug

SEQ ID NO: 150413 - RNA, 22 nt, Human
uggccaggaggcugcuucugac

SEQ ID NO: 150414 - RNA, 22 nt, Human
uuccagagcaguuuucagauca

SEQ ID NO: 150415 - RNA, 22 nt, Human
auggccuggggauuccugagca

SEQ ID NO: 150416 - RNA, 23 nt, Human
ugagggacaugguggcuucugag

SEQ ID NO: 150417 - RNA, 22 nt, Human
cacauacugagaaucacaccca

SEQ ID NO: 150418 - RNA, 22 nt, Human
ucuggggaugaggaccuagaug

SEQ ID NO: 150419 - RNA, 22 nt, Human
ccccuuccuuccucagacagcc

SEQ ID NO: 150420 - RNA, 22 nt, Human
auuucuguaacuuaugaaaguu

SEQ ID NO: 150421 - RNA, 22 nt, Human
uugguuccuucugaaaguauug

SEQ ID NO: 150422 - RNA, 22 nt, Human
ucacacacauuugcugucugau

SEQ ID NO: 150423 - RNA, 22 nt, Human
gcuggcaggagaaacggggugc

SEQ ID NO: 150424 - RNA, 21 nt, Human
uccaagcucaacucccuuccu

SEQ ID NO: 150425 - RNA, 22 nt, Human
uaagaacaguagaacaguaggu

SEQ ID NO: 150426 - RNA, 22 nt, Human
ggaaccacagcccccagcaggc

SEQ ID NO: 150427 - RNA, 22 nt, Human
uguaaacauauguauguaugua

SEQ ID NO: 150428 - RNA, 18 nt, Human
uccucucuuuccccaggg

SEQ ID NO: 150429 - RNA, 22 nt, Human
uguucagagacagaaauucuaa

SEQ ID NO: 150430 - RNA, 22 nt, Human
agccuccaucucccaucuguga

SEQ ID NO: 150431 - RNA, 22 nt, Human
caugaagcucuugcaccucuag

SEQ ID NO: 150432 - RNA, 17 nt, Human
aaaauucuguaaagagg

SEQ ID NO: 150433 - RNA, 19 nt, Human
cuccaaguuaagagggagg

SEQ ID NO: 150434 - RNA, 22 nt, Human
agucuagggugggguccacagg

SEQ ID NO: 150435 - RNA, 22 nt, Human
uucacauuugaaaggaaagaua

SEQ ID NO: 150436 - RNA, 22 nt, Human
acuggcagugucguuuacauga

SEQ ID NO: 150437 - RNA, 22 nt, Human
cgcaggcuccggggugcccugg

SEQ ID NO: 150438 - RNA, 22 nt, Human
cuccucuguauugauugggacu

SEQ ID NO: 150439 - RNA, 22 nt, Human
caggcucuuuugguggcaagga

SEQ ID NO: 150440 - RNA, 22 nt, Human
caggcccugggcaggcacagag

SEQ ID NO: 150441 - RNA, 22 nt, Human
ugcuucuggcagauugagugag

SEQ ID NO: 150442 - RNA, 22 nt, Human
agagcagauggagcuggaagag

SEQ ID NO: 150443 - RNA, 22 nt, Human
acacacaugcaugcuugccauu

SEQ ID NO: 150444 - RNA, 22 nt, Human
ucuggcagagugauaggauaag

SEQ ID NO: 150445 - RNA, 22 nt, Human
agcaggcuccuuccuucucugg

SEQ ID NO: 150446 - RNA, 22 nt, Human
ggcaggcuuugagaaagagcau

SEQ ID NO: 150447 - RNA, 22 nt, Human
auccucuguggauuacaccuag

SEQ ID NO: 150448 - RNA, 21 nt, Human
ccacucaugacuccacucacc

SEQ ID NO: 150449 - RNA, 22 nt, Human
aaugugaaaccgcacagaauaa

SEQ ID NO: 150450 - RNA, 22 nt, Human
ggugccagugggucucaggaua

SEQ ID NO: 150451 - RNA, 22 nt, Human
gccuggcaggccuguuggggcu

SEQ ID NO: 150452 - RNA, 22 nt, Human
guccucugggcuuugagcaguc

SEQ ID NO: 150453 - RNA, 21 nt, Human
ccagcccagcugugucccagc

SEQ ID NO: 150454 - RNA, 22 nt, Human
ccucugccaccucccacgaggc

SEQ ID NO: 150455 - RNA, 22 nt, Human
gccuggaaucaugcagggguua

SEQ ID NO: 150456 - RNA, 22 nt, Human
gaauauuuguaauuacuguuga

SEQ ID NO: 150457 - RNA, 22 nt, Human
uguaugaaaaggaauagauuga

SEQ ID NO: 150458 - RNA, 22 nt, Human
gugggcuucuguuagggaggcu

SEQ ID NO: 150459 - RNA, 22 nt, Human
guggcagucgcugacagauaca

SEQ ID NO: 150460 - RNA, 19 nt, Human
aggcuuggcuagauuuacu

SEQ ID NO: 150461 - RNA, 22 nt, Human
ggccucucaugcccagagccaa

SEQ ID NO: 150462 - RNA, 22 nt, Human
acuggcagaacuggugauuguc

SEQ ID NO: 150463 - RNA, 22 nt, Human
cacacacuggagcaaggagaug

SEQ ID NO: 150464 - RNA, 22 nt, Human
uuugaaguaccugguucugacu

SEQ ID NO: 150465 - RNA, 22 nt, Human
ugcuucugauucaugguuauug

SEQ ID NO: 150466 - RNA, 22 nt, Human
ucugcagaauucgaggaagaaa

SEQ ID NO: 150467 - RNA, 22 nt, Human
ccaggcucaggccugcucguug

SEQ ID NO: 150468 - RNA, 21 nt, Human
ccuggcagaagccugauaugc

SEQ ID NO: 150469 - RNA, 22 nt, Human
cugugggaacacugaggacuuc

SEQ ID NO: 150470 - RNA, 22 nt, Human
cagaaauucccauuucagauuc

SEQ ID NO: 150471 - RNA, 22 nt, Human
gcugggcugagcuagacuuggc

SEQ ID NO: 150472 - RNA, 22 nt, Human
uuccaggaagcaguuagcagcc

SEQ ID NO: 150473 - RNA, 22 nt, Human
uguggagacuauagccauaaca

SEQ ID NO: 150474 - RNA, 22 nt, Human
aaagaucacgucccaggacucg

SEQ ID NO: 150475 - RNA, 22 nt, Human
ggaaucagaauuaggauuugaa

SEQ ID NO: 150476 - RNA, 22 nt, Human
ucccacacuacacgguuguugg

SEQ ID NO: 150477 - RNA, 23 nt, Human
ucuguucaaggcuuucuccuuga

SEQ ID NO: 150478 - RNA, 22 nt, Human
auguaugauauuuccaguauca

SEQ ID NO: 150479 - RNA, 22 nt, Human
uuacaauaccacaucaccucau

SEQ ID NO: 150480 - RNA, 22 nt, Human
auauauuugagaauauucauga

SEQ ID NO: 150481 - RNA, 18 nt, Human
gccugcucugcucucccc

SEQ ID NO: 150482 - RNA, 22 nt, Human
ccuggcaguuuugcccaggauu

SEQ ID NO: 150483 - RNA, 22 nt, Human
ucuggcagcucuccucggcgga

SEQ ID NO: 150484 - RNA, 22 nt, Human
ucuguucagaauuguaacacuc

SEQ ID NO: 150485 - RNA, 22 nt, Human
caaauucucacccuguuugauu

SEQ ID NO: 150486 - RNA, 20 nt, Human
agcaggcugcagggugaaau

SEQ ID NO: 150487 - RNA, 22 nt, Human
uuucuguaaguggcaaauaaug

SEQ ID NO: 150488 - RNA, 22 nt, Human
ucacuguauuugcugaugcaua

SEQ ID NO: 150489 - RNA, 22 nt, Human
guccaaguacauguguguacau

SEQ ID NO: 150490 - RNA, 22 nt, Human
gggaccuggcaccuuugcucug

SEQ ID NO: 150491 - RNA, 22 nt, Human
uccccacaucucugcaucaggc

SEQ ID NO: 150492 - RNA, 22 nt, Human
uuccuggccaagcagaguggaa

SEQ ID NO: 150493 - RNA, 22 nt, Human
acagguggaggcuuuaggaggu

SEQ ID NO: 150494 - RNA, 22 nt, Human
agagcacagaagaauaggugcu

SEQ ID NO: 150495 - RNA, 22 nt, Human
cugaaccaucucuguucuguau

SEQ ID NO: 150496 - RNA, 22 nt, Human
cuggcaguuugccaggagcucg

SEQ ID NO: 150497 - RNA, 22 nt, Human
cuccugcaagccuccccaagca

SEQ ID NO: 150498 - RNA, 22 nt, Human
cagccucuguggcugccacacc

SEQ ID NO: 150499 - RNA, 23 nt, Human
ccaggcucuuucaccugcuauuc

SEQ ID NO: 150500 - RNA, 22 nt, Human
uccuggcaaagauguugguguu

SEQ ID NO: 150501 - RNA, 22 nt, Human
ugcuucugaaaugcaggucuuc

SEQ ID NO: 150502 - RNA, 20 nt, Human
gcuguucacauuauuaguag

SEQ ID NO: 150503 - RNA, 22 nt, Human
uugaaucucuugaaucucuguu

SEQ ID NO: 150504 - RNA, 19 nt, Human
gcagagugggguggagggu

SEQ ID NO: 150505 - RNA, 22 nt, Human
uggcaggcgggagccauagagg

SEQ ID NO: 150506 - RNA, 20 nt, Human
auguaaaauuauaaggcuga

SEQ ID NO: 150507 - RNA, 22 nt, Human
gugcuaggauuacaggcauggg

SEQ ID NO: 150508 - RNA, 18 nt, Human
ggcaggcucucuggguca

SEQ ID NO: 150509 - RNA, 22 nt, Human
gcuggggacuccccaccauagc

SEQ ID NO: 150510 - RNA, 22 nt, Human
agggcugacaaauggcagugac

SEQ ID NO: 150511 - RNA, 22 nt, Human
ugguccuggaagguccugaggg

SEQ ID NO: 150512 - RNA, 21 nt, Human
aggcucucauccagggaccca

SEQ ID NO: 150513 - RNA, 18 nt, Human
ugcaggcugggguuccuc

SEQ ID NO: 150514 - RNA, 22 nt, Human
gcuaggaggaagaaugugaauu

SEQ ID NO: 150515 - RNA, 22 nt, Human
ccuggcagcuguuuggcuuggc

SEQ ID NO: 150516 - RNA, 22 nt, Human
ggcuuuggggugugcagagaug

SEQ ID NO: 150517 - RNA, 22 nt, Human
agaugaaagauuuuuauagaga

SEQ ID NO: 150518 - RNA, 19 nt, Human
ucccaggaagcaaauguca

SEQ ID NO: 150519 - RNA, 22 nt, Human
cgaggcucagagagggugacuu

SEQ ID NO: 150520 - RNA, 22 nt, Human
ucuggcagaaggcagaaauuca

SEQ ID NO: 150521 - RNA, 22 nt, Human
agggacucccugggccgacacg

SEQ ID NO: 150522 - RNA, 22 nt, Human
aguugacauccagagacauucu

SEQ ID NO: 150523 - RNA, 22 nt, Human
uuucauaauagugcaguuuguu

SEQ ID NO: 150524 - RNA, 22 nt, Human
gagcacugauuuauuuuugucu

SEQ ID NO: 150525 - RNA, 22 nt, Human
cugucucagcaggaagucauca

SEQ ID NO: 150526 - RNA, 22 nt, Human
ccagccucacuggcaucaccua

SEQ ID NO: 150527 - RNA, 22 nt, Human
uucuguuuuagaaauaaguagu

SEQ ID NO: 150528 - RNA, 22 nt, Human
gcuggcagaauuucuucuugcu

SEQ ID NO: 150529 - RNA, 22 nt, Human
ucuguucacugagcaauggcaa

SEQ ID NO: 150530 - RNA, 19 nt, Human
cgcaggcuucgggucgcuc

SEQ ID NO: 150531 - RNA, 22 nt, Human
ucugggcugaaaugaaggccuu

SEQ ID NO: 150532 - RNA, 22 nt, Human
cccacccugggcuacacaucca

SEQ ID NO: 150533 - RNA, 22 nt, Human
uaauuucacugauaugaaguca

SEQ ID NO: 150534 - RNA, 22 nt, Human
gucauuccuauccauuugauac

SEQ ID NO: 150535 - RNA, 22 nt, Human
ugcacaggugagacucaggaag

SEQ ID NO: 150536 - RNA, 22 nt, Human
gugggagaaauuagcucuaguu

SEQ ID NO: 150537 - RNA, 22 nt, Human
ucuccugucuucucagcacccc

SEQ ID NO: 150538 - RNA, 22 nt, Human
aauauguugagucuaucuuuau

SEQ ID NO: 150539 - RNA, 22 nt, Human
ccuggcaguggugaagaagagg

SEQ ID NO: 150540 - RNA, 22 nt, Human
cgcugauaaacgucacguuccc

SEQ ID NO: 150541 - RNA, 22 nt, Human
gguaaaaugcagauucuuagcc

SEQ ID NO: 150542 - RNA, 22 nt, Human
gcccagccuccaagcuccaagg

SEQ ID NO: 150543 - RNA, 17 nt, Human
aaugaaugaauucuuug

SEQ ID NO: 150544 - RNA, 22 nt, Human
agcaggcuuaugguugaaggga

SEQ ID NO: 150545 - RNA, 22 nt, Human
ucacaaaagcuuuugaauuugg

SEQ ID NO: 150546 - RNA, 22 nt, Human
uauuucagcaagaagaaugugg

SEQ ID NO: 150547 - RNA, 22 nt, Human
ccccacacucuuuacauucaua

SEQ ID NO: 150548 - RNA, 22 nt, Human
ucuguucaguugauuagacaga

SEQ ID NO: 150549 - RNA, 22 nt, Human
gaggccugucgcuaggccucug

SEQ ID NO: 150550 - RNA, 22 nt, Human
uugggaucucaaauccagcuau

SEQ ID NO: 150551 - RNA, 22 nt, Human
cccacccucaagggugucuaua

SEQ ID NO: 150552 - RNA, 22 nt, Human
ggcagugagaggucuccugguc

SEQ ID NO: 150553 - RNA, 22 nt, Human
ucugggcuugguuagggcuguu

SEQ ID NO: 150554 - RNA, 22 nt, Human
gugggguagaucuuucucagga

SEQ ID NO: 150555 - RNA, 22 nt, Human
caugaaaauaacauuguuguga

SEQ ID NO: 150556 - RNA, 22 nt, Human
ugcaggcuggauuugcuuuugu

SEQ ID NO: 150557 - RNA, 22 nt, Human
ugcuucuguauuuugggcuuga

SEQ ID NO: 150558 - RNA, 17 nt, Human
gggcugacaguggccuc

SEQ ID NO: 150559 - RNA, 22 nt, Human
aagauucagccaaauuguucau

SEQ ID NO: 150560 - RNA, 22 nt, Human
gcagcucuccucugugaggaac

SEQ ID NO: 150561 - RNA, 22 nt, Human
guccaagucuuccuucccaaac

SEQ ID NO: 150562 - RNA, 20 nt, Human
aaguuuucuccaaauacagu

SEQ ID NO: 150563 - RNA, 22 nt, Human
guccuggcugguucuguggggc

SEQ ID NO: 150564 - RNA, 22 nt, Human
aaaucagugcucauuugaaagg

SEQ ID NO: 150565 - RNA, 22 nt, Human
uuggcaggaggcuucaguuccu

SEQ ID NO: 150566 - RNA, 22 nt, Human
ugcaggcugcuggcaguagcuu

SEQ ID NO: 150567 - RNA, 22 nt, Human
ccacacuaaacugcucaaacca

SEQ ID NO: 150568 - RNA, 22 nt, Human
aggcacaggaggugguaagaag

SEQ ID NO: 150569 - RNA, 22 nt, Human
ccuggcuccugccucugcaggg

SEQ ID NO: 150570 - RNA, 22 nt, Human
ggcuccaaagggcagugugagg

SEQ ID NO: 150571 - RNA, 22 nt, Human
gugugggaaggcuaggaugcug

SEQ ID NO: 150572 - RNA, 22 nt, Human
uaaauucugaucaaguuccuuc

SEQ ID NO: 150573 - RNA, 22 nt, Human
caggacaaagcccuuugagaaa

SEQ ID NO: 150574 - RNA, 22 nt, Human
gcuuggaaguaggauugggaga

SEQ ID NO: 150575 - RNA, 22 nt, Human
ucccacauaugcaauccugaau

SEQ ID NO: 150576 - RNA, 22 nt, Human
augggcugugagguccggcagg

SEQ ID NO: 150577 - RNA, 22 nt, Human
gagaggcuggcagugccagguu

SEQ ID NO: 150578 - RNA, 22 nt, Human
ugaagccauaggacagaggaua

SEQ ID NO: 150579 - RNA, 22 nt, Human
gcacacaggcaguuuccagcca

SEQ ID NO: 150580 - RNA, 22 nt, Human
aagugccaucauagcauggcug

SEQ ID NO: 150581 - RNA, 22 nt, Human
ccaggcucuguuccccgaggag

SEQ ID NO: 150582 - RNA, 22 nt, Human
ugaguguauaucaggagagagc

SEQ ID NO: 150583 - RNA, 22 nt, Human
ucuggcagggguucugcacuug

SEQ ID NO: 150584 - RNA, 22 nt, Human
gcuguucaagacuaggaaauuu

SEQ ID NO: 150585 - RNA, 22 nt, Human
gccuggcaauggccucaggaag

SEQ ID NO: 150586 - RNA, 22 nt, Human
ccugccuguacuagagacccag

SEQ ID NO: 150587 - RNA, 22 nt, Human
auauauuuugcggucacguggc

SEQ ID NO: 150588 - RNA, 22 nt, Human
gaggagcuguucccucaccucu

SEQ ID NO: 150589 - RNA, 23 nt, Human
acauacauggagauaaagugaug

SEQ ID NO: 150590 - RNA, 22 nt, Human
cagccucuuuccacaucaggca

SEQ ID NO: 150591 - RNA, 22 nt, Human
aaaagucugcucucauuucaga

SEQ ID NO: 150592 - RNA, 22 nt, Human
agucuucacucuucacuacuau

SEQ ID NO: 150593 - RNA, 22 nt, Human
cagcccagccuugucucuuuau

SEQ ID NO: 150594 - RNA, 23 nt, Human
agucuucauuguauuuccagacc

SEQ ID NO: 150595 - RNA, 22 nt, Human
guggcuuggaccagucacagug

SEQ ID NO: 150596 - RNA, 22 nt, Human
gaaagacuuccuuugagaguac

SEQ ID NO: 150597 - RNA, 22 nt, Human
ucacacacauggauaguauuuu

SEQ ID NO: 150598 - RNA, 22 nt, Human
ggggcugagucagugggaagag

SEQ ID NO: 150599 - RNA, 22 nt, Human
ccugggcuuccacgagcagagg

SEQ ID NO: 150600 - RNA, 22 nt, Human
agcaccaucacagcuguauguc

SEQ ID NO: 150601 - RNA, 22 nt, Human
ccuacauucucugaguuuuccu

SEQ ID NO: 150602 - RNA, 22 nt, Human
guggcagguuccguagacagca

SEQ ID NO: 150603 - RNA, 23 nt, Human
ggccucagcgcacagaaacugcu

SEQ ID NO: 150604 - RNA, 22 nt, Human
ccuucucucugaagaccccaaa

SEQ ID NO: 150605 - RNA, 22 nt, Human
gcagccucaaacuccccagcuc

SEQ ID NO: 150606 - RNA, 22 nt, Human
uuccaagugcugaggacaguag

SEQ ID NO: 150607 - RNA, 22 nt, Human
cuguaugaacccauauacuuau

SEQ ID NO: 150608 - RNA, 22 nt, Human
aauauugagaaccagcauguuu

SEQ ID NO: 150609 - RNA, 22 nt, Human
ucuucaaaugcuaguaauauca

SEQ ID NO: 150610 - RNA, 22 nt, Human
agcagguggacagaggaagaaa

SEQ ID NO: 150611 - RNA, 22 nt, Human
cugcagccacgagucacagccc

SEQ ID NO: 150612 - RNA, 22 nt, Human
cacugucccuguuuccuggaaa

SEQ ID NO: 150613 - RNA, 22 nt, Human
cucaccccacuaccccuuggug

SEQ ID NO: 150614 - RNA, 22 nt, Human
uccaaggcuccggcccuggcgu

SEQ ID NO: 150615 - RNA, 17 nt, Human
ugcuucuguauugcugg

SEQ ID NO: 150616 - RNA, 22 nt, Human
ccuggcagguggcgcccucggc

SEQ ID NO: 150617 - RNA, 22 nt, Human
ucuggcaggaccaugaagcgua

SEQ ID NO: 150618 - RNA, 22 nt, Human
gcuggcagggacagcugcgugu

SEQ ID NO: 150619 - RNA, 22 nt, Human
cuggcagguuuggugucuggug

SEQ ID NO: 150620 - RNA, 20 nt, Human
gauacacagcacagagggcc

SEQ ID NO: 150621 - RNA, 22 nt, Human
ugggcuuuaucaugggucuggu

SEQ ID NO: 150622 - RNA, 22 nt, Human
acacacuguugcucauccaggc

SEQ ID NO: 150623 - RNA, 16 nt, Human
ucacauacuuccuugc

SEQ ID NO: 150624 - RNA, 22 nt, Human
gaaaagaguccugugugaggag

SEQ ID NO: 150625 - RNA, 22 nt, Human
gaacacaugauuauaaaugcua

SEQ ID NO: 150626 - RNA, 22 nt, Human
gcuggcagagacaagaagacua

SEQ ID NO: 150627 - RNA, 22 nt, Human
ucuggggagggagccacagguc

SEQ ID NO: 150628 - RNA, 22 nt, Human
aucuuguuaaaaugcagaaacu

SEQ ID NO: 150629 - RNA, 22 nt, Human
aucuucaaagggauguccaugg

SEQ ID NO: 150630 - RNA, 22 nt, Human
cacacagacagcucucugaaga

SEQ ID NO: 150631 - RNA, 22 nt, Human
cacuggaauucaagauacugag

SEQ ID NO: 150632 - RNA, 22 nt, Human
ugggcagggagcuggaaccaca

SEQ ID NO: 150633 - RNA, 22 nt, Human
uucugggguuaugggugauucu

SEQ ID NO: 150634 - RNA, 22 nt, Human
caggcugccuggaagaggacug

SEQ ID NO: 150635 - RNA, 22 nt, Human
augggcuggccuuucccgcucu

SEQ ID NO: 150636 - RNA, 22 nt, Human
gccuggcacaggaauuaggagg

SEQ ID NO: 150637 - RNA, 22 nt, Human
auucagagcacuggguagaauu

SEQ ID NO: 150638 - RNA, 22 nt, Human
augggcugaggugggauagaag

SEQ ID NO: 150639 - RNA, 22 nt, Human
aggcugugggaguugagagucu

SEQ ID NO: 150640 - RNA, 22 nt, Human
acuguucauuuggauuucucug

SEQ ID NO: 150641 - RNA, 18 nt, Human
ucaggcucucuggcuaga

SEQ ID NO: 150642 - RNA, 20 nt, Human
gcugggcuuugacugacaca

SEQ ID NO: 150643 - RNA, 22 nt, Human
ugccaggcacgugagaguggcc

SEQ ID NO: 150644 - RNA, 22 nt, Human
gaggagcucugcuccauccuuc

SEQ ID NO: 150645 - RNA, 22 nt, Human
cacuguccaauagauacauaau

SEQ ID NO: 150646 - RNA, 19 nt, Human
uucacaauuaugaaauuag

SEQ ID NO: 150647 - RNA, 22 nt, Human
auaacaugaccugugcuucaca

SEQ ID NO: 150648 - RNA, 23 nt, Human
caggcucccggaccaggauccgc

SEQ ID NO: 150649 - RNA, 17 nt, Human
ugccagccugucccagg

SEQ ID NO: 150650 - RNA, 22 nt, Human
cuguugcaucauggcucuuaau

SEQ ID NO: 150651 - RNA, 22 nt, Human
ucacauaaauuuaccagaugau

SEQ ID NO: 150652 - RNA, 22 nt, Human
gaugaaaaaagacgagcauaua

SEQ ID NO: 150653 - RNA, 22 nt, Human
agguaaaauagauaguauuucu

SEQ ID NO: 150654 - RNA, 22 nt, Human
cuuuaagagaucaccaaucaca

SEQ ID NO: 150655 - RNA, 20 nt, Human
aagagucuuuacugagcuaa

SEQ ID NO: 150656 - RNA, 22 nt, Human
ucccugugagaaaugaagcagg

SEQ ID NO: 150657 - RNA, 22 nt, Human
ugguccugccccgugcacagag

SEQ ID NO: 150658 - RNA, 22 nt, Human
ccaggcucugucuggucagaag

SEQ ID NO: 150659 - RNA, 22 nt, Human
caaaugcuacuaauaggcaagu

SEQ ID NO: 150660 - RNA, 22 nt, Human
cucugagcagaggccguggcua

SEQ ID NO: 150661 - RNA, 23 nt, Human
uaaauuaccuuuccagugcaggg

SEQ ID NO: 150662 - RNA, 22 nt, Human
ccugcagaggucaggccagaaa

SEQ ID NO: 150663 - RNA, 22 nt, Human
gacaaaaguguuuugaacaagg

SEQ ID NO: 150664 - RNA, 22 nt, Human
acacacagguaaaggagccugg

SEQ ID NO: 150665 - RNA, 22 nt, Human
aucugggggagcugcucaugga

SEQ ID NO: 150666 - RNA, 18 nt, Human
uguagagccagguuugcc

SEQ ID NO: 150667 - RNA, 22 nt, Human
cauauuugguauaacuuaagca

SEQ ID NO: 150668 - RNA, 22 nt, Human
gccaaugacagucucaguucug

SEQ ID NO: 150669 - RNA, 22 nt, Human
guguaugaggggagaauguuuu

SEQ ID NO: 150670 - RNA, 22 nt, Human
uggcuggagcauuccuugucuu

SEQ ID NO: 150671 - RNA, 22 nt, Human
auuucuguaguccacauucuuu

SEQ ID NO: 150672 - RNA, 22 nt, Human
ggagccugaaaagucugcauuu

SEQ ID NO: 150673 - RNA, 20 nt, Human
acuggcagccugccugcugu

SEQ ID NO: 150674 - RNA, 22 nt, Human
cuugaaucuucugaguauuugc

SEQ ID NO: 150675 - RNA, 22 nt, Human
cuuuaagacucugcucuuggug

SEQ ID NO: 150676 - RNA, 22 nt, Human
gccaagcuuugcaggaguguug

SEQ ID NO: 150677 - RNA, 22 nt, Human
cagaggcugcucuggguggcau

SEQ ID NO: 150678 - RNA, 22 nt, Human
cccaggccagaacuugguugcu

SEQ ID NO: 150679 - RNA, 22 nt, Human
ccugggcuuacgaccucugacu

SEQ ID NO: 150680 - RNA, 22 nt, Human
ggaagaaagcacacaaacuuga

SEQ ID NO: 150681 - RNA, 22 nt, Human
agcucugcuucuugggaagaug

SEQ ID NO: 150682 - RNA, 22 nt, Human
augggcugggaucugaguguca

SEQ ID NO: 150683 - RNA, 22 nt, Human
uauuccagguauucuucaagag

SEQ ID NO: 150684 - RNA, 22 nt, Human
cccucucucaggcugacagccu

SEQ ID NO: 150685 - RNA, 22 nt, Human
uuggaacaugccgggguccagg

SEQ ID NO: 150686 - RNA, 22 nt, Human
ccuguucaagguauuaauuauc

SEQ ID NO: 150687 - RNA, 22 nt, Human
auggcagauggcuggagcaggu

SEQ ID NO: 150688 - RNA, 22 nt, Human
ccucucagcgauuccucuugga

SEQ ID NO: 150689 - RNA, 22 nt, Human
gacagccaucagcacacgcugc

SEQ ID NO: 150690 - RNA, 22 nt, Human
aguugacauccauaacaggaag

SEQ ID NO: 150691 - RNA, 22 nt, Human
ucaaauaccagcuuuuccagaa

SEQ ID NO: 150692 - RNA, 22 nt, Human
acuggggaguugaagcacuuuc

SEQ ID NO: 150693 - RNA, 22 nt, Human
cuuaaaaucuggcaguuagcua

SEQ ID NO: 150694 - RNA, 22 nt, Human
ugaguagagaauucagcuaagg

SEQ ID NO: 150695 - RNA, 22 nt, Human
uuauuccaauuucuccuacaaa

SEQ ID NO: 150696 - RNA, 22 nt, Human
ucuccaggaagcccucccugac

SEQ ID NO: 150697 - RNA, 22 nt, Human
cugggagaggaaccucgagggu

SEQ ID NO: 150698 - RNA, 22 nt, Human
aaucuuuuaggggauccugagg

SEQ ID NO: 150699 - RNA, 22 nt, Human
ucuggggacggggcccagcaau

SEQ ID NO: 150700 - RNA, 22 nt, Human
ugccugccucuggcagcccugc

SEQ ID NO: 150701 - RNA, 22 nt, Human
aaucucuugggaggaaugaauu

SEQ ID NO: 150702 - RNA, 22 nt, Human
gcuggcagccaagugaagaggg

SEQ ID NO: 150703 - RNA, 20 nt, Human
aaaagagugcuucaacugcu

SEQ ID NO: 150704 - RNA, 22 nt, Human
cuggccucagagggucauggug

SEQ ID NO: 150705 - RNA, 19 nt, Human
ccaaaagcaauuccaagua

SEQ ID NO: 150706 - RNA, 17 nt, Human
uguagcuucuccuucuc

SEQ ID NO: 150707 - RNA, 22 nt, Human
uuuuggaaugaggaacauccag

SEQ ID NO: 150708 - RNA, 22 nt, Human
cucugggcacuguauggguucu

SEQ ID NO: 150709 - RNA, 20 nt, Human
cacaacuguccacaugcucc

SEQ ID NO: 150710 - RNA, 20 nt, Human
ucaggcuccgcauuaacuua

SEQ ID NO: 150711 - RNA, 22 nt, Human
uguaugaaccuuuaauauagug

SEQ ID NO: 150712 - RNA, 22 nt, Human
auacaugacucacacauucugc

SEQ ID NO: 150713 - RNA, 22 nt, Human
ucacuguaauagguuugaagau

SEQ ID NO: 150714 - RNA, 22 nt, Human
ugcaggcuggggaggcagacuu

SEQ ID NO: 150715 - RNA, 22 nt, Human
cuccagggggcauccacacagc

SEQ ID NO: 150716 - RNA, 22 nt, Human
ccaggcucaggugcgagagaca

SEQ ID NO: 150717 - RNA, 22 nt, Human
ugggcugaaaugcuguggacua

SEQ ID NO: 150718 - RNA, 22 nt, Human
ugcauugauagaaaaacaugga

SEQ ID NO: 150719 - RNA, 22 nt, Human
gcuggcagagagcuggugagga

SEQ ID NO: 150720 - RNA, 22 nt, Human
ugccagccagggaagcucaccc

SEQ ID NO: 150721 - RNA, 22 nt, Human
cuuggcaggguggaggaugcag

SEQ ID NO: 150722 - RNA, 22 nt, Human
agcuucuugggcuuuacacaaa

SEQ ID NO: 150723 - RNA, 22 nt, Human
aaauucaguuuuaauaaucacu

SEQ ID NO: 150724 - RNA, 19 nt, Human
gcuggcagauguggccgug

SEQ ID NO: 150725 - RNA, 22 nt, Human
agauauuuguaucuugcuauug

SEQ ID NO: 150726 - RNA, 20 nt, Human
uuucuggguacucucccucu

SEQ ID NO: 150727 - RNA, 22 nt, Human
gacacagagggcaccagauaug

SEQ ID NO: 150728 - RNA, 22 nt, Human
aguugggaguuauagacucuau

SEQ ID NO: 150729 - RNA, 22 nt, Human
ucuggcagugaagucaugaggu

SEQ ID NO: 150730 - RNA, 23 nt, Human
uccuuccuuugagaggcuccauc

SEQ ID NO: 150731 - RNA, 22 nt, Human
acugggcugcuugagugccuuc

SEQ ID NO: 150732 - RNA, 22 nt, Human
uauucugugugauauguaaaug

SEQ ID NO: 150733 - RNA, 22 nt, Human
caggaguccagagugucauuuu

SEQ ID NO: 150734 - RNA, 22 nt, Human
gccacagguacuaugggagaga

SEQ ID NO: 150735 - RNA, 22 nt, Human
auuugaagucuucaugauuucu

SEQ ID NO: 150736 - RNA, 22 nt, Human
gggguggccaaggacucugacc

SEQ ID NO: 150737 - RNA, 22 nt, Human
ugcccccugguggccagagccg

SEQ ID NO: 150738 - RNA, 22 nt, Human
ccuggcagaauauuaaagugca

SEQ ID NO: 150739 - RNA, 22 nt, Human
uuucuauaugaggagcuaaagu

SEQ ID NO: 150740 - RNA, 22 nt, Human
agaauauugaaaguucuugaca

SEQ ID NO: 150741 - RNA, 22 nt, Human
gccuccggaguugcagugucuu

SEQ ID NO: 150742 - RNA, 22 nt, Human
cugccugcucuauccaggccug

SEQ ID NO: 150743 - RNA, 22 nt, Human
gccagguugcugacgacgaucu

SEQ ID NO: 150744 - RNA, 22 nt, Human
ggccucucagggcagagacccu

SEQ ID NO: 150745 - RNA, 22 nt, Human
ggugccaggcuguagucagggu

SEQ ID NO: 150746 - RNA, 23 nt, Human
uugggaaauaguuaagacaugag

SEQ ID NO: 150747 - RNA, 21 nt, Human
agcaggcuuuggaguggggcu

SEQ ID NO: 150748 - RNA, 22 nt, Human
agcaggcuaaauaauaauacau

SEQ ID NO: 150749 - RNA, 22 nt, Human
acagguggggcacuuggagccu

SEQ ID NO: 150750 - RNA, 19 nt, Human
agcaggcuaggcugccucu

SEQ ID NO: 150751 - RNA, 22 nt, Human
ucucuuaauuguaaugguuccu

SEQ ID NO: 150752 - RNA, 22 nt, Human
cugagcagugguucuugagcgc

SEQ ID NO: 150753 - RNA, 22 nt, Human
cuccugaggaaaagcuugguca

SEQ ID NO: 150754 - RNA, 22 nt, Human
gcugggcuugguuucccugcuu

SEQ ID NO: 150755 - RNA, 22 nt, Human
uugaaaacuuucuagaccaaga

SEQ ID NO: 150756 - RNA, 21 nt, Human
aacacauccagaguauuugac

SEQ ID NO: 150757 - RNA, 22 nt, Human
ugagaaaagguugagaugauaa

SEQ ID NO: 150758 - RNA, 22 nt, Human
guuaggaacacuggagccuaaa

SEQ ID NO: 150759 - RNA, 22 nt, Human
cagcccaaagccccaggcuaga

SEQ ID NO: 150760 - RNA, 22 nt, Human
accagugggaaguggaaaauga

SEQ ID NO: 150761 - RNA, 22 nt, Human
ucccacaggaaaguagacauug

SEQ ID NO: 150762 - RNA, 22 nt, Human
ugaaacacugcgauaaaauccu

SEQ ID NO: 150763 - RNA, 22 nt, Human
guccuggcccaggaguacacau

SEQ ID NO: 150764 - RNA, 22 nt, Human
caaauucucaagguuuauccca

SEQ ID NO: 150765 - RNA, 22 nt, Human
uuuaaauuuagaagaaacacug

SEQ ID NO: 150766 - RNA, 22 nt, Human
uuccaaguagaagcauuugcau

SEQ ID NO: 150767 - RNA, 19 nt, Human
ucuguucacauuguuucgc

SEQ ID NO: 150768 - RNA, 22 nt, Human
ugcaggcugccuucacagagcc

SEQ ID NO: 150769 - RNA, 22 nt, Human
gcauccaaaccauucaucagcc

SEQ ID NO: 150770 - RNA, 22 nt, Human
uuuauuuauaagccacuugcug

SEQ ID NO: 150771 - RNA, 20 nt, Human
gcugggcuaccacuggcccu

SEQ ID NO: 150772 - RNA, 22 nt, Human
accugccuucucaaggacauga

SEQ ID NO: 150773 - RNA, 22 nt, Human
ugguuccucaagcgcuggcggc

SEQ ID NO: 150774 - RNA, 22 nt, Human
ugcaggcugcucaagacuuagu

SEQ ID NO: 150775 - RNA, 22 nt, Human
auggcagacgaggcagcagggg

SEQ ID NO: 150776 - RNA, 22 nt, Human
uacaauauguggccuuuuguga

SEQ ID NO: 150777 - RNA, 22 nt, Human
acagguccucaagucagcuggg

SEQ ID NO: 150778 - RNA, 22 nt, Human
gcuggcagguaaagccccgggg

SEQ ID NO: 150779 - RNA, 22 nt, Human
cagugggggggccaugcugcag

SEQ ID NO: 150780 - RNA, 22 nt, Human
cucuccagccuuuagcccacgc

SEQ ID NO: 150781 - RNA, 22 nt, Human
gcuccugggcccugggcuaacu

SEQ ID NO: 150782 - RNA, 22 nt, Human
uuauuccagcuaagaguccugg

SEQ ID NO: 150783 - RNA, 22 nt, Human
uauuuaguuaucuuucauaaaa

SEQ ID NO: 150784 - RNA, 22 nt, Human
ccugggcuguugcaucauccuu

SEQ ID NO: 150785 - RNA, 22 nt, Human
uuguacaaauaggaaccucuga

SEQ ID NO: 150786 - RNA, 22 nt, Human
ccuggggaaaagcaggcauuua

SEQ ID NO: 150787 - RNA, 22 nt, Human
cugagggucaacuugauuguau

SEQ ID NO: 150788 - RNA, 22 nt, Human
agcuuuggagacugacuccauc

SEQ ID NO: 150789 - RNA, 22 nt, Human
acugggcucaagugauuguccu

SEQ ID NO: 150790 - RNA, 17 nt, Human
gugaagagucauugaau

SEQ ID NO: 150791 - RNA, 22 nt, Human
cuacauggagaagaaaauucuu

SEQ ID NO: 150792 - RNA, 22 nt, Human
augggcugaggaagcuccugag

SEQ ID NO: 150793 - RNA, 21 nt, Human
ggcuaggaugcugggguuucc

SEQ ID NO: 150794 - RNA, 22 nt, Human
cugggcuuugaagccaggcugc

SEQ ID NO: 150795 - RNA, 22 nt, Human
aagcuguucucuaaguuucaug

SEQ ID NO: 150796 - RNA, 20 nt, Human
cucuuuugacucuuugcaag

SEQ ID NO: 150797 - RNA, 17 nt, Human
ugcaggcuccugucccu

SEQ ID NO: 150798 - RNA, 22 nt, Human
aaauaugaaugauaagaguuau

SEQ ID NO: 150799 - RNA, 23 nt, Human
uugugggcagauuccauggggag

SEQ ID NO: 150800 - RNA, 22 nt, Human
uugaagcagagaaauacuugaa

SEQ ID NO: 150801 - RNA, 22 nt, Human
uauguaaaguagauggcaggua

SEQ ID NO: 150802 - RNA, 18 nt, Human
cuacauucauaggaaagg

SEQ ID NO: 150803 - RNA, 22 nt, Human
ggggcugauggaacucaggccu

SEQ ID NO: 150804 - RNA, 19 nt, Human
cugagagaugcuucacaca

SEQ ID NO: 150805 - RNA, 22 nt, Human
uucuucaaauagcagggaguca

SEQ ID NO: 150806 - RNA, 23 nt, Human
uucaaaacuggaaaaucagaugc

SEQ ID NO: 150807 - RNA, 22 nt, Human
cccuggcagagggggcaggugc

SEQ ID NO: 150808 - RNA, 18 nt, Human
ucuaggagaguaccuacc

SEQ ID NO: 150809 - RNA, 22 nt, Human
caaaaguucucacccagacaug

SEQ ID NO: 150810 - RNA, 22 nt, Human
ccagggggcuuggugaggccau

SEQ ID NO: 150811 - RNA, 22 nt, Human
ugcaggcugaggcuggcucaac

SEQ ID NO: 150812 - RNA, 22 nt, Human
aacuuucagcaaguaauucugg

SEQ ID NO: 150813 - RNA, 22 nt, Human
cuguaugaaauuaaguaaacag

SEQ ID NO: 150814 - RNA, 22 nt, Human
caggucccugcgccccggccuc

SEQ ID NO: 150815 - RNA, 19 nt, Human
acuggcagcuguagucugu

SEQ ID NO: 150816 - RNA, 22 nt, Human
uggcacaguccugggugccugc

SEQ ID NO: 150817 - RNA, 22 nt, Human
ucccagccacaguuuccaccug

SEQ ID NO: 150818 - RNA, 22 nt, Human
aagagcacuaacagagcugaua

SEQ ID NO: 150819 - RNA, 22 nt, Human
aauacugucuuucacagauauu

SEQ ID NO: 150820 - RNA, 22 nt, Human
acuggcuugaaguagauucaaa

SEQ ID NO: 150821 - RNA, 22 nt, Human
ucaggcucuacacuugacacac

SEQ ID NO: 150822 - RNA, 22 nt, Human
gagcucagauucuggugucaga

SEQ ID NO: 150823 - RNA, 22 nt, Human
gaugaagcuuugaagucuaauc

SEQ ID NO: 150824 - RNA, 22 nt, Human
acuggcagguccaucgcccuuu

SEQ ID NO: 150825 - RNA, 22 nt, Human
cagguggccaguacucaaggau

SEQ ID NO: 150826 - RNA, 22 nt, Human
uuucaaauagaaucuuuccaaa

SEQ ID NO: 150827 - RNA, 21 nt, Human
ugacugaggcuucuucacaca

SEQ ID NO: 150828 - RNA, 22 nt, Human
ucugggcuggcuuuaugcugac

SEQ ID NO: 150829 - RNA, 22 nt, Human
uuguuaaagaugcagauuccau

SEQ ID NO: 150830 - RNA, 22 nt, Human
cugagagaucaagccacaggau

SEQ ID NO: 150831 - RNA, 22 nt, Human
cacaacuuuaggaaccacauuc

SEQ ID NO: 150832 - RNA, 22 nt, Human
ccugggcucaccaugccuugga

SEQ ID NO: 150833 - RNA, 22 nt, Human
cugaaagaauaagauguuuaca

SEQ ID NO: 150834 - RNA, 22 nt, Human
gugggcuggauuugcuugcaga

SEQ ID NO: 150835 - RNA, 22 nt, Human
cuacauaaauuuaucacagacu

SEQ ID NO: 150836 - RNA, 22 nt, Human
uuccggaagguucucuagaauu

SEQ ID NO: 150837 - RNA, 22 nt, Human
cugggcucaccuguggcuggca

SEQ ID NO: 150838 - RNA, 22 nt, Human
agagugaaaagcuagagcagua

SEQ ID NO: 150839 - RNA, 22 nt, Human
gacuguggggggcggacacaag

SEQ ID NO: 150840 - RNA, 22 nt, Human
ugcaggcucaucucaagaguag

SEQ ID NO: 150841 - RNA, 22 nt, Human
aaagagucuggcacuguaccag

SEQ ID NO: 150842 - RNA, 22 nt, Human
ccaggcuccccaggaggcccuu

SEQ ID NO: 150843 - RNA, 22 nt, Human
gagccagguuugaaucucaguc

SEQ ID NO: 150844 - RNA, 22 nt, Human
uucuguauauuguaaagacuca

SEQ ID NO: 150845 - RNA, 22 nt, Human
gcuguucacaucuggaccauuu

SEQ ID NO: 150846 - RNA, 22 nt, Human
cauaaguuggguaauauaauga

SEQ ID NO: 150847 - RNA, 22 nt, Human
caugaagcuugaagcaguccac

SEQ ID NO: 150848 - RNA, 22 nt, Human
ccugggcuugcaucugugcugg

SEQ ID NO: 150849 - RNA, 22 nt, Human
gccuggaaugcaaugugacgaa

SEQ ID NO: 150850 - RNA, 22 nt, Human
agcacaggaacauggagauggg

SEQ ID NO: 150851 - RNA, 22 nt, Human
auuaaagaaacccagcauguga

SEQ ID NO: 150852 - RNA, 20 nt, Human
ugccaggcacggagugcaug

SEQ ID NO: 150853 - RNA, 20 nt, Human
ggcugcaggacucauuggcu

SEQ ID NO: 150854 - RNA, 22 nt, Human
ugcaggcuguaaucugaggcua

SEQ ID NO: 150855 - RNA, 22 nt, Human
cagcucagucuugaagcacugg

SEQ ID NO: 150856 - RNA, 22 nt, Human
cuccuggcucgcccccagcuga

SEQ ID NO: 150857 - RNA, 21 nt, Human
aaagagcccgcugagagguuc

SEQ ID NO: 150858 - RNA, 22 nt, Human
guaugaaguaagauauuguuca

SEQ ID NO: 150859 - RNA, 22 nt, Human
ugcaggcuuggaucacaucucc

SEQ ID NO: 150860 - RNA, 22 nt, Human
ugcaggcuguuugguggaucuc

SEQ ID NO: 150861 - RNA, 22 nt, Human
ggaggacaggggcugcagcaca

SEQ ID NO: 150862 - RNA, 22 nt, Human
auuaaaauuccaagguaugcca

SEQ ID NO: 150863 - RNA, 22 nt, Human
gccaagcucuuuaaaggccaaa

SEQ ID NO: 150864 - RNA, 20 nt, Human
acuccagguggcaugaggac

SEQ ID NO: 150865 - RNA, 22 nt, Human
augacugcucugggcucccaug

SEQ ID NO: 150866 - RNA, 18 nt, Human
cucucuuuccacucuuug

SEQ ID NO: 150867 - RNA, 22 nt, Human
gacucguucauaguuccaauuu

SEQ ID NO: 150868 - RNA, 22 nt, Human
uacacaucacuguaucuuucag

SEQ ID NO: 150869 - RNA, 22 nt, Human
ccuggggaauagagucaagggg

SEQ ID NO: 150870 - RNA, 22 nt, Human
ucuguucagaagaggugaaagu

SEQ ID NO: 150871 - RNA, 22 nt, Human
ucagcucuaaguuuuaugcaaa

SEQ ID NO: 150872 - RNA, 22 nt, Human
aaugaagccacugaagacaauc

SEQ ID NO: 150873 - RNA, 22 nt, Human
uggcaucuccgacagucuugau

SEQ ID NO: 150874 - RNA, 22 nt, Human
acaucccacagaaacauacaua

SEQ ID NO: 150875 - RNA, 22 nt, Human
aucuagauuagguauaagagcu

SEQ ID NO: 150876 - RNA, 22 nt, Human
cccccaaaguuugcacggauaa

SEQ ID NO: 150877 - RNA, 22 nt, Human
caggccucuuccaugcagcagc

SEQ ID NO: 150878 - RNA, 22 nt, Human
ucacacauuucucaaguguagg

SEQ ID NO: 150879 - RNA, 21 nt, Human
acaggcucacgauccauuucu

SEQ ID NO: 150880 - RNA, 22 nt, Human
gagcucagcaaaggucugugug

SEQ ID NO: 150881 - RNA, 22 nt, Human
cugcaggcccccuuccuggagu

SEQ ID NO: 150882 - RNA, 22 nt, Human
aguguugggucuuuagaauuua

SEQ ID NO: 150883 - RNA, 22 nt, Human
gcuggcaggagccuuucccuuu

SEQ ID NO: 150884 - RNA, 22 nt, Human
aguaugaauugcuuugccugua

SEQ ID NO: 150885 - RNA, 22 nt, Human
acuggcagagggaaaaccauuc

SEQ ID NO: 150886 - RNA, 18 nt, Human
cuccuggcugauggugag

SEQ ID NO: 150887 - RNA, 22 nt, Human
cugggcuguuuguucuggucuc

SEQ ID NO: 150888 - RNA, 21 nt, Human
agugccaguagguauggagga

SEQ ID NO: 150889 - RNA, 22 nt, Human
augggcugagaaucaagaauau

SEQ ID NO: 150890 - RNA, 22 nt, Human
aaauuacagaucaccaaugcau

SEQ ID NO: 150891 - RNA, 23 nt, Human
cugggcugcuugagucccuggcu

SEQ ID NO: 150892 - RNA, 22 nt, Human
agcaggcuaagggaccuguuua

SEQ ID NO: 150893 - RNA, 22 nt, Human
uuuuauguaauccuuacugucg

SEQ ID NO: 150894 - RNA, 22 nt, Human
cccacacacauuuaugauagga

SEQ ID NO: 150895 - RNA, 22 nt, Human
acuguucacagauuagucgaug

SEQ ID NO: 150896 - RNA, 22 nt, Human
acaaaagugagugugucucaga

SEQ ID NO: 150897 - RNA, 22 nt, Human
ucacacaugcuaagccagagau

SEQ ID NO: 150898 - RNA, 22 nt, Human
gaauauuuuuaaagggacuaau

SEQ ID NO: 150899 - RNA, 22 nt, Human
ccagcucucuuugaagcauaaa

SEQ ID NO: 150900 - RNA, 17 nt, Human
ucgguuugccaggcuuc

SEQ ID NO: 150901 - RNA, 20 nt, Human
aggcucugccugcaggccca

SEQ ID NO: 150902 - RNA, 22 nt, Human
ugcuucuguuucauugaucuua

SEQ ID NO: 150903 - RNA, 22 nt, Human
caugagauuugggaggggccag

SEQ ID NO: 150904 - RNA, 22 nt, Human
auuuccagcagcauauuugucu

SEQ ID NO: 150905 - RNA, 22 nt, Human
cagaguuuuaucauacguggau

SEQ ID NO: 150906 - RNA, 22 nt, Human
ucuggggagcagcccuggugag

SEQ ID NO: 150907 - RNA, 22 nt, Human
gaggugagaagggggucagaug

SEQ ID NO: 150908 - RNA, 22 nt, Human
gguuccuucugaggucccugua

SEQ ID NO: 150909 - RNA, 23 nt, Human
ucacauaauccuucauccacagg

SEQ ID NO: 150910 - RNA, 22 nt, Human
uauuccaaaaucccaaacugcc

SEQ ID NO: 150911 - RNA, 21 nt, Human
ucacacacguuuccaagggca

SEQ ID NO: 150912 - RNA, 22 nt, Human
ugcagagaagaggacaguucua

SEQ ID NO: 150913 - RNA, 22 nt, Human
aguaugaauggaaacuaccuau

SEQ ID NO: 150914 - RNA, 22 nt, Human
accaagcuucguggaggaaguu

SEQ ID NO: 150915 - RNA, 22 nt, Human
ccugaccuauuuuucucagcug

SEQ ID NO: 150916 - RNA, 20 nt, Human
uucaugggagcaaagaggcc

SEQ ID NO: 150917 - RNA, 22 nt, Human
uugcauuccaguccccacugug

SEQ ID NO: 150918 - RNA, 22 nt, Human
aagaggucauaccagauaaggg

SEQ ID NO: 150919 - RNA, 22 nt, Human
ccugggcucaagugaugguccc

SEQ ID NO: 150920 - RNA, 22 nt, Human
uggcacucacucucagagucug

SEQ ID NO: 150921 - RNA, 22 nt, Human
agcuuguuagaaauguagacuc

SEQ ID NO: 150922 - RNA, 22 nt, Human
cuggcagggugggcuuugcuuu

SEQ ID NO: 150923 - RNA, 22 nt, Human
cuaggaaucaccaagauucuag

SEQ ID NO: 150924 - RNA, 22 nt, Human
ccugccucccagagguccucua

SEQ ID NO: 150925 - RNA, 22 nt, Human
aacaaaagccgaaguagguguc

SEQ ID NO: 150926 - RNA, 22 nt, Human
gguggcagagaggagguaguuu

SEQ ID NO: 150927 - RNA, 22 nt, Human
gaggcucugugaugugccaggc

SEQ ID NO: 150928 - RNA, 22 nt, Human
aauuucagaccauuugcaauua

SEQ ID NO: 150929 - RNA, 22 nt, Human
uuguaaacugcugcaggagugc

SEQ ID NO: 150930 - RNA, 22 nt, Human
ccuucaaaacacuaguuuuuga

SEQ ID NO: 150931 - RNA, 22 nt, Human
uguaaaauaauucuccauguuu

SEQ ID NO: 150932 - RNA, 22 nt, Human
uccaggcuccccugcgugcucc

SEQ ID NO: 150933 - RNA, 22 nt, Human
gcuguucauagaaauggucuca

SEQ ID NO: 150934 - RNA, 22 nt, Human
agucacaguuucccugagagag

SEQ ID NO: 150935 - RNA, 23 nt, Human
gggaccugguaggaggugauugg

SEQ ID NO: 150936 - RNA, 22 nt, Human
aauuucagagguagagauucua

SEQ ID NO: 150937 - RNA, 22 nt, Human
aucuuuuacauuacugcccaga

SEQ ID NO: 150938 - RNA, 22 nt, Human
acuggcagggggagccccgaga

SEQ ID NO: 150939 - RNA, 22 nt, Human
ccuggcagguagcauugaggag

SEQ ID NO: 150940 - RNA, 20 nt, Human
agggucugaugugguggccc

SEQ ID NO: 150941 - RNA, 22 nt, Human
uggguaggggacguggaagaaa

SEQ ID NO: 150942 - RNA, 22 nt, Human
ugauucacagacuucacaaggc

SEQ ID NO: 150943 - RNA, 22 nt, Human
uguaugaaugggaaaaggaaac

SEQ ID NO: 150944 - RNA, 22 nt, Human
ucuguucaugucuuuuuaagug

SEQ ID NO: 150945 - RNA, 22 nt, Human
gcacacaguagggauucaauga

SEQ ID NO: 150946 - RNA, 22 nt, Human
uggccucugggaaagcagauuc

SEQ ID NO: 150947 - RNA, 22 nt, Human
gagacacacauucuggagagaa

SEQ ID NO: 150948 - RNA, 22 nt, Human
uauuacagaaucaggcauaacu

SEQ ID NO: 150949 - RNA, 22 nt, Human
uuuacagaucuguugauuuguu

SEQ ID NO: 150950 - RNA, 22 nt, Human
auuuacagaagcauguaauagc

SEQ ID NO: 150951 - RNA, 22 nt, Human
aguggcugccaagagcaaugcu

SEQ ID NO: 150952 - RNA, 21 nt, Human
aguugcauaggccagccaucc

SEQ ID NO: 150953 - RNA, 22 nt, Human
gguuuccugcauugggaaauuu

SEQ ID NO: 150954 - RNA, 22 nt, Human
accacccauucagaaacacuga

SEQ ID NO: 150955 - RNA, 22 nt, Human
acauaucuuucccucuccugaa

SEQ ID NO: 150956 - RNA, 22 nt, Human
ucuggggauggucuacuuucug

SEQ ID NO: 150957 - RNA, 22 nt, Human
ucccucuaaacuguaagauucu

SEQ ID NO: 150958 - RNA, 20 nt, Human
uauuugaaauggccaagugu

SEQ ID NO: 150959 - RNA, 22 nt, Human
agcaggcugggcaauaugggca

SEQ ID NO: 150960 - RNA, 22 nt, Human
cacacagaugguaagggaggga

SEQ ID NO: 150961 - RNA, 22 nt, Human
cagguuggggacuuaggaugac

SEQ ID NO: 150962 - RNA, 22 nt, Human
ucuggcaggucaaucauucuuu

SEQ ID NO: 150963 - RNA, 22 nt, Human
uggcagagaacacggcugaucu

SEQ ID NO: 150964 - RNA, 21 nt, Human
cuacuuaaguaggggauuagg

SEQ ID NO: 150965 - RNA, 19 nt, Human
gacuccaacuuuaagcaug

SEQ ID NO: 150966 - RNA, 22 nt, Human
gggcugacaguuuccccugaaa

SEQ ID NO: 150967 - RNA, 22 nt, Human
ccuggggagagaaagcccagcc

SEQ ID NO: 150968 - RNA, 22 nt, Human
cagcucuggguaggaggaaucu

SEQ ID NO: 150969 - RNA, 22 nt, Human
gcacacaggggaguucucagaa

SEQ ID NO: 150970 - RNA, 21 nt, Human
ugcaggcugugcgcuccugcc

SEQ ID NO: 150971 - RNA, 22 nt, Human
ucuccaggagcaagucacccag

SEQ ID NO: 150972 - RNA, 22 nt, Human
gcagggguagugucuuccugag

SEQ ID NO: 150973 - RNA, 22 nt, Human
agaggccugugugcuccagugg

SEQ ID NO: 150974 - RNA, 22 nt, Human
uccugagcaacacagcuaagug

SEQ ID NO: 150975 - RNA, 22 nt, Human
uaagauguuuugguuugauaag

SEQ ID NO: 150976 - RNA, 22 nt, Human
gagaaagauguaggcugggagg

SEQ ID NO: 150977 - RNA, 22 nt, Human
ggagacucggguucuagccuug

SEQ ID NO: 150978 - RNA, 22 nt, Human
cccacccugggaagcuaggcag

SEQ ID NO: 150979 - RNA, 22 nt, Human
guccucuggaagaugaguucuu

SEQ ID NO: 150980 - RNA, 22 nt, Human
gaggagcucaugaaagcggugu

SEQ ID NO: 150981 - RNA, 22 nt, Human
acauacacaagcguacaugaac

SEQ ID NO: 150982 - RNA, 22 nt, Human
cugggcugcaguuccugguccu

SEQ ID NO: 150983 - RNA, 22 nt, Human
auuuguaauuucuuaucugugu

SEQ ID NO: 150984 - RNA, 22 nt, Human
caguauagaaaguuuuaaauug

SEQ ID NO: 150985 - RNA, 22 nt, Human
gcuuuuaauuaguugcuuccau

SEQ ID NO: 150986 - RNA, 22 nt, Human
uggccaggccucuuggugccca

SEQ ID NO: 150987 - RNA, 22 nt, Human
guugcacaguuccucaagcagg

SEQ ID NO: 150988 - RNA, 18 nt, Human
ccaaggccccugcugggg

SEQ ID NO: 150989 - RNA, 22 nt, Human
cuaugaaaggauuuggaguugu

SEQ ID NO: 150990 - RNA, 22 nt, Human
cuccuggcacugucuugaccca

SEQ ID NO: 150991 - RNA, 22 nt, Human
uauuccagugugaucuuuguag

SEQ ID NO: 150992 - RNA, 22 nt, Human
uucauuccuucccuaagcaacu

SEQ ID NO: 150993 - RNA, 22 nt, Human
gccuccuggguucaugccauuc

SEQ ID NO: 150994 - RNA, 22 nt, Human
uuguaugaggauagcaagaagc

SEQ ID NO: 150995 - RNA, 22 nt, Human
caccuaggguuucgccuuucuu

SEQ ID NO: 150996 - RNA, 22 nt, Human
acuggcagagacccugauggcc

SEQ ID NO: 150997 - RNA, 22 nt, Human
ccaggcuccucaugaucuuguu

SEQ ID NO: 150998 - RNA, 22 nt, Human
uguaugaagccagaaucuguuu

SEQ ID NO: 150999 - RNA, 22 nt, Human
aaagcucuuauagcagagugug

SEQ ID NO: 151000 - RNA, 22 nt, Human
gcccaagcuggacugcaguggc

SEQ ID NO: 151001 - RNA, 22 nt, Human
gggaccuggacaugugugugcu

SEQ ID NO: 151002 - RNA, 22 nt, Human
cacacacucuuccuggcaccua

SEQ ID NO: 151003 - RNA, 22 nt, Human
caggcuggagugcaauggcaca

SEQ ID NO: 151004 - RNA, 21 nt, Human
cacacagugaucuauccacau

SEQ ID NO: 151005 - RNA, 22 nt, Human
acugggcucccaggcuugucau

SEQ ID NO: 151006 - RNA, 22 nt, Human
aguaaaauuaauggaucagaag

SEQ ID NO: 151007 - RNA, 22 nt, Human
gcuguucaaaagccacaguuac

SEQ ID NO: 151008 - RNA, 22 nt, Human
ucuguucagacacuuuacaugu

SEQ ID NO: 151009 - RNA, 22 nt, Human
ucaggcccuuugcugcugcccc

SEQ ID NO: 151010 - RNA, 22 nt, Human
ucacuguauuuggaagggaugg

SEQ ID NO: 151011 - RNA, 22 nt, Human
uguuggaauuaggauacagagg

SEQ ID NO: 151012 - RNA, 22 nt, Human
uaaacauuuguuauucuuguuu

SEQ ID NO: 151013 - RNA, 22 nt, Human
cuucugggcauggcagagccug

SEQ ID NO: 151014 - RNA, 22 nt, Human
agcaggcuuucaagagucuucu

SEQ ID NO: 151015 - RNA, 22 nt, Human
ucaggcucaggaauguguuuau

SEQ ID NO: 151016 - RNA, 22 nt, Human
uacacagaaccugguguacagu

SEQ ID NO: 151017 - RNA, 22 nt, Human
ggcucugcaugugagugggugg

SEQ ID NO: 151018 - RNA, 22 nt, Human
uuccaggauagcuuucaggaau

SEQ ID NO: 151019 - RNA, 22 nt, Human
ggcaggcuugguggcaccgguu

SEQ ID NO: 151020 - RNA, 22 nt, Human
uccuggcauugugcagggugug

SEQ ID NO: 151021 - RNA, 22 nt, Human
agaaagaggaugcagaucucau

SEQ ID NO: 151022 - RNA, 20 nt, Human
guggcaggcagugaaggagc

SEQ ID NO: 151023 - RNA, 22 nt, Human
ucuguucaucaucuggacacau

SEQ ID NO: 151024 - RNA, 22 nt, Human
uuccaagugaaaguagcuuugu

SEQ ID NO: 151025 - RNA, 23 nt, Human
gcugggcuuacucuuucagugag

SEQ ID NO: 151026 - RNA, 22 nt, Human
cuuuccaaugucacuaugaauc

SEQ ID NO: 151027 - RNA, 20 nt, Human
gcuccaggucagagaggacg

SEQ ID NO: 151028 - RNA, 22 nt, Human
cagcucuguucauagauggugc

SEQ ID NO: 151029 - RNA, 22 nt, Human
ggccucaguuucuccauggguu

SEQ ID NO: 151030 - RNA, 22 nt, Human
guggcagugaaggucauagcau

SEQ ID NO: 151031 - RNA, 22 nt, Human
uuggguaggagaaagaacagau

SEQ ID NO: 151032 - RNA, 22 nt, Human
ccugaggggcugcaggccagcu

SEQ ID NO: 151033 - RNA, 22 nt, Human
uuccaggacaagauguuucagg

SEQ ID NO: 151034 - RNA, 22 nt, Human
ccuucuucuguguggcccaaga

SEQ ID NO: 151035 - RNA, 22 nt, Human
gcagcucuuuucuuaaagagau

SEQ ID NO: 151036 - RNA, 22 nt, Human
guaugaaguuggacuguauaaa

SEQ ID NO: 151037 - RNA, 22 nt, Human
ucuggcagcuauccucuggcca

SEQ ID NO: 151038 - RNA, 22 nt, Human
ucuggcaggccuugucaaucug

SEQ ID NO: 151039 - RNA, 22 nt, Human
cuuuucacaggaggauaagccc

SEQ ID NO: 151040 - RNA, 22 nt, Human
uuaggaaguguguccagaagcg

SEQ ID NO: 151041 - RNA, 22 nt, Human
ccugggcucaagugauccuccu

SEQ ID NO: 151042 - RNA, 22 nt, Human
augggcugacuaaugguaaacu

SEQ ID NO: 151043 - RNA, 22 nt, Human
ccugggcucacagccaaggcuc

SEQ ID NO: 151044 - RNA, 22 nt, Human
aaauacugcugcuauuccuuuu

SEQ ID NO: 151045 - RNA, 22 nt, Human
ggcaggcugggagucaucagag

SEQ ID NO: 151046 - RNA, 22 nt, Human
gucauuccuuauguugauucag

SEQ ID NO: 151047 - RNA, 22 nt, Human
gaacugaguuuucugccuggac

SEQ ID NO: 151048 - RNA, 22 nt, Human
uuggagagcaguaaaccacacu

SEQ ID NO: 151049 - RNA, 22 nt, Human
uugauuccuugaaauauccuug

SEQ ID NO: 151050 - RNA, 22 nt, Human
uggcaugggcaaaccagggaaa

SEQ ID NO: 151051 - RNA, 22 nt, Human
uccugccuguuuaccuguacuu

SEQ ID NO: 151052 - RNA, 22 nt, Human
aggaggcuuuugcaggugccac

SEQ ID NO: 151053 - RNA, 22 nt, Human
ugcaggcuccacguuguugucc

SEQ ID NO: 151054 - RNA, 22 nt, Human
cccagccuacucugccauagca

SEQ ID NO: 151055 - RNA, 22 nt, Human
ccuuuaaagacugcauaacuuc

SEQ ID NO: 151056 - RNA, 22 nt, Human
cccuuccugggugucccggagu

SEQ ID NO: 151057 - RNA, 22 nt, Human
uucccacauucuuuacauucau

SEQ ID NO: 151058 - RNA, 22 nt, Human
guccaagagucaagaagggggc

SEQ ID NO: 151059 - RNA, 22 nt, Human
cauuugaaauaguucauucuug

SEQ ID NO: 151060 - RNA, 22 nt, Human
ugaagccacuuuccagaaucac

SEQ ID NO: 151061 - RNA, 22 nt, Human
caaaagucuuccuauucucuua

SEQ ID NO: 151062 - RNA, 22 nt, Human
acaucacaguaguuaagccaga

SEQ ID NO: 151063 - RNA, 22 nt, Human
ugcuucugcaggagcuccugau

SEQ ID NO: 151064 - RNA, 22 nt, Human
uuauauaucuugauuuguucca

SEQ ID NO: 151065 - RNA, 22 nt, Human
cauuugaauuguucugugggaa

SEQ ID NO: 151066 - RNA, 22 nt, Human
acugggcugguuaguuuuacua

SEQ ID NO: 151067 - RNA, 22 nt, Human
aguaugaagaauacauagauga

SEQ ID NO: 151068 - RNA, 22 nt, Human
agcaggcuuguuaugucugaga

SEQ ID NO: 151069 - RNA, 22 nt, Human
caaauauuccagguacaucccu

SEQ ID NO: 151070 - RNA, 22 nt, Human
ccccuguguuguucaaggguca

SEQ ID NO: 151071 - RNA, 22 nt, Human
cuccuggcaggcugagugaaau

SEQ ID NO: 151072 - RNA, 20 nt, Human
agggcugagaagggacuagc

SEQ ID NO: 151073 - RNA, 22 nt, Human
uuccugccccugagagcuccca

SEQ ID NO: 151074 - RNA, 22 nt, Human
ccuggcagcuaagugcuuugag

SEQ ID NO: 151075 - RNA, 22 nt, Human
cccuuccuugugacuggugggg

SEQ ID NO: 151076 - RNA, 17 nt, Human
uugggagagaaagguau

SEQ ID NO: 151077 - RNA, 22 nt, Human
uuggaagacagugaaacagcac

SEQ ID NO: 151078 - RNA, 22 nt, Human
gguucccggaucuccgaguccc

SEQ ID NO: 151079 - RNA, 22 nt, Human
uguaacacucaaucuguuuaac

SEQ ID NO: 151080 - RNA, 22 nt, Human
cacacacaguuuuguauucugu

SEQ ID NO: 151081 - RNA, 22 nt, Human
accaagcuguauauuauugguu

SEQ ID NO: 151082 - RNA, 22 nt, Human
auuugaagaaaguuuucuagau

SEQ ID NO: 151083 - RNA, 22 nt, Human
augggcugacccagucguggca

SEQ ID NO: 151084 - RNA, 22 nt, Human
uccaggcuaauuuugcauuguu

SEQ ID NO: 151085 - RNA, 22 nt, Human
acaucacacgccuuccaggagg

SEQ ID NO: 151086 - RNA, 22 nt, Human
gcuggggagcuagaccucagca

SEQ ID NO: 151087 - RNA, 22 nt, Human
aggggugugcauccuggaggau

SEQ ID NO: 151088 - RNA, 22 nt, Human
cugugggaugggaccucagcug

SEQ ID NO: 151089 - RNA, 22 nt, Human
gggcugaccccaccccucacuc

SEQ ID NO: 151090 - RNA, 22 nt, Human
gagaaagacguaggcugggagg

SEQ ID NO: 151091 - RNA, 22 nt, Human
ucccagccuuccuuguggugaa

SEQ ID NO: 151092 - RNA, 22 nt, Human
gcucucagaugcuccagcagcc

SEQ ID NO: 151093 - RNA, 22 nt, Human
gccaggcauguccucugcagaa

SEQ ID NO: 151094 - RNA, 22 nt, Human
guaacauaguuugugcuucauc

SEQ ID NO: 151095 - RNA, 22 nt, Human
ggcaggcuggcuuuguuccagg

SEQ ID NO: 151096 - RNA, 22 nt, Human
ugcuucuggaaacaguggcugu

SEQ ID NO: 151097 - RNA, 22 nt, Human
cucugagauaguuucuaucaau

SEQ ID NO: 151098 - RNA, 22 nt, Human
ugucuucaguaaaauacacuau

SEQ ID NO: 151099 - RNA, 19 nt, Human
ucugcagaaggcauacaug

SEQ ID NO: 151100 - RNA, 22 nt, Human
cuggcacgcccacguaggcacu

SEQ ID NO: 151101 - RNA, 22 nt, Human
gcacacacaugugaguacaugc

SEQ ID NO: 151102 - RNA, 22 nt, Human
uuccaggcucccuuggaggugu

SEQ ID NO: 151103 - RNA, 21 nt, Human
uccacccucucugcucccagu

SEQ ID NO: 151104 - RNA, 22 nt, Human
aggugaguuacaggaggagguc

SEQ ID NO: 151105 - RNA, 22 nt, Human
uaaauuuacccaaggaacaugu

SEQ ID NO: 151106 - RNA, 22 nt, Human
guggcaggggcgggcuguuccg

SEQ ID NO: 151107 - RNA, 22 nt, Human
gggaccugcgccacucacuguc

SEQ ID NO: 151108 - RNA, 22 nt, Human
ggcuucugcucagccugcacgc

SEQ ID NO: 151109 - RNA, 22 nt, Human
caaauacuacgauucuugcagu

SEQ ID NO: 151110 - RNA, 22 nt, Human
uacacaucccagacucccagga

SEQ ID NO: 151111 - RNA, 22 nt, Human
uuauuccaguaaucucuguaau

SEQ ID NO: 151112 - RNA, 22 nt, Human
aaagcuaugaggcaugcauuuc

SEQ ID NO: 151113 - RNA, 19 nt, Human
uccuggcacaguggaacca

SEQ ID NO: 151114 - RNA, 22 nt, Human
guccucuguguaggcugcagac

SEQ ID NO: 151115 - RNA, 22 nt, Human
ucuucauuuuacaggcagaccu

SEQ ID NO: 151116 - RNA, 21 nt, Human
acacagaggcaucaucacuuu

SEQ ID NO: 151117 - RNA, 21 nt, Human
guacacacagguggaugggcu

SEQ ID NO: 151118 - RNA, 22 nt, Human
gauggccuuguuuucucccuuc

SEQ ID NO: 151119 - RNA, 22 nt, Human
cuuccagguccuucuugagaag

SEQ ID NO: 151120 - RNA, 22 nt, Human
acacccaggcuggcgugcagug

SEQ ID NO: 151121 - RNA, 22 nt, Human
ccacacagauaaguguuuucua

SEQ ID NO: 151122 - RNA, 22 nt, Human
acuguucacccagcacuagcag

SEQ ID NO: 151123 - RNA, 17 nt, Human
ccauacugacauauuga

SEQ ID NO: 151124 - RNA, 22 nt, Human
ucccuccccacuucugagcuuu

SEQ ID NO: 151125 - RNA, 22 nt, Human
gaaauauucuugucuuguuuuc

SEQ ID NO: 151126 - RNA, 22 nt, Human
aauguucagaggacaauauaaa

SEQ ID NO: 151127 - RNA, 22 nt, Human
gcuggcaguaaaggguuuggca

SEQ ID NO: 151128 - RNA, 22 nt, Human
agcagguugugauacacucaga

SEQ ID NO: 151129 - RNA, 22 nt, Human
uuucacauuggcuucuauuucu

SEQ ID NO: 151130 - RNA, 22 nt, Human
cugggccugucagggcuuuuug

SEQ ID NO: 151131 - RNA, 22 nt, Human
uggcagagcccagacuccaguc

SEQ ID NO: 151132 - RNA, 22 nt, Human
gaagcuucguggcucuucaaau

SEQ ID NO: 151133 - RNA, 22 nt, Human
gggcuaggcuuggccagcacug

SEQ ID NO: 151134 - RNA, 22 nt, Human
augggcugcuucuccagcaccu

SEQ ID NO: 151135 - RNA, 22 nt, Human
uauuccaguccuauccucuuuu

SEQ ID NO: 151136 - RNA, 22 nt, Human
ggagcugaguucuucagccggg

SEQ ID NO: 151137 - RNA, 19 nt, Human
ccagcccacagugacuuuc

SEQ ID NO: 151138 - RNA, 22 nt, Human
cccuuccucccaggcuucugug

SEQ ID NO: 151139 - RNA, 22 nt, Human
gcuguucagaugcgauucagga

SEQ ID NO: 151140 - RNA, 22 nt, Human
cuggggacgucgggcaguguuc

SEQ ID NO: 151141 - RNA, 22 nt, Human
uggcagugucuuaucaggagug

SEQ ID NO: 151142 - RNA, 22 nt, Human
agcacagggacaaugccaggug

SEQ ID NO: 151143 - RNA, 22 nt, Human
aguuuccaaagcauguucacac

SEQ ID NO: 151144 - RNA, 22 nt, Human
ugcugagcgcauccggcggccg

SEQ ID NO: 151145 - RNA, 22 nt, Human
auaugaaguuacagguaagaaa

SEQ ID NO: 151146 - RNA, 22 nt, Human
gaugaagcuauuugguuggcac

SEQ ID NO: 151147 - RNA, 22 nt, Human
cuucuuaaauuggauugcuauu

SEQ ID NO: 151148 - RNA, 22 nt, Human
caggcccucaggcaagggcucu

SEQ ID NO: 151149 - RNA, 22 nt, Human
gcaggcucaaaagcugguagga

SEQ ID NO: 151150 - RNA, 22 nt, Human
gggccccuugcugcucugcugg

SEQ ID NO: 151151 - RNA, 22 nt, Human
ccuggcaggcuggggacagugc

SEQ ID NO: 151152 - RNA, 22 nt, Human
uaauuucaauagcuugcauaau

SEQ ID NO: 151153 - RNA, 22 nt, Human
ucccacccccuccaaggaggaa

SEQ ID NO: 151154 - RNA, 22 nt, Human
gcagcucugacaaugccuggaa

SEQ ID NO: 151155 - RNA, 21 nt, Human
aggcugcuggcucaggguccu

SEQ ID NO: 151156 - RNA, 22 nt, Human
guucuguacuccaagcucuucc

SEQ ID NO: 151157 - RNA, 22 nt, Human
uucuggggcuaauacagagguc

SEQ ID NO: 151158 - RNA, 19 nt, Human
aggugagugugggaaaggg

SEQ ID NO: 151159 - RNA, 22 nt, Human
cauacauuuauacacaucuaug

SEQ ID NO: 151160 - RNA, 22 nt, Human
ucaggguugcugugaucagucc

SEQ ID NO: 151161 - RNA, 22 nt, Human
agggagacacaugaggaaguca

SEQ ID NO: 151162 - RNA, 22 nt, Human
gcacauacccacugucaagcac

SEQ ID NO: 151163 - RNA, 22 nt, Human
ccaggcucugccaggcccuuga

SEQ ID NO: 151164 - RNA, 22 nt, Human
gcaggugaugugaugugagcau

SEQ ID NO: 151165 - RNA, 17 nt, Human
agccugccccaugcugc

SEQ ID NO: 151166 - RNA, 22 nt, Human
caugaagcccucaucagucuga

SEQ ID NO: 151167 - RNA, 22 nt, Human
aagcuuucagagcagaauguga

SEQ ID NO: 151168 - RNA, 22 nt, Human
ugcuucugacuaagcugcauga

SEQ ID NO: 151169 - RNA, 22 nt, Human
ggcuucuggugggagcaugacu

SEQ ID NO: 151170 - RNA, 22 nt, Human
ccugggcuucugucuagauguu

SEQ ID NO: 151171 - RNA, 22 nt, Human
gccgggaccaaggccacggagc

SEQ ID NO: 151172 - RNA, 22 nt, Human
ugcuucuggcacuugagggggu

SEQ ID NO: 151173 - RNA, 22 nt, Human
cugccugcaggacaccucgcua

SEQ ID NO: 151174 - RNA, 22 nt, Human
gcacaggaugauggguugaggg

SEQ ID NO: 151175 - RNA, 23 nt, Human
acugggcugaaauuuuucauggc

SEQ ID NO: 151176 - RNA, 22 nt, Human
uucaagauggccccagugagcc

SEQ ID NO: 151177 - RNA, 22 nt, Human
ugcagccccugaaaauggcagc

SEQ ID NO: 151178 - RNA, 22 nt, Human
uuccaagucacccuuaggguca

SEQ ID NO: 151179 - RNA, 22 nt, Human
acuggcagcuguaggaugcaug

SEQ ID NO: 151180 - RNA, 22 nt, Human
ggcaggcucagcagccaaggag

SEQ ID NO: 151181 - RNA, 22 nt, Human
ccuggggaaucuugcaggggaa

SEQ ID NO: 151182 - RNA, 22 nt, Human
ggcugcagagcugggugggccu

SEQ ID NO: 151183 - RNA, 22 nt, Human
aggccacaguacuuugcagacc

SEQ ID NO: 151184 - RNA, 22 nt, Human
ucaggcucuggguacaccugac

SEQ ID NO: 151185 - RNA, 22 nt, Human
gaagcacugccauaauucagac

SEQ ID NO: 151186 - RNA, 22 nt, Human
gggucaggcucagcagggcagc

SEQ ID NO: 151187 - RNA, 22 nt, Human
ucugggcugcugugcagugacc

SEQ ID NO: 151188 - RNA, 22 nt, Human
agguggcucugacagcucuggu

SEQ ID NO: 151189 - RNA, 23 nt, Human
guccucuggagagaaaggcagua

SEQ ID NO: 151190 - RNA, 22 nt, Human
ccacagaccuuggcuuccaccu

SEQ ID NO: 151191 - RNA, 22 nt, Human
guacacacuauuuaaaguguuu

SEQ ID NO: 151192 - RNA, 22 nt, Human
aggcccaaaagaaaccacuggg

SEQ ID NO: 151193 - RNA, 21 nt, Human
acacacucugagucuucuauu

SEQ ID NO: 151194 - RNA, 22 nt, Human
ccuggggauucugacacggagu

SEQ ID NO: 151195 - RNA, 20 nt, Human
cuaggaacuauggucuggcu

SEQ ID NO: 151196 - RNA, 22 nt, Human
agaaauaugcugauuagaugaa

SEQ ID NO: 151197 - RNA, 22 nt, Human
auuuaaugucgagcuauuguag

SEQ ID NO: 151198 - RNA, 22 nt, Human
ugcaggcucugguuuauagugc

SEQ ID NO: 151199 - RNA, 18 nt, Human
uccuggcagucagagagg

SEQ ID NO: 151200 - RNA, 22 nt, Human
ggccucagaccggagcuggcca

SEQ ID NO: 151201 - RNA, 20 nt, Human
gcuggcagaugucuugagau

SEQ ID NO: 151202 - RNA, 20 nt, Human
ggcaggcuuuauauggaggg

SEQ ID NO: 151203 - RNA, 22 nt, Human
ugggcugagcacugaggaagga

SEQ ID NO: 151204 - RNA, 22 nt, Human
uuagaauuauuguuuccuucua

SEQ ID NO: 151205 - RNA, 22 nt, Human
cagggacaauggcagagccuga

SEQ ID NO: 151206 - RNA, 22 nt, Human
cuccaagucggcugcagcugga

SEQ ID NO: 151207 - RNA, 22 nt, Human
aaguuucaugauguaauuauug

SEQ ID NO: 151208 - RNA, 22 nt, Human
acacacagaaggaagccccacu

SEQ ID NO: 151209 - RNA, 22 nt, Human
auaugagagaggaaagauuuua

SEQ ID NO: 151210 - RNA, 17 nt, Human
gcuaggagagggaggag

SEQ ID NO: 151211 - RNA, 22 nt, Human
caggaguggugugagggacucc

SEQ ID NO: 151212 - RNA, 22 nt, Human
ggcagagguagcuggaaccagg

SEQ ID NO: 151213 - RNA, 22 nt, Human
ggaccaggccagccucccugcg

SEQ ID NO: 151214 - RNA, 22 nt, Human
gcuggcaggagaccauacccua

SEQ ID NO: 151215 - RNA, 22 nt, Human
agcuuugggcagaagaggauuc

SEQ ID NO: 151216 - RNA, 15 nt, Human
cacacagacagcuug

SEQ ID NO: 151217 - RNA, 22 nt, Human
gaccaccagagguccgugggua

SEQ ID NO: 151218 - RNA, 22 nt, Human
auaauucagguuuucuggcaca

SEQ ID NO: 151219 - RNA, 22 nt, Human
uggaagagaaaauccacccuua

SEQ ID NO: 151220 - RNA, 22 nt, Human
aggaggcuguggagcacuccau

SEQ ID NO: 151221 - RNA, 22 nt, Human
ggccagggggcuucagacucca

SEQ ID NO: 151222 - RNA, 22 nt, Human
uuugaaaagaaccaucgccuua

SEQ ID NO: 151223 - RNA, 22 nt, Human
cuaaaugacuuccagugguuau

SEQ ID NO: 151224 - RNA, 22 nt, Human
ucuuugaaaagauauuccuccu

SEQ ID NO: 151225 - RNA, 22 nt, Human
uuauuccauagaagucaaggaa

SEQ ID NO: 151226 - RNA, 22 nt, Human
uccaaguugauguuucuuaaau

SEQ ID NO: 151227 - RNA, 22 nt, Human
ucccugccuccuggcagugcca

SEQ ID NO: 151228 - RNA, 22 nt, Human
ccaggcucugcgcuggacaugg

SEQ ID NO: 151229 - RNA, 22 nt, Human
gacccggcuccaggcccagcag

SEQ ID NO: 151230 - RNA, 22 nt, Human
uuuaaagaaauuccucaucuuu

SEQ ID NO: 151231 - RNA, 17 nt, Human
ucuguucaugcauaccu

SEQ ID NO: 151232 - RNA, 22 nt, Human
agugccccaugggugccugggg

SEQ ID NO: 151233 - RNA, 22 nt, Human
cucugggcugccuuuuagcucu

SEQ ID NO: 151234 - RNA, 22 nt, Human
acagacuggccugucucgcacc

SEQ ID NO: 151235 - RNA, 23 nt, Human
cuggggcuuucaaaucugggcag

SEQ ID NO: 151236 - RNA, 21 nt, Human
ccaggcugggagggcaguucc

SEQ ID NO: 151237 - RNA, 22 nt, Human
ccuggcaggcaagaggaaggga

SEQ ID NO: 151238 - RNA, 19 nt, Human
ugcuucuggaaccaugauc

SEQ ID NO: 151239 - RNA, 22 nt, Human
gggcugacucugcacugagcca

SEQ ID NO: 151240 - RNA, 22 nt, Human
uagaaucuaguucauucauuug

SEQ ID NO: 151241 - RNA, 20 nt, Human
ccuguucacugcgcaguuuc

SEQ ID NO: 151242 - RNA, 22 nt, Human
ccuggcagcgccgaagcuggcc

SEQ ID NO: 151243 - RNA, 22 nt, Human
cugguggagagugggcucugga

SEQ ID NO: 151244 - RNA, 22 nt, Human
ucuggcagcucaguucaggucu

SEQ ID NO: 151245 - RNA, 22 nt, Human
ggccucaguuucuucaacugua

SEQ ID NO: 151246 - RNA, 22 nt, Human
guuuacauauuuuaauugguga

SEQ ID NO: 151247 - RNA, 22 nt, Human
cccacacucugagaaaugcuga

SEQ ID NO: 151248 - RNA, 22 nt, Human
gguguugggcucacugguccuu

SEQ ID NO: 151249 - RNA, 22 nt, Human
agcaggggcuccuccacagcca

SEQ ID NO: 151250 - RNA, 22 nt, Human
ucuugggauagugucucauggc

SEQ ID NO: 151251 - RNA, 22 nt, Human
gccccaccuugagagcagaaac

SEQ ID NO: 151252 - RNA, 17 nt, Human
cucuggggacaguucua

SEQ ID NO: 151253 - RNA, 22 nt, Human
gaugccuggcacccagcaagga

SEQ ID NO: 151254 - RNA, 22 nt, Human
gagacaucauaaugaaguuucc

SEQ ID NO: 151255 - RNA, 22 nt, Human
cuaugaaaugucagauucugca

SEQ ID NO: 151256 - RNA, 22 nt, Human
cuuguucaguccugacuuccug

SEQ ID NO: 151257 - RNA, 22 nt, Human
ccugccuucagcccugaagucu

SEQ ID NO: 151258 - RNA, 22 nt, Human
cagccucugacaccacagucgu

SEQ ID NO: 151259 - RNA, 22 nt, Human
uccacccugcuuucuuaucucc

SEQ ID NO: 151260 - RNA, 22 nt, Human
ccaggcucagcuauuaagaaac

SEQ ID NO: 151261 - RNA, 22 nt, Human
cgcaggcuggcgcggaguggca

SEQ ID NO: 151262 - RNA, 21 nt, Human
uucaauacuauuucaauaguc

SEQ ID NO: 151263 - RNA, 22 nt, Human
guccucugauuucuagguauau

SEQ ID NO: 151264 - RNA, 22 nt, Human
gcuaggagugggauggaagucg

SEQ ID NO: 151265 - RNA, 22 nt, Human
uggaagcuguggcauaacugag

SEQ ID NO: 151266 - RNA, 22 nt, Human
ccaggcucagcgcgcacgucug

SEQ ID NO: 151267 - RNA, 22 nt, Human
caggcuccuucccagggauggu

SEQ ID NO: 151268 - RNA, 22 nt, Human
uuugacauuggcuuauucuguu

SEQ ID NO: 151269 - RNA, 22 nt, Human
uccuccuccucacagucaccug

SEQ ID NO: 151270 - RNA, 22 nt, Human
uuccaggccgggcaggaaacac

SEQ ID NO: 151271 - RNA, 22 nt, Human
uguuucauuaguacugacaaua

SEQ ID NO: 151272 - RNA, 22 nt, Human
gcugccagucuaaugggaaaca

SEQ ID NO: 151273 - RNA, 22 nt, Human
cacauacaaggcacacuggagg

SEQ ID NO: 151274 - RNA, 22 nt, Human
acagcucugcauggcaguuauu

SEQ ID NO: 151275 - RNA, 20 nt, Human
auuucaguguuugcaauuuc

SEQ ID NO: 151276 - RNA, 22 nt, Human
ucagccucagguguucagauuu

SEQ ID NO: 151277 - RNA, 22 nt, Human
agggcugaaguuauggcugagc

SEQ ID NO: 151278 - RNA, 22 nt, Human
auccaggccccaagaccccgac

SEQ ID NO: 151279 - RNA, 22 nt, Human
caauacugaguuuacauucauc

SEQ ID NO: 151280 - RNA, 22 nt, Human
ugucuucaucucagacacaguu

SEQ ID NO: 151281 - RNA, 22 nt, Human
gacacuucaccuuucccagccu

SEQ ID NO: 151282 - RNA, 22 nt, Human
auaaguaggaaaauuugaauau

SEQ ID NO: 151283 - RNA, 23 nt, Human
ccuggggagcuguauccagagug

SEQ ID NO: 151284 - RNA, 22 nt, Human
gaggagcugcagggggagucua

SEQ ID NO: 151285 - RNA, 22 nt, Human
cauucccacguguucuuugcuu

SEQ ID NO: 151286 - RNA, 22 nt, Human
cuucuggguugcaggucuuggc

SEQ ID NO: 151287 - RNA, 22 nt, Human
augaaugcugggacaaauauau

SEQ ID NO: 151288 - RNA, 22 nt, Human
cuggggacuuugguucuccaug

SEQ ID NO: 151289 - RNA, 22 nt, Human
gugggcuuguuuugaugagauc

SEQ ID NO: 151290 - RNA, 22 nt, Human
ucuguuuaggcaaaauagcuac

SEQ ID NO: 151291 - RNA, 20 nt, Human
agguauaagaaaugugauuu

SEQ ID NO: 151292 - RNA, 22 nt, Human
aaaauguaaagcuugaguguag

SEQ ID NO: 151293 - RNA, 22 nt, Human
gcuucuggaagcugcuucugcc

SEQ ID NO: 151294 - RNA, 22 nt, Human
aaauucagcagugaaaugcccc

SEQ ID NO: 151295 - RNA, 22 nt, Human
ccuggcagacugugagggcagg

SEQ ID NO: 151296 - RNA, 21 nt, Human
cccuugccugcacuccucggc

SEQ ID NO: 151297 - RNA, 22 nt, Human
ggcaggcuccaagcauccuaug

SEQ ID NO: 151298 - RNA, 22 nt, Human
ugcuucuguuuguuucugucau

SEQ ID NO: 151299 - RNA, 22 nt, Human
guccucuggccuuucccaggac

SEQ ID NO: 151300 - RNA, 22 nt, Human
auauuccauugguuucccuucu

SEQ ID NO: 151301 - RNA, 22 nt, Human
ucugugacugauggaggcuuuu

SEQ ID NO: 151302 - RNA, 22 nt, Human
ccucugcaaagaauuugucucc

SEQ ID NO: 151303 - RNA, 22 nt, Human
uacacagacucuucaauucaga

SEQ ID NO: 151304 - RNA, 22 nt, Human
acccacccuacuagcagugucc

SEQ ID NO: 151305 - RNA, 22 nt, Human
cagcucugcugggaggaugcag

SEQ ID NO: 151306 - RNA, 22 nt, Human
aguaugaagauuauaauuuuuc

SEQ ID NO: 151307 - RNA, 22 nt, Human
aacagcauaccaauguacauau

SEQ ID NO: 151308 - RNA, 22 nt, Human
auuucaguguuuuaagaguuca

SEQ ID NO: 151309 - RNA, 22 nt, Human
cuugccucccucagcucacagc

SEQ ID NO: 151310 - RNA, 22 nt, Human
uggaacacagugauugauagcg

SEQ ID NO: 151311 - RNA, 22 nt, Human
uuccuugguagagagaauauuu

SEQ ID NO: 151312 - RNA, 22 nt, Human
acuggcaggcugcuggccggcg

SEQ ID NO: 151313 - RNA, 22 nt, Human
gcugcaggcggccgugguggcg

SEQ ID NO: 151314 - RNA, 22 nt, Human
ucuggggauaagacccagguau

SEQ ID NO: 151315 - RNA, 22 nt, Human
uggcaguagauccagucucucu

SEQ ID NO: 151316 - RNA, 22 nt, Human
agcagcuccugccaugagugcu

SEQ ID NO: 151317 - RNA, 18 nt, Human
ggccucuggacuggcagc

SEQ ID NO: 151318 - RNA, 22 nt, Human
ggcuucugagugcucugcuguu

SEQ ID NO: 151319 - RNA, 22 nt, Human
uccuucaagaugccacagcuuu

SEQ ID NO: 151320 - RNA, 22 nt, Human
ccagcccugccagagagagcug

SEQ ID NO: 151321 - RNA, 22 nt, Human
agacacagucugucuggaggag

SEQ ID NO: 151322 - RNA, 20 nt, Human
cuggggacagcaauggcugu

SEQ ID NO: 151323 - RNA, 22 nt, Human
ucuggcagagauauccauccca

SEQ ID NO: 151324 - RNA, 20 nt, Human
uuccuguauacaaagaguuc

SEQ ID NO: 151325 - RNA, 22 nt, Human
cagcucagucuggagagaugca

SEQ ID NO: 151326 - RNA, 19 nt, Human
ucuggcagguaauuaggga

SEQ ID NO: 151327 - RNA, 22 nt, Human
aggaggcugaacuagggucugg

SEQ ID NO: 151328 - RNA, 22 nt, Human
uuaagacauucagauauuucua

SEQ ID NO: 151329 - RNA, 22 nt, Human
gcaaauucuuaacuggacugug

SEQ ID NO: 151330 - RNA, 22 nt, Human
gcugggcugcgucggggaagcc

SEQ ID NO: 151331 - RNA, 22 nt, Human
uuaugaaggaucagguacuugg

SEQ ID NO: 151332 - RNA, 22 nt, Human
cacaaaaguaggaggcaggcgg

SEQ ID NO: 151333 - RNA, 22 nt, Human
uguaugaagguuuaccugcugu

SEQ ID NO: 151334 - RNA, 22 nt, Human
guguaugaacgaaagaauggau

SEQ ID NO: 151335 - RNA, 21 nt, Human
uucucuccauaugcccagccc

SEQ ID NO: 151336 - RNA, 22 nt, Human
gacacagauaucucugagauua

SEQ ID NO: 151337 - RNA, 22 nt, Human
aagagagagugcgcucacagaa

SEQ ID NO: 151338 - RNA, 22 nt, Human
ucaucccuaaggacagcucugc

SEQ ID NO: 151339 - RNA, 22 nt, Human
uugaaauacugcauuguucagu

SEQ ID NO: 151340 - RNA, 22 nt, Human
aaguuuuccuguguccaagaug

SEQ ID NO: 151341 - RNA, 22 nt, Human
uguucaaaugaucuucuuaaau

SEQ ID NO: 151342 - RNA, 22 nt, Human
gcuguucacauuuugggccaaa

SEQ ID NO: 151343 - RNA, 22 nt, Human
ugcagagagauccucaggguuu

SEQ ID NO: 151344 - RNA, 22 nt, Human
aaucucuuuggcucaaggaucc

SEQ ID NO: 151345 - RNA, 22 nt, Human
accaagcuagaacauuacaggc

SEQ ID NO: 151346 - RNA, 22 nt, Human
gcuggggaccagcugucucuga

SEQ ID NO: 151347 - RNA, 22 nt, Human
uggaacacaucuaaggaagcag

SEQ ID NO: 151348 - RNA, 22 nt, Human
aguaugaagcugaaugauuuua

SEQ ID NO: 151349 - RNA, 22 nt, Human
uguaaauaaugcauguaaauca

SEQ ID NO: 151350 - RNA, 19 nt, Human
ugcuucuggggcuucucca

SEQ ID NO: 151351 - RNA, 22 nt, Human
gugagagggcugggcucaugau

SEQ ID NO: 151352 - RNA, 22 nt, Human
gcuccaggcagcauaguggaug

SEQ ID NO: 151353 - RNA, 20 nt, Human
cccacacccuucccacuugg

SEQ ID NO: 151354 - RNA, 22 nt, Human
uacacaacugacaaccauucug

SEQ ID NO: 151355 - RNA, 22 nt, Human
uuuaaaauuuagaccucuccac

SEQ ID NO: 151356 - RNA, 22 nt, Human
uuuccacaauguuuuugcagga

SEQ ID NO: 151357 - RNA, 22 nt, Human
cuugggaaugcuaacagaugac

SEQ ID NO: 151358 - RNA, 22 nt, Human
aaacagcuggucucaaauguuc

SEQ ID NO: 151359 - RNA, 22 nt, Human
auccaagucagggauaguuuga

SEQ ID NO: 151360 - RNA, 22 nt, Human
ggcacagagcuuugucccaguu

SEQ ID NO: 151361 - RNA, 22 nt, Human
gcuuccaaaucuguucaaaaug

SEQ ID NO: 151362 - RNA, 20 nt, Human
uugauucccucuaaacucgc

SEQ ID NO: 151363 - RNA, 22 nt, Human
guggcagggugcucaucaugca

SEQ ID NO: 151364 - RNA, 22 nt, Human
ucuucaaaaaauauccaucagu

SEQ ID NO: 151365 - RNA, 22 nt, Human
cugggcugcggugguagguugu

SEQ ID NO: 151366 - RNA, 20 nt, Human
uuucuguaaggcauuaaucu

SEQ ID NO: 151367 - RNA, 22 nt, Human
uuccaggcuucucuggggcguc

SEQ ID NO: 151368 - RNA, 19 nt, Human
uuaugaaggcuggggggag

SEQ ID NO: 151369 - RNA, 22 nt, Human
ggcuucugaaccaggcccugga

SEQ ID NO: 151370 - RNA, 19 nt, Human
ucuuuucacgcauuuugaa

SEQ ID NO: 151371 - RNA, 22 nt, Human
caggcccugccuugagggaccu

SEQ ID NO: 151372 - RNA, 22 nt, Human
ucacacagcuccuuuccuuagu

SEQ ID NO: 151373 - RNA, 22 nt, Human
uguggggaagaguaugacuugg

SEQ ID NO: 151374 - RNA, 22 nt, Human
cuucugggagagcuuuugcuuc

SEQ ID NO: 151375 - RNA, 22 nt, Human
uccuggcagcccgcaggugcug

SEQ ID NO: 151376 - RNA, 19 nt, Human
gggagcugaggucuuuggu

SEQ ID NO: 151377 - RNA, 22 nt, Human
ccuccccaugacccggugcugg

SEQ ID NO: 151378 - RNA, 22 nt, Human
uuccaggcaugucagacauagg

SEQ ID NO: 151379 - RNA, 22 nt, Human
cgcauacauagaaacacacaga

SEQ ID NO: 151380 - RNA, 22 nt, Human
agggaagaagcugguaguaggu

SEQ ID NO: 151381 - RNA, 22 nt, Human
cuguucacacacuuguacucuc

SEQ ID NO: 151382 - RNA, 22 nt, Human
gccugcagaggugcugcuagcu

SEQ ID NO: 151383 - RNA, 22 nt, Human
acugggcuccaaggaccuggag

SEQ ID NO: 151384 - RNA, 22 nt, Human
uuaugaaguuccuguuacagug

SEQ ID NO: 151385 - RNA, 22 nt, Human
agggggucguccggaagaccug

SEQ ID NO: 151386 - RNA, 22 nt, Human
aguaugaaucucuuuauucugc

SEQ ID NO: 151387 - RNA, 22 nt, Human
agcacaggcuuuggugugaggg

SEQ ID NO: 151388 - RNA, 23 nt, Human
ugccaaaguuuaccuaacacugg

SEQ ID NO: 151389 - RNA, 21 nt, Human
ucacguggucacaugagcuuu

SEQ ID NO: 151390 - RNA, 22 nt, Human
uacugacacaaagccaaucccu

SEQ ID NO: 151391 - RNA, 22 nt, Human
guggggacgggauggcucacug

SEQ ID NO: 151392 - RNA, 22 nt, Human
ugcuucugaugugagcagcccc

SEQ ID NO: 151393 - RNA, 18 nt, Human
acuggcuuuagcaucaga

SEQ ID NO: 151394 - RNA, 22 nt, Human
cuggggacugaaggauguugcu

SEQ ID NO: 151395 - RNA, 22 nt, Human
ccuaggaacccccaggcuucug

SEQ ID NO: 151396 - RNA, 22 nt, Human
cuccaggccccuggccuucugc

SEQ ID NO: 151397 - RNA, 23 nt, Human
cauccaggagcugagucugacug

SEQ ID NO: 151398 - RNA, 22 nt, Human
ugaaauaucauuuucaucuccc

SEQ ID NO: 151399 - RNA, 22 nt, Human
cacucuccagcacaccccauuu

SEQ ID NO: 151400 - RNA, 22 nt, Human
ucuggcagcgaagcguguacuu

SEQ ID NO: 151401 - RNA, 22 nt, Human
cuuguucaguugccucuccugc

SEQ ID NO: 151402 - RNA, 22 nt, Human
cgcaggcucgguucacagagca

SEQ ID NO: 151403 - RNA, 22 nt, Human
ucugggcugggagcguguggac

SEQ ID NO: 151404 - RNA, 22 nt, Human
ggcuucuguccucuggaucugu

SEQ ID NO: 151405 - RNA, 20 nt, Human
ccugggcucaaagcauccuc

SEQ ID NO: 151406 - RNA, 22 nt, Human
acacauacauggggaagaugag

SEQ ID NO: 151407 - RNA, 22 nt, Human
gggaccugccauugcucacagg

SEQ ID NO: 151408 - RNA, 22 nt, Human
gcuaggaguggugggucaagga

SEQ ID NO: 151409 - RNA, 23 nt, Human
uguaugaauaugccacaguuuaa

SEQ ID NO: 151410 - RNA, 18 nt, Human
acucugcggaggccccag

SEQ ID NO: 151411 - RNA, 22 nt, Human
uagaauaugauuaauuuucuua

SEQ ID NO: 151412 - RNA, 22 nt, Human
cccagcaugcacgcugacacuc

SEQ ID NO: 151413 - RNA, 22 nt, Human
uauucccagccucuuucuaucu

SEQ ID NO: 151414 - RNA, 22 nt, Human
ucugggcuuuuccaugccugug

SEQ ID NO: 151415 - RNA, 23 nt, Human
uguaaacaucacccccuggaguu

SEQ ID NO: 151416 - RNA, 22 nt, Human
augggcuguccuaguccagccc

SEQ ID NO: 151417 - RNA, 22 nt, Human
ucuggggaugagugaugucgua

SEQ ID NO: 151418 - RNA, 22 nt, Human
gugggcuuuggccucuuucucc

SEQ ID NO: 151419 - RNA, 22 nt, Human
uuuacagagaauguacauaaag

SEQ ID NO: 151420 - RNA, 22 nt, Human
ccaggcucacugacuaccacau

SEQ ID NO: 151421 - RNA, 22 nt, Human
gcuggcagacugggggcagaac

SEQ ID NO: 151422 - RNA, 22 nt, Human
uccugggguuuuggccgcagcu

SEQ ID NO: 151423 - RNA, 22 nt, Human
cagagcucagagcagggcacuc

SEQ ID NO: 151424 - RNA, 22 nt, Human
gacacauaugcguauaguuuag

SEQ ID NO: 151425 - RNA, 22 nt, Human
ggggcugacgggcauguggcuu

SEQ ID NO: 151426 - RNA, 22 nt, Human
ggggaccuaggcucugucucuu

SEQ ID NO: 151427 - RNA, 22 nt, Human
uguaugaauauguauuuucaua

SEQ ID NO: 151428 - RNA, 22 nt, Human
augccaaauucucagccucuuu

SEQ ID NO: 151429 - RNA, 22 nt, Human
ucuggcaggauaucgaagugaa

SEQ ID NO: 151430 - RNA, 22 nt, Human
ucccacaugugaauccucaggu

SEQ ID NO: 151431 - RNA, 22 nt, Human
ucaggcucagguuaggggccaa

SEQ ID NO: 151432 - RNA, 19 nt, Human
ccuugccugucccugcagc

SEQ ID NO: 151433 - RNA, 22 nt, Human
uccaggcuagguuuacaggaca

SEQ ID NO: 151434 - RNA, 20 nt, Human
cagcccuccaguggaggcag

SEQ ID NO: 151435 - RNA, 22 nt, Human
uagacacaucuucauccacaau

SEQ ID NO: 151436 - RNA, 22 nt, Human
cucuucaaaagucuaauccuua

SEQ ID NO: 151437 - RNA, 22 nt, Human
cugggcuucucccccuggcaga

SEQ ID NO: 151438 - RNA, 22 nt, Human
uaaauucagugaguaauuucug

SEQ ID NO: 151439 - RNA, 22 nt, Human
aacccaggguggagguugcagu

SEQ ID NO: 151440 - RNA, 22 nt, Human
aaagaucaauagauaaagcuac

SEQ ID NO: 151441 - RNA, 22 nt, Human
cugggcuuucaggcccuaaggc

SEQ ID NO: 151442 - RNA, 22 nt, Human
aauucaugaguagaaucuauau

SEQ ID NO: 151443 - RNA, 22 nt, Human
acaggcucucuauugagugcag

SEQ ID NO: 151444 - RNA, 22 nt, Human
acaggcucaguucacuggauuu

SEQ ID NO: 151445 - RNA, 22 nt, Human
acccacaccuccguauaucacu

SEQ ID NO: 151446 - RNA, 22 nt, Human
gccaagcuggaugaagagguug

SEQ ID NO: 151447 - RNA, 22 nt, Human
auacuguacgucccagauagga

SEQ ID NO: 151448 - RNA, 22 nt, Human
uacauuccuguuagcaucuaag

SEQ ID NO: 151449 - RNA, 22 nt, Human
uuggcagggccaggcucucucu

SEQ ID NO: 151450 - RNA, 22 nt, Human
gggaccugccaaggccacccag

SEQ ID NO: 151451 - RNA, 22 nt, Human
ucuaggagcaugaagggaaggc

SEQ ID NO: 151452 - RNA, 22 nt, Human
ccaggcucugagaggaauguga

SEQ ID NO: 151453 - RNA, 23 nt, Human
ccucucucccuguuuggcaaaua

SEQ ID NO: 151454 - RNA, 22 nt, Human
cacacagaaccgcucgccacuu

SEQ ID NO: 151455 - RNA, 22 nt, Human
acauaaugagcucuuuauaaau

SEQ ID NO: 151456 - RNA, 22 nt, Human
gaggcugcuuugaugacaggag

SEQ ID NO: 151457 - RNA, 22 nt, Human
ucaggagcucuucccuggugug

SEQ ID NO: 151458 - RNA, 22 nt, Human
augggcugcuuggcuuccaccc

SEQ ID NO: 151459 - RNA, 22 nt, Human
ccuggggagaagagcuuccccc

SEQ ID NO: 151460 - RNA, 22 nt, Human
ugcuccagugccugccccacag

SEQ ID NO: 151461 - RNA, 22 nt, Human
aggcaguggagcuggaauaggc

SEQ ID NO: 151462 - RNA, 22 nt, Human
guuuccaaccccaccaaagugc

SEQ ID NO: 151463 - RNA, 22 nt, Human
uuccagauuucuacacaagacc

SEQ ID NO: 151464 - RNA, 22 nt, Human
auauaaguuaguggucauguuu

SEQ ID NO: 151465 - RNA, 22 nt, Human
ucuggcagcaagucuguuucuc

SEQ ID NO: 151466 - RNA, 22 nt, Human
ugcaggcuggcagugcugaaau

SEQ ID NO: 151467 - RNA, 19 nt, Human
uggccagguacugucugcu

SEQ ID NO: 151468 - RNA, 22 nt, Human
ccaggcucugagccucacucuu

SEQ ID NO: 151469 - RNA, 22 nt, Human
agaggccggccgagcccauggg

SEQ ID NO: 151470 - RNA, 22 nt, Human
aguaugaaccuggguucuggau

SEQ ID NO: 151471 - RNA, 19 nt, Human
ccacacagugugcaauuua

SEQ ID NO: 151472 - RNA, 22 nt, Human
agagugaaguucaucgugcagc

SEQ ID NO: 151473 - RNA, 22 nt, Human
gcugggcuggaaggccaaggca

SEQ ID NO: 151474 - RNA, 22 nt, Human
acuguucauccuuuuugaacaa

SEQ ID NO: 151475 - RNA, 22 nt, Human
agugugagccuacaggccaaag

SEQ ID NO: 151476 - RNA, 22 nt, Human
ucucuucacaugcuugcuccaa

SEQ ID NO: 151477 - RNA, 21 nt, Human
agagucugagugugcaagggc

SEQ ID NO: 151478 - RNA, 22 nt, Human
ugcuucuguuacauaccagaac

SEQ ID NO: 151479 - RNA, 22 nt, Human
gcaggcucguuggaaguccccu

SEQ ID NO: 151480 - RNA, 22 nt, Human
auuucuguuugcuacuauaagu

SEQ ID NO: 151481 - RNA, 22 nt, Human
cccugccuugggguccacaccg

SEQ ID NO: 151482 - RNA, 22 nt, Human
ugcuucugaaguggaugggugc

SEQ ID NO: 151483 - RNA, 22 nt, Human
aggaagcuuggggcagggcuac

SEQ ID NO: 151484 - RNA, 22 nt, Human
uuuaacaugugaauuuuggaag

SEQ ID NO: 151485 - RNA, 19 nt, Human
auggaaaaugccagacuga

SEQ ID NO: 151486 - RNA, 22 nt, Human
uucuggggccccaguguccucg

SEQ ID NO: 151487 - RNA, 22 nt, Human
uuaaauauuuucagcaggguca

SEQ ID NO: 151488 - RNA, 22 nt, Human
agcccagcuuugaaccauauca

SEQ ID NO: 151489 - RNA, 22 nt, Human
uggaacacuguggaugagaaga

SEQ ID NO: 151490 - RNA, 23 nt, Human
aaauucaguccuucaacucugag

SEQ ID NO: 151491 - RNA, 22 nt, Human
ugagggacucccggcccugcca

SEQ ID NO: 151492 - RNA, 22 nt, Human
gcugcuaagcguuucuguucca

SEQ ID NO: 151493 - RNA, 22 nt, Human
aggacaagcuaaaggacuuccu

SEQ ID NO: 151494 - RNA, 22 nt, Human
aaugaagcaguccaucugcucu

SEQ ID NO: 151495 - RNA, 22 nt, Human
uuuguguuuguacaaugcacua

SEQ ID NO: 151496 - RNA, 22 nt, Human
ucccaccccuugacucuuuaag

SEQ ID NO: 151497 - RNA, 22 nt, Human
ccuggcagcccagagcgccgcu

SEQ ID NO: 151498 - RNA, 22 nt, Human
uccccacacagauacagaguag

SEQ ID NO: 151499 - RNA, 22 nt, Human
uauuugagcgaagcaguguuuu

SEQ ID NO: 151500 - RNA, 23 nt, Human
uccuuuaaugcuggaauggcuag

SEQ ID NO: 151501 - RNA, 22 nt, Human
gcuucuggaagcauaugcaaga

SEQ ID NO: 151502 - RNA, 22 nt, Human
ugcuucugggcaaaugugugug

SEQ ID NO: 151503 - RNA, 22 nt, Human
cuggaaaggguccucauucugu

SEQ ID NO: 151504 - RNA, 22 nt, Human
cuucugggugccugugaguguu

SEQ ID NO: 151505 - RNA, 22 nt, Human
ggcaggguuuacaauagcaaua

SEQ ID NO: 151506 - RNA, 22 nt, Human
agagaguugaggaagcaacacu

SEQ ID NO: 151507 - RNA, 22 nt, Human
caccagggccccaggcugugcc

SEQ ID NO: 151508 - RNA, 22 nt, Human
cagaguuuugugaacaacuugg

SEQ ID NO: 151509 - RNA, 21 nt, Human
acauacauaccuuaccaccuu

SEQ ID NO: 151510 - RNA, 22 nt, Human
cauuugaaccuggauguucuua

SEQ ID NO: 151511 - RNA, 22 nt, Human
cuucugggauuaauuuuuccug

SEQ ID NO: 151512 - RNA, 22 nt, Human
cacccacauuccaucacucugc

SEQ ID NO: 151513 - RNA, 22 nt, Human
aaauuucaagcaaaguagcuau

SEQ ID NO: 151514 - RNA, 19 nt, Human
aggcugugagggaggacuc

SEQ ID NO: 151515 - RNA, 22 nt, Human
augggcuggggaagcucacucc

SEQ ID NO: 151516 - RNA, 22 nt, Human
uccuggcagagggcggccucga

SEQ ID NO: 151517 - RNA, 22 nt, Human
acagguggcuuauuggcugauu

SEQ ID NO: 151518 - RNA, 22 nt, Human
uuggaaaguuuuuacugaagac

SEQ ID NO: 151519 - RNA, 22 nt, Human
cgcuaggauuaggauuaauccu

SEQ ID NO: 151520 - RNA, 20 nt, Human
ugcaggcuucgcucuaggag

SEQ ID NO: 151521 - RNA, 22 nt, Human
caucuuuucagaagccauucug

SEQ ID NO: 151522 - RNA, 22 nt, Human
cuggccuggggggacacauccc

SEQ ID NO: 151523 - RNA, 22 nt, Human
aaaucucaauuugaauuguagc

SEQ ID NO: 151524 - RNA, 22 nt, Human
ucagccuccgaaagugcuggga

SEQ ID NO: 151525 - RNA, 22 nt, Human
acacacuggcccccaguacuga

SEQ ID NO: 151526 - RNA, 22 nt, Human
aagagccagcuagugaagaggc

SEQ ID NO: 151527 - RNA, 22 nt, Human
ugcaggcugggaagagggacaa

SEQ ID NO: 151528 - RNA, 22 nt, Human
cacauaagaaaugaauaugaga

SEQ ID NO: 151529 - RNA, 22 nt, Human
cagccucugagccuuggcagau

SEQ ID NO: 151530 - RNA, 22 nt, Human
acuggcagcagcagcccuuggg

SEQ ID NO: 151531 - RNA, 22 nt, Human
gccuccggagucacagugucuu

SEQ ID NO: 151532 - RNA, 22 nt, Human
cugggaggcagucucucuagaa

SEQ ID NO: 151533 - RNA, 22 nt, Human
auuucaguguugguuagcaagc

SEQ ID NO: 151534 - RNA, 22 nt, Human
ucaggcucucagaccaacagca

SEQ ID NO: 151535 - RNA, 21 nt, Human
gggcagaggggccuccugggu

SEQ ID NO: 151536 - RNA, 21 nt, Human
acuguucaucuguucagaagc

SEQ ID NO: 151537 - RNA, 22 nt, Human
cccagccuuugcuuccugguuc

SEQ ID NO: 151538 - RNA, 22 nt, Human
uauuccaguucaccuuuucauc

SEQ ID NO: 151539 - RNA, 22 nt, Human
ccugcagagccacgugccagcg

SEQ ID NO: 151540 - RNA, 22 nt, Human
gaggcuguuaggagggacucug

SEQ ID NO: 151541 - RNA, 22 nt, Human
gcuggcagagcucugggcuggg

SEQ ID NO: 151542 - RNA, 22 nt, Human
caaauucucuuacuguuugaca

SEQ ID NO: 151543 - RNA, 22 nt, Human
ugggggcugugcacaggcucac

SEQ ID NO: 151544 - RNA, 19 nt, Human
uucuggggccuggccuugg

SEQ ID NO: 151545 - RNA, 17 nt, Human
cccaggccgccgggagc

SEQ ID NO: 151546 - RNA, 22 nt, Human
acuggcagaacgugaugcgggu

SEQ ID NO: 151547 - RNA, 22 nt, Human
aggcaggggagcuggaagggua

SEQ ID NO: 151548 - RNA, 22 nt, Human
ggcccagcgaggccaccuacag

SEQ ID NO: 151549 - RNA, 19 nt, Human
cagguggcgcucuacaggg

SEQ ID NO: 151550 - RNA, 22 nt, Human
uuuccuguugccaucaagaaug

SEQ ID NO: 151551 - RNA, 22 nt, Human
ggccucagaggaggugugaguc

SEQ ID NO: 151552 - RNA, 22 nt, Human
cucuucaauagauuguugaggg

SEQ ID NO: 151553 - RNA, 22 nt, Human
uggaacacuggcuuuccacugu

SEQ ID NO: 151554 - RNA, 22 nt, Human
cuccaggccauggcugcggagg

SEQ ID NO: 151555 - RNA, 22 nt, Human
auccccacgauauagccaaagc

SEQ ID NO: 151556 - RNA, 22 nt, Human
uugaaucuggguacuuguaaua

SEQ ID NO: 151557 - RNA, 22 nt, Human
caggauggucucgaucuccuga

SEQ ID NO: 151558 - RNA, 22 nt, Human
ccuguucaccauggucacgugc

SEQ ID NO: 151559 - RNA, 22 nt, Human
cuggaaagaccugcuugcuuuu

SEQ ID NO: 151560 - RNA, 22 nt, Human
aggcuccugcaggugaggugcu

SEQ ID NO: 151561 - RNA, 22 nt, Human
uacacacaugcauuugccuuau

SEQ ID NO: 151562 - RNA, 22 nt, Human
uuccaagaguaaauucaaauug

SEQ ID NO: 151563 - RNA, 22 nt, Human
gggaccugggccagaggacagu

SEQ ID NO: 151564 - RNA, 22 nt, Human
aggcugugacagggucauggag

SEQ ID NO: 151565 - RNA, 21 nt, Human
agaugcugaugcugcaggucc

SEQ ID NO: 151566 - RNA, 22 nt, Human
uuccagugaugggcaauuuggu

SEQ ID NO: 151567 - RNA, 22 nt, Human
agcaggugggaucaagcuggca

SEQ ID NO: 151568 - RNA, 22 nt, Human
cuucuggggauggagcccagaa

SEQ ID NO: 151569 - RNA, 22 nt, Human
acugccaaugguaguuugaugg

SEQ ID NO: 151570 - RNA, 22 nt, Human
auuuaagacugacuucaccagu

SEQ ID NO: 151571 - RNA, 22 nt, Human
gggguggcccuacccucuggaa

SEQ ID NO: 151572 - RNA, 22 nt, Human
cacauacauacguauguauaca

SEQ ID NO: 151573 - RNA, 22 nt, Human
cauaugaaauaugaguugaaca

SEQ ID NO: 151574 - RNA, 22 nt, Human
agguagggaagaaggcaugaaa

SEQ ID NO: 151575 - RNA, 22 nt, Human
gggaccugaggagggguuucag

SEQ ID NO: 151576 - RNA, 22 nt, Human
gaaauauugggacucagagcuu

SEQ ID NO: 151577 - RNA, 22 nt, Human
gggacaauggaggccucucucc

SEQ ID NO: 151578 - RNA, 23 nt, Human
acaggcucuuaaucagugcuccu

SEQ ID NO: 151579 - RNA, 22 nt, Human
ccagcucugcauguuucccuug

SEQ ID NO: 151580 - RNA, 22 nt, Human
cugggcuugaguuccugcucgu

SEQ ID NO: 151581 - RNA, 22 nt, Human
uccacccugcuuuugucuuuga

SEQ ID NO: 151582 - RNA, 22 nt, Human
uggcuaggacucauccuguuuc

SEQ ID NO: 151583 - RNA, 22 nt, Human
gcuggcaguguauuguuagcug

SEQ ID NO: 151584 - RNA, 23 nt, Human
cauaaaauauuaguaugguagca

SEQ ID NO: 151585 - RNA, 22 nt, Human
gggaccuggucuagcacugagc

SEQ ID NO: 151586 - RNA, 22 nt, Human
uuuauguuugacaaugaucugg

SEQ ID NO: 151587 - RNA, 22 nt, Human
cagguggguguaugaaugcaaa

SEQ ID NO: 151588 - RNA, 23 nt, Human
agcaggcugcuucuccacagcug

SEQ ID NO: 151589 - RNA, 22 nt, Human
ucuguucagaaauggaagugcc

SEQ ID NO: 151590 - RNA, 19 nt, Human
ccuuccuccccagggccau

SEQ ID NO: 151591 - RNA, 22 nt, Human
caggggccaaggguccagaccu

SEQ ID NO: 151592 - RNA, 22 nt, Human
cuggccagagguuccucugccc

SEQ ID NO: 151593 - RNA, 22 nt, Human
ccacuguauuuuggaagcagau

SEQ ID NO: 151594 - RNA, 22 nt, Human
ugcuucugacauguucuugguu

SEQ ID NO: 151595 - RNA, 22 nt, Human
ggggccuuuucugaauguggaa

SEQ ID NO: 151596 - RNA, 22 nt, Human
guggcaguuuugacaucacaaa

SEQ ID NO: 151597 - RNA, 22 nt, Human
auuugcaugcuucuauugugaa

SEQ ID NO: 151598 - RNA, 22 nt, Human
caugagauaauuuuucuccagu

SEQ ID NO: 151599 - RNA, 22 nt, Human
ugaagcuugagugucaguuccu

SEQ ID NO: 151600 - RNA, 22 nt, Human
ugcuucuggguaggccucagga

SEQ ID NO: 151601 - RNA, 22 nt, Human
guccacagagggcugggcaggc

SEQ ID NO: 151602 - RNA, 22 nt, Human
uucaaacaaaacuguucccaua

SEQ ID NO: 151603 - RNA, 22 nt, Human
acccacacaucucuaauucagu

SEQ ID NO: 151604 - RNA, 22 nt, Human
gcuaggagccgcugcacuaggu

SEQ ID NO: 151605 - RNA, 22 nt, Human
aauucuuguuguuaguauauuu

SEQ ID NO: 151606 - RNA, 19 nt, Human
guucaaacacugauucagc

SEQ ID NO: 151607 - RNA, 19 nt, Human
gugggacagacauuacaua

SEQ ID NO: 151608 - RNA, 22 nt, Human
ccagcucucagcgggagacuca

SEQ ID NO: 151609 - RNA, 22 nt, Human
gcuguucagggcacucaugggc

SEQ ID NO: 151610 - RNA, 22 nt, Human
ugggccaggucugugucagcug

SEQ ID NO: 151611 - RNA, 22 nt, Human
uacauugcuagaaauguauuuu

SEQ ID NO: 151612 - RNA, 22 nt, Human
aaaauauuuuagggccaggaga

SEQ ID NO: 151613 - RNA, 22 nt, Human
auaugaagucagacaaacuggg

SEQ ID NO: 151614 - RNA, 22 nt, Human
ggccucagggucacucuguaga

SEQ ID NO: 151615 - RNA, 22 nt, Human
ccuguucacuuugacuucucca

SEQ ID NO: 151616 - RNA, 21 nt, Human
gggagggauggaaaugauguu

SEQ ID NO: 151617 - RNA, 22 nt, Human
ccuggggaagucacuucucuuu

SEQ ID NO: 151618 - RNA, 22 nt, Human
aggguagggcccggagacagac

SEQ ID NO: 151619 - RNA, 22 nt, Human
ucugggcuuuaguuuguuaucu

SEQ ID NO: 151620 - RNA, 22 nt, Human
gaggagcugggacccugucauc

SEQ ID NO: 151621 - RNA, 22 nt, Human
uggaaacaucucugccuuuauu

SEQ ID NO: 151622 - RNA, 22 nt, Human
gagcucagacucgggccugggg

SEQ ID NO: 151623 - RNA, 22 nt, Human
acaucugaggagaccagccucu

SEQ ID NO: 151624 - RNA, 22 nt, Human
cucuggggaagcagccagcugg

SEQ ID NO: 151625 - RNA, 22 nt, Human
cacugaaauauuaauaucuuau

SEQ ID NO: 151626 - RNA, 22 nt, Human
caugaaaaugucaaguucugcu

SEQ ID NO: 151627 - RNA, 22 nt, Human
cuaggaaugguaccucuuacaa

SEQ ID NO: 151628 - RNA, 22 nt, Human
ugcaggcugcaccccugcccug

SEQ ID NO: 151629 - RNA, 22 nt, Human
cacauacauucauguuacucua

SEQ ID NO: 151630 - RNA, 22 nt, Human
gcuccaggaggaugaccuuccu

SEQ ID NO: 151631 - RNA, 18 nt, Human
cuccuccacagccccugc

SEQ ID NO: 151632 - RNA, 22 nt, Human
uacacauccauguuuugacuuu

SEQ ID NO: 151633 - RNA, 22 nt, Human
uaugaagcugauaaucacugau

SEQ ID NO: 151634 - RNA, 17 nt, Human
ggagaucuggcagaggg

SEQ ID NO: 151635 - RNA, 22 nt, Human
aaccucaggcucucuggacaau

SEQ ID NO: 151636 - RNA, 22 nt, Human
ugcccccuuuucuuguuacacu

SEQ ID NO: 151637 - RNA, 21 nt, Human
cagcccagcccauugacagug

SEQ ID NO: 151638 - RNA, 22 nt, Human
ccuguucagagcuaagcaucau

SEQ ID NO: 151639 - RNA, 22 nt, Human
guuucauacagauuauucaugg

SEQ ID NO: 151640 - RNA, 18 nt, Human
cuguucuagaacuccugu

SEQ ID NO: 151641 - RNA, 22 nt, Human
cacacauuucagaugcuacaau

SEQ ID NO: 151642 - RNA, 22 nt, Human
aaauaaguaguuuaguguugug

SEQ ID NO: 151643 - RNA, 22 nt, Human
aaagaaucagaagucucaaaca

SEQ ID NO: 151644 - RNA, 22 nt, Human
uauuccuauuucuaaacauaug

SEQ ID NO: 151645 - RNA, 22 nt, Human
aaauccuaaggagaauaugauu

SEQ ID NO: 151646 - RNA, 22 nt, Human
ccaggcuguaagagugauguug

SEQ ID NO: 151647 - RNA, 22 nt, Human
ccugggcucuauccugacccag

SEQ ID NO: 151648 - RNA, 19 nt, Human
ggcaggcuggauagagagg

SEQ ID NO: 151649 - RNA, 19 nt, Human
auuucaagagguuuauugg

SEQ ID NO: 151650 - RNA, 22 nt, Human
uuauuccauuauuucacuuagg

SEQ ID NO: 151651 - RNA, 18 nt, Human
aggaaagaaaggcaggug

SEQ ID NO: 151652 - RNA, 22 nt, Human
cccaggccuggucugggccagu

SEQ ID NO: 151653 - RNA, 20 nt, Dobrava virus
ucaugugggguuuacuauug

SEQ ID NO: 151654 - RNA, 22 nt, Dobrava virus
uaguaguagacuccgcaagaaa

SEQ ID NO: 151655 - RNA, 22 nt, Dobrava virus
aaaggaaaauuuuauguauuca

SEQ ID NO: 151656 - RNA, 22 nt, Human
uacaaaaggaagagggaucuua

SEQ ID NO: 151657 - RNA, 22 nt, Human
ucuggcagaggaaggaggccug

SEQ ID NO: 151658 - RNA, 22 nt, Human
gacugccucaguuucccugcag

SEQ ID NO: 151659 - RNA, 22 nt, Human
ucaucacaauuuuaugacccuc

SEQ ID NO: 151660 - RNA, 22 nt, Human
uuccuggccuaagguaggugac

SEQ ID NO: 151661 - RNA, 22 nt, Human
agaggccugugugcuccagugg

SEQ ID NO: 151662 - RNA, 22 nt, Human
uucaguuccauuucaggugggu

SEQ ID NO: 151663 - RNA, 22 nt, Human
cacacugucagguaaauaacac

SEQ ID NO: 151664 - RNA, 22 nt, Human
cccacacacuggcugcugccaa

SEQ ID NO: 151665 - RNA, 22 nt, Human
uagacacaucuucauccacaau

SEQ ID NO: 151666 - RNA, 22 nt, Human
ccucugccaccucccacgaggc

SEQ ID NO: 151667 - RNA, 22 nt, Human
ccuggcagcccagagcgccgcu

SEQ ID NO: 151668 - RNA, 22 nt, Human
cucaucaccacauauaacaaag

SEQ ID NO: 151669 - RNA, 22 nt, Human
uggccucugggaaagcagauuc

SEQ ID NO: 151670 - RNA, 22 nt, Human
aagagagaacucccuucgccag

SEQ ID NO: 151671 - RNA, 22 nt, Human
agcccaggucuggcccagccug

SEQ ID NO: 151672 - RNA, 22 nt, Human
gcacauacugcaaagauuacua

SEQ ID NO: 151673 - RNA, 22 nt, Human
acagguggcuuauuggcugauu

SEQ ID NO: 151674 - RNA, 22 nt, Human
ucaucacauguguagucauccc

SEQ ID NO: 151675 - RNA, 23 nt, Human
uuggagagggugaguagugucag

SEQ ID NO: 151676 - RNA, 22 nt, Human
uggccucugugggagcugagca

SEQ ID NO: 151677 - RNA, 21 nt, Human
ugacugaggcuucuucacaca

SEQ ID NO: 151678 - RNA, 22 nt, Human
cccugagcucaggcccuugggg

SEQ ID NO: 151679 - RNA, 20 nt, Human
acuggcagccugccugcugu

SEQ ID NO: 151680 - RNA, 22 nt, Human
cugccugcuuaccaugcaucag

SEQ ID NO: 151681 - RNA, 22 nt, Human
gccuggcaggccuguuggggcu

SEQ ID NO: 151682 - RNA, 22 nt, Human
gcuggcaggauaacuucuaagc

SEQ ID NO: 151683 - RNA, 22 nt, Human
cgcugauaaacgucacguuccc

SEQ ID NO: 151684 - RNA, 22 nt, Human
gcuggcaguguauuguuagcug

SEQ ID NO: 151685 - RNA, 22 nt, Human
ucacacacauaaucuaagauua

SEQ ID NO: 151686 - RNA, 22 nt, Human
ccaggccucuggcugcuuaguc

SEQ ID NO: 151687 - RNA, 22 nt, Human
uacacagauaugugaucaauca

SEQ ID NO: 151688 - RNA, 22 nt, Human
agacacagcugcaggagguggg

SEQ ID NO: 151689 - RNA, 22 nt, Human
gggccccuuguaucucuggcuc

SEQ ID NO: 151690 - RNA, 22 nt, Human
uuccuggccccaccccuggaga

SEQ ID NO: 151691 - RNA, 22 nt, Human
ccuggcagguuacaaccaguua

SEQ ID NO: 151692 - RNA, 22 nt, Human
uggcaucuccgacagucuugau

SEQ ID NO: 151693 - RNA, 22 nt, Human
gcuggcagguaaagccccgggg

SEQ ID NO: 151694 - RNA, 22 nt, Human
aggccccaaagcagugcaagua

SEQ ID NO: 151695 - RNA, 22 nt, Human
uuccugccccugagagcuccca

SEQ ID NO: 151696 - RNA, 22 nt, Human
gagaaagauguaggcugggagg

SEQ ID NO: 151697 - RNA, 19 nt, Human
ccagucccauacaggagau

SEQ ID NO: 151698 - RNA, 19 nt, Human
acauucccaucagcaaugu

SEQ ID NO: 151699 - RNA, 22 nt, Human
aagucguggcaggcuugcacga

SEQ ID NO: 151700 - RNA, 22 nt, Human
ccagcccuugcugaaggguggc

SEQ ID NO: 151701 - RNA, 22 nt, Human
ugagagucucagaccuccuggu

SEQ ID NO: 151702 - RNA, 22 nt, Human
cagguugguauucaucuccaca

SEQ ID NO: 151703 - RNA, 22 nt, Human
uccaggcuugagaccaggcucu

SEQ ID NO: 151704 - RNA, 22 nt, Human
gccuccuggaagucacauguuu

SEQ ID NO: 151705 - RNA, 22 nt, Human
ugccugccaugcagaaagcuga

SEQ ID NO: 151706 - RNA, 22 nt, Human
gcacacacuguuuuccucacau

SEQ ID NO: 151707 - RNA, 22 nt, Human
cuccuggcaggcugagugaaau

SEQ ID NO: 151708 - RNA, 22 nt, Human
ucccagccacaguuuccaccug

SEQ ID NO: 151709 - RNA, 22 nt, Human
cuggccucagagggucauggug

SEQ ID NO: 151710 - RNA, 22 nt, Human
ucacacagcugacagagccuuu

SEQ ID NO: 151711 - RNA, 22 nt, Human
gagacaucauaaugaaguuucc

SEQ ID NO: 151712 - RNA, 22 nt, Human
ucuggcaggacaugcugaccau

SEQ ID NO: 151713 - RNA, 22 nt, Human
cacaacuuuaggaaccacauuc

SEQ ID NO: 151714 - RNA, 22 nt, Human
uguaaacauauguauguaugua

SEQ ID NO: 151715 - RNA, 22 nt, Human
cccacacaaaucauggggagaa

SEQ ID NO: 151716 - RNA, 22 nt, Human
ucaggauggagggaagcacaga

SEQ ID NO: 151717 - RNA, 21 nt, Human
uucucuccauaugcccagccc

SEQ ID NO: 151718 - RNA, 20 nt, Human
uggccucugagaugccacgg

SEQ ID NO: 151719 - RNA, 22 nt, Human
ucacacaugaguaaauacaggg

SEQ ID NO: 151720 - RNA, 22 nt, Human
gccccaccuugagagcagaaac

SEQ ID NO: 151721 - RNA, 22 nt, Human
cucugagcagaggccguggcua

SEQ ID NO: 151722 - RNA, 22 nt, Human
guugggaaggcaagaaguagaa

SEQ ID NO: 151723 - RNA, 19 nt, Human
acuggcagcuguagucugu

SEQ ID NO: 151724 - RNA, 18 nt, Human
acaggcugugggaauggu

SEQ ID NO: 151725 - RNA, 21 nt, Human
acacagaggcaucaucacuuu

SEQ ID NO: 151726 - RNA, 22 nt, Human
uccuucccaggugucgccgccu

SEQ ID NO: 151727 - RNA, 22 nt, Human
cuccugaggacuucuauugggu

SEQ ID NO: 151728 - RNA, 22 nt, Human
acugagagucaagauagcaugg

SEQ ID NO: 151729 - RNA, 22 nt, Human
uuccuggcauagagagggcaca

SEQ ID NO: 151730 - RNA, 22 nt, Human
uccugagcccuguaggacccug

SEQ ID NO: 151731 - RNA, 22 nt, Human
ggccucucugagagcagacguu

SEQ ID NO: 151732 - RNA, 22 nt, Human
gagggugucugcguaacuggca

SEQ ID NO: 151733 - RNA, 18 nt, Human
cccacacagcaguagcuc

SEQ ID NO: 151734 - RNA, 19 nt, Human
gcuggcagauguggccgug

SEQ ID NO: 151735 - RNA, 22 nt, Human
uuggagagauuuaggucucagu

SEQ ID NO: 151736 - RNA, 22 nt, Human
ggagagaauuccauggacaugu

SEQ ID NO: 151737 - RNA, 22 nt, Human
uggcacucacucucagagucug

SEQ ID NO: 151738 - RNA, 20 nt, Human
accccacagaguccauugca

SEQ ID NO: 151739 - RNA, 22 nt, Human
agcacagggacaaugccaggug

SEQ ID NO: 151740 - RNA, 22 nt, Human
uugggaagaaacauguccauca

SEQ ID NO: 151741 - RNA, 22 nt, Human
ccccacacucuuuacauucaua

SEQ ID NO: 151742 - RNA, 22 nt, Human
uauguaaaguagauggcaggua

SEQ ID NO: 151743 - RNA, 22 nt, Human
uacacacuuacuggagaugaag

SEQ ID NO: 151744 - RNA, 22 nt, Human
gccacagguacuaugggagaga

SEQ ID NO: 151745 - RNA, 22 nt, Human
ccuggcaggcuggggacagugc

SEQ ID NO: 151746 - RNA, 22 nt, Human
ugcacaggugagacucaggaag

SEQ ID NO: 151747 - RNA, 22 nt, Human
guggcagugggaugcuaucagg

SEQ ID NO: 151748 - RNA, 22 nt, Human
aucacaauguacguuaaaaugu

SEQ ID NO: 151749 - RNA, 22 nt, Human
uuggaaaguuuuuacugaagac

SEQ ID NO: 151750 - RNA, 22 nt, Human
aggcuggauuuauggggacuuc

SEQ ID NO: 151751 - RNA, 22 nt, Human
gccuccuguuaugccaugugcc

SEQ ID NO: 151752 - RNA, 22 nt, Human
acaucccacagaaacauacaua

SEQ ID NO: 151753 - RNA, 22 nt, Human
guccucugaaagaugaaccaug

SEQ ID NO: 151754 - RNA, 22 nt, Human
gccuggcacaggaauuaggagg

SEQ ID NO: 151755 - RNA, 22 nt, Human
gacacagagcucacagucuccu

SEQ ID NO: 151756 - RNA, 22 nt, Human
gccacauagaggaggauauuaa

SEQ ID NO: 151757 - RNA, 22 nt, Human
uccaggccauugacugcauccu

SEQ ID NO: 151758 - RNA, 22 nt, Human
uccaggcuagguuuacaggaca

SEQ ID NO: 151759 - RNA, 22 nt, Human
ccaggcugggcggggaaccugg

SEQ ID NO: 151760 - RNA, 22 nt, Human
ucuggcaguuugagaaaggcua

SEQ ID NO: 151761 - RNA, 22 nt, Human
acuggcagguccaucgcccuuu

SEQ ID NO: 151762 - RNA, 22 nt, Human
acuccugggugcugaccagcgu

SEQ ID NO: 151763 - RNA, 22 nt, Human
aaaagagugacugauaaguaua

SEQ ID NO: 151764 - RNA, 22 nt, Human
gacacauaugcguauaguuuag

SEQ ID NO: 151765 - RNA, 22 nt, Human
acacaucagaaauaugaaugag

SEQ ID NO: 151766 - RNA, 20 nt, Human
agggcugagaagggacuagc

SEQ ID NO: 151767 - RNA, 17 nt, Human
uuaagguggaucagcac

SEQ ID NO: 151768 - RNA, 22 nt, Human
ccccacccaccuaagagaaacu

SEQ ID NO: 151769 - RNA, 22 nt, Human
ucccugccuccuggcagugcca

SEQ ID NO: 151770 - RNA, 21 nt, Human
ucuggcaggcacgggcccagc

SEQ ID NO: 151771 - RNA, 22 nt, Human
acuggcagagggaaaaccauuc

SEQ ID NO: 151772 - RNA, 22 nt, Human
uccuggcagagggcggccucga

SEQ ID NO: 151773 - RNA, 22 nt, Human
ugguccugccccgugcacagag

SEQ ID NO: 151774 - RNA, 22 nt, Human
auggccugcagugcugccacag

SEQ ID NO: 151775 - RNA, 22 nt, Human
cccagcaugcacgcugacacuc

SEQ ID NO: 151776 - RNA, 22 nt, Human
gacucugggcugagccagggcc

SEQ ID NO: 151777 - RNA, 22 nt, Human
uguaaacagccccauggagagc

SEQ ID NO: 151778 - RNA, 22 nt, Human
acaugacuuuucucuuccagag

SEQ ID NO: 151779 - RNA, 22 nt, Human
aggaggcuguggagcacuccau

SEQ ID NO: 151780 - RNA, 22 nt, Human
uucccacaguguugaauccucu

SEQ ID NO: 151781 - RNA, 22 nt, Human
uggccugccacugccacgccac

SEQ ID NO: 151782 - RNA, 20 nt, Human
ucacacaugguaagcuauga

SEQ ID NO: 151783 - RNA, 21 nt, Human
aacacauccagaguauuugac

SEQ ID NO: 151784 - RNA, 22 nt, Human
ccacccuaacaauccuuacugu

SEQ ID NO: 151785 - RNA, 22 nt, Human
uccugagccugacaaucaccau

SEQ ID NO: 151786 - RNA, 17 nt, Human
gcccacccuuaggagcu

SEQ ID NO: 151787 - RNA, 22 nt, Human
aucucccagccacagcauucuu

SEQ ID NO: 151788 - RNA, 22 nt, Human
cuuacacagucuggcacuucuu

SEQ ID NO: 151789 - RNA, 22 nt, Human
ucuggcaguggaugagggcagc

SEQ ID NO: 151790 - RNA, 22 nt, Human
cuccuggcacucaguguggaag

SEQ ID NO: 151791 - RNA, 22 nt, Human
guccucuguuagaaaugugcuu

SEQ ID NO: 151792 - RNA, 22 nt, Human
uuguaaacugcugcaggagugc

SEQ ID NO: 151793 - RNA, 22 nt, Human
acacauaagccuaaucaucucc

SEQ ID NO: 151794 - RNA, 22 nt, Human
gcuggcagagagcuggugagga

SEQ ID NO: 151795 - RNA, 22 nt, Human
ccuugcucaagcuagugacggg

SEQ ID NO: 151796 - RNA, 20 nt, Human
cacaacuguccacaugcucc

SEQ ID NO: 151797 - RNA, 22 nt, Human
acagaguccuagcugcaaagaa

SEQ ID NO: 151798 - RNA, 18 nt, Human
acucugcggaggccccag

SEQ ID NO: 151799 - RNA, 22 nt, Human
gcccacacaccagcucaggagg

SEQ ID NO: 151800 - RNA, 23 nt, Human
acuccccagucucuucuugccaa

SEQ ID NO: 151801 - RNA, 22 nt, Human
guccucugggcuuugagcaguc

SEQ ID NO: 151802 - RNA, 22 nt, Human
aggggugugcauccuggaggau

SEQ ID NO: 151803 - RNA, 22 nt, Human
gcccacaccauuuauucuuugu

SEQ ID NO: 151804 - RNA, 22 nt, Human
uggcagagcccagacuccaguc

SEQ ID NO: 151805 - RNA, 22 nt, Human
acuggcagaacgugaugcgggu

SEQ ID NO: 151806 - RNA, 18 nt, Human
ggcagggaaaagauaggg

SEQ ID NO: 151807 - RNA, 22 nt, Human
uccuggcagaaauggggcugug

SEQ ID NO: 151808 - RNA, 22 nt, Human
cuguccagcuuggcuccugggg

SEQ ID NO: 151809 - RNA, 22 nt, Human
ucuggcagaucuucccacguuu

SEQ ID NO: 151810 - RNA, 20 nt, Human
uuccacaucuuugcacaugc

SEQ ID NO: 151811 - RNA, 22 nt, Human
agucacaguuucccugagagag

SEQ ID NO: 151812 - RNA, 22 nt, Human
uggcagugguaccggcucucag

SEQ ID NO: 151813 - RNA, 22 nt, Human
gcacacagcuagauuaccauuc

SEQ ID NO: 151814 - RNA, 22 nt, Human
uccuggcauccgugggucugug

SEQ ID NO: 151815 - RNA, 22 nt, Human
cuggcaguauuaagagaaguga

SEQ ID NO: 151816 - RNA, 22 nt, Human
uugggaagaauggaggugguua

SEQ ID NO: 151817 - RNA, 22 nt, Human
ccauucauacaauuuuguucua

SEQ ID NO: 151818 - RNA, 22 nt, Human
uggcagagucaucacaucugga

SEQ ID NO: 151819 - RNA, 17 nt, Human
uccaggcagcaacugag

SEQ ID NO: 151820 - RNA, 22 nt, Human
cuccaggccccuggccuucugc

SEQ ID NO: 151821 - RNA, 22 nt, Human
acauacacaagcguacaugaac

SEQ ID NO: 151822 - RNA, 22 nt, Human
aacaaaagccgaaguagguguc

SEQ ID NO: 151823 - RNA, 22 nt, Human
acacacaugcaugcuugccauu

SEQ ID NO: 151824 - RNA, 22 nt, Human
acuggcagcagcagcccuuggg

SEQ ID NO: 151825 - RNA, 22 nt, Human
agagggugcuggagagacauug

SEQ ID NO: 151826 - RNA, 22 nt, Human
caucacagguccugaugacauu

SEQ ID NO: 151827 - RNA, 22 nt, Human
ucuggcagugagcaacuugaca

SEQ ID NO: 151828 - RNA, 22 nt, Human
ccacaaaacugugugucaaaga

SEQ ID NO: 151829 - RNA, 22 nt, Human
ggagcugaaccccaucgugcug

SEQ ID NO: 151830 - RNA, 22 nt, Human
acacacuguaaggacuaucacu

SEQ ID NO: 151831 - RNA, 22 nt, Human
ccuggcagguggcgcccucggc

SEQ ID NO: 151832 - RNA, 21 nt, Human
ucuggcaguggucuuucaaau

SEQ ID NO: 151833 - RNA, 22 nt, Human
gugggagaaauuagcucuaguu

SEQ ID NO: 151834 - RNA, 22 nt, Human
uccaggcuaauuuugcauuguu

SEQ ID NO: 151835 - RNA, 22 nt, Human
aucccacaccccuacaacauau

SEQ ID NO: 151836 - RNA, 22 nt, Human
agacaagaaacugggagucucu

SEQ ID NO: 151837 - RNA, 22 nt, Human
uccuggcaaagauguugguguu

SEQ ID NO: 151838 - RNA, 22 nt, Human
acacacaugccuuuccuaagua

SEQ ID NO: 151839 - RNA, 20 nt, Human
gcuggcagaugucuugagau

SEQ ID NO: 151840 - RNA, 22 nt, Human
aggaggcugcaacccugaggcc

SEQ ID NO: 151841 - RNA, 22 nt, Human
ucuggcagcaagauaacaaugg

SEQ ID NO: 151842 - RNA, 22 nt, Human
ccugccucccagagguccucua

SEQ ID NO: 151843 - RNA, 22 nt, Human
cuuggcaggguggaggaugcag

SEQ ID NO: 151844 - RNA, 22 nt, Human
cacaucccuggaguuacccagu

SEQ ID NO: 151845 - RNA, 22 nt, Human
ucccacacuacacgguuguugg

SEQ ID NO: 151846 - RNA, 22 nt, Human
aacacauauuuauauaugcaca

SEQ ID NO: 151847 - RNA, 21 nt, Human
ucacguggucacaugagcuuu

SEQ ID NO: 151848 - RNA, 22 nt, Human
gcuggcagaagagcugguucaa

SEQ ID NO: 151849 - RNA, 22 nt, Human
cuccugaggaaaagcuugguca

SEQ ID NO: 151850 - RNA, 22 nt, Human
cugccugcucuauccaggccug

SEQ ID NO: 151851 - RNA, 22 nt, Human
aagaggucauaccagauaaggg

SEQ ID NO: 151852 - RNA, 22 nt, Human
gcuugggaagggcccuguguac

SEQ ID NO: 151853 - RNA, 22 nt, Human
gcacauaacugaccacaucuaa

SEQ ID NO: 151854 - RNA, 23 nt, Human
uuccaggcagagcagggauuaga

SEQ ID NO: 151855 - RNA, 21 nt, Human
gggcagaggggccuccugggu

SEQ ID NO: 151856 - RNA, 22 nt, Human
gagccugaugaaacaggcagac

SEQ ID NO: 151857 - RNA, 22 nt, Human
ugcagagagaccccugggccag

SEQ ID NO: 151858 - RNA, 22 nt, Human
gcuggcagugugaaugacaagc

SEQ ID NO: 151859 - RNA, 22 nt, Human
cccacccugggcuacacaucca

SEQ ID NO: 151860 - RNA, 22 nt, Human
cagccaagaaccacagacccag

SEQ ID NO: 151861 - RNA, 22 nt, Human
gcccacacagcagauccuuugg

SEQ ID NO: 151862 - RNA, 22 nt, Human
cacugucccuguuuccuggaaa

SEQ ID NO: 151863 - RNA, 22 nt, Human
cugccugcaggacaccucgcua

SEQ ID NO: 151864 - RNA, 22 nt, Human
uaaaggguagguuuuacuguaa

SEQ ID NO: 151865 - RNA, 22 nt, Human
agcccagcuuugaaccauauca

SEQ ID NO: 151866 - RNA, 22 nt, Human
gcccucucuucugcagccucca

SEQ ID NO: 151867 - RNA, 22 nt, Human
cuggcagguuuggugucuggug

SEQ ID NO: 151868 - RNA, 22 nt, Human
aggcaggggagcuggaagggua

SEQ ID NO: 151869 - RNA, 22 nt, Human
caauacugaguuuacauucauc

SEQ ID NO: 151870 - RNA, 22 nt, Human
agagcacagaagaauaggugcu

SEQ ID NO: 151871 - RNA, 22 nt, Human
uggcacaguccugggugccugc

SEQ ID NO: 151872 - RNA, 22 nt, Human
gacaaaaguguuuugaacaagg

SEQ ID NO: 151873 - RNA, 22 nt, Human
gacacagaauuuacucccgaua

SEQ ID NO: 151874 - RNA, 21 nt, Human
cccuugccugcacuccucggc

SEQ ID NO: 151875 - RNA, 22 nt, Human
cacacacucuuccuggcaccua

SEQ ID NO: 151876 - RNA, 22 nt, Human
ccaggcccugcuccucacacca

SEQ ID NO: 151877 - RNA, 22 nt, Human
uccacacacauuucuaugugca

SEQ ID NO: 151878 - RNA, 22 nt, Human
acuggcagaggauagcacuaau

SEQ ID NO: 151879 - RNA, 22 nt, Human
ugagagucuguuccucuugcag

SEQ ID NO: 151880 - RNA, 22 nt, Human
cuccaggcucguccaagaucga

SEQ ID NO: 151881 - RNA, 22 nt, Human
guccuggcugguucuguggggc

SEQ ID NO: 151882 - RNA, 22 nt, Human
cuggccuggggggacacauccc

SEQ ID NO: 151883 - RNA, 22 nt, Human
aguguugggucuuuagaauuua

SEQ ID NO: 151884 - RNA, 22 nt, Human
accugccuauggagccacaugg

SEQ ID NO: 151885 - RNA, 22 nt, Human
cccacacucugagaaaugcuga

SEQ ID NO: 151886 - RNA, 22 nt, Human
acagacuggccugucucgcacc

SEQ ID NO: 151887 - RNA, 22 nt, Human
ccuggcagucaggggaguccuu

SEQ ID NO: 151888 - RNA, 22 nt, Human
gccuggcaggggccugggagug

SEQ ID NO: 151889 - RNA, 22 nt, Human
cagucacauagguauacacaua

SEQ ID NO: 151890 - RNA, 19 nt, Human
guccuggcgccgccacacc

SEQ ID NO: 151891 - RNA, 22 nt, Human
agagucccagggacacuccaga

SEQ ID NO: 151892 - RNA, 22 nt, Human
ccuggcagcagcacaugccuuc

SEQ ID NO: 151893 - RNA, 22 nt, Human
cuggcaugaaauggcaucucau

SEQ ID NO: 151894 - RNA, 19 nt, Human
ccacacagugugcaauuua

SEQ ID NO: 151895 - RNA, 22 nt, Human
ucacauacugaaaguccaguga

SEQ ID NO: 151896 - RNA, 22 nt, Human
gccccacagccugcggucucag

SEQ ID NO: 151897 - RNA, 22 nt, Human
acacucacccucccacugccug

SEQ ID NO: 151898 - RNA, 22 nt, Human
cagcccagccuugucucuuuau

SEQ ID NO: 151899 - RNA, 22 nt, Human
gcacacaggcaguuuccagcca

SEQ ID NO: 151900 - RNA, 18 nt, Human
uccuggcagucagagagg

SEQ ID NO: 151901 - RNA, 22 nt, Human
cagcacagugaccagacccacu

SEQ ID NO: 151902 - RNA, 22 nt, Human
uccaggcaagggaggagcaugg

SEQ ID NO: 151903 - RNA, 22 nt, Human
agggccccauagucacugcccg

SEQ ID NO: 151904 - RNA, 22 nt, Human
gcaguguuuguguucucacaug

SEQ ID NO: 151905 - RNA, 22 nt, Human
ccucucccgggugccgcugggc

SEQ ID NO: 151906 - RNA, 22 nt, Human
ggugccaggcuguagucagggu

SEQ ID NO: 151907 - RNA, 22 nt, Human
ccuggcagcuaagugcuuugag

SEQ ID NO: 151908 - RNA, 22 nt, Human
cccuuccugggugucccggagu

SEQ ID NO: 151909 - RNA, 22 nt, Human
ugccucucuaacccaugcccaa

SEQ ID NO: 151910 - RNA, 22 nt, Human
ggcccagccucagacaugcccu

SEQ ID NO: 151911 - RNA, 22 nt, Human
cuuggcagagggcugggcucag

SEQ ID NO: 151912 - RNA, 17 nt, Human
uugggagagaaagguau

SEQ ID NO: 151913 - RNA, 22 nt, Human
aaagagucaaaggcaugucucu

SEQ ID NO: 151914 - RNA, 22 nt, Human
uacacagaaccugguguacagu

SEQ ID NO: 151915 - RNA, 22 nt, Human
ccacacuaaacugcucaaacca

SEQ ID NO: 151916 - RNA, 22 nt, Human
aaauuacagaucaccaaugcau

SEQ ID NO: 151917 - RNA, 22 nt, Human
cagcccaggccgacaguuccuc

SEQ ID NO: 151918 - RNA, 22 nt, Human
acuggcaggcugcuggccggcg

SEQ ID NO: 151919 - RNA, 22 nt, Human
cucucuccuuagcugcagacca

SEQ ID NO: 151920 - RNA, 22 nt, Human
uguggggaagaguaugacuugg

SEQ ID NO: 151921 - RNA, 22 nt, Human
ggcaagagggcagauggagugc

SEQ ID NO: 151922 - RNA, 22 nt, Human
ucuggcagugaagucaugaggu

SEQ ID NO: 151923 - RNA, 22 nt, Human
gcagccucaaacuccccagcuc

SEQ ID NO: 151924 - RNA, 22 nt, Human
gcuggcaggagaaacggggugc

SEQ ID NO: 151925 - RNA, 22 nt, Human
ucuggcagugauuucugugauc

SEQ ID NO: 151926 - RNA, 22 nt, Human
ccuggcagcgccgaagcuggcc

SEQ ID NO: 151927 - RNA, 22 nt, Human
auggcagagggauugaacagcu

SEQ ID NO: 151928 - RNA, 22 nt, Human
auuccacacaguaauacucaau

SEQ ID NO: 151929 - RNA, 19 nt, Human
agaggccucagcagcuggc

SEQ ID NO: 151930 - RNA, 22 nt, Human
uuccagcccgcgacuuguucag

SEQ ID NO: 151931 - RNA, 22 nt, Human
ggugccagugggucucaggaua

SEQ ID NO: 151932 - RNA, 22 nt, Human
cacacacuggagcaaggagaug

SEQ ID NO: 151933 - RNA, 18 nt, Human
ggccucuggacuggcagc

SEQ ID NO: 151934 - RNA, 22 nt, Human
uacacagauuucaguaucauca

SEQ ID NO: 151935 - RNA, 22 nt, Human
ucuggcaguugccgcuucaguc

SEQ ID NO: 151936 - RNA, 22 nt, Human
ccuggcagaauauuaaagugca

SEQ ID NO: 151937 - RNA, 22 nt, Human
gcuccaggaggaugaccuuccu

SEQ ID NO: 151938 - RNA, 22 nt, Human
guccucuggaagaugaguucuu

SEQ ID NO: 151939 - RNA, 22 nt, Human
cacacauuucagaugcuacaau

SEQ ID NO: 151940 - RNA, 22 nt, Human
cagcccaaagccccaggcuaga

SEQ ID NO: 151941 - RNA, 22 nt, Human
cagguuggggacuuaggaugac

SEQ ID NO: 151942 - RNA, 22 nt, Human
ccuggcagguggagguugcagu

SEQ ID NO: 151943 - RNA, 22 nt, Human
accugccuucucaaggacauga

SEQ ID NO: 151944 - RNA, 21 nt, Human
ucuggcaggaagacggauggg

SEQ ID NO: 151945 - RNA, 21 nt, Human
ccuggcagaagccugauaugc

SEQ ID NO: 151946 - RNA, 22 nt, Human
ggaggacacuggcucugccuuc

SEQ ID NO: 151947 - RNA, 15 nt, Human
cacacagacagcuug

SEQ ID NO: 151948 - RNA, 22 nt, Human
aggcaguggagcuggaauaggc

SEQ ID NO: 151949 - RNA, 23 nt, Human
ggacacauuuauuucagaauuca

SEQ ID NO: 151950 - RNA, 22 nt, Human
guuaggaacacuggagccuaaa

SEQ ID NO: 151951 - RNA, 22 nt, Human
ucccacacuugaaacaaggcug

SEQ ID NO: 151952 - RNA, 22 nt, Human
uucuuucaauagcuggcauaug

SEQ ID NO: 151953 - RNA, 19 nt, Human
gugggacagacauuacaua

SEQ ID NO: 151954 - RNA, 22 nt, Human
ccacaucauggauacaguuaug

SEQ ID NO: 151955 - RNA, 22 nt, Human
aaaagagucuuaggcagucaua

SEQ ID NO: 151956 - RNA, 22 nt, Human
acuggcaguagagggagcgcau

SEQ ID NO: 151957 - RNA, 22 nt, Human
gagaggcuggcagugccagguu

SEQ ID NO: 151958 - RNA, 22 nt, Human
guccucugggcagcugccccac

SEQ ID NO: 151959 - RNA, 22 nt, Human
ccugccuguacuagagacccag

SEQ ID NO: 151960 - RNA, 22 nt, Human
aaagagucguguuccagguuug

SEQ ID NO: 151961 - RNA, 20 nt, Human
aaaagagugcuucaacugcu

SEQ ID NO: 151962 - RNA, 22 nt, Human
acuggcagugucguuuacauga

SEQ ID NO: 151963 - RNA, 22 nt, Human
cccugagcgugaggaggaagua

SEQ ID NO: 151964 - RNA, 18 nt, Human
uccugccugugccccagg

SEQ ID NO: 151965 - RNA, 22 nt, Human
acacagaugcauuacacaucua

SEQ ID NO: 151966 - RNA, 22 nt, Human
uggaaagaggaagugcccagca

SEQ ID NO: 151967 - RNA, 22 nt, Human
ugcacaggaggcuguggagaag

SEQ ID NO: 151968 - RNA, 22 nt, Human
ggugccagaguggcccaggggc

SEQ ID NO: 151969 - RNA, 17 nt, Human
gccuucucugcccucac

SEQ ID NO: 151970 - RNA, 22 nt, Human
guccucugacucagccuuggga

SEQ ID NO: 151971 - RNA, 22 nt, Human
auggccuggggauuccugagca

SEQ ID NO: 151972 - RNA, 22 nt, Human
cuggcaguuugccaggagcucg

SEQ ID NO: 151973 - RNA, 22 nt, Human
cagguggguguaugaaugcaaa

SEQ ID NO: 151974 - RNA, 22 nt, Human
uccuggcacuuugggggcucgc

SEQ ID NO: 151975 - RNA, 22 nt, Human
guccucugagggggcugcacgc

SEQ ID NO: 151976 - RNA, 22 nt, Human
acaucacaguaguuaagccaga

SEQ ID NO: 151977 - RNA, 22 nt, Human
guccucugauuucuagguauau

SEQ ID NO: 151978 - RNA, 22 nt, Human
aggaagaacagauaauggacgc

SEQ ID NO: 151979 - RNA, 22 nt, Human
auguuggagucguaaggcaugg

SEQ ID NO: 151980 - RNA, 20 nt, Human
uucaugggagcaaagaggcc

SEQ ID NO: 151981 - RNA, 22 nt, Human
ucuggcagggucagggcccagg

SEQ ID NO: 151982 - RNA, 22 nt, Human
auacauucaaaggaaggauaga

SEQ ID NO: 151983 - RNA, 22 nt, Human
ggccucagagaaggcugugcgg

SEQ ID NO: 151984 - RNA, 22 nt, Human
gcuggcagguccaagauagagc

SEQ ID NO: 151985 - RNA, 22 nt, Human
ccuggcugguggcagcgacaag

SEQ ID NO: 151986 - RNA, 23 nt, Human
uguaaacaucacccccuggaguu

SEQ ID NO: 151987 - RNA, 22 nt, Human
ccagccucacuggcaucaccua

SEQ ID NO: 151988 - RNA, 22 nt, Human
cagguuggucggcaaguacaca

SEQ ID NO: 151989 - RNA, 22 nt, Human
ugacaggaggcuugaggccagg

SEQ ID NO: 151990 - RNA, 22 nt, Human
uuccagccaugguuucccuaug

SEQ ID NO: 151991 - RNA, 22 nt, Human
uccaggcucuaggcugcucucc

SEQ ID NO: 151992 - RNA, 22 nt, Human
acagguggaggcuuuaggaggu

SEQ ID NO: 151993 - RNA, 19 nt, Human
ccagcccacagugacuuuc

SEQ ID NO: 151994 - RNA, 18 nt, Human
uguagagccagguuugcc

SEQ ID NO: 151995 - RNA, 22 nt, Human
uccugccuguuuaccuguacuu

SEQ ID NO: 151996 - RNA, 22 nt, Human
ggagcugaguucuucagccggg

SEQ ID NO: 151997 - RNA, 16 nt, Human
ucacauacuuccuugc

SEQ ID NO: 151998 - RNA, 17 nt, Human
ccauacugacauauuga

SEQ ID NO: 151999 - RNA, 22 nt, Human
cccagcccacgguccugggugg

SEQ ID NO: 152000 - RNA, 22 nt, Human
uccugagcaacacagcuaagug

SEQ ID NO: 152001 - RNA, 22 nt, Human
gaggagcucaugaaagcggugu

SEQ ID NO: 152002 - RNA, 22 nt, Human
ccuggcagcauugguagagauu

SEQ ID NO: 152003 - RNA, 23 nt, Human
guccucuggagagaaaggcagua

SEQ ID NO: 152004 - RNA, 22 nt, Human
uuccuggcgccacggagccggu

SEQ ID NO: 152005 - RNA, 22 nt, Human
uggcaggaaaguaacagagcac

SEQ ID NO: 152006 - RNA, 22 nt, Human
uccaggcuccccugcgugcucc

SEQ ID NO: 152007 - RNA, 22 nt, Human
cugccugccuuggccuccagga

SEQ ID NO: 152008 - RNA, 22 nt, Human
guccucugggagccuugagccu

SEQ ID NO: 152009 - RNA, 22 nt, Human
uggcagagagagugcagucgac

SEQ ID NO: 152010 - RNA, 22 nt, Human
cuccuggcacugucuugaccca

SEQ ID NO: 152011 - RNA, 22 nt, Human
uacacacaugcauuugccuuau

SEQ ID NO: 152012 - RNA, 22 nt, Human
acacacacaagcagguugugga

SEQ ID NO: 152013 - RNA, 22 nt, Human
agaggccggccgagcccauggg

SEQ ID NO: 152014 - RNA, 22 nt, Human
caggaguggugugagggacucc

SEQ ID NO: 152015 - RNA, 22 nt, Human
gccuggcacaguagggacccaa

SEQ ID NO: 152016 - RNA, 22 nt, Human
gcuggcaggauagaagucuaau

SEQ ID NO: 152017 - RNA, 22 nt, Human
auccuggcccagguguggaggg

SEQ ID NO: 152018 - RNA, 22 nt, Human
acagguccucaagucagcuggg

SEQ ID NO: 152019 - RNA, 22 nt, Human
ccuggcaggacuguuguaagaa

SEQ ID NO: 152020 - RNA, 22 nt, Human
gguguugggcucacugguccuu

SEQ ID NO: 152021 - RNA, 22 nt, Human
acugccaaugguaguuugaugg

SEQ ID NO: 152022 - RNA, 22 nt, Human
ucuggcagcgaagcguguacuu

SEQ ID NO: 152023 - RNA, 22 nt, Human
ccacacagggggaugaguuauu

SEQ ID NO: 152024 - RNA, 22 nt, Human
augacugcucugggcucccaug

SEQ ID NO: 152025 - RNA, 22 nt, Human
gcccagccuccaagcuccaagg

SEQ ID NO: 152026 - RNA, 22 nt, Human
ccacauacaaauggggugcugu

SEQ ID NO: 152027 - RNA, 22 nt, Human
cacauuccuggugcucagcagc

SEQ ID NO: 152028 - RNA, 17 nt, Human
gcaucacagauaacacg

SEQ ID NO: 152029 - RNA, 22 nt, Human
ccagcccugucaccaacuggag

SEQ ID NO: 152030 - RNA, 22 nt, Human
ugagggacucccggcccugcca

SEQ ID NO: 152031 - RNA, 22 nt, Human
uccaggcucccucaggaugcac

SEQ ID NO: 152032 - RNA, 22 nt, Human
uccugcagccacugcaggcaga

SEQ ID NO: 152033 - RNA, 22 nt, Human
gaagagaaaggcaaggaguuuu

SEQ ID NO: 152034 - RNA, 19 nt, Human
acuggcagggcugcggugg

SEQ ID NO: 152035 - RNA, 20 nt, Human
ucuggcaggugaacgagcug

SEQ ID NO: 152036 - RNA, 22 nt, Human
cccacccucaagggugucuaua

SEQ ID NO: 152037 - RNA, 22 nt, Human
gcuggcagaauuucuucuugcu

SEQ ID NO: 152038 - RNA, 22 nt, Human
uguaaagaaagacgcagaguua

SEQ ID NO: 152039 - RNA, 22 nt, Human
ggcacagggggcugaggacuag

SEQ ID NO: 152040 - RNA, 19 nt, Human
guccucucaacaacccggg

SEQ ID NO: 152041 - RNA, 22 nt, Human
aucacagagcucccuuccacug

SEQ ID NO: 152042 - RNA, 22 nt, Human
ucccacacagcccgcucaccgg

SEQ ID NO: 152043 - RNA, 22 nt, Human
cauacauuuauacacaucuaug

SEQ ID NO: 152044 - RNA, 22 nt, Human
agacacagucugucuggaggag

SEQ ID NO: 152045 - RNA, 22 nt, Human
gguggcagaggugcaucagccc

SEQ ID NO: 152046 - RNA, 22 nt, Human
agucuagggugggguccacagg

SEQ ID NO: 152047 - RNA, 22 nt, Human
aaagaucaauagauaaagcuac

SEQ ID NO: 152048 - RNA, 22 nt, Human
cagucccaugagcccagaacau

SEQ ID NO: 152049 - RNA, 22 nt, Human
ugcuggcacguggaccaggaga

SEQ ID NO: 152050 - RNA, 22 nt, Human
gaggagcuggcagcgucuccgc

SEQ ID NO: 152051 - RNA, 22 nt, Human
ucccagccaggcucuaccacuu

SEQ ID NO: 152052 - RNA, 22 nt, Human
auaauggccgggggcugaaugc

SEQ ID NO: 152053 - RNA, 22 nt, Human
uucccacauucuuuacauucau

SEQ ID NO: 152054 - RNA, 20 nt, Human
acaaagacuggaaaagcaag

SEQ ID NO: 152055 - RNA, 22 nt, Human
uguaaacauaccagagccaagu

SEQ ID NO: 152056 - RNA, 22 nt, Human
aggaaagauggaaggaggauaa

SEQ ID NO: 152057 - RNA, 21 nt, Human
ucacacacguuuccaagggca

SEQ ID NO: 152058 - RNA, 22 nt, Human
uggucucugcaggccaggcuca

SEQ ID NO: 152059 - RNA, 22 nt, Human
acacacuguugcucauccaggc

SEQ ID NO: 152060 - RNA, 22 nt, Human
acacacagguaaaggagccugg

SEQ ID NO: 152061 - RNA, 22 nt, Human
ggagaagaggagcuggaagccu

SEQ ID NO: 152062 - RNA, 22 nt, Human
ucccuccuggccgucaccgcug

SEQ ID NO: 152063 - RNA, 22 nt, Human
ucaggagcucuucccuggugug

SEQ ID NO: 152064 - RNA, 22 nt, Human
cuggcaguuggcauuggcaucu

SEQ ID NO: 152065 - RNA, 22 nt, Human
cuccuggcucgcccccagcuga

SEQ ID NO: 152066 - RNA, 21 nt, Human
aggcugcuggcucaggguccu

SEQ ID NO: 152067 - RNA, 22 nt, Human
gcacacaguauaugcucauuaa

SEQ ID NO: 152068 - RNA, 22 nt, Human
cuccaggccauggcugcggagg

SEQ ID NO: 152069 - RNA, 22 nt, Human
gccuggcauauaguaguugugc

SEQ ID NO: 152070 - RNA, 22 nt, Human
acacaucucaggggacacucuc

SEQ ID NO: 152071 - RNA, 21 nt, Human
cagcccagcccauugacagug

SEQ ID NO: 152072 - RNA, 22 nt, Human
ucccacauaugcaauccugaau

SEQ ID NO: 152073 - RNA, 22 nt, Human
agaggcuuggaggugcaagguu

SEQ ID NO: 152074 - RNA, 22 nt, Human
aagugccaucauagcauggcug

SEQ ID NO: 152075 - RNA, 22 nt, Human
cccagcccccgagugucuggaa

SEQ ID NO: 152076 - RNA, 22 nt, Human
gaggagcucugcuccauccuuc

SEQ ID NO: 152077 - RNA, 22 nt, Human
guggcaguuuugacaucacaaa

SEQ ID NO: 152078 - RNA, 22 nt, Human
auccccacgauauagccaaagc

SEQ ID NO: 152079 - RNA, 21 nt, Human
gggagggauggaaaugauguu

SEQ ID NO: 152080 - RNA, 22 nt, Human
aggacaagcuaaaggacuuccu

SEQ ID NO: 152081 - RNA, 22 nt, Human
ggcagagguagcuggaaccagg

SEQ ID NO: 152082 - RNA, 22 nt, Human
caaauacuacgauucuugcagu

SEQ ID NO: 152083 - RNA, 22 nt, Human
auagggccuaaaaaguauugcu

SEQ ID NO: 152084 - RNA, 22 nt, Human
gacacagagggcaccagauaug

SEQ ID NO: 152085 - RNA, 22 nt, Human
gauggcagguaguggucucauc

SEQ ID NO: 152086 - RNA, 22 nt, Human
uccacccugcuuucuuaucucc

SEQ ID NO: 152087 - RNA, 22 nt, Human
ccagcccugccagagagagcug

SEQ ID NO: 152088 - RNA, 22 nt, Human
gucacaggcaguaacuaggacc

SEQ ID NO: 152089 - RNA, 22 nt, Human
ucccacauuacccugacugaca

SEQ ID NO: 152090 - RNA, 22 nt, Human
uccaggaggaggaaggcugcca

SEQ ID NO: 152091 - RNA, 18 nt, Human
cuccuccacagccccugc

SEQ ID NO: 152092 - RNA, 22 nt, Human
aggagcugcagauucugccuug

SEQ ID NO: 152093 - RNA, 22 nt, Human
ccuggcagaaagaguuacaccu

SEQ ID NO: 152094 - RNA, 22 nt, Human
gccuccggagucacagugucuu

SEQ ID NO: 152095 - RNA, 22 nt, Human
gaggcacauauauacagagccc

SEQ ID NO: 152096 - RNA, 22 nt, Human
gaggggcuggguagggcaaccc

SEQ ID NO: 152097 - RNA, 22 nt, Human
uauucccagccucuuucuaucu

SEQ ID NO: 152098 - RNA, 22 nt, Human
caggagggcccgagacucuucc

SEQ ID NO: 152099 - RNA, 22 nt, Human
cucuccagccuuuagcccacgc

SEQ ID NO: 152100 - RNA, 22 nt, Human
gcacauacccacugucaagcac

SEQ ID NO: 152101 - RNA, 22 nt, Human
caggucccugcgccccggccuc

SEQ ID NO: 152102 - RNA, 22 nt, Human
cggcuggugucgggcacagcaa

SEQ ID NO: 152103 - RNA, 22 nt, Human
gaggacucugggcguguauggg

SEQ ID NO: 152104 - RNA, 19 nt, Human
uccuggcauuuguaggaaa

SEQ ID NO: 152105 - RNA, 22 nt, Human
acaggugguaaaauggacuguc

SEQ ID NO: 152106 - RNA, 22 nt, Human
ccagcccuuagauaaaccuggc

SEQ ID NO: 152107 - RNA, 22 nt, Human
uggcacagggcuuggucgcuca

SEQ ID NO: 152108 - RNA, 21 nt, Human
cacacagugaucuauccacau

SEQ ID NO: 152109 - RNA, 22 nt, Human
guacacacuguuugaucauuuc

SEQ ID NO: 152110 - RNA, 22 nt, Human
uggcaguagauccagucucucu

SEQ ID NO: 152111 - RNA, 22 nt, Human
ugggagaaacugucucucccac

SEQ ID NO: 152112 - RNA, 22 nt, Human
ccuggcagacugugagggcagg

SEQ ID NO: 152113 - RNA, 22 nt, Human
ccucagcugcuucccuggagcc

SEQ ID NO: 152114 - RNA, 22 nt, Human
cagugggggggccaugcugcag

SEQ ID NO: 152115 - RNA, 22 nt, Human
gugugggaaggcuaggaugcug

SEQ ID NO: 152116 - RNA, 18 nt, Human
cuccuggcugauggugag

SEQ ID NO: 152117 - RNA, 17 nt, Human
ugcuggcaacauacaaa

SEQ ID NO: 152118 - RNA, 21 nt, Human
agagucugagugugcaagggc

SEQ ID NO: 152119 - RNA, 22 nt, Human
ccacagaccuuggcuuccaccu

SEQ ID NO: 152120 - RNA, 22 nt, Human
agaaagaggaugcagaucucau

SEQ ID NO: 152121 - RNA, 22 nt, Human
ccuccagcgcgauccacuccgg

SEQ ID NO: 152122 - RNA, 22 nt, Human
caccagggccccaggcugugcc

SEQ ID NO: 152123 - RNA, 22 nt, Human
uccuggcauugugcagggugug

SEQ ID NO: 152124 - RNA, 22 nt, Human
ggagucugcucccagacaugau

SEQ ID NO: 152125 - RNA, 22 nt, Human
agugccccaugggugccugggg

SEQ ID NO: 152126 - RNA, 22 nt, Human
gaggagcugcagggggagucua

SEQ ID NO: 152127 - RNA, 22 nt, Human
gcacacauucggauucuuaacc

SEQ ID NO: 152128 - RNA, 20 nt, Human
cugcuccacccggcucucag

SEQ ID NO: 152129 - RNA, 19 nt, Human
cugagagaugcuucacaca

SEQ ID NO: 152130 - RNA, 22 nt, Human
agcacaggaacauggagauggg

SEQ ID NO: 152131 - RNA, 22 nt, Human
acccacccuacuagcagugucc

SEQ ID NO: 152132 - RNA, 22 nt, Human
caggacaaagcccuuugagaaa

SEQ ID NO: 152133 - RNA, 22 nt, Human
uauuacagaaucaggcauaacu

SEQ ID NO: 152134 - RNA, 22 nt, Human
ucuggcagagauauccauccca

SEQ ID NO: 152135 - RNA, 22 nt, Human
gucacaggccuggaugaggggc

SEQ ID NO: 152136 - RNA, 22 nt, Human
cccuuccuugauuuuaacugga

SEQ ID NO: 152137 - RNA, 22 nt, Human
gacuguggggggcggacacaag

SEQ ID NO: 152138 - RNA, 22 nt, Human
cacacagaugguaagggaggga

SEQ ID NO: 152139 - RNA, 22 nt, Human
cuccucuguauugauugggacu

SEQ ID NO: 152140 - RNA, 18 nt, Human
ccuagccuccaagcucau

SEQ ID NO: 152141 - RNA, 22 nt, Human
acuggcagcuguaggaugcaug

SEQ ID NO: 152142 - RNA, 22 nt, Human
cccacacauuuuucacuuaccg

SEQ ID NO: 152143 - RNA, 22 nt, Human
acuggcagccacaacuggcagg

SEQ ID NO: 152144 - RNA, 22 nt, Human
auacaugacucacacauucugc

SEQ ID NO: 152145 - RNA, 22 nt, Human
ccuggcagggcugcaguaaugg

SEQ ID NO: 152146 - RNA, 22 nt, Human
uuccaggcaugucagacauagg

SEQ ID NO: 152147 - RNA, 22 nt, Human
ugcuccagugccugccccacag

SEQ ID NO: 152148 - RNA, 22 nt, Human
ucuggcaggucaaucauucuuu

SEQ ID NO: 152149 - RNA, 22 nt, Human
cugagccagggccacacaugga

SEQ ID NO: 152150 - RNA, 22 nt, Human
cacaaaaguaggaggcaggcgg

SEQ ID NO: 152151 - RNA, 22 nt, Human
acauacacaugaauauauuuuu

SEQ ID NO: 152152 - RNA, 23 nt, Human
acauacauggagauaaagugaug

SEQ ID NO: 152153 - RNA, 22 nt, Human
acacacagaaggaagccccacu

SEQ ID NO: 152154 - RNA, 22 nt, Human
ugggacucacucuuuuggccag

SEQ ID NO: 152155 - RNA, 21 nt, Human
uccuguaagcuuggguggcuc

SEQ ID NO: 152156 - RNA, 22 nt, Human
ccuggcagguagcauugaggag

SEQ ID NO: 152157 - RNA, 22 nt, Human
uacacacagaggccaugggauu

SEQ ID NO: 152158 - RNA, 22 nt, Human
acacauuugcauaauaccucau

SEQ ID NO: 152159 - RNA, 22 nt, Human
guacacacuauguauuguacac

SEQ ID NO: 152160 - RNA, 22 nt, Human
uccugagcuacaguaguaugau

SEQ ID NO: 152161 - RNA, 22 nt, Human
cuguccuccagacgacaguccc

SEQ ID NO: 152162 - RNA, 22 nt, Human
uuccaggccgggcaggaaacac

SEQ ID NO: 152163 - RNA, 22 nt, Human
ucuggcagggguucugcacuug

SEQ ID NO: 152164 - RNA, 20 nt, Human
gauacacagcacagagggcc

SEQ ID NO: 152165 - RNA, 22 nt, Human
uggcgucucucauaaguaugug

SEQ ID NO: 152166 - RNA, 22 nt, Human
ucuggcagcuauccucuggcca

SEQ ID NO: 152167 - RNA, 23 nt, Human
uugggaaauaguuaagacaugag

SEQ ID NO: 152168 - RNA, 22 nt, Human
ccuggcagcgugccgagcugcg

SEQ ID NO: 152169 - RNA, 22 nt, Human
aggguagggcccggagacagac

SEQ ID NO: 152170 - RNA, 22 nt, Human
ccuucucucugaagaccccaaa

SEQ ID NO: 152171 - RNA, 22 nt, Human
guccacagagggcugggcaggc

SEQ ID NO: 152172 - RNA, 22 nt, Human
ucccagccuuucuuuucugcug

SEQ ID NO: 152173 - RNA, 22 nt, Human
aaagagucuggcacuguaccag

SEQ ID NO: 152174 - RNA, 22 nt, Human
ucacauaaauuuaccagaugau

SEQ ID NO: 152175 - RNA, 22 nt, Human
ucuggcagagugauaggauaag

SEQ ID NO: 152176 - RNA, 22 nt, Human
cgcauacauagaaacacacaga

SEQ ID NO: 152177 - RNA, 22 nt, Human
caugagauaauuuuucuccagu

SEQ ID NO: 152178 - RNA, 22 nt, Human
gaaagaagcuuuagauggcuau

SEQ ID NO: 152179 - RNA, 22 nt, Human
gcacaggaugauggguugaggg

SEQ ID NO: 152180 - RNA, 22 nt, Human
uuccaggcuauccggugaaggg

SEQ ID NO: 152181 - RNA, 22 nt, Human
guugggaagcagauggaugagc

SEQ ID NO: 152182 - RNA, 22 nt, Human
uggcaguggauaggggagcggu

SEQ ID NO: 152183 - RNA, 22 nt, Human
gcuggcaggguucucacugaaa

SEQ ID NO: 152184 - RNA, 22 nt, Human
ggccucucagggcagagacccu

SEQ ID NO: 152185 - RNA, 22 nt, Human
cccagccuuugcuuccugguuc

SEQ ID NO: 152186 - RNA, 22 nt, Human
ccuucuucuguguggcccaaga

SEQ ID NO: 152187 - RNA, 22 nt, Human
guccuggcccacuggcaggcug

SEQ ID NO: 152188 - RNA, 22 nt, Human
caucacagaaauaaacauaccu

SEQ ID NO: 152189 - RNA, 19 nt, Human
gggagcugaggucuuuggu

SEQ ID NO: 152190 - RNA, 22 nt, Human
acacauaagaaacuacaaagag

SEQ ID NO: 152191 - RNA, 22 nt, Human
ucuggcaggguguguauuuaca

SEQ ID NO: 152192 - RNA, 22 nt, Human
cccagcccaucucaaaggucua

SEQ ID NO: 152193 - RNA, 22 nt, Human
ccuccccaugacccggugcugg

SEQ ID NO: 152194 - RNA, 20 nt, Human
gcuccaggucagagaggacg

SEQ ID NO: 152195 - RNA, 22 nt, Human
gauggccuggguccccuuccgg

SEQ ID NO: 152196 - RNA, 22 nt, Human
ucccugcccucagugcacccgg

SEQ ID NO: 152197 - RNA, 22 nt, Human
agggagacacaugaggaaguca

SEQ ID NO: 152198 - RNA, 22 nt, Human
cacacacaguuuuguauucugu

SEQ ID NO: 152199 - RNA, 22 nt, Human
gcuccaggugucccagguaaaa

SEQ ID NO: 152200 - RNA, 23 nt, Human
gcccacccucagcguccucacgg

SEQ ID NO: 152201 - RNA, 22 nt, Human
ucccacccauccugcaucucuu

SEQ ID NO: 152202 - RNA, 22 nt, Human
guccucugcuucaugcccugau

SEQ ID NO: 152203 - RNA, 22 nt, Human
gccuggcacucaaucaucugcu

SEQ ID NO: 152204 - RNA, 22 nt, Human
cuaugagaagaaaacaagauua

SEQ ID NO: 152205 - RNA, 22 nt, Human
gccucaggccgcccugcugcuc

SEQ ID NO: 152206 - RNA, 19 nt, Human
ucuggcagguaauuaggga

SEQ ID NO: 152207 - RNA, 22 nt, Human
gguggcauaagaacacuaaaga

SEQ ID NO: 152208 - RNA, 22 nt, Human
aggaggcuuuugcaggugccac

SEQ ID NO: 152209 - RNA, 22 nt, Human
ucuggcagagucagugcacaca

SEQ ID NO: 152210 - RNA, 22 nt, Human
acagguggccccgagggagugg

SEQ ID NO: 152211 - RNA, 22 nt, Human
ucccaccccuugacucuuuaag

SEQ ID NO: 152212 - RNA, 22 nt, Human
gauggccuuguuuucucccuuc

SEQ ID NO: 152213 - RNA, 22 nt, Human
gcacacacaugugaguacaugc

SEQ ID NO: 152214 - RNA, 22 nt, Human
aucacagagauugcuuuuaaaa

SEQ ID NO: 152215 - RNA, 22 nt, Human
uuccaggcuucucuggggcguc

SEQ ID NO: 152216 - RNA, 22 nt, Human
ccuggcagccucagccaauucu

SEQ ID NO: 152217 - RNA, 22 nt, Human
acaucacagagcccagauaaag

SEQ ID NO: 152218 - RNA, 22 nt, Human
auccaggccccaagaccccgac

SEQ ID NO: 152219 - RNA, 22 nt, Human
ucacacacauuugcugucugau

SEQ ID NO: 152220 - RNA, 22 nt, Human
ucuggcagaagugcugucagua

SEQ ID NO: 152221 - RNA, 22 nt, Human
ucuggcagcaagucuguuucuc

SEQ ID NO: 152222 - RNA, 22 nt, Human
cccccaaaguuugcacggauaa

SEQ ID NO: 152223 - RNA, 22 nt, Human
aacacagaucaaaauauuuccu

SEQ ID NO: 152224 - RNA, 22 nt, Human
uuccacauuccuuacauucaua

SEQ ID NO: 152225 - RNA, 22 nt, Human
gaggcuguuaggagggacucug

SEQ ID NO: 152226 - RNA, 22 nt, Human
cuggccucuguguucaccauag

SEQ ID NO: 152227 - RNA, 22 nt, Human
agcacugugauuuauaacauuu

SEQ ID NO: 152228 - RNA, 22 nt, Human
cacacaguaggcacucauuaau

SEQ ID NO: 152229 - RNA, 22 nt, Human
ucacauacacuaggauauuuuu

SEQ ID NO: 152230 - RNA, 22 nt, Human
cacccacauggaaauucacagu

SEQ ID NO: 152231 - RNA, 22 nt, Human
aaauacugcugcuauuccuuuu

SEQ ID NO: 152232 - RNA, 22 nt, Human
ucuggcagguucccauguuaug

SEQ ID NO: 152233 - RNA, 22 nt, Human
uacacaacugacaaccauucug

SEQ ID NO: 152234 - RNA, 22 nt, Human
gacccauauaggacccuccaaa

SEQ ID NO: 152235 - RNA, 22 nt, Human
uccccacacuuucacuccuggc

SEQ ID NO: 152236 - RNA, 22 nt, Human
ucuggcagcagcaucaguggcu

SEQ ID NO: 152237 - RNA, 21 nt, Human
acauacauaccuuaccaccuu

SEQ ID NO: 152238 - RNA, 22 nt, Human
cccaggccagaacuugguugcu

SEQ ID NO: 152239 - RNA, 22 nt, Human
gcacauaaagggcaugggaggu

SEQ ID NO: 152240 - RNA, 22 nt, Human
uguuggaauuaggauacagagg

SEQ ID NO: 152241 - RNA, 22 nt, Human
acuggcaguggcagcagaaaga

SEQ ID NO: 152242 - RNA, 22 nt, Human
acuggcaguuugagaaugcauu

SEQ ID NO: 152243 - RNA, 22 nt, Human
ugguaagaacccaucagagaag

SEQ ID NO: 152244 - RNA, 22 nt, Human
cugagggucaacuugauuguau

SEQ ID NO: 152245 - RNA, 22 nt, Human
uggcagugggaauggacaaaca

SEQ ID NO: 152246 - RNA, 22 nt, Human
gguuccuucugaggucccugua

SEQ ID NO: 152247 - RNA, 22 nt, Human
acuggcagggggagccccgaga

SEQ ID NO: 152248 - RNA, 22 nt, Human
ccucuccuugcacccgucccgc

SEQ ID NO: 152249 - RNA, 22 nt, Human
gcuggcagagcucugggcuggg

SEQ ID NO: 152250 - RNA, 21 nt, Human
ucuggcagcaguuuguugagu

SEQ ID NO: 152251 - RNA, 22 nt, Human
aaagaucacgucccaggacucg

SEQ ID NO: 152252 - RNA, 22 nt, Human
agggaagaagcugguaguaggu

SEQ ID NO: 152253 - RNA, 23 nt, Human
acacugucucauggauagacugc

SEQ ID NO: 152254 - RNA, 22 nt, Human
agcacaggcuuuggugugaggg

SEQ ID NO: 152255 - RNA, 18 nt, Human
aggaaagaaaggcaggug

SEQ ID NO: 152256 - RNA, 22 nt, Human
gcuggcaggagaccauacccua

SEQ ID NO: 152257 - RNA, 22 nt, Human
ggccucucaugcccagagccaa

SEQ ID NO: 152258 - RNA, 22 nt, Human
ccucccuucaguagagcccaau

SEQ ID NO: 152259 - RNA, 22 nt, Human
uccuggcaguaauuugauguug

SEQ ID NO: 152260 - RNA, 22 nt, Human
uccuggcacccuuggguuggag

SEQ ID NO: 152261 - RNA, 22 nt, Human
auggccugaugcaccuguccca

SEQ ID NO: 152262 - RNA, 22 nt, Human
gucuggaaggaggagauggagc

SEQ ID NO: 152263 - RNA, 22 nt, Human
cccgagugucuacucacuccca

SEQ ID NO: 152264 - RNA, 22 nt, Human
ccuggcaggccccuccuggauu

SEQ ID NO: 152265 - RNA, 22 nt, Human
guacacacuauuuaaaguguuu

SEQ ID NO: 152266 - RNA, 22 nt, Human
ccuggcagcuguuuggcuuggc

SEQ ID NO: 152267 - RNA, 22 nt, Human
cacaauuuuaauacacagucaa

SEQ ID NO: 152268 - RNA, 22 nt, Human
uccugagcugccgcaucagcag

SEQ ID NO: 152269 - RNA, 22 nt, Human
gcuggcaguaaaggguuuggca

SEQ ID NO: 152270 - RNA, 22 nt, Human
uccccaccccagaacuacuagg

SEQ ID NO: 152271 - RNA, 22 nt, Human
cacacagaaccgcucgccacuu

SEQ ID NO: 152272 - RNA, 22 nt, Human
acaagagcauugcagguguguu

SEQ ID NO: 152273 - RNA, 22 nt, Human
cccacacacauuuaugauagga

SEQ ID NO: 152274 - RNA, 22 nt, Human
gacccggcuccaggcccagcag

SEQ ID NO: 152275 - RNA, 22 nt, Human
uccccacagcagaagaucugag

SEQ ID NO: 152276 - RNA, 22 nt, Human
gagagaaaagggggaauugauu

SEQ ID NO: 152277 - RNA, 22 nt, Human
cacccacauuccaucacucugc

SEQ ID NO: 152278 - RNA, 22 nt, Human
gaggagcugggacccugucauc

SEQ ID NO: 152279 - RNA, 22 nt, Human
aauggcagaggcaaagauggua

SEQ ID NO: 152280 - RNA, 22 nt, Human
uggcagagaacacacaugauuc

SEQ ID NO: 152281 - RNA, 18 nt, Human
gacacauccccaggccuc

SEQ ID NO: 152282 - RNA, 22 nt, Human
cuggcagucugguggaaggccu

SEQ ID NO: 152283 - RNA, 21 nt, Human
acacacucugagucuucuauu

SEQ ID NO: 152284 - RNA, 22 nt, Human
ugccugacugcugccaccacua

SEQ ID NO: 152285 - RNA, 22 nt, Human
acaucacacgccuuccaggagg

SEQ ID NO: 152286 - RNA, 22 nt, Human
cccugccucugaagcugcucag

SEQ ID NO: 152287 - RNA, 22 nt, Human
ccuggcagacagcacugaagcu

SEQ ID NO: 152288 - RNA, 22 nt, Human
uuccuggcagaggccccgacag

SEQ ID NO: 152289 - RNA, 22 nt, Human
ccacacagucaguuuccaagaa

SEQ ID NO: 152290 - RNA, 20 nt, Human
ugccuggccuuucucugccc

SEQ ID NO: 152291 - RNA, 22 nt, Human
uacacaucccagacucccagga

SEQ ID NO: 152292 - RNA, 21 nt, Human
ccacucaugacuccacucacc

SEQ ID NO: 152293 - RNA, 22 nt, Human
uggccuccccuaacagccucuu

SEQ ID NO: 152294 - RNA, 22 nt, Human
gcacacaguagggauucaauga

SEQ ID NO: 152295 - RNA, 22 nt, Human
ugguccuggaagguccugaggg

SEQ ID NO: 152296 - RNA, 22 nt, Human
ucccugccugacagcacccacc

SEQ ID NO: 152297 - RNA, 22 nt, Human
ucccacaugugaauccucaggu

SEQ ID NO: 152298 - RNA, 22 nt, Human
cacacacugacaccuuaucuug

SEQ ID NO: 152299 - RNA, 22 nt, Human
agaggcuucucggauggggcag

SEQ ID NO: 152300 - RNA, 22 nt, Human
ggcacagagcuuugucccaguu

SEQ ID NO: 152301 - RNA, 21 nt, Human
agaugcugaugcugcaggucc

SEQ ID NO: 152302 - RNA, 22 nt, Human
cccagccuacucugccauagca

SEQ ID NO: 152303 - RNA, 22 nt, Human
cacacacuguuaauguaggagu

SEQ ID NO: 152304 - RNA, 22 nt, Human
guccucuggugaaagcauuccc

SEQ ID NO: 152305 - RNA, 22 nt, Human
gcuggcagcuggaaguugggcu

SEQ ID NO: 152306 - RNA, 22 nt, Human
guccucuggccuuucccaggac

SEQ ID NO: 152307 - RNA, 22 nt, Human
ccaggcuguaagagugauguug

SEQ ID NO: 152308 - RNA, 22 nt, Human
uggcagggugccaguugcgagu

SEQ ID NO: 152309 - RNA, 22 nt, Human
cuugccucccucagcucacagc

SEQ ID NO: 152310 - RNA, 22 nt, Human
gagaccucuugguaucgcuagg

SEQ ID NO: 152311 - RNA, 22 nt, Human
agcagguugugauacacucaga

SEQ ID NO: 152312 - RNA, 22 nt, Human
uacacaucucugucaguaguga

SEQ ID NO: 152313 - RNA, 22 nt, Human
gucacacagggccuccaaauca

SEQ ID NO: 152314 - RNA, 23 nt, Human
aguguugguugggaagccaagca

SEQ ID NO: 152315 - RNA, 22 nt, Human
ccaggcccaggguacugaccaa

SEQ ID NO: 152316 - RNA, 22 nt, Human
gagaaagacguaggcugggagg

SEQ ID NO: 152317 - RNA, 22 nt, Human
acaaauccagugaacuccagug

SEQ ID NO: 152318 - RNA, 22 nt, Human
gggacaauggaggccucucucc

SEQ ID NO: 152319 - RNA, 22 nt, Human
acacauacauggggaagaugag

SEQ ID NO: 152320 - RNA, 21 nt, Human
uccccacauuucuaaacagac

SEQ ID NO: 152321 - RNA, 22 nt, Human
uccugugccaucucuagagacu

SEQ ID NO: 152322 - RNA, 22 nt, Human
uuccaggcugaugggccacagg

SEQ ID NO: 152323 - RNA, 22 nt, Human
gacacauagaucuaucucacuc

SEQ ID NO: 152324 - RNA, 22 nt, Human
aggcugcuucagcugcagggag

SEQ ID NO: 152325 - RNA, 22 nt, Human
aggcacaggaggugguaagaag

SEQ ID NO: 152326 - RNA, 22 nt, Human
ucccaccccggucaagggcuga

SEQ ID NO: 152327 - RNA, 22 nt, Human
uacacauccauguuuugacuuu

SEQ ID NO: 152328 - RNA, 22 nt, Human
ccccacaccugccgggcagcag

SEQ ID NO: 152329 - RNA, 22 nt, Human
ucccagccuggacccugccagu

SEQ ID NO: 152330 - RNA, 22 nt, Human
ccuggcagcuccguggccuucc

SEQ ID NO: 152331 - RNA, 18 nt, Human
gacaaaaguacagacaga

SEQ ID NO: 152332 - RNA, 22 nt, Human
uagauacaggcucucugagccu

SEQ ID NO: 152333 - RNA, 22 nt, Human
cacacaucuuaucccaguuauu

SEQ ID NO: 152334 - RNA, 22 nt, Human
guccuggcccaggaguacacau

SEQ ID NO: 152335 - RNA, 22 nt, Human
agggcugaagggaggugcucau

SEQ ID NO: 152336 - RNA, 22 nt, Human
uccaggcuuuuucaugcugucu

SEQ ID NO: 152337 - RNA, 22 nt, Human
ggcugaguugagaggauuacuu

SEQ ID NO: 152338 - RNA, 22 nt, Human
ggagacucggguucuagccuug

SEQ ID NO: 152339 - RNA, 22 nt, Human
cuccucuggguccugguggcca

SEQ ID NO: 152340 - RNA, 22 nt, Human
ggagccugaaaagucugcauuu

SEQ ID NO: 152341 - RNA, 22 nt, Human
gaggcacagucccgaggcaagg

SEQ ID NO: 152342 - RNA, 22 nt, Human
cucucugggcccaguuggcacc

SEQ ID NO: 152343 - RNA, 22 nt, Human
ucacacagcuccuuuccuuagu

SEQ ID NO: 152344 - RNA, 22 nt, Human
acuggcagaacuggugauuguc

SEQ ID NO: 152345 - RNA, 22 nt, Human
acacucuguaaugucacacucc

SEQ ID NO: 152346 - RNA, 22 nt, Human
cuggcaggagcauucacagagg

SEQ ID NO: 152347 - RNA, 22 nt, Human
aaagaaucagaagucucaaaca

SEQ ID NO: 152348 - RNA, 22 nt, Human
cuucccacuaguaucacagagc

SEQ ID NO: 152349 - RNA, 22 nt, Human
uacacaucacuguaucuuucag

SEQ ID NO: 152350 - RNA, 22 nt, Human
gaccugccugagcugccucugc

SEQ ID NO: 152351 - RNA, 22 nt, Human
gcuggcagggugguugagagag

SEQ ID NO: 152352 - RNA, 22 nt, Human
agggcugacagugaggagucaa

SEQ ID NO: 152353 - RNA, 22 nt, Human
ggcccagcgaggccaccuacag

SEQ ID NO: 152354 - RNA, 22 nt, Human
ggggcugagucagugggaagag

SEQ ID NO: 152355 - RNA, 22 nt, Human
caggcuggagugcaauggcaca

SEQ ID NO: 152356 - RNA, 22 nt, Human
ucuggcaggaccaugaagcgua

SEQ ID NO: 152357 - RNA, 22 nt, Human
auccaggcgaaugcagaaggcc

SEQ ID NO: 152358 - RNA, 22 nt, Human
ucuccugggaggacaaggaagg

SEQ ID NO: 152359 - RNA, 17 nt, Human
ugccagccugucccagg

SEQ ID NO: 152360 - RNA, 22 nt, Human
ggagcugaaggggugggcucag

SEQ ID NO: 152361 - RNA, 22 nt, Human
cuccuggcuuucccagaccagg

SEQ ID NO: 152362 - RNA, 22 nt, Human
cccugccuugggguccacaccg

SEQ ID NO: 152363 - RNA, 22 nt, Human
agggcugacaaauggcagugac

SEQ ID NO: 152364 - RNA, 22 nt, Human
cugagagaucaagccacaggau

SEQ ID NO: 152365 - RNA, 22 nt, Human
gcugcuaagcguuucuguucca

SEQ ID NO: 152366 - RNA, 22 nt, Human
cacauaagaaaugaauaugaga

SEQ ID NO: 152367 - RNA, 22 nt, Human
ccaucacaguccccaucgugau

SEQ ID NO: 152368 - RNA, 23 nt, Human
cauccaggagcugagucugacug

SEQ ID NO: 152369 - RNA, 22 nt, Human
cccuggcagagggggcaggugc

SEQ ID NO: 152370 - RNA, 22 nt, Human
uauucccauuccacuuaucaag

SEQ ID NO: 152371 - RNA, 22 nt, Human
gcuggcagucccaucagcuggg

SEQ ID NO: 152372 - RNA, 22 nt, Human
ucuggcagcucaguucaggucu

SEQ ID NO: 152373 - RNA, 22 nt, Human
gaggagcuguucccucaccucu

SEQ ID NO: 152374 - RNA, 22 nt, Human
acacacaugguauuguucagaa

SEQ ID NO: 152375 - RNA, 22 nt, Human
auccucuguggauuacaccuag

SEQ ID NO: 152376 - RNA, 22 nt, Human
ucuggcagaaggcagaaauuca

SEQ ID NO: 152377 - RNA, 22 nt, Human
uuggaacaugccgggguccagg

SEQ ID NO: 152378 - RNA, 22 nt, Human
cugcaggacgaccgccucaucu

SEQ ID NO: 152379 - RNA, 23 nt, Human
ccuggcagcaaacgaggagguua

SEQ ID NO: 152380 - RNA, 19 nt, Human
ugccuggcaccagcuccac

SEQ ID NO: 152381 - RNA, 22 nt, Human
guccucugcccaggucaagguu

SEQ ID NO: 152382 - RNA, 23 nt, Human
uccuuccuuugagaggcuccauc

SEQ ID NO: 152383 - RNA, 19 nt, Human
ccuuccuccccagggccau

SEQ ID NO: 152384 - RNA, 22 nt, Human
cauuacaaccccaaauuacaaa

SEQ ID NO: 152385 - RNA, 22 nt, Human
ugccagccagggaagcucaccc

SEQ ID NO: 152386 - RNA, 21 nt, Human
ccagcccagcugugucccagc

SEQ ID NO: 152387 - RNA, 22 nt, Human
gcuggcagcauuagacccuggg

SEQ ID NO: 152388 - RNA, 22 nt, Human
accugccuaucagcugccugcu

SEQ ID NO: 152389 - RNA, 22 nt, Human
gcuggcagggacagcugcgugu

SEQ ID NO: 152390 - RNA, 22 nt, Human
caggauggucucgaucuccuga

SEQ ID NO: 152391 - RNA, 22 nt, Human
acacacucaauugcauaagcac

SEQ ID NO: 152392 - RNA, 22 nt, Human
ccccacccucgcuccauuucgg

SEQ ID NO: 152393 - RNA, 22 nt, Human
gacacagaaggucacauguuca

SEQ ID NO: 152394 - RNA, 22 nt, Human
agggacucccugggccgacacg

SEQ ID NO: 152395 - RNA, 22 nt, Human
ucacacauuucucaaguguagg

SEQ ID NO: 152396 - RNA, 19 nt, Human
acacauuugcacaauccac

SEQ ID NO: 152397 - RNA, 22 nt, Human
cugagcagugguucuugagcgc

SEQ ID NO: 152398 - RNA, 20 nt, Human
auacacaugcagacagaugc

SEQ ID NO: 152399 - RNA, 22 nt, Human
ucaggcccuuugcugcugcccc

SEQ ID NO: 152400 - RNA, 22 nt, Human
guccucugucccuggggcacgg

SEQ ID NO: 152401 - RNA, 22 nt, Human
ucuccacacuuucucucccagg

SEQ ID NO: 152402 - RNA, 22 nt, Human
ccugccuucagcccugaagucu

SEQ ID NO: 152403 - RNA, 22 nt, Human
gcacacaggggaguucucagaa

SEQ ID NO: 152404 - RNA, 22 nt, Human
gaaagacuuccuuugagaguac

SEQ ID NO: 152405 - RNA, 22 nt, Human
uccccacacagauacagaguag

SEQ ID NO: 152406 - RNA, 22 nt, Human
gcuggcaguuuccucaccgagg

SEQ ID NO: 152407 - RNA, 22 nt, Human
gccagguugcugacgacgaucu

SEQ ID NO: 152408 - RNA, 22 nt, Human
cagccaggauggagaacuguug

SEQ ID NO: 152409 - RNA, 22 nt, Human
cacauacauacguauguauaca

SEQ ID NO: 152410 - RNA, 22 nt, Human
agguagggaagaaggcaugaaa

SEQ ID NO: 152411 - RNA, 22 nt, Human
guccucuguuuccaucugacuu

SEQ ID NO: 152412 - RNA, 22 nt, Human
guccucuguagggcugggccac

SEQ ID NO: 152413 - RNA, 22 nt, Human
gagacacacauucuggagagaa

SEQ ID NO: 152414 - RNA, 22 nt, Human
gcuggcagacugggggcagaac

SEQ ID NO: 152415 - RNA, 22 nt, Human
uggcagagagacucuccuugau

SEQ ID NO: 152416 - RNA, 22 nt, Human
uccuggcagggucuaggucuag

SEQ ID NO: 152417 - RNA, 22 nt, Human
acaguucccgucuugcacagcu

SEQ ID NO: 152418 - RNA, 22 nt, Human
aacacauaggcagagcaugaca

SEQ ID NO: 152419 - RNA, 20 nt, Human
ucccucccuccagcucuggg

SEQ ID NO: 152420 - RNA, 22 nt, Human
cuuacaaauacacuuaggagag

SEQ ID NO: 152421 - RNA, 22 nt, Human
agaggccuccgaaaggugggcu

SEQ ID NO: 152422 - RNA, 22 nt, Human
acaauucugaugguuucccagu

SEQ ID NO: 152423 - RNA, 22 nt, Human
uccaggcaaaaaccaacuacag

SEQ ID NO: 152424 - RNA, 22 nt, Human
ucuggcaggccuugucaaucug

SEQ ID NO: 152425 - RNA, 22 nt, Human
ucaggcccuucucccaggacuc

SEQ ID NO: 152426 - RNA, 22 nt, Human
cccagccugugacagccguccu

SEQ ID NO: 152427 - RNA, 22 nt, Human
uccuggcagcccgcaggugcug

SEQ ID NO: 152428 - RNA, 22 nt, Human
ucaucacauaugucaugauuug

SEQ ID NO: 152429 - RNA, 22 nt, Human
gccgggaccaaggccacggagc

SEQ ID NO: 152430 - RNA, 22 nt, Human
agccagggucucucgcucuguu

SEQ ID NO: 152431 - RNA, 22 nt, Human
ucuggcaguuccuuguugauau

SEQ ID NO: 152432 - RNA, 22 nt, Human
uacauuccuguuagcaucuaag

SEQ ID NO: 152433 - RNA, 22 nt, Human
aggccacaguacuuugcagacc

SEQ ID NO: 152434 - RNA, 22 nt, Human
cauucccacguguucuuugcuu

SEQ ID NO: 152435 - RNA, 22 nt, Human
aggaggcugggcacaguggccu

SEQ ID NO: 152436 - RNA, 22 nt, Human
cacauacugagaaucacaccca

SEQ ID NO: 152437 - RNA, 22 nt, Human
gacacagauaucucugagauua

SEQ ID NO: 152438 - RNA, 22 nt, Human
ccagguccuguuuucaccacag

SEQ ID NO: 152439 - RNA, 20 nt, Human
gagucacagaagaagcugaa

SEQ ID NO: 152440 - RNA, 22 nt, Human
cucagccccaauucuccccauu

SEQ ID NO: 152441 - RNA, 19 nt, Human
gcuggcagaauuuugaacc

SEQ ID NO: 152442 - RNA, 22 nt, Human
aggccuccagccacaugccagu

SEQ ID NO: 152443 - RNA, 22 nt, Human
cacacagacagcucucugaaga

SEQ ID NO: 152444 - RNA, 22 nt, Human
agacacauaggaccacacugug

SEQ ID NO: 152445 - RNA, 22 nt, Human
ucuggcaggcaaucggcucugg

SEQ ID NO: 152446 - RNA, 22 nt, Human
cccagccucuguuugcuccucu

SEQ ID NO: 152447 - RNA, 20 nt, Human
cccagccccuaccuguugcc

SEQ ID NO: 152448 - RNA, 21 nt, Human
guacacacagguggaugggcu

SEQ ID NO: 152449 - RNA, 22 nt, Human
guccucuguguaggcugcagac

SEQ ID NO: 152450 - RNA, 22 nt, Human
auggcagacgaggcagcagggg

SEQ ID NO: 152451 - RNA, 22 nt, Human
cccuuccuugugacuggugggg

SEQ ID NO: 152452 - RNA, 22 nt, Human
cacacaucaaccuagacauugu

SEQ ID NO: 152453 - RNA, 22 nt, Human
guccucuggagguuuuuaggug

SEQ ID NO: 152454 - RNA, 22 nt, Human
acacacagaguuuauacaggca

SEQ ID NO: 152455 - RNA, 22 nt, Human
acacacuggcccccaguacuga

SEQ ID NO: 152456 - RNA, 22 nt, Human
uuccaggcucccuuggaggugu

SEQ ID NO: 152457 - RNA, 21 nt, Human
uccacccucucugcucccagu

SEQ ID NO: 152458 - RNA, 20 nt, Human
cccacacccuucccacuugg

SEQ ID NO: 152459 - RNA, 22 nt, Human
ucacacacauggauaguauuuu

SEQ ID NO: 152460 - RNA, 22 nt, Human
acacacuuuaaauuaaaccucu

SEQ ID NO: 152461 - RNA, 22 nt, Human
gagaaagauuguccuucagggg

SEQ ID NO: 152462 - RNA, 22 nt, Human
uccucuccaugucucacgccac

SEQ ID NO: 152463 - RNA, 22 nt, Human
ccucucagcgauuccucuugga

SEQ ID NO: 152464 - RNA, 22 nt, Human
gaugccuggcacccagcaagga

SEQ ID NO: 152465 - RNA, 22 nt, Human
ucuggcagcucuccucggcgga

SEQ ID NO: 152466 - RNA, 22 nt, Human
aggaggcugaacuagggucugg

SEQ ID NO: 152467 - RNA, 22 nt, Human
guccuggcaccucacuggcuac

SEQ ID NO: 152468 - RNA, 22 nt, Human
cccuuccucccaggcuucugug

SEQ ID NO: 152469 - RNA, 22 nt, Human
cagaaagaccugggcucaagag

SEQ ID NO: 152470 - RNA, 22 nt, Human
ccuggcagcaggugggcccgug

SEQ ID NO: 152471 - RNA, 22 nt, Human
cuccuggcaguuccccuuguca

SEQ ID NO: 152472 - RNA, 22 nt, Human
cuugggaaugcuaacagaugac

SEQ ID NO: 152473 - RNA, 22 nt, Human
acuggcagaauugaauaguugu

SEQ ID NO: 152474 - RNA, 22 nt, Human
ccagugcccagcugcccaggca

SEQ ID NO: 152475 - RNA, 18 nt, Human
gccugcucugcucucccc

SEQ ID NO: 152476 - RNA, 18 nt, Human
ccuggcagccaugcgcgc

SEQ ID NO: 152477 - RNA, 22 nt, Human
acccacaccuccguauaucacu

SEQ ID NO: 152478 - RNA, 22 nt, Human
acacagaguuugacacauggga

SEQ ID NO: 152479 - RNA, 22 nt, Human
aggcaguguguagcuggaagag

SEQ ID NO: 152480 - RNA, 22 nt, Human
acuggcagagacccugauggcc

SEQ ID NO: 152481 - RNA, 22 nt, Human
uggcagugucuuaucaggagug

SEQ ID NO: 152482 - RNA, 22 nt, Human
gaaaagaguccugugugaggag

SEQ ID NO: 152483 - RNA, 22 nt, Human
uccaaggcuccggcccuggcgu

SEQ ID NO: 152484 - RNA, 20 nt, Human
ccuggcaggcggguuacuua

SEQ ID NO: 152485 - RNA, 22 nt, Human
gggccccuugcugcucugcugg

SEQ ID NO: 152486 - RNA, 22 nt, Human
cagggacaauggcagagccuga

SEQ ID NO: 152487 - RNA, 22 nt, Human
cuggccucauagccaagcugug

SEQ ID NO: 152488 - RNA, 22 nt, Human
ucccagccuuccagucugguuu

SEQ ID NO: 152489 - RNA, 22 nt, Human
cugcaggagcaaagccucugcu

SEQ ID NO: 152490 - RNA, 22 nt, Human
acaggugguagaguggaaagag

SEQ ID NO: 152491 - RNA, 22 nt, Human
acacaucuuagacugaaauaug

SEQ ID NO: 152492 - RNA, 21 nt, Human
ccuagccucuuacccagcuuu

SEQ ID NO: 152493 - RNA, 17 nt, Human
agccugccccaugcugc

SEQ ID NO: 152494 - RNA, 22 nt, Human
ucccuccccacuucugagcuuu

SEQ ID NO: 152495 - RNA, 22 nt, Human
aguugggaguuauagacucuau

SEQ ID NO: 152496 - RNA, 22 nt, Human
gagauggccagugccaggacaa

SEQ ID NO: 152497 - RNA, 22 nt, Human
ucuggcaggauaucgaagugaa

SEQ ID NO: 152498 - RNA, 22 nt, Human
cacuguccaugcuugcuaaccc

SEQ ID NO: 152499 - RNA, 22 nt, Human
cccacccugggaagcuaggcag

SEQ ID NO: 152500 - RNA, 17 nt, Human
cccaggccgccgggagc

SEQ ID NO: 152501 - RNA, 22 nt, Human
gcuggcagagacaagaagacua

SEQ ID NO: 152502 - RNA, 22 nt, Human
cacauacaaggcacacuggagg

SEQ ID NO: 152503 - RNA, 22 nt, Human
agcacaggaccaaggaagcugu

SEQ ID NO: 152504 - RNA, 22 nt, Human
ugaccaggauacugcagggaug

SEQ ID NO: 152505 - RNA, 22 nt, Human
uugggaucucaaauccagcuau

SEQ ID NO: 152506 - RNA, 22 nt, Human
uacacagacucuucaauucaga

SEQ ID NO: 152507 - RNA, 22 nt, Human
cccagccuuccacccuggacua

SEQ ID NO: 152508 - RNA, 22 nt, Human
aagagcacuaacagagcugaua

SEQ ID NO: 152509 - RNA, 22 nt, Human
cagacagagucuucccaucagu

SEQ ID NO: 152510 - RNA, 22 nt, Human
cuggcacgcccacguaggcacu

SEQ ID NO: 152511 - RNA, 22 nt, Human
ggagcugaggcugaggccucac

SEQ ID NO: 152512 - RNA, 19 nt, Human
acuggcaguuucugcaugg

SEQ ID NO: 152513 - RNA, 19 nt, Human
cagcccucuuaccacugug

SEQ ID NO: 152514 - RNA, 22 nt, Human
uaagaacaguagaacaguaggu

SEQ ID NO: 152515 - RNA, 22 nt, Human
acaucugaggagaccagccucu

SEQ ID NO: 152516 - RNA, 22 nt, Human
ccuggcaggcaagaggaaggga

SEQ ID NO: 152517 - RNA, 22 nt, Human
gcuccaggagagggaagcagau

SEQ ID NO: 152518 - RNA, 22 nt, Human
uggaaagagguagaggaucugg

SEQ ID NO: 152519 - RNA, 22 nt, Human
aagagccagcuagugaagaggc

SEQ ID NO: 152520 - RNA, 22 nt, Human
acagguggggcacuuggagccu

SEQ ID NO: 152521 - RNA, 19 nt, Human
ccuugccugucccugcagc

SEQ ID NO: 152522 - RNA, 22 nt, Human
uuccuggcucacagcagugggg

SEQ ID NO: 152523 - RNA, 22 nt, Human
gacacuucaccuuucccagccu

SEQ ID NO: 152524 - RNA, 22 nt, Human
guugggaaggugaacaugaugc

SEQ ID NO: 152525 - RNA, 20 nt, Human
aagagucuuuacugagcuaa

SEQ ID NO: 152526 - RNA, 22 nt, Human
gguucccggaucuccgaguccc

SEQ ID NO: 152527 - RNA, 22 nt, Human
cacauacauucauguuacucua

SEQ ID NO: 152528 - RNA, 22 nt, Human
gcacacaugcaugcacaggagu

SEQ ID NO: 152529 - RNA, 22 nt, Human
cugccugcucaccagggcucug

SEQ ID NO: 152530 - RNA, 22 nt, Human
ccuccuggcuuuucccauugaa

SEQ ID NO: 152531 - RNA, 16 nt, Human
gcacacacaucaauga

SEQ ID NO: 152532 - RNA, 23 nt, Human
ugagggacaugguggcuucugag

SEQ ID NO: 152533 - RNA, 22 nt, Human
auggcagauggcuggagcaggu

SEQ ID NO: 152534 - RNA, 22 nt, Human
auggcagaccuccuggccacaa

SEQ ID NO: 152535 - RNA, 22 nt, Human
cagcccaggucucucuuccagu

SEQ ID NO: 152536 - RNA, 22 nt, Human
ccugaccuauuuuucucagcug

SEQ ID NO: 152537 - RNA, 22 nt, Human
guggcagucgcugacagauaca

SEQ ID NO: 152538 - RNA, 22 nt, Human
ugcagagagauccucaggguuu

SEQ ID NO: 152539 - RNA, 22 nt, Human
uucauugcaguucuucagguua

SEQ ID NO: 152540 - RNA, 22 nt, Human
ucuggcaguaauaggggagaga

SEQ ID NO: 152541 - RNA, 22 nt, Human
cucuccagaauaugccgccgug

SEQ ID NO: 152542 - RNA, 22 nt, Human
aaaaagucugcaaaggagguug

SEQ ID NO: 152543 - RNA, 22 nt, Human
ugcagagaagaggacaguucua

SEQ ID NO: 152544 - RNA, 22 nt, Human
uccccaccuaagauacccaucu

SEQ ID NO: 152545 - RNA, 22 nt, Human
cugccugcugcccuccagagcc

SEQ ID NO: 152546 - RNA, 21 nt, Human
acacacugaguuuuccacugu

SEQ ID NO: 152547 - RNA, 20 nt, Human
aaagagcccuuggagcaggc

SEQ ID NO: 152548 - RNA, 22 nt, Human
acacacagcgccuaccaugugc

SEQ ID NO: 152549 - RNA, 22 nt, Human
uuccuggccaagcagaguggaa

SEQ ID NO: 152550 - RNA, 22 nt, Human
ccuggcagcuccuccccggcgg

SEQ ID NO: 152551 - RNA, 22 nt, Human
cacuguccaauagauacauaau

SEQ ID NO: 152552 - RNA, 22 nt, Human
uccugagcacagagacaaggaa

SEQ ID NO: 152553 - RNA, 22 nt, Human
gcuggcagccaagugaagaggg

SEQ ID NO: 152554 - RNA, 22 nt, Human
cuuccucuagccuaguaaugcc

SEQ ID NO: 152555 - RNA, 22 nt, Human
uacaaaaguaauuacgguuuuu

SEQ ID NO: 152556 - RNA, 18 nt, Human
acacacacaccuguguau

SEQ ID NO: 152557 - RNA, 22 nt, Human
uccccacaucucugcaucaggc

SEQ ID NO: 152558 - RNA, 22 nt, Human
gcuggcaggagccuuucccuuu

SEQ ID NO: 152559 - RNA, 22 nt, Human
ccacacagauaaguguuuucua

SEQ ID NO: 152560 - RNA, 22 nt, Human
gcagggacagggcagggccuuu

SEQ ID NO: 152561 - RNA, 22 nt, Human
ucuuuuucugcacacguguccc

SEQ ID NO: 152562 - RNA, 23 nt, Human
uaaauuaccuuuccagugcaggg

SEQ ID NO: 152563 - RNA, 22 nt, Human
guggcagugaaggucauagcau

SEQ ID NO: 152564 - RNA, 22 nt, Human
ggcaaggggucaggcugagaca

SEQ ID NO: 152565 - RNA, 22 nt, Human
ucaggcccagagucacggaucc

SEQ ID NO: 152566 - RNA, 19 nt, Human
uccuggcacaguggaacca

SEQ ID NO: 152567 - RNA, 22 nt, Human
gucaggacucugacccgucccg

SEQ ID NO: 152568 - RNA, 21 nt, Human
aaagagcccgcugagagguuc

SEQ ID NO: 152569 - RNA, 22 nt, Human
uggcaguggcucagagugcaga

SEQ ID NO: 152570 - RNA, 22 nt, Human
gccuccggaguugcagugucuu

SEQ ID NO: 152571 - RNA, 22 nt, Human
gcacucuccuggcugccacagu

SEQ ID NO: 152572 - RNA, 22 nt, Human
cacauacuuguguguacauaug

SEQ ID NO: 152573 - RNA, 22 nt, Human
ggaggacaggggcugcagcaca

SEQ ID NO: 152574 - RNA, 22 nt, Human
ugaguagagaauucagcuaagg

SEQ ID NO: 152575 - RNA, 22 nt, Human
ugcagagaaaacuccuggguac

SEQ ID NO: 152576 - RNA, 22 nt, Human
aggaagaaccuaagaaagucuc

SEQ ID NO: 152577 - RNA, 22 nt, Human
ccuggcaguggugaagaagagg

SEQ ID NO: 152578 - RNA, 22 nt, Human
aggacacacagaauacaaaucc

SEQ ID NO: 152579 - RNA, 22 nt, Human
gcuccaggcagcauaguggaug

SEQ ID NO: 152580 - RNA, 22 nt, Human
uucccacagagauuacauugaa

SEQ ID NO: 152581 - RNA, 23 nt, Human
ucacauaauccuucauccacagg

SEQ ID NO: 152582 - RNA, 22 nt, Human
uccacccugcuuuugucuuuga

SEQ ID NO: 152583 - RNA, 22 nt, Human
ucccacaggaaaguagacauug

SEQ ID NO: 152584 - RNA, 22 nt, Human
ucccacaccugucuauuccuag

SEQ ID NO: 152585 - RNA, 22 nt, Human
uacugacacaaagccaaucccu

SEQ ID NO: 152586 - RNA, 22 nt, Human
auuccacagcuacaucaaucua

SEQ ID NO: 152587 - RNA, 20 nt, Human
agaggcuuccuugggaggag

SEQ ID NO: 152588 - RNA, 22 nt, Human
gcugcgccggaucccacguucc

SEQ ID NO: 152589 - RNA, 22 nt, Human
guacacacaaucucuggucagu

SEQ ID NO: 152590 - RNA, 22 nt, Human
guccucugaaguugugcaaugc

SEQ ID NO: 152591 - RNA, 22 nt, Human
ucacacaugcuaagccagagau

SEQ ID NO: 152592 - RNA, 22 nt, Human
gccuggcaauggccucaggaag

SEQ ID NO: 152593 - RNA, 21 nt, Human
uccugccuuaguccagagcag

SEQ ID NO: 152594 - RNA, 22 nt, Human
ccuggcaguuuugcccaggauu

SEQ ID NO: 152595 - RNA, 22 nt, Human
aguguggcaggaaugacuagaa

SEQ ID NO: 152596 - RNA, 22 nt, Human
aaagaucaaguaggcauggccu

SEQ ID NO: 152597 - RNA, 22 nt, Human
ugcucuguauucuauggcaguu

SEQ ID NO: 152598 - RNA, 22 nt, Human
cucaccccacuaccccuuggug

SEQ ID NO: 152599 - RNA, 22 nt, Human
ccuggcuccugccucugcaggg

SEQ ID NO: 152600 - RNA, 22 nt, Human
uuuaaauuuagaagaaacacug

SEQ ID NO: 152601 - RNA, 22 nt, Human
gaggagcugagccacguccugg

SEQ ID NO: 152602 - RNA, 22 nt, Human
gaggcugcuuugaugacaggag

SEQ ID NO: 152603 - RNA, 22 nt, Human
uccuggcagugcuuguuuugga

SEQ ID NO: 152604 - RNA, 22 nt, Human
ccuggcaguucaucaaauggca

SEQ ID NO: 152605 - RNA, 22 nt, Human
cccaggccuggucugggccagu

SEQ ID NO: 152606 - RNA, 22 nt, Human
acacaucaugccaaguuucacc

SEQ ID NO: 152607 - RNA, 22 nt, Human
cugccucuauaggaguccacca

SEQ ID NO: 152608 - RNA, 20 nt, Human
ccccacacuauugagcacuu

SEQ ID NO: 152609 - RNA, 22 nt, Human
uugggaaguuuaaugacagacu

SEQ ID NO: 152610 - RNA, 22 nt, Human
cuuggcaguuucggaaggauga

SEQ ID NO: 152611 - RNA, 22 nt, Human
ugccugccucuggcagcccugc

SEQ ID NO: 152612 - RNA, 23 nt, Human
uccaggagcaugcuggcuggcga

SEQ ID NO: 152613 - RNA, 22 nt, Human
cugccugccacguucagcugua

SEQ ID NO: 152614 - RNA, 21 nt, Human
agugccaguagguauggagga

SEQ ID NO: 152615 - RNA, 22 nt, Human
gaggcugcggggaggagccugc

SEQ ID NO: 152616 - RNA, 22 nt, Human
accugccucagugcagcuggau

SEQ ID NO: 152617 - RNA, 22 nt, Human
ggcagugagaggucuccugguc

SEQ ID NO: 152618 - RNA, 22 nt, Human
ucuugggauagugucucauggc

SEQ ID NO: 152619 - RNA, 22 nt, Human
gacacagacaguuagagguaau

SEQ ID NO: 152620 - RNA, 22 nt, Human
gccuggcaaggcccuguugacu

SEQ ID NO: 152621 - RNA, 22 nt, Human
cacaauguauauguauaucaaa

SEQ ID NO: 152622 - RNA, 22 nt, Human
gagaaagaugaagaguggcguu

SEQ ID NO: 152623 - RNA, 22 nt, Human
acuggcagagguuggacaccau

SEQ ID NO: 152624 - RNA, 19 nt, Human
uggcagguagugagcaguc

SEQ ID NO: 152625 - RNA, 22 nt, Human
uggcagagaacacggcugaucu

SEQ ID NO: 152626 - RNA, 22 nt, Human
auacacacugcuauccuuuuuu

SEQ ID NO: 152627 - RNA, 22 nt, Human
acccacacaucucuaauucagu

SEQ ID NO: 152628 - RNA, 22 nt, Human
ucccacccccuccaaggaggaa

SEQ ID NO: 152629 - RNA, 22 nt, Human
cacagagacagaagcacuuaug

SEQ ID NO: 152630 - RNA, 22 nt, Human
ccauacacacaccaaauuugua

SEQ ID NO: 152631 - RNA, 22 nt, Human
ccaccccaaaugaagaccucuc

SEQ ID NO: 152632 - RNA, 22 nt, Human
ucauggcacuuagcacaguccu

SEQ ID NO: 152633 - RNA, 22 nt, Human
aagagagagugcgcucacagaa

SEQ ID NO: 152634 - RNA, 22 nt, Human
acauaaugagcucuuuauaaau

SEQ ID NO: 152635 - RNA, 22 nt, Human
uaaguauguuagaaaaucaagu

SEQ ID NO: 152636 - RNA, 22 nt, Human
gaaggcaagcagcauaaauguc

SEQ ID NO: 152637 - RNA, 17 nt, Human
gagguaggaagugaguc

SEQ ID NO: 152638 - RNA, 22 nt, Human
cugagguagggacgugccguag

SEQ ID NO: 152639 - RNA, 22 nt, Human
aaauugcaaaaguacuuuuagg

SEQ ID NO: 152640 - RNA, 22 nt, Human
caagauauguccuguuacuaag

SEQ ID NO: 152641 - RNA, 22 nt, Human
ugaaagcucugucaucauuccu

SEQ ID NO: 152642 - RNA, 22 nt, Human
cugagguagaggaaauguagcu

SEQ ID NO: 152643 - RNA, 22 nt, Human
aaauugaauuugggaaacauug

SEQ ID NO: 152644 - RNA, 22 nt, Human
cuaagguuggcaguggaauugg

SEQ ID NO: 152645 - RNA, 22 nt, Human
augaauaaaacauuuuaaucag

SEQ ID NO: 152646 - RNA, 22 nt, Human
auuguugacuugauuacucaac

SEQ ID NO: 152647 - RNA, 22 nt, Human
uggaaauaguugugagucaggc

SEQ ID NO: 152648 - RNA, 22 nt, Human
ggaaaaugggaaccugaagcca

SEQ ID NO: 152649 - RNA, 22 nt, Human
uuccggaauggcaggguagcuc

SEQ ID NO: 152650 - RNA, 22 nt, Human
uguuaguauuggcaaauuuguu

SEQ ID NO: 152651 - RNA, 22 nt, Human
aauacagauggcaugugaagau

SEQ ID NO: 152652 - RNA, 22 nt, Human
uaaaugaaaggguuuaauuuau

SEQ ID NO: 152653 - RNA, 22 nt, Human
ugcuccaggcugcugaagaucu

SEQ ID NO: 152654 - RNA, 22 nt, Human
uaacuaggauuacaagcgugcg

SEQ ID NO: 152655 - RNA, 23 nt, Human
aguacauuugacccaaauaagcu

SEQ ID NO: 152656 - RNA, 22 nt, Human
uggaaaauauuuaggugaauga

SEQ ID NO: 152657 - RNA, 22 nt, Human
cauuguuggcagagggacagag

SEQ ID NO: 152658 - RNA, 18 nt, Human
cuacauucauaggaaagg

SEQ ID NO: 152659 - RNA, 22 nt, Human
cagugcaacguugugcauucaa

SEQ ID NO: 152660 - RNA, 22 nt, Human
cagaaagcaguugucaaugggc

SEQ ID NO: 152661 - RNA, 22 nt, Human
cucaggaaaauauugaagaagu

SEQ ID NO: 152662 - RNA, 22 nt, Human
uuuaaacuaacaguacacguug

SEQ ID NO: 152663 - RNA, 22 nt, Human
aaauacaguggcagcagauaau

SEQ ID NO: 152664 - RNA, 22 nt, Human
agaaaagaggcuuucuaagcau

SEQ ID NO: 152665 - RNA, 21 nt, Human
acagaaguggcuuggucucag

SEQ ID NO: 152666 - RNA, 22 nt, Human
aaggauuuuuggaaugagaugg

SEQ ID NO: 152667 - RNA, 22 nt, Human
auaucuaggcugaauguaaaau

SEQ ID NO: 152668 - RNA, 22 nt, Human
acauucaggccacaguggaguc

SEQ ID NO: 152669 - RNA, 22 nt, Human
ucagguagugguuaaguucugu

SEQ ID NO: 152670 - RNA, 22 nt, Human
aaguuauugguggagagcacug

SEQ ID NO: 152671 - RNA, 22 nt, Human
aaagcuauuuuauugcagcucu

SEQ ID NO: 152672 - RNA, 22 nt, Human
acagaagugacaauuucuuggg

SEQ ID NO: 152673 - RNA, 22 nt, Human
aguacaagugaugugguaaaaa

SEQ ID NO: 152674 - RNA, 22 nt, Human
aauaaguacuuggggauaacuu

SEQ ID NO: 152675 - RNA, 22 nt, Human
caaucaaugcugcuaguuccuu

SEQ ID NO: 152676 - RNA, 22 nt, Human
aaauugcauuuuaaagguagau

SEQ ID NO: 152677 - RNA, 20 nt, Human
uuacagaaaugauguuauuu

SEQ ID NO: 152678 - RNA, 22 nt, Human
aguuauugagugcagagcaggg

SEQ ID NO: 152679 - RNA, 22 nt, Human
ugggaugagcuauauagaaagu

SEQ ID NO: 152680 - RNA, 22 nt, Human
auguaguauuuggaaauguaaa

SEQ ID NO: 152681 - RNA, 22 nt, Human
uuauugagcacauaguaugugg

SEQ ID NO: 152682 - RNA, 22 nt, Eastern equine encephalitis virus
caagucacugcaaagaugcuuu

SEQ ID NO: 152683 - RNA, 22 nt, Eastern equine encephalitis virus
cgccuaggcggauuaggauccc

SEQ ID NO: 152684 - RNA, 21 nt, Eastern equine encephalitis virus
acguaguucaccucguagcgu

SEQ ID NO: 152685 - RNA, 20 nt, Eastern equine encephalitis virus
gcucucgauguauaccacau

SEQ ID NO: 152686 - RNA, 21 nt, Eastern equine encephalitis virus
uggucgcacagugucgcuggc

SEQ ID NO: 152687 - RNA, 22 nt, Eastern equine encephalitis virus
ggguuaaucggcgccauaggcg

SEQ ID NO: 152688 - RNA, 22 nt, Eastern equine encephalitis virus
augcuaauguggucaacgcugu

SEQ ID NO: 152689 - RNA, 22 nt, Eastern equine encephalitis virus
guguggauauucgguagcagca

SEQ ID NO: 152690 - RNA, 22 nt, Human
cacugaaggacaguaggaaggg

SEQ ID NO: 152691 - RNA, 22 nt, Human
agcugggaggugggcagugaga

SEQ ID NO: 152692 - RNA, 22 nt, Human
acucugcuuauugcugcaggca

SEQ ID NO: 152693 - RNA, 22 nt, Human
cuauugaaaguguacaauucaa

SEQ ID NO: 152694 - RNA, 22 nt, Human
aagcagaaaaacugagcuccaa

SEQ ID NO: 152695 - RNA, 22 nt, Human
cauuucugcagaauugcucuuc

SEQ ID NO: 152696 - RNA, 22 nt, Human
aucaguuucuaccauguggaau

SEQ ID NO: 152697 - RNA, 20 nt, Human
caggcacacucauuccugcu

SEQ ID NO: 152698 - RNA, 22 nt, Human
agugcauauaugaagaguauga

SEQ ID NO: 152699 - RNA, 21 nt, Human
aaauguguuccauaaugcuuu

SEQ ID NO: 152700 - RNA, 22 nt, Human
uggcucagccuggcccuuucau

SEQ ID NO: 152701 - RNA, 22 nt, Human
uagagcauuuagaggggcagga

SEQ ID NO: 152702 - RNA, 22 nt, Human
aggccuggcaugagaccugaga

SEQ ID NO: 152703 - RNA, 17 nt, Human
gcagugaaaagagauca

SEQ ID NO: 152704 - RNA, 22 nt, Human
cuuccucccccacacacucacu

SEQ ID NO: 152705 - RNA, 22 nt, Human
cagagccauccaggugccuguu

SEQ ID NO: 152706 - RNA, 22 nt, Human
uaugcauaauuggauaaguaga

SEQ ID NO: 152707 - RNA, 22 nt, Human
gagugcagaugaacagaagauu

SEQ ID NO: 152708 - RNA, 22 nt, Human
cagagccccccuucugaucaca

SEQ ID NO: 152709 - RNA, 22 nt, Human
agggugcauguuugcaagagug

SEQ ID NO: 152710 - RNA, 22 nt, Human
agggugccuggaagccacucac

SEQ ID NO: 152711 - RNA, 22 nt, Human
guggcucuccauugacauggaa

SEQ ID NO: 152712 - RNA, 17 nt, Human
cugaggcccagggccca

SEQ ID NO: 152713 - RNA, 22 nt, Human
gcugcccagcaggccccagggg

SEQ ID NO: 152714 - RNA, 22 nt, Human
aggcacugauucuguuuuccau

SEQ ID NO: 152715 - RNA, 22 nt, Human
gcugcagcagaaguucucagag

SEQ ID NO: 152716 - RNA, 23 nt, Human
ccugcagcugcuggggcuccacc

SEQ ID NO: 152717 - RNA, 22 nt, Human
ggagcugcuccuucagccaagu

SEQ ID NO: 152718 - RNA, 22 nt, Human
agccacagcauguguguaugua

SEQ ID NO: 152719 - RNA, 22 nt, Human
gaggggcagaaugugaucaggg

SEQ ID NO: 152720 - RNA, 22 nt, Human
cuggagccuucaccaggggaaa

SEQ ID NO: 152721 - RNA, 19 nt, Human
uggcagggagugauauuag

SEQ ID NO: 152722 - RNA, 22 nt, Human
caaauguguaaggaaguguuag

SEQ ID NO: 152723 - RNA, 22 nt, Human
gagccugggacugggggucaug

SEQ ID NO: 152724 - RNA, 22 nt, Human
accuuuuuguucuguucucagc

SEQ ID NO: 152725 - RNA, 22 nt, Human
guuauaaauaccuaauaggauu

SEQ ID NO: 152726 - RNA, 22 nt, Human
gcugucccaugguugcaagaug

SEQ ID NO: 152727 - RNA, 22 nt, Human
cagagcugucauuugccaguga

SEQ ID NO: 152728 - RNA, 22 nt, Human
ugcugccagagagacagggacu

SEQ ID NO: 152729 - RNA, 18 nt, Human
gguggcucagucaugggg

SEQ ID NO: 152730 - RNA, 22 nt, Human
gugcauuucucauacacuaaau

SEQ ID NO: 152731 - RNA, 22 nt, Human
aaucagucauuagcucugaccu

SEQ ID NO: 152732 - RNA, 22 nt, Human
uaaaugcaguacaaauuguucu

SEQ ID NO: 152733 - RNA, 22 nt, Human
ggcagcucugaugaugcucugg

SEQ ID NO: 152734 - RNA, 22 nt, Human
cucugggcaaguaugauagaaa

SEQ ID NO: 152735 - RNA, 22 nt, Human
gggaagggagggaccucagucu

SEQ ID NO: 152736 - RNA, 18 nt, Human
gcccagaggucugggccc

SEQ ID NO: 152737 - RNA, 22 nt, Human
ccugcagaccacacucaguccu

SEQ ID NO: 152738 - RNA, 22 nt, Human
cugcuuccaugcaauggcaguc

SEQ ID NO: 152739 - RNA, 22 nt, Human
gagccagccgcaagagcuguga

SEQ ID NO: 152740 - RNA, 22 nt, Human
ccuccagcgcgauccacuccgg

SEQ ID NO: 152741 - RNA, 22 nt, Human
uuuuuccuuggaugugucucuc

SEQ ID NO: 152742 - RNA, 20 nt, Human
cuggguggcaagcaaggggg

SEQ ID NO: 152743 - RNA, 22 nt, Human
ucaugcccagagcaguaaauua

SEQ ID NO: 152744 - RNA, 18 nt, Human
uuucacaaccuccagagg

SEQ ID NO: 152745 - RNA, 22 nt, Human
gggcugcugcccaggaggcacc

SEQ ID NO: 152746 - RNA, 22 nt, Human
cguguggucccggcaaggcaag

SEQ ID NO: 152747 - RNA, 22 nt, Human
ugucauuuucuaaucuguuguc

SEQ ID NO: 152748 - RNA, 22 nt, Human
ucagggcaggacaguguaggcc

SEQ ID NO: 152749 - RNA, 22 nt, Human
ucucagagauguuagggaagag

SEQ ID NO: 152750 - RNA, 22 nt, Human
uauuucuuguuauucucguuga

SEQ ID NO: 152751 - RNA, 22 nt, Human
cagugggugaugaguccugggg

SEQ ID NO: 152752 - RNA, 22 nt, Human
uucaagguaugguagcugguca

SEQ ID NO: 152753 - RNA, 22 nt, Human
ucagcuuggacagcuugguuga

SEQ ID NO: 152754 - RNA, 22 nt, Human
agcaggguauguuagagcugua

SEQ ID NO: 152755 - RNA, 22 nt, Human
cagucccagacauaguaaggga

SEQ ID NO: 152756 - RNA, 22 nt, Human
uguggcucucagauccuccaau

SEQ ID NO: 152757 - RNA, 22 nt, Human
cauguaaaacacucagaacagu

SEQ ID NO: 152758 - RNA, 22 nt, Human
cuugugcauuucauuccucagg

SEQ ID NO: 152759 - RNA, 21 nt, Human
ggcagaaguagcauggacggg

SEQ ID NO: 152760 - RNA, 22 nt, Human
gcucccuguucucagccaugau

SEQ ID NO: 152761 - RNA, 22 nt, Human
ggccagaggccauccuccugcu

SEQ ID NO: 152762 - RNA, 22 nt, Human
aacagacaacuccuguggcuca

SEQ ID NO: 152763 - RNA, 22 nt, Human
cuggggcugcagcgaucuucau

SEQ ID NO: 152764 - RNA, 22 nt, Human
ugagccugcaauaagcacagcc

SEQ ID NO: 152765 - RNA, 22 nt, Human
auguaacuguuauauuuuguug

SEQ ID NO: 152766 - RNA, 22 nt, Human
uuuuaaucaugcuucuaugucc

SEQ ID NO: 152767 - RNA, 22 nt, Human
cccugcagaccaaugccauaga

SEQ ID NO: 152768 - RNA, 23 nt, Human
uggcagugaucaaaagcuuacau

SEQ ID NO: 152769 - RNA, 22 nt, Human
uucauguaauuccauaagguaa

SEQ ID NO: 152770 - RNA, 22 nt, Human
uccugcagaccucagucagguc

SEQ ID NO: 152771 - RNA, 22 nt, Human
gcccagcacauugcugaggacc

SEQ ID NO: 152772 - RNA, 22 nt, Human
gccagccccuuagggcucuccc

SEQ ID NO: 152773 - RNA, 22 nt, Human
cccucugcaggcuggaccugcc

SEQ ID NO: 152774 - RNA, 22 nt, Human
auacuuuggggguuaguguaga

SEQ ID NO: 152775 - RNA, 22 nt, Human
uccaggaggaggaaggcugcca

SEQ ID NO: 152776 - RNA, 22 nt, Human
gaggggcuggcuguggucccau

SEQ ID NO: 152777 - RNA, 22 nt, Human
cucuguccacagguuugucccu

SEQ ID NO: 152778 - RNA, 22 nt, Human
ugccugugucacagugauguuu

SEQ ID NO: 152779 - RNA, 22 nt, Human
acugaaauacugcucuuggauu

SEQ ID NO: 152780 - RNA, 22 nt, Human
uggcaggggaggugcuugcuua

SEQ ID NO: 152781 - RNA, 22 nt, Human
cagcugcccaagccccagaugu

SEQ ID NO: 152782 - RNA, 22 nt, Human
cagggcaggaugcugugauuau

SEQ ID NO: 152783 - RNA, 22 nt, Human
gcaaagcugggugugaaugcac

SEQ ID NO: 152784 - RNA, 22 nt, Human
gcugcagcagcugcaggguugu

SEQ ID NO: 152785 - RNA, 22 nt, Human
agguacagaugaaagucuaguu

SEQ ID NO: 152786 - RNA, 22 nt, Human
agggcugggcugcuuguuguca

SEQ ID NO: 152787 - RNA, 22 nt, Human
cucuugggagugcucuggagaa

SEQ ID NO: 152788 - RNA, 22 nt, Human
gguccccagcaguggcugcuuc

SEQ ID NO: 152789 - RNA, 22 nt, Human
aggccugucuggggcucagcca

SEQ ID NO: 152790 - RNA, 22 nt, Human
gcacugaaugcuuuuacuguaa

SEQ ID NO: 152791 - RNA, 22 nt, Human
aaaaagguugauccagauuagg

SEQ ID NO: 152792 - RNA, 22 nt, Human
uaagaacauaaauucauacggg

SEQ ID NO: 152793 - RNA, 22 nt, Human
uuguuuuggaagaacuuacucu

SEQ ID NO: 152794 - RNA, 22 nt, Human
caggggccaggcugucugcugu

SEQ ID NO: 152795 - RNA, 22 nt, Human
gggacuguaaauucauauggcc

SEQ ID NO: 152796 - RNA, 22 nt, Human
uggcagaggcucugugauguug

SEQ ID NO: 152797 - RNA, 22 nt, Human
ggcugagggccagggcuagucu

SEQ ID NO: 152798 - RNA, 18 nt, Human
uggguggcuagggaguuu

SEQ ID NO: 152799 - RNA, 17 nt, Human
agaggcagauacuugga

SEQ ID NO: 152800 - RNA, 22 nt, Human
caggaacagcaccaggagcuag

SEQ ID NO: 152801 - RNA, 22 nt, Human
aucauuccacauguaccacuag

SEQ ID NO: 152802 - RNA, 22 nt, Human
uguggccuugcagccuggaggu

SEQ ID NO: 152803 - RNA, 22 nt, Human
uuucuuccuuaccuuacuagag

SEQ ID NO: 152804 - RNA, 22 nt, Human
gcuggccauagaagccaaagag

SEQ ID NO: 152805 - RNA, 22 nt, Human
ugcagcugaggccagcuaugcc

SEQ ID NO: 152806 - RNA, 22 nt, Human
cucugagagcggucuguggcuu

SEQ ID NO: 152807 - RNA, 22 nt, Human
uuaugaaagacauuucuguugg

SEQ ID NO: 152808 - RNA, 22 nt, Human
uugggcugaaguagagggcaga

SEQ ID NO: 152809 - RNA, 22 nt, Human
ugaagccaucaggaagccagca

SEQ ID NO: 152810 - RNA, 23 nt, Human
agcagccagagauccucggcccu

SEQ ID NO: 152811 - RNA, 22 nt, Human
acuuccuguguuggucuugcug

SEQ ID NO: 152812 - RNA, 22 nt, Human
acauuucuuugcuagacagcag

SEQ ID NO: 152813 - RNA, 22 nt, Human
uggcucaguaaucgagucuccu

SEQ ID NO: 152814 - RNA, 22 nt, Human
uuucuguuaggcaucauuuuaa

SEQ ID NO: 152815 - RNA, 22 nt, Human
uaggagaggugaauggcacacu

SEQ ID NO: 152816 - RNA, 22 nt, Human
gugauuccuauuaguacaugca

SEQ ID NO: 152817 - RNA, 22 nt, Human
gcaggcugauagaggauuccau

SEQ ID NO: 152818 - RNA, 22 nt, Human
gaguggggcguggauccagcgu

SEQ ID NO: 152819 - RNA, 22 nt, Human
uggcucugccacuaacuuggua

SEQ ID NO: 152820 - RNA, 22 nt, Human
ugggguggauagaaagugaugu

SEQ ID NO: 152821 - RNA, 22 nt, Human
gcagacagccagacugcacugg

SEQ ID NO: 152822 - RNA, 22 nt, Human
ggcucaggggccaggccugucc

SEQ ID NO: 152823 - RNA, 22 nt, Human
ggcucuggguucugcaaugcgu

SEQ ID NO: 152824 - RNA, 22 nt, Human
caaaguuaugaaugauaagauu

SEQ ID NO: 152825 - RNA, 22 nt, Human
gcugucagaaggugaaggguaa

SEQ ID NO: 152826 - RNA, 22 nt, Human
cuggccucaccucagacuuacu

SEQ ID NO: 152827 - RNA, 23 nt, Human
ggcugagacuacaggcgcuugcc

SEQ ID NO: 152828 - RNA, 22 nt, Human
aggcucagagagcuguguccau

SEQ ID NO: 152829 - RNA, 18 nt, Human
gaagggagcuggaaugca

SEQ ID NO: 152830 - RNA, 22 nt, Human
gcacugaaugccaaaguguagg

SEQ ID NO: 152831 - RNA, 22 nt, Human
aucuaggauuugaaugcacagu

SEQ ID NO: 152832 - RNA, 22 nt, Human
ccagagcaauucucacagaacu

SEQ ID NO: 152833 - RNA, 22 nt, Human
agccuggauccuaggcucagcu

SEQ ID NO: 152834 - RNA, 22 nt, Human
uggcuucagacuucugcuacgu

SEQ ID NO: 152835 - RNA, 22 nt, Human
gccaaagcagucuugccucugc

SEQ ID NO: 152836 - RNA, 22 nt, Human
ucagaagcauguggggagccug

SEQ ID NO: 152837 - RNA, 22 nt, Human
gcacacaguauaugcucauuaa

SEQ ID NO: 152838 - RNA, 21 nt, Human
ggcccugguuacgccuccucu

SEQ ID NO: 152839 - RNA, 22 nt, Human
caggcagcauuuacucugauga

SEQ ID NO: 152840 - RNA, 22 nt, Human
agcugggccugagcuggaagcu

SEQ ID NO: 152841 - RNA, 22 nt, Human
acacaggagauauguaauggcu

SEQ ID NO: 152842 - RNA, 22 nt, Human
uggcuaggcuccaagagcugga

SEQ ID NO: 152843 - RNA, 22 nt, Human
cuggccuagcucucugcuugaa

SEQ ID NO: 152844 - RNA, 22 nt, Human
gcugagcuagaaaaggaccaca

SEQ ID NO: 152845 - RNA, 22 nt, Human
agauacaucauuuauaccuuca

SEQ ID NO: 152846 - RNA, 22 nt, Human
agaucucaccucuguguauuau

SEQ ID NO: 152847 - RNA, 22 nt, Human
caggccucuauggucagcugag

SEQ ID NO: 152848 - RNA, 23 nt, Human
ggccuguguuuugucugaaguac

SEQ ID NO: 152849 - RNA, 22 nt, Human
ccagggugagugucauggguua

SEQ ID NO: 152850 - RNA, 22 nt, Human
gguuggggcgagcuggaggccc

SEQ ID NO: 152851 - RNA, 19 nt, Human
ucccgcccacugagcgugc

SEQ ID NO: 152852 - RNA, 22 nt, Human
augggguggaguccgggcagcg

SEQ ID NO: 152853 - RNA, 22 nt, Human
gacagacauuuccugauccaau

SEQ ID NO: 152854 - RNA, 22 nt, Human
gggagagaugcugauugccaau

SEQ ID NO: 152855 - RNA, 22 nt, Human
uguuaaucaaucaacaguauua

SEQ ID NO: 152856 - RNA, 22 nt, Human
gggacuggaguagaggccggug

SEQ ID NO: 152857 - RNA, 22 nt, Human
cugcaggggccucgagcacagg

SEQ ID NO: 152858 - RNA, 22 nt, Human
caagccucagaaucuucuccau

SEQ ID NO: 152859 - RNA, 22 nt, Human
uuuuagaaauacugauuuagug

SEQ ID NO: 152860 - RNA, 22 nt, Human
agcugccagggacugggcaugg

SEQ ID NO: 152861 - RNA, 20 nt, Human
ugugugcacacaugacauuc

SEQ ID NO: 152862 - RNA, 22 nt, Human
aggacuucaucaccuguauaaa

SEQ ID NO: 152863 - RNA, 22 nt, Human
cugggaggugcagcaaaaauca

SEQ ID NO: 152864 - RNA, 22 nt, Human
agcagcauagaagcugggagga

SEQ ID NO: 152865 - RNA, 22 nt, Human
ggcuccugaaagacuaugggaa

SEQ ID NO: 152866 - RNA, 22 nt, Human
cucacuggcaagacuacaggug

SEQ ID NO: 152867 - RNA, 22 nt, Human
uuuccucuaaacgcauuugcuu

SEQ ID NO: 152868 - RNA, 22 nt, Human
agcauuuaguuaguaaauguuu

SEQ ID NO: 152869 - RNA, 22 nt, Human
cucaggaugcaauuccaucaag

SEQ ID NO: 152870 - RNA, 22 nt, Human
aggaggccccuccuggguugcu

SEQ ID NO: 152871 - RNA, 22 nt, Human
gaugggggccagggccugcuuu

SEQ ID NO: 152872 - RNA, 22 nt, Human
cugcaggaauucaaagugagcu

SEQ ID NO: 152873 - RNA, 22 nt, Human
caaagggcucuagacucagcag

SEQ ID NO: 152874 - RNA, 22 nt, Human
cagggccaaguuggugccuuuu

SEQ ID NO: 152875 - RNA, 22 nt, Human
cugggagaugacucagagcagg

SEQ ID NO: 152876 - RNA, 22 nt, Human
acuggacagaggaaauauggag

SEQ ID NO: 152877 - RNA, 22 nt, Human
cuggggggagcugcguccagca

SEQ ID NO: 152878 - RNA, 20 nt, Human
ugucauuguuucuaggaccu

SEQ ID NO: 152879 - RNA, 20 nt, Human
ggcacuggaagcacacagga

SEQ ID NO: 152880 - RNA, 22 nt, Human
caggcagcugcuggguucagcc

SEQ ID NO: 152881 - RNA, 22 nt, Human
aacacaaagaagcugcaggauc

SEQ ID NO: 152882 - RNA, 22 nt, Human
cuguacaggugaggagggggcu

SEQ ID NO: 152883 - RNA, 22 nt, Human
ccauggcauuuuaugugucuua

SEQ ID NO: 152884 - RNA, 22 nt, Human
gggcugcugccaaucacagccu

SEQ ID NO: 152885 - RNA, 22 nt, Human
ggagauuuauagcacacuucag

SEQ ID NO: 152886 - RNA, 22 nt, Human
ucugccuucgcugcucccugaa

SEQ ID NO: 152887 - RNA, 22 nt, Human
ggggauggaauguaguagugau

SEQ ID NO: 152888 - RNA, 21 nt, Human
aaggccugcuuacugcuaguu

SEQ ID NO: 152889 - RNA, 22 nt, Human
cccagcucugcagaccugcccu

SEQ ID NO: 152890 - RNA, 17 nt, Human
agugacuuggaaagagc

SEQ ID NO: 152891 - RNA, 22 nt, Human
uauuggugggggcagagagaga

SEQ ID NO: 152892 - RNA, 22 nt, Human
aggaagccugcaggugacugcu

SEQ ID NO: 152893 - RNA, 19 nt, Human
gccugggaugggcagaacu

SEQ ID NO: 152894 - RNA, 22 nt, Human
uacuuuggauccuuacaauagc

SEQ ID NO: 152895 - RNA, 22 nt, Human
uaaaugugaccuucauuuuaua

SEQ ID NO: 152896 - RNA, 22 nt, Human
caggugggagccacagcguaca

SEQ ID NO: 152897 - RNA, 22 nt, Human
gggcuggcaucgguugcugaga

SEQ ID NO: 152898 - RNA, 22 nt, Human
ucccaaggcacagggcagggac

SEQ ID NO: 152899 - RNA, 22 nt, Human
cugcucugcagcuuggacuccc

SEQ ID NO: 152900 - RNA, 22 nt, Human
cuugucugugucggauaaaacu

SEQ ID NO: 152901 - RNA, 22 nt, Human
cuggcuucugggccagggcaga

SEQ ID NO: 152902 - RNA, 20 nt, Human
aaggcacuaugucugcuagc

SEQ ID NO: 152903 - RNA, 22 nt, Human
uugauacaggcucuauuucauc

SEQ ID NO: 152904 - RNA, 22 nt, Human
uaaauguguguagccaucugug

SEQ ID NO: 152905 - RNA, 22 nt, Human
augaagucuagcaagcauugaa

SEQ ID NO: 152906 - RNA, 22 nt, Human
ggccacuccgcugcuacuggaa

SEQ ID NO: 152907 - RNA, 19 nt, Human
ggaggccuggguauuugcc

SEQ ID NO: 152908 - RNA, 22 nt, Human
ucacuguaucauguugcacuua

SEQ ID NO: 152909 - RNA, 22 nt, Human
cagcagcuggugagacacagcc

SEQ ID NO: 152910 - RNA, 22 nt, Human
agccuggccacucagggccuga

SEQ ID NO: 152911 - RNA, 22 nt, Human
cccaggucugugccagcucuga

SEQ ID NO: 152912 - RNA, 22 nt, Human
cagagccccucagcucucuccc

SEQ ID NO: 152913 - RNA, 22 nt, Human
agccucugacugucagcaaggu

SEQ ID NO: 152914 - RNA, 22 nt, Human
agggacacaugugauuauuuau

SEQ ID NO: 152915 - RNA, 22 nt, Human
cuguuuaucuaggaguugcagg

SEQ ID NO: 152916 - RNA, 22 nt, Human
cuuuuuccagcuucaggguggg

SEQ ID NO: 152917 - RNA, 22 nt, Human
uugggcucaggaguuugagacc

SEQ ID NO: 152918 - RNA, 22 nt, Human
ugcauuucagaagaaaauucgg

SEQ ID NO: 152919 - RNA, 22 nt, Human
uccuucagcuacucaguuucca

SEQ ID NO: 152920 - RNA, 22 nt, Human
cccuccccacaaagcuucacac

SEQ ID NO: 152921 - RNA, 22 nt, Human
ggugcucaagagggcauccucu

SEQ ID NO: 152922 - RNA, 22 nt, Human
ggugaggcccagugaucugugu

SEQ ID NO: 152923 - RNA, 22 nt, Human
ggaggccaucuggcuggaggcu

SEQ ID NO: 152924 - RNA, 22 nt, Human
agaguguuucagucuuccuaga

SEQ ID NO: 152925 - RNA, 22 nt, Human
caagaaaugggauuugacugcc

SEQ ID NO: 152926 - RNA, 22 nt, Human
agggcugcaccggggcuucgcg

SEQ ID NO: 152927 - RNA, 21 nt, Human
uggagcugaauuuuuggcauc

SEQ ID NO: 152928 - RNA, 22 nt, Human
aggaagccaugguggacgucua

SEQ ID NO: 152929 - RNA, 21 nt, Human
ccucugcucgggcaugcguuu

SEQ ID NO: 152930 - RNA, 22 nt, Human
ucuggcucauacaagccugcaa

SEQ ID NO: 152931 - RNA, 22 nt, Human
agaggccagcagugccuaucug

SEQ ID NO: 152932 - RNA, 20 nt, Human
uuccagagaucugcauuuua

SEQ ID NO: 152933 - RNA, 22 nt, Human
cugcuuugaaaauaaacuuguc

SEQ ID NO: 152934 - RNA, 22 nt, Human
aucuggcucauucagggaacgg

SEQ ID NO: 152935 - RNA, 22 nt, Human
cccagggauuauaaaggugaaa

SEQ ID NO: 152936 - RNA, 22 nt, Human
uuauuuucuccucagaaagugg

SEQ ID NO: 152937 - RNA, 22 nt, Human
cuggaagggucuacuuagcaga

SEQ ID NO: 152938 - RNA, 22 nt, Human
gcucugggaacugacugccuuc

SEQ ID NO: 152939 - RNA, 22 nt, Human
agcucuggaauaaugaugugau

SEQ ID NO: 152940 - RNA, 22 nt, Human
ccccaccugugcgucugccgca

SEQ ID NO: 152941 - RNA, 22 nt, Human
uugaagcaaauucugugcagua

SEQ ID NO: 152942 - RNA, 22 nt, Human
aggaguguggccagggcucugg

SEQ ID NO: 152943 - RNA, 22 nt, Human
ccacagggugucaucagcuuga

SEQ ID NO: 152944 - RNA, 22 nt, Human
cugcagcugucucuacugggca

SEQ ID NO: 152945 - RNA, 22 nt, Human
ugggugaggaugaugaggcagc

SEQ ID NO: 152946 - RNA, 22 nt, Human
ugagaguauuuuggcauuauca

SEQ ID NO: 152947 - RNA, 22 nt, Human
ccuggagcccaaggcagugaga

SEQ ID NO: 152948 - RNA, 22 nt, Human
cuuucaaugugccugccuuggg

SEQ ID NO: 152949 - RNA, 22 nt, Human
cugaggcuuugugugcaugccu

SEQ ID NO: 152950 - RNA, 22 nt, Human
agugucauaugccacugcaucc

SEQ ID NO: 152951 - RNA, 22 nt, Human
uggaggaaaauuacuggggucu

SEQ ID NO: 152952 - RNA, 22 nt, Human
ccuggcagaauauuaaagugca

SEQ ID NO: 152953 - RNA, 22 nt, Human
uuucaagcauaacugggaagag

SEQ ID NO: 152954 - RNA, 22 nt, Human
aguauuucuaguugguucuacu

SEQ ID NO: 152955 - RNA, 22 nt, Human
uuucacauaaauauuaugccua

SEQ ID NO: 152956 - RNA, 22 nt, Human
auaaaacuuauuagaauugugu

SEQ ID NO: 152957 - RNA, 22 nt, Human
gcuugcucaacccccgucucuc

SEQ ID NO: 152958 - RNA, 22 nt, Human
ccagcuggagccaagguggacu

SEQ ID NO: 152959 - RNA, 22 nt, Human
gcagagccugugucugagcaaa

SEQ ID NO: 152960 - RNA, 22 nt, Human
caagagcauuuaguuagcuggu

SEQ ID NO: 152961 - RNA, 22 nt, Human
ccuggccuggcacucccucugc

SEQ ID NO: 152962 - RNA, 22 nt, Human
ugguccuggggaucugcaguga

SEQ ID NO: 152963 - RNA, 22 nt, Human
gguggccuuucaguggaucagg

SEQ ID NO: 152964 - RNA, 22 nt, Human
ugcaaucucggcacuuugggag

SEQ ID NO: 152965 - RNA, 22 nt, Human
guggcucucgccagccugcggg

SEQ ID NO: 152966 - RNA, 22 nt, Human
gggcuggucuggcuuagucagg

SEQ ID NO: 152967 - RNA, 22 nt, Human
aaggagagguuguccguguugu

SEQ ID NO: 152968 - RNA, 22 nt, Human
aggggccucgcaggaccgcucc

SEQ ID NO: 152969 - RNA, 22 nt, Human
ccagcugauucgguggugguug

SEQ ID NO: 152970 - RNA, 22 nt, Human
agcuuccuacaaccaucucaga

SEQ ID NO: 152971 - RNA, 22 nt, Human
cauuaucugccauugacaccau

SEQ ID NO: 152972 - RNA, 22 nt, Human
caucacugacgcugagauucca

SEQ ID NO: 152973 - RNA, 22 nt, Human
agugcacaccuuaguacaaagu

SEQ ID NO: 152974 - RNA, 22 nt, Human
caguggggaggccaggauagaa

SEQ ID NO: 152975 - RNA, 22 nt, Human
ccugcagcuguaggagaaggcg

SEQ ID NO: 152976 - RNA, 22 nt, Human
uuuccucuccggggccuccagg

SEQ ID NO: 152977 - RNA, 22 nt, Human
caggccugugacaccgugucug

SEQ ID NO: 152978 - RNA, 21 nt, Human
aagagcugucaggaaggcugc

SEQ ID NO: 152979 - RNA, 22 nt, Human
cuggcagcgugagcagcaucca

SEQ ID NO: 152980 - RNA, 22 nt, Human
agagcagcacguuguccccaca

SEQ ID NO: 152981 - RNA, 22 nt, Human
ggggagaguccuuuccaguucc

SEQ ID NO: 152982 - RNA, 22 nt, Human
aacuucuugguccugagcuguu

SEQ ID NO: 152983 - RNA, 22 nt, Human
ucucuuuuauguacacccugac

SEQ ID NO: 152984 - RNA, 22 nt, Human
auaacagagagcuacugaacug

SEQ ID NO: 152985 - RNA, 22 nt, Human
accaucagagcacaguccgugc

SEQ ID NO: 152986 - RNA, 22 nt, Human
ugccuggaugugcuggccucac

SEQ ID NO: 152987 - RNA, 22 nt, Human
cuugugcaauugacauugaauc

SEQ ID NO: 152988 - RNA, 22 nt, Human
ggaggaccugcuggcccugcaa

SEQ ID NO: 152989 - RNA, 22 nt, Human
ugggcugccagcucuccagaug

SEQ ID NO: 152990 - RNA, 22 nt, Human
aaucuggcauguaagcuuagag

SEQ ID NO: 152991 - RNA, 22 nt, Human
cgccugggaguccacaccugcu

SEQ ID NO: 152992 - RNA, 22 nt, Human
ucagcugagcuccagcucauag

SEQ ID NO: 152993 - RNA, 17 nt, Human
ggcugcugugcuggugc

SEQ ID NO: 152994 - RNA, 20 nt, Human
ggcugccuccuuccuuuccu

SEQ ID NO: 152995 - RNA, 21 nt, Human
uccauaagagaccaucuccua

SEQ ID NO: 152996 - RNA, 22 nt, Human
ucucagaggugcccuggcaucu

SEQ ID NO: 152997 - RNA, 22 nt, Human
cucugcagaauuugagcugcuc

SEQ ID NO: 152998 - RNA, 22 nt, Human
cuggagccacuuuuuauccuuu

SEQ ID NO: 152999 - RNA, 22 nt, Human
gccccugggagcagagccacca

SEQ ID NO: 153000 - RNA, 22 nt, Human
uggccugccuucgcugagcuga

SEQ ID NO: 153001 - RNA, 22 nt, Human
uguccucuaauuggccucuugc

SEQ ID NO: 153002 - RNA, 22 nt, Human
uuuuagauugggaaauguaaag

SEQ ID NO: 153003 - RNA, 22 nt, Human
cccaaggcauggcaugguggca

SEQ ID NO: 153004 - RNA, 22 nt, Human
gggcuaggcuuggccagcacug

SEQ ID NO: 153005 - RNA, 22 nt, Human
gggauggggggaagcguccaug

SEQ ID NO: 153006 - RNA, 22 nt, Human
ggagcugggacccugucaucug

SEQ ID NO: 153007 - RNA, 22 nt, Human
agggaaauuaaugugagcaaug

SEQ ID NO: 153008 - RNA, 22 nt, Human
ccagcucugccaagcgucagcu

SEQ ID NO: 153009 - RNA, 22 nt, Human
cagggugacugcccuggccacu

SEQ ID NO: 153010 - RNA, 23 nt, Human
ggcuggcccggggcugcuccuga

SEQ ID NO: 153011 - RNA, 22 nt, Human
gccuuuuuuguugcucugucac

SEQ ID NO: 153012 - RNA, 22 nt, Human
uggagggcaugcuguccauggg

SEQ ID NO: 153013 - RNA, 22 nt, Human
cuggugguucaggagaauggcu

SEQ ID NO: 153014 - RNA, 22 nt, Human
ccaggcugggcuacaaguugag

SEQ ID NO: 153015 - RNA, 22 nt, Human
cagaguguugaccauaagccca

SEQ ID NO: 153016 - RNA, 22 nt, Human
gcugcucuugaggggcucacug

SEQ ID NO: 153017 - RNA, 22 nt, Human
agaggccacuuugccugugaug

SEQ ID NO: 153018 - RNA, 22 nt, Human
aaugggaggauuuucucucuug

SEQ ID NO: 153019 - RNA, 22 nt, Human
guggcuucuggcugggccucag

SEQ ID NO: 153020 - RNA, 22 nt, Human
gaaggagggugcggaucugagc

SEQ ID NO: 153021 - RNA, 22 nt, Human
cauagcaacagcaucaagucaa

SEQ ID NO: 153022 - RNA, 22 nt, Human
cucuggaauuaaggaagccugu

SEQ ID NO: 153023 - RNA, 22 nt, Human
cucuggagcgcugcuucccgcg

SEQ ID NO: 153024 - RNA, 19 nt, Human
aagaagcaauaagcuguga

SEQ ID NO: 153025 - RNA, 22 nt, Human
agccacaccuguccugccagcu

SEQ ID NO: 153026 - RNA, 22 nt, Human
aacaugaaguuuucuauaguga

SEQ ID NO: 153027 - RNA, 22 nt, Human
caaaugcauagaaagaugaaac

SEQ ID NO: 153028 - RNA, 22 nt, Human
ugucagugaguuaguugcaagu

SEQ ID NO: 153029 - RNA, 22 nt, Human
agcacuuuccuggcaaaugugg

SEQ ID NO: 153030 - RNA, 22 nt, Human
ucaguggagcuaagcaugagau

SEQ ID NO: 153031 - RNA, 22 nt, Human
uaaguucauuagacuacagaua

SEQ ID NO: 153032 - RNA, 17 nt, Human
gcagcagagagacccuc

SEQ ID NO: 153033 - RNA, 22 nt, Human
agcuggggcugcagagaacagg

SEQ ID NO: 153034 - RNA, 22 nt, Human
uuucacaaguaaaguccuaagu

SEQ ID NO: 153035 - RNA, 22 nt, Human
uauaagaaacaaggcaaauuuu

SEQ ID NO: 153036 - RNA, 22 nt, Human
agggccagggaagcuguauuuu

SEQ ID NO: 153037 - RNA, 22 nt, Human
ccaggguggaggcuggauggag

SEQ ID NO: 153038 - RNA, 22 nt, Human
ccugaagcaaggguaggcaggu

SEQ ID NO: 153039 - RNA, 19 nt, Human
uggccagguacugucugcu

SEQ ID NO: 153040 - RNA, 22 nt, Human
caaagugcugagauuacaggua

SEQ ID NO: 153041 - RNA, 22 nt, Human
gcagaggcaaucagguaugugg

SEQ ID NO: 153042 - RNA, 22 nt, Human
cugcuccacaccuccauuuccu

SEQ ID NO: 153043 - RNA, 22 nt, Human
agauacauuaguaguuacuugu

SEQ ID NO: 153044 - RNA, 22 nt, Human
cuggccuggggccucagcugcu

SEQ ID NO: 153045 - RNA, 22 nt, Human
gagaagccgagucagcugagcc

SEQ ID NO: 153046 - RNA, 22 nt, Human
gaugcacuugccccuccucaga

SEQ ID NO: 153047 - RNA, 22 nt, Human
gggcagcugcagggauggugac

SEQ ID NO: 153048 - RNA, 22 nt, Human
uugcuauuuugagagucauagu

SEQ ID NO: 153049 - RNA, 23 nt, Human
gcagauggccccagagugcugcc

SEQ ID NO: 153050 - RNA, 22 nt, Human
cuggguggcgucuggggccagu

SEQ ID NO: 153051 - RNA, 22 nt, Human
cacugaaggcugcagcucagcc

SEQ ID NO: 153052 - RNA, 22 nt, Human
ugaggccacuuccccacagccc

SEQ ID NO: 153053 - RNA, 22 nt, Human
caaugugucaggaaaagggcca

SEQ ID NO: 153054 - RNA, 22 nt, Human
gccuggagaccugcuccucuac

SEQ ID NO: 153055 - RNA, 22 nt, Human
uauuucugggaguucagaaauu

SEQ ID NO: 153056 - RNA, 22 nt, Human
ccagacuguggaguuccuggug

SEQ ID NO: 153057 - RNA, 22 nt, Human
aagcugccuuccaugugaggaa

SEQ ID NO: 153058 - RNA, 22 nt, Human
acaguaaugauucugagucucu

SEQ ID NO: 153059 - RNA, 23 nt, Human
ccugggcauuggcugcagcuucu

SEQ ID NO: 153060 - RNA, 22 nt, Human
aauuccugucuuaacaguucug

SEQ ID NO: 153061 - RNA, 22 nt, Human
agggggcaucagguccuggcuc

SEQ ID NO: 153062 - RNA, 20 nt, Human
cuuuggcaaugagaacaggg

SEQ ID NO: 153063 - RNA, 19 nt, Human
aggacucuggaggcaugag

SEQ ID NO: 153064 - RNA, 22 nt, Human
aagaacagguucuagaaccauu

SEQ ID NO: 153065 - RNA, 22 nt, Human
acacagggcaaugcuuugaccu

SEQ ID NO: 153066 - RNA, 22 nt, Human
cagcugugcuguauuaagcucu

SEQ ID NO: 153067 - RNA, 22 nt, Human
agcagaaccacagcacuguuga

SEQ ID NO: 153068 - RNA, 22 nt, Human
uguggcucucaugcacucccag

SEQ ID NO: 153069 - RNA, 22 nt, Human
ccagggccaguaagauuggcau

SEQ ID NO: 153070 - RNA, 22 nt, Human
aaaaucugguaauuugaaugug

SEQ ID NO: 153071 - RNA, 19 nt, Human
cugaggugcaguaagaggc

SEQ ID NO: 153072 - RNA, 22 nt, Human
ugaagacagaccaaggagaaug

SEQ ID NO: 153073 - RNA, 22 nt, Human
cagcaugcaaguccagaugugg

SEQ ID NO: 153074 - RNA, 22 nt, Human
gugcagugaaaaaagaaugucc

SEQ ID NO: 153075 - RNA, 22 nt, Human
aaaguuugagugauuugacaca

SEQ ID NO: 153076 - RNA, 22 nt, Human
uccugcaggccuguucccagua

SEQ ID NO: 153077 - RNA, 22 nt, Human
ucucaagagggaggcaaucaug

SEQ ID NO: 153078 - RNA, 22 nt, Human
acaggcagggaccuuggcuaag

SEQ ID NO: 153079 - RNA, 22 nt, Human
cugccgaguacagccauagaaa

SEQ ID NO: 153080 - RNA, 22 nt, Human
ugagcuuacuucuguacacaga

SEQ ID NO: 153081 - RNA, 22 nt, Human
ggcacugagaacaggcugacuu

SEQ ID NO: 153082 - RNA, 22 nt, Human
cccuggugguacggcacuggca

SEQ ID NO: 153083 - RNA, 22 nt, Human
accuuucaaaguggcuaucacu

SEQ ID NO: 153084 - RNA, 22 nt, Human
augucacagucugacucaguga

SEQ ID NO: 153085 - RNA, 22 nt, Human
cagcaucaccgccauuucugau

SEQ ID NO: 153086 - RNA, 22 nt, Human
gccucugcucucagguagccuc

SEQ ID NO: 153087 - RNA, 23 nt, Human
ggccauggagacuuagaaugggc

SEQ ID NO: 153088 - RNA, 22 nt, Human
cugagaggaugcugcaguggag

SEQ ID NO: 153089 - RNA, 19 nt, Human
gccacuccugaugcugccc

SEQ ID NO: 153090 - RNA, 22 nt, Human
cagggacaugacuggucucugu

SEQ ID NO: 153091 - RNA, 22 nt, Human
ggccccuggcaccaggcugauu

SEQ ID NO: 153092 - RNA, 22 nt, Human
agacaaagaaaccguagaagca

SEQ ID NO: 153093 - RNA, 22 nt, Human
aguguacauguuuacagcaucu

SEQ ID NO: 153094 - RNA, 22 nt, Human
acugcuuacaaaaggaaagaau

SEQ ID NO: 153095 - RNA, 22 nt, Human
agaacagcagcacgucaagcug

SEQ ID NO: 153096 - RNA, 22 nt, Human
aaggguggauuucugagcucua

SEQ ID NO: 153097 - RNA, 22 nt, Human
aaggcugaguaaaacagagaac

SEQ ID NO: 153098 - RNA, 22 nt, Human
ggccucuguuuggagccaggau

SEQ ID NO: 153099 - RNA, 22 nt, Human
gcccugagacugagcauggguu

SEQ ID NO: 153100 - RNA, 22 nt, Human
agugcagugguuaggagccagg

SEQ ID NO: 153101 - RNA, 21 nt, Human
ucucugggaggacuugugaga

SEQ ID NO: 153102 - RNA, 18 nt, Human
cuuucagauggauaugcu

SEQ ID NO: 153103 - RNA, 21 nt, Human
ccagcuccaggaccuuggauc

SEQ ID NO: 153104 - RNA, 23 nt, Human
gagugcagaauagacaugcagug

SEQ ID NO: 153105 - RNA, 18 nt, Human
uugagggaggggcagagu

SEQ ID NO: 153106 - RNA, 22 nt, Human
uuugcauuuccagaguagcaga

SEQ ID NO: 153107 - RNA, 22 nt, Human
gugcaggggaucagguugcagc

SEQ ID NO: 153108 - RNA, 22 nt, Human
uggcagucggacuucuaucuca

SEQ ID NO: 153109 - RNA, 22 nt, Human
gcaggagcuggaaagugauguu

SEQ ID NO: 153110 - RNA, 17 nt, Human
agcagaagucagaggga

SEQ ID NO: 153111 - RNA, 22 nt, Human
agcaagcuaccuagauagucua

SEQ ID NO: 153112 - RNA, 22 nt, Human
ccacagggcacagacaggaagc

SEQ ID NO: 153113 - RNA, 21 nt, Human
ccugggagaucagcugccuuc

SEQ ID NO: 153114 - RNA, 22 nt, Human
agccuggaguucccaggagaag

SEQ ID NO: 153115 - RNA, 22 nt, Human
ugcccugcagugagugcgucug

SEQ ID NO: 153116 - RNA, 22 nt, Human
agcaauaugacauugcuacauc

SEQ ID NO: 153117 - RNA, 22 nt, Human
uuucuucucacccaggacagag

SEQ ID NO: 153118 - RNA, 22 nt, Human
agggcugcaggcaagauauggc

SEQ ID NO: 153119 - RNA, 22 nt, Human
gcauguguggaggagaugugcu

SEQ ID NO: 153120 - RNA, 22 nt, Human
aagacccacaaggcugaauguu

SEQ ID NO: 153121 - RNA, 21 nt, Human
aucagcaaaugccugucuccc

SEQ ID NO: 153122 - RNA, 22 nt, Human
caguacuugggaaugcugggga

SEQ ID NO: 153123 - RNA, 22 nt, Human
cuucagaggggacucaaaguca

SEQ ID NO: 153124 - RNA, 22 nt, Human
agagcuguagcuuccuagagcc

SEQ ID NO: 153125 - RNA, 22 nt, Human
cacagggcagugauuguccaca

SEQ ID NO: 153126 - RNA, 22 nt, Human
caaagccucugauuucacuugu

SEQ ID NO: 153127 - RNA, 22 nt, Human
gcagauggacuguaugaccuga

SEQ ID NO: 153128 - RNA, 22 nt, Human
ccucccuggccagagcagcagc

SEQ ID NO: 153129 - RNA, 22 nt, Human
agccaaagaucagugugcaagu

SEQ ID NO: 153130 - RNA, 22 nt, Human
agggucuguggaugcaucuggg

SEQ ID NO: 153131 - RNA, 22 nt, Human
uggccuggugucugcgaggccu

SEQ ID NO: 153132 - RNA, 22 nt, Human
uuucagaugcaauuaauuuuca

SEQ ID NO: 153133 - RNA, 22 nt, Human
agagcugcaauuucauguggug

SEQ ID NO: 153134 - RNA, 22 nt, Human
cagaaaaccugacucuagaacu

SEQ ID NO: 153135 - RNA, 22 nt, Human
gcugcuuccuuuccugcugacc

SEQ ID NO: 153136 - RNA, 22 nt, Human
gaaugcacuuccaacaucuauu

SEQ ID NO: 153137 - RNA, 22 nt, Human
cuggcaggaagaggaaagguca

SEQ ID NO: 153138 - RNA, 22 nt, Human
gcacccaggccggcgacugcag

SEQ ID NO: 153139 - RNA, 22 nt, Human
ucugucacccgagcaggcgaga

SEQ ID NO: 153140 - RNA, 22 nt, Human
uggagccauaacccuuucguac

SEQ ID NO: 153141 - RNA, 22 nt, Human
caguguacuuggaauguaacag

SEQ ID NO: 153142 - RNA, 20 nt, Human
ucaggcaguggggaaaggca

SEQ ID NO: 153143 - RNA, 22 nt, Human
aggcugcaggucugggucaugu

SEQ ID NO: 153144 - RNA, 22 nt, Human
ugggccacuugaaaguggaugu

SEQ ID NO: 153145 - RNA, 22 nt, Human
agaagccauguuuaguaggaug

SEQ ID NO: 153146 - RNA, 18 nt, Human
aucucccauuggccaagg

SEQ ID NO: 153147 - RNA, 22 nt, Human
gcucaggagcugacagccucaa

SEQ ID NO: 153148 - RNA, 22 nt, Human
gcuggagcugaguucccugggc

SEQ ID NO: 153149 - RNA, 22 nt, Human
gauuucaauccagcuuucuucu

SEQ ID NO: 153150 - RNA, 22 nt, Human
gggcuccaacggugagcaugga

SEQ ID NO: 153151 - RNA, 22 nt, Human
caaugugugcuuacaggccagu

SEQ ID NO: 153152 - RNA, 22 nt, Human
aaaaucaguacacuuuauuuug

SEQ ID NO: 153153 - RNA, 22 nt, Human
acagagcuucccagccugagca

SEQ ID NO: 153154 - RNA, 22 nt, Human
ugggccagcaauugcugcucag

SEQ ID NO: 153155 - RNA, 22 nt, Human
aauguguguauuucuaggcgag

SEQ ID NO: 153156 - RNA, 21 nt, Human
gcagcuggucucagagcuugc

SEQ ID NO: 153157 - RNA, 22 nt, Human
ucagggacuuacaaaccagaag

SEQ ID NO: 153158 - RNA, 19 nt, Human
ucuggcuccgccucuuagu

SEQ ID NO: 153159 - RNA, 22 nt, Human
agguauagaauugaaaggguuu

SEQ ID NO: 153160 - RNA, 22 nt, Human
ucuguggccuguguccaagugc

SEQ ID NO: 153161 - RNA, 19 nt, Human
cugucaggggcuggauguu

SEQ ID NO: 153162 - RNA, 19 nt, Human
cugagagaugcuucacaca

SEQ ID NO: 153163 - RNA, 22 nt, Human
gccagccugugggggcucugug

SEQ ID NO: 153164 - RNA, 22 nt, Human
ccugggagguggagguugcagc

SEQ ID NO: 153165 - RNA, 22 nt, Human
agccuggagaagauguguauug

SEQ ID NO: 153166 - RNA, 22 nt, Human
uccucagacuucccuuugugua

SEQ ID NO: 153167 - RNA, 22 nt, Human
uuuauguaguuacggacuauca

SEQ ID NO: 153168 - RNA, 22 nt, Human
guggcugcuguccucucugguu

SEQ ID NO: 153169 - RNA, 17 nt, Human
cucugcagugcauggcu

SEQ ID NO: 153170 - RNA, 22 nt, Human
cccccagccagcagugcucagc

SEQ ID NO: 153171 - RNA, 22 nt, Human
agcaggagagcagugcgugguc

SEQ ID NO: 153172 - RNA, 22 nt, Human
uuaugacauaugaguacaagua

SEQ ID NO: 153173 - RNA, 22 nt, Human
aggagcugucagagugccagag

SEQ ID NO: 153174 - RNA, 22 nt, Human
ugggagagugcucaaugugcaa

SEQ ID NO: 153175 - RNA, 22 nt, Human
cugaagcacagcauauaaauaa

SEQ ID NO: 153176 - RNA, 21 nt, Human
cugcucugacagugaggccag

SEQ ID NO: 153177 - RNA, 22 nt, Human
cuggagcuccagggucuccucu

SEQ ID NO: 153178 - RNA, 22 nt, Human
gagagugauucccucccauaga

SEQ ID NO: 153179 - RNA, 19 nt, Human
uggcugggugccaauggcc

SEQ ID NO: 153180 - RNA, 19 nt, Human
aauguaguguuaugucaac

SEQ ID NO: 153181 - RNA, 22 nt, Human
aggcucagcccaagguggagag

SEQ ID NO: 153182 - RNA, 17 nt, Human
uguuccauuugaccacc

SEQ ID NO: 153183 - RNA, 21 nt, Human
cagggcacacagaggauggua

SEQ ID NO: 153184 - RNA, 22 nt, Human
gugcuuucugcaugguuccuac

SEQ ID NO: 153185 - RNA, 22 nt, Human
cucugaagggagggccaagccc

SEQ ID NO: 153186 - RNA, 22 nt, Human
ccagggcauguccaagacuuag

SEQ ID NO: 153187 - RNA, 22 nt, Human
ccacacugaaccucagugucuu

SEQ ID NO: 153188 - RNA, 22 nt, Human
caggggcugugggcggagccuc

SEQ ID NO: 153189 - RNA, 22 nt, Human
gggugggaucuguggagccuca

SEQ ID NO: 153190 - RNA, 22 nt, Human
ggaggccaggguggguggaucg

SEQ ID NO: 153191 - RNA, 22 nt, Human
uucaagucaaggaaagaggucu

SEQ ID NO: 153192 - RNA, 23 nt, Human
gacagagugagaccuugucuuac

SEQ ID NO: 153193 - RNA, 22 nt, Human
cugaggucucuuuccauaguga

SEQ ID NO: 153194 - RNA, 22 nt, Human
ucccagcgcggggggaggaucc

SEQ ID NO: 153195 - RNA, 22 nt, Human
aagauuucugcuuuuggaggca

SEQ ID NO: 153196 - RNA, 20 nt, Human
uccugagauuuaagggguuc

SEQ ID NO: 153197 - RNA, 22 nt, Human
cucuguccuugcacaguuccua

SEQ ID NO: 153198 - RNA, 22 nt, Human
ucagaacauuuaaaaagugguu

SEQ ID NO: 153199 - RNA, 22 nt, Human
acaaaguuauucuuucagagga

SEQ ID NO: 153200 - RNA, 22 nt, Human
caagagcucagaaacccuugcu

SEQ ID NO: 153201 - RNA, 22 nt, Human
acccaggagguggaggcugcag

SEQ ID NO: 153202 - RNA, 22 nt, Human
augcacagacccaaaggccauc

SEQ ID NO: 153203 - RNA, 22 nt, Human
uggcagaaguucacuaguagcu

SEQ ID NO: 153204 - RNA, 22 nt, Human
aaaugcuugcucuugauuauuu

SEQ ID NO: 153205 - RNA, 22 nt, Human
ccagcccugccagagagagcug

SEQ ID NO: 153206 - RNA, 22 nt, Human
gccugggagggcagcagugugg

SEQ ID NO: 153207 - RNA, 22 nt, Human
ucagaaauacuaucagcuuuug

SEQ ID NO: 153208 - RNA, 22 nt, Human
acuccagggcuccaucccuugu

SEQ ID NO: 153209 - RNA, 22 nt, Human
gugauuucaaauauagagugag

SEQ ID NO: 153210 - RNA, 22 nt, Human
ugcuucucccaaccagggccug

SEQ ID NO: 153211 - RNA, 22 nt, Human
uuuucauuuacauuagggaaga

SEQ ID NO: 153212 - RNA, 19 nt, Human
acuuugcaugugugucuaa

SEQ ID NO: 153213 - RNA, 22 nt, Human
accagcuguguccuggcugcag

SEQ ID NO: 153214 - RNA, 22 nt, Human
uauacuuuccugcaacuuugau

SEQ ID NO: 153215 - RNA, 22 nt, Human
ggccugccucacagucagcacc

SEQ ID NO: 153216 - RNA, 22 nt, Human
gaagccaacauuccaaguagaa

SEQ ID NO: 153217 - RNA, 22 nt, Human
auucugucuuuuuaaaauaaua

SEQ ID NO: 153218 - RNA, 22 nt, Human
caggcuggaguuaccuuuaggg

SEQ ID NO: 153219 - RNA, 22 nt, Human
gagagucacugucugcauuucc

SEQ ID NO: 153220 - RNA, 22 nt, Human
agaaaucucaguaucucaggga

SEQ ID NO: 153221 - RNA, 22 nt, Human
gaaaucugaacaacagcuguca

SEQ ID NO: 153222 - RNA, 22 nt, Human
uagacacaagagaaggguauaa

SEQ ID NO: 153223 - RNA, 22 nt, Human
gagggcugaagauuguggcccc

SEQ ID NO: 153224 - RNA, 22 nt, Human
cuggccugaggucggcuguagg

SEQ ID NO: 153225 - RNA, 22 nt, Human
agucucagcuacuugggaggcu

SEQ ID NO: 153226 - RNA, 22 nt, Human
ggaaggagggcggcaaugauga

SEQ ID NO: 153227 - RNA, 22 nt, Human
gagagugaggccugggaaucua

SEQ ID NO: 153228 - RNA, 23 nt, Human
aguuuguaaagaaauauuugcac

SEQ ID NO: 153229 - RNA, 22 nt, Human
ggaaagagcccagcagugcuug

SEQ ID NO: 153230 - RNA, 23 nt, Human
agcagccauagggaagcaauaca

SEQ ID NO: 153231 - RNA, 22 nt, Human
uagcugccauugcuccaggaag

SEQ ID NO: 153232 - RNA, 22 nt, Human
uguacaugugucuguauaucuu

SEQ ID NO: 153233 - RNA, 22 nt, Human
agccucugauggcucccaagga

SEQ ID NO: 153234 - RNA, 20 nt, Human
uccuggccuucucgggcagu

SEQ ID NO: 153235 - RNA, 22 nt, Human
ugccucuguggaaauggugguc

SEQ ID NO: 153236 - RNA, 22 nt, Human
gaggcagagucacaaagagucu

SEQ ID NO: 153237 - RNA, 22 nt, Human
gagagcugggggacuguggaug

SEQ ID NO: 153238 - RNA, 22 nt, Human
agggccuggaacugugggcagg

SEQ ID NO: 153239 - RNA, 22 nt, Human
ugugaaaggagccauagacagu

SEQ ID NO: 153240 - RNA, 22 nt, Human
guggccuggaaaggcuggucug

SEQ ID NO: 153241 - RNA, 23 nt, Human
aaccagauaaauggcuccagggc

SEQ ID NO: 153242 - RNA, 22 nt, Human
cugucccaggagcuguaagaca

SEQ ID NO: 153243 - RNA, 22 nt, Human
gaggccuggugugucucccgcu

SEQ ID NO: 153244 - RNA, 22 nt, Human
ccugaggggcugcaggccagcu

SEQ ID NO: 153245 - RNA, 22 nt, Human
caggcagcugggucaccguccc

SEQ ID NO: 153246 - RNA, 22 nt, Human
cggcagcaaaggaagccagguc

SEQ ID NO: 153247 - RNA, 22 nt, Human
agcaggugacccaagcaggcug

SEQ ID NO: 153248 - RNA, 23 nt, Human
uuuuaauuuggacauaagaagau

SEQ ID NO: 153249 - RNA, 22 nt, Human
ccuggagcacauggcaggaggc

SEQ ID NO: 153250 - RNA, 20 nt, Human
gcugcucuccacggucugca

SEQ ID NO: 153251 - RNA, 22 nt, Human
uggcagagcaaaaagauagaau

SEQ ID NO: 153252 - RNA, 21 nt, Human
auccauccaucuuggccuaac

SEQ ID NO: 153253 - RNA, 22 nt, Human
aucagcaagauugugucuugua

SEQ ID NO: 153254 - RNA, 22 nt, Human
uccacagaauguaagauccaca

SEQ ID NO: 153255 - RNA, 22 nt, Human
cuuuauguccuugaagaguugu

SEQ ID NO: 153256 - RNA, 22 nt, Human
gugucaugggagucagaaguga

SEQ ID NO: 153257 - RNA, 22 nt, Human
gaaaaaugcuccaaaucugugg

SEQ ID NO: 153258 - RNA, 18 nt, Human
gggaucaggcugccuagg

SEQ ID NO: 153259 - RNA, 22 nt, Human
cuguuuauacgacagguggagg

SEQ ID NO: 153260 - RNA, 22 nt, Human
agcagccaaccuuacauucauc

SEQ ID NO: 153261 - RNA, 22 nt, Human
aggaagcucggagagggcaaau

SEQ ID NO: 153262 - RNA, 22 nt, Human
gcagcguggggacaggagcuca

SEQ ID NO: 153263 - RNA, 22 nt, Human
uggcucuggggacaguaagucc

SEQ ID NO: 153264 - RNA, 22 nt, Human
agagcccuuucuccaggcaccu

SEQ ID NO: 153265 - RNA, 22 nt, Human
acagcuuuucaauucugcugag

SEQ ID NO: 153266 - RNA, 22 nt, Human
acuuccuggcguagcugacauu

SEQ ID NO: 153267 - RNA, 22 nt, Human
gcucugaggcugggagcacucu

SEQ ID NO: 153268 - RNA, 22 nt, Human
caggaggaaaugugacccugcu

SEQ ID NO: 153269 - RNA, 21 nt, Human
ugagagccuccaaccggcuac

SEQ ID NO: 153270 - RNA, 22 nt, Human
ucccugggccuccugcuaugca

SEQ ID NO: 153271 - RNA, 22 nt, Human
ccaucagcuccaguaucuucug

SEQ ID NO: 153272 - RNA, 22 nt, Human
gcucaggauuucauccaugugu

SEQ ID NO: 153273 - RNA, 22 nt, Human
gugucauuaaccaccaugcaaa

SEQ ID NO: 153274 - RNA, 22 nt, Human
cugccucucagccugaccgcca

SEQ ID NO: 153275 - RNA, 22 nt, Human
gaaggcugaugacagauucugc

SEQ ID NO: 153276 - RNA, 22 nt, Human
aggugaguugguaggaaguuug

SEQ ID NO: 153277 - RNA, 22 nt, Human
gagcagaacuacucacauaucg

SEQ ID NO: 153278 - RNA, 20 nt, Human
cuaucuccuggcgugccuuc

SEQ ID NO: 153279 - RNA, 22 nt, Human
agggccuggcgcguggccgccg

SEQ ID NO: 153280 - RNA, 22 nt, Human
ccuggccucagacagagggugg

SEQ ID NO: 153281 - RNA, 22 nt, Human
caggugccgggaaugcagcaau

SEQ ID NO: 153282 - RNA, 22 nt, Human
acccagaggugucuagcaagcu

SEQ ID NO: 153283 - RNA, 22 nt, Human
gcaggaguguauuugcauguaa

SEQ ID NO: 153284 - RNA, 22 nt, Human
ucaagagaagugcuccacagua

SEQ ID NO: 153285 - RNA, 22 nt, Human
agucccagccuaggcugugcug

SEQ ID NO: 153286 - RNA, 22 nt, Human
cugucacacugauaucaggcuu

SEQ ID NO: 153287 - RNA, 22 nt, Human
cuuacauuaaguaagagauuga

SEQ ID NO: 153288 - RNA, 22 nt, Human
aaagcugcugccaaucaggcuu

SEQ ID NO: 153289 - RNA, 22 nt, Human
aagggcaggugggcauuucugg

SEQ ID NO: 153290 - RNA, 22 nt, Human
uugacaauguccuuugaauuuc

SEQ ID NO: 153291 - RNA, 22 nt, Human
gggcuggcucccagguguugaa

SEQ ID NO: 153292 - RNA, 22 nt, Human
gcaggggcaggagaucucaggc

SEQ ID NO: 153293 - RNA, 22 nt, Human
ccuucugcucccuggccagggc

SEQ ID NO: 153294 - RNA, 22 nt, Human
ucccagcccagauuugugugac

SEQ ID NO: 153295 - RNA, 22 nt, Human
uuaaugcagaaaucaaacugac

SEQ ID NO: 153296 - RNA, 22 nt, Human
cugugugugucugcagcauacu

SEQ ID NO: 153297 - RNA, 20 nt, Human
uccuucaggcagggccuagu

SEQ ID NO: 153298 - RNA, 22 nt, Human
cagaauuugaaguaauauucca

SEQ ID NO: 153299 - RNA, 20 nt, Human
cuguagggugcagcaggcuc

SEQ ID NO: 153300 - RNA, 22 nt, Human
caggagacuauggcccaaggcc

SEQ ID NO: 153301 - RNA, 22 nt, Human
auucuagaugcuguaaguagca

SEQ ID NO: 153302 - RNA, 22 nt, Human
cagaacauucacucauaugugg

SEQ ID NO: 153303 - RNA, 22 nt, Human
caggcagcugaggacuuugcua

SEQ ID NO: 153304 - RNA, 22 nt, Human
ugcaggagaaaguacggagcgu

SEQ ID NO: 153305 - RNA, 22 nt, Human
aaggcugcuuuuaacaugcaua

SEQ ID NO: 153306 - RNA, 22 nt, Human
gggaugucacugugccuggcac

SEQ ID NO: 153307 - RNA, 22 nt, Human
aaaugcacaaaguaaguguaau

SEQ ID NO: 153308 - RNA, 22 nt, Human
uugucugaaagaucauuacauu

SEQ ID NO: 153309 - RNA, 22 nt, Human
ugaaccagagucuccagugguu

SEQ ID NO: 153310 - RNA, 22 nt, Human
cagagcugguaagugguagagg

SEQ ID NO: 153311 - RNA, 22 nt, Human
cucaggauagauuguccucuca

SEQ ID NO: 153312 - RNA, 22 nt, Human
acugggaguucuccaugucccu

SEQ ID NO: 153313 - RNA, 22 nt, Human
auuugucucugcacuuuacuca

SEQ ID NO: 153314 - RNA, 22 nt, Human
ccagcauggcaccugagaugag

SEQ ID NO: 153315 - RNA, 22 nt, Human
ggagugacucacagcugggaca

SEQ ID NO: 153316 - RNA, 22 nt, Human
ccucagggccaucucugucccu

SEQ ID NO: 153317 - RNA, 22 nt, Human
uguuauugagguuacuuauaag

SEQ ID NO: 153318 - RNA, 22 nt, Human
ugcauuguugaugaguugaaua

SEQ ID NO: 153319 - RNA, 22 nt, Human
gcugccaauccagcugugggag

SEQ ID NO: 153320 - RNA, 22 nt, Human
ugccagccagguucugaggcua

SEQ ID NO: 153321 - RNA, 20 nt, Human
cuguggcucaugcaucugcc

SEQ ID NO: 153322 - RNA, 22 nt, Human
uuugcauuacuugacuuuaguu

SEQ ID NO: 153323 - RNA, 22 nt, Human
ugcucacugaacucuugcuguc

SEQ ID NO: 153324 - RNA, 22 nt, Human
gcagcugggccccagccucucc

SEQ ID NO: 153325 - RNA, 22 nt, Human
agggcacaucugcugggaaugg

SEQ ID NO: 153326 - RNA, 22 nt, Human
cacagggccacuuucccaguaa

SEQ ID NO: 153327 - RNA, 22 nt, Human
uuccagggcuaauuccugugga

SEQ ID NO: 153328 - RNA, 22 nt, Human
uacuuuuugucucuuugaaugu

SEQ ID NO: 153329 - RNA, 22 nt, Human
uagaaaauagggccuguggagc

SEQ ID NO: 153330 - RNA, 22 nt, Human
ugggccugggcuccuguccucu

SEQ ID NO: 153331 - RNA, 22 nt, Human
gauuuagagaauguuuuguaag

SEQ ID NO: 153332 - RNA, 19 nt, Human
uagcugccuguuaccucca

SEQ ID NO: 153333 - RNA, 22 nt, Human
ggugucccaggccagcugugug

SEQ ID NO: 153334 - RNA, 19 nt, Human
aggucauugauagugcagg

SEQ ID NO: 153335 - RNA, 22 nt, Human
ucugucacuuuuauuuacugaa

SEQ ID NO: 153336 - RNA, 23 nt, Human
uagggcagcugggagggacaugc

SEQ ID NO: 153337 - RNA, 22 nt, Human
cuguccuguagcuccaucaguc

SEQ ID NO: 153338 - RNA, 22 nt, Human
acagagcaauucuuggguguuu

SEQ ID NO: 153339 - RNA, 22 nt, Human
cugggaguugacgaggcuugua

SEQ ID NO: 153340 - RNA, 22 nt, Human
uggcucagaagaaaagguaaac

SEQ ID NO: 153341 - RNA, 19 nt, Human
cccaaggcccugggcaggc

SEQ ID NO: 153342 - RNA, 22 nt, Human
agccagccaguucacuaggaaa

SEQ ID NO: 153343 - RNA, 22 nt, Human
cagagcuggagcuugaauggag

SEQ ID NO: 153344 - RNA, 22 nt, Human
cuggggcucacuuuggucaggc

SEQ ID NO: 153345 - RNA, 22 nt, Human
gggcagcagcaggaggucucug

SEQ ID NO: 153346 - RNA, 22 nt, Human
uauaguaaaauuuucauuuaug

SEQ ID NO: 153347 - RNA, 22 nt, Human
gcucccugaaaagaacaaaguc

SEQ ID NO: 153348 - RNA, 22 nt, Human
gucaccagucccagcuccugaa

SEQ ID NO: 153349 - RNA, 22 nt, Human
cagcugagcucccaggccauca

SEQ ID NO: 153350 - RNA, 22 nt, Human
ggcagagacuggguuggcagag

SEQ ID NO: 153351 - RNA, 22 nt, Human
guccuggcuuaguucgcuguaa

SEQ ID NO: 153352 - RNA, 22 nt, Human
caguuucuucaucaguuaagca

SEQ ID NO: 153353 - RNA, 18 nt, Human
ggcucaggcuauccuaac

SEQ ID NO: 153354 - RNA, 18 nt, Human
ggagagugagaucaaaca

SEQ ID NO: 153355 - RNA, 22 nt, Human
agcccagcaaagggagguucag

SEQ ID NO: 153356 - RNA, 22 nt, Human
agcaggguuuggggauuggcac

SEQ ID NO: 153357 - RNA, 22 nt, Human
aggcacugguccauuuucugca

SEQ ID NO: 153358 - RNA, 22 nt, Human
uauguguacaucugguugagca

SEQ ID NO: 153359 - RNA, 22 nt, Human
uccugagggcgauucagcaggu

SEQ ID NO: 153360 - RNA, 22 nt, Human
cucaggagacaguguccacaug

SEQ ID NO: 153361 - RNA, 22 nt, Human
aaaucagugcucauuugaaagg

SEQ ID NO: 153362 - RNA, 22 nt, Human
ggagcuggucagccuugagcau

SEQ ID NO: 153363 - RNA, 22 nt, Human
cucugggcacauuuuccaggac

SEQ ID NO: 153364 - RNA, 22 nt, Human
caguuucucucaauaagcaucg

SEQ ID NO: 153365 - RNA, 22 nt, Human
uaugcacgucuauuuaugaaga

SEQ ID NO: 153366 - RNA, 19 nt, Human
gcacacccugcaccaccau

SEQ ID NO: 153367 - RNA, 22 nt, Human
caggcugggaacgccacccgcu

SEQ ID NO: 153368 - RNA, 22 nt, Human
aaugaacaaaauaugcuuugca

SEQ ID NO: 153369 - RNA, 22 nt, Human
ucaaaguuuguggcaauuuauu

SEQ ID NO: 153370 - RNA, 22 nt, Human
uggaggccagagguacugggac

SEQ ID NO: 153371 - RNA, 22 nt, Human
gguggcagaggugcaucagccc

SEQ ID NO: 153372 - RNA, 22 nt, Human
gaagcccuauccucuccuggga

SEQ ID NO: 153373 - RNA, 22 nt, Human
acaggcuuacaggcugcaagua

SEQ ID NO: 153374 - RNA, 17 nt, Human
gguguauggggagggaa

SEQ ID NO: 153375 - RNA, 22 nt, Human
cagggacaauggcagagccuga

SEQ ID NO: 153376 - RNA, 22 nt, Human
aagaauguucauuaaacuguug

SEQ ID NO: 153377 - RNA, 22 nt, Human
uguagcacagagcuuugacacu

SEQ ID NO: 153378 - RNA, 22 nt, Human
cuuggcugucuauaggaaagag

SEQ ID NO: 153379 - RNA, 22 nt, Human
cuggcuccacucccugccugac

SEQ ID NO: 153380 - RNA, 23 nt, Human
ugagcugguauuguccaucucca

SEQ ID NO: 153381 - RNA, 22 nt, Human
ucauaaaacacaccagguaguu

SEQ ID NO: 153382 - RNA, 22 nt, Human
cuuccuguugucacagucugcg

SEQ ID NO: 153383 - RNA, 22 nt, Human
gaagcccagggcguggccgggc

SEQ ID NO: 153384 - RNA, 22 nt, Human
ccagucugaggccuggugaggg

SEQ ID NO: 153385 - RNA, 22 nt, Human
ugggugagugggaaaagcccag

SEQ ID NO: 153386 - RNA, 22 nt, Human
agcucugggccaggaacccuaa

SEQ ID NO: 153387 - RNA, 22 nt, Human
agauuucccaaauacuuguuau

SEQ ID NO: 153388 - RNA, 22 nt, Human
cugagauggccacugggucuca

SEQ ID NO: 153389 - RNA, 22 nt, Human
ccugggagagucuguggucucc

SEQ ID NO: 153390 - RNA, 22 nt, Human
ugcacagcgggugucugucagg

SEQ ID NO: 153391 - RNA, 22 nt, Human
cagcccucagguccucagcagc

SEQ ID NO: 153392 - RNA, 22 nt, Human
aaggcacugacugugcagggga

SEQ ID NO: 153393 - RNA, 22 nt, Human
agcuuccucaccucagaggucu

SEQ ID NO: 153394 - RNA, 22 nt, Human
cuucucuucccagggacacagg

SEQ ID NO: 153395 - RNA, 22 nt, Human
cugcagccuaggugcagcuggg

SEQ ID NO: 153396 - RNA, 22 nt, Human
ucccagagcagaugugcuaaag

SEQ ID NO: 153397 - RNA, 22 nt, Human
gccugccugcugucaucugccu

SEQ ID NO: 153398 - RNA, 22 nt, Human
caugcacuuaccugaaauucaa

SEQ ID NO: 153399 - RNA, 16 nt, Human
gagccaggugccuuga

SEQ ID NO: 153400 - RNA, 22 nt, Human
guggcuucugcggugugcgcag

SEQ ID NO: 153401 - RNA, 22 nt, Human
ucaguuuugaaaacauugaaug

SEQ ID NO: 153402 - RNA, 22 nt, Human
auuauauugaguauaaccagag

SEQ ID NO: 153403 - RNA, 21 nt, Human
uuacuuuugcagcaaccuaau

SEQ ID NO: 153404 - RNA, 22 nt, Human
acuggcaguuugagaaugcauu

SEQ ID NO: 153405 - RNA, 22 nt, Human
acauuucugucuuagggacugu

SEQ ID NO: 153406 - RNA, 22 nt, Human
cagggacugagauccagacugu

SEQ ID NO: 153407 - RNA, 22 nt, Human
uggcagcuuccugcucauagga

SEQ ID NO: 153408 - RNA, 22 nt, Human
uggacucaaguccaaguucacg

SEQ ID NO: 153409 - RNA, 22 nt, Human
agggcagaccacgugcaaggau

SEQ ID NO: 153410 - RNA, 19 nt, Human
cugccuguuauggagagaa

SEQ ID NO: 153411 - RNA, 18 nt, Human
aagccagagaccacugcc

SEQ ID NO: 153412 - RNA, 22 nt, Human
aaaugcagaucccugaaucuca

SEQ ID NO: 153413 - RNA, 22 nt, Human
guacaaaguggaccugauagua

SEQ ID NO: 153414 - RNA, 22 nt, Human
aacaacugaaaagcuuuuucug

SEQ ID NO: 153415 - RNA, 22 nt, Human
cacagguggcuccaaguuagag

SEQ ID NO: 153416 - RNA, 22 nt, Human
ccugccugcagaaaguaucucc

SEQ ID NO: 153417 - RNA, 22 nt, Human
gacagaguuguugauguaugcu

SEQ ID NO: 153418 - RNA, 22 nt, Human
auuuaaauuuucugauggagag

SEQ ID NO: 153419 - RNA, 22 nt, Human
ucagagugugacuuggucauga

SEQ ID NO: 153420 - RNA, 22 nt, Human
uuugggaacucuaucauggaaa

SEQ ID NO: 153421 - RNA, 20 nt, Human
ccuggcugcauucaggacgg

SEQ ID NO: 153422 - RNA, 22 nt, Human
uggccuuggacagagcgcuccu

SEQ ID NO: 153423 - RNA, 22 nt, Human
agauuucaaugugagcauuagu

SEQ ID NO: 153424 - RNA, 23 nt, Human
cacugcagcguggucuggcagga

SEQ ID NO: 153425 - RNA, 22 nt, Human
auaaauuuauaauuguuuccug

SEQ ID NO: 153426 - RNA, 22 nt, Human
cuguccucuguccucagcagga

SEQ ID NO: 153427 - RNA, 20 nt, Human
agcugguuaucuuaauucuu

SEQ ID NO: 153428 - RNA, 22 nt, Human
aguguggguuuuauggagcccu

SEQ ID NO: 153429 - RNA, 22 nt, Human
ugugccugaguuggcugaguac

SEQ ID NO: 153430 - RNA, 22 nt, Human
uggccuggaagagaggucgagg

SEQ ID NO: 153431 - RNA, 22 nt, Human
cugccucugcgucccacagagu

SEQ ID NO: 153432 - RNA, 22 nt, Human
cagagccuaaaacgacuccacu

SEQ ID NO: 153433 - RNA, 23 nt, Human
uggcccugaaucuguccuggagg

SEQ ID NO: 153434 - RNA, 22 nt, Human
gcucugggcugcccucuggaca

SEQ ID NO: 153435 - RNA, 22 nt, Human
agugaaauggaugcugcuacug

SEQ ID NO: 153436 - RNA, 22 nt, Human
ugcuugagacacauaugaauuu

SEQ ID NO: 153437 - RNA, 22 nt, Human
ucacugcaaggaggcuucucaa

SEQ ID NO: 153438 - RNA, 19 nt, Human
ugagaggcuuaaggcagcu

SEQ ID NO: 153439 - RNA, 22 nt, Human
gacagggccgcagauggagacu

SEQ ID NO: 153440 - RNA, 22 nt, Human
gagggcagagucuaaugaugca

SEQ ID NO: 153441 - RNA, 22 nt, Human
aauggcugggaguguauuuugg

SEQ ID NO: 153442 - RNA, 17 nt, Human
acagggcagaaacagcu

SEQ ID NO: 153443 - RNA, 22 nt, Human
ugaagcaggaaccagcagcauu

SEQ ID NO: 153444 - RNA, 21 nt, Human
ccuggcuucagggugcacugg

SEQ ID NO: 153445 - RNA, 22 nt, Human
aaaugugcuugugaucagcugu

SEQ ID NO: 153446 - RNA, 22 nt, Human
gaaggccucacucugcagcaua

SEQ ID NO: 153447 - RNA, 22 nt, Human
aaaggucauugaaaaggaggaa

SEQ ID NO: 153448 - RNA, 22 nt, Human
aggcagcagggccacuggcuga

SEQ ID NO: 153449 - RNA, 22 nt, Human
uggugcugacaguucugagugc

SEQ ID NO: 153450 - RNA, 17 nt, Human
gcaaucucagucuccuu

SEQ ID NO: 153451 - RNA, 22 nt, Human
ugcagucuuccagcugcacaaa

SEQ ID NO: 153452 - RNA, 22 nt, Human
ggaaaaggccauuguuucucug

SEQ ID NO: 153453 - RNA, 22 nt, Human
caucugcuguuccuuggacuca

SEQ ID NO: 153454 - RNA, 22 nt, Human
caacagaagguguacuacugaa

SEQ ID NO: 153455 - RNA, 22 nt, Human
ggcuucucgugccgaagcaaga

SEQ ID NO: 153456 - RNA, 22 nt, Human
ccugcuggccaguggagggcug

SEQ ID NO: 153457 - RNA, 22 nt, Human
ggcagggagagcaugcugauaa

SEQ ID NO: 153458 - RNA, 22 nt, Human
cucaggccauucuuccagcugc

SEQ ID NO: 153459 - RNA, 21 nt, Human
cugugcuucuuccuaagccag

SEQ ID NO: 153460 - RNA, 22 nt, Human
ugaagcagcuucuuucugucaa

SEQ ID NO: 153461 - RNA, 22 nt, Human
ggcugagcacuuuaggcaggag

SEQ ID NO: 153462 - RNA, 22 nt, Human
gguggggcccuggcacugguau

SEQ ID NO: 153463 - RNA, 19 nt, Human
guggccucggagcgcgcgg

SEQ ID NO: 153464 - RNA, 22 nt, Human
uuccucugaaauggcuuggaaa

SEQ ID NO: 153465 - RNA, 22 nt, Human
aaggaagggaaauagugauguc

SEQ ID NO: 153466 - RNA, 22 nt, Human
cuggcucagacagcugugcagu

SEQ ID NO: 153467 - RNA, 22 nt, Human
gugccugcugcagagucgcugu

SEQ ID NO: 153468 - RNA, 22 nt, Human
cucagagaagucuuugcuaaac

SEQ ID NO: 153469 - RNA, 22 nt, Human
gggugaggagcugccagucaug

SEQ ID NO: 153470 - RNA, 22 nt, Human
uacauguauugauuucucuucu

SEQ ID NO: 153471 - RNA, 22 nt, Human
uccucacagucaacacuuugag

SEQ ID NO: 153472 - RNA, 22 nt, Human
uaagaacaagauguuccuguuu

SEQ ID NO: 153473 - RNA, 22 nt, Human
gcaggauggugcccuuucugcc

SEQ ID NO: 153474 - RNA, 17 nt, Human
ugcauguccuuuguucc

SEQ ID NO: 153475 - RNA, 22 nt, Human
caggaaagguagucacaaugua

SEQ ID NO: 153476 - RNA, 22 nt, Human
auucaguucuaaggucagugcc

SEQ ID NO: 153477 - RNA, 22 nt, Human
ggauggagguucucagaugcuc

SEQ ID NO: 153478 - RNA, 22 nt, Human
acccugccgugggcugcuugug

SEQ ID NO: 153479 - RNA, 22 nt, Human
uggcucaggagggaucuuugcu

SEQ ID NO: 153480 - RNA, 22 nt, Human
auacaugucaucauauguuugu

SEQ ID NO: 153481 - RNA, 22 nt, Human
agaauucucuuccauugaaaca

SEQ ID NO: 153482 - RNA, 22 nt, Human
ucccuggccauuccucuaggcc

SEQ ID NO: 153483 - RNA, 22 nt, Human
aagaauuauugcaauacuagau

SEQ ID NO: 153484 - RNA, 22 nt, Human
uuccuuccgggcaccaggcacu

SEQ ID NO: 153485 - RNA, 22 nt, Human
cagaagccugccucagaugcac

SEQ ID NO: 153486 - RNA, 22 nt, Human
agccugagccccauccagcuga

SEQ ID NO: 153487 - RNA, 22 nt, Human
ugguccugagcaccagccugac

SEQ ID NO: 153488 - RNA, 22 nt, Human
uggucaguugcaucagagaagu

SEQ ID NO: 153489 - RNA, 22 nt, Human
uaaguucaaugaacucaguucu

SEQ ID NO: 153490 - RNA, 22 nt, Human
uuguaacacuuuucuauuaaua

SEQ ID NO: 153491 - RNA, 22 nt, Human
cauuucuguacauguuuuggug

SEQ ID NO: 153492 - RNA, 22 nt, Human
gcugagcucccagcaguaucug

SEQ ID NO: 153493 - RNA, 22 nt, Human
ggcuucugccacgagagggaag

SEQ ID NO: 153494 - RNA, 22 nt, Human
gccugccugcugugugcaaguu

SEQ ID NO: 153495 - RNA, 22 nt, Human
aaaggugacugcagcagcuauu

SEQ ID NO: 153496 - RNA, 22 nt, Human
ggcugggcuccgggagcaugcg

SEQ ID NO: 153497 - RNA, 22 nt, Human
ucagguggcuucggggaguggc

SEQ ID NO: 153498 - RNA, 17 nt, Human
ucagagggaugagcagg

SEQ ID NO: 153499 - RNA, 23 nt, Human
ugacacauuuccuuuccacugca

SEQ ID NO: 153500 - RNA, 22 nt, Human
acauuguauaaugauuaucaca

SEQ ID NO: 153501 - RNA, 20 nt, Human
ggggcccaagcccucuugcc

SEQ ID NO: 153502 - RNA, 22 nt, Human
aaguuguauauaccgcuuuaag

SEQ ID NO: 153503 - RNA, 23 nt, Human
aagcuuccuucacgucuccuggg

SEQ ID NO: 153504 - RNA, 22 nt, Human
uguacacugcaggaugcauugc

SEQ ID NO: 153505 - RNA, 22 nt, Human
cagacagaaggcuccuugaggu

SEQ ID NO: 153506 - RNA, 22 nt, Human
uuaugcuaagugcaacaagcca

SEQ ID NO: 153507 - RNA, 22 nt, Human
aaguaaaagcuuuaccaugcgc

SEQ ID NO: 153508 - RNA, 22 nt, Human
ccucuuugugccugcaggcugc

SEQ ID NO: 153509 - RNA, 22 nt, Human
uuuauuauagugguggggacug

SEQ ID NO: 153510 - RNA, 22 nt, Human
gcugcagcucgccuuccggccu

SEQ ID NO: 153511 - RNA, 22 nt, Human
cuggcagcucugagucccuucu

SEQ ID NO: 153512 - RNA, 22 nt, Human
ggggugggguuacucauugugc

SEQ ID NO: 153513 - RNA, 22 nt, Human
ugacucuguaccugucugccuu

SEQ ID NO: 153514 - RNA, 20 nt, Human
caguagcaauaauuagaagc

SEQ ID NO: 153515 - RNA, 22 nt, Human
cuacuucugugaugaaacuaca

SEQ ID NO: 153516 - RNA, 22 nt, Human
ucugagagccucuagccuaagu

SEQ ID NO: 153517 - RNA, 22 nt, Human
ccuggcugcauuuugcuggaug

SEQ ID NO: 153518 - RNA, 22 nt, Human
gguggagcuggaccaggagagg

SEQ ID NO: 153519 - RNA, 22 nt, Human
gggaccaggugggugcauuccg

SEQ ID NO: 153520 - RNA, 21 nt, Human
cugagggccgcagcugggcuc

SEQ ID NO: 153521 - RNA, 22 nt, Human
uuuagaaauucaucuauggccu

SEQ ID NO: 153522 - RNA, 22 nt, Human
ucucagagcuucaguuauuuuc

SEQ ID NO: 153523 - RNA, 18 nt, Human
ugacagaaccuggagccu

SEQ ID NO: 153524 - RNA, 22 nt, Human
aaaaccaggcguuuccuauuau

SEQ ID NO: 153525 - RNA, 22 nt, Human
aguacagaccugucucuuccug

SEQ ID NO: 153526 - RNA, 22 nt, Human
cuucuuaaugacagauuaaaau

SEQ ID NO: 153527 - RNA, 22 nt, Human
cucuggacacuggcaugggguc

SEQ ID NO: 153528 - RNA, 22 nt, Human
aagccagguguugugguaagag

SEQ ID NO: 153529 - RNA, 22 nt, Human
aguaaacauaauuuaccuguag

SEQ ID NO: 153530 - RNA, 23 nt, Human
ucugggcaccuuguugacaugau

SEQ ID NO: 153531 - RNA, 23 nt, Human
uccucccaaauuucagccucauu

SEQ ID NO: 153532 - RNA, 22 nt, Human
cuguucucuggcgguggcuguu

SEQ ID NO: 153533 - RNA, 22 nt, Human
gccugaagaacagcugugagga

SEQ ID NO: 153534 - RNA, 19 nt, Human
guggccagggcaggggcug

SEQ ID NO: 153535 - RNA, 22 nt, Human
cuggagcugucuucacaggccu

SEQ ID NO: 153536 - RNA, 19 nt, Human
agagaggcugugugaggga

SEQ ID NO: 153537 - RNA, 22 nt, Human
ucucaggaauagaguggcagca

SEQ ID NO: 153538 - RNA, 22 nt, Human
uccucugcuccaucuuuacugu

SEQ ID NO: 153539 - RNA, 22 nt, Human
gagcuggcuaauacugacuuau

SEQ ID NO: 153540 - RNA, 22 nt, Human
aagcagcuuaaauuagagccug

SEQ ID NO: 153541 - RNA, 22 nt, Human
uucaagauggccccagugagcc

SEQ ID NO: 153542 - RNA, 22 nt, Human
gcccagcuggcuuccagcacau

SEQ ID NO: 153543 - RNA, 22 nt, Human
caggugccucaggaugagacaa

SEQ ID NO: 153544 - RNA, 22 nt, Human
uauuuugacuauuaaaccaaca

SEQ ID NO: 153545 - RNA, 22 nt, Human
agaagauuuagguugacgcuau

SEQ ID NO: 153546 - RNA, 22 nt, Human
ugacuuccugcacucaggugau

SEQ ID NO: 153547 - RNA, 22 nt, Human
ugagcccaggaguuggaggcug

SEQ ID NO: 153548 - RNA, 21 nt, Human
gcaggggauagaaauggucug

SEQ ID NO: 153549 - RNA, 22 nt, Human
gcuggccaguguggugaccacc

SEQ ID NO: 153550 - RNA, 17 nt, Human
guuugcaugguguuaac

SEQ ID NO: 153551 - RNA, 22 nt, Human
caucaguguggcaguucacugu

SEQ ID NO: 153552 - RNA, 19 nt, Human
gcaugcuugguggcuucug

SEQ ID NO: 153553 - RNA, 18 nt, Human
gcagcugcaguuguagcu

SEQ ID NO: 153554 - RNA, 22 nt, Human
aggaggcugguucaggccauau

SEQ ID NO: 153555 - RNA, 22 nt, Human
gggccuggugcuucugacuccu

SEQ ID NO: 153556 - RNA, 22 nt, Human
cuguccugcaguugggggcagg

SEQ ID NO: 153557 - RNA, 19 nt, Human
ggaaacaggggccagagga

SEQ ID NO: 153558 - RNA, 22 nt, Human
uuauccaaacuggugaaucauu

SEQ ID NO: 153559 - RNA, 22 nt, Human
aaugcaguuucauuuguagaau

SEQ ID NO: 153560 - RNA, 22 nt, Human
uuguguccugauuugacacaau

SEQ ID NO: 153561 - RNA, 22 nt, Human
ggccagaaaguuaagcuguggc

SEQ ID NO: 153562 - RNA, 23 nt, Human
cagggccaggcagcagcugucac

SEQ ID NO: 153563 - RNA, 21 nt, Human
gucagcagauccagcacuugu

SEQ ID NO: 153564 - RNA, 22 nt, Human
gucccugggaugcccuucuggg

SEQ ID NO: 153565 - RNA, 22 nt, Human
auggcccaggccuccuguggcu

SEQ ID NO: 153566 - RNA, 22 nt, Human
gcagagcugucuaagucacuuc

SEQ ID NO: 153567 - RNA, 22 nt, Human
ucucccacugcaagcccaggcu

SEQ ID NO: 153568 - RNA, 22 nt, Human
gccaggcugaggcucuggaaga

SEQ ID NO: 153569 - RNA, 18 nt, Human
uucagcagcagacacacu

SEQ ID NO: 153570 - RNA, 22 nt, Human
cucuggcuuugcucaugcaucc

SEQ ID NO: 153571 - RNA, 20 nt, Human
uucuggaggcuacaagucug

SEQ ID NO: 153572 - RNA, 18 nt, Human
cugccuguugcugagagg

SEQ ID NO: 153573 - RNA, 22 nt, Human
uauguacaccggggaagguggg

SEQ ID NO: 153574 - RNA, 22 nt, Human
cagaaauggagcccaggaaucu

SEQ ID NO: 153575 - RNA, 22 nt, Human
ugcaggugguuuggacacugcu

SEQ ID NO: 153576 - RNA, 22 nt, Human
ucuuugcaacucccauuuccau

SEQ ID NO: 153577 - RNA, 22 nt, Human
agcccugggaggccagcuugua

SEQ ID NO: 153578 - RNA, 22 nt, Human
ggcaugggccgaggugccuccu

SEQ ID NO: 153579 - RNA, 22 nt, Human
caggguggaauggaaugcuggc

SEQ ID NO: 153580 - RNA, 22 nt, Human
aauuuagaauucgcuagcuaau

SEQ ID NO: 153581 - RNA, 22 nt, Human
accaaggagacaaagguguauu

SEQ ID NO: 153582 - RNA, 22 nt, Human
aagaacauguuaaaagauucac

SEQ ID NO: 153583 - RNA, 19 nt, Human
cugguccugacugaggggu

SEQ ID NO: 153584 - RNA, 19 nt, Human
ggcucucuuaaagcuguuu

SEQ ID NO: 153585 - RNA, 22 nt, Human
agcagggcugcagugugucuuu

SEQ ID NO: 153586 - RNA, 22 nt, Human
aggcagcagccacaaggccuga

SEQ ID NO: 153587 - RNA, 22 nt, Human
cugcaguguucuggaaugcauu

SEQ ID NO: 153588 - RNA, 22 nt, Human
aagggccuccuggggagccugg

SEQ ID NO: 153589 - RNA, 22 nt, Human
cggggcugcgcucuuccugccg

SEQ ID NO: 153590 - RNA, 22 nt, Human
ccucagagguguggcaucucug

SEQ ID NO: 153591 - RNA, 22 nt, Human
aaaugcagguucuugagccaag

SEQ ID NO: 153592 - RNA, 22 nt, Human
gcccagcugucuggcagggaug

SEQ ID NO: 153593 - RNA, 22 nt, Human
gugcugucguggaacugggcug

SEQ ID NO: 153594 - RNA, 22 nt, Human
cucugcaggggaggcaugcacu

SEQ ID NO: 153595 - RNA, 22 nt, Human
ucccaggauguuggcggcaggu

SEQ ID NO: 153596 - RNA, 23 nt, Human
gccuggccaccccagggcugcuu

SEQ ID NO: 153597 - RNA, 22 nt, Human
ggagaaggugcuggucacugug

SEQ ID NO: 153598 - RNA, 22 nt, Human
ggaggugggagacauaggcggc

SEQ ID NO: 153599 - RNA, 22 nt, Human
gccuggagcucggcugagggcg

SEQ ID NO: 153600 - RNA, 22 nt, Human
gccuccuggauuuuagugccau

SEQ ID NO: 153601 - RNA, 22 nt, Human
cugccucuguugggcauggucu

SEQ ID NO: 153602 - RNA, 22 nt, Human
gggcaggaugcaguuucagaga

SEQ ID NO: 153603 - RNA, 22 nt, Human
agagcagauggccagggggccu

SEQ ID NO: 153604 - RNA, 22 nt, Human
ucacaacucuuuccauuuaaua

SEQ ID NO: 153605 - RNA, 22 nt, Human
ugggcugcggauaggccucgga

SEQ ID NO: 153606 - RNA, 22 nt, Human
uucuggaguauuccuggcaccu

SEQ ID NO: 153607 - RNA, 22 nt, Human
ggugaggggagagugaaagaaa

SEQ ID NO: 153608 - RNA, 21 nt, Human
acagcagacaggcuuaggacc

SEQ ID NO: 153609 - RNA, 22 nt, Human
uggagcaggacugcugcccuca

SEQ ID NO: 153610 - RNA, 22 nt, Human
cuuucacauaauugaccuugaa

SEQ ID NO: 153611 - RNA, 21 nt, Human
gggccacaccuucugcagacc

SEQ ID NO: 153612 - RNA, 22 nt, Human
cuccucacuuuccagacugggc

SEQ ID NO: 153613 - RNA, 22 nt, Human
ccaaaguccauaguuuacauaa

SEQ ID NO: 153614 - RNA, 22 nt, Human
uaaagguaguuuuaaaggugcu

SEQ ID NO: 153615 - RNA, 22 nt, Human
cagcugagucugagguucuuug

SEQ ID NO: 153616 - RNA, 22 nt, Human
caggaagagaacauggaggcug

SEQ ID NO: 153617 - RNA, 22 nt, Human
acagggcagugucuugaaaaau

SEQ ID NO: 153618 - RNA, 22 nt, Human
ggagccaggggaccuucacaga

SEQ ID NO: 153619 - RNA, 22 nt, Human
uggccucaagucugagggccuu

SEQ ID NO: 153620 - RNA, 22 nt, Human
uuggcagggccaggcucucucu

SEQ ID NO: 153621 - RNA, 22 nt, Human
uuaguaaauaaagucuacuuuc

SEQ ID NO: 153622 - RNA, 22 nt, Human
auguuacacauaggcauaaaug

SEQ ID NO: 153623 - RNA, 22 nt, Human
guggccucuguuggcuccuagg

SEQ ID NO: 153624 - RNA, 22 nt, Human
ggcugucucugugacugccacc

SEQ ID NO: 153625 - RNA, 22 nt, Human
ugcagcauugcaaagcagucuu

SEQ ID NO: 153626 - RNA, 22 nt, Human
ugagggaggcccuuugagcaga

SEQ ID NO: 153627 - RNA, 22 nt, Human
agcugagccagcagcaacagga

SEQ ID NO: 153628 - RNA, 22 nt, Human
uggcucaguuuagcagcucagu

SEQ ID NO: 153629 - RNA, 22 nt, Human
gugccuuccccgguggucuguu

SEQ ID NO: 153630 - RNA, 22 nt, Human
gagcugccuguugcauagcaac

SEQ ID NO: 153631 - RNA, 22 nt, Human
gaggccuggucuaugagauguu

SEQ ID NO: 153632 - RNA, 22 nt, Human
aggaccuguagggccugcaucc

SEQ ID NO: 153633 - RNA, 23 nt, Human
gccucugcucugcguuggggacu

SEQ ID NO: 153634 - RNA, 22 nt, Human
cccagccuuugcuuccugguuc

SEQ ID NO: 153635 - RNA, 22 nt, Human
acaaagucucuaauaaucuucu

SEQ ID NO: 153636 - RNA, 22 nt, Human
agugccaggagcaaggagcucc

SEQ ID NO: 153637 - RNA, 22 nt, Human
gggcucugggaugcucuuagag

SEQ ID NO: 153638 - RNA, 22 nt, Human
uggagggaacccaggcugcucu

SEQ ID NO: 153639 - RNA, 22 nt, Human
gcucucugaggugcuggcagag

SEQ ID NO: 153640 - RNA, 22 nt, Human
ccuggaaggcaggcauggauug

SEQ ID NO: 153641 - RNA, 22 nt, Human
gcucagagcaucccagugaaug

SEQ ID NO: 153642 - RNA, 22 nt, Human
gcugucugcaucucuagagcuu

SEQ ID NO: 153643 - RNA, 22 nt, Human
agagcuggccagggaucacucu

SEQ ID NO: 153644 - RNA, 22 nt, Human
gccucugcaacuccgccuuggu

SEQ ID NO: 153645 - RNA, 22 nt, Human
guggcagcaaaauccugcauuc

SEQ ID NO: 153646 - RNA, 22 nt, Human
guccacauaggaacccagcuuc

SEQ ID NO: 153647 - RNA, 22 nt, Human
ccagagccuggcaucugcauaa

SEQ ID NO: 153648 - RNA, 22 nt, Human
gcugcagcaagcccuccagggg

SEQ ID NO: 153649 - RNA, 22 nt, Human
ucaggcuggaaugcaguggggc

SEQ ID NO: 153650 - RNA, 22 nt, Human
ucagaaaugaucguuauucauu

SEQ ID NO: 153651 - RNA, 22 nt, Human
ggccuggaaugcuuuccuacca

SEQ ID NO: 153652 - RNA, 22 nt, Human
ccucauggccuugagcugaggg

SEQ ID NO: 153653 - RNA, 22 nt, Human
ugauuucaaguagugacaugcu

SEQ ID NO: 153654 - RNA, 20 nt, Human
agcccaggccugugugaguc

SEQ ID NO: 153655 - RNA, 22 nt, Human
aggugcugccccgagaaggaug

SEQ ID NO: 153656 - RNA, 22 nt, Human
agaaaugacacacaugagacau

SEQ ID NO: 153657 - RNA, 22 nt, Human
acagagcacauagauuggaguu

SEQ ID NO: 153658 - RNA, 22 nt, Human
ggacacaagcuccggggcugca

SEQ ID NO: 153659 - RNA, 22 nt, Human
uggcugaauaaaauaugguguu

SEQ ID NO: 153660 - RNA, 22 nt, Human
uaauguguugaauauuuguaca

SEQ ID NO: 153661 - RNA, 22 nt, Human
cugcuggggucagagcacuggg

SEQ ID NO: 153662 - RNA, 22 nt, Human
uggggugggcaugcgcuguccu

SEQ ID NO: 153663 - RNA, 22 nt, Human
uccagcagguuggucaggugca

SEQ ID NO: 153664 - RNA, 22 nt, Human
acagagcacugcccugugccgc

SEQ ID NO: 153665 - RNA, 22 nt, Human
aauuuggcagugucuugaagua

SEQ ID NO: 153666 - RNA, 22 nt, Human
caguggcuguuucuggaaggca

SEQ ID NO: 153667 - RNA, 22 nt, Human
aggagucagauaugggaaaguu

SEQ ID NO: 153668 - RNA, 22 nt, Human
cucugagaggugagaagcagca

SEQ ID NO: 153669 - RNA, 22 nt, Human
ggagugaguacuggaguagcug

SEQ ID NO: 153670 - RNA, 22 nt, Human
gggccucucccuucucacgcau

SEQ ID NO: 153671 - RNA, 22 nt, Human
cuggccaguuguccuggcuugg

SEQ ID NO: 153672 - RNA, 22 nt, Human
gggaucagaaacauagcccuga

SEQ ID NO: 153673 - RNA, 22 nt, Human
ccuggcugcuuucacuauggag

SEQ ID NO: 153674 - RNA, 22 nt, Human
gcagccccaggagacgcccagg

SEQ ID NO: 153675 - RNA, 22 nt, Human
caucuggcuagcuaucauugug

SEQ ID NO: 153676 - RNA, 22 nt, Human
gugccugguuuggggaauguuc

SEQ ID NO: 153677 - RNA, 22 nt, Human
cugaugcuauaagccacagugg

SEQ ID NO: 153678 - RNA, 22 nt, Human
ccuggccacucagguguggggc

SEQ ID NO: 153679 - RNA, 22 nt, Human
acacugaagagcacuuucaaag

SEQ ID NO: 153680 - RNA, 22 nt, Human
agacaggacacaagcugcauaa

SEQ ID NO: 153681 - RNA, 22 nt, Human
auuuucugguugagguuuaaca

SEQ ID NO: 153682 - RNA, 22 nt, Human
aaagauuucacaucccaagccu

SEQ ID NO: 153683 - RNA, 22 nt, Human
uggcuggggagccccgacuccc

SEQ ID NO: 153684 - RNA, 22 nt, Human
accaggggugucaacagcauuu

SEQ ID NO: 153685 - RNA, 22 nt, Human
agagugaaguucaucgugcagc

SEQ ID NO: 153686 - RNA, 22 nt, Human
uggcucagagagggagugugga

SEQ ID NO: 153687 - RNA, 18 nt, Human
ccagguggugacagagau

SEQ ID NO: 153688 - RNA, 22 nt, Human
cacugcuucuggaggaauuugg

SEQ ID NO: 153689 - RNA, 22 nt, Human
gcucugcucuaacauuccugac

SEQ ID NO: 153690 - RNA, 22 nt, Human
ccaggggcuggugcugagcugg

SEQ ID NO: 153691 - RNA, 22 nt, Human
aggcacugugcuucuuauaugu

SEQ ID NO: 153692 - RNA, 19 nt, Human
cucuggagcagacacugga

SEQ ID NO: 153693 - RNA, 22 nt, Human
agugaaaugacugaaucagaua

SEQ ID NO: 153694 - RNA, 22 nt, Human
gcaagauguuaacauagggaga

SEQ ID NO: 153695 - RNA, 22 nt, Human
agcaggaguguccccuggcugu

SEQ ID NO: 153696 - RNA, 22 nt, Human
guccucagagugggcagguccu

SEQ ID NO: 153697 - RNA, 22 nt, Human
gcaggccuccccugcuggagcu

SEQ ID NO: 153698 - RNA, 22 nt, Human
gugaggggaguaaagccauguu

SEQ ID NO: 153699 - RNA, 22 nt, Human
gcugcucuacccaugcaucugu

SEQ ID NO: 153700 - RNA, 22 nt, Human
agacagcauggagcugauaaca

SEQ ID NO: 153701 - RNA, 22 nt, Human
guggauggauugaggcaguggg

SEQ ID NO: 153702 - RNA, 22 nt, Human
cccuuucccuucuggcucaggg

SEQ ID NO: 153703 - RNA, 22 nt, Human
aaaaguaauugcaauuuuguag

SEQ ID NO: 153704 - RNA, 22 nt, Human
ccucagagccuccagaaggaau

SEQ ID NO: 153705 - RNA, 22 nt, Human
agccaggaaugcaugcucugcu

SEQ ID NO: 153706 - RNA, 22 nt, Human
cuuagaaaucgaacucagguua

SEQ ID NO: 153707 - RNA, 22 nt, Human
agagacaccgcgcaucauggcu

SEQ ID NO: 153708 - RNA, 22 nt, Human
caggggcuagcacuuaauguuu

SEQ ID NO: 153709 - RNA, 22 nt, Human
cucuuuccucagccacagucua

SEQ ID NO: 153710 - RNA, 22 nt, Human
cccaggcuggagugcaauggca

SEQ ID NO: 153711 - RNA, 22 nt, Human
gggagagagaaaacguggcgca

SEQ ID NO: 153712 - RNA, 22 nt, Human
caaaugugguuucucagcauuc

SEQ ID NO: 153713 - RNA, 22 nt, Human
aaggucauuuaacaauuuauga

SEQ ID NO: 153714 - RNA, 22 nt, Human
gcagggccagggcucaggcugu

SEQ ID NO: 153715 - RNA, 22 nt, Human
cagcauggcuugaguguuuccu

SEQ ID NO: 153716 - RNA, 22 nt, Human
ggcaaggccuugcccagcauuc

SEQ ID NO: 153717 - RNA, 22 nt, Human
gggcuggcaggaccugggcuga

SEQ ID NO: 153718 - RNA, 22 nt, Human
ccucucccacguggcagaggcu

SEQ ID NO: 153719 - RNA, 22 nt, Human
uccuggauucugcccugaaggc

SEQ ID NO: 153720 - RNA, 22 nt, Human
ggagccagaggcugcugcugug

SEQ ID NO: 153721 - RNA, 22 nt, Human
aaaaaugcuuggacuuaauaaa

SEQ ID NO: 153722 - RNA, 22 nt, Human
gccugaggaaugcuccugacuu

SEQ ID NO: 153723 - RNA, 21 nt, Human
gcaaggcuuuuguguuuccca

SEQ ID NO: 153724 - RNA, 22 nt, Human
ggcccuguuagagcucccacaa

SEQ ID NO: 153725 - RNA, 22 nt, Human
caaagguauucucauuuuggaa

SEQ ID NO: 153726 - RNA, 22 nt, Human
aggaggcccuagagcucuagag

SEQ ID NO: 153727 - RNA, 22 nt, Human
aagguacaccaaaguucaaguu

SEQ ID NO: 153728 - RNA, 22 nt, Human
acauuuaaauaccuauguuucu

SEQ ID NO: 153729 - RNA, 23 nt, Human
acuuaaaugguucuuuaucucag

SEQ ID NO: 153730 - RNA, 22 nt, Human
ccucuuccacugggccccaucc

SEQ ID NO: 153731 - RNA, 22 nt, Human
acagcagccuuguugguuucga

SEQ ID NO: 153732 - RNA, 22 nt, Human
aagucauuaucucuucuaaucu

SEQ ID NO: 153733 - RNA, 22 nt, Human
gcuguucccauguggggcucag

SEQ ID NO: 153734 - RNA, 22 nt, Human
gcuggugccuuguuguuguuac

SEQ ID NO: 153735 - RNA, 22 nt, Human
auaaggcauauagucacuuuuu

SEQ ID NO: 153736 - RNA, 22 nt, Human
gaugaggggucauuggcuggga

SEQ ID NO: 153737 - RNA, 22 nt, Human
cagcagcugggaaggaggcuga

SEQ ID NO: 153738 - RNA, 22 nt, Human
ucugaggcccugcaggcagugu

SEQ ID NO: 153739 - RNA, 22 nt, Human
aagcagaaguugaucuaccaua

SEQ ID NO: 153740 - RNA, 22 nt, Human
cagcucugaagaaaggugucua

SEQ ID NO: 153741 - RNA, 21 nt, Human
agggccugugcucuccagguc

SEQ ID NO: 153742 - RNA, 22 nt, Human
cuuuauguccaccagacugcaa

SEQ ID NO: 153743 - RNA, 22 nt, Human
uggcucagcgguggcagcagac

SEQ ID NO: 153744 - RNA, 22 nt, Human
ucuccuggauggaccuucucuu

SEQ ID NO: 153745 - RNA, 22 nt, Human
cccaggagauggagguugcagu

SEQ ID NO: 153746 - RNA, 22 nt, Human
guuuucuuugaaugcuucuaga

SEQ ID NO: 153747 - RNA, 22 nt, Human
gcuguccaugucuggccucagu

SEQ ID NO: 153748 - RNA, 22 nt, Human
cauggcagagaaggggaacugg

SEQ ID NO: 153749 - RNA, 22 nt, Human
ucacagacaauuguuuuggugu

SEQ ID NO: 153750 - RNA, 22 nt, Human
ugaaggagcucaaugaugaugc

SEQ ID NO: 153751 - RNA, 22 nt, Human
aaacuuuaagacaguccucaag

SEQ ID NO: 153752 - RNA, 22 nt, Human
ugaacagauggcccagcagagg

SEQ ID NO: 153753 - RNA, 22 nt, Human
gaaaagggcaagagagagggca

SEQ ID NO: 153754 - RNA, 22 nt, Human
guaacagaaagucaugcucauu

SEQ ID NO: 153755 - RNA, 20 nt, Human
aggcacuggauuucuuauau

SEQ ID NO: 153756 - RNA, 22 nt, Human
gcuccuggcuccaggcagccaa

SEQ ID NO: 153757 - RNA, 22 nt, Human
cugagcccaggcgggagcugag

SEQ ID NO: 153758 - RNA, 16 nt, Human
ggagagugucugcaaa

SEQ ID NO: 153759 - RNA, 22 nt, Human
cugccacuuucacccagugcuc

SEQ ID NO: 153760 - RNA, 22 nt, Human
ugggggagauuagagcuucuua

SEQ ID NO: 153761 - RNA, 22 nt, Human
ggcagaaggccucccagcuccu

SEQ ID NO: 153762 - RNA, 22 nt, Human
aucaguuuaacugucaagagcc

SEQ ID NO: 153763 - RNA, 21 nt, Human
cauugucgacauuuuccccuc

SEQ ID NO: 153764 - RNA, 22 nt, Human
ccuggcugcuauagcagcaugu

SEQ ID NO: 153765 - RNA, 22 nt, Human
agguagagcuccaguagaaaau

SEQ ID NO: 153766 - RNA, 22 nt, Human
gccuaauaugcaaaauugauac

SEQ ID NO: 153767 - RNA, 22 nt, Human
uuugcauuguuucaaaagugaa

SEQ ID NO: 153768 - RNA, 22 nt, Human
uccguauuugacuauugcaccg

SEQ ID NO: 153769 - RNA, 22 nt, Human
gacagcagacagaacuaccugc

SEQ ID NO: 153770 - RNA, 23 nt, Human
aggauguaggauguauggcagag

SEQ ID NO: 153771 - RNA, 22 nt, Human
aagggcuggccacauucugggu

SEQ ID NO: 153772 - RNA, 22 nt, Human
guuguauucuucaauaucagag

SEQ ID NO: 153773 - RNA, 19 nt, Human
ggcucucccuugagagagc

SEQ ID NO: 153774 - RNA, 22 nt, Human
gcagggaccugccacugcuguc

SEQ ID NO: 153775 - RNA, 22 nt, Human
ccucauggaccucagacugucc

SEQ ID NO: 153776 - RNA, 22 nt, Human
gccaggcuggugcaaggauauu

SEQ ID NO: 153777 - RNA, 22 nt, Human
gcagacuggucuucagccuugg

SEQ ID NO: 153778 - RNA, 22 nt, Human
uagaaaucagguuuuuagaaag

SEQ ID NO: 153779 - RNA, 23 nt, Human
cagaccuggcagucauccucaac

SEQ ID NO: 153780 - RNA, 22 nt, Human
cugccuggaaggagcaagggga

SEQ ID NO: 153781 - RNA, 22 nt, Human
acagagcauuugggacagagag

SEQ ID NO: 153782 - RNA, 22 nt, Human
ugcagaagaauguaggcauaag

SEQ ID NO: 153783 - RNA, 22 nt, Human
ucuuuucuggacucugcaugga

SEQ ID NO: 153784 - RNA, 22 nt, Human
gcauuucugugcauacacauga

SEQ ID NO: 153785 - RNA, 20 nt, Human
cucugcuuuaggagagucag

SEQ ID NO: 153786 - RNA, 22 nt, Human
ggcagcaguaggagcuaaucuu

SEQ ID NO: 153787 - RNA, 22 nt, Human
ugcuuuauguuaucagaagggu

SEQ ID NO: 153788 - RNA, 23 nt, Human
auggagcugguacuagcuaccuc

SEQ ID NO: 153789 - RNA, 22 nt, Human
uagggcaguuauaacauuagug

SEQ ID NO: 153790 - RNA, 20 nt, Human
uggcccuguuuucuccaggc

SEQ ID NO: 153791 - RNA, 22 nt, Human
aaaugcaccuugcugugagacu

SEQ ID NO: 153792 - RNA, 22 nt, Human
ucugagagucucugaggcagau

SEQ ID NO: 153793 - RNA, 23 nt, Human
aaaugcagggucgcagguuacag

SEQ ID NO: 153794 - RNA, 22 nt, Human
uuguuucaugaguguaaaggga

SEQ ID NO: 153795 - RNA, 22 nt, Human
gaggugagaagggggucagaug

SEQ ID NO: 153796 - RNA, 22 nt, Human
aaacuguaaacacagcaguaca

SEQ ID NO: 153797 - RNA, 19 nt, Human
uggcuucuguuuucauguu

SEQ ID NO: 153798 - RNA, 22 nt, Human
agaauuagucacaauuauagga

SEQ ID NO: 153799 - RNA, 22 nt, Human
uagcugucaccagaaauggcca

SEQ ID NO: 153800 - RNA, 22 nt, Human
cagagacagggcagggagugug

SEQ ID NO: 153801 - RNA, 22 nt, Human
uuugcuauuuuucugugcagcu

SEQ ID NO: 153802 - RNA, 22 nt, Human
uggcucaggauaauuuucccaa

SEQ ID NO: 153803 - RNA, 22 nt, Human
cccagcuccagagccagaaaca

SEQ ID NO: 153804 - RNA, 22 nt, Human
uguggcugcucaggugcagacc

SEQ ID NO: 153805 - RNA, 22 nt, Human
gacuguguccaugugcuggauu

SEQ ID NO: 153806 - RNA, 22 nt, Human
agugcauuauauguuucaaugg

SEQ ID NO: 153807 - RNA, 22 nt, Human
ccaggcagccaagugugugugu

SEQ ID NO: 153808 - RNA, 22 nt, Human
ugaagcugugggcaguggagcc

SEQ ID NO: 153809 - RNA, 22 nt, Human
agugccuggaccccaugacaua

SEQ ID NO: 153810 - RNA, 22 nt, Human
cugggcucagaugagaggaagg

SEQ ID NO: 153811 - RNA, 23 nt, Human
uccaagggcuacaaacacagacc

SEQ ID NO: 153812 - RNA, 22 nt, Human
aaguucaaggcucuagaguucc

SEQ ID NO: 153813 - RNA, 22 nt, Human
agaggccagggacacugcucaa

SEQ ID NO: 153814 - RNA, 23 nt, Human
ccucagcauggcaggagcccagc

SEQ ID NO: 153815 - RNA, 22 nt, Human
gguggguauaguuagggccucu

SEQ ID NO: 153816 - RNA, 22 nt, Human
ggucucuguugccuccaucaag

SEQ ID NO: 153817 - RNA, 22 nt, Human
ccagcaugagacgaugaugaag

SEQ ID NO: 153818 - RNA, 22 nt, Human
uagcugcccaucuuuccuuuag

SEQ ID NO: 153819 - RNA, 22 nt, Human
gacccuguuucuacaaauaauu

SEQ ID NO: 153820 - RNA, 22 nt, Human
caggugggcguggcgagaaggc

SEQ ID NO: 153821 - RNA, 22 nt, Human
gcucugcugucuucuugcaggc

SEQ ID NO: 153822 - RNA, 22 nt, Human
cccuggagugccggaaucaaga

SEQ ID NO: 153823 - RNA, 22 nt, Human
gccuggccgcuccgagcuccgc

SEQ ID NO: 153824 - RNA, 22 nt, Human
uccuugaauccuagcauccuau

SEQ ID NO: 153825 - RNA, 22 nt, Human
aguacuuuacuucuuacaguuu

SEQ ID NO: 153826 - RNA, 22 nt, Human
uggccuggggaagaccaugggc

SEQ ID NO: 153827 - RNA, 22 nt, Human
cugcccugggauggucugugcg

SEQ ID NO: 153828 - RNA, 22 nt, Human
ugggcuguccagcaccugggcu

SEQ ID NO: 153829 - RNA, 22 nt, Human
uuauuuaauuuucucacucaga

SEQ ID NO: 153830 - RNA, 22 nt, Human
caagagcuagaaauugguuaga

SEQ ID NO: 153831 - RNA, 22 nt, Human
cggagccugcuuguugcagcug

SEQ ID NO: 153832 - RNA, 22 nt, Human
ugaggggagaagcagcagccug

SEQ ID NO: 153833 - RNA, 22 nt, Human
uuuucucuacaaaauaaccagc

SEQ ID NO: 153834 - RNA, 22 nt, Human
gcauacagagaggauguggcau

SEQ ID NO: 153835 - RNA, 22 nt, Human
ccagucccaucucugucgcuua

SEQ ID NO: 153836 - RNA, 22 nt, Human
cugucuccuccacugcauggga

SEQ ID NO: 153837 - RNA, 22 nt, Human
acaaagugaauugcaucgaguu

SEQ ID NO: 153838 - RNA, 18 nt, Human
agucucagcggaggagua

SEQ ID NO: 153839 - RNA, 22 nt, Human
uuagauauguuuuugcuaaugc

SEQ ID NO: 153840 - RNA, 22 nt, Human
agagcuguucagcagccagguu

SEQ ID NO: 153841 - RNA, 18 nt, Human
uggcagggaggaaauaua

SEQ ID NO: 153842 - RNA, 22 nt, Human
cagaacugggcagggagcagag

SEQ ID NO: 153843 - RNA, 22 nt, Human
aaaauacacauacuaggggaaa

SEQ ID NO: 153844 - RNA, 22 nt, Human
cacugucuuuugugaagacaau

SEQ ID NO: 153845 - RNA, 22 nt, Human
ucagaccauccugcuguuagug

SEQ ID NO: 153846 - RNA, 22 nt, Human
cugccuugaaaaugaagcuuua

SEQ ID NO: 153847 - RNA, 22 nt, Human
auguaguauuuggaaauguaaa

SEQ ID NO: 153848 - RNA, 22 nt, Human
agagugaagguugacacuucac

SEQ ID NO: 153849 - RNA, 22 nt, Human
cuggagccaugucuugacugcu

SEQ ID NO: 153850 - RNA, 22 nt, Human
acaggagugaaucuggcacuua

SEQ ID NO: 153851 - RNA, 22 nt, Human
gaaggcuggcuuucugagagca

SEQ ID NO: 153852 - RNA, 22 nt, Human
aagccaggggcugcuuaggaga

SEQ ID NO: 153853 - RNA, 22 nt, Human
ucacaggguguacaucaccuau

SEQ ID NO: 153854 - RNA, 22 nt, Human
ugcccacauucaaaaggugaug

SEQ ID NO: 153855 - RNA, 22 nt, Human
aagcugaggcccauggcaaggu

SEQ ID NO: 153856 - RNA, 22 nt, Human
agaaaucacaggaggcagaagg

SEQ ID NO: 153857 - RNA, 22 nt, Human
uuggcugaagguuaagugcugg

SEQ ID NO: 153858 - RNA, 19 nt, Human
cugagcagcggcagcacuu

SEQ ID NO: 153859 - RNA, 22 nt, Human
aaaucaguuaagaugaggccau

SEQ ID NO: 153860 - RNA, 22 nt, Human
cagggaguuuuuguuccucuag

SEQ ID NO: 153861 - RNA, 22 nt, Human
ggcugggcaggucugcacaggg

SEQ ID NO: 153862 - RNA, 22 nt, Human
gagcucagcccaaagagcagug

SEQ ID NO: 153863 - RNA, 22 nt, Human
gaggaaaauggaguguaauuaa

SEQ ID NO: 153864 - RNA, 22 nt, Human
gggacuggaacuacuggugcag

SEQ ID NO: 153865 - RNA, 22 nt, Human
acacaugcauaagccuucccuu

SEQ ID NO: 153866 - RNA, 22 nt, Human
guucacaucacuucacugaacc

SEQ ID NO: 153867 - RNA, 22 nt, Human
uauaaaguuucgaaagauguau

SEQ ID NO: 153868 - RNA, 22 nt, Human
guguuuccaguucagaaagcaa

SEQ ID NO: 153869 - RNA, 22 nt, Human
uguggcugacuccuggucccca

SEQ ID NO: 153870 - RNA, 22 nt, Human
aggcucagagaugaguaagcac

SEQ ID NO: 153871 - RNA, 19 nt, Human
ggcagaagguguaggggga

SEQ ID NO: 153872 - RNA, 22 nt, Human
cagacaugauguaagcagaggc

SEQ ID NO: 153873 - RNA, 22 nt, Human
auaaacacuucuagggcacaca

SEQ ID NO: 153874 - RNA, 22 nt, Human
gagcugucuggggacucugggu

SEQ ID NO: 153875 - RNA, 22 nt, Human
ucauccuuuugcaugggaaggc

SEQ ID NO: 153876 - RNA, 21 nt, Human
guauucuuuaugaagugaaaa

SEQ ID NO: 153877 - RNA, 22 nt, Human
auggcagggcagccucucagag

SEQ ID NO: 153878 - RNA, 22 nt, Human
gaguuauuucagaaggaaagau

SEQ ID NO: 153879 - RNA, 18 nt, Human
ccuggagcuccacagcaa

SEQ ID NO: 153880 - RNA, 22 nt, Human
gcagcugccuauucagggcuug

SEQ ID NO: 153881 - RNA, 22 nt, Human
cagagcaggcccacugcccucc

SEQ ID NO: 153882 - RNA, 22 nt, Human
gaggaggcuggcgccgccugcc

SEQ ID NO: 153883 - RNA, 22 nt, Human
cucaggauuuacuaauuucaag

SEQ ID NO: 153884 - RNA, 22 nt, Human
ccugugcauccgguggucauug

SEQ ID NO: 153885 - RNA, 22 nt, Human
uugggcaaaguguuucuggagc

SEQ ID NO: 153886 - RNA, 22 nt, Human
caucagcaggcaacacucuugg

SEQ ID NO: 153887 - RNA, 22 nt, Human
cauuuagaaacuguuuuuaaca

SEQ ID NO: 153888 - RNA, 22 nt, Human
cuacauuuguucuauagcuuuu

SEQ ID NO: 153889 - RNA, 22 nt, Human
uggcucagccauucguguugcc

SEQ ID NO: 153890 - RNA, 22 nt, Human
cucugcuuggaacuggacagaa

SEQ ID NO: 153891 - RNA, 22 nt, Human
ccugagugaauucccucacugu

SEQ ID NO: 153892 - RNA, 17 nt, Human
cccagagaugcugccuu

SEQ ID NO: 153893 - RNA, 22 nt, Human
uccagagguauguagagaguau

SEQ ID NO: 153894 - RNA, 22 nt, Human
cucucccccacagcagccuucu

SEQ ID NO: 153895 - RNA, 22 nt, Human
aaaugcacacaccaggaaacua

SEQ ID NO: 153896 - RNA, 22 nt, Human
augagcugugggauuccagagg

SEQ ID NO: 153897 - RNA, 22 nt, Human
ucuguuccauguuuuguuccau

SEQ ID NO: 153898 - RNA, 19 nt, Human
agcagagcccugaagaucc

SEQ ID NO: 153899 - RNA, 22 nt, Human
agggcccauagaucgucagcuu

SEQ ID NO: 153900 - RNA, 22 nt, Human
cagggccucuccuccaggaacu

SEQ ID NO: 153901 - RNA, 18 nt, Human
cagggccccagaauuauc

SEQ ID NO: 153902 - RNA, 22 nt, Human
uccucccacauaggacaauggg

SEQ ID NO: 153903 - RNA, 22 nt, Human
ggggcuggcucacuaagagacu

SEQ ID NO: 153904 - RNA, 23 nt, Human
aaagacugcugagaauuuuagga

SEQ ID NO: 153905 - RNA, 22 nt, Human
ggaggcaggaaagacagguuca

SEQ ID NO: 153906 - RNA, 22 nt, Human
agagccugugggagaugcagcu

SEQ ID NO: 153907 - RNA, 22 nt, Human
uugcaggggaaggagcagagcu

SEQ ID NO: 153908 - RNA, 20 nt, Human
auauguguacguguauacau

SEQ ID NO: 153909 - RNA, 22 nt, Human
cacagaggaaaggcaguuggua

SEQ ID NO: 153910 - RNA, 22 nt, Human
gagccagguuggaggcugcagu

SEQ ID NO: 153911 - RNA, 22 nt, Human
ccuggccuccuggccuucucau

SEQ ID NO: 153912 - RNA, 22 nt, Human
aacaucuuuuuguuugcugaaa

SEQ ID NO: 153913 - RNA, 22 nt, Human
uaauuauaacaguuacaucuua

SEQ ID NO: 153914 - RNA, 22 nt, Human
uguuuauaccuugguauaacca

SEQ ID NO: 153915 - RNA, 22 nt, Human
ugucccagguccuagaugacca

SEQ ID NO: 153916 - RNA, 22 nt, Human
ugggcuggcguggagaguuuag

SEQ ID NO: 153917 - RNA, 22 nt, Human
caguacuuugaagauauuuuag

SEQ ID NO: 153918 - RNA, 22 nt, Human
accaggaggccuggagcacaaa

SEQ ID NO: 153919 - RNA, 19 nt, Human
gcauaaaaugucaaugugu

SEQ ID NO: 153920 - RNA, 22 nt, Human
ggagagcagggaggcugcucug

SEQ ID NO: 153921 - RNA, 23 nt, Human
ucagcugcuuccuccugccugcc

SEQ ID NO: 153922 - RNA, 20 nt, Human
gccagcacagggagcaguuc

SEQ ID NO: 153923 - RNA, 22 nt, Human
agcagccaauuggaggaugaag

SEQ ID NO: 153924 - RNA, 22 nt, Human
aaucaguuucuuggcaaguuua

SEQ ID NO: 153925 - RNA, 22 nt, Human
uacauacacaaauauacuguuu

SEQ ID NO: 153926 - RNA, 22 nt, Human
ucuggcucucucaucacccaau

SEQ ID NO: 153927 - RNA, 22 nt, Human
gagccuccuccuggugugccga

SEQ ID NO: 153928 - RNA, 22 nt, Human
ccagcucugcagggccuggggu

SEQ ID NO: 153929 - RNA, 21 nt, Human
ucagcagcuuuugcagucccu

SEQ ID NO: 153930 - RNA, 22 nt, Human
agcucccagaagccagagucgg

SEQ ID NO: 153931 - RNA, 22 nt, Human
cagggcccaagacacaaugagg

SEQ ID NO: 153932 - RNA, 22 nt, Human
cuucccugauaagagccucaga

SEQ ID NO: 153933 - RNA, 22 nt, Human
caguggcagagaacagagaccu

SEQ ID NO: 153934 - RNA, 22 nt, Human
gacagguggggaaacuaaggua

SEQ ID NO: 153935 - RNA, 22 nt, Human
cccaggcugaguuagagguguc

SEQ ID NO: 153936 - RNA, 22 nt, Human
ggcugcuguacugaugucaguu

SEQ ID NO: 153937 - RNA, 22 nt, Human
gcaaagucugcaucuggaucag

SEQ ID NO: 153938 - RNA, 22 nt, Human
acaggcagcacuaaucucuggu

SEQ ID NO: 153939 - RNA, 22 nt, Human
gcucaagagagaugcaguucuu

SEQ ID NO: 153940 - RNA, 22 nt, Human
uggcagaguucgcuccuauuca

SEQ ID NO: 153941 - RNA, 22 nt, Human
ccagagccuaagaucugauccu

SEQ ID NO: 153942 - RNA, 22 nt, Human
ccagcuccucuucccaguguca

SEQ ID NO: 153943 - RNA, 22 nt, Human
ggcauguuucaucacaucaaga

SEQ ID NO: 153944 - RNA, 22 nt, Human
agagagcccgggccagggcaca

SEQ ID NO: 153945 - RNA, 22 nt, Human
agcagcugccagagagaguucc

SEQ ID NO: 153946 - RNA, 22 nt, Human
ugagguguguccccagggaggu

SEQ ID NO: 153947 - RNA, 22 nt, Human
acaguuucuccauuuacaccuu

SEQ ID NO: 153948 - RNA, 22 nt, Human
ccugccagauccccugagcuga

SEQ ID NO: 153949 - RNA, 22 nt, Human
ggugcagaggagccagcugggg

SEQ ID NO: 153950 - RNA, 22 nt, Human
uggcagcagggaggccaguguu

SEQ ID NO: 153951 - RNA, 22 nt, Human
guccucuggccuuucccaggac

SEQ ID NO: 153952 - RNA, 22 nt, Human
caggcacugugcuagauccuug

SEQ ID NO: 153953 - RNA, 20 nt, Human
aaaauauguauaacucuucu

SEQ ID NO: 153954 - RNA, 22 nt, Human
ugcaccauguaaguggccacgu

SEQ ID NO: 153955 - RNA, 22 nt, Human
uaaagguaugucuuaaucaaac

SEQ ID NO: 153956 - RNA, 22 nt, Human
cuggacagaaaaggccacugga

SEQ ID NO: 153957 - RNA, 22 nt, Human
gcagugcuaaguagcuggccca

SEQ ID NO: 153958 - RNA, 22 nt, Human
caggggaagaugccaagggaga

SEQ ID NO: 153959 - RNA, 22 nt, Human
cagcccagcacuaaguagauuu

SEQ ID NO: 153960 - RNA, 22 nt, Human
gacugucauucuagugcccaug

SEQ ID NO: 153961 - RNA, 22 nt, Human
uggagccagagcgcagccuggg

SEQ ID NO: 153962 - RNA, 20 nt, Human
uguucacaguaguugcugcu

SEQ ID NO: 153963 - RNA, 22 nt, Human
ggcuucauggaggaggugaguc

SEQ ID NO: 153964 - RNA, 22 nt, Human
gggcucugggauucagagcaag

SEQ ID NO: 153965 - RNA, 22 nt, Human
uggcucagugcauucacaguaa

SEQ ID NO: 153966 - RNA, 22 nt, Human
aaggccaugcacauccuaggca

SEQ ID NO: 153967 - RNA, 22 nt, Human
ucaaagucuaucuguaauuacu

SEQ ID NO: 153968 - RNA, 20 nt, Human
ucagggcaugggacagcccc

SEQ ID NO: 153969 - RNA, 22 nt, Human
ccucagggacuccaugcugcag

SEQ ID NO: 153970 - RNA, 22 nt, Human
auuuuucucucacacuuaccag

SEQ ID NO: 153971 - RNA, 22 nt, Human
uuccauaauaaccugagagaaa

SEQ ID NO: 153972 - RNA, 22 nt, Human
auaugugugaugcauggacuaa

SEQ ID NO: 153973 - RNA, 22 nt, Human
ugcucagacaagcugaacagua

SEQ ID NO: 153974 - RNA, 22 nt, Human
ccagggucucugcugccugaga

SEQ ID NO: 153975 - RNA, 22 nt, Human
auggggugaccaugagcauuua

SEQ ID NO: 153976 - RNA, 22 nt, Human
ucaccacugaacagaccuuugg

SEQ ID NO: 153977 - RNA, 22 nt, Human
auaacagaguugggaagugaaa

SEQ ID NO: 153978 - RNA, 20 nt, Human
ccagacagcaccugccuggu

SEQ ID NO: 153979 - RNA, 22 nt, Human
cagcucaaguuucccaggucag

SEQ ID NO: 153980 - RNA, 22 nt, Human
gcugcagccaaauucauuguca

SEQ ID NO: 153981 - RNA, 22 nt, Human
uuguuucauggggauguuuauu

SEQ ID NO: 153982 - RNA, 20 nt, Human
agugccagggcaggugagag

SEQ ID NO: 153983 - RNA, 22 nt, Human
guggugcauccuugaguaagcu

SEQ ID NO: 153984 - RNA, 22 nt, Human
gaggugggaugugugugcuacu

SEQ ID NO: 153985 - RNA, 22 nt, Human
aguguguguuugggcgguuuau

SEQ ID NO: 153986 - RNA, 23 nt, Human
agccacuucuaucuugcuccugg

SEQ ID NO: 153987 - RNA, 22 nt, Human
aggcuucuuagauuggcuggag

SEQ ID NO: 153988 - RNA, 22 nt, Human
acacaggaagucagcacugaug

SEQ ID NO: 153989 - RNA, 21 nt, Human
aaagaacaggcagauguucuu

SEQ ID NO: 153990 - RNA, 22 nt, Human
gcuggccauucucuuugagaug

SEQ ID NO: 153991 - RNA, 22 nt, Human
uguccucacaggaaugaacuuu

SEQ ID NO: 153992 - RNA, 22 nt, Human
gcuuccugucccucagccauga

SEQ ID NO: 153993 - RNA, 22 nt, Human
gaaacuguauguaguuuuuggg

SEQ ID NO: 153994 - RNA, 22 nt, Human
ccuccuggcccugggccuggaa

SEQ ID NO: 153995 - RNA, 22 nt, Human
uggagggcaucuguggucaggc

SEQ ID NO: 153996 - RNA, 20 nt, Human
aaagucuuaugguuaauuuu

SEQ ID NO: 153997 - RNA, 22 nt, Human
ucaggcugagaaaaucuggacc

SEQ ID NO: 153998 - RNA, 22 nt, Human
aaaauguaaagcuugaguguag

SEQ ID NO: 153999 - RNA, 22 nt, Human
uuugacaggacuaacauauggc

SEQ ID NO: 154000 - RNA, 22 nt, Human
uugaagcaggaaaauuucuauu

SEQ ID NO: 154001 - RNA, 22 nt, Human
uggguaaacugggucuggagag

SEQ ID NO: 154002 - RNA, 22 nt, Human
cugcugggcuccucaugugacu

SEQ ID NO: 154003 - RNA, 22 nt, Human
gggcucuggaaggugcaccaug

SEQ ID NO: 154004 - RNA, 22 nt, Human
cuacugaguccuucagcugcca

SEQ ID NO: 154005 - RNA, 20 nt, Human
aguagcagugugacauugac

SEQ ID NO: 154006 - RNA, 22 nt, Human
ggugggcacauucagucucugu

SEQ ID NO: 154007 - RNA, 22 nt, Human
ggauggagaugaccauggugac

SEQ ID NO: 154008 - RNA, 20 nt, Human
gugugaagcccucaggagga

SEQ ID NO: 154009 - RNA, 22 nt, Human
aacucaguguguuucuuaguau

SEQ ID NO: 154010 - RNA, 22 nt, Human
gcuggagguuucaccugaguuu

SEQ ID NO: 154011 - RNA, 22 nt, Human
cugcagagcauaaaucugaaua

SEQ ID NO: 154012 - RNA, 22 nt, Human
ugcuggaggaguuuacuguggc

SEQ ID NO: 154013 - RNA, 22 nt, Human
uagauuucucauucauagauug

SEQ ID NO: 154014 - RNA, 22 nt, Human
ucugggagcacacgcagugauc

SEQ ID NO: 154015 - RNA, 22 nt, Human
gucccucugugucccugcaguc

SEQ ID NO: 154016 - RNA, 21 nt, Human
cugcucuggggaccggcugug

SEQ ID NO: 154017 - RNA, 22 nt, Human
uagaacagaguuccagugauca

SEQ ID NO: 154018 - RNA, 22 nt, Human
ugcagggcccuugggguugaac

SEQ ID NO: 154019 - RNA, 22 nt, Human
ggccugagcuugggcagcguau

SEQ ID NO: 154020 - RNA, 22 nt, Human
cagugucuuauuuguagcucag

SEQ ID NO: 154021 - RNA, 22 nt, Human
uccuuccugcaggccaaguccu

SEQ ID NO: 154022 - RNA, 22 nt, Human
uccaguggagugugggggugaa

SEQ ID NO: 154023 - RNA, 22 nt, Human
cugucugcuagaacaucuauac

SEQ ID NO: 154024 - RNA, 22 nt, Human
augcucuggaguacgugaaauu

SEQ ID NO: 154025 - RNA, 22 nt, Human
cugugucucuccuuacaagacu

SEQ ID NO: 154026 - RNA, 22 nt, Human
aagggcagcuuaaauugguagc

SEQ ID NO: 154027 - RNA, 22 nt, Human
aggagaguucacacuggucaga

SEQ ID NO: 154028 - RNA, 22 nt, Human
cagcugccuaugaccuagccuc

SEQ ID NO: 154029 - RNA, 22 nt, Human
aaagacugguguguuacauaua

SEQ ID NO: 154030 - RNA, 22 nt, Human
ggcuucuccagguacugagcau

SEQ ID NO: 154031 - RNA, 22 nt, Human
ucagaagacuacuaggacacau

SEQ ID NO: 154032 - RNA, 22 nt, Human
aaugggagguaguaugggaggu

SEQ ID NO: 154033 - RNA, 22 nt, Human
gggcaguggcucacgccuguaa

SEQ ID NO: 154034 - RNA, 22 nt, Human
ccagcagagggucuuggccauu

SEQ ID NO: 154035 - RNA, 22 nt, Human
ucagcagucacauguuguccca

SEQ ID NO: 154036 - RNA, 22 nt, Human
agaaaaggcuugaagagguuuu

SEQ ID NO: 154037 - RNA, 21 nt, Human
ugugucacuaacuagaggcua

SEQ ID NO: 154038 - RNA, 22 nt, Human
ugcguugcgcuccugcagcagg

SEQ ID NO: 154039 - RNA, 22 nt, Human
agcuuaggaggaugaugaacau

SEQ ID NO: 154040 - RNA, 22 nt, Human
gucugcccucacgccagcuggg

SEQ ID NO: 154041 - RNA, 22 nt, Human
cgcugccaggucaccaggggua

SEQ ID NO: 154042 - RNA, 22 nt, Human
uauguagaagcugcucaaagaa

SEQ ID NO: 154043 - RNA, 22 nt, Human
ccaggcucugucuggucagaag

SEQ ID NO: 154044 - RNA, 22 nt, Human
cugcagagaauuguggggcuuc

SEQ ID NO: 154045 - RNA, 22 nt, Human
cagcagccuacaaugcacagaa

SEQ ID NO: 154046 - RNA, 22 nt, Human
cugcugccggcgagccucccuu

SEQ ID NO: 154047 - RNA, 22 nt, Human
ugcuggcugggcugcuggagac

SEQ ID NO: 154048 - RNA, 22 nt, Human
cagggcagugaagaacacacgu

SEQ ID NO: 154049 - RNA, 22 nt, Human
cucaggauugugccuagggaga

SEQ ID NO: 154050 - RNA, 22 nt, Human
ggguccagcgacagcaggcuca

SEQ ID NO: 154051 - RNA, 22 nt, Human
cuuucacagcugugcuuaugau

SEQ ID NO: 154052 - RNA, 22 nt, Human
acagagcaauaacagggagagg

SEQ ID NO: 154053 - RNA, 22 nt, Human
aaccaggacaauuuugaaagua

SEQ ID NO: 154054 - RNA, 22 nt, Human
gcaggggaguggcaggcccgga

SEQ ID NO: 154055 - RNA, 22 nt, Human
ccacucugcugugcuccaugau

SEQ ID NO: 154056 - RNA, 21 nt, Human
uuugcauuuuacaugugggga

SEQ ID NO: 154057 - RNA, 22 nt, Human
cuggcuggucaucagcaguacg

SEQ ID NO: 154058 - RNA, 22 nt, Human
aucuggcucccuuggaauccgu

SEQ ID NO: 154059 - RNA, 22 nt, Human
augggcugugagguccggcagg

SEQ ID NO: 154060 - RNA, 22 nt, Human
acagagcaugcucaguguguga

SEQ ID NO: 154061 - RNA, 22 nt, Human
gaagcccauuuguacagcacau

SEQ ID NO: 154062 - RNA, 22 nt, Human
cccuggcagaaugucucugggc

SEQ ID NO: 154063 - RNA, 22 nt, Human
uccugggcugugugccacucug

SEQ ID NO: 154064 - RNA, 22 nt, Human
ccauaagguugaaaacuguaca

SEQ ID NO: 154065 - RNA, 22 nt, Human
uuucucuaaauagggaggcuua

SEQ ID NO: 154066 - RNA, 22 nt, Human
gaggaaaagagacagguuauug

SEQ ID NO: 154067 - RNA, 22 nt, Human
uggcucaggccuacgacgccuu

SEQ ID NO: 154068 - RNA, 22 nt, Human
cccaugccuucugacucacagg

SEQ ID NO: 154069 - RNA, 22 nt, Human
gccugggugucgaucacuagug

SEQ ID NO: 154070 - RNA, 22 nt, Human
gccagcagguugucaaggagcu

SEQ ID NO: 154071 - RNA, 22 nt, Human
aagauuuacuagcauaauagcu

SEQ ID NO: 154072 - RNA, 22 nt, Human
augggcuguccuaguccagccc

SEQ ID NO: 154073 - RNA, 22 nt, Human
uuccucucaacaugccugccgg

SEQ ID NO: 154074 - RNA, 22 nt, Human
uccuugaaugaagagaggugac

SEQ ID NO: 154075 - RNA, 22 nt, Human
agagcagugcugaagaguaggg

SEQ ID NO: 154076 - RNA, 22 nt, Human
gagccugaauuugaccugcuua

SEQ ID NO: 154077 - RNA, 22 nt, Human
aagauuuccuggauguaauucc

SEQ ID NO: 154078 - RNA, 22 nt, Human
ucccuuaaaacucauguguugu

SEQ ID NO: 154079 - RNA, 22 nt, Human
cagagcugcacauucuaugaug

SEQ ID NO: 154080 - RNA, 22 nt, Human
gcucugcugcuuacuagauggu

SEQ ID NO: 154081 - RNA, 22 nt, Human
ugccaggcccagcuccagagcu

SEQ ID NO: 154082 - RNA, 22 nt, Human
cugaagccacgauagcuuccua

SEQ ID NO: 154083 - RNA, 22 nt, Human
ucuggcucuguguccccaccca

SEQ ID NO: 154084 - RNA, 22 nt, Human
gggagcugagggaccucugugg

SEQ ID NO: 154085 - RNA, 22 nt, Human
agcagcucacaggauuccugaa

SEQ ID NO: 154086 - RNA, 22 nt, Human
cuggcucaggaaaguugcugcu

SEQ ID NO: 154087 - RNA, 22 nt, Human
ugcaucuuacguuuugaaaggg

SEQ ID NO: 154088 - RNA, 22 nt, Human
agcagggguaacagaaggaaag

SEQ ID NO: 154089 - RNA, 23 nt, Human
aacaauagguuuuggcagaauag

SEQ ID NO: 154090 - RNA, 22 nt, Human
ugcaauaacuacuuuaauguug

SEQ ID NO: 154091 - RNA, 22 nt, Human
aggagcagaacuguuguggagg

SEQ ID NO: 154092 - RNA, 22 nt, Human
uaugcacacaucgcagcaggaa

SEQ ID NO: 154093 - RNA, 22 nt, Human
uuuguuuucaaugugucauuca

SEQ ID NO: 154094 - RNA, 22 nt, Human
uuggaggcaaugggaaggaggc

SEQ ID NO: 154095 - RNA, 22 nt, Human
gcaggcagguggcaucuuguga

SEQ ID NO: 154096 - RNA, 22 nt, Human
uuauuauaaugagggauaaaaa

SEQ ID NO: 154097 - RNA, 22 nt, Human
aaggcucuuggagugaaugcag

SEQ ID NO: 154098 - RNA, 22 nt, Human
gccucugcaucaucacuccagc

SEQ ID NO: 154099 - RNA, 22 nt, Human
ugugaggagaggcccagcuccc

SEQ ID NO: 154100 - RNA, 23 nt, Human
ggguccagagacaggcaugggug

SEQ ID NO: 154101 - RNA, 22 nt, Human
agcuguguguuuccacugagcu

SEQ ID NO: 154102 - RNA, 21 nt, Human
guauugcagaguuaugugcuc

SEQ ID NO: 154103 - RNA, 22 nt, Human
augggugugaaaauggucaucu

SEQ ID NO: 154104 - RNA, 18 nt, Human
cugagggcagccccuggg

SEQ ID NO: 154105 - RNA, 22 nt, Human
uagcagugccaggauuuugcug

SEQ ID NO: 154106 - RNA, 22 nt, Human
uauucacaguugauuuacaguu

SEQ ID NO: 154107 - RNA, 22 nt, Human
acagagauguggaugagggauu

SEQ ID NO: 154108 - RNA, 19 nt, Human
ugagaaggcaguggggagc

SEQ ID NO: 154109 - RNA, 22 nt, Human
agaaaucaauaucuauauguug

SEQ ID NO: 154110 - RNA, 22 nt, Human
agcugguucauucauucauggu

SEQ ID NO: 154111 - RNA, 22 nt, Human
uacaguagaauuuuuaguaacu

SEQ ID NO: 154112 - RNA, 22 nt, Human
cagcagguauguuuguucagca

SEQ ID NO: 154113 - RNA, 22 nt, Human
ggucuuccgagaggccugugcu

SEQ ID NO: 154114 - RNA, 15 nt, Human
ugauuuccuacuaac

SEQ ID NO: 154115 - RNA, 22 nt, Human
auuguauuuccagcuugaaugu

SEQ ID NO: 154116 - RNA, 22 nt, Human
ucagaggacgcacuaggguugu

SEQ ID NO: 154117 - RNA, 22 nt, Human
aggucauuacaauuaucauuuu

SEQ ID NO: 154118 - RNA, 22 nt, Human
caggacagagcccagacugugu

SEQ ID NO: 154119 - RNA, 19 nt, Human
aggcugcaagguggugggc

SEQ ID NO: 154120 - RNA, 22 nt, Human
agaacuguccuuggaggagagu

SEQ ID NO: 154121 - RNA, 22 nt, Human
cccuucccuucugggagaucca

SEQ ID NO: 154122 - RNA, 22 nt, Human
uauuucuguaacucagggucug

SEQ ID NO: 154123 - RNA, 22 nt, Human
guggcugcucgggcuccggccc

SEQ ID NO: 154124 - RNA, 22 nt, Human
agugggcagugcgcucggaugc

SEQ ID NO: 154125 - RNA, 22 nt, Human
uucccaguauuaccuucaggaa

SEQ ID NO: 154126 - RNA, 22 nt, Human
cacacagaugguaagggaggga

SEQ ID NO: 154127 - RNA, 23 nt, Human
cugaggccugcugcguucagguu

SEQ ID NO: 154128 - RNA, 22 nt, Human
cacugaagccacuggaagagga

SEQ ID NO: 154129 - RNA, 22 nt, Human
gggcugggaauggcuaaguaug

SEQ ID NO: 154130 - RNA, 22 nt, Human
ccaggugguucaggucaccaua

SEQ ID NO: 154131 - RNA, 22 nt, Human
aagagcuggaugaagaaaucaa

SEQ ID NO: 154132 - RNA, 22 nt, Human
agcccagcagaaaguccagccu

SEQ ID NO: 154133 - RNA, 22 nt, Human
agggacaguuacaucaucagac

SEQ ID NO: 154134 - RNA, 22 nt, Human
gagcagugaagacagaaguaca

SEQ ID NO: 154135 - RNA, 22 nt, Human
gcuccagaugaaaggccagagg

SEQ ID NO: 154136 - RNA, 20 nt, Human
uuuuuccuucucuacaggca

SEQ ID NO: 154137 - RNA, 22 nt, Human
ccuuuccuuuuuagugugggag

SEQ ID NO: 154138 - RNA, 22 nt, Human
agugggcagcccaggaggucuu

SEQ ID NO: 154139 - RNA, 17 nt, Human
gagugcugguggagcuc

SEQ ID NO: 154140 - RNA, 22 nt, Human
gcucugagccgggggccugucc

SEQ ID NO: 154141 - RNA, 22 nt, Human
agcugcaggccucuccugggga

SEQ ID NO: 154142 - RNA, 22 nt, Human
gccaggcuggaaagaacagaca

SEQ ID NO: 154143 - RNA, 22 nt, Human
auguguagaacuguaaugccca

SEQ ID NO: 154144 - RNA, 22 nt, Human
gagggcugauaaaugcgcaugg

SEQ ID NO: 154145 - RNA, 20 nt, Human
gucucagaauggauuugcau

SEQ ID NO: 154146 - RNA, 23 nt, Human
uggggagaguuacccuggaagcg

SEQ ID NO: 154147 - RNA, 22 nt, Human
agugggaggcggcugacgggcg

SEQ ID NO: 154148 - RNA, 22 nt, Human
ggccugagucacaucaggagag

SEQ ID NO: 154149 - RNA, 22 nt, Human
gaacaauagugguaacaaagcc

SEQ ID NO: 154150 - RNA, 22 nt, Human
agucagcagccuggccaggaga

SEQ ID NO: 154151 - RNA, 22 nt, Human
aucuggcuuucuuaaugacuua

SEQ ID NO: 154152 - RNA, 22 nt, Human
uugugucccccuuugagagcca

SEQ ID NO: 154153 - RNA, 22 nt, Human
cagagagaggccacugcuauua

SEQ ID NO: 154154 - RNA, 22 nt, Human
gcagagcuguuaauggagcuga

SEQ ID NO: 154155 - RNA, 22 nt, Human
uggccuuccuggugacucauga

SEQ ID NO: 154156 - RNA, 22 nt, Human
ccagucccaggcagaaauccag

SEQ ID NO: 154157 - RNA, 22 nt, Human
accaggcuggagugcaguggcg

SEQ ID NO: 154158 - RNA, 18 nt, Human
uguacaguuaugagcauu

SEQ ID NO: 154159 - RNA, 22 nt, Human
auaauguagguauguguauuua

SEQ ID NO: 154160 - RNA, 22 nt, Human
cacugagaggucucauuuccaa

SEQ ID NO: 154161 - RNA, 20 nt, Human
acuuucucgguuucucaccu

SEQ ID NO: 154162 - RNA, 22 nt, Human
ucucagagaucuuucugcaugu

SEQ ID NO: 154163 - RNA, 22 nt, Human
ggcagagcugcaugagcacuca

SEQ ID NO: 154164 - RNA, 22 nt, Human
gugucauggaaaauugcaaugg

SEQ ID NO: 154165 - RNA, 22 nt, Human
ccccuuccacagugcuuccuaa

SEQ ID NO: 154166 - RNA, 22 nt, Human
gcuuccuaaaugcacagggcag

SEQ ID NO: 154167 - RNA, 22 nt, Human
uuucaaauggagucgugaaaug

SEQ ID NO: 154168 - RNA, 22 nt, Human
ccagagucuaugaguccucauu

SEQ ID NO: 154169 - RNA, 22 nt, Human
cuggcagcuucaggacacucgg

SEQ ID NO: 154170 - RNA, 22 nt, Human
cuggaugcuuccucucugcuag

SEQ ID NO: 154171 - RNA, 23 nt, Human
ucuggcucuaugugacagcucuc

SEQ ID NO: 154172 - RNA, 22 nt, Human
gagcuggcuccgccaugcugcu

SEQ ID NO: 154173 - RNA, 20 nt, Human
agugucugggccucaggccc

SEQ ID NO: 154174 - RNA, 22 nt, Human
auaauuaauuucaguaaucucc

SEQ ID NO: 154175 - RNA, 22 nt, Human
uguaucaaggguuuauguaagc

SEQ ID NO: 154176 - RNA, 22 nt, Human
ccagggcaggagaaagacucac

SEQ ID NO: 154177 - RNA, 22 nt, Human
gcugccaccguggagaugagug

SEQ ID NO: 154178 - RNA, 22 nt, Human
agcaaaguagcugcuguucuua

SEQ ID NO: 154179 - RNA, 22 nt, Human
cugggcaguuuauucaguucug

SEQ ID NO: 154180 - RNA, 22 nt, Human
uagccgggugugguggaacucc

SEQ ID NO: 154181 - RNA, 22 nt, Human
ugagccagucugucugggugaa

SEQ ID NO: 154182 - RNA, 22 nt, Human
gcugucugacuccaaguuggag

SEQ ID NO: 154183 - RNA, 22 nt, Human
gauaugaaguggcauugugaag

SEQ ID NO: 154184 - RNA, 22 nt, Human
ugugugacccccagugaagccu

SEQ ID NO: 154185 - RNA, 22 nt, Human
ugcagccaauucauucauucuu

SEQ ID NO: 154186 - RNA, 22 nt, Human
aaaugcagauuuugaugcagca

SEQ ID NO: 154187 - RNA, 22 nt, Human
gcauggcagugaggauggugcu

SEQ ID NO: 154188 - RNA, 22 nt, Human
caguuuuuagauuaguuggugg

SEQ ID NO: 154189 - RNA, 22 nt, Human
auugaaagagaauguagcucuu

SEQ ID NO: 154190 - RNA, 19 nt, Human
auuccucaaggacagaaau

SEQ ID NO: 154191 - RNA, 22 nt, Human
uacagaaaaacuggcauugaag

SEQ ID NO: 154192 - RNA, 22 nt, Human
ggaggggcagccauggaacucc

SEQ ID NO: 154193 - RNA, 22 nt, Human
ucauugcaagcucauuuaucug

SEQ ID NO: 154194 - RNA, 22 nt, Human
cuccagggggcauccacacagc

SEQ ID NO: 154195 - RNA, 22 nt, Human
guggccugccgugugguauggg

SEQ ID NO: 154196 - RNA, 22 nt, Human
uugcauugcuuggucuucaaga

SEQ ID NO: 154197 - RNA, 22 nt, Human
agggaauguagcaagaugccaa

SEQ ID NO: 154198 - RNA, 22 nt, Human
gcaaaugaguuguaacauaaaa

SEQ ID NO: 154199 - RNA, 22 nt, Human
caggcuggagugaguguagugg

SEQ ID NO: 154200 - RNA, 22 nt, Human
cagccuguagaauacaguaaau

SEQ ID NO: 154201 - RNA, 22 nt, Human
gcaggaugccagggcagcagcg

SEQ ID NO: 154202 - RNA, 22 nt, Human
ugaaaucuacccuauucagggu

SEQ ID NO: 154203 - RNA, 22 nt, Human
cucugggcuuguugaccugcac

SEQ ID NO: 154204 - RNA, 22 nt, Human
caggagcuacucagguuggguu

SEQ ID NO: 154205 - RNA, 22 nt, Human
ccugugugcacacgaggccaug

SEQ ID NO: 154206 - RNA, 23 nt, Human
uggcucuguggaucccucaggag

SEQ ID NO: 154207 - RNA, 21 nt, Human
gcucucugcaugguggcucag

SEQ ID NO: 154208 - RNA, 22 nt, Human
ggcuggcaagugucugcucaug

SEQ ID NO: 154209 - RNA, 22 nt, Human
aguauguagugcaaucagucag

SEQ ID NO: 154210 - RNA, 22 nt, Human
gccucugcugcaagccugguug

SEQ ID NO: 154211 - RNA, 22 nt, Human
ggccucucauguccugggcuuc

SEQ ID NO: 154212 - RNA, 22 nt, Human
acugagcugcuugaagugaacu

SEQ ID NO: 154213 - RNA, 22 nt, Human
ggcucaggaugagccuucucau

SEQ ID NO: 154214 - RNA, 22 nt, Human
gagggaaagguuaauacaugau

SEQ ID NO: 154215 - RNA, 22 nt, Human
cagcagcuacuuggagcagcag

SEQ ID NO: 154216 - RNA, 22 nt, Human
agaggcugagaaacccucuucu

SEQ ID NO: 154217 - RNA, 22 nt, Human
ucaggccacuucacaggugauu

SEQ ID NO: 154218 - RNA, 22 nt, Human
uucuuacuaguauguuucagca

SEQ ID NO: 154219 - RNA, 22 nt, Human
caaaugcagucccuuuguugcu

SEQ ID NO: 154220 - RNA, 22 nt, Human
gagagcugucagcguagcaccg

SEQ ID NO: 154221 - RNA, 22 nt, Human
aaaaaaucagaucuuugguuaa

SEQ ID NO: 154222 - RNA, 22 nt, Human
aucacgucaugguuugaucugg

SEQ ID NO: 154223 - RNA, 22 nt, Human
ggagccagggaagcugcuuccu

SEQ ID NO: 154224 - RNA, 19 nt, Human
gcuccugggccucacucau

SEQ ID NO: 154225 - RNA, 22 nt, Human
acaggggauugauuggaagucu

SEQ ID NO: 154226 - RNA, 22 nt, Human
ccucaggguggcaucagaucuu

SEQ ID NO: 154227 - RNA, 21 nt, Human
gcagccacugccuucaacaau

SEQ ID NO: 154228 - RNA, 22 nt, Human
ggucauuguucuuuucugugau

SEQ ID NO: 154229 - RNA, 22 nt, Human
caaagcucaugcucuuagccau

SEQ ID NO: 154230 - RNA, 22 nt, Human
ucacuuuugaucccuaugcagu

SEQ ID NO: 154231 - RNA, 21 nt, Human
gccugccugcgugacccucuu

SEQ ID NO: 154232 - RNA, 22 nt, Human
ucaaaguagggguaagccaggc

SEQ ID NO: 154233 - RNA, 20 nt, Human
ggcugcugugggcagagagg

SEQ ID NO: 154234 - RNA, 20 nt, Human
caccaggcgcucugagaaca

SEQ ID NO: 154235 - RNA, 22 nt, Human
cauggccuugagugacugcacu

SEQ ID NO: 154236 - RNA, 22 nt, Human
uggccucugcaauggauucacc

SEQ ID NO: 154237 - RNA, 22 nt, Human
uaugugcaguuugcucuuaaca

SEQ ID NO: 154238 - RNA, 22 nt, Human
gcugugcuggaaggggaccugc

SEQ ID NO: 154239 - RNA, 21 nt, Human
ccacaggggcuccccugucag

SEQ ID NO: 154240 - RNA, 22 nt, Human
ugaagcagauggucuggucauu

SEQ ID NO: 154241 - RNA, 22 nt, Human
ugggggugugccagggaccucc

SEQ ID NO: 154242 - RNA, 22 nt, Human
aggcacugggaauaugcugagg

SEQ ID NO: 154243 - RNA, 22 nt, Human
gcugugcagucuuuggugugcc

SEQ ID NO: 154244 - RNA, 22 nt, Human
gcaggagugacauggaugugga

SEQ ID NO: 154245 - RNA, 22 nt, Human
gcagagugaggaagagcuucca

SEQ ID NO: 154246 - RNA, 22 nt, Human
guuugcauuucuugaacuauau

SEQ ID NO: 154247 - RNA, 18 nt, Human
cugcugcaggcacucagg

SEQ ID NO: 154248 - RNA, 22 nt, Human
uccugccucuugccuucuucac

SEQ ID NO: 154249 - RNA, 22 nt, Human
ugagcuuacgugggaacagacu

SEQ ID NO: 154250 - RNA, 22 nt, Human
gaugcugagagguggagggaac

SEQ ID NO: 154251 - RNA, 22 nt, Human
uugaagcauuucuuugagcuuc

SEQ ID NO: 154252 - RNA, 22 nt, Human
aaggucauggcaaauuacuuuu

SEQ ID NO: 154253 - RNA, 22 nt, Human
acagaacugcaggaggaaaagc

SEQ ID NO: 154254 - RNA, 18 nt, Human
gggaagaggaucuggccc

SEQ ID NO: 154255 - RNA, 22 nt, Human
uggggccugagguggagcugca

SEQ ID NO: 154256 - RNA, 22 nt, Human
acauagcuuaaaugagaagaua

SEQ ID NO: 154257 - RNA, 22 nt, Human
acagggcagagggcaguuggua

SEQ ID NO: 154258 - RNA, 22 nt, Human
agugacugggcagggcagggcc

SEQ ID NO: 154259 - RNA, 22 nt, Human
uccugggcuugcuccuccagcu

SEQ ID NO: 154260 - RNA, 22 nt, Human
guguccacggcugagaaugauu

SEQ ID NO: 154261 - RNA, 22 nt, Human
ucugucugacaggguaugaacu

SEQ ID NO: 154262 - RNA, 22 nt, Human
aguaauaauuuauauuagggag

SEQ ID NO: 154263 - RNA, 19 nt, Human
aggcagcacccaguccuug

SEQ ID NO: 154264 - RNA, 23 nt, Human
ugggggugcacgggccacaucuu

SEQ ID NO: 154265 - RNA, 22 nt, Human
ucugccugcaguguggcagggc

SEQ ID NO: 154266 - RNA, 22 nt, Human
gaacaguaaauuuaugcagcac

SEQ ID NO: 154267 - RNA, 22 nt, Human
cucugggcaggaccaguggacc

SEQ ID NO: 154268 - RNA, 22 nt, Human
cucuguccuaugcuugauagaa

SEQ ID NO: 154269 - RNA, 22 nt, Human
ugcccaaguguuuggcugaguc

SEQ ID NO: 154270 - RNA, 22 nt, Human
ucagcuccucaugcaggggaua

SEQ ID NO: 154271 - RNA, 22 nt, Human
uccuucaguuaaagaucucaca

SEQ ID NO: 154272 - RNA, 22 nt, Human
cucagggacguuagaggacagg

SEQ ID NO: 154273 - RNA, 22 nt, Human
ccuccagguguuacauaugacu

SEQ ID NO: 154274 - RNA, 19 nt, Human
gggcuucugggaucaagag

SEQ ID NO: 154275 - RNA, 22 nt, Human
agcagggccucuggcacugguc

SEQ ID NO: 154276 - RNA, 22 nt, Human
aagucacagcuaaauagcuaag

SEQ ID NO: 154277 - RNA, 22 nt, Human
aguggggagguccaggccaccc

SEQ ID NO: 154278 - RNA, 19 nt, Human
acccagagcccuuugcagg

SEQ ID NO: 154279 - RNA, 22 nt, Human
acacagggaggaggugcugugc

SEQ ID NO: 154280 - RNA, 22 nt, Human
agggagccagaguugggagcuc

SEQ ID NO: 154281 - RNA, 22 nt, Human
gagagcuggguucaaguagcug

SEQ ID NO: 154282 - RNA, 22 nt, Human
ggcagcugggucacaccgaucu

SEQ ID NO: 154283 - RNA, 22 nt, Human
cucuccagccacagaagcugcu

SEQ ID NO: 154284 - RNA, 22 nt, Human
aggcaguguguagcuggaagag

SEQ ID NO: 154285 - RNA, 19 nt, Human
cagaguccuugaccagucc

SEQ ID NO: 154286 - RNA, 22 nt, Human
uugugaaauguuucaaaauagu

SEQ ID NO: 154287 - RNA, 22 nt, Human
ccagucccagcucugccaugcu

SEQ ID NO: 154288 - RNA, 22 nt, Human
uccagggaucuuuagagucuuu

SEQ ID NO: 154289 - RNA, 22 nt, Human
acagaguaucuaucaggaguau

SEQ ID NO: 154290 - RNA, 22 nt, Human
aagcccaguuucacacugagac

SEQ ID NO: 154291 - RNA, 22 nt, Human
acagagccaaaaggacauagua

SEQ ID NO: 154292 - RNA, 22 nt, Human
ccugggcaacauagugagaccu

SEQ ID NO: 154293 - RNA, 22 nt, Human
cauuucugucacguucuuuuau

SEQ ID NO: 154294 - RNA, 22 nt, Human
agagcuguuuggacaucugagu

SEQ ID NO: 154295 - RNA, 22 nt, Human
cagcuccugccugggcagcugu

SEQ ID NO: 154296 - RNA, 22 nt, Human
acauguuagaaaugcagaaucu

SEQ ID NO: 154297 - RNA, 22 nt, Human
ggagagagaugccgccuugcuc

SEQ ID NO: 154298 - RNA, 22 nt, Human
ggcugcuggggacgugggagag

SEQ ID NO: 154299 - RNA, 22 nt, Human
gggaguggauuauguggaccca

SEQ ID NO: 154300 - RNA, 22 nt, Human
gagaaagcuucuuucccacagg

SEQ ID NO: 154301 - RNA, 22 nt, Human
cgccaggcuugguagcucaugc

SEQ ID NO: 154302 - RNA, 22 nt, Human
aguaaugugccugaaauacuug

SEQ ID NO: 154303 - RNA, 22 nt, Human
gccucugccaagggggcugcgg

SEQ ID NO: 154304 - RNA, 22 nt, Human
cagguggggcagcugugggagc

SEQ ID NO: 154305 - RNA, 22 nt, Human
gugggccuugcagggugcaggg

SEQ ID NO: 154306 - RNA, 22 nt, Human
uacauuccacuagugacuggcg

SEQ ID NO: 154307 - RNA, 22 nt, Human
cagagugaaauaggggaucaag

SEQ ID NO: 154308 - RNA, 22 nt, Human
aaaaacuguaauuacuuuugca

SEQ ID NO: 154309 - RNA, 22 nt, Human
ccagagccggauugugaagugc

SEQ ID NO: 154310 - RNA, 22 nt, Human
agcugcaguaaagcucuccagg

SEQ ID NO: 154311 - RNA, 22 nt, Human
aggggccuggacauggacgcgc

SEQ ID NO: 154312 - RNA, 22 nt, Human
ggagugaaucacuagaugcaga

SEQ ID NO: 154313 - RNA, 23 nt, Human
gcagaggagcaagcuggacacca

SEQ ID NO: 154314 - RNA, 22 nt, Human
gccuuccugcagcucugagcgu

SEQ ID NO: 154315 - RNA, 22 nt, Human
aggggcuguggaaaccaacucu

SEQ ID NO: 154316 - RNA, 22 nt, Human
agcugcuguggggcucggccug

SEQ ID NO: 154317 - RNA, 22 nt, Human
ugccugagugauguggcagcca

SEQ ID NO: 154318 - RNA, 22 nt, Human
auggcaggcccagguguucauu

SEQ ID NO: 154319 - RNA, 21 nt, Human
guggcucugccaggacugaaa

SEQ ID NO: 154320 - RNA, 22 nt, Human
ugagccugaguucaaggcugca

SEQ ID NO: 154321 - RNA, 22 nt, Human
uccucuucugcccaucagaggc

SEQ ID NO: 154322 - RNA, 22 nt, Human
ccaggccagcaggcacaccugc

SEQ ID NO: 154323 - RNA, 22 nt, Human
uggccgggccgggcgccuccac

SEQ ID NO: 154324 - RNA, 22 nt, Human
ucugaggcuaagagacagaggc

SEQ ID NO: 154325 - RNA, 22 nt, Human
cuccagaagacccauccucaug

SEQ ID NO: 154326 - RNA, 17 nt, Human
gcucccugaggacagcu

SEQ ID NO: 154327 - RNA, 22 nt, Human
acaaagcuagagaagagaauug

SEQ ID NO: 154328 - RNA, 18 nt, Human
ggccugaggauuucagca

SEQ ID NO: 154329 - RNA, 22 nt, Human
gacauucacagguaaacauucc

SEQ ID NO: 154330 - RNA, 22 nt, Human
gagacauggcaaaagcacuggu

SEQ ID NO: 154331 - RNA, 22 nt, Human
gccaugccugugucuccaggcc

SEQ ID NO: 154332 - RNA, 22 nt, Human
ggcacugacugugcagcgcacc

SEQ ID NO: 154333 - RNA, 22 nt, Human
aaguguuaaaagauuaaaugcu

SEQ ID NO: 154334 - RNA, 22 nt, Human
auuugucuucaguagguucuuc

SEQ ID NO: 154335 - RNA, 19 nt, Human
uaaaaugucuguggucagu

SEQ ID NO: 154336 - RNA, 22 nt, Human
ccugagagcauuccacacugaa

SEQ ID NO: 154337 - RNA, 21 nt, Human
agcagcugggcaacauggagg

SEQ ID NO: 154338 - RNA, 22 nt, Human
gcaaaugcucuccuuggucagg

SEQ ID NO: 154339 - RNA, 22 nt, Human
gcugggcugagcuagacuuggc

SEQ ID NO: 154340 - RNA, 19 nt, Human
agucccaggcccgaaagag

SEQ ID NO: 154341 - RNA, 22 nt, Human
accaaggaagaaucuauuugag

SEQ ID NO: 154342 - RNA, 22 nt, Human
ggcugcagcagagggacucacg

SEQ ID NO: 154343 - RNA, 22 nt, Human
uacaaacuuguuuuaaguaagu

SEQ ID NO: 154344 - RNA, 22 nt, Human
aggaaagggguagguguggacg

SEQ ID NO: 154345 - RNA, 22 nt, Human
guccugggccugcugaggcuga

SEQ ID NO: 154346 - RNA, 19 nt, Human
acagaaauguaagugagac

SEQ ID NO: 154347 - RNA, 22 nt, Human
cauggccucaaaggacugcaga

SEQ ID NO: 154348 - RNA, 22 nt, Human
ucaggcagagcuguggagcucu

SEQ ID NO: 154349 - RNA, 22 nt, Human
cuggagaggcugggaacagguu

SEQ ID NO: 154350 - RNA, 22 nt, Human
aggugcuggagucugggcagga

SEQ ID NO: 154351 - RNA, 22 nt, Human
cagggccauaucuugugcacca

SEQ ID NO: 154352 - RNA, 21 nt, Human
aaagagguuaauauuguaagu

SEQ ID NO: 154353 - RNA, 20 nt, Human
uuugagaccagucugcccaa

SEQ ID NO: 154354 - RNA, 22 nt, Human
uggccugggcaugaagcaucgu

SEQ ID NO: 154355 - RNA, 23 nt, Human
cccagagcacagccuccagaugc

SEQ ID NO: 154356 - RNA, 22 nt, Human
cauggacucugguuuggggagc

SEQ ID NO: 154357 - RNA, 22 nt, Human
cugagccagcgggcucacuuuu

SEQ ID NO: 154358 - RNA, 22 nt, Human
aguaggaggcgggagcaugaag

SEQ ID NO: 154359 - RNA, 22 nt, Human
ucucaggcuaccuugcacaagg

SEQ ID NO: 154360 - RNA, 22 nt, Human
agucccagcccaguccuguaag

SEQ ID NO: 154361 - RNA, 22 nt, Human
ugauuuccaugaagcugaaggc

SEQ ID NO: 154362 - RNA, 22 nt, Human
cacagcuucugagugaggauuu

SEQ ID NO: 154363 - RNA, 19 nt, Human
ggaccagguccugggcagc

SEQ ID NO: 154364 - RNA, 21 nt, Human
gagcauggcuuacaucagcag

SEQ ID NO: 154365 - RNA, 22 nt, Human
uggugccuugggccuacagcgc

SEQ ID NO: 154366 - RNA, 22 nt, Human
caagauggacauaaggagagaa

SEQ ID NO: 154367 - RNA, 22 nt, Human
acagaaauaacuuuuuauguuu

SEQ ID NO: 154368 - RNA, 22 nt, Human
cagccaucaguaaagacagcuu

SEQ ID NO: 154369 - RNA, 18 nt, Human
aggcuucccaggcaggcc

SEQ ID NO: 154370 - RNA, 22 nt, Human
ccuuucucuaucgacccaucgc

SEQ ID NO: 154371 - RNA, 22 nt, Human
uccagucaucucccuucacauu

SEQ ID NO: 154372 - RNA, 22 nt, Human
caggcagggagcuggaaaggau

SEQ ID NO: 154373 - RNA, 22 nt, Human
uccauuuuguagguaugcuaca

SEQ ID NO: 154374 - RNA, 22 nt, Human
ugggggugacuaucucgggaau

SEQ ID NO: 154375 - RNA, 22 nt, Human
agugugggugagggaggcccuc

SEQ ID NO: 154376 - RNA, 22 nt, Human
ggggacaguuaaagaccaagac

SEQ ID NO: 154377 - RNA, 22 nt, Human
ccaagggcucugacuugccugc

SEQ ID NO: 154378 - RNA, 19 nt, Human
auaaggcaauuggauuugg

SEQ ID NO: 154379 - RNA, 22 nt, Human
uccuggguccauggcagccgaa

SEQ ID NO: 154380 - RNA, 22 nt, Human
cauugcuguuaauugucucuag

SEQ ID NO: 154381 - RNA, 22 nt, Human
ggccaagauggaaggagagaug

SEQ ID NO: 154382 - RNA, 22 nt, Human
caaugauggcuaggcagcugcu

SEQ ID NO: 154383 - RNA, 20 nt, Human
aagagcauaguacaggaaga

SEQ ID NO: 154384 - RNA, 22 nt, Human
ggaggccuagccagcuccaguu

SEQ ID NO: 154385 - RNA, 22 nt, Human
uuucuuaggcucuaaaaugacu

SEQ ID NO: 154386 - RNA, 22 nt, Human
agcuccugcacccagccuugag

SEQ ID NO: 154387 - RNA, 22 nt, Human
uaagaacauuuucggaaagaua

SEQ ID NO: 154388 - RNA, 22 nt, Human
cuggguggaaagugcugagaau

SEQ ID NO: 154389 - RNA, 22 nt, Human
ugucccagaucacaggagggga

SEQ ID NO: 154390 - RNA, 22 nt, Human
aauguacaauaagacaaagagg

SEQ ID NO: 154391 - RNA, 22 nt, Human
gggauggcucaaaggagucagg

SEQ ID NO: 154392 - RNA, 22 nt, Human
gcugucacaucaaggcacuaaa

SEQ ID NO: 154393 - RNA, 22 nt, Human
guggcccugucccaggccuccu

SEQ ID NO: 154394 - RNA, 22 nt, Human
aggccugaggaccagauaaaug

SEQ ID NO: 154395 - RNA, 19 nt, Human
ucucaauguucagaaagcu

SEQ ID NO: 154396 - RNA, 22 nt, Human
aagauuuaccacuuuauucaag

SEQ ID NO: 154397 - RNA, 22 nt, Human
ccucucaucauuaucgcuuugu

SEQ ID NO: 154398 - RNA, 22 nt, Human
uggcagcuccggguaggggcug

SEQ ID NO: 154399 - RNA, 22 nt, Human
uuugcauuguaauauuuaguuc

SEQ ID NO: 154400 - RNA, 22 nt, Human
gcucugcuugcaucaugacugc

SEQ ID NO: 154401 - RNA, 22 nt, Human
cauugcaccacauugcaucccu

SEQ ID NO: 154402 - RNA, 22 nt, Human
gagcugccuacauugccaagag

SEQ ID NO: 154403 - RNA, 22 nt, Human
cuuuauguucaguacaaugcuu

SEQ ID NO: 154404 - RNA, 22 nt, Human
ccugggugucaugggcagcugg

SEQ ID NO: 154405 - RNA, 19 nt, Human
ggccaggcugacugugguc

SEQ ID NO: 154406 - RNA, 22 nt, Human
ugaugggacugccagcugcuga

SEQ ID NO: 154407 - RNA, 20 nt, Human
ucugcucagcccucaguggc

SEQ ID NO: 154408 - RNA, 22 nt, Human
ggaggccaaggugggcggauca

SEQ ID NO: 154409 - RNA, 22 nt, Human
cugaggccagcugcagagcucu

SEQ ID NO: 154410 - RNA, 22 nt, Human
ugcuguagcccugcacagugca

SEQ ID NO: 154411 - RNA, 22 nt, Human
uacuacauuaauaaaacauuca

SEQ ID NO: 154412 - RNA, 22 nt, Human
caagaugaucccugaaggcagc

SEQ ID NO: 154413 - RNA, 22 nt, Human
uucaaugagcccaagaacguga

SEQ ID NO: 154414 - RNA, 22 nt, Human
aggccagggucccacacucgca

SEQ ID NO: 154415 - RNA, 22 nt, Human
ccugccugcguccucugagggc

SEQ ID NO: 154416 - RNA, 22 nt, Human
gucuggagccacccuaagcauu

SEQ ID NO: 154417 - RNA, 22 nt, Human
ugagccuggccugcagagacca

SEQ ID NO: 154418 - RNA, 21 nt, Human
uuguucuuccagaagcaaagu

SEQ ID NO: 154419 - RNA, 22 nt, Human
cuacauuuggagaguauaggaa

SEQ ID NO: 154420 - RNA, 22 nt, Human
cugagagucagcuucuccuccu

SEQ ID NO: 154421 - RNA, 23 nt, Human
gccuucagcucgggaaggcuccc

SEQ ID NO: 154422 - RNA, 22 nt, Human
gccugguggacacugggcauca

SEQ ID NO: 154423 - RNA, 22 nt, Human
ccaggcuggauuuugcaguuca

SEQ ID NO: 154424 - RNA, 22 nt, Human
aacaaaugaccugauuucuucc

SEQ ID NO: 154425 - RNA, 22 nt, Human
cccaggaggcagagguugcagu

SEQ ID NO: 154426 - RNA, 22 nt, Human
aggcuccaugcaaaggcuguuu

SEQ ID NO: 154427 - RNA, 22 nt, Human
gcugagagcaaagcaugucuag

SEQ ID NO: 154428 - RNA, 22 nt, Human
ucccccacucuaaaggagccuu

SEQ ID NO: 154429 - RNA, 22 nt, Human
ugggcuggugagggaucauuua

SEQ ID NO: 154430 - RNA, 22 nt, Human
caccaucagcagcaggugucaa

SEQ ID NO: 154431 - RNA, 22 nt, Human
uccagggaugguaaugagcagu

SEQ ID NO: 154432 - RNA, 22 nt, Human
agcagcuggggccugugacgau

SEQ ID NO: 154433 - RNA, 22 nt, Human
ucaaagucauggcaggcucaga

SEQ ID NO: 154434 - RNA, 22 nt, Human
gcucaaggcaggcagacaugag

SEQ ID NO: 154435 - RNA, 22 nt, Human
caggccucaggggcucaggcug

SEQ ID NO: 154436 - RNA, 22 nt, Human
cuuauguacacacauauauugu

SEQ ID NO: 154437 - RNA, 22 nt, Human
uuuccucuuccgagggggaggc

SEQ ID NO: 154438 - RNA, 22 nt, Human
gaaacccaaacuaagacaguag

SEQ ID NO: 154439 - RNA, 22 nt, Human
cuggggugagcagaaacagggg

SEQ ID NO: 154440 - RNA, 22 nt, Human
uggcagcugucuguggggucuc

SEQ ID NO: 154441 - RNA, 22 nt, Human
acugccaggauggcacuagagg

SEQ ID NO: 154442 - RNA, 23 nt, Human
uuucuguuggguauauauccaag

SEQ ID NO: 154443 - RNA, 22 nt, Human
cagcagagcauuugguaggagg

SEQ ID NO: 154444 - RNA, 22 nt, Human
cccuggagucagguuggccugg

SEQ ID NO: 154445 - RNA, 22 nt, Human
agccaggauggucucgaucggc

SEQ ID NO: 154446 - RNA, 22 nt, Human
ccagagacgucggucagggcgc

SEQ ID NO: 154447 - RNA, 22 nt, Human
uugauacaggccuucuagauga

SEQ ID NO: 154448 - RNA, 21 nt, Human
agcugagcccagaagacuggu

SEQ ID NO: 154449 - RNA, 23 nt, Human
ccuggcuggauucucugcauuca

SEQ ID NO: 154450 - RNA, 22 nt, Human
ucuguagcaagugagaggcauu

SEQ ID NO: 154451 - RNA, 22 nt, Human
agcagcuguacuuucaucuguu

SEQ ID NO: 154452 - RNA, 22 nt, Human
uguccugcaacugaaggagaag

SEQ ID NO: 154453 - RNA, 22 nt, Human
ccuugcaggggaacaggcagug

SEQ ID NO: 154454 - RNA, 22 nt, Human
uacauuaucuuguuaucuuuca

SEQ ID NO: 154455 - RNA, 21 nt, Human
uguucacauggagcagaaugu

SEQ ID NO: 154456 - RNA, 17 nt, Human
uagagcugguucaggag

SEQ ID NO: 154457 - RNA, 22 nt, Human
uuccagaauuuuguucugcuug

SEQ ID NO: 154458 - RNA, 22 nt, Human
uggagggcucuuucaccuggua

SEQ ID NO: 154459 - RNA, 22 nt, Human
aggaaucccgcaccagcugcug

SEQ ID NO: 154460 - RNA, 22 nt, Human
ucucccagaggaucccagugga

SEQ ID NO: 154461 - RNA, 22 nt, Human
cuggccacuggagguggcaccc

SEQ ID NO: 154462 - RNA, 22 nt, Human
cuuguacauagagaagaagccu

SEQ ID NO: 154463 - RNA, 22 nt, Human
cagcacuggggggauucggagc

SEQ ID NO: 154464 - RNA, 21 nt, Human
ccuccaggugauuccgugcuc

SEQ ID NO: 154465 - RNA, 22 nt, Human
agccacagagcaggagaccuuu

SEQ ID NO: 154466 - RNA, 22 nt, Human
aaauaauuauagcgagucuauc

SEQ ID NO: 154467 - RNA, 22 nt, Human
auucagcauaaucaguagcuug

SEQ ID NO: 154468 - RNA, 23 nt, Human
auucuucauuaucuucuagaaaa

SEQ ID NO: 154469 - RNA, 22 nt, Human
auugcagcuggucaggguaauu

SEQ ID NO: 154470 - RNA, 22 nt, Human
cugggagagaagcgaagcuggg

SEQ ID NO: 154471 - RNA, 22 nt, Human
gugucccaaagauuagaaauca

SEQ ID NO: 154472 - RNA, 22 nt, Human
gugcagagaaaugagaagucga

SEQ ID NO: 154473 - RNA, 22 nt, Human
uuaaacagacaguaaaugaaac

SEQ ID NO: 154474 - RNA, 22 nt, Human
agugucauuuuguccaucuucu

SEQ ID NO: 154475 - RNA, 22 nt, Human
accacugcccauggugaaaacu

SEQ ID NO: 154476 - RNA, 22 nt, Human
uuggccuuaaccucucugugcc

SEQ ID NO: 154477 - RNA, 22 nt, Human
ccaaagugcugagauuacaggu

SEQ ID NO: 154478 - RNA, 22 nt, Human
ugggcugcccaagguggccaug

SEQ ID NO: 154479 - RNA, 22 nt, Human
guccucugggagccuugagccu

SEQ ID NO: 154480 - RNA, 22 nt, Human
ggaggaugagcuacgaggagcu

SEQ ID NO: 154481 - RNA, 22 nt, Human
uggguagagacacagucugggg

SEQ ID NO: 154482 - RNA, 22 nt, Human
cagcuuccaucuccacugcccu

SEQ ID NO: 154483 - RNA, 22 nt, Human
aggcuuccucgugccuuagaua

SEQ ID NO: 154484 - RNA, 22 nt, Human
uuugcauugcauuaaguauucu

SEQ ID NO: 154485 - RNA, 22 nt, Human
cagcagggcccccgggugcgcc

SEQ ID NO: 154486 - RNA, 22 nt, Human
uaaugcacauagaaguacuuag

SEQ ID NO: 154487 - RNA, 22 nt, Human
acccaggagcaggcugggcagu

SEQ ID NO: 154488 - RNA, 22 nt, Human
aagagagaacucccuucgccag

SEQ ID NO: 154489 - RNA, 22 nt, Human
ccugucuguccucucaugagcc

SEQ ID NO: 154490 - RNA, 22 nt, Human
ggcagggucuggacugaaagcu

SEQ ID NO: 154491 - RNA, 22 nt, Human
ucuuuacaucacaauuguaugg

SEQ ID NO: 154492 - RNA, 22 nt, Human
gcuggcuguguuucaucucuga

SEQ ID NO: 154493 - RNA, 22 nt, Human
aggcccuggguuagggcccacu

SEQ ID NO: 154494 - RNA, 22 nt, Human
caagggcucacggucugcuggg

SEQ ID NO: 154495 - RNA, 22 nt, Human
uaagauaugguaggaaguuugg

SEQ ID NO: 154496 - RNA, 22 nt, Human
aggcuggguaccugucauaugc

SEQ ID NO: 154497 - RNA, 22 nt, Human
uuccaguugguagaauguaagg

SEQ ID NO: 154498 - RNA, 21 nt, Human
gcacagugccaggcacacagu

SEQ ID NO: 154499 - RNA, 22 nt, Human
cagcuggcuccaccucugggcu

SEQ ID NO: 154500 - RNA, 22 nt, Human
ucugucaccgagggcauccaaa

SEQ ID NO: 154501 - RNA, 22 nt, Human
ggcugagcucaggggcagcagg

SEQ ID NO: 154502 - RNA, 22 nt, Human
agagcugcaggguggacccagg

SEQ ID NO: 154503 - RNA, 22 nt, Human
uggcagcaguggagguagaaag

SEQ ID NO: 154504 - RNA, 22 nt, Human
ggcccuguccuggcugucuccg

SEQ ID NO: 154505 - RNA, 22 nt, Human
gcagagguggcaucugggcucu

SEQ ID NO: 154506 - RNA, 22 nt, Human
uccaaacacccuccaugcugca

SEQ ID NO: 154507 - RNA, 21 nt, Human
ugaggcuguuguaccagggag

SEQ ID NO: 154508 - RNA, 22 nt, Human
ucauccaguuguggagagggaa

SEQ ID NO: 154509 - RNA, 22 nt, Human
cagcaguguacaaggugucaga

SEQ ID NO: 154510 - RNA, 22 nt, Human
caguggaggcucaagugugcuu

SEQ ID NO: 154511 - RNA, 22 nt, Human
uggcgugcccuccagacuuggc

SEQ ID NO: 154512 - RNA, 22 nt, Human
uagagaaaagcagggaucagga

SEQ ID NO: 154513 - RNA, 22 nt, Human
cauaccuuucucaagcacaugu

SEQ ID NO: 154514 - RNA, 22 nt, Human
cagcagcugcgugcccaggccg

SEQ ID NO: 154515 - RNA, 22 nt, Human
gccuggagggcucuagagaggc

SEQ ID NO: 154516 - RNA, 22 nt, Human
ucagaguggugguuuugccuuc

SEQ ID NO: 154517 - RNA, 22 nt, Human
agaagcagacucugaggcaagg

SEQ ID NO: 154518 - RNA, 22 nt, Human
cucagaguccccacaucugggu

SEQ ID NO: 154519 - RNA, 22 nt, Human
caagggcucuuuugaggaaugu

SEQ ID NO: 154520 - RNA, 22 nt, Human
uaaaugcaaugugcuuuaccag

SEQ ID NO: 154521 - RNA, 22 nt, Human
gagauuggccuggcuugccaac

SEQ ID NO: 154522 - RNA, 22 nt, Human
agaagccacuggagguugagau

SEQ ID NO: 154523 - RNA, 22 nt, Human
augguuuguguggcccagauga

SEQ ID NO: 154524 - RNA, 22 nt, Human
gcccagcagcugguggagaagg

SEQ ID NO: 154525 - RNA, 22 nt, Human
aagccagggauuccugagggag

SEQ ID NO: 154526 - RNA, 22 nt, Human
cagcaauaagccagguuagaca

SEQ ID NO: 154527 - RNA, 22 nt, Human
auuugucuuugagugcccugcu

SEQ ID NO: 154528 - RNA, 22 nt, Human
caagagcuuuagaaaugcucau

SEQ ID NO: 154529 - RNA, 22 nt, Human
gguggcagucuuaagagaucuu

SEQ ID NO: 154530 - RNA, 22 nt, Human
cugagccagcuggcaugugcua

SEQ ID NO: 154531 - RNA, 22 nt, Human
augggaggcaggcucagaaccg

SEQ ID NO: 154532 - RNA, 21 nt, Human
uggcucugagccucauggcug

SEQ ID NO: 154533 - RNA, 22 nt, Human
uguauuuugugaggaucacucu

SEQ ID NO: 154534 - RNA, 22 nt, Human
accugccucuaagcagcaggug

SEQ ID NO: 154535 - RNA, 22 nt, Human
ggagcugggaauuggaucaucu

SEQ ID NO: 154536 - RNA, 22 nt, Human
ugucaccaguuccaggaaauaa

SEQ ID NO: 154537 - RNA, 22 nt, Human
cugagccagagggagucggguc

SEQ ID NO: 154538 - RNA, 22 nt, Human
caggguccaucuuucaucacug

SEQ ID NO: 154539 - RNA, 22 nt, Human
gagcuuccugaugccgaccagu

SEQ ID NO: 154540 - RNA, 22 nt, Human
ccugcagcuccggauuucuggg

SEQ ID NO: 154541 - RNA, 19 nt, Human
uggcaggcccaggauggac

SEQ ID NO: 154542 - RNA, 22 nt, Human
gucucagauaacauguauucua

SEQ ID NO: 154543 - RNA, 22 nt, Human
gcucagaggcacgaccucuugg

SEQ ID NO: 154544 - RNA, 22 nt, Human
ucugcucagugcuuaucucuaa

SEQ ID NO: 154545 - RNA, 22 nt, Human
aucuggcuccuacacuugaaga

SEQ ID NO: 154546 - RNA, 22 nt, Human
uccuguaguugcuaaguuuguu

SEQ ID NO: 154547 - RNA, 22 nt, Human
auacuuacuuuucuucagacua

SEQ ID NO: 154548 - RNA, 22 nt, Human
auggaaagggaagcaaggaaca

SEQ ID NO: 154549 - RNA, 22 nt, Human
agugaccauuuucagcuagagg

SEQ ID NO: 154550 - RNA, 22 nt, Human
cccagccucugggcucacccaa

SEQ ID NO: 154551 - RNA, 22 nt, Human
gccgaagcugccgucugguccu

SEQ ID NO: 154552 - RNA, 22 nt, Human
ggcagcugauuagcaucaagga

SEQ ID NO: 154553 - RNA, 22 nt, Human
agcagugggugacagagcugag

SEQ ID NO: 154554 - RNA, 22 nt, Human
uaaaucacuccuaauaaucagu

SEQ ID NO: 154555 - RNA, 22 nt, Human
agaaauguuuauggcugccuau

SEQ ID NO: 154556 - RNA, 22 nt, Human
cccaagggagugccuggucaac

SEQ ID NO: 154557 - RNA, 22 nt, Human
ggucagccuuggauuugguagc

SEQ ID NO: 154558 - RNA, 22 nt, Human
aggcucauucuugccucugagc

SEQ ID NO: 154559 - RNA, 22 nt, Human
gguccuggaaauugacggaaag

SEQ ID NO: 154560 - RNA, 22 nt, Human
cagcuugcuaauuuugacuuca

SEQ ID NO: 154561 - RNA, 22 nt, Human
uggccuugggcagguggccugc

SEQ ID NO: 154562 - RNA, 22 nt, Human
ccagccaguccagcauuggugu

SEQ ID NO: 154563 - RNA, 22 nt, Human
uggcagaguggaccauacucaa

SEQ ID NO: 154564 - RNA, 22 nt, Human
uccugcagagacagaggccuca

SEQ ID NO: 154565 - RNA, 22 nt, Human
cuuacauugucuuaguuuucaa

SEQ ID NO: 154566 - RNA, 22 nt, Human
uucacaggcuuggagguggggg

SEQ ID NO: 154567 - RNA, 22 nt, Human
gggcugggcaugguguucccuc

SEQ ID NO: 154568 - RNA, 22 nt, Human
uuuuccuacugauaaacaguua

SEQ ID NO: 154569 - RNA, 22 nt, Human
uacauguaggugacauuuuaau

SEQ ID NO: 154570 - RNA, 22 nt, Human
ucucuccuuaucauuguguuua

SEQ ID NO: 154571 - RNA, 22 nt, Human
augaaggauggcuggcugcccu

SEQ ID NO: 154572 - RNA, 22 nt, Human
cuuugaaaacuuaaauaacagc

SEQ ID NO: 154573 - RNA, 22 nt, Human
gcugcaggcauuuuccugggca

SEQ ID NO: 154574 - RNA, 19 nt, Human
ccugggaggcggagguugc

SEQ ID NO: 154575 - RNA, 22 nt, Human
uggcagagaacacacaugauuc

SEQ ID NO: 154576 - RNA, 22 nt, Human
uguaggaguccaaucaggagac

SEQ ID NO: 154577 - RNA, 22 nt, Human
ccacaggggucucuguagcuga

SEQ ID NO: 154578 - RNA, 22 nt, Human
gaugcacagugacccugccagu

SEQ ID NO: 154579 - RNA, 22 nt, Human
ugcagcucauugcuggggucug

SEQ ID NO: 154580 - RNA, 22 nt, Human
gcugucacucuccggccuuccc

SEQ ID NO: 154581 - RNA, 22 nt, Human
agggcccucuggcaggccaggc

SEQ ID NO: 154582 - RNA, 22 nt, Human
ccugggcuucugucuagauguu

SEQ ID NO: 154583 - RNA, 22 nt, Human
ucagcugccuuucccaugcuag

SEQ ID NO: 154584 - RNA, 22 nt, Human
agagccugggaauuugcauguu

SEQ ID NO: 154585 - RNA, 22 nt, Human
uggcccugcuguaucaucugcu

SEQ ID NO: 154586 - RNA, 22 nt, Human
acaguaauuaaaauggaucugc

SEQ ID NO: 154587 - RNA, 22 nt, Human
uggagcauauucuggagcuugg

SEQ ID NO: 154588 - RNA, 22 nt, Human
ucaggagcagcaugggugagag

SEQ ID NO: 154589 - RNA, 22 nt, Human
cagagcucagagcagggcacuc

SEQ ID NO: 154590 - RNA, 22 nt, Human
ggaggugguggcagugacaauu

SEQ ID NO: 154591 - RNA, 22 nt, Human
cagcauggggaucacuguaggc

SEQ ID NO: 154592 - RNA, 22 nt, Human
caggcuugcugcuagagcacuu

SEQ ID NO: 154593 - RNA, 20 nt, Human
uggcuccugcgguggaacca

SEQ ID NO: 154594 - RNA, 22 nt, Human
guguuuccucuagaagccaugg

SEQ ID NO: 154595 - RNA, 23 nt, Human
agagcuuagggaauucacaugag

SEQ ID NO: 154596 - RNA, 22 nt, Human
aagaacaguguccugggacucg

SEQ ID NO: 154597 - RNA, 22 nt, Human
uuagcucagaaaauuuaaacuu

SEQ ID NO: 154598 - RNA, 22 nt, Human
ugucccaguuuaucugggacug

SEQ ID NO: 154599 - RNA, 22 nt, Human
gccuuccuuacaccugcucagc

SEQ ID NO: 154600 - RNA, 20 nt, Human
ccucaagcagacugacagcu

SEQ ID NO: 154601 - RNA, 22 nt, Human
acaggugggcuuaagagucggc

SEQ ID NO: 154602 - RNA, 22 nt, Human
auuguacaaugccuggaacauu

SEQ ID NO: 154603 - RNA, 22 nt, Human
ccugauggagcccugcugcaug

SEQ ID NO: 154604 - RNA, 22 nt, Human
ucuuucagccacuuaccugucu

SEQ ID NO: 154605 - RNA, 22 nt, Human
aaauaauguuaggccuuugcuc

SEQ ID NO: 154606 - RNA, 22 nt, Human
gccugcuggauguggccaggcc

SEQ ID NO: 154607 - RNA, 22 nt, Human
ggaggccaggaaggcucggaga

SEQ ID NO: 154608 - RNA, 22 nt, Human
gcucugagcacugugcggcugg

SEQ ID NO: 154609 - RNA, 22 nt, Human
agcagggcaaagucaggcuaac

SEQ ID NO: 154610 - RNA, 22 nt, Human
ggcugcagagcugggugggccu

SEQ ID NO: 154611 - RNA, 22 nt, Human
gugugcaugcauagacaccaca

SEQ ID NO: 154612 - RNA, 22 nt, Human
agcagagcuauucuugugcaau

SEQ ID NO: 154613 - RNA, 22 nt, Human
caguggucugugcuucuguaca

SEQ ID NO: 154614 - RNA, 22 nt, Human
agccucucugaugugacagcua

SEQ ID NO: 154615 - RNA, 22 nt, Human
aaauguagaccuauagggaccu

SEQ ID NO: 154616 - RNA, 22 nt, Human
auugacaaucuacuauguucug

SEQ ID NO: 154617 - RNA, 22 nt, Human
caggaggccaacugugggacuu

SEQ ID NO: 154618 - RNA, 22 nt, Human
gugucccagcagcacauuggcu

SEQ ID NO: 154619 - RNA, 22 nt, Human
acacagccgugaaucugcuucu

SEQ ID NO: 154620 - RNA, 22 nt, Human
cauaucccauuggccaggacau

SEQ ID NO: 154621 - RNA, 22 nt, Human
caggugggagcggagacugauu

SEQ ID NO: 154622 - RNA, 22 nt, Human
acagccagggucucaggaggcg

SEQ ID NO: 154623 - RNA, 22 nt, Human
uggacucagaaguguucuuuua

SEQ ID NO: 154624 - RNA, 22 nt, Human
cugugcuggcagaccuggaguu

SEQ ID NO: 154625 - RNA, 22 nt, Human
gcagguguggaguggggugagc

SEQ ID NO: 154626 - RNA, 22 nt, Human
aucagcaaucaaauugcagagu

SEQ ID NO: 154627 - RNA, 22 nt, Human
ucuggaaguuagaggaggaaag

SEQ ID NO: 154628 - RNA, 22 nt, Human
agguaggguuaauggagauaua

SEQ ID NO: 154629 - RNA, 22 nt, Human
agggcagcuagcuguagaaaga

SEQ ID NO: 154630 - RNA, 22 nt, Human
aaauguguuugauaggaauauu

SEQ ID NO: 154631 - RNA, 22 nt, Human
aaaaguuaccucuguaauauaa

SEQ ID NO: 154632 - RNA, 22 nt, Human
ugccaggggaccuagggauguc

SEQ ID NO: 154633 - RNA, 22 nt, Human
uguacaaugccgagacuaacuc

SEQ ID NO: 154634 - RNA, 22 nt, Human
gcucccagcauugcuucccagg

SEQ ID NO: 154635 - RNA, 22 nt, Human
aagggcuggaucucucugagca

SEQ ID NO: 154636 - RNA, 22 nt, Human
ucuggagcgaggucccugucug

SEQ ID NO: 154637 - RNA, 22 nt, Human
cugggcucagcccaugcugucc

SEQ ID NO: 154638 - RNA, 22 nt, Human
cagugggcugugauggauucac

SEQ ID NO: 154639 - RNA, 22 nt, Human
gcugugugacugagagccuggc

SEQ ID NO: 154640 - RNA, 17 nt, Human
accagccucuccugggg

SEQ ID NO: 154641 - RNA, 22 nt, Human
ucugggcugggagcguguggac

SEQ ID NO: 154642 - RNA, 20 nt, Human
cuuugccuauucucugccug

SEQ ID NO: 154643 - RNA, 22 nt, Human
ggggauggugggaaggcaaucu

SEQ ID NO: 154644 - RNA, 22 nt, Human
cuggccacaugugugcugagca

SEQ ID NO: 154645 - RNA, 22 nt, Human
ugauggcuaucccuggaagggc

SEQ ID NO: 154646 - RNA, 22 nt, Human
ucaggcaguagaauugcuugaa

SEQ ID NO: 154647 - RNA, 22 nt, Human
ccagggugggaggcugaaggcg

SEQ ID NO: 154648 - RNA, 22 nt, Human
acagagaugcaaguguguauuu

SEQ ID NO: 154649 - RNA, 22 nt, Human
uuacaguauuguuaaacucuuu

SEQ ID NO: 154650 - RNA, 22 nt, Human
ucaugacaucuguuuaucucaa

SEQ ID NO: 154651 - RNA, 22 nt, Human
accagagaaaacacagcaggcu

SEQ ID NO: 154652 - RNA, 22 nt, Human
gcccugucccuuggcuucuagg

SEQ ID NO: 154653 - RNA, 21 nt, Human
agcuggugucagagcucuggg

SEQ ID NO: 154654 - RNA, 22 nt, Human
ugagcuggucacuccuucugaa

SEQ ID NO: 154655 - RNA, 22 nt, Human
gcagggacaucuuugucuagua

SEQ ID NO: 154656 - RNA, 22 nt, Human
agggucaggagacacuggcaac

SEQ ID NO: 154657 - RNA, 22 nt, Human
gcagcagaugcuuucauggaca

SEQ ID NO: 154658 - RNA, 22 nt, Human
aagaagagaaaugugcugcugg

SEQ ID NO: 154659 - RNA, 22 nt, Human
ucuggccuacuggaguccauga

SEQ ID NO: 154660 - RNA, 22 nt, Human
agggcagcacagcugugcuccu

SEQ ID NO: 154661 - RNA, 22 nt, Human
aggcacuggguaauuaguagcu

SEQ ID NO: 154662 - RNA, 22 nt, Human
caggaaccuaaagagacauuac

SEQ ID NO: 154663 - RNA, 22 nt, Human
cuuagaaauuguuacucauuca

SEQ ID NO: 154664 - RNA, 22 nt, Human
cuaaaugcccuacaaugacugg

SEQ ID NO: 154665 - RNA, 22 nt, Human
aggccugggcaagaaggggcgu

SEQ ID NO: 154666 - RNA, 22 nt, Human
uugcauuguugcaaugaaguau

SEQ ID NO: 154667 - RNA, 22 nt, Human
ggcagaguggagugcggccucc

SEQ ID NO: 154668 - RNA, 22 nt, Human
cugccagguuggcgcucgcucu

SEQ ID NO: 154669 - RNA, 22 nt, Human
uucauuacugcgguagucacac

SEQ ID NO: 154670 - RNA, 22 nt, Human
gccuucaggaaaucaguccuug

SEQ ID NO: 154671 - RNA, 22 nt, Human
gccuggagcucuccacuugggg

SEQ ID NO: 154672 - RNA, 22 nt, Human
aaggcagauauaaagacuagag

SEQ ID NO: 154673 - RNA, 22 nt, Human
gccucccuguucuuccacaaua

SEQ ID NO: 154674 - RNA, 22 nt, Human
uccugccucacaguugaaguuu

SEQ ID NO: 154675 - RNA, 22 nt, Human
uuagauaauguagagauaugag

SEQ ID NO: 154676 - RNA, 22 nt, Human
ccagcucucagcgggagacuca

SEQ ID NO: 154677 - RNA, 22 nt, Human
caggcacuggggaugcugggau

SEQ ID NO: 154678 - RNA, 22 nt, Human
uuauuaaugaguacaaguuauu

SEQ ID NO: 154679 - RNA, 22 nt, Human
guggagacuucuacuagagacc

SEQ ID NO: 154680 - RNA, 22 nt, Human
gagcugccaguguaugaauucu

SEQ ID NO: 154681 - RNA, 22 nt, Human
ccucucuguaagggucccuccc

SEQ ID NO: 154682 - RNA, 22 nt, Human
caggcugagcucuggccugggc

SEQ ID NO: 154683 - RNA, 22 nt, Human
cccagcccaucucaaaggucua

SEQ ID NO: 154684 - RNA, 22 nt, Human
uggggugccgacagggagggca

SEQ ID NO: 154685 - RNA, 22 nt, Human
uacccaggagaaacagcagggc

SEQ ID NO: 154686 - RNA, 22 nt, Human
ggcuggcucagggcuugagaga

SEQ ID NO: 154687 - RNA, 22 nt, Human
aagcagugcgcucaucuaaggg

SEQ ID NO: 154688 - RNA, 22 nt, Human
aggggcugggacagagccaagc

SEQ ID NO: 154689 - RNA, 22 nt, Human
aggagcugaaacuucucauaug

SEQ ID NO: 154690 - RNA, 22 nt, Human
agagugaaaagcuagagcagua

SEQ ID NO: 154691 - RNA, 22 nt, Human
ggcucugggucuguggggagcg

SEQ ID NO: 154692 - RNA, 22 nt, Human
gcaagcuggcuguuagaggaug

SEQ ID NO: 154693 - RNA, 22 nt, Human
uuuccuuccuugcuagccugag

SEQ ID NO: 154694 - RNA, 22 nt, Human
cccagacugcagagcgggcaga

SEQ ID NO: 154695 - RNA, 22 nt, Human
caggaucccuggccuccgccca

SEQ ID NO: 154696 - RNA, 22 nt, Human
gcucccaccaggcagaccuacc

SEQ ID NO: 154697 - RNA, 22 nt, Human
gcugucugggaugucacugcug

SEQ ID NO: 154698 - RNA, 22 nt, Human
gccauuuagggaggcaagguga

SEQ ID NO: 154699 - RNA, 22 nt, Human
ucucagagagaugaaacuucca

SEQ ID NO: 154700 - RNA, 22 nt, Human
uaaugcacaugacugaacuauu

SEQ ID NO: 154701 - RNA, 22 nt, Human
ggcagcaguccauggcccaagg

SEQ ID NO: 154702 - RNA, 18 nt, Human
uccugccugcgggcuccc

SEQ ID NO: 154703 - RNA, 22 nt, Human
aguugaaauuagaguccuggcu

SEQ ID NO: 154704 - RNA, 17 nt, Human
uauguaguacuuauaaa

SEQ ID NO: 154705 - RNA, 22 nt, Human
uuucacauuuuauacuuaagcc

SEQ ID NO: 154706 - RNA, 22 nt, Human
cagggccagccgcagcauccac

SEQ ID NO: 154707 - RNA, 22 nt, Human
ggccucacccaucggugccuuu

SEQ ID NO: 154708 - RNA, 22 nt, Human
cuggcucccucgcugaggugcu

SEQ ID NO: 154709 - RNA, 22 nt, Human
uuagugucuucuucauccucug

SEQ ID NO: 154710 - RNA, 22 nt, Human
uuaucguacgcuucagaaauuu

SEQ ID NO: 154711 - RNA, 22 nt, Human
gagagcugcagccgagaggggg

SEQ ID NO: 154712 - RNA, 22 nt, Human
cugagcugggcucucuugaggg

SEQ ID NO: 154713 - RNA, 22 nt, Human
ccucuggcuguaccacuggcac

SEQ ID NO: 154714 - RNA, 19 nt, Human
augauacaggugaaaauug

SEQ ID NO: 154715 - RNA, 22 nt, Human
ggccuggcucuugcccagccug

SEQ ID NO: 154716 - RNA, 19 nt, Human
acaaagcugugagcagcuu

SEQ ID NO: 154717 - RNA, 22 nt, Human
caagggcuucaaguggccaaga

SEQ ID NO: 154718 - RNA, 19 nt, Human
ccugcagggaugagagguu

SEQ ID NO: 154719 - RNA, 22 nt, Human
cagcuuugauucuuucugccau

SEQ ID NO: 154720 - RNA, 22 nt, Human
cuguggcuaggaagcuguggga

SEQ ID NO: 154721 - RNA, 22 nt, Human
uuccucaugggguuccuucaga

SEQ ID NO: 154722 - RNA, 22 nt, Human
ggucccaggaagugcggcggcg

SEQ ID NO: 154723 - RNA, 22 nt, Human
ggugccagccuagugcaguggu

SEQ ID NO: 154724 - RNA, 22 nt, Human
agcugccaucugaagaacugca

SEQ ID NO: 154725 - RNA, 21 nt, Human
agcagcugcaguuucuaucug

SEQ ID NO: 154726 - RNA, 22 nt, Human
gagcugccugugugccaugaug

SEQ ID NO: 154727 - RNA, 22 nt, Human
ggcugugcgggcagccguggga

SEQ ID NO: 154728 - RNA, 22 nt, Human
ugaagccuuguguggccucucu

SEQ ID NO: 154729 - RNA, 22 nt, Human
cuguccuuacugcuucuggcuu

SEQ ID NO: 154730 - RNA, 22 nt, Human
gcaggaagaugagcucagguaa

SEQ ID NO: 154731 - RNA, 20 nt, Human
uaugaguauuacuuucagga

SEQ ID NO: 154732 - RNA, 22 nt, Human
cuggugagacgguugacaggag

SEQ ID NO: 154733 - RNA, 22 nt, Human
cugggcagagcuaacaccugag

SEQ ID NO: 154734 - RNA, 22 nt, Human
ggcaaaaaccauaauuacuuuu

SEQ ID NO: 154735 - RNA, 22 nt, Human
agugacucacuagcucucagug

SEQ ID NO: 154736 - RNA, 22 nt, Human
uuccaguucccaugaggauuaa

SEQ ID NO: 154737 - RNA, 22 nt, Human
agggccugucagcgguguccug

SEQ ID NO: 154738 - RNA, 22 nt, Human
uuggaaggugagucccuggguu

SEQ ID NO: 154739 - RNA, 22 nt, Human
ucugccugaaauucacauguaa

SEQ ID NO: 154740 - RNA, 22 nt, Human
auguaacaggugaagcucugag

SEQ ID NO: 154741 - RNA, 22 nt, Human
ugauuuccucuacuagcaauua

SEQ ID NO: 154742 - RNA, 22 nt, Human
gaacaguaucaguagugccagu

SEQ ID NO: 154743 - RNA, 18 nt, Human
auggucucauacugggag

SEQ ID NO: 154744 - RNA, 22 nt, Human
ucccagcagcauagcucagaau

SEQ ID NO: 154745 - RNA, 22 nt, Human
cacugcauggaugauggcugua

SEQ ID NO: 154746 - RNA, 22 nt, Human
ccagggcagaaaaagagggaau

SEQ ID NO: 154747 - RNA, 20 nt, Human
aagagcugacucacaguggu

SEQ ID NO: 154748 - RNA, 18 nt, Human
gggcaagcggcugucacc

SEQ ID NO: 154749 - RNA, 22 nt, Human
ucuggcuccaggaccgggcaca

SEQ ID NO: 154750 - RNA, 22 nt, Human
gagggggcgugcaaggcuccgc

SEQ ID NO: 154751 - RNA, 22 nt, Human
gguucacacuuucaugauuuca

SEQ ID NO: 154752 - RNA, 22 nt, Human
gcucucugccauaugaggauac

SEQ ID NO: 154753 - RNA, 22 nt, Human
acugcagggcauccuggccaag

SEQ ID NO: 154754 - RNA, 19 nt, Human
agccuggcuuugcucugcu

SEQ ID NO: 154755 - RNA, 19 nt, Human
ucccuggcgccucucgggc

SEQ ID NO: 154756 - RNA, 22 nt, Human
agggcugcugcuccgggcccag

SEQ ID NO: 154757 - RNA, 22 nt, Human
ucauucuccucuggaaaaggca

SEQ ID NO: 154758 - RNA, 22 nt, Human
ucugagagagggucagaugcua

SEQ ID NO: 154759 - RNA, 22 nt, Human
uuuuuccuuagggguuacucac

SEQ ID NO: 154760 - RNA, 22 nt, Human
uuacaaagcguugagacaagua

SEQ ID NO: 154761 - RNA, 22 nt, Human
uguggcugucuguucuccuagg

SEQ ID NO: 154762 - RNA, 22 nt, Human
gccuggagggucccucucugga

SEQ ID NO: 154763 - RNA, 22 nt, Human
uaggcagcugcaaacuucgguc

SEQ ID NO: 154764 - RNA, 22 nt, Human
agggucugacuccucuggcaag

SEQ ID NO: 154765 - RNA, 22 nt, Human
cagucccaaggaggaagcaguc

SEQ ID NO: 154766 - RNA, 22 nt, Human
ucacuggggccuuuggucagga

SEQ ID NO: 154767 - RNA, 22 nt, Human
uccugggcuguggccccgggca

SEQ ID NO: 154768 - RNA, 22 nt, Human
uccuccaggucuaggguggcuu

SEQ ID NO: 154769 - RNA, 22 nt, Human
guugggaagcagauggaugagc

SEQ ID NO: 154770 - RNA, 21 nt, Human
aagcaggacauaugaugcccu

SEQ ID NO: 154771 - RNA, 22 nt, Human
gauuucaagcccccagagauuc

SEQ ID NO: 154772 - RNA, 23 nt, Human
gugcucugcggucugcuagucug

SEQ ID NO: 154773 - RNA, 22 nt, Human
gggccugggaacuugcauuuag

SEQ ID NO: 154774 - RNA, 22 nt, Human
gagagugagauccuccugggga

SEQ ID NO: 154775 - RNA, 22 nt, Human
aaauauguaagauuagcacuag

SEQ ID NO: 154776 - RNA, 22 nt, Human
cauugcacuuuggguccaggac

SEQ ID NO: 154777 - RNA, 22 nt, Human
agugaaaacacuaguucuugcc

SEQ ID NO: 154778 - RNA, 22 nt, Human
ggcagcagcaagguuggagcug

SEQ ID NO: 154779 - RNA, 22 nt, Human
accagcagaguugaggaggaca

SEQ ID NO: 154780 - RNA, 22 nt, Human
cuggcucucugagauauugagu

SEQ ID NO: 154781 - RNA, 22 nt, Human
ggagagaaauugagguagcaag

SEQ ID NO: 154782 - RNA, 22 nt, Human
augaguaagaccauaauuuuug

SEQ ID NO: 154783 - RNA, 22 nt, Human
ugcauugcauuugucaugaaga

SEQ ID NO: 154784 - RNA, 22 nt, Human
cuuugcaauagaggcacacaug

SEQ ID NO: 154785 - RNA, 22 nt, Human
agcugccaggccccugagaacc

SEQ ID NO: 154786 - RNA, 22 nt, Human
ucuggccagugaaaugcagaau

SEQ ID NO: 154787 - RNA, 22 nt, Human
aaggcagagggcuggaucagag

SEQ ID NO: 154788 - RNA, 22 nt, Human
gccugagaaggauaggaagcga

SEQ ID NO: 154789 - RNA, 22 nt, Human
aggugaguuacaggaggagguc

SEQ ID NO: 154790 - RNA, 16 nt, Human
ccacagggcaaggggc

SEQ ID NO: 154791 - RNA, 22 nt, Human
ccuguggcugccacuuggguga

SEQ ID NO: 154792 - RNA, 22 nt, Human
cacugggcguguccugggugag

SEQ ID NO: 154793 - RNA, 22 nt, Human
ugggcugcugucugcacaugcu

SEQ ID NO: 154794 - RNA, 22 nt, Human
gacacagcacuguacaaggaau

SEQ ID NO: 154795 - RNA, 23 nt, Human
cccagcgcugagcccugcaggca

SEQ ID NO: 154796 - RNA, 19 nt, Human
cucugccucuggcuguggc

SEQ ID NO: 154797 - RNA, 22 nt, Human
ucugucugagggagugacauuu

SEQ ID NO: 154798 - RNA, 22 nt, Human
gaaaggagggaaacagagcggu

SEQ ID NO: 154799 - RNA, 22 nt, Human
ccaaggagcaaggcucaacaag

SEQ ID NO: 154800 - RNA, 22 nt, Human
gcagcuggaagugacacucugu

SEQ ID NO: 154801 - RNA, 17 nt, Human
uucucuuccuggauagu

SEQ ID NO: 154802 - RNA, 21 nt, Human
ccuggcagaagccugauaugc

SEQ ID NO: 154803 - RNA, 22 nt, Human
agucccagaucuacaggaggga

SEQ ID NO: 154804 - RNA, 17 nt, Human
ugagcaguagaagaugc

SEQ ID NO: 154805 - RNA, 22 nt, Human
cagcaauaacucaaagccauuu

SEQ ID NO: 154806 - RNA, 22 nt, Human
ugucaguguauacauacaguau

SEQ ID NO: 154807 - RNA, 22 nt, Human
aaacagaaauuuccucaugcuc

SEQ ID NO: 154808 - RNA, 22 nt, Human
gcugccuguugaagggucugug

SEQ ID NO: 154809 - RNA, 22 nt, Human
ucagcugccucucccuggaaga

SEQ ID NO: 154810 - RNA, 22 nt, Human
ccaggagcagauauggacauaa

SEQ ID NO: 154811 - RNA, 22 nt, Human
aagcagcugauuucacagcuca

SEQ ID NO: 154812 - RNA, 22 nt, Human
aaaguuugcaauuuauguuaau

SEQ ID NO: 154813 - RNA, 22 nt, Human
aagcagcagaccugauuuugaa

SEQ ID NO: 154814 - RNA, 22 nt, Human
gccugagagacccauggggcaa

SEQ ID NO: 154815 - RNA, 22 nt, Human
ugcugcacaauuggaaaguauc

SEQ ID NO: 154816 - RNA, 22 nt, Human
aggcugcuuucauggccgcccc

SEQ ID NO: 154817 - RNA, 22 nt, Human
gagaggccauggcugugcagug

SEQ ID NO: 154818 - RNA, 22 nt, Human
agguggguccuggcucugccau

SEQ ID NO: 154819 - RNA, 22 nt, Human
aaaagucagucucuccuagcuc

SEQ ID NO: 154820 - RNA, 22 nt, Human
guggcugcagagggcacagcau

SEQ ID NO: 154821 - RNA, 22 nt, Human
uaaguucaguuggucgaaguag

SEQ ID NO: 154822 - RNA, 19 nt, Human
acacagggaucagaggguu

SEQ ID NO: 154823 - RNA, 18 nt, Human
aggcacagagcauacaua

SEQ ID NO: 154824 - RNA, 22 nt, Human
caggccuggagugcaauggcac

SEQ ID NO: 154825 - RNA, 22 nt, Human
cuggcugguuacuauuucuggu

SEQ ID NO: 154826 - RNA, 22 nt, Human
uaugcacaccuggguccuuguc

SEQ ID NO: 154827 - RNA, 22 nt, Human
cuggcagccaagugggauacuc

SEQ ID NO: 154828 - RNA, 22 nt, Human
aagagguugucugugaugaguu

SEQ ID NO: 154829 - RNA, 22 nt, Human
agggcagagcugucuaaauggc

SEQ ID NO: 154830 - RNA, 22 nt, Human
gucucuggguuaagcagugcau

SEQ ID NO: 154831 - RNA, 22 nt, Human
gggcccuggauuuaagcaugga

SEQ ID NO: 154832 - RNA, 19 nt, Human
uggcugggcgugccuccgu

SEQ ID NO: 154833 - RNA, 22 nt, Human
ugggcagagaucuggaucaaac

SEQ ID NO: 154834 - RNA, 21 nt, Human
cucaggaucuuauauauuagu

SEQ ID NO: 154835 - RNA, 23 nt, Human
cagggcugguagggaagagcgug

SEQ ID NO: 154836 - RNA, 22 nt, Human
aggcagccagauggcagccugc

SEQ ID NO: 154837 - RNA, 22 nt, Human
ccagguggcuucugcccgaugu

SEQ ID NO: 154838 - RNA, 22 nt, Human
uagggcagccuuauagcuccca

SEQ ID NO: 154839 - RNA, 22 nt, Human
cagcuggcuggucagugcacaa

SEQ ID NO: 154840 - RNA, 22 nt, Human
ggcuccuggcaucuggugggua

SEQ ID NO: 154841 - RNA, 22 nt, Human
gagagaagaaagccaugguccu

SEQ ID NO: 154842 - RNA, 19 nt, Human
acagaaauuaguuauuuuc

SEQ ID NO: 154843 - RNA, 22 nt, Human
cuggagccccagacagggagag

SEQ ID NO: 154844 - RNA, 22 nt, Human
agagaaaacucauugagguguc

SEQ ID NO: 154845 - RNA, 22 nt, Human
agagcagguggcaacucuggga

SEQ ID NO: 154846 - RNA, 22 nt, Human
uguguacauaucuauccuagau

SEQ ID NO: 154847 - RNA, 21 nt, Human
gaaaggucuuaacuuacagag

SEQ ID NO: 154848 - RNA, 22 nt, Human
aaaugcaucagcucauaagaga

SEQ ID NO: 154849 - RNA, 22 nt, Human
uggagcuggaauuucugggccu

SEQ ID NO: 154850 - RNA, 22 nt, Human
ugcagaaggccugacauugcac

SEQ ID NO: 154851 - RNA, 22 nt, Human
ggcaugggguguauguggcacg

SEQ ID NO: 154852 - RNA, 22 nt, Human
ugcugccaugcagagcaacaga

SEQ ID NO: 154853 - RNA, 22 nt, Human
gcagcccaauggacugagacag

SEQ ID NO: 154854 - RNA, 22 nt, Human
uacagauacagaucuagauaca

SEQ ID NO: 154855 - RNA, 22 nt, Human
aggcacugcagauuacaggcgc

SEQ ID NO: 154856 - RNA, 22 nt, Human
gucuggaggaggaagaaggcac

SEQ ID NO: 154857 - RNA, 21 nt, Human
gcagagccggggcgagaaggc

SEQ ID NO: 154858 - RNA, 22 nt, Human
cagugccucuuaagugucaccc

SEQ ID NO: 154859 - RNA, 22 nt, Human
uccaaagggaagcgcuuucugu

SEQ ID NO: 154860 - RNA, 22 nt, Human
uuauuuauggcacuguuggugg

SEQ ID NO: 154861 - RNA, 22 nt, Human
gucagaggggcagcugccaggc

SEQ ID NO: 154862 - RNA, 22 nt, Human
uugggguguuggauggagcaag

SEQ ID NO: 154863 - RNA, 22 nt, Human
ggccugaggcgucccagcugug

SEQ ID NO: 154864 - RNA, 16 nt, Human
agcagggcgggaagga

SEQ ID NO: 154865 - RNA, 22 nt, Human
agagggagcccagucauagcug

SEQ ID NO: 154866 - RNA, 22 nt, Human
aagccagggucaggggccuccu

SEQ ID NO: 154867 - RNA, 22 nt, Human
cugggggcaagcagacagcugu

SEQ ID NO: 154868 - RNA, 22 nt, Human
uagcagaaccagcagucaauuu

SEQ ID NO: 154869 - RNA, 22 nt, Human
auacaucuaugccuuucugaca

SEQ ID NO: 154870 - RNA, 22 nt, Human
cauaagaaauaaugaugaugac

SEQ ID NO: 154871 - RNA, 20 nt, Human
gaagcagcuucauguagaca

SEQ ID NO: 154872 - RNA, 22 nt, Human
aagaguuaagcaacagauacca

SEQ ID NO: 154873 - RNA, 22 nt, Human
ugcagcaggagccaggccuggu

SEQ ID NO: 154874 - RNA, 22 nt, Human
guccucuggugaaagcauuccc

SEQ ID NO: 154875 - RNA, 22 nt, Human
uaagaaauuuaguuauagaaug

SEQ ID NO: 154876 - RNA, 22 nt, Human
ccugccaggagcuggugcugca

SEQ ID NO: 154877 - RNA, 22 nt, Human
agcccagccggauucccaguuc

SEQ ID NO: 154878 - RNA, 22 nt, Human
uccagggccaagucauggaacc

SEQ ID NO: 154879 - RNA, 22 nt, Human
aggcugucugaccccagagccc

SEQ ID NO: 154880 - RNA, 22 nt, Human
gcagcaugagcuauacaaagua

SEQ ID NO: 154881 - RNA, 20 nt, Human
cucuccuugccgacuuggca

SEQ ID NO: 154882 - RNA, 22 nt, Human
agcuguucccucacugcaguca

SEQ ID NO: 154883 - RNA, 22 nt, Human
ugcauugcaguuaacucaguau

SEQ ID NO: 154884 - RNA, 22 nt, Human
aggcaguggcugagaccagggg

SEQ ID NO: 154885 - RNA, 22 nt, Human
augagacuaccuguaauguggc

SEQ ID NO: 154886 - RNA, 22 nt, Human
gccagcagcccagaaggacuuu

SEQ ID NO: 154887 - RNA, 22 nt, Human
ugccuggguucccaccccaaag

SEQ ID NO: 154888 - RNA, 22 nt, Human
uauguacaaucagcaguucaua

SEQ ID NO: 154889 - RNA, 22 nt, Human
agggccagaggcaccuugcagc

SEQ ID NO: 154890 - RNA, 22 nt, Human
aggaccaacauagcagcagugg

SEQ ID NO: 154891 - RNA, 22 nt, Human
aaggccagcuuguagggcuggu

SEQ ID NO: 154892 - RNA, 21 nt, Human
ucuuugcaucaguuguuuucu

SEQ ID NO: 154893 - RNA, 22 nt, Human
caggcacuggccagucagcaca

SEQ ID NO: 154894 - RNA, 22 nt, Human
ccaggcagcaaauuuucugaau

SEQ ID NO: 154895 - RNA, 22 nt, Human
ugcuccauucucuagccagugc

SEQ ID NO: 154896 - RNA, 22 nt, Human
gcuggagccauuggcuuggccu

SEQ ID NO: 154897 - RNA, 22 nt, Human
uucuccgcuaaguucucugcag

SEQ ID NO: 154898 - RNA, 22 nt, Human
gcuccacuugcagcuaggcuug

SEQ ID NO: 154899 - RNA, 22 nt, Human
auugagaauccauuugagauga

SEQ ID NO: 154900 - RNA, 22 nt, Human
acaguaauauugaugcucguca

SEQ ID NO: 154901 - RNA, 22 nt, Human
cccuggcaaaacacucucuuga

SEQ ID NO: 154902 - RNA, 22 nt, Human
gcaggagcucguuuccaggcug

SEQ ID NO: 154903 - RNA, 22 nt, Human
uggagccugagucagcggaggc

SEQ ID NO: 154904 - RNA, 22 nt, Human
aggcugucaucuuugcaggcag

SEQ ID NO: 154905 - RNA, 20 nt, Human
ucacaucuggcagcugauga

SEQ ID NO: 154906 - RNA, 22 nt, Human
uacaguucacaguaucauaaau

SEQ ID NO: 154907 - RNA, 22 nt, Human
uuauguacucugcaauguuuga

SEQ ID NO: 154908 - RNA, 22 nt, Human
ucaagcaggguagcaagcuggu

SEQ ID NO: 154909 - RNA, 22 nt, Human
ugagcuuccucccugcauccau

SEQ ID NO: 154910 - RNA, 20 nt, Human
cuuagaaauuuuuacccugg

SEQ ID NO: 154911 - RNA, 22 nt, Human
gagcaacaguuuaugguuuuuc

SEQ ID NO: 154912 - RNA, 22 nt, Human
ucaaaugcuguauuguaguaau

SEQ ID NO: 154913 - RNA, 22 nt, Human
cucccuggaggcccagaccugg

SEQ ID NO: 154914 - RNA, 22 nt, Human
cagcugccugucuggaggcaau

SEQ ID NO: 154915 - RNA, 22 nt, Human
ggagccaggcaaucuguacuuu

SEQ ID NO: 154916 - RNA, 22 nt, Human
ucaguggauauuucuguggcug

SEQ ID NO: 154917 - RNA, 22 nt, Human
uccuccuucgggacugcuugac

SEQ ID NO: 154918 - RNA, 22 nt, Human
acuccuggggauccauuccuuu

SEQ ID NO: 154919 - RNA, 22 nt, Human
uccaagggcagccauagaacuu

SEQ ID NO: 154920 - RNA, 22 nt, Human
cugaggugcuagggucccugcu

SEQ ID NO: 154921 - RNA, 22 nt, Human
accagagauggggcuucucugu

SEQ ID NO: 154922 - RNA, 22 nt, Human
uggccucucuaccaggcagccu

SEQ ID NO: 154923 - RNA, 21 nt, Human
ggccucugccuugccccacuc

SEQ ID NO: 154924 - RNA, 22 nt, Human
gugcucuggcuggucucccggu

SEQ ID NO: 154925 - RNA, 20 nt, Human
accauaauguuaauuacaaa

SEQ ID NO: 154926 - RNA, 22 nt, Human
gggcuggagccagcuguggcug

SEQ ID NO: 154927 - RNA, 19 nt, Human
ccagucccauacaggagau

SEQ ID NO: 154928 - RNA, 22 nt, Human
ucauugcagaaauaaaggugaa

SEQ ID NO: 154929 - RNA, 22 nt, Human
aaaggucagcugccaucguucu

SEQ ID NO: 154930 - RNA, 22 nt, Human
aaagccuugagauccuauaguu

SEQ ID NO: 154931 - RNA, 20 nt, Human
gccugcagguuggaugggau

SEQ ID NO: 154932 - RNA, 22 nt, Human
cugccuguuagucuagcaguua

SEQ ID NO: 154933 - RNA, 22 nt, Human
uaaaguuuggcagacaauaaca

SEQ ID NO: 154934 - RNA, 22 nt, Human
ggcagcucugcuccacaugagu

SEQ ID NO: 154935 - RNA, 22 nt, Human
cuggaagguuccucccagcucc

SEQ ID NO: 154936 - RNA, 22 nt, Human
ggccuuggugcucuguguugca

SEQ ID NO: 154937 - RNA, 22 nt, Human
agaguggggaagguguugagaa

SEQ ID NO: 154938 - RNA, 22 nt, Human
gaaggccauugcguccugggau

SEQ ID NO: 154939 - RNA, 22 nt, Human
agucccagaucuccauucgguc

SEQ ID NO: 154940 - RNA, 22 nt, Human
agcugcugcggaaagaugccac

SEQ ID NO: 154941 - RNA, 22 nt, Human
ggcugcuggcauugagguaggu

SEQ ID NO: 154942 - RNA, 22 nt, Human
uuucagaucauuuuuuaaguac

SEQ ID NO: 154943 - RNA, 22 nt, Human
auacauuagaaucugguacuca

SEQ ID NO: 154944 - RNA, 22 nt, Human
uuguuucugaguuuucauguau

SEQ ID NO: 154945 - RNA, 22 nt, Human
aagcagccacuggccaguuaua

SEQ ID NO: 154946 - RNA, 22 nt, Human
gagccaggcccguacuugcugu

SEQ ID NO: 154947 - RNA, 22 nt, Human
ggugggcaggcgaggcccaggu

SEQ ID NO: 154948 - RNA, 22 nt, Human
gccuguccuggaugcucugcaa

SEQ ID NO: 154949 - RNA, 22 nt, Human
cagaggugcauacaggucauua

SEQ ID NO: 154950 - RNA, 22 nt, Human
aucaguuuugggggacauacug

SEQ ID NO: 154951 - RNA, 22 nt, Human
ggcucaggacugcagcguagag

SEQ ID NO: 154952 - RNA, 22 nt, Human
agagcuggcugguagcccugau

SEQ ID NO: 154953 - RNA, 22 nt, Human
gucccuggucuaccguggcuuc

SEQ ID NO: 154954 - RNA, 22 nt, Human
ggcuuccuggagaaggucugag

SEQ ID NO: 154955 - RNA, 22 nt, Human
uugccuugauucuucucaugug

SEQ ID NO: 154956 - RNA, 22 nt, Human
acagaauauugguuacuguugc

SEQ ID NO: 154957 - RNA, 22 nt, Human
cuggggcugcggacgggagccc

SEQ ID NO: 154958 - RNA, 22 nt, Human
gaagcagcaaguauaggacagg

SEQ ID NO: 154959 - RNA, 22 nt, Human
uuccaaagaaauugaccaagac

SEQ ID NO: 154960 - RNA, 22 nt, Human
ggcaggagauaaaauauuaguu

SEQ ID NO: 154961 - RNA, 22 nt, Human
ugggcucuccuggaggacaaca

SEQ ID NO: 154962 - RNA, 20 nt, Human
uacugggcaagcccacagac

SEQ ID NO: 154963 - RNA, 22 nt, Human
ucaggggacagccagcuggagg

SEQ ID NO: 154964 - RNA, 22 nt, Human
gaacagcugcuagagaucugug

SEQ ID NO: 154965 - RNA, 22 nt, Human
ccagucugugugccagccugcg

SEQ ID NO: 154966 - RNA, 22 nt, Human
ggcacugacacuagcauggcac

SEQ ID NO: 154967 - RNA, 22 nt, Human
ugaguagcggcuauguguaacu

SEQ ID NO: 154968 - RNA, 23 nt, Human
aucaaaguggaaaucaauuaucu

SEQ ID NO: 154969 - RNA, 22 nt, Human
uauguguaggaggaggacaggg

SEQ ID NO: 154970 - RNA, 22 nt, Human
gacagggcaagacucugucuaa

SEQ ID NO: 154971 - RNA, 19 nt, Human
augucuguugaauuucaua

SEQ ID NO: 154972 - RNA, 22 nt, Human
cucccuggcacagcgagagguu

SEQ ID NO: 154973 - RNA, 22 nt, Human
ucugagcuuuuauuaucaaccu

SEQ ID NO: 154974 - RNA, 22 nt, Human
ucugccagugguuuggcccuga

SEQ ID NO: 154975 - RNA, 22 nt, Human
caggcacuguguuaggcacugu

SEQ ID NO: 154976 - RNA, 22 nt, Human
agguggggaaaccagcgauccc

SEQ ID NO: 154977 - RNA, 22 nt, Human
ugggcagauuaaugcaguggcu

SEQ ID NO: 154978 - RNA, 22 nt, Human
acugagcucuugacugggaguu

SEQ ID NO: 154979 - RNA, 22 nt, Human
gcuggccugaccagccacaggc

SEQ ID NO: 154980 - RNA, 22 nt, Human
ggcucuggcaaggggaggcuac

SEQ ID NO: 154981 - RNA, 22 nt, Human
ggcugccugaacuuuggggaaa

SEQ ID NO: 154982 - RNA, 22 nt, Human
gcccuuccaacccagagggcaa

SEQ ID NO: 154983 - RNA, 20 nt, Human
uauuuagauucaaguaugga

SEQ ID NO: 154984 - RNA, 20 nt, Human
cuguccccgaggucaccagg

SEQ ID NO: 154985 - RNA, 22 nt, Human
uccagggacagcgcuggagcua

SEQ ID NO: 154986 - RNA, 22 nt, Human
uugaagauggaucgccacucuc

SEQ ID NO: 154987 - RNA, 22 nt, Human
cuucuuuccuuccuccaguggc

SEQ ID NO: 154988 - RNA, 22 nt, Human
cagagaaacucagauagcugau

SEQ ID NO: 154989 - RNA, 22 nt, Human
uacaaagcuguauagccugguc

SEQ ID NO: 154990 - RNA, 22 nt, Human
cuguagccagaagcagaaggcc

SEQ ID NO: 154991 - RNA, 17 nt, Human
aagauuucauuagcuga

SEQ ID NO: 154992 - RNA, 22 nt, Human
guugaguggguuaggaugcuga

SEQ ID NO: 154993 - RNA, 22 nt, Human
ucuggagagucacagugccaga

SEQ ID NO: 154994 - RNA, 22 nt, Human
ggcagaggaagcuggaaguggg

SEQ ID NO: 154995 - RNA, 22 nt, Human
aggggagccccugguccuggug

SEQ ID NO: 154996 - RNA, 22 nt, Human
uaaguaaauuuauaaugugauu

SEQ ID NO: 154997 - RNA, 22 nt, Human
uaaauguauaggcacuaaaccu

SEQ ID NO: 154998 - RNA, 22 nt, Human
ucauuacagagauauaaucuac

SEQ ID NO: 154999 - RNA, 22 nt, Human
gcuggcaucacuggcuucggug

SEQ ID NO: 155000 - RNA, 22 nt, Human
aguaacaagugccaacguuaga

SEQ ID NO: 155001 - RNA, 22 nt, Human
ugucuguaagguguuuauguua

SEQ ID NO: 155002 - RNA, 22 nt, Human
aaaucaguaaauguucauuaac

SEQ ID NO: 155003 - RNA, 22 nt, Human
cagggcccaggccacuggguug

SEQ ID NO: 155004 - RNA, 22 nt, Human
uggagcaagcuggagagaacau

SEQ ID NO: 155005 - RNA, 22 nt, Human
ucuguaucacccguucccagaa

SEQ ID NO: 155006 - RNA, 22 nt, Human
acagcagagacacucaggaggc

SEQ ID NO: 155007 - RNA, 22 nt, Human
ucaccagucuuucuuaccauug

SEQ ID NO: 155008 - RNA, 22 nt, Human
ccagggcaugggaagaacugaa

SEQ ID NO: 155009 - RNA, 22 nt, Human
ugcucauuggcgaucugaggga

SEQ ID NO: 155010 - RNA, 22 nt, Human
uugcauugaaaauauauuuuaa

SEQ ID NO: 155011 - RNA, 22 nt, Human
gcaaggagacuguagggccaag

SEQ ID NO: 155012 - RNA, 22 nt, Human
acauuucucagguaagucauuu

SEQ ID NO: 155013 - RNA, 22 nt, Human
aggagaguaccauugggccgca

SEQ ID NO: 155014 - RNA, 22 nt, Human
ggccccacgggggaguccuagu

SEQ ID NO: 155015 - RNA, 22 nt, Human
cacagaaucugugacuccaaga

SEQ ID NO: 155016 - RNA, 22 nt, Human
ggcugcugcccaccccugcaug

SEQ ID NO: 155017 - RNA, 22 nt, Human
uugaaagggauauaucuuucug

SEQ ID NO: 155018 - RNA, 22 nt, Human
ccuggcagacagcacugaagcu

SEQ ID NO: 155019 - RNA, 22 nt, Human
aaggagcucccggcagaccagg

SEQ ID NO: 155020 - RNA, 22 nt, Human
auuugcagagcucugaauuuug

SEQ ID NO: 155021 - RNA, 22 nt, Human
ucuuuccuuagaauaauucuuu

SEQ ID NO: 155022 - RNA, 22 nt, Human
gagcagaugugugccaggaugc

SEQ ID NO: 155023 - RNA, 22 nt, Human
cagagcugcuucccaguuugug

SEQ ID NO: 155024 - RNA, 22 nt, Human
agccaggaaccagcuacagucu

SEQ ID NO: 155025 - RNA, 22 nt, Human
cagggagaaaucuccaggaggu

SEQ ID NO: 155026 - RNA, 22 nt, Human
agaaagaacguugguuaucuua

SEQ ID NO: 155027 - RNA, 22 nt, Human
uccuggagauaauugcagugaa

SEQ ID NO: 155028 - RNA, 22 nt, Human
aaggcccuggcaggaagcagga

SEQ ID NO: 155029 - RNA, 22 nt, Human
cagaggccuauccaguguccau

SEQ ID NO: 155030 - RNA, 22 nt, Human
uggaggaugagugugggcucug

SEQ ID NO: 155031 - RNA, 22 nt, Human
agccacagucaaccuguccaua

SEQ ID NO: 155032 - RNA, 22 nt, Human
cugacucuccucaagcauaaau

SEQ ID NO: 155033 - RNA, 22 nt, Human
aggguauaaagagcaagcagaa

SEQ ID NO: 155034 - RNA, 22 nt, Human
ugggcuguggagcaccuuugca

SEQ ID NO: 155035 - RNA, 21 nt, Human
guuuuaagggagaaaaccuag

SEQ ID NO: 155036 - RNA, 18 nt, Human
cuccagggaacucaguca

SEQ ID NO: 155037 - RNA, 22 nt, Human
gagcugcugguugcuggugccu

SEQ ID NO: 155038 - RNA, 22 nt, Human
guccuggggauuauagaguguu

SEQ ID NO: 155039 - RNA, 22 nt, Human
aaguucaaggaagccuccaguu

SEQ ID NO: 155040 - RNA, 22 nt, Human
uacaaaguagaaauucaguaaa

SEQ ID NO: 155041 - RNA, 22 nt, Human
auugaauagaugcauuauacua

SEQ ID NO: 155042 - RNA, 22 nt, Human
ucaggcagcuccaggaauggua

SEQ ID NO: 155043 - RNA, 22 nt, Human
cagccagaaccuaggaugagcu

SEQ ID NO: 155044 - RNA, 22 nt, Human
uguucaauccccagguccugaa

SEQ ID NO: 155045 - RNA, 22 nt, Human
ggggccugcgagguucaacuuc

SEQ ID NO: 155046 - RNA, 20 nt, Human
gaggcucugggcauggcgcc

SEQ ID NO: 155047 - RNA, 22 nt, Human
ucucagagggaaacaugaguga

SEQ ID NO: 155048 - RNA, 22 nt, Human
uccuuuccaugcuucuagaggc

SEQ ID NO: 155049 - RNA, 22 nt, Human
ggcagcuuuuaucccugacaga

SEQ ID NO: 155050 - RNA, 22 nt, Human
cuucucucugcauaggcauggg

SEQ ID NO: 155051 - RNA, 22 nt, Human
ugcagcuccucuggcugccuga

SEQ ID NO: 155052 - RNA, 22 nt, Human
ggguccagacacuccagaggaa

SEQ ID NO: 155053 - RNA, 22 nt, Human
uucauucauuacgugccaggca

SEQ ID NO: 155054 - RNA, 22 nt, Human
acauucaugucccacuucuagc

SEQ ID NO: 155055 - RNA, 22 nt, Human
aguuuaugaaacacagauuuga

SEQ ID NO: 155056 - RNA, 18 nt, Human
cugaggcuggcaggagcc

SEQ ID NO: 155057 - RNA, 21 nt, Human
gcagccagccgagaccaugcc

SEQ ID NO: 155058 - RNA, 22 nt, Human
acaagagacaagagguucuucu

SEQ ID NO: 155059 - RNA, 22 nt, Human
auccuuggaugugucuuuuugu

SEQ ID NO: 155060 - RNA, 23 nt, Human
gcccaugcuguugggcccgagca

SEQ ID NO: 155061 - RNA, 22 nt, Human
gccuggagcagacgugucccgg

SEQ ID NO: 155062 - RNA, 22 nt, Human
guccucaggaaagcagauaaca

SEQ ID NO: 155063 - RNA, 22 nt, Human
cuuccugguuugaagcucgccg

SEQ ID NO: 155064 - RNA, 22 nt, Human
aaugauggucauggcaacuuuu

SEQ ID NO: 155065 - RNA, 22 nt, Human
ggguccagaguugaagagguua

SEQ ID NO: 155066 - RNA, 22 nt, Human
gcagcugggacacugaggccag

SEQ ID NO: 155067 - RNA, 22 nt, Human
uacagaguggugagaucuuuug

SEQ ID NO: 155068 - RNA, 22 nt, Human
caggggcucugggugaugugag

SEQ ID NO: 155069 - RNA, 22 nt, Human
gccaggcugcuggcugcugucc

SEQ ID NO: 155070 - RNA, 22 nt, Human
ugaggcuggcaaggcugguauu

SEQ ID NO: 155071 - RNA, 22 nt, Human
uugugaaacauucauggauuug

SEQ ID NO: 155072 - RNA, 22 nt, Human
acuccuggggcugccaucacag

SEQ ID NO: 155073 - RNA, 22 nt, Human
gccagggaggcuguaggguccu

SEQ ID NO: 155074 - RNA, 21 nt, Human
gauuucacuuaccuucauuua

SEQ ID NO: 155075 - RNA, 22 nt, Human
gagguacagaguguuccaaugu

SEQ ID NO: 155076 - RNA, 22 nt, Human
gccaggcagccacccucugcga

SEQ ID NO: 155077 - RNA, 22 nt, Human
ucgugucagaucagagguuccu

SEQ ID NO: 155078 - RNA, 22 nt, Human
gcauuguccugcuucugagugu

SEQ ID NO: 155079 - RNA, 22 nt, Human
acucugugugaguagagccugu

SEQ ID NO: 155080 - RNA, 22 nt, Human
ugucauaaaacacaagcuguug

SEQ ID NO: 155081 - RNA, 22 nt, Human
cccauuuaucccaagguuacuc

SEQ ID NO: 155082 - RNA, 22 nt, Human
cugccagccaggccagguaggc

SEQ ID NO: 155083 - RNA, 22 nt, Human
ggucccagcugcucaagaggcu

SEQ ID NO: 155084 - RNA, 22 nt, Human
cugcuuugauuagaagaguaca

SEQ ID NO: 155085 - RNA, 23 nt, Human
uucaagauacgguuuccaggcug

SEQ ID NO: 155086 - RNA, 22 nt, Human
agacaucagcuugugugcaggg

SEQ ID NO: 155087 - RNA, 22 nt, Human
guaaaucccauccuuucucugg

SEQ ID NO: 155088 - RNA, 22 nt, Human
gccacaugcaauugcagcacgu

SEQ ID NO: 155089 - RNA, 22 nt, Human
ggcuucuuccugugaacauguu

SEQ ID NO: 155090 - RNA, 19 nt, Human
ugcucaggccaaggagccc

SEQ ID NO: 155091 - RNA, 22 nt, Human
accccagcucugagccacacca

SEQ ID NO: 155092 - RNA, 22 nt, Human
guuauguaaucuaacacucagu

SEQ ID NO: 155093 - RNA, 22 nt, Human
gcagaggccaucaacuuugcca

SEQ ID NO: 155094 - RNA, 22 nt, Human
cagcaaaauuugaggauugccu

SEQ ID NO: 155095 - RNA, 22 nt, Human
acagcuggcaggggggcaugaa

SEQ ID NO: 155096 - RNA, 17 nt, Human
ucaggcugggugcagug

SEQ ID NO: 155097 - RNA, 22 nt, Human
cuggcucauccagguguugcuc

SEQ ID NO: 155098 - RNA, 22 nt, Human
aagggccauaacuugcaguguu

SEQ ID NO: 155099 - RNA, 19 nt, Human
cccagagcauccugaacuu

SEQ ID NO: 155100 - RNA, 22 nt, Human
ggacacaguggaagacagcuug

SEQ ID NO: 155101 - RNA, 22 nt, Human
agcugccauccuguucagcacc

SEQ ID NO: 155102 - RNA, 22 nt, Human
agcuucuggaaggcaaggcuug

SEQ ID NO: 155103 - RNA, 22 nt, Human
uuggaaggcccugccuagcagg

SEQ ID NO: 155104 - RNA, 22 nt, Human
gaaggcaggcuucugauuaggu

SEQ ID NO: 155105 - RNA, 22 nt, Human
gcugcccuaauaucacauguua

SEQ ID NO: 155106 - RNA, 22 nt, Human
ugcugaggagguggcugugcuu

SEQ ID NO: 155107 - RNA, 20 nt, Human
cccugagacaaaggaggggc

SEQ ID NO: 155108 - RNA, 22 nt, Human
gcaaggaccuuugagcgugcca

SEQ ID NO: 155109 - RNA, 22 nt, Human
ggccuugguaaagggaugcaug

SEQ ID NO: 155110 - RNA, 22 nt, Human
gaggcccaguccugcaagcacg

SEQ ID NO: 155111 - RNA, 22 nt, Human
ugugccauuucuauucugcagc

SEQ ID NO: 155112 - RNA, 22 nt, Human
ucucagagggaaaggccaauuu

SEQ ID NO: 155113 - RNA, 22 nt, Human
ucacugcucucuaagcaucgcc

SEQ ID NO: 155114 - RNA, 22 nt, Human
cauuuucucaaugaacccucuu

SEQ ID NO: 155115 - RNA, 23 nt, Human
cuggcucuguagguggcauccuu

SEQ ID NO: 155116 - RNA, 22 nt, Human
aggucacccguuugacuaucca

SEQ ID NO: 155117 - RNA, 22 nt, Human
ugccagaagugcuuuauaagug

SEQ ID NO: 155118 - RNA, 22 nt, Human
uaugcacauucacacaaaaaug

SEQ ID NO: 155119 - RNA, 22 nt, Human
gacagggcgcccagccuguuuc

SEQ ID NO: 155120 - RNA, 22 nt, Human
cugggccaucagaggggcugga

SEQ ID NO: 155121 - RNA, 22 nt, Human
agagaugucgccuugcccaggg

SEQ ID NO: 155122 - RNA, 22 nt, Human
uggccugggccugccggugcaa

SEQ ID NO: 155123 - RNA, 22 nt, Human
gugagcaggauuucauggugua

SEQ ID NO: 155124 - RNA, 22 nt, Human
ucagaggaauaaugcugcauuu

SEQ ID NO: 155125 - RNA, 22 nt, Human
acagaguagcucaagaagauug

SEQ ID NO: 155126 - RNA, 22 nt, Human
aaaugucuuucaauagagaaau

SEQ ID NO: 155127 - RNA, 22 nt, Human
uggaaggggagcuggaaagggg

SEQ ID NO: 155128 - RNA, 22 nt, Human
cauugacaguucuuuaaguugc

SEQ ID NO: 155129 - RNA, 22 nt, Human
guucauuuuacuguaaauagca

SEQ ID NO: 155130 - RNA, 22 nt, Human
ccucacagggccaggccccuca

SEQ ID NO: 155131 - RNA, 22 nt, Human
ggcucaggccagaccacgacuc

SEQ ID NO: 155132 - RNA, 18 nt, Human
aaaaugcaggcgacaugg

SEQ ID NO: 155133 - RNA, 22 nt, Human
gugccucagcaccgccugcagc

SEQ ID NO: 155134 - RNA, 22 nt, Human
gggcagugguccaggcuacagc

SEQ ID NO: 155135 - RNA, 22 nt, Human
gggaaauugugugagaucuuug

SEQ ID NO: 155136 - RNA, 22 nt, Human
ccagagccucgcccggagccuc

SEQ ID NO: 155137 - RNA, 22 nt, Human
gacagccucaugaggagcaaaa

SEQ ID NO: 155138 - RNA, 22 nt, Human
uccucaggugacuagguaucuu

SEQ ID NO: 155139 - RNA, 22 nt, Human
caggggcuguuugccucaggcc

SEQ ID NO: 155140 - RNA, 22 nt, Human
cagagccugccaccuuucuccc

SEQ ID NO: 155141 - RNA, 22 nt, Human
uggggaggacgggcgccuuccu

SEQ ID NO: 155142 - RNA, 22 nt, Human
uacuguauuugauaagugaagu

SEQ ID NO: 155143 - RNA, 22 nt, Human
acacuuuguuguggcauauacg

SEQ ID NO: 155144 - RNA, 22 nt, Human
gaggagcacaugaggcugaggg

SEQ ID NO: 155145 - RNA, 22 nt, Human
gcuucucuggccugcagggcau

SEQ ID NO: 155146 - RNA, 22 nt, Human
gauacauuuuaucuccuaacag

SEQ ID NO: 155147 - RNA, 22 nt, Human
gcaugcugcaccagagccucuc

SEQ ID NO: 155148 - RNA, 22 nt, Human
gccuucaggaggguuccagaca

SEQ ID NO: 155149 - RNA, 22 nt, Human
guuccuauauagccuuaaggau

SEQ ID NO: 155150 - RNA, 22 nt, Human
gagagcugcaagguagggcggg

SEQ ID NO: 155151 - RNA, 22 nt, Human
cuggcaggaaguuagaugguaa

SEQ ID NO: 155152 - RNA, 22 nt, Human
uugaagcauuguggcuuguauu

SEQ ID NO: 155153 - RNA, 22 nt, Human
uggcagaggaaaaagucacugg

SEQ ID NO: 155154 - RNA, 22 nt, Human
agcuggccuguuagagcugagu

SEQ ID NO: 155155 - RNA, 22 nt, Human
guaucuuuuacaccaggaaauu

SEQ ID NO: 155156 - RNA, 22 nt, Human
aggcccuggcacugccugggag

SEQ ID NO: 155157 - RNA, 22 nt, Human
uaagaacaucuguccccagauu

SEQ ID NO: 155158 - RNA, 22 nt, Human
gcucugcuggaaguucucugga

SEQ ID NO: 155159 - RNA, 22 nt, Human
aaagaggaaccaagagcacgug

SEQ ID NO: 155160 - RNA, 22 nt, Human
aaaguguagagacuuuggaacc

SEQ ID NO: 155161 - RNA, 22 nt, Human
gcagagccccauugcuggcggg

SEQ ID NO: 155162 - RNA, 22 nt, Human
aaaguucaugguguuauagaaa

SEQ ID NO: 155163 - RNA, 22 nt, Human
cucugagaaagcugugagcuaa

SEQ ID NO: 155164 - RNA, 22 nt, Human
uuucauguuuauggaaaaugag

SEQ ID NO: 155165 - RNA, 22 nt, Human
uuaguaauguguuaauaugaau

SEQ ID NO: 155166 - RNA, 22 nt, Human
uuagaaaucugcugccaugcaa

SEQ ID NO: 155167 - RNA, 22 nt, Human
aggcacugagaggcuguguugc

SEQ ID NO: 155168 - RNA, 22 nt, Human
ucuuucucucuaaucaagcaca

SEQ ID NO: 155169 - RNA, 22 nt, Human
uggcugaaggaagauucuucua

SEQ ID NO: 155170 - RNA, 22 nt, Human
aaagaacagauguguggugcau

SEQ ID NO: 155171 - RNA, 22 nt, Human
cccuggagguggagguugcagg

SEQ ID NO: 155172 - RNA, 22 nt, Human
cucaguuucugacauuaaaauc

SEQ ID NO: 155173 - RNA, 22 nt, Human
aaaugaacaguugcauucucug

SEQ ID NO: 155174 - RNA, 22 nt, Human
augucuuucgcaucaguagcua

SEQ ID NO: 155175 - RNA, 22 nt, Human
uggcagggccugaaucuuauac

SEQ ID NO: 155176 - RNA, 22 nt, Human
guuccacaaaauguacccaguu

SEQ ID NO: 155177 - RNA, 22 nt, Human
ucuggcuccacuuucuucauuu

SEQ ID NO: 155178 - RNA, 22 nt, Human
ggugaggcuaagugacacaggg

SEQ ID NO: 155179 - RNA, 22 nt, Human
aaagauuugaguucugcuuaua

SEQ ID NO: 155180 - RNA, 22 nt, Human
ucacauuuuaucuauuuuaagu

SEQ ID NO: 155181 - RNA, 22 nt, Human
ugacagcugagccccaggcaag

SEQ ID NO: 155182 - RNA, 22 nt, Human
cugggggcaauggucagagugu

SEQ ID NO: 155183 - RNA, 22 nt, Human
ggacucagcagccaggaguggc

SEQ ID NO: 155184 - RNA, 22 nt, Human
guuuuccuucucagccauugcc

SEQ ID NO: 155185 - RNA, 22 nt, Human
ugggcucugugccagguuggug

SEQ ID NO: 155186 - RNA, 22 nt, Human
ucagaagcaaacaucacucuag

SEQ ID NO: 155187 - RNA, 22 nt, Human
cagggccugccugguuccugga

SEQ ID NO: 155188 - RNA, 22 nt, Human
uggcucagcuuacuuuugaggg

SEQ ID NO: 155189 - RNA, 22 nt, Human
aggaggccgcugaugggcuccc

SEQ ID NO: 155190 - RNA, 19 nt, Human
ggucacagggguuacaagg

SEQ ID NO: 155191 - RNA, 22 nt, Human
cccucccagaugggcuugaggu

SEQ ID NO: 155192 - RNA, 22 nt, Human
cuccugagcucugaggaagcuu

SEQ ID NO: 155193 - RNA, 22 nt, Human
cugaaggauuagagagcacuua

SEQ ID NO: 155194 - RNA, 22 nt, Human
uggcagaggaggcucagauuga

SEQ ID NO: 155195 - RNA, 22 nt, Human
agcagugaugcaugacagccua

SEQ ID NO: 155196 - RNA, 22 nt, Human
gcucagagaugucugcugccuu

SEQ ID NO: 155197 - RNA, 22 nt, Human
ucagagaaaugaaguagggauu

SEQ ID NO: 155198 - RNA, 22 nt, Human
ugaggccagucucaucacaggc

SEQ ID NO: 155199 - RNA, 22 nt, Human
gggucccaggaaggagcagugu

SEQ ID NO: 155200 - RNA, 22 nt, Human
agccucugugacucacagguca

SEQ ID NO: 155201 - RNA, 22 nt, Human
aggcccaguuauccuacuuguu

SEQ ID NO: 155202 - RNA, 22 nt, Human
uugucuguaaagacggccacca

SEQ ID NO: 155203 - RNA, 22 nt, Human
acagggccucagcugauucugg

SEQ ID NO: 155204 - RNA, 21 nt, Human
agcagaggcagaauguaugca

SEQ ID NO: 155205 - RNA, 22 nt, Human
uagucuuuuuaauaaauaaugc

SEQ ID NO: 155206 - RNA, 22 nt, Human
ugcugccuuagcagccaggcaa

SEQ ID NO: 155207 - RNA, 22 nt, Human
cugccuuggcccuaguucaugg

SEQ ID NO: 155208 - RNA, 22 nt, Human
gcugcucugcuguguaagcagg

SEQ ID NO: 155209 - RNA, 22 nt, Human
acuuccuguuaugugugccucu

SEQ ID NO: 155210 - RNA, 22 nt, Human
aaaugucuguuagucauaucau

SEQ ID NO: 155211 - RNA, 22 nt, Human
gcccucagaggacagcugacuu

SEQ ID NO: 155212 - RNA, 22 nt, Human
gcugcucuccauggccgugagu

SEQ ID NO: 155213 - RNA, 22 nt, Human
cugcuuuguguggucccuccag

SEQ ID NO: 155214 - RNA, 22 nt, Human
cauugcacgggcgucugucugu

SEQ ID NO: 155215 - RNA, 21 nt, Human
cccuguguuccacagcagaca

SEQ ID NO: 155216 - RNA, 22 nt, Human
uggcugggccgggccuugugcc

SEQ ID NO: 155217 - RNA, 20 nt, Human
ccagcauguacacaugugga

SEQ ID NO: 155218 - RNA, 22 nt, Human
gagagcugggaaagccguggag

SEQ ID NO: 155219 - RNA, 22 nt, Human
agcagcagaggucagaaaggua

SEQ ID NO: 155220 - RNA, 22 nt, Human
ugcagaaggaggaggaaaucca

SEQ ID NO: 155221 - RNA, 22 nt, Human
agccauggcgccacuagaggga

SEQ ID NO: 155222 - RNA, 22 nt, Human
cacaggguuguucugaggauuc

SEQ ID NO: 155223 - RNA, 22 nt, Human
ugcucagggacaauggagaggg

SEQ ID NO: 155224 - RNA, 22 nt, Human
caggaaggcccaccuguccugu

SEQ ID NO: 155225 - RNA, 22 nt, Human
agcucccagaguccucugccca

SEQ ID NO: 155226 - RNA, 22 nt, Human
uguggccaccagagcugcuauu

SEQ ID NO: 155227 - RNA, 22 nt, Human
cugaggcugcccagggccaggu

SEQ ID NO: 155228 - RNA, 22 nt, Human
cucaggaugucggugacuauug

SEQ ID NO: 155229 - RNA, 22 nt, Human
ggcagcucacugauuagcaauu

SEQ ID NO: 155230 - RNA, 22 nt, Human
ugggagcucagaaagggagguc

SEQ ID NO: 155231 - RNA, 22 nt, Human
agggcagccaugagccuucagg

SEQ ID NO: 155232 - RNA, 22 nt, Human
gggacaggccccucgcuagcuu

SEQ ID NO: 155233 - RNA, 22 nt, Human
gcuggccugcgagggcaggcug

SEQ ID NO: 155234 - RNA, 22 nt, Human
gcagggcuguucaggagggugg

SEQ ID NO: 155235 - RNA, 21 nt, Human
aaggaaaagcuuggucucuga

SEQ ID NO: 155236 - RNA, 22 nt, Human
uucagcagugcagacacccagu

SEQ ID NO: 155237 - RNA, 22 nt, Human
aagggcugccagggggugccag

SEQ ID NO: 155238 - RNA, 22 nt, Human
agucucugccagcuuguccucu

SEQ ID NO: 155239 - RNA, 22 nt, Human
caguuauuaugaggucauuagg

SEQ ID NO: 155240 - RNA, 22 nt, Human
uuccagaaaucuuucagcucaa

SEQ ID NO: 155241 - RNA, 22 nt, Human
gggcagggguagcauuccaagu

SEQ ID NO: 155242 - RNA, 22 nt, Human
cuggagggugagccucaucucu

SEQ ID NO: 155243 - RNA, 22 nt, Human
uaagacauuugaaaugugaucc

SEQ ID NO: 155244 - RNA, 22 nt, Human
agaaaugggccuugggacacaa

SEQ ID NO: 155245 - RNA, 20 nt, Human
uaucaaucagaaagaagacu

SEQ ID NO: 155246 - RNA, 22 nt, Human
cuccagggaaaggggcguccgc

SEQ ID NO: 155247 - RNA, 22 nt, Human
caggagccccaggcugacaaua

SEQ ID NO: 155248 - RNA, 22 nt, Human
aucuuugaagaggacuugaagu

SEQ ID NO: 155249 - RNA, 22 nt, Human
ggccugcacagagguggcucua

SEQ ID NO: 155250 - RNA, 22 nt, Human
agaggcccucucucuccugaug

SEQ ID NO: 155251 - RNA, 22 nt, Human
ccaggagcuggagggugcagug

SEQ ID NO: 155252 - RNA, 22 nt, Human
cccugagagugagugccaccuu

SEQ ID NO: 155253 - RNA, 22 nt, Human
aggacuccauguguccuggaga

SEQ ID NO: 155254 - RNA, 22 nt, Human
ggggagugacgcagggccauag

SEQ ID NO: 155255 - RNA, 22 nt, Human
ugcaagggcuuagggggcugug

SEQ ID NO: 155256 - RNA, 22 nt, Human
ccagcccuugagauggaaggga

SEQ ID NO: 155257 - RNA, 22 nt, Human
ugucccagggaaggcccagcac

SEQ ID NO: 155258 - RNA, 21 nt, Human
aaagugguaaggauuauuuug

SEQ ID NO: 155259 - RNA, 22 nt, Human
uaaauguguaaaccuccauuac

SEQ ID NO: 155260 - RNA, 22 nt, Human
aaggcacugagccagccgucuc

SEQ ID NO: 155261 - RNA, 22 nt, Human
cuggccugagcacagcggcugc

SEQ ID NO: 155262 - RNA, 22 nt, Human
ucaguuuuaagguuugagaauu

SEQ ID NO: 155263 - RNA, 22 nt, Human
cucaggggaccuggcuccgagu

SEQ ID NO: 155264 - RNA, 22 nt, Human
aggcuggaguacaguggcuauu

SEQ ID NO: 155265 - RNA, 22 nt, Human
uccaagaucuacagcaguuuag

SEQ ID NO: 155266 - RNA, 22 nt, Human
ucuucucccaucuccaggcagg

SEQ ID NO: 155267 - RNA, 22 nt, Human
agcugucuuucugccuccugau

SEQ ID NO: 155268 - RNA, 22 nt, Human
uacaugcaugucacagaaugaa

SEQ ID NO: 155269 - RNA, 19 nt, Human
ccucuccgcccaccagccc

SEQ ID NO: 155270 - RNA, 22 nt, Human
gccucugcccauccaccaucag

SEQ ID NO: 155271 - RNA, 22 nt, Human
ugcagugguguccagguguacu

SEQ ID NO: 155272 - RNA, 17 nt, Human
aggagucucagaugagc

SEQ ID NO: 155273 - RNA, 22 nt, Human
aggcacuguggguguggccgga

SEQ ID NO: 155274 - RNA, 22 nt, Human
cuguggagcuuguggcaguggg

SEQ ID NO: 155275 - RNA, 22 nt, Human
uggcagcagacaaaaggccauu

SEQ ID NO: 155276 - RNA, 22 nt, Human
caccaggcugaaccagagggga

SEQ ID NO: 155277 - RNA, 22 nt, Human
uucaacacaggaacaugauaua

SEQ ID NO: 155278 - RNA, 22 nt, Human
ggugcagaaggaagggagcugg

SEQ ID NO: 155279 - RNA, 22 nt, Human
ucuucuuccuccacagggccca

SEQ ID NO: 155280 - RNA, 22 nt, Human
caagagcuagacuuugucagga

SEQ ID NO: 155281 - RNA, 18 nt, Human
cccagcuccacuucccuc

SEQ ID NO: 155282 - RNA, 22 nt, Human
ccagagcugauuccugggacuu

SEQ ID NO: 155283 - RNA, 19 nt, Human
augagcuggcauuucaggu

SEQ ID NO: 155284 - RNA, 22 nt, Human
cugcagagguugguucuaagau

SEQ ID NO: 155285 - RNA, 22 nt, Human
uguuuuguuuaugagagcacag

SEQ ID NO: 155286 - RNA, 18 nt, Human
caugggugacagguggau

SEQ ID NO: 155287 - RNA, 21 nt, Human
uggcucugcucagagcagucc

SEQ ID NO: 155288 - RNA, 23 nt, Human
gccugggacugguagugugaccu

SEQ ID NO: 155289 - RNA, 22 nt, Human
ucaacacucuuuggcacaguua

SEQ ID NO: 155290 - RNA, 22 nt, Human
gccucugcggagcuguacauca

SEQ ID NO: 155291 - RNA, 22 nt, Human
ucacaucuuauuagaguaucuc

SEQ ID NO: 155292 - RNA, 22 nt, Human
aagucagagcaacugagacauu

SEQ ID NO: 155293 - RNA, 22 nt, Human
cagcucuggcgucagggagcga

SEQ ID NO: 155294 - RNA, 22 nt, Human
ucacuuauugcucaucucaugc

SEQ ID NO: 155295 - RNA, 22 nt, Human
acccucccauuuccauguagca

SEQ ID NO: 155296 - RNA, 22 nt, Human
aauaguguuguucacucaggag

SEQ ID NO: 155297 - RNA, 22 nt, Human
ucauaacagcuaagucccuuuc

SEQ ID NO: 155298 - RNA, 22 nt, Human
cugggguggauggguccaaguu

SEQ ID NO: 155299 - RNA, 22 nt, Human
auaucuuuguaugguucagcag

SEQ ID NO: 155300 - RNA, 22 nt, Human
caggguggaaaagcuaguugga

SEQ ID NO: 155301 - RNA, 18 nt, Human
agggucagugucacuggc

SEQ ID NO: 155302 - RNA, 22 nt, Human
gucaugccuggcuucuuagaca

SEQ ID NO: 155303 - RNA, 19 nt, Human
acagggcagcaauaggaua

SEQ ID NO: 155304 - RNA, 22 nt, Human
ccucugaggucauggacuuggc

SEQ ID NO: 155305 - RNA, 22 nt, Human
cucuccagaucugcugagccag

SEQ ID NO: 155306 - RNA, 22 nt, Human
cuuugaaagcucccaggacuua

SEQ ID NO: 155307 - RNA, 22 nt, Human
uggcccugacacgugguacugg

SEQ ID NO: 155308 - RNA, 22 nt, Human
aucagcaaucucguguauuagg

SEQ ID NO: 155309 - RNA, 22 nt, Human
aucuacagugcacaggacagcc

SEQ ID NO: 155310 - RNA, 22 nt, Human
gcagugugaccgagcuugcuuc

SEQ ID NO: 155311 - RNA, 22 nt, Human
gccugggugaauuugauccuaa

SEQ ID NO: 155312 - RNA, 22 nt, Human
auguguauacuugugcuuacuc

SEQ ID NO: 155313 - RNA, 22 nt, Human
auccaggguguggagagagcuc

SEQ ID NO: 155314 - RNA, 19 nt, Human
ugaggccaaggucacagau

SEQ ID NO: 155315 - RNA, 22 nt, Human
aggccuguuccuuccugggcac

SEQ ID NO: 155316 - RNA, 22 nt, Human
ugagcuucaaaauaugugaauc

SEQ ID NO: 155317 - RNA, 22 nt, Human
caguacuuauuucuauuuaggg

SEQ ID NO: 155318 - RNA, 19 nt, Human
ggcugcugguuacagaggc

SEQ ID NO: 155319 - RNA, 22 nt, Human
ucucacucauuuccuaggucuu

SEQ ID NO: 155320 - RNA, 22 nt, Human
gucuuguuugggauguggaugg

SEQ ID NO: 155321 - RNA, 22 nt, Human
agcugguuagcaaucuaaguga

SEQ ID NO: 155322 - RNA, 22 nt, Human
agacagcugcucgcagagcuau

SEQ ID NO: 155323 - RNA, 22 nt, Human
ugcauuguuuagaacucuuugg

SEQ ID NO: 155324 - RNA, 22 nt, Human
ugggcucucuggcaggaaggcu

SEQ ID NO: 155325 - RNA, 22 nt, Human
uggcagggccuaccccaauauc

SEQ ID NO: 155326 - RNA, 22 nt, Human
cauuuacauuuaagguuaauau

SEQ ID NO: 155327 - RNA, 23 nt, Human
acagggcauugcuggccucgagg

SEQ ID NO: 155328 - RNA, 22 nt, Human
ucagaagaagagacuccacagc

SEQ ID NO: 155329 - RNA, 22 nt, Human
gcugagugauugauauuuuagu

SEQ ID NO: 155330 - RNA, 22 nt, Human
guacauuuuacuuuguuugaau

SEQ ID NO: 155331 - RNA, 22 nt, Human
ccugugucuuccccacuggugu

SEQ ID NO: 155332 - RNA, 22 nt, Human
uagaauaugugguaggaucugg

SEQ ID NO: 155333 - RNA, 22 nt, Human
agggcccaggacagcaucaggg

SEQ ID NO: 155334 - RNA, 22 nt, Human
cagcagcuucuguugaucagaa

SEQ ID NO: 155335 - RNA, 22 nt, Human
ggcccucccugagccagguggg

SEQ ID NO: 155336 - RNA, 22 nt, Human
cagagcugggcauggugaaagg

SEQ ID NO: 155337 - RNA, 22 nt, Human
ccugggaguggcacucacagca

SEQ ID NO: 155338 - RNA, 22 nt, Human
gaguggagcaaaagagguagau

SEQ ID NO: 155339 - RNA, 22 nt, Human
ugauuucccuguagccucugaa

SEQ ID NO: 155340 - RNA, 22 nt, Human
gcuguuccugcuuagaggucgg

SEQ ID NO: 155341 - RNA, 22 nt, Human
aucucagggcuggagcccugga

SEQ ID NO: 155342 - RNA, 22 nt, Human
gcagagccaggagagacccuug

SEQ ID NO: 155343 - RNA, 22 nt, Human
aagcuggagaguuaggugaaua

SEQ ID NO: 155344 - RNA, 22 nt, Human
aaggucauuuuuuccucuguug

SEQ ID NO: 155345 - RNA, 22 nt, Human
cacagggcuaaaugaaggguug

SEQ ID NO: 155346 - RNA, 22 nt, Human
gccagagcugagacacgagucc

SEQ ID NO: 155347 - RNA, 22 nt, Human
ucucagggaccaugaugaugac

SEQ ID NO: 155348 - RNA, 22 nt, Human
gugucccaauguucaggacggc

SEQ ID NO: 155349 - RNA, 22 nt, Human
ccacccuuggguucggaggccg

SEQ ID NO: 155350 - RNA, 22 nt, Human
gcaggcaggcuuccuugaacug

SEQ ID NO: 155351 - RNA, 22 nt, Human
gggcugcacagaucuucaaggg

SEQ ID NO: 155352 - RNA, 22 nt, Human
aagguacagaaauuaacaagga

SEQ ID NO: 155353 - RNA, 22 nt, Human
uaauaucuacuucauagaguuu

SEQ ID NO: 155354 - RNA, 22 nt, Human
gggaggugauggcaagcagcgg

SEQ ID NO: 155355 - RNA, 22 nt, Human
uagaaagugaagguuaauuaau

SEQ ID NO: 155356 - RNA, 22 nt, Human
ugaucagucccaugaucuucca

SEQ ID NO: 155357 - RNA, 22 nt, Human
accaugggucagccaccucagc

SEQ ID NO: 155358 - RNA, 22 nt, Human
cugcccugagucaugccagaug

SEQ ID NO: 155359 - RNA, 22 nt, Human
agguaaggcuguaagcuaagcc

SEQ ID NO: 155360 - RNA, 22 nt, Human
gaggccacgguuuuccuugggg

SEQ ID NO: 155361 - RNA, 22 nt, Human
gagggggagaugugcacacacu

SEQ ID NO: 155362 - RNA, 22 nt, Human
auuauguaacugugguucagca

SEQ ID NO: 155363 - RNA, 22 nt, Human
cuggccaggcuugggacagaca

SEQ ID NO: 155364 - RNA, 22 nt, Human
agaaaguucacugguauauuuu

SEQ ID NO: 155365 - RNA, 22 nt, Human
ccuguccuccaagagcacaucu

SEQ ID NO: 155366 - RNA, 22 nt, Human
cccugagaugccucacccuagu

SEQ ID NO: 155367 - RNA, 22 nt, Human
ugugaagcuggauccuggagcu

SEQ ID NO: 155368 - RNA, 23 nt, Human
cauguacagaguuugauaaagug

SEQ ID NO: 155369 - RNA, 22 nt, Human
cauggaaggcaaaagacacaga

SEQ ID NO: 155370 - RNA, 22 nt, Human
uggcagagagagugcagucgac

SEQ ID NO: 155371 - RNA, 22 nt, Human
ccaggacuucgaggcuacagug

SEQ ID NO: 155372 - RNA, 22 nt, Human
caaagcaaggcucaguuugaac

SEQ ID NO: 155373 - RNA, 22 nt, Human
gucccuggggaaucagcuggag

SEQ ID NO: 155374 - RNA, 21 nt, Human
uccucugcucucauaccacaa

SEQ ID NO: 155375 - RNA, 22 nt, Human
ucugucugcaccuaagcacagu

SEQ ID NO: 155376 - RNA, 22 nt, Human
cacugcuuauaaauucuaggca

SEQ ID NO: 155377 - RNA, 22 nt, Human
ccuagagcucugcuuuaucuaa

SEQ ID NO: 155378 - RNA, 20 nt, Human
acuggagccaucucagccua

SEQ ID NO: 155379 - RNA, 22 nt, Human
guuugcauuccaauuuagggga

SEQ ID NO: 155380 - RNA, 20 nt, Human
acugagcugcauggagagga

SEQ ID NO: 155381 - RNA, 22 nt, Human
guuuggggucugcagagcggcg

SEQ ID NO: 155382 - RNA, 22 nt, Human
uauuuugagguauuuuugagcu

SEQ ID NO: 155383 - RNA, 22 nt, Human
uucucuuagcuguaaagucaau

SEQ ID NO: 155384 - RNA, 22 nt, Human
aucuggcuauuucuggucgggg

SEQ ID NO: 155385 - RNA, 22 nt, Human
uaauuuaauuucaugccagccu

SEQ ID NO: 155386 - RNA, 22 nt, Human
agcagccacccagcugcucauu

SEQ ID NO: 155387 - RNA, 22 nt, Human
ucuguuccaguagaaaggugca

SEQ ID NO: 155388 - RNA, 22 nt, Human
cugggccagcaacugcaaugga

SEQ ID NO: 155389 - RNA, 20 nt, Human
agugacagagacuguguggc

SEQ ID NO: 155390 - RNA, 22 nt, Human
cagagcugauuggauccagaga

SEQ ID NO: 155391 - RNA, 22 nt, Human
ugaggugaccgcagaugggaag

SEQ ID NO: 155392 - RNA, 21 nt, Human
cacugcagccuugaccugggc

SEQ ID NO: 155393 - RNA, 22 nt, Human
acagagguguguguaggacagu

SEQ ID NO: 155394 - RNA, 22 nt, Human
cucugagcagaggccguggcua

SEQ ID NO: 155395 - RNA, 23 nt, Human
uuucauaugguguggaugaagaa

SEQ ID NO: 155396 - RNA, 20 nt, Human
acugcuucuuucucugaccu

SEQ ID NO: 155397 - RNA, 22 nt, Human
aagagcuggaagugaagauaac

SEQ ID NO: 155398 - RNA, 22 nt, Human
ccucccagugccuccagagcag

SEQ ID NO: 155399 - RNA, 22 nt, Human
aguuuauguagaauuggcaaua

SEQ ID NO: 155400 - RNA, 22 nt, Human
ccuccaggauaagucagggccu

SEQ ID NO: 155401 - RNA, 22 nt, Human
ucccagaggaaauggcagcuga

SEQ ID NO: 155402 - RNA, 22 nt, Human
ucccagaggucucugcugguuc

SEQ ID NO: 155403 - RNA, 22 nt, Human
aaaugaccagaauacaggcuuc

SEQ ID NO: 155404 - RNA, 22 nt, Human
cacccaggcuggagugcagggg

SEQ ID NO: 155405 - RNA, 22 nt, Human
caggcagauuugcugcccucca

SEQ ID NO: 155406 - RNA, 22 nt, Human
uucuuuaaaauagugagaaaga

SEQ ID NO: 155407 - RNA, 22 nt, Human
ccaaggaguagagcaggaagcu

SEQ ID NO: 155408 - RNA, 22 nt, Human
auugacaaauggauguugacau

SEQ ID NO: 155409 - RNA, 22 nt, Human
cagugcaguuucccagaugcug

SEQ ID NO: 155410 - RNA, 22 nt, Human
caugcacagugauaucugaaga

SEQ ID NO: 155411 - RNA, 16 nt, Human
agcagccagcacugga

SEQ ID NO: 155412 - RNA, 20 nt, Human
acaaaugcauucugugacau

SEQ ID NO: 155413 - RNA, 22 nt, Human
uagaaaugcaguguacuguguc

SEQ ID NO: 155414 - RNA, 22 nt, Human
ucccagagccaagcuauggaug

SEQ ID NO: 155415 - RNA, 22 nt, Human
ggaccagagaagugagcaccug

SEQ ID NO: 155416 - RNA, 22 nt, Human
ugacacagauuagagacauacc

SEQ ID NO: 155417 - RNA, 20 nt, Human
gguagcagcugcugucaucc

SEQ ID NO: 155418 - RNA, 22 nt, Human
gcagacagacugcagugauuuu

SEQ ID NO: 155419 - RNA, 22 nt, Human
aagggcaggcacccacccucac

SEQ ID NO: 155420 - RNA, 22 nt, Human
cacaguggcagguguggguugu

SEQ ID NO: 155421 - RNA, 22 nt, Human
ugcagaagcagagccgguggcc

SEQ ID NO: 155422 - RNA, 22 nt, Human
acugcagccuagggaccacagu

SEQ ID NO: 155423 - RNA, 22 nt, Human
ccacaggggcccacgagccgcu

SEQ ID NO: 155424 - RNA, 22 nt, Human
cagcuggcagaaccugcaucca

SEQ ID NO: 155425 - RNA, 22 nt, Human
uugaggagcacuagucagguau

SEQ ID NO: 155426 - RNA, 23 nt, Human
gugugccaagcacugugccagga

SEQ ID NO: 155427 - RNA, 19 nt, Human
guuuuucccagacgaggca

SEQ ID NO: 155428 - RNA, 22 nt, Human
gcaguggcaugaugugggcuca

SEQ ID NO: 155429 - RNA, 22 nt, Human
gcagccaccucccauggcgggg

SEQ ID NO: 155430 - RNA, 22 nt, Human
uaaaguucagugcaugaaugug

SEQ ID NO: 155431 - RNA, 22 nt, Human
accucugcaaugcaaugucaug

SEQ ID NO: 155432 - RNA, 22 nt, Human
cugggagguggagguugcauug

SEQ ID NO: 155433 - RNA, 22 nt, Human
agcagccagaaagggcagucga

SEQ ID NO: 155434 - RNA, 22 nt, Human
uucauauauaugcacuacguac

SEQ ID NO: 155435 - RNA, 22 nt, Human
ugugaaagauacuaggcagagg

SEQ ID NO: 155436 - RNA, 22 nt, Human
ucaaggugcugugcugugcuag

SEQ ID NO: 155437 - RNA, 22 nt, Human
ccuccugguccagcaucucuuu

SEQ ID NO: 155438 - RNA, 22 nt, Human
ugagcuucuuuauuuggccaga

SEQ ID NO: 155439 - RNA, 22 nt, Human
ggacucuguuuuccugaucacu

SEQ ID NO: 155440 - RNA, 18 nt, Human
acagacaaaauggaaaug

SEQ ID NO: 155441 - RNA, 22 nt, Human
caguggaggccuugggaccuuu

SEQ ID NO: 155442 - RNA, 22 nt, Human
gccuguguggaugcgccggugc

SEQ ID NO: 155443 - RNA, 20 nt, Human
aggcucagagcaguaguaca

SEQ ID NO: 155444 - RNA, 22 nt, Human
ccugccaggacauugcuugaag

SEQ ID NO: 155445 - RNA, 22 nt, Human
gcuggccucaucacugacuucu

SEQ ID NO: 155446 - RNA, 22 nt, Human
gaaggaagugcucauacuaguu

SEQ ID NO: 155447 - RNA, 20 nt, Human
gggcaguggcgcuaucucag

SEQ ID NO: 155448 - RNA, 22 nt, Human
ugcaggugugguuccucagcca

SEQ ID NO: 155449 - RNA, 22 nt, Human
ucagcugcucuguugagcugaa

SEQ ID NO: 155450 - RNA, 22 nt, Human
aaugaugguuaaacacuggagg

SEQ ID NO: 155451 - RNA, 22 nt, Human
agagcuuauaucuuggccaucc

SEQ ID NO: 155452 - RNA, 22 nt, Human
uuacaaaguucugaguucaaac

SEQ ID NO: 155453 - RNA, 22 nt, Human
ccucacuggccagccaggggug

SEQ ID NO: 155454 - RNA, 22 nt, Human
auucuuggcaaggagauuuaaa

SEQ ID NO: 155455 - RNA, 22 nt, Human
caggugggcuugggagaacacu

SEQ ID NO: 155456 - RNA, 22 nt, Human
uccagggcuuggcugggacggu

SEQ ID NO: 155457 - RNA, 22 nt, Human
aguuauauaacuaucuagaugc

SEQ ID NO: 155458 - RNA, 22 nt, Human
ccuuggaggacugcugcuucuu

SEQ ID NO: 155459 - RNA, 21 nt, Human
aggcucagagaucaaacagua

SEQ ID NO: 155460 - RNA, 22 nt, Human
ucagaaauagucuuuaaaauga

SEQ ID NO: 155461 - RNA, 22 nt, Human
gcagggucuugagaggcagcca

SEQ ID NO: 155462 - RNA, 22 nt, Human
auggcucauuuaucuugcagcc

SEQ ID NO: 155463 - RNA, 23 nt, Human
ggagugcaauggcgccaucucgg

SEQ ID NO: 155464 - RNA, 22 nt, Human
gagaaguuucugguuugcauag

SEQ ID NO: 155465 - RNA, 22 nt, Human
guguaaggccccagguucuuua

SEQ ID NO: 155466 - RNA, 22 nt, Human
gcuggcugcgucaucacagggc

SEQ ID NO: 155467 - RNA, 22 nt, Human
agggcugccugcucugcauuga

SEQ ID NO: 155468 - RNA, 22 nt, Human
cugggagucaccaggagcaagg

SEQ ID NO: 155469 - RNA, 22 nt, Human
uggagccagcccaggccccucu

SEQ ID NO: 155470 - RNA, 22 nt, Human
uaagaacagugacagccaacau

SEQ ID NO: 155471 - RNA, 22 nt, Human
ugcugucugauucagggugauu

SEQ ID NO: 155472 - RNA, 22 nt, Human
ggagccaguuuagaccucaguu

SEQ ID NO: 155473 - RNA, 22 nt, Human
uaaggcacacaguugcugcaug

SEQ ID NO: 155474 - RNA, 22 nt, Human
uacagaaaucacaucgcuuuga

SEQ ID NO: 155475 - RNA, 22 nt, Human
uaaaugcagcaguuucuguucu

SEQ ID NO: 155476 - RNA, 22 nt, Human
ucugccuggauuuuggaaagcu

SEQ ID NO: 155477 - RNA, 22 nt, Human
cagcucugugcaggccugggga

SEQ ID NO: 155478 - RNA, 19 nt, Human
ucgagucaagacacuaggc

SEQ ID NO: 155479 - RNA, 22 nt, Human
uacaaaguuuucuuggauugag

SEQ ID NO: 155480 - RNA, 22 nt, Human
gagccuguguuuccuguagcca

SEQ ID NO: 155481 - RNA, 22 nt, Human
ggcacugagcgggcucugagcg

SEQ ID NO: 155482 - RNA, 22 nt, Human
ucacacguccuugcuacuccuc

SEQ ID NO: 155483 - RNA, 22 nt, Human
uggaagccaggcccgcuccuaa

SEQ ID NO: 155484 - RNA, 21 nt, Human
cagaggcugagagggcaaucu

SEQ ID NO: 155485 - RNA, 19 nt, Human
uccugggcugggccagguc

SEQ ID NO: 155486 - RNA, 22 nt, Human
uggagcagcaucacuuugagcu

SEQ ID NO: 155487 - RNA, 21 nt, Human
gagcugggcgaggcuccgggg

SEQ ID NO: 155488 - RNA, 20 nt, Human
aggcucagcugagcucuugg

SEQ ID NO: 155489 - RNA, 18 nt, Human
cuucagugacagucuggc

SEQ ID NO: 155490 - RNA, 22 nt, Human
uagggcaguuucauguuaucuu

SEQ ID NO: 155491 - RNA, 22 nt, Human
ugugcuucugcagagacuauuu

SEQ ID NO: 155492 - RNA, 22 nt, Human
aauuuagauugauaaacaugga

SEQ ID NO: 155493 - RNA, 18 nt, Human
uucaccagugugaugggu

SEQ ID NO: 155494 - RNA, 22 nt, Human
ugaagcagagugaaggugaauu

SEQ ID NO: 155495 - RNA, 22 nt, Human
cuggcucaauaaauauuagcug

SEQ ID NO: 155496 - RNA, 22 nt, Human
aauaaacugcucaauugcauca

SEQ ID NO: 155497 - RNA, 22 nt, Human
ggagagaauuccauggacaugu

SEQ ID NO: 155498 - RNA, 22 nt, Human
cacaccuguaauaccagcuacu

SEQ ID NO: 155499 - RNA, 22 nt, Human
aacauuuaugguagucauugca

SEQ ID NO: 155500 - RNA, 22 nt, Human
uccuuggcuuucuggagcuucu

SEQ ID NO: 155501 - RNA, 22 nt, Human
ggggauggauuccgggucccug

SEQ ID NO: 155502 - RNA, 22 nt, Human
auaagagcuagucuuuuccuug

SEQ ID NO: 155503 - RNA, 22 nt, Human
ugccugggggacuaaggccaaa

SEQ ID NO: 155504 - RNA, 22 nt, Human
guauuugauacaugaaauggug

SEQ ID NO: 155505 - RNA, 21 nt, Human
agggcagauuagcuguaagag

SEQ ID NO: 155506 - RNA, 22 nt, Human
uugcauugauguuccuucuugc

SEQ ID NO: 155507 - RNA, 22 nt, Human
agggcagaggcggacacggaag

SEQ ID NO: 155508 - RNA, 22 nt, Human
agaauucuuggugguuagaaua

SEQ ID NO: 155509 - RNA, 22 nt, Human
uggggcuggcuauugucucccu

SEQ ID NO: 155510 - RNA, 22 nt, Human
aaaaaugugaccacaggguguu

SEQ ID NO: 155511 - RNA, 22 nt, Human
cuguccuaugaguacucacuag

SEQ ID NO: 155512 - RNA, 22 nt, Human
accaaggagccacauacaaccu

SEQ ID NO: 155513 - RNA, 19 nt, Human
ucacaggcaucuccccaga

SEQ ID NO: 155514 - RNA, 22 nt, Human
cugggagcugucaggagcgugu

SEQ ID NO: 155515 - RNA, 22 nt, Human
cuggcagcucuacucagagccu

SEQ ID NO: 155516 - RNA, 22 nt, Human
ugaaaaggagccuuagguaggu

SEQ ID NO: 155517 - RNA, 22 nt, Human
agcugcucugauaaaccuacuu

SEQ ID NO: 155518 - RNA, 22 nt, Human
cagccagggagcaaagaguuga

SEQ ID NO: 155519 - RNA, 22 nt, Human
gcucccaccuuugcuaucagua

SEQ ID NO: 155520 - RNA, 22 nt, Human
cccagacucaucccugggagcu

SEQ ID NO: 155521 - RNA, 22 nt, Human
gaaggaaaggucucaugccuuu

SEQ ID NO: 155522 - RNA, 22 nt, Human
ccagagcccgggaccuggacuu

SEQ ID NO: 155523 - RNA, 22 nt, Human
ccuggcucuucagagguuccua

SEQ ID NO: 155524 - RNA, 22 nt, Human
ggcugcuggaagacugaacaag

SEQ ID NO: 155525 - RNA, 22 nt, Human
aggcuccuugcucacaggcuca

SEQ ID NO: 155526 - RNA, 22 nt, Human
cuacuuuaauuuucugcagaga

SEQ ID NO: 155527 - RNA, 22 nt, Human
acugugugggccgcucacuggg

SEQ ID NO: 155528 - RNA, 22 nt, Human
caaaguuuaaaguagauuucag

SEQ ID NO: 155529 - RNA, 22 nt, Human
gcucuggguagccacugccugg

SEQ ID NO: 155530 - RNA, 22 nt, Human
guggcaggucccauuggagcag

SEQ ID NO: 155531 - RNA, 22 nt, Human
agcagcugaccagugaguccug

SEQ ID NO: 155532 - RNA, 22 nt, Human
ucuggccugggccugccggugc

SEQ ID NO: 155533 - RNA, 21 nt, Human
cuccugggcuaagauauagug

SEQ ID NO: 155534 - RNA, 22 nt, Human
cugggaggcagucucucuagaa

SEQ ID NO: 155535 - RNA, 22 nt, Human
uuuuuaagagauucuccagucu

SEQ ID NO: 155536 - RNA, 22 nt, Human
auguuacauaguccuuauuugu

SEQ ID NO: 155537 - RNA, 22 nt, Human
cuuucucugugugguaaagggc

SEQ ID NO: 155538 - RNA, 22 nt, Human
ugggacugcucuugcugggguc

SEQ ID NO: 155539 - RNA, 22 nt, Human
agagcuggguggacuuguaguu

SEQ ID NO: 155540 - RNA, 22 nt, Human
ugcaagagguaaaaugaaagga

SEQ ID NO: 155541 - RNA, 20 nt, Human
cagaaggucuaagcuuuaga

SEQ ID NO: 155542 - RNA, 22 nt, Human
agagugaucagauaucaggugu

SEQ ID NO: 155543 - RNA, 22 nt, Human
cagguggguacaucacagagac

SEQ ID NO: 155544 - RNA, 23 nt, Human
ccaaagucgaagucuaguccaga

SEQ ID NO: 155545 - RNA, 22 nt, Human
augggaguuuucucugaugcuc

SEQ ID NO: 155546 - RNA, 22 nt, Human
aggcugccucgugagcucgcug

SEQ ID NO: 155547 - RNA, 22 nt, Human
cagggcuguaaauuagugcuga

SEQ ID NO: 155548 - RNA, 22 nt, Human
gcagagugauggaaugugggug

SEQ ID NO: 155549 - RNA, 22 nt, Human
uggcagaguucgcugugccuuu

SEQ ID NO: 155550 - RNA, 22 nt, Human
cacugcaguuccccagugcgca

SEQ ID NO: 155551 - RNA, 22 nt, Human
gaagccaguacugugcucugca

SEQ ID NO: 155552 - RNA, 22 nt, Human
agagugggugaucucuguuguc

SEQ ID NO: 155553 - RNA, 22 nt, Human
gccaccagugggggccugggca

SEQ ID NO: 155554 - RNA, 22 nt, Human
cauggcccucuucuggagcaau

SEQ ID NO: 155555 - RNA, 22 nt, Human
auaauuuacaacugcuuuuaau

SEQ ID NO: 155556 - RNA, 22 nt, Human
gcagcugcaggcaggcuugcug

SEQ ID NO: 155557 - RNA, 21 nt, Human
ccugagccuguuuauccagaa

SEQ ID NO: 155558 - RNA, 22 nt, Human
gcugcccucccagggcaagcuu

SEQ ID NO: 155559 - RNA, 22 nt, Human
gcagcuuuuuggaugucaguua

SEQ ID NO: 155560 - RNA, 22 nt, Human
cauucauuagaauagauaugua

SEQ ID NO: 155561 - RNA, 22 nt, Human
cugcugucuuuauuucacugcu

SEQ ID NO: 155562 - RNA, 22 nt, Human
ugguacuuggaggcagaaaaau

SEQ ID NO: 155563 - RNA, 18 nt, Human
acagaaauagcugugccu

SEQ ID NO: 155564 - RNA, 22 nt, Human
ggggcagaguagcuggggugug

SEQ ID NO: 155565 - RNA, 22 nt, Human
uccuggagcuuccuucauggua

SEQ ID NO: 155566 - RNA, 22 nt, Human
gugcauauaugcacauaugugu

SEQ ID NO: 155567 - RNA, 22 nt, Human
uccuugaaaaucuugguuuaga

SEQ ID NO: 155568 - RNA, 22 nt, Human
ugagccagaguggagugugccu

SEQ ID NO: 155569 - RNA, 22 nt, Human
cagcuccagcccaggcagcucc

SEQ ID NO: 155570 - RNA, 22 nt, Human
ugggcagagaguagaggcaacg

SEQ ID NO: 155571 - RNA, 22 nt, Human
cuccaguaucuguaggaaaagg

SEQ ID NO: 155572 - RNA, 21 nt, Human
agcucagccgggcacaguggc

SEQ ID NO: 155573 - RNA, 22 nt, Human
gcugccacgaucucugcuguag

SEQ ID NO: 155574 - RNA, 22 nt, Human
uccaguggguugcugagggagg

SEQ ID NO: 155575 - RNA, 22 nt, Human
gcuaccugagcaagagcuucaa

SEQ ID NO: 155576 - RNA, 22 nt, Human
aggauccuuuggccacuucuua

SEQ ID NO: 155577 - RNA, 22 nt, Human
ucaggugguccuaagugccauc

SEQ ID NO: 155578 - RNA, 22 nt, Human
gcaggggcuaaggacacagaga

SEQ ID NO: 155579 - RNA, 22 nt, Human
agaugcuucaguguuuaauuua

SEQ ID NO: 155580 - RNA, 22 nt, Human
gagucaguaauggauaugucau

SEQ ID NO: 155581 - RNA, 22 nt, Human
cauuaugugggaaaauguucuu

SEQ ID NO: 155582 - RNA, 19 nt, Human
gccagcagaaugaugaggc

SEQ ID NO: 155583 - RNA, 22 nt, Human
agacaaaggauuaaugaugaug

SEQ ID NO: 155584 - RNA, 22 nt, Human
gcucuggacccuggaguggcug

SEQ ID NO: 155585 - RNA, 22 nt, Human
gcucuuccauuucucuugaacu

SEQ ID NO: 155586 - RNA, 22 nt, Human
uagacacauccguggaagcuuc

SEQ ID NO: 155587 - RNA, 22 nt, Human
guuauugcaguauagaggucua

SEQ ID NO: 155588 - RNA, 22 nt, Human
aaagcaaugaugguagacacgu

SEQ ID NO: 155589 - RNA, 21 nt, Human
ugaagccugaggcauagcccc

SEQ ID NO: 155590 - RNA, 18 nt, Human
ugcucuggucucacuugg

SEQ ID NO: 155591 - RNA, 22 nt, Human
ugcagcuguaacagaggccuca

SEQ ID NO: 155592 - RNA, 20 nt, Human
gcaggcagggaaugggggug

SEQ ID NO: 155593 - RNA, 22 nt, Human
gcaggagcagucaggggcagcu

SEQ ID NO: 155594 - RNA, 22 nt, Human
ccugagagcagcuuccugcuua

SEQ ID NO: 155595 - RNA, 22 nt, Human
gguggagcuguggacaggaagg

SEQ ID NO: 155596 - RNA, 22 nt, Human
aucugacaaccuauugacuuga

SEQ ID NO: 155597 - RNA, 22 nt, Human
cugaggaugguguggucuucuc

SEQ ID NO: 155598 - RNA, 22 nt, Human
uccugagauaaaucucauguga

SEQ ID NO: 155599 - RNA, 22 nt, Human
ucccagggugcgccugcccucg

SEQ ID NO: 155600 - RNA, 22 nt, Human
ccagcacugcucucagacugag

SEQ ID NO: 155601 - RNA, 22 nt, Human
acuuucucaggaauucacagac

SEQ ID NO: 155602 - RNA, 22 nt, Human
cuccaggccagggaaguggaca

SEQ ID NO: 155603 - RNA, 22 nt, Human
ucuaaaaaagucuguucacuug

SEQ ID NO: 155604 - RNA, 22 nt, Human
aaugcacaugccacauguggua

SEQ ID NO: 155605 - RNA, 22 nt, Human
cccuggaggcggauguugcagu

SEQ ID NO: 155606 - RNA, 22 nt, Human
agauuucccacuccauguauug

SEQ ID NO: 155607 - RNA, 23 nt, Human
agagcuuucuaaaauguaaaucu

SEQ ID NO: 155608 - RNA, 22 nt, Human
agcucacaguguccuuccucaa

SEQ ID NO: 155609 - RNA, 20 nt, Human
ccugucugcaauggagguca

SEQ ID NO: 155610 - RNA, 22 nt, Human
gagcacagcuggagguagcauu

SEQ ID NO: 155611 - RNA, 22 nt, Human
ccacagagagugucagccuuug

SEQ ID NO: 155612 - RNA, 22 nt, Human
ugccuugguucucuacuuggag

SEQ ID NO: 155613 - RNA, 22 nt, Human
ccuggagauuauuugguccaau

SEQ ID NO: 155614 - RNA, 22 nt, Human
cauucauuuaugaaauaucuau

SEQ ID NO: 155615 - RNA, 22 nt, Human
ccccuuccaggaagcagaaucg

SEQ ID NO: 155616 - RNA, 21 nt, Human
ccccugggagcccugucagua

SEQ ID NO: 155617 - RNA, 22 nt, Human
aucuggcugacuuugugggaca

SEQ ID NO: 155618 - RNA, 22 nt, Human
uggagcagccaugaugacagag

SEQ ID NO: 155619 - RNA, 22 nt, Human
agucucugcugguugugccuau

SEQ ID NO: 155620 - RNA, 20 nt, Human
aaucagaaagugugagcucu

SEQ ID NO: 155621 - RNA, 22 nt, Human
agcugagagguggcaagcugua

SEQ ID NO: 155622 - RNA, 22 nt, Human
uggcacugccuggcagggcccc

SEQ ID NO: 155623 - RNA, 22 nt, Human
uagauuucgcugcaucucaauc

SEQ ID NO: 155624 - RNA, 22 nt, Human
gcugccuuuugcuccucccacc

SEQ ID NO: 155625 - RNA, 22 nt, Human
uggcugcuagccagagcuucag

SEQ ID NO: 155626 - RNA, 22 nt, Human
uccugaggaaaguucaugaaug

SEQ ID NO: 155627 - RNA, 22 nt, Human
ugcucugucaagaaaagaugcc

SEQ ID NO: 155628 - RNA, 20 nt, Human
cccaggagugagcagcuuua

SEQ ID NO: 155629 - RNA, 22 nt, Human
ccaucuccacugucccugucaa

SEQ ID NO: 155630 - RNA, 22 nt, Human
gccuguccacuaaacagccaag

SEQ ID NO: 155631 - RNA, 20 nt, Human
gaggcugcggacugcuggac

SEQ ID NO: 155632 - RNA, 22 nt, Human
gccagcucagaugcaggaagga

SEQ ID NO: 155633 - RNA, 22 nt, Human
uagccucuggaauccuuucucu

SEQ ID NO: 155634 - RNA, 22 nt, Human
cucagggucugguccuuagauu

SEQ ID NO: 155635 - RNA, 22 nt, Human
aaaugguaagacaacacauuau

SEQ ID NO: 155636 - RNA, 22 nt, Human
ggcaccuggauguagcagugaa

SEQ ID NO: 155637 - RNA, 21 nt, Human
gggaaauuaggauugcucauc

SEQ ID NO: 155638 - RNA, 22 nt, Human
aauagguagccagauauauaaa

SEQ ID NO: 155639 - RNA, 22 nt, Human
gugugcagaagacacaagacau

SEQ ID NO: 155640 - RNA, 22 nt, Human
aggaaaaaccuguuaaugguag

SEQ ID NO: 155641 - RNA, 22 nt, Human
cagcacugcuucgcagccaggg

SEQ ID NO: 155642 - RNA, 22 nt, Human
ucuuccagcaaugugaaaucac

SEQ ID NO: 155643 - RNA, 22 nt, Human
agaaaucauucccaaacccaua

SEQ ID NO: 155644 - RNA, 19 nt, Human
ucaguuuuagucaucaguu

SEQ ID NO: 155645 - RNA, 22 nt, Human
ucacaccuguaaucccaggccu

SEQ ID NO: 155646 - RNA, 22 nt, Human
agggggcccuugcaggugagcg

SEQ ID NO: 155647 - RNA, 22 nt, Human
gugcuuaauacaugucaauaac

SEQ ID NO: 155648 - RNA, 22 nt, Human
aggguagggcccggagacagac

SEQ ID NO: 155649 - RNA, 22 nt, Human
aaggcugccucugccagaggag

SEQ ID NO: 155650 - RNA, 22 nt, Human
ccugucuggaacauggccuguu

SEQ ID NO: 155651 - RNA, 22 nt, Human
gauuucuucauucauuagaugg

SEQ ID NO: 155652 - RNA, 22 nt, Human
acagaggucauggagaguucuc

SEQ ID NO: 155653 - RNA, 22 nt, Human
auagucuuagaucagauaaagu

SEQ ID NO: 155654 - RNA, 22 nt, Human
ggacagagcccugguggccuaa

SEQ ID NO: 155655 - RNA, 22 nt, Human
aagagcuguaugccauaugauu

SEQ ID NO: 155656 - RNA, 22 nt, Human
acauuuaggauguuuugagaga

SEQ ID NO: 155657 - RNA, 22 nt, Human
ggucucagcuggaguccuuggu

SEQ ID NO: 155658 - RNA, 22 nt, Human
ccauaagguuuggggccaugca

SEQ ID NO: 155659 - RNA, 19 nt, Human
uggcauugguccagauaaa

SEQ ID NO: 155660 - RNA, 17 nt, Human
agguggguggaucaccu

SEQ ID NO: 155661 - RNA, 22 nt, Human
aagcagcacaguaauauuggug

SEQ ID NO: 155662 - RNA, 22 nt, Human
agccagcaugaagacagaggcc

SEQ ID NO: 155663 - RNA, 22 nt, Human
ggcagauggagaagcagcaggu

SEQ ID NO: 155664 - RNA, 22 nt, Human
acacagggucuagaguuaggcc

SEQ ID NO: 155665 - RNA, 22 nt, Human
augagcuguaagguggcuuccu

SEQ ID NO: 155666 - RNA, 22 nt, Human
uuaauacagucuccagaaguaa

SEQ ID NO: 155667 - RNA, 22 nt, Human
uggaggaaguggcuggccagaa

SEQ ID NO: 155668 - RNA, 22 nt, Human
cagugccaugucugagccccua

SEQ ID NO: 155669 - RNA, 22 nt, Human
gaugugagugguagcugggauu

SEQ ID NO: 155670 - RNA, 22 nt, Human
gagcugggacauggguccucuc

SEQ ID NO: 155671 - RNA, 22 nt, Human
uacaugaacaaaauagcagaaa

SEQ ID NO: 155672 - RNA, 22 nt, Human
augucuuuggcuuugacauggc

SEQ ID NO: 155673 - RNA, 22 nt, Human
uuacuuugaugaucaaugagcg

SEQ ID NO: 155674 - RNA, 22 nt, Human
gucagugucuuaacagagauua

SEQ ID NO: 155675 - RNA, 22 nt, Human
uuaaaaugcagauucugauuca

SEQ ID NO: 155676 - RNA, 22 nt, Human
uaaaauguuugcaagagaccag

SEQ ID NO: 155677 - RNA, 22 nt, Human
ucagcaauaugauaggcuuugu

SEQ ID NO: 155678 - RNA, 22 nt, Human
ucauggcacuuagcacaguccu

SEQ ID NO: 155679 - RNA, 22 nt, Human
ucucaggaucuaauacauggua

SEQ ID NO: 155680 - RNA, 22 nt, Human
ugccagaagauucucuaucaga

SEQ ID NO: 155681 - RNA, 23 nt, Human
gccaggcuccggucuguggccac

SEQ ID NO: 155682 - RNA, 22 nt, Human
ggagcauguggggugagcaggg

SEQ ID NO: 155683 - RNA, 22 nt, Human
cagcagugaugugugaggguuc

SEQ ID NO: 155684 - RNA, 19 nt, Human
ggacacagaaagcugcauu

SEQ ID NO: 155685 - RNA, 22 nt, Human
ugucccauggauaccaggcuau

SEQ ID NO: 155686 - RNA, 22 nt, Human
ugggcacuggaagccugcugug

SEQ ID NO: 155687 - RNA, 22 nt, Human
gcucaggaccgaggggugggaa

SEQ ID NO: 155688 - RNA, 22 nt, Human
gugccugcagcaauccauggca

SEQ ID NO: 155689 - RNA, 22 nt, Human
gagccagguuugaaucucaguc

SEQ ID NO: 155690 - RNA, 21 nt, Human
gcugccaccgcgugcuccagg

SEQ ID NO: 155691 - RNA, 20 nt, Human
cagagaccugucuucacaga

SEQ ID NO: 155692 - RNA, 22 nt, Human
ugccucugggugaccaaggagc

SEQ ID NO: 155693 - RNA, 22 nt, Human
cugggcaguuuuacaucauugc

SEQ ID NO: 155694 - RNA, 22 nt, Human
ggcagcaguggcugcuauuguc

SEQ ID NO: 155695 - RNA, 20 nt, Human
gcuuuuucuaauagcagucc

SEQ ID NO: 155696 - RNA, 22 nt, Human
cucaaggacuuauucaugccug

SEQ ID NO: 155697 - RNA, 22 nt, Human
cucacugcaaguuccaccuacc

SEQ ID NO: 155698 - RNA, 22 nt, Human
ggggacccucaggacugcgucu

SEQ ID NO: 155699 - RNA, 22 nt, Human
agcuuuaugggagcuuagauaa

SEQ ID NO: 155700 - RNA, 22 nt, Human
gcugccucuguagcuuuggacc

SEQ ID NO: 155701 - RNA, 22 nt, Human
ugggccuguugccugaguccau

SEQ ID NO: 155702 - RNA, 22 nt, Human
uucuggagagaaaccuuacaaa

SEQ ID NO: 155703 - RNA, 22 nt, Human
aagagggaggugcgggugcaga

SEQ ID NO: 155704 - RNA, 22 nt, Human
augggaggcagcagagcccagc

SEQ ID NO: 155705 - RNA, 22 nt, Human
auuucuuccucugucaguaacu

SEQ ID NO: 155706 - RNA, 22 nt, Human
aaaaaucacuuuuauaggcagc

SEQ ID NO: 155707 - RNA, 22 nt, Human
ccagggugagaaaaggcuggau

SEQ ID NO: 155708 - RNA, 22 nt, Human
uggagcaggccggaaguggcuu

SEQ ID NO: 155709 - RNA, 22 nt, Human
gccagggaacccaagggccuca

SEQ ID NO: 155710 - RNA, 22 nt, Human
gcugagguaggagguugcagug

SEQ ID NO: 155711 - RNA, 22 nt, Human
acucuugucucaacuuuuguau

SEQ ID NO: 155712 - RNA, 22 nt, Human
cugucuguuucugauucaaccu

SEQ ID NO: 155713 - RNA, 22 nt, Human
aucuagaaguggcaugaauuac

SEQ ID NO: 155714 - RNA, 22 nt, Human
aaggagaaaugguagaugugca

SEQ ID NO: 155715 - RNA, 22 nt, Human
agccccacacucucucugagaa

SEQ ID NO: 155716 - RNA, 22 nt, Human
agaugcugugaggaagcuagga

SEQ ID NO: 155717 - RNA, 22 nt, Human
aucuggcuuacgaagcacuggu

SEQ ID NO: 155718 - RNA, 22 nt, Human
aagaacauuuuguagaaugaca

SEQ ID NO: 155719 - RNA, 22 nt, Human
uuguuuuuaugaacauccagga

SEQ ID NO: 155720 - RNA, 22 nt, Human
cugccagcacugccuccugagg

SEQ ID NO: 155721 - RNA, 22 nt, Human
ggguggaggagaacaggcccca

SEQ ID NO: 155722 - RNA, 22 nt, Human
ugcagggccagacuggguugga

SEQ ID NO: 155723 - RNA, 22 nt, Human
ccaggaaugaaauguagauaaa

SEQ ID NO: 155724 - RNA, 22 nt, Human
cuagaaauauuuuacagucaag

SEQ ID NO: 155725 - RNA, 22 nt, Human
gcugucugagaacaugguggaa

SEQ ID NO: 155726 - RNA, 22 nt, Human
cuucuggaggacacuggcccca

SEQ ID NO: 155727 - RNA, 22 nt, Human
ggcagagaugugggucagaauc

SEQ ID NO: 155728 - RNA, 22 nt, Human
cagagguauugcaaaagccuag

SEQ ID NO: 155729 - RNA, 22 nt, Human
ggcugggagcuggacaggccgg

SEQ ID NO: 155730 - RNA, 22 nt, Human
aagcugccauagaacgagaggu

SEQ ID NO: 155731 - RNA, 17 nt, Human
gauuuccugaaguucuu

SEQ ID NO: 155732 - RNA, 22 nt, Human
agcaccuguggcucaugcucgu

SEQ ID NO: 155733 - RNA, 22 nt, Human
ggcaggagaauggcgugaacuc

SEQ ID NO: 155734 - RNA, 22 nt, Human
agcuuccuguugagagagggag

SEQ ID NO: 155735 - RNA, 22 nt, Human
gagcugccggcccacaguacua

SEQ ID NO: 155736 - RNA, 22 nt, Human
aggccugaggaccuucuggagg

SEQ ID NO: 155737 - RNA, 22 nt, Human
cccagcuccaagggacagcgaa

SEQ ID NO: 155738 - RNA, 22 nt, Human
uguuuuaugagccauauaaccu

SEQ ID NO: 155739 - RNA, 22 nt, Human
aggggaggagcuuuucuugccu

SEQ ID NO: 155740 - RNA, 22 nt, Human
agucuucccugugccagagugu

SEQ ID NO: 155741 - RNA, 22 nt, Human
gcaaggcugugcacuuugcauu

SEQ ID NO: 155742 - RNA, 22 nt, Human
cacaggagagcugggaggugcc

SEQ ID NO: 155743 - RNA, 22 nt, Human
cagagcuggguuugggaaaccu

SEQ ID NO: 155744 - RNA, 22 nt, Human
ugugugcagccucugucuuugg

SEQ ID NO: 155745 - RNA, 22 nt, Human
gcguaaggccucuggucucgga

SEQ ID NO: 155746 - RNA, 18 nt, Human
agaaggagcuaugggcag

SEQ ID NO: 155747 - RNA, 22 nt, Human
ucuuuccuguaacugcuguuca

SEQ ID NO: 155748 - RNA, 22 nt, Human
ucaaguguaguggugucagguc

SEQ ID NO: 155749 - RNA, 22 nt, Human
ccugagaggcccucucacuguc

SEQ ID NO: 155750 - RNA, 22 nt, Human
ggcagagcuugcagugagccga

SEQ ID NO: 155751 - RNA, 22 nt, Human
agagcuggggccagagucaagg

SEQ ID NO: 155752 - RNA, 17 nt, Human
agcagcuggcacaggag

SEQ ID NO: 155753 - RNA, 22 nt, Human
caccagcagaagacugagggug

SEQ ID NO: 155754 - RNA, 22 nt, Human
cugcucugugguccaugagaca

SEQ ID NO: 155755 - RNA, 22 nt, Human
cugcugggucuaugcaagugga

SEQ ID NO: 155756 - RNA, 22 nt, Human
gucucccaaccccugugcccag

SEQ ID NO: 155757 - RNA, 22 nt, Human
ucucuggaguauaaccagggau

SEQ ID NO: 155758 - RNA, 23 nt, Human
caugccaguuugugcaggcagau

SEQ ID NO: 155759 - RNA, 23 nt, Human
agccucuuuucuccugcccugca

SEQ ID NO: 155760 - RNA, 22 nt, Human
ggcucuggaaaguguccuugau

SEQ ID NO: 155761 - RNA, 22 nt, Human
ucagaacauugacauucuuauu

SEQ ID NO: 155762 - RNA, 22 nt, Human
cacagcuggugcacuagcucug

SEQ ID NO: 155763 - RNA, 22 nt, Human
agggaagaagcugguaguaggu

SEQ ID NO: 155764 - RNA, 22 nt, Human
aggcccugcuuuccagagcuca

SEQ ID NO: 155765 - RNA, 22 nt, Human
ggucacugcucuaaacaaaagu

SEQ ID NO: 155766 - RNA, 22 nt, Human
ggaugcugacuuuggagcaugg

SEQ ID NO: 155767 - RNA, 22 nt, Human
uccagagggcgauggcuggggg

SEQ ID NO: 155768 - RNA, 22 nt, Human
agcaugaaagcauaggacaguc

SEQ ID NO: 155769 - RNA, 22 nt, Human
cccagggagguagcaggagaaa

SEQ ID NO: 155770 - RNA, 20 nt, Human
ugcucaggauggagaggugu

SEQ ID NO: 155771 - RNA, 22 nt, Human
guccucaguaagagggccucug

SEQ ID NO: 155772 - RNA, 22 nt, Human
aaggagcuuguucgccuuccuc

SEQ ID NO: 155773 - RNA, 20 nt, Human
cccuggccuguuucaugccc

SEQ ID NO: 155774 - RNA, 22 nt, Human
aucagcaagcaugguuaggugu

SEQ ID NO: 155775 - RNA, 22 nt, Human
agcaauauaaauguuggguaga

SEQ ID NO: 155776 - RNA, 22 nt, Human
ggugaagggugucauggcauuu

SEQ ID NO: 155777 - RNA, 22 nt, Human
aggucauuuuugccuucuauuu

SEQ ID NO: 155778 - RNA, 22 nt, Human
aaggcgacacaggcagcaggcc

SEQ ID NO: 155779 - RNA, 21 nt, Human
uucaaaguuugccuaaagauu

SEQ ID NO: 155780 - RNA, 22 nt, Human
augcaagauguauagaagacuu

SEQ ID NO: 155781 - RNA, 18 nt, Human
ggcugagguugacuagaa

SEQ ID NO: 155782 - RNA, 22 nt, Human
cagcagggggcagcgcagauca

SEQ ID NO: 155783 - RNA, 23 nt, Human
ugagcccaggaggucaaggcugc

SEQ ID NO: 155784 - RNA, 22 nt, Human
ugcccuuggguaacuugcugau

SEQ ID NO: 155785 - RNA, 22 nt, Human
acuuuauuuccuauugcaucca

SEQ ID NO: 155786 - RNA, 22 nt, Human
uucuuucccaguagaugugaaa

SEQ ID NO: 155787 - RNA, 22 nt, Human
cuguguggacugguugaggccc

SEQ ID NO: 155788 - RNA, 22 nt, Human
gcucuggaagcaucugagagga

SEQ ID NO: 155789 - RNA, 22 nt, Human
uagauuucaggcuggcuugcgg

SEQ ID NO: 155790 - RNA, 22 nt, Human
gaggccagcgcgcagcacuuuu

SEQ ID NO: 155791 - RNA, 22 nt, Human
augguacaaaauguauaaaguc

SEQ ID NO: 155792 - RNA, 18 nt, Human
ucucagaggccauccuag

SEQ ID NO: 155793 - RNA, 22 nt, Human
cacagggcaggccccaggccuc

SEQ ID NO: 155794 - RNA, 22 nt, Human
cuccugggcucaagugauccuc

SEQ ID NO: 155795 - RNA, 18 nt, Human
cagaaguccuucaaggcc

SEQ ID NO: 155796 - RNA, 22 nt, Human
agcugguucagaaauuagaugg

SEQ ID NO: 155797 - RNA, 21 nt, Human
ggcuccugcuuugugaggggc

SEQ ID NO: 155798 - RNA, 22 nt, Human
acaaaguuaacaguuggauagu

SEQ ID NO: 155799 - RNA, 21 nt, Human
aggggacagaguagcuccagg

SEQ ID NO: 155800 - RNA, 20 nt, Human
auacacauauucuugcaacu

SEQ ID NO: 155801 - RNA, 22 nt, Human
cagaggcucuuccucacugccc

SEQ ID NO: 155802 - RNA, 22 nt, Human
uggcuggcccugggagugcaga

SEQ ID NO: 155803 - RNA, 22 nt, Human
cacugccugugagcugugugcc

SEQ ID NO: 155804 - RNA, 22 nt, Human
ggugugccuggggcuuagcugc

SEQ ID NO: 155805 - RNA, 22 nt, Human
acacacaacucauuguguaaua

SEQ ID NO: 155806 - RNA, 22 nt, Human
acucugccccgaguucugggaa

SEQ ID NO: 155807 - RNA, 22 nt, Human
aagagcuggauugugcugcaga

SEQ ID NO: 155808 - RNA, 22 nt, Human
uuugcauuaguuuagauuucaa

SEQ ID NO: 155809 - RNA, 19 nt, Human
uguuuuguuaaagcagucc

SEQ ID NO: 155810 - RNA, 22 nt, Human
ccugcugggccugagcaaugag

SEQ ID NO: 155811 - RNA, 22 nt, Human
ugcuauugugaacagugccaca

SEQ ID NO: 155812 - RNA, 23 nt, Human
acucacaaagcaggaucauguug

SEQ ID NO: 155813 - RNA, 22 nt, Human
ccagagcuccagggcuacagaa

SEQ ID NO: 155814 - RNA, 22 nt, Human
ucagaggaccuuacugagaacc

SEQ ID NO: 155815 - RNA, 23 nt, Human
auaaggcauaaagguacauugga

SEQ ID NO: 155816 - RNA, 22 nt, Human
guggccuuuccugaagaaauga

SEQ ID NO: 155817 - RNA, 22 nt, Human
uuuauuaugauggacaccuucg

SEQ ID NO: 155818 - RNA, 22 nt, Human
cuggcuuccaugcuguaguggc

SEQ ID NO: 155819 - RNA, 22 nt, Human
gaagcagcgaaguggaagggac

SEQ ID NO: 155820 - RNA, 20 nt, Human
guucucacugaucugcaggg

SEQ ID NO: 155821 - RNA, 22 nt, Human
guccucuguagggcugggccac

SEQ ID NO: 155822 - RNA, 22 nt, Human
gcuguggcuguacagagaccau

SEQ ID NO: 155823 - RNA, 22 nt, Human
uucauuccuucuguaccuugcc

SEQ ID NO: 155824 - RNA, 22 nt, Human
cugggcugagccugggcugugu

SEQ ID NO: 155825 - RNA, 22 nt, Human
ucaggcugguggucagauggcu

SEQ ID NO: 155826 - RNA, 22 nt, Human
uauuucuuucagguauguguug

SEQ ID NO: 155827 - RNA, 22 nt, Human
gccuggcugagguggggaggca

SEQ ID NO: 155828 - RNA, 22 nt, Human
uuaauuuauguccaaaccagau

SEQ ID NO: 155829 - RNA, 22 nt, Human
agccugcaggaugggcagcacc

SEQ ID NO: 155830 - RNA, 22 nt, Human
aggcagagaaaaaccagauaug

SEQ ID NO: 155831 - RNA, 22 nt, Human
ucugggcacugcugagccugua

SEQ ID NO: 155832 - RNA, 23 nt, Human
agucaguguaaguuuggaaugca

SEQ ID NO: 155833 - RNA, 22 nt, Human
cagccaggagccucugcaacua

SEQ ID NO: 155834 - RNA, 22 nt, Human
guauccuuugcggaaauuucua

SEQ ID NO: 155835 - RNA, 22 nt, Human
cagcuccugcagcugcugccgu

SEQ ID NO: 155836 - RNA, 22 nt, Human
aaaugcagguaguauuuauuuu

SEQ ID NO: 155837 - RNA, 21 nt, Human
uggcccuggccacggcugcca

SEQ ID NO: 155838 - RNA, 22 nt, Human
ucuggcucugaauucacuucug

SEQ ID NO: 155839 - RNA, 22 nt, Human
cugcagggcagggccuccuggc

SEQ ID NO: 155840 - RNA, 19 nt, Human
aggaaagguggccuuagca

SEQ ID NO: 155841 - RNA, 22 nt, Human
agaggccuuucuguugagugaa

SEQ ID NO: 155842 - RNA, 22 nt, Human
auguacauuuuccuaauguuuu

SEQ ID NO: 155843 - RNA, 22 nt, Human
uguggugagaaacugguagauu

SEQ ID NO: 155844 - RNA, 22 nt, Human
cccagcugcaccucuauggccu

SEQ ID NO: 155845 - RNA, 22 nt, Human
ucuuugcaggagcccuuugaac

SEQ ID NO: 155846 - RNA, 22 nt, Human
gcagggcacagacagugccaag

SEQ ID NO: 155847 - RNA, 22 nt, Human
uggggcuggggaucuugagccu

SEQ ID NO: 155848 - RNA, 22 nt, Human
auuuccuagccucucuugcagu

SEQ ID NO: 155849 - RNA, 19 nt, Human
ggcuggcaagugacagugu

SEQ ID NO: 155850 - RNA, 22 nt, Human
ugccugaugcaggaguaucaga

SEQ ID NO: 155851 - RNA, 22 nt, Human
aggaaaaucgagucuggaggca

SEQ ID NO: 155852 - RNA, 22 nt, Human
ugaaaucugucccacuuuagcu

SEQ ID NO: 155853 - RNA, 22 nt, Human
ucugagccaauuucugugucca

SEQ ID NO: 155854 - RNA, 22 nt, Human
gugccugggguugagcuaugaa

SEQ ID NO: 155855 - RNA, 22 nt, Human
ucuacuuuucccuauacaguuu

SEQ ID NO: 155856 - RNA, 22 nt, Human
gcaguggcuaggagucuggcgu

SEQ ID NO: 155857 - RNA, 22 nt, Human
caucacagauguuguguggagu

SEQ ID NO: 155858 - RNA, 22 nt, Human
uuccucagagggcgcuggggaa

SEQ ID NO: 155859 - RNA, 22 nt, Human
agggagcuuccgaacuacagcu

SEQ ID NO: 155860 - RNA, 22 nt, Human
cucuggcuucuaccuugcaguu

SEQ ID NO: 155861 - RNA, 22 nt, Human
ccuuucucauuuuaagcauuag

SEQ ID NO: 155862 - RNA, 22 nt, Human
ccaggcucugcgcuggacaugg

SEQ ID NO: 155863 - RNA, 22 nt, Human
aagcugccagcugagcugaggc

SEQ ID NO: 155864 - RNA, 22 nt, Human
agaugggcgcccuggacugagg

SEQ ID NO: 155865 - RNA, 22 nt, Human
ugagggaguuggguguauagga

SEQ ID NO: 155866 - RNA, 22 nt, Human
gcaggaaagguugagacuuugc

SEQ ID NO: 155867 - RNA, 22 nt, Human
agcugcucuuugaaggacacuu

SEQ ID NO: 155868 - RNA, 22 nt, Human
cccagggcuuuucucacuagac

SEQ ID NO: 155869 - RNA, 22 nt, Human
uccagggagagccgcugcucca

SEQ ID NO: 155870 - RNA, 22 nt, Human
ugcaccauuaauuuaugugaga

SEQ ID NO: 155871 - RNA, 22 nt, Human
cagcaguggccaucuguguggu

SEQ ID NO: 155872 - RNA, 22 nt, Human
cagggccugagggcugcucugc

SEQ ID NO: 155873 - RNA, 22 nt, Human
ccugucugcaugagugagcaua

SEQ ID NO: 155874 - RNA, 22 nt, Human
accuggagucauuugaggagua

SEQ ID NO: 155875 - RNA, 22 nt, Human
cuucccagacgggguggcagcc

SEQ ID NO: 155876 - RNA, 17 nt, Human
aggaaacauuuucuuuc

SEQ ID NO: 155877 - RNA, 22 nt, Human
ucagggcauccauugccuguug

SEQ ID NO: 155878 - RNA, 22 nt, Human
aagcagccagccaucaugcccg

SEQ ID NO: 155879 - RNA, 22 nt, Human
cuuggggcugucacucuggcau

SEQ ID NO: 155880 - RNA, 21 nt, Human
cacucaggguaugugccaggc

SEQ ID NO: 155881 - RNA, 22 nt, Human
gccaggccugcaagugcuggug

SEQ ID NO: 155882 - RNA, 22 nt, Human
caggccaggcugcauuugcccc

SEQ ID NO: 155883 - RNA, 22 nt, Human
uggacagguuugggugccuguu

SEQ ID NO: 155884 - RNA, 22 nt, Human
gcagagcucuguucuuaucucc

SEQ ID NO: 155885 - RNA, 22 nt, Human
uccuucaggccucauucucaua

SEQ ID NO: 155886 - RNA, 22 nt, Human
cuggagccuagguugaccuggg

SEQ ID NO: 155887 - RNA, 22 nt, Human
agcuggagaucaugcugauacu

SEQ ID NO: 155888 - RNA, 22 nt, Human
gcuuuccuggcccugucccugc

SEQ ID NO: 155889 - RNA, 22 nt, Human
ggcacugagaggcucuuccuaa

SEQ ID NO: 155890 - RNA, 22 nt, Human
ugucauguguucuuaaauacau

SEQ ID NO: 155891 - RNA, 22 nt, Human
ucuggcucugacacuacuguua

SEQ ID NO: 155892 - RNA, 22 nt, Human
uugcauaaaagaguauaucuua

SEQ ID NO: 155893 - RNA, 22 nt, Human
gcccauggcagaacugugagca

SEQ ID NO: 155894 - RNA, 22 nt, Human
uaagacaugguugaucuagugu

SEQ ID NO: 155895 - RNA, 22 nt, Human
uaugaguacaaggacucugucu

SEQ ID NO: 155896 - RNA, 22 nt, Human
ccagggccaagagaccucgagg

SEQ ID NO: 155897 - RNA, 22 nt, Human
cugagcuuccaguuccuccagg

SEQ ID NO: 155898 - RNA, 22 nt, Human
ccugggaggcggagguugcagu

SEQ ID NO: 155899 - RNA, 20 nt, Human
aucagcaacugccacucagu

SEQ ID NO: 155900 - RNA, 22 nt, Human
cgcugggcgccgaccugcuggc

SEQ ID NO: 155901 - RNA, 22 nt, Human
ugaagaugucagcagggguggu

SEQ ID NO: 155902 - RNA, 22 nt, Human
gcuggagcuugagaggacaggg

SEQ ID NO: 155903 - RNA, 22 nt, Human
agagcagaggcauggccguggg

SEQ ID NO: 155904 - RNA, 22 nt, Human
ggagccuggccuggcucugugu

SEQ ID NO: 155905 - RNA, 18 nt, Human
gccugcaggcacgggggu

SEQ ID NO: 155906 - RNA, 22 nt, Human
agcugagcauuugauccaccuc

SEQ ID NO: 155907 - RNA, 22 nt, Human
aggcucugugacaaucaagcug

SEQ ID NO: 155908 - RNA, 22 nt, Human
uugaagcagagaaauacuugaa

SEQ ID NO: 155909 - RNA, 22 nt, Human
ggcagcaugagccuggugaauu

SEQ ID NO: 155910 - RNA, 22 nt, Human
gcucugucuucagcacacagua

SEQ ID NO: 155911 - RNA, 20 nt, Human
uccugggguaagccaugguc

SEQ ID NO: 155912 - RNA, 22 nt, Human
aggcucugcagugcuggaggac

SEQ ID NO: 155913 - RNA, 21 nt, Human
uauuucuuugacucucucccu

SEQ ID NO: 155914 - RNA, 23 nt, Human
ucagaaugcacugaauuuacccu

SEQ ID NO: 155915 - RNA, 22 nt, Human
ucugagaguccaucuccaagcc

SEQ ID NO: 155916 - RNA, 23 nt, Human
ccaggcaguagcuauugaaguga

SEQ ID NO: 155917 - RNA, 22 nt, Human
ucugagggcuugaggggaagua

SEQ ID NO: 155918 - RNA, 22 nt, Human
gcugucuucacuuccugguuuc

SEQ ID NO: 155919 - RNA, 22 nt, Human
cugccugugccaaugcuccuuu

SEQ ID NO: 155920 - RNA, 22 nt, Human
gcagugccuugcuucucugucu

SEQ ID NO: 155921 - RNA, 22 nt, Human
aaggcacuguacuaguuaguua

SEQ ID NO: 155922 - RNA, 22 nt, Human
cacagaguggaggcuuggccug

SEQ ID NO: 155923 - RNA, 22 nt, Human
ccagccaggcuggcuguggagg

SEQ ID NO: 155924 - RNA, 22 nt, Human
gcccaggccggagagcagugcu

SEQ ID NO: 155925 - RNA, 23 nt, Human
cauggcagcaagagcucauggcc

SEQ ID NO: 155926 - RNA, 22 nt, Human
ucugccugccagucugguccuc

SEQ ID NO: 155927 - RNA, 22 nt, Human
gaaccaaguaggauacaaggag

SEQ ID NO: 155928 - RNA, 22 nt, Human
guuugcauguguacuuaauugg

SEQ ID NO: 155929 - RNA, 22 nt, Human
ggcagcugagcauggcuaccuu

SEQ ID NO: 155930 - RNA, 22 nt, Human
cacguuuuaugacagaagaagc

SEQ ID NO: 155931 - RNA, 22 nt, Human
uuuauuauucucuggagaaugu

SEQ ID NO: 155932 - RNA, 22 nt, Human
gaccugccugagcugccucugc

SEQ ID NO: 155933 - RNA, 22 nt, Human
ggcccacacugacagcugagcu

SEQ ID NO: 155934 - RNA, 22 nt, Human
aaaugcacaggagaaccaauuc

SEQ ID NO: 155935 - RNA, 22 nt, Human
cccaggucuaugccagcucuga

SEQ ID NO: 155936 - RNA, 22 nt, Human
cacagaaguuucauagucucga

SEQ ID NO: 155937 - RNA, 22 nt, Human
acagggccagccugggaccugg

SEQ ID NO: 155938 - RNA, 22 nt, Human
gggcugugggacccggcacuuu

SEQ ID NO: 155939 - RNA, 22 nt, Human
acucacuuuccauucaagcacc

SEQ ID NO: 155940 - RNA, 22 nt, Human
ugcugucccccgugucugggcu

SEQ ID NO: 155941 - RNA, 22 nt, Human
uccucagggggccaacccagcc

SEQ ID NO: 155942 - RNA, 22 nt, Human
agcagggcagugaucagaaagg

SEQ ID NO: 155943 - RNA, 22 nt, Human
agcccuggcccggcugugcuuu

SEQ ID NO: 155944 - RNA, 22 nt, Human
aaucaguuguucacucugaaaa

SEQ ID NO: 155945 - RNA, 22 nt, Human
cagggcagggccacacccccug

SEQ ID NO: 155946 - RNA, 22 nt, Human
cuguccugauggugccacuggu

SEQ ID NO: 155947 - RNA, 22 nt, Human
guaggcagauaggagugcagcc

SEQ ID NO: 155948 - RNA, 23 nt, Human
aagaauaaaugacauuaaaggug

SEQ ID NO: 155949 - RNA, 22 nt, Human
uccagggaagagcagaggcuac

SEQ ID NO: 155950 - RNA, 22 nt, Human
guacauuuugagguuaaaacaa

SEQ ID NO: 155951 - RNA, 22 nt, Human
ugcugccuccaacuccugggcu

SEQ ID NO: 155952 - RNA, 22 nt, Human
aguaaaaucuuaagcacagugg

SEQ ID NO: 155953 - RNA, 22 nt, Human
ucuggcucccagccugcucuca

SEQ ID NO: 155954 - RNA, 22 nt, Human
gccggggcuggggagagacaug

SEQ ID NO: 155955 - RNA, 22 nt, Human
cagcugaauucuucagacucca

SEQ ID NO: 155956 - RNA, 22 nt, Human
aggccucacauugggcuucaag

SEQ ID NO: 155957 - RNA, 22 nt, Human
caagacaagaucuaagcaugcu

SEQ ID NO: 155958 - RNA, 20 nt, Human
cucucccagcacagcuuccu

SEQ ID NO: 155959 - RNA, 22 nt, Human
ggagcuguaacgagccauugcu

SEQ ID NO: 155960 - RNA, 22 nt, Human
gaagaacacuucaugauucauu

SEQ ID NO: 155961 - RNA, 19 nt, Human
agggagaauuccaagagga

SEQ ID NO: 155962 - RNA, 22 nt, Human
ucagccagugccuugaucuugc

SEQ ID NO: 155963 - RNA, 23 nt, Human
auaauaacgucugucuugucucu

SEQ ID NO: 155964 - RNA, 22 nt, Human
ucugagcuggagcccaucaccu

SEQ ID NO: 155965 - RNA, 22 nt, Human
gaguuauuaauggcugaguuug

SEQ ID NO: 155966 - RNA, 22 nt, Human
ccuggcagcgugccgagcugcg

SEQ ID NO: 155967 - RNA, 19 nt, Human
agcagccauagacaauaug

SEQ ID NO: 155968 - RNA, 22 nt, Human
cagcacugcugcuguacacaca

SEQ ID NO: 155969 - RNA, 22 nt, Human
acucucagaggguggcagcaau

SEQ ID NO: 155970 - RNA, 22 nt, Human
ccaggccuggaccaugccaggg

SEQ ID NO: 155971 - RNA, 22 nt, Human
caugggcucuucuggacugcac

SEQ ID NO: 155972 - RNA, 20 nt, Human
ucugcccaccccggcuccca

SEQ ID NO: 155973 - RNA, 20 nt, Human
ugaaaggugggaauuguggg

SEQ ID NO: 155974 - RNA, 22 nt, Human
uccagcagaaaagagguaggga

SEQ ID NO: 155975 - RNA, 21 nt, Human
cuguuucuugugaagugacac

SEQ ID NO: 155976 - RNA, 22 nt, Human
aucaguuuaaaugggcuguugg

SEQ ID NO: 155977 - RNA, 22 nt, Human
auugacaagcaguaugucuuag

SEQ ID NO: 155978 - RNA, 22 nt, Human
cccugcugucaggugcugggag

SEQ ID NO: 155979 - RNA, 22 nt, Human
cuuauguaugcuacuuuguggu

SEQ ID NO: 155980 - RNA, 22 nt, Human
gcauuccuacaggcugcuauga

SEQ ID NO: 155981 - RNA, 21 nt, Human
ugggggagaauugguugcuuu

SEQ ID NO: 155982 - RNA, 22 nt, Human
acagguggagugguuagcaggc

SEQ ID NO: 155983 - RNA, 19 nt, Human
cugggagguguucagagaa

SEQ ID NO: 155984 - RNA, 22 nt, Human
gcugucagugaggugagacaug

SEQ ID NO: 155985 - RNA, 22 nt, Human
cacaggagguuaggaagugguc

SEQ ID NO: 155986 - RNA, 22 nt, Human
uuuguaaauagcaguacucaug

SEQ ID NO: 155987 - RNA, 22 nt, Human
gccuccugagaagccacaggcu

SEQ ID NO: 155988 - RNA, 22 nt, Human
auagucuuagucuauaguuuug

SEQ ID NO: 155989 - RNA, 22 nt, Human
gggcugggauggcuugaagauu

SEQ ID NO: 155990 - RNA, 22 nt, Human
cccugccuucuuggccuuuaaa

SEQ ID NO: 155991 - RNA, 22 nt, Human
cagucccagaagagccugggag

SEQ ID NO: 155992 - RNA, 22 nt, Human
acacaggggcucggcugggugc

SEQ ID NO: 155993 - RNA, 22 nt, Human
gaaugugucacccugucccaug

SEQ ID NO: 155994 - RNA, 22 nt, Human
gaagagcuuaguuguccuagaa

SEQ ID NO: 155995 - RNA, 22 nt, Human
ugcagcuguuacggacccuguc

SEQ ID NO: 155996 - RNA, 22 nt, Human
guggccucaugucuauaaagag

SEQ ID NO: 155997 - RNA, 22 nt, Human
gcucuggcuacuguggcuaccg

SEQ ID NO: 155998 - RNA, 22 nt, Human
uuccucucucuugccagaaugu

SEQ ID NO: 155999 - RNA, 22 nt, Human
gcugccugcucggcuccuggga

SEQ ID NO: 156000 - RNA, 23 nt, Human
uccuucagagccucccuccaagc

SEQ ID NO: 156001 - RNA, 22 nt, Human
uuugcauuucucguaaggaaac

SEQ ID NO: 156002 - RNA, 22 nt, Human
acauacauaugacaacuuuccu

SEQ ID NO: 156003 - RNA, 22 nt, Human
cuggaggcugaguugggucucc

SEQ ID NO: 156004 - RNA, 22 nt, Human
gggcugacucugcacugagcca

SEQ ID NO: 156005 - RNA, 22 nt, Human
uggcucagaaggcugccuucac

SEQ ID NO: 156006 - RNA, 22 nt, Human
ugucacuucaggaaugcaggga

SEQ ID NO: 156007 - RNA, 19 nt, Human
gagcagcugcacccauuga

SEQ ID NO: 156008 - RNA, 22 nt, Human
uggcuccuaucaaggagugggu

SEQ ID NO: 156009 - RNA, 22 nt, Human
caggagcucuuaaggaugugau

SEQ ID NO: 156010 - RNA, 22 nt, Human
aaaauguguuuaugcauuucgu

SEQ ID NO: 156011 - RNA, 22 nt, Human
uuugcauuauauuuauagaaga

SEQ ID NO: 156012 - RNA, 22 nt, Human
ccagcagcagcguccaaggaga

SEQ ID NO: 156013 - RNA, 22 nt, Human
gcucuggagauggagccuugag

SEQ ID NO: 156014 - RNA, 22 nt, Human
gcucccaggaugaggagccagg

SEQ ID NO: 156015 - RNA, 22 nt, Human
agcucagggcgaucugucucgg

SEQ ID NO: 156016 - RNA, 22 nt, Human
uuaaaaccaucagcuguaagau

SEQ ID NO: 156017 - RNA, 22 nt, Human
acccagcucuuugauggucuug

SEQ ID NO: 156018 - RNA, 22 nt, Human
ugcucuguaacaaauugacaug

SEQ ID NO: 156019 - RNA, 22 nt, Human
uggcccugacagguccugggca

SEQ ID NO: 156020 - RNA, 22 nt, Human
cagagccaggguugcaccccug

SEQ ID NO: 156021 - RNA, 22 nt, Human
gggcauggugaugugcaccugu

SEQ ID NO: 156022 - RNA, 22 nt, Human
caggccugugaguugaggcccc

SEQ ID NO: 156023 - RNA, 22 nt, Human
uugucuguccaggcaccccaag

SEQ ID NO: 156024 - RNA, 22 nt, Human
uauuaucauugguaauaugguc

SEQ ID NO: 156025 - RNA, 22 nt, Human
ugccugggccucugaggaaggc

SEQ ID NO: 156026 - RNA, 22 nt, Human
ugaagacacauacaagggaaug

SEQ ID NO: 156027 - RNA, 21 nt, Human
gccaccccuggcacaggugcu

SEQ ID NO: 156028 - RNA, 22 nt, Human
cagggagaucuuggcuccuggu

SEQ ID NO: 156029 - RNA, 22 nt, Human
cagggcuggauccuccagacuc

SEQ ID NO: 156030 - RNA, 22 nt, Human
cugaaauuccauuucagccaca

SEQ ID NO: 156031 - RNA, 22 nt, Human
ccagcucccugaagccuggucu

SEQ ID NO: 156032 - RNA, 22 nt, Human
gagggcugccacguugggcgag

SEQ ID NO: 156033 - RNA, 22 nt, Human
ggagggagucagcugauuagaa

SEQ ID NO: 156034 - RNA, 22 nt, Human
uguaugcuuuccaaaaaugcug

SEQ ID NO: 156035 - RNA, 22 nt, Human
ccucugagagaaggccuucagc

SEQ ID NO: 156036 - RNA, 22 nt, Human
agcagaagaaagccacaugacu

SEQ ID NO: 156037 - RNA, 23 nt, Human
agggcccaagccuggacagcagg

SEQ ID NO: 156038 - RNA, 22 nt, Human
uggagcagggcaucacugugcg

SEQ ID NO: 156039 - RNA, 22 nt, Human
cggggacacacuggcagcuccu

SEQ ID NO: 156040 - RNA, 22 nt, Human
gauuucaaaaguagauccauca

SEQ ID NO: 156041 - RNA, 21 nt, Human
aacauuucaggauccaaauug

SEQ ID NO: 156042 - RNA, 22 nt, Human
gccuggagcccaguguggggcu

SEQ ID NO: 156043 - RNA, 22 nt, Human
cuggaagguucuuugugugccu

SEQ ID NO: 156044 - RNA, 22 nt, Human
uccuggaggcaaaugagcacau

SEQ ID NO: 156045 - RNA, 22 nt, Human
agcagagcgccugcucagaggg

SEQ ID NO: 156046 - RNA, 22 nt, Human
ugggggagccuucacaguagcu

SEQ ID NO: 156047 - RNA, 22 nt, Human
guacauuucauuuaaaugaugu

SEQ ID NO: 156048 - RNA, 22 nt, Human
ccugucugaggaggugcucuuu

SEQ ID NO: 156049 - RNA, 22 nt, Human
acuuccugcaaucguccacucc

SEQ ID NO: 156050 - RNA, 22 nt, Human
acacccagagcgccagugccga

SEQ ID NO: 156051 - RNA, 22 nt, Human
aagggcaggaaaagauggaugu

SEQ ID NO: 156052 - RNA, 22 nt, Human
ggaugcaggggcagcagagccu

SEQ ID NO: 156053 - RNA, 22 nt, Human
agagccugcagcugugaagaaa

SEQ ID NO: 156054 - RNA, 22 nt, Human
uggcagcacuagguacugagcu

SEQ ID NO: 156055 - RNA, 22 nt, Human
uucuggagcuaaaguccacucu

SEQ ID NO: 156056 - RNA, 22 nt, Human
cacagggcaccaguuggccauc

SEQ ID NO: 156057 - RNA, 22 nt, Human
aaaugcacagaaaggaugugga

SEQ ID NO: 156058 - RNA, 22 nt, Human
gaggaaugucagcacaggccuc

SEQ ID NO: 156059 - RNA, 22 nt, Human
gggcuccagcccgggaccaggu

SEQ ID NO: 156060 - RNA, 22 nt, Human
uguacauuuagagcucaauaga

SEQ ID NO: 156061 - RNA, 22 nt, Human
agaauuguaagcaauuugauua

SEQ ID NO: 156062 - RNA, 18 nt, Human
cuuuaugugcagagcuuu

SEQ ID NO: 156063 - RNA, 18 nt, Human
aaagaaggauuggagagc

SEQ ID NO: 156064 - RNA, 22 nt, Human
ucugccugcggcugcagguggc

SEQ ID NO: 156065 - RNA, 22 nt, Human
gggcugcacguauucugcucac

SEQ ID NO: 156066 - RNA, 23 nt, Human
ccuucagaagaaguaacaggggc

SEQ ID NO: 156067 - RNA, 22 nt, Human
gcuggccugggcagaggcuaug

SEQ ID NO: 156068 - RNA, 22 nt, Human
ugggauggagccugaguauagu

SEQ ID NO: 156069 - RNA, 22 nt, Human
gcugucacauuuggagcacugg

SEQ ID NO: 156070 - RNA, 22 nt, Human
ccagcccugucaccaacuggag

SEQ ID NO: 156071 - RNA, 22 nt, Human
cucugagcugaaacaugagcau

SEQ ID NO: 156072 - RNA, 22 nt, Human
aagugguaggaagagagcacug

SEQ ID NO: 156073 - RNA, 22 nt, Human
gugucacaagagcccaggaaac

SEQ ID NO: 156074 - RNA, 22 nt, Human
gccuggaguggacuuggccccu

SEQ ID NO: 156075 - RNA, 23 nt, Human
ugcucccaggugacgcugcuguu

SEQ ID NO: 156076 - RNA, 20 nt, Human
ucauccaggacaggaguggc

SEQ ID NO: 156077 - RNA, 19 nt, Human
ggcucagggcgcugccgcc

SEQ ID NO: 156078 - RNA, 22 nt, Human
agggcugguauguccaugaaag

SEQ ID NO: 156079 - RNA, 22 nt, Human
ggcaggaggugaguggcgggug

SEQ ID NO: 156080 - RNA, 18 nt, Human
aggagccuuugcacugga

SEQ ID NO: 156081 - RNA, 22 nt, Human
cucaggaggugguagaggcccu

SEQ ID NO: 156082 - RNA, 22 nt, Human
ucagggacugcagagggaagcu

SEQ ID NO: 156083 - RNA, 20 nt, Human
aggagccauugacugcagca

SEQ ID NO: 156084 - RNA, 22 nt, Human
acagaauuaaaguguuugugga

SEQ ID NO: 156085 - RNA, 22 nt, Human
aggggagaguuaaugugaaugu

SEQ ID NO: 156086 - RNA, 22 nt, Human
ugcugccagccaggccauggag

SEQ ID NO: 156087 - RNA, 22 nt, Human
gcucccacaaccuucuugcucc

SEQ ID NO: 156088 - RNA, 22 nt, Human
aggucacacaacugucagaggc

SEQ ID NO: 156089 - RNA, 22 nt, Human
ucugagcauugaauuuucuucc

SEQ ID NO: 156090 - RNA, 22 nt, Human
ggccugagucccaccuggcugu

SEQ ID NO: 156091 - RNA, 20 nt, Human
caggccucugggggcccugg

SEQ ID NO: 156092 - RNA, 22 nt, Human
ccagaggugccacagaaagagc

SEQ ID NO: 156093 - RNA, 22 nt, Human
uggagcugauacagcuggcuuu

SEQ ID NO: 156094 - RNA, 21 nt, Human
agcagccauggaugguaugua

SEQ ID NO: 156095 - RNA, 22 nt, Human
uuucauuacguguuugacuugu

SEQ ID NO: 156096 - RNA, 22 nt, Human
acugugcacaauucuaaguccu

SEQ ID NO: 156097 - RNA, 21 nt, Human
ugcagcugacacugguaugcc

SEQ ID NO: 156098 - RNA, 23 nt, Human
agcccagcagagaaccuaggucc

SEQ ID NO: 156099 - RNA, 22 nt, Human
ccugaggcuuaaucugucccaa

SEQ ID NO: 156100 - RNA, 23 nt, Human
acacaauagaguacuauucagcc

SEQ ID NO: 156101 - RNA, 22 nt, Human
ugggcagaggcucugaagucca

SEQ ID NO: 156102 - RNA, 22 nt, Human
caguggccaugguggcaggggu

SEQ ID NO: 156103 - RNA, 22 nt, Human
gcagggcugggugggagacaga

SEQ ID NO: 156104 - RNA, 22 nt, Human
agccacagcuccuugguggaga

SEQ ID NO: 156105 - RNA, 22 nt, Human
aacuuuauuguuaggggcuaaa

SEQ ID NO: 156106 - RNA, 22 nt, Human
guuuuuaucuaauagcaguuau

SEQ ID NO: 156107 - RNA, 22 nt, Human
guccucugcccaggucaagguu

SEQ ID NO: 156108 - RNA, 22 nt, Human
uguguccuucugggagucccag

SEQ ID NO: 156109 - RNA, 22 nt, Human
gcucccacugcagcccugagcc

SEQ ID NO: 156110 - RNA, 22 nt, Human
caguauuuauggcuugaguauu

SEQ ID NO: 156111 - RNA, 22 nt, Human
cugaagcaaaugaaacagcucu

SEQ ID NO: 156112 - RNA, 22 nt, Human
agccucucuuucugguggcuaa

SEQ ID NO: 156113 - RNA, 22 nt, Human
gccugggagagggauagugcag

SEQ ID NO: 156114 - RNA, 22 nt, Human
gcuggcucuucaguggagauag

SEQ ID NO: 156115 - RNA, 22 nt, Human
gccuggaggggacagucucugg

SEQ ID NO: 156116 - RNA, 22 nt, Human
cagugggaagggcagaggcuuu

SEQ ID NO: 156117 - RNA, 22 nt, Human
cuacauuucccagcugccuucc

SEQ ID NO: 156118 - RNA, 22 nt, Human
acacugaauguuuaagaacuug

SEQ ID NO: 156119 - RNA, 22 nt, Human
acccuuucuuacucacacgcuc

SEQ ID NO: 156120 - RNA, 22 nt, Human
uagaaaagauaacauucugugc

SEQ ID NO: 156121 - RNA, 22 nt, Human
uucauucaucucuaaaaugccu

SEQ ID NO: 156122 - RNA, 22 nt, Human
gugcagcugugugagagcucca

SEQ ID NO: 156123 - RNA, 22 nt, Human
uagccgcuuaauuauuugguga

SEQ ID NO: 156124 - RNA, 22 nt, Human
uguauagaguuggaagaugacu

SEQ ID NO: 156125 - RNA, 22 nt, Human
uugcauguguaauuuuucuaaa

SEQ ID NO: 156126 - RNA, 22 nt, Human
agcugggaugauaaccucaguc

SEQ ID NO: 156127 - RNA, 22 nt, Human
uuauacauguguuuugagauga

SEQ ID NO: 156128 - RNA, 22 nt, Human
aggcugccaaagcuucugucuc

SEQ ID NO: 156129 - RNA, 22 nt, Human
aggaaaugcugaugcuccugga

SEQ ID NO: 156130 - RNA, 22 nt, Human
ucagaggugguaaaggacagca

SEQ ID NO: 156131 - RNA, 22 nt, Human
aggagcuggguuccuuuggugg

SEQ ID NO: 156132 - RNA, 22 nt, Human
gugcuuuccauccucccugcug

SEQ ID NO: 156133 - RNA, 22 nt, Human
caugcacaaagguaagaugcgu

SEQ ID NO: 156134 - RNA, 22 nt, Human
uuccuauuuccaugaaacacaa

SEQ ID NO: 156135 - RNA, 22 nt, Human
guguacaugagaaaucaacuuu

SEQ ID NO: 156136 - RNA, 22 nt, Human
uggacagcgaaagugccuggga

SEQ ID NO: 156137 - RNA, 22 nt, Human
ugcugcauuuaucuucucaaac

SEQ ID NO: 156138 - RNA, 22 nt, Human
auuguacuuuuauuacauguag

SEQ ID NO: 156139 - RNA, 22 nt, Human
agggccagcccauaaugccaaa

SEQ ID NO: 156140 - RNA, 23 nt, Human
agcacagacuagaaaggucuuuc

SEQ ID NO: 156141 - RNA, 22 nt, Human
cugccucuauaggaguccacca

SEQ ID NO: 156142 - RNA, 22 nt, Human
gccagagcaugcacugccugca

SEQ ID NO: 156143 - RNA, 22 nt, Human
uauuucugucagccagauaugg

SEQ ID NO: 156144 - RNA, 22 nt, Human
guuugaaaaaagcaguauguaa

SEQ ID NO: 156145 - RNA, 22 nt, Human
aaaucuguaagcaauugcucag

SEQ ID NO: 156146 - RNA, 22 nt, Human
aaggccugggaggccucucuuc

SEQ ID NO: 156147 - RNA, 22 nt, Human
ugacagaaagaauaugucaauc

SEQ ID NO: 156148 - RNA, 22 nt, Human
ggcugcugguggaaugguaggc

SEQ ID NO: 156149 - RNA, 22 nt, Human
cagagcagagugauuguucugg

SEQ ID NO: 156150 - RNA, 22 nt, Human
gcugugugaaaacugggccugg

SEQ ID NO: 156151 - RNA, 22 nt, Human
ccuggcugugcauugccggccc

SEQ ID NO: 156152 - RNA, 22 nt, Human
cauucauuuacuuucaacagcu

SEQ ID NO: 156153 - RNA, 22 nt, Human
aauguguacuuuuucaugcuca

SEQ ID NO: 156154 - RNA, 22 nt, Human
ucaaugaugcugaagguagcgu

SEQ ID NO: 156155 - RNA, 22 nt, Human
ggccccaggaccuccacggucc

SEQ ID NO: 156156 - RNA, 22 nt, Human
accugagccuagggagguugag

SEQ ID NO: 156157 - RNA, 22 nt, Human
uccuggaggggacagcaugggc

SEQ ID NO: 156158 - RNA, 22 nt, Human
cuggcucauuuuagcaucaggu

SEQ ID NO: 156159 - RNA, 22 nt, Human
ucucugucugagccuggcagac

SEQ ID NO: 156160 - RNA, 22 nt, Human
cucccaagggguaagggagcug

SEQ ID NO: 156161 - RNA, 22 nt, Human
caggccacaaguuggguucaag

SEQ ID NO: 156162 - RNA, 22 nt, Human
cagcaauaguguguuuguuuca

SEQ ID NO: 156163 - RNA, 22 nt, Human
ugcccaggguggagugcagcgg

SEQ ID NO: 156164 - RNA, 22 nt, Human
aaggcacuacgcugcuggggcg

SEQ ID NO: 156165 - RNA, 22 nt, Human
gucacacuagggccaaguggag

SEQ ID NO: 156166 - RNA, 22 nt, Human
uuccgcuggggccgccuggcgg

SEQ ID NO: 156167 - RNA, 22 nt, Human
uuaauaaacaggugcagcugaa

SEQ ID NO: 156168 - RNA, 23 nt, Human
cuggggcuuucaaaucugggcag

SEQ ID NO: 156169 - RNA, 22 nt, Human
gaugcacaugugaguauagaag

SEQ ID NO: 156170 - RNA, 22 nt, Human
uaacagaaauaguaggugaggg

SEQ ID NO: 156171 - RNA, 22 nt, Human
ggcuucuccccuuugagucuuc

SEQ ID NO: 156172 - RNA, 22 nt, Human
gcucccagcuggagccucaaca

SEQ ID NO: 156173 - RNA, 22 nt, Human
ccugggcuugcaucugugcugg

SEQ ID NO: 156174 - RNA, 22 nt, Human
ugauuuccuagcugacaugaaa

SEQ ID NO: 156175 - RNA, 22 nt, Human
ucagaacagaagcuggcuauaa

SEQ ID NO: 156176 - RNA, 22 nt, Human
uugaaaggaauacagaggccua

SEQ ID NO: 156177 - RNA, 22 nt, Human
ucuccaagcagggcugcaaggc

SEQ ID NO: 156178 - RNA, 19 nt, Human
ggcuccuguggcugcagcc

SEQ ID NO: 156179 - RNA, 22 nt, Human
gcagggcucauucuaguacaau

SEQ ID NO: 156180 - RNA, 22 nt, Human
guacauuggcaacucucuuaga

SEQ ID NO: 156181 - RNA, 22 nt, Human
agcuccuccugugccaggccag

SEQ ID NO: 156182 - RNA, 22 nt, Human
caaaugaagaaccuucucaccu

SEQ ID NO: 156183 - RNA, 21 nt, Human
acaggcucuggggaugcuggg

SEQ ID NO: 156184 - RNA, 22 nt, Human
caguacuuguccucagguguua

SEQ ID NO: 156185 - RNA, 22 nt, Human
gucauugcaguggcaaaucaca

SEQ ID NO: 156186 - RNA, 17 nt, Human
ucuggccuuccugaacu

SEQ ID NO: 156187 - RNA, 22 nt, Human
ggggaggcugaugugggcaaag

SEQ ID NO: 156188 - RNA, 22 nt, Human
gagcugccugaacaagcagcag

SEQ ID NO: 156189 - RNA, 22 nt, Human
caugagauaauuuuucuccagu

SEQ ID NO: 156190 - RNA, 22 nt, Human
uagaaacauguucuguucuguu

SEQ ID NO: 156191 - RNA, 22 nt, Human
ugauuucccucaucauaacaga

SEQ ID NO: 156192 - RNA, 22 nt, Human
gagcagcuuaugucaagccaga

SEQ ID NO: 156193 - RNA, 22 nt, Human
ucagcuggagaugagaaccgaa

SEQ ID NO: 156194 - RNA, 20 nt, Human
agugcaagaaagcacagcug

SEQ ID NO: 156195 - RNA, 22 nt, Human
guggccugucagaagccguggg

SEQ ID NO: 156196 - RNA, 22 nt, Human
uagagugguuaacaguuuagaa

SEQ ID NO: 156197 - RNA, 22 nt, Human
acauuucuggaguuucucaaca

SEQ ID NO: 156198 - RNA, 22 nt, Human
ugggcagacgcuguuggaaggc

SEQ ID NO: 156199 - RNA, 22 nt, Human
uggcccugccacucacugcuga

SEQ ID NO: 156200 - RNA, 22 nt, Human
aauauguucaaaauagaucacu

SEQ ID NO: 156201 - RNA, 22 nt, Human
agcagccacacgccuccuucuc

SEQ ID NO: 156202 - RNA, 22 nt, Human
aaagaucagucugaagcaacau

SEQ ID NO: 156203 - RNA, 22 nt, Human
cagagcuguccaaacccugaca

SEQ ID NO: 156204 - RNA, 22 nt, Human
aaucgguugaacccaggaagug

SEQ ID NO: 156205 - RNA, 22 nt, Human
agugaguggguuacagauggga

SEQ ID NO: 156206 - RNA, 22 nt, Human
gccuaauaacuagcuguguaac

SEQ ID NO: 156207 - RNA, 22 nt, Human
ucagggcagguuaacuugggug

SEQ ID NO: 156208 - RNA, 22 nt, Human
aucaaaguucguaacugauaac

SEQ ID NO: 156209 - RNA, 22 nt, Human
aggccugaaguguggagugggg

SEQ ID NO: 156210 - RNA, 22 nt, Human
cagcccuuuccuucucagcuuu

SEQ ID NO: 156211 - RNA, 22 nt, Human
accacugggcgggcagccugcu

SEQ ID NO: 156212 - RNA, 17 nt, Human
aauagcugcucagagag

SEQ ID NO: 156213 - RNA, 22 nt, Human
aaagcccauguggaaguacagg

SEQ ID NO: 156214 - RNA, 22 nt, Human
gagaggcugaaaucacaggagc

SEQ ID NO: 156215 - RNA, 22 nt, Human
cagacagcugcuuucuugcugu

SEQ ID NO: 156216 - RNA, 22 nt, Human
augcacaagaggcuagaaaaga

SEQ ID NO: 156217 - RNA, 22 nt, Human
ugugggcaggcccgggucugag

SEQ ID NO: 156218 - RNA, 22 nt, Human
cuccuuccugguuagcaccuua

SEQ ID NO: 156219 - RNA, 22 nt, Human
uuuuccuaguaggccuauuaga

SEQ ID NO: 156220 - RNA, 22 nt, Human
ggacacagcugcagccacaccc

SEQ ID NO: 156221 - RNA, 22 nt, Human
uggcucucaggccugcugcguu

SEQ ID NO: 156222 - RNA, 22 nt, Human
aaaucaguucacguucugaggu

SEQ ID NO: 156223 - RNA, 22 nt, Human
uaaggcaccuguccaggcuggg

SEQ ID NO: 156224 - RNA, 22 nt, Human
aaggcacuuaacgugggaggau

SEQ ID NO: 156225 - RNA, 22 nt, Human
ggagucccagcaaagccuuccc

SEQ ID NO: 156226 - RNA, 22 nt, Human
uuuauuugucuugccauuuagu

SEQ ID NO: 156227 - RNA, 22 nt, Human
agucuccuuggccucaaugccu

SEQ ID NO: 156228 - RNA, 21 nt, Human
ugaaaucugaugggacaaaug

SEQ ID NO: 156229 - RNA, 22 nt, Human
gagccuggagcuggaacgaagc

SEQ ID NO: 156230 - RNA, 23 nt, Human
uggcaccaggcauucuaggggua

SEQ ID NO: 156231 - RNA, 22 nt, Human
acagaccaaaaaaggauauugg

SEQ ID NO: 156232 - RNA, 17 nt, Human
uggacccuugggccucc

SEQ ID NO: 156233 - RNA, 22 nt, Human
gcuggcaggguucucacugaaa

SEQ ID NO: 156234 - RNA, 22 nt, Human
ggccugaggcaauagucagaca

SEQ ID NO: 156235 - RNA, 22 nt, Human
cugaaggaagcagaagcgaggu

SEQ ID NO: 156236 - RNA, 22 nt, Human
ggcuggcauccagggaaaucca

SEQ ID NO: 156237 - RNA, 22 nt, Human
cuuuccuagauggccaucuuuc

SEQ ID NO: 156238 - RNA, 22 nt, Human
aaguuacaggagaaagagauca

SEQ ID NO: 156239 - RNA, 22 nt, Human
aaagaacaaauuagcuguuuua

SEQ ID NO: 156240 - RNA, 22 nt, Human
ggagcugcuuugaucugaagaa

SEQ ID NO: 156241 - RNA, 22 nt, Human
cccaggccagaacuugguugcu

SEQ ID NO: 156242 - RNA, 22 nt, Human
uagaucugauacaauucaucug

SEQ ID NO: 156243 - RNA, 22 nt, Human
ugaggcaggagguugagaacug

SEQ ID NO: 156244 - RNA, 22 nt, Human
ggccucugccccagccacaccu

SEQ ID NO: 156245 - RNA, 22 nt, Human
acuggcagagguuggacaccau

SEQ ID NO: 156246 - RNA, 22 nt, Human
aagggcagaaagggacgcuuug

SEQ ID NO: 156247 - RNA, 22 nt, Human
uucacaggaggguggaugcaug

SEQ ID NO: 156248 - RNA, 22 nt, Human
ugggcugcccugaugguccuca

SEQ ID NO: 156249 - RNA, 22 nt, Human
cuccaggccauggcugcggagg

SEQ ID NO: 156250 - RNA, 22 nt, Human
ugaagcccugugucagcuucca

SEQ ID NO: 156251 - RNA, 22 nt, Human
gagaggaguaggcugauggugc

SEQ ID NO: 156252 - RNA, 21 nt, Human
ugguggagugugcugagcaug

SEQ ID NO: 156253 - RNA, 22 nt, Human
cucuggagugcagccugguggc

SEQ ID NO: 156254 - RNA, 22 nt, Human
gggcccuggacguggcggcaga

SEQ ID NO: 156255 - RNA, 22 nt, Human
ggccucagaccggagcuggcca

SEQ ID NO: 156256 - RNA, 22 nt, Human
ucaguuuuguauguuguaaguc

SEQ ID NO: 156257 - RNA, 22 nt, Human
gcuuuguguagaaggaggaugg

SEQ ID NO: 156258 - RNA, 22 nt, Human
aggcuucccagcugagcucagc

SEQ ID NO: 156259 - RNA, 22 nt, Human
cgcuggggcuuuuugcuugaga

SEQ ID NO: 156260 - RNA, 22 nt, Human
augggaugcauggcuguggcca

SEQ ID NO: 156261 - RNA, 22 nt, Human
gugcaugugucuuuauaguaga

SEQ ID NO: 156262 - RNA, 22 nt, Human
agcugguguccuccuggagcug

SEQ ID NO: 156263 - RNA, 22 nt, Human
agggacacugaugagaaauucu

SEQ ID NO: 156264 - RNA, 22 nt, Human
ccugccuggcugucagcagagc

SEQ ID NO: 156265 - RNA, 22 nt, Human
gcccugagggguggugucugua

SEQ ID NO: 156266 - RNA, 22 nt, Human
gaguguuccagaaacuggcccu

SEQ ID NO: 156267 - RNA, 22 nt, Human
agggagcuguggucagcucagu

SEQ ID NO: 156268 - RNA, 22 nt, Human
cacagggcuuugauggcugagu

SEQ ID NO: 156269 - RNA, 19 nt, Human
agcagccaucgaccaugga

SEQ ID NO: 156270 - RNA, 22 nt, Human
gugccuggagcuaauguguaua

SEQ ID NO: 156271 - RNA, 22 nt, Human
ggcugcaggcagaggcugucug

SEQ ID NO: 156272 - RNA, 22 nt, Human
aaaaauaggucaaccguguaug

SEQ ID NO: 156273 - RNA, 22 nt, Human
cacugaagaugcgacuagugcu

SEQ ID NO: 156274 - RNA, 22 nt, Human
gcuguucugcgucccaggcugg

SEQ ID NO: 156275 - RNA, 22 nt, Human
acuucuugggacccuggcaccg

SEQ ID NO: 156276 - RNA, 22 nt, Human
ccucccaccauuuagagagagc

SEQ ID NO: 156277 - RNA, 22 nt, Human
ugugccuggaucucugugacaa

SEQ ID NO: 156278 - RNA, 22 nt, Human
uaagacaauucuucagucacaa

SEQ ID NO: 156279 - RNA, 22 nt, Human
cucuggagaacuccuugugucu

SEQ ID NO: 156280 - RNA, 22 nt, Human
gaggccugaggcugccuggagc

SEQ ID NO: 156281 - RNA, 22 nt, Human
uggcagagagacucuccuugau

SEQ ID NO: 156282 - RNA, 19 nt, Human
ggccccucucacaggaguu

SEQ ID NO: 156283 - RNA, 22 nt, Human
gcccagcuuuuugaggcaggca

SEQ ID NO: 156284 - RNA, 18 nt, Human
cucagggcaucagucugg

SEQ ID NO: 156285 - RNA, 22 nt, Human
cagagcugugauaaauagauau

SEQ ID NO: 156286 - RNA, 22 nt, Human
ugugcagggaagggcaugcuau

SEQ ID NO: 156287 - RNA, 22 nt, Human
aagcugccuugcugaggagaaa

SEQ ID NO: 156288 - RNA, 19 nt, Human
ucagaggauuuggcuauga

SEQ ID NO: 156289 - RNA, 23 nt, Human
agaagcagcuucuggaguaucgg

SEQ ID NO: 156290 - RNA, 19 nt, Human
aacuagaaagguuuugaga

SEQ ID NO: 156291 - RNA, 23 nt, Human
ggcucugugcugggccugcagga

SEQ ID NO: 156292 - RNA, 22 nt, Human
gggcuggcucugucuagaaagg

SEQ ID NO: 156293 - RNA, 22 nt, Human
aggauccuguauggagaagcug

SEQ ID NO: 156294 - RNA, 22 nt, Human
uguaccuuuuucugugcaugcu

SEQ ID NO: 156295 - RNA, 22 nt, Human
auuucuuuucaagagggugcuu

SEQ ID NO: 156296 - RNA, 20 nt, Human
ccugaggguuuguguucuuu

SEQ ID NO: 156297 - RNA, 22 nt, Human
gucagcugucuccccagagugg

SEQ ID NO: 156298 - RNA, 22 nt, Human
uacauuguucaugcaugagaaa

SEQ ID NO: 156299 - RNA, 22 nt, Human
aucuagaaaguguugaagauca

SEQ ID NO: 156300 - RNA, 22 nt, Human
caaaaugugagucccaccucaa

SEQ ID NO: 156301 - RNA, 21 nt, Human
aaaaugugagcgugaugcuua

SEQ ID NO: 156302 - RNA, 22 nt, Human
ugucacauguguggcauuuuuc

SEQ ID NO: 156303 - RNA, 22 nt, Human
gguggccucucaugcaagguag

SEQ ID NO: 156304 - RNA, 22 nt, Human
uugaacagcuguuacauuguua

SEQ ID NO: 156305 - RNA, 22 nt, Human
cauuuagacauuugauuugggg

SEQ ID NO: 156306 - RNA, 22 nt, Human
cauggggagacaccuagggaaa

SEQ ID NO: 156307 - RNA, 22 nt, Human
aguauuucugcucaugaaagag

SEQ ID NO: 156308 - RNA, 22 nt, Human
agugaguggacccugcaaggaa

SEQ ID NO: 156309 - RNA, 22 nt, Human
gcugccuuuuaaagccucgcuu

SEQ ID NO: 156310 - RNA, 22 nt, Human
uucuuucagaacacaagugauu

SEQ ID NO: 156311 - RNA, 22 nt, Human
uggguggcggccugguucugag

SEQ ID NO: 156312 - RNA, 22 nt, Human
ccugucaggguuugccucagaa

SEQ ID NO: 156313 - RNA, 22 nt, Human
aacuagaaccacuuguauuucc

SEQ ID NO: 156314 - RNA, 21 nt, Human
aggcagaaagagcccaggcug

SEQ ID NO: 156315 - RNA, 23 nt, Human
ugccagaggcagucacaguggug

SEQ ID NO: 156316 - RNA, 22 nt, Human
uuuccucuucuggcaggcaggg

SEQ ID NO: 156317 - RNA, 22 nt, Human
cugggccagggaggugucugua

SEQ ID NO: 156318 - RNA, 22 nt, Human
agcuggccuccgggugccuggg

SEQ ID NO: 156319 - RNA, 22 nt, Human
guuuuuccuugcugaggacccg

SEQ ID NO: 156320 - RNA, 22 nt, Human
gagagaagggggauaugagccu

SEQ ID NO: 156321 - RNA, 22 nt, Human
aaugccaguguguugauuccag

SEQ ID NO: 156322 - RNA, 22 nt, Human
ucaaaagucugcauucuucaca

SEQ ID NO: 156323 - RNA, 22 nt, Human
cacacaugagucuccccauugg

SEQ ID NO: 156324 - RNA, 22 nt, Human
uccucuggggucagggcacuac

SEQ ID NO: 156325 - RNA, 20 nt, Human
uauuugaaauggccaagugu

SEQ ID NO: 156326 - RNA, 22 nt, Human
agaaauaugcugauuagaugaa

SEQ ID NO: 156327 - RNA, 22 nt, Human
cccaggccccagggcuugucag

SEQ ID NO: 156328 - RNA, 22 nt, Human
aagagcuggaguuugcagcccu

SEQ ID NO: 156329 - RNA, 22 nt, Human
ccuggagcacagcccaguccca

SEQ ID NO: 156330 - RNA, 22 nt, Human
ugucccauggacacaacuucuu

SEQ ID NO: 156331 - RNA, 22 nt, Human
cuguacaucccgagagccagua

SEQ ID NO: 156332 - RNA, 21 nt, Human
aaggcagaagcauggaaugag

SEQ ID NO: 156333 - RNA, 22 nt, Human
gagugcaucguggccauuuuaa

SEQ ID NO: 156334 - RNA, 22 nt, Human
gcacagggagcaggucucuggu

SEQ ID NO: 156335 - RNA, 22 nt, Human
ugaagccacagagcaucugccu

SEQ ID NO: 156336 - RNA, 22 nt, Human
agaaauuccuaagguacacaag

SEQ ID NO: 156337 - RNA, 22 nt, Human
gggcauggaggucugucugcag

SEQ ID NO: 156338 - RNA, 19 nt, Human
augucccaccgccccugag

SEQ ID NO: 156339 - RNA, 22 nt, Human
ggcugagccuggagcaucuggu

SEQ ID NO: 156340 - RNA, 22 nt, Human
uggcagagaugaagaguuguuu

SEQ ID NO: 156341 - RNA, 20 nt, Human
cugugcuuuggaaccuggaa

SEQ ID NO: 156342 - RNA, 22 nt, Human
uacaaaaguaauuacgguuuuu

SEQ ID NO: 156343 - RNA, 22 nt, Human
ugcaggagcugugcggugaggg

SEQ ID NO: 156344 - RNA, 22 nt, Human
ggcaguggguuccccaaggcac

SEQ ID NO: 156345 - RNA, 22 nt, Human
ccuuaaaagaacuaucucuucu

SEQ ID NO: 156346 - RNA, 22 nt, Human
gcacacccucucaccagcacug

SEQ ID NO: 156347 - RNA, 22 nt, Human
ggcagggguccugguguugacu

SEQ ID NO: 156348 - RNA, 22 nt, Human
auccuugacacacuccaguacu

SEQ ID NO: 156349 - RNA, 22 nt, Human
ugcagucuggauguccucagau

SEQ ID NO: 156350 - RNA, 22 nt, Human
ugggccugggagggcagacgcu

SEQ ID NO: 156351 - RNA, 22 nt, Human
caggggcuguggcacauggugu

SEQ ID NO: 156352 - RNA, 22 nt, Human
caggcacugugcaagggucucg

SEQ ID NO: 156353 - RNA, 22 nt, Human
uccuuggcaugccgucuucucc

SEQ ID NO: 156354 - RNA, 22 nt, Human
gcuggggagcuagaccucagca

SEQ ID NO: 156355 - RNA, 22 nt, Human
agggccuggugaccuggguccu

SEQ ID NO: 156356 - RNA, 22 nt, Human
cccaggcagggacgugcucugg

SEQ ID NO: 156357 - RNA, 22 nt, Human
cagaacauuccaugugcccugc

SEQ ID NO: 156358 - RNA, 22 nt, Human
agagccagcauuugacacuggc

SEQ ID NO: 156359 - RNA, 22 nt, Human
ugcccuguuccugccuccagcu

SEQ ID NO: 156360 - RNA, 22 nt, Human
gcagagccugggggucugcgga

SEQ ID NO: 156361 - RNA, 22 nt, Human
agcagagcggggccuccggaag

SEQ ID NO: 156362 - RNA, 22 nt, Human
cagagccucagaauccugugga

SEQ ID NO: 156363 - RNA, 22 nt, Human
uugcagcagggugaauucacuc

SEQ ID NO: 156364 - RNA, 22 nt, Human
gcucccugccuacacggaccuu

SEQ ID NO: 156365 - RNA, 19 nt, Human
ucuaacagaagugucgucc

SEQ ID NO: 156366 - RNA, 22 nt, Human
cucucuggcuuggcacggagau

SEQ ID NO: 156367 - RNA, 23 nt, Human
uggcagagacccagaaucuacau

SEQ ID NO: 156368 - RNA, 22 nt, Human
uacauuccauguguguguauuc

SEQ ID NO: 156369 - RNA, 22 nt, Human
caggugcucccagagaagugcu

SEQ ID NO: 156370 - RNA, 20 nt, Human
ugggccugagccugugggcu

SEQ ID NO: 156371 - RNA, 22 nt, Human
uggccuggaaaaaugcagaugg

SEQ ID NO: 156372 - RNA, 22 nt, Human
aagagcuggcucuugcagcagc

SEQ ID NO: 156373 - RNA, 22 nt, Human
agcaguggagcgagauguuuaa

SEQ ID NO: 156374 - RNA, 21 nt, Human
aggugggagaccauguagguc

SEQ ID NO: 156375 - RNA, 22 nt, Human
uagauaaauuagaaaguuuacu

SEQ ID NO: 156376 - RNA, 22 nt, Human
gcagccacuuugcaaccaagag

SEQ ID NO: 156377 - RNA, 22 nt, Human
ugugaaagucaaauuaauugaa

SEQ ID NO: 156378 - RNA, 22 nt, Human
gagccauacaaccuauaaagug

SEQ ID NO: 156379 - RNA, 22 nt, Human
cccauuuaaacacaagcuuuca

SEQ ID NO: 156380 - RNA, 22 nt, Human
ugcuccagugagcuggccaucc

SEQ ID NO: 156381 - RNA, 22 nt, Human
agcugcagagguuugugcaaca

SEQ ID NO: 156382 - RNA, 22 nt, Human
agaaggaguguacaggucaugc

SEQ ID NO: 156383 - RNA, 22 nt, Human
cagacuugacggcagcugcuuu

SEQ ID NO: 156384 - RNA, 23 nt, Human
uggcucugugucacauacaggau

SEQ ID NO: 156385 - RNA, 22 nt, Human
agugaaauccuggucaacaggu

SEQ ID NO: 156386 - RNA, 22 nt, Human
ccaaggagcaaguuuacaccug

SEQ ID NO: 156387 - RNA, 22 nt, Human
aaguguguauuguuuaugcugc

SEQ ID NO: 156388 - RNA, 22 nt, Human
cuccuucccuucaaguguuccu

SEQ ID NO: 156389 - RNA, 17 nt, Human
ccaggugggaggugggg

SEQ ID NO: 156390 - RNA, 18 nt, Human
ucugggcuucccgaggcu

SEQ ID NO: 156391 - RNA, 22 nt, Human
uagugcacacgcauguagcagu

SEQ ID NO: 156392 - RNA, 19 nt, Human
gcugugugaccuugggcaa

SEQ ID NO: 156393 - RNA, 22 nt, Human
ugaaagguuaaaaguaguauug

SEQ ID NO: 156394 - RNA, 22 nt, Human
ggcaggagcucuccaguuugcc

SEQ ID NO: 156395 - RNA, 22 nt, Human
gugcauuuggugacucucaccc

SEQ ID NO: 156396 - RNA, 23 nt, Human
ugaugggaaggaacgacuaccac

SEQ ID NO: 156397 - RNA, 22 nt, Human
caguagcaggcacucagcacgu

SEQ ID NO: 156398 - RNA, 22 nt, Human
gcucugucauuuugcagacacu

SEQ ID NO: 156399 - RNA, 22 nt, Human
cauguacaaaaggcaaaugccu

SEQ ID NO: 156400 - RNA, 22 nt, Human
agaaggccuaacuugggggcaa

SEQ ID NO: 156401 - RNA, 22 nt, Human
accugagaaugggggcaugugu

SEQ ID NO: 156402 - RNA, 21 nt, Human
ccugggccaaauucccuggac

SEQ ID NO: 156403 - RNA, 22 nt, Human
auaaaaguuuccaaucaugccu

SEQ ID NO: 156404 - RNA, 22 nt, Human
ccuccagggcagacggggagca

SEQ ID NO: 156405 - RNA, 22 nt, Human
uuagauaaauuaagacuuuaca

SEQ ID NO: 156406 - RNA, 22 nt, Human
ugcagcagguuccaaaggguua

SEQ ID NO: 156407 - RNA, 22 nt, Human
gcagcaggcuuuucauaccuug

SEQ ID NO: 156408 - RNA, 22 nt, Human
ccagggcugcugugggacucca

SEQ ID NO: 156409 - RNA, 22 nt, Human
cagaccugagguugaguaccag

SEQ ID NO: 156410 - RNA, 22 nt, Human
agauacauauagaaaacaucaa

SEQ ID NO: 156411 - RNA, 22 nt, Human
aggacuucuccgauaagucaga

SEQ ID NO: 156412 - RNA, 19 nt, Human
cccucaggucugagcaguc

SEQ ID NO: 156413 - RNA, 22 nt, Human
gcaggcuggaggcuguucuggg

SEQ ID NO: 156414 - RNA, 18 nt, Human
uccagagcuacuguggug

SEQ ID NO: 156415 - RNA, 22 nt, Human
cugcaggcccccuuccuggagu

SEQ ID NO: 156416 - RNA, 23 nt, Human
ugcucugggaggcccuggagagc

SEQ ID NO: 156417 - RNA, 22 nt, Human
aguguuucucagaagggccuau

SEQ ID NO: 156418 - RNA, 22 nt, Human
acugagcugcaagucagggagg

SEQ ID NO: 156419 - RNA, 22 nt, Human
caggguuucaccauguuagcag

SEQ ID NO: 156420 - RNA, 18 nt, Human
aagcugcccucaggcagg

SEQ ID NO: 156421 - RNA, 22 nt, Human
gugcucaggaagcuguuccugc

SEQ ID NO: 156422 - RNA, 22 nt, Human
cucagagcccaggguacacccg

SEQ ID NO: 156423 - RNA, 22 nt, Human
cagcuugggaguuugguuuuau

SEQ ID NO: 156424 - RNA, 22 nt, Human
ccucagaggugaacaucagugc

SEQ ID NO: 156425 - RNA, 22 nt, Human
agcccaagcauaggagggaggc

SEQ ID NO: 156426 - RNA, 22 nt, Human
ucuuugcaucccuuccauaguu

SEQ ID NO: 156427 - RNA, 22 nt, Human
uccuauugguagacauuucugu

SEQ ID NO: 156428 - RNA, 22 nt, Human
agcagagccagaauuggaccag

SEQ ID NO: 156429 - RNA, 22 nt, Human
ucaagcaucuuggucuacgauc

SEQ ID NO: 156430 - RNA, 22 nt, Human
gcugccuguguggccacucacu

SEQ ID NO: 156431 - RNA, 22 nt, Human
aagauuucuuacuuauugaugc

SEQ ID NO: 156432 - RNA, 22 nt, Human
ggaaagaggauaguggguaggu

SEQ ID NO: 156433 - RNA, 22 nt, Human
aaugaacaucaaaugccuacca

SEQ ID NO: 156434 - RNA, 22 nt, Human
agacagaacagaauaauuguug

SEQ ID NO: 156435 - RNA, 22 nt, Human
uacagucuuuggaaagagauag

SEQ ID NO: 156436 - RNA, 22 nt, Human
ggagugggaacaaugacauggu

SEQ ID NO: 156437 - RNA, 22 nt, Human
gagagcuguccggcugagcagc

SEQ ID NO: 156438 - RNA, 22 nt, Human
cuggccuggcagggagggcaug

SEQ ID NO: 156439 - RNA, 22 nt, Human
cacuguaucuuuuccaaagucu

SEQ ID NO: 156440 - RNA, 22 nt, Human
gcugucuuccuugcuccaaggg

SEQ ID NO: 156441 - RNA, 22 nt, Human
uacacauguuuggcaaguaugu

SEQ ID NO: 156442 - RNA, 22 nt, Human
agagcugaauuuggguggugga

SEQ ID NO: 156443 - RNA, 23 nt, Human
guggagccacaucacaggcuccu

SEQ ID NO: 156444 - RNA, 21 nt, Human
uggcucuggguaggagagugc

SEQ ID NO: 156445 - RNA, 22 nt, Human
cauucacucagcgaugccagua

SEQ ID NO: 156446 - RNA, 22 nt, Human
gcagggcuguggacacuuuggu

SEQ ID NO: 156447 - RNA, 22 nt, Human
gcagccacacuguuacagaaug

SEQ ID NO: 156448 - RNA, 22 nt, Human
uggcucaguuucugcccagcug

SEQ ID NO: 156449 - RNA, 22 nt, Human
cagggucuuauaaggccaauuu

SEQ ID NO: 156450 - RNA, 22 nt, Human
ugucagugguagacccagaggu

SEQ ID NO: 156451 - RNA, 22 nt, Human
uaguccaguaaaacagcuaacg

SEQ ID NO: 156452 - RNA, 22 nt, Human
gggcucucaugaguguguggua

SEQ ID NO: 156453 - RNA, 22 nt, Human
agugucugccaacugcaugguc

SEQ ID NO: 156454 - RNA, 22 nt, Human
cugagagcagggacuugagcca

SEQ ID NO: 156455 - RNA, 22 nt, Human
agcugcugugugcucaggcagg

SEQ ID NO: 156456 - RNA, 22 nt, Human
uagaaacacagaucugguguca

SEQ ID NO: 156457 - RNA, 22 nt, Human
ggcaguggugggaggcucgcuc

SEQ ID NO: 156458 - RNA, 22 nt, Human
agggcagaaguacagacacuua

SEQ ID NO: 156459 - RNA, 22 nt, Human
cuacacaguucugccuaauggc

SEQ ID NO: 156460 - RNA, 22 nt, Human
cugucaucacaguugagcagcc

SEQ ID NO: 156461 - RNA, 22 nt, Human
cacagaagaaucaugcuguguu

SEQ ID NO: 156462 - RNA, 22 nt, Human
gugugcagugagcaaaagaucu

SEQ ID NO: 156463 - RNA, 22 nt, Human
uggagcccagacacuggcauug

SEQ ID NO: 156464 - RNA, 22 nt, Human
gcuucauuacugacagucugug

SEQ ID NO: 156465 - RNA, 22 nt, Human
uaggccaguggcagguugugug

SEQ ID NO: 156466 - RNA, 22 nt, Human
ccugccugcaccuucucugggg

SEQ ID NO: 156467 - RNA, 22 nt, Human
uuccucaucugugcaccucacu

SEQ ID NO: 156468 - RNA, 22 nt, Human
uggagcucaaaggccuguggga

SEQ ID NO: 156469 - RNA, 22 nt, Human
cacagaggcaaccuucuggggu

SEQ ID NO: 156470 - RNA, 22 nt, Human
ugggccuggaguuuguccagag

SEQ ID NO: 156471 - RNA, 22 nt, Human
augcaguacugauacaugccac

SEQ ID NO: 156472 - RNA, 22 nt, Human
ggcagagcuuguuccuucuguu

SEQ ID NO: 156473 - RNA, 22 nt, Human
ugguggcuguugcagaacugag

SEQ ID NO: 156474 - RNA, 22 nt, Human
ugcuggggagugauugaccauc

SEQ ID NO: 156475 - RNA, 22 nt, Human
uuuuugaaggcugaugugauua

SEQ ID NO: 156476 - RNA, 22 nt, Human
ucccuggggauguuggccugcc

SEQ ID NO: 156477 - RNA, 22 nt, Human
uggcugaaucugcagcaggaag

SEQ ID NO: 156478 - RNA, 22 nt, Human
gagcugccaagauuacaaucag

SEQ ID NO: 156479 - RNA, 20 nt, Human
uagauuucauacuucucuuu

SEQ ID NO: 156480 - RNA, 22 nt, Human
gcucuguccagcgugcacagaa

SEQ ID NO: 156481 - RNA, 16 nt, Human
agaggccuugaggaag

SEQ ID NO: 156482 - RNA, 22 nt, Human
cugaagaugucugagaugcuca

SEQ ID NO: 156483 - RNA, 22 nt, Human
ggcugccuucagacuccagcuu

SEQ ID NO: 156484 - RNA, 22 nt, Human
aaguuuuaacaaguacuuacua

SEQ ID NO: 156485 - RNA, 22 nt, Human
gaaaugcagauucugauucugu

SEQ ID NO: 156486 - RNA, 22 nt, Human
uaugaagaaguucugugaaaug

SEQ ID NO: 156487 - RNA, 22 nt, Human
gaaaugugugacaaguuucaau

SEQ ID NO: 156488 - RNA, 22 nt, Human
cugcccuguggcucugagucau

SEQ ID NO: 156489 - RNA, 21 nt, Human
ugaaaguuggagucaaaugua

SEQ ID NO: 156490 - RNA, 22 nt, Human
gaggccugcagcguggucccug

SEQ ID NO: 156491 - RNA, 22 nt, Human
ggcagcaggcgacuucccuauu

SEQ ID NO: 156492 - RNA, 23 nt, Human
uggcagcagaucuuaaagugacc

SEQ ID NO: 156493 - RNA, 22 nt, Human
uggagccaaggccaguucucag

SEQ ID NO: 156494 - RNA, 22 nt, Human
cagggccagcgcccaggcccag

SEQ ID NO: 156495 - RNA, 22 nt, Human
ccaaagucagugcucagucguc

SEQ ID NO: 156496 - RNA, 19 nt, Human
aguagcagaaagugcagug

SEQ ID NO: 156497 - RNA, 22 nt, Human
gucccacaccuugaggggucuu

SEQ ID NO: 156498 - RNA, 22 nt, Human
ucaggaaagaagaugcucagug

SEQ ID NO: 156499 - RNA, 22 nt, Human
uccugcagagccgcccucaggu

SEQ ID NO: 156500 - RNA, 22 nt, Human
auguaucaugcaggguccauga

SEQ ID NO: 156501 - RNA, 22 nt, Human
acuuuguauaagacaauaaaga

SEQ ID NO: 156502 - RNA, 22 nt, Human
cagggcuggcuguggcaaucuc

SEQ ID NO: 156503 - RNA, 22 nt, Human
gcuucccacagcuggacugggg

SEQ ID NO: 156504 - RNA, 22 nt, Human
aaaugcagcagcuaauugaaaa

SEQ ID NO: 156505 - RNA, 22 nt, Human
ucucaggguuuccugggggcug

SEQ ID NO: 156506 - RNA, 22 nt, Human
ugugaaggcagcagcucugucc

SEQ ID NO: 156507 - RNA, 23 nt, Human
uugcauguagcccaugaguaacu

SEQ ID NO: 156508 - RNA, 22 nt, Human
agcugccauccgaggugucaga

SEQ ID NO: 156509 - RNA, 22 nt, Human
ccaggaagcggugagggcugcc

SEQ ID NO: 156510 - RNA, 22 nt, Human
ccuuggagcggucagcacuggu

SEQ ID NO: 156511 - RNA, 19 nt, Human
ggcugucuggcguguggau

SEQ ID NO: 156512 - RNA, 22 nt, Human
uguguacagcaggauuucucaa

SEQ ID NO: 156513 - RNA, 22 nt, Human
augcacagcagugaguucagug

SEQ ID NO: 156514 - RNA, 22 nt, Human
auaaggcaucucucaguuagca

SEQ ID NO: 156515 - RNA, 22 nt, Human
aucagcaagcauuuauugagug

SEQ ID NO: 156516 - RNA, 22 nt, Human
cccaggcucccaggugggacaa

SEQ ID NO: 156517 - RNA, 22 nt, Human
gcugcucugugacagccuccgg

SEQ ID NO: 156518 - RNA, 22 nt, Human
gagagcugugguuugaccaggc

SEQ ID NO: 156519 - RNA, 18 nt, Human
augggaggggccaagaga

SEQ ID NO: 156520 - RNA, 22 nt, Human
uagcagcuuaaguaauuagaau

SEQ ID NO: 156521 - RNA, 22 nt, Human
gcccucucggcauagcaggggc

SEQ ID NO: 156522 - RNA, 22 nt, Human
agggaugguggagguugcaagu

SEQ ID NO: 156523 - RNA, 22 nt, Human
ccagaggcuggguucaccucag

SEQ ID NO: 156524 - RNA, 22 nt, Human
aggaaaaaagucugugauuaua

SEQ ID NO: 156525 - RNA, 22 nt, Human
uacccagcuucaagucaggacu

SEQ ID NO: 156526 - RNA, 22 nt, Human
acugucacuccaacugagucgu

SEQ ID NO: 156527 - RNA, 22 nt, Human
cucuggaggccuaaggaagugg

SEQ ID NO: 156528 - RNA, 22 nt, Human
aggccuggccccaguugcuagg

SEQ ID NO: 156529 - RNA, 22 nt, Human
ggagagcugguagcuggcucca

SEQ ID NO: 156530 - RNA, 22 nt, Human
uaucuguuccaggcacucagcu

SEQ ID NO: 156531 - RNA, 21 nt, Human
agcuuccugcagugggagguc

SEQ ID NO: 156532 - RNA, 22 nt, Human
caggccagugugcuucccaggc

SEQ ID NO: 156533 - RNA, 22 nt, Human
ccuggccugcucggcucuuaag

SEQ ID NO: 156534 - RNA, 22 nt, Human
ugaggcagcaauuguauuguau

SEQ ID NO: 156535 - RNA, 22 nt, Human
ugucucugauaaguaguucagu

SEQ ID NO: 156536 - RNA, 22 nt, Human
gcugggcagccuggccgcugcc

SEQ ID NO: 156537 - RNA, 22 nt, Human
gacauuucaaucucauuauggg

SEQ ID NO: 156538 - RNA, 22 nt, Human
uggcccugcuggccaaaggcua

SEQ ID NO: 156539 - RNA, 22 nt, Human
cuguggcuaugguguacauacu

SEQ ID NO: 156540 - RNA, 22 nt, Human
cagagcagggugcaccuugggc

SEQ ID NO: 156541 - RNA, 22 nt, Human
aaguuugagaagcuuauagaua

SEQ ID NO: 156542 - RNA, 21 nt, Human
acccuggguucuccauacccu

SEQ ID NO: 156543 - RNA, 21 nt, Human
ugcucaugcaaugcaugucca

SEQ ID NO: 156544 - RNA, 22 nt, Human
agaaaagggcaggagggauaca

SEQ ID NO: 156545 - RNA, 22 nt, Human
ggccagggccuggggacugucc

SEQ ID NO: 156546 - RNA, 23 nt, Human
uggcuggcagaaacugaagcaug

SEQ ID NO: 156547 - RNA, 22 nt, Human
cacaggcuccggccuugcagcc

SEQ ID NO: 156548 - RNA, 22 nt, Human
cagaguguggcaucuuccaacu

SEQ ID NO: 156549 - RNA, 22 nt, Human
guucauauuacuuugagugcag

SEQ ID NO: 156550 - RNA, 22 nt, Human
gaugcacugcaguauauacugu

SEQ ID NO: 156551 - RNA, 22 nt, Human
aagaggaacugggggcugaguc

SEQ ID NO: 156552 - RNA, 22 nt, Human
ugagcccaggaguaugaggcug

SEQ ID NO: 156553 - RNA, 22 nt, Human
cuguccccgcgaguccagagcu

SEQ ID NO: 156554 - RNA, 22 nt, Human
auccaaaucaugucagaagaac

SEQ ID NO: 156555 - RNA, 22 nt, Human
uguuuguucccucucuuuccug

SEQ ID NO: 156556 - RNA, 22 nt, Human
gcuuccucgcugggcagaggca

SEQ ID NO: 156557 - RNA, 22 nt, Human
ugugacaucgcugugucuguuu

SEQ ID NO: 156558 - RNA, 17 nt, Human
uuccaguuuaguauugu

SEQ ID NO: 156559 - RNA, 22 nt, Human
aaaguuugaaugauauauuagu

SEQ ID NO: 156560 - RNA, 20 nt, Human
gcugccagugccugaugcuu

SEQ ID NO: 156561 - RNA, 22 nt, Human
gucaccaggucugaugcagcca

SEQ ID NO: 156562 - RNA, 22 nt, Human
acagcagcauaaacugacuaag

SEQ ID NO: 156563 - RNA, 22 nt, Human
agccccugggaguagcugcugc

SEQ ID NO: 156564 - RNA, 22 nt, Human
ucuuaaaaguaugccaauugga

SEQ ID NO: 156565 - RNA, 22 nt, Human
auugacaagugagcugggcugc

SEQ ID NO: 156566 - RNA, 22 nt, Human
uccagugguacauggagacacu

SEQ ID NO: 156567 - RNA, 21 nt, Human
ucagaguguguuacagcaagc

SEQ ID NO: 156568 - RNA, 22 nt, Human
cauguacaguuuuucuguccug

SEQ ID NO: 156569 - RNA, 22 nt, Human
uggccuggcugcccugucugga

SEQ ID NO: 156570 - RNA, 22 nt, Human
ggcuggaaguccaagaucaagg

SEQ ID NO: 156571 - RNA, 22 nt, Human
cuggcaggagcauucacagagg

SEQ ID NO: 156572 - RNA, 22 nt, Human
ucagagcuaaggggagagcaaa

SEQ ID NO: 156573 - RNA, 22 nt, Human
aguggugcugcgcgcggagcuc

SEQ ID NO: 156574 - RNA, 22 nt, Human
cugcucugacccuuucaccuuc

SEQ ID NO: 156575 - RNA, 22 nt, Human
ucucaccaaagccuugaccaua

SEQ ID NO: 156576 - RNA, 22 nt, Human
gccccagguugccugucccagg

SEQ ID NO: 156577 - RNA, 22 nt, Human
ccagggcaacgcugucucagag

SEQ ID NO: 156578 - RNA, 18 nt, Human
guucaaggucaagagaga

SEQ ID NO: 156579 - RNA, 22 nt, Human
ggaguucacugugcaggcucug

SEQ ID NO: 156580 - RNA, 22 nt, Human
agggcagcagcggcccaggccu

SEQ ID NO: 156581 - RNA, 21 nt, Human
agagaagggacucuuccaguc

SEQ ID NO: 156582 - RNA, 22 nt, Human
agugaaaugauaguguaaauac

SEQ ID NO: 156583 - RNA, 19 nt, Human
cagagccucagagcuagaa

SEQ ID NO: 156584 - RNA, 22 nt, Human
gccugggaacucugaucuccug

SEQ ID NO: 156585 - RNA, 22 nt, Human
cugugccaggcccagcugacuu

SEQ ID NO: 156586 - RNA, 22 nt, Human
cucagaguucuccugggaggug

SEQ ID NO: 156587 - RNA, 22 nt, Human
ugccagggugucaggagagcua

SEQ ID NO: 156588 - RNA, 22 nt, Human
uguggucucguuauguugccca

SEQ ID NO: 156589 - RNA, 21 nt, Human
ugcagagauaucugaagcaga

SEQ ID NO: 156590 - RNA, 22 nt, Human
agagauaugaguaguugugaca

SEQ ID NO: 156591 - RNA, 22 nt, Human
agugaaauaaagcugccuaugg

SEQ ID NO: 156592 - RNA, 22 nt, Human
ugggcuggagcuuguugcuucc

SEQ ID NO: 156593 - RNA, 22 nt, Human
caucaaauggcaagugaaagcu

SEQ ID NO: 156594 - RNA, 22 nt, Human
ucucuuucuauugcaccaugcu

SEQ ID NO: 156595 - RNA, 22 nt, Human
cccacagguccccaugaacucg

SEQ ID NO: 156596 - RNA, 22 nt, Human
acauuuguaugcguuuuuacug

SEQ ID NO: 156597 - RNA, 22 nt, Human
ucuuuacacaagacaagaauaa

SEQ ID NO: 156598 - RNA, 22 nt, Human
ccugagcugaacuaagcaguuu

SEQ ID NO: 156599 - RNA, 22 nt, Human
ggcagccagagggcagcuggau

SEQ ID NO: 156600 - RNA, 20 nt, Human
ccuggagccuggaaggaguc

SEQ ID NO: 156601 - RNA, 18 nt, Human
aggccugggaagcugagg

SEQ ID NO: 156602 - RNA, 20 nt, Human
ugcagcugcaggaggguggg

SEQ ID NO: 156603 - RNA, 22 nt, Human
cggggcugcucguccuccugug

SEQ ID NO: 156604 - RNA, 21 nt, Human
cccagggaagccgcagucacc

SEQ ID NO: 156605 - RNA, 22 nt, Human
guauacauagaugaugaacaag

SEQ ID NO: 156606 - RNA, 22 nt, Human
ugucagggcaugcgguccagcc

SEQ ID NO: 156607 - RNA, 22 nt, Human
ucaguuuucaauuucaucagag

SEQ ID NO: 156608 - RNA, 22 nt, Human
gcacagguugcaaaaguucaca

SEQ ID NO: 156609 - RNA, 22 nt, Human
uugaggagucaggggcacggaa

SEQ ID NO: 156610 - RNA, 22 nt, Human
aggguccaucaaggacugcaca

SEQ ID NO: 156611 - RNA, 22 nt, Human
auggacagugugaagcagauag

SEQ ID NO: 156612 - RNA, 22 nt, Human
uaaggcacgcauaagagggggc

SEQ ID NO: 156613 - RNA, 22 nt, Human
acauuugaggauguuaagaaug

SEQ ID NO: 156614 - RNA, 22 nt, Human
guuaauaaagguauagaaucag

SEQ ID NO: 156615 - RNA, 22 nt, Human
gaggcugcuguuagcccugggc

SEQ ID NO: 156616 - RNA, 22 nt, Human
auuuugaaaccaaguuauuucc

SEQ ID NO: 156617 - RNA, 22 nt, Human
cuguagccaguuuggccucacc

SEQ ID NO: 156618 - RNA, 22 nt, Human
cugagccaaaaagcagagcuug

SEQ ID NO: 156619 - RNA, 22 nt, Human
cugucaguucuuccagauagag

SEQ ID NO: 156620 - RNA, 22 nt, Human
gcagcuguguaaugagcccaca

SEQ ID NO: 156621 - RNA, 22 nt, Human
ugcuuccuucccguucuucucc

SEQ ID NO: 156622 - RNA, 22 nt, Human
caagagcugaggcuggagaggu

SEQ ID NO: 156623 - RNA, 22 nt, Human
ccauggccgccgcugcucagga

SEQ ID NO: 156624 - RNA, 22 nt, Human
ucagaggguggcugggagcauc

SEQ ID NO: 156625 - RNA, 22 nt, Human
augggcagcagcugccauucau

SEQ ID NO: 156626 - RNA, 23 nt, Human
augcucugggcugugggaccugc

SEQ ID NO: 156627 - RNA, 23 nt, Human
caguacuuaguguagcguuaauu

SEQ ID NO: 156628 - RNA, 22 nt, Human
cacagggcuucucauggggugc

SEQ ID NO: 156629 - RNA, 22 nt, Human
uuuguaaagucuguucugaguu

SEQ ID NO: 156630 - RNA, 22 nt, Human
gagcaggccagcaauggaaggg

SEQ ID NO: 156631 - RNA, 22 nt, Human
gcaggcagagguggaggagaca

SEQ ID NO: 156632 - RNA, 22 nt, Human
uucugucacuuaggaggucaua

SEQ ID NO: 156633 - RNA, 22 nt, Human
ggcugcagcggauuggggauug

SEQ ID NO: 156634 - RNA, 22 nt, Human
cucugggcaaagaugccucauc

SEQ ID NO: 156635 - RNA, 22 nt, Human
ucccagcagucagagcuaugug

SEQ ID NO: 156636 - RNA, 22 nt, Human
cagggccaccguguuugcugcu

SEQ ID NO: 156637 - RNA, 22 nt, Human
ugggagcugggguuggacgucu

SEQ ID NO: 156638 - RNA, 20 nt, Human
ucucaggccccaguuuucuu

SEQ ID NO: 156639 - RNA, 22 nt, Human
uagaggugucacuuugggaagu

SEQ ID NO: 156640 - RNA, 23 nt, Human
cagagcuggcucagagcugccug

SEQ ID NO: 156641 - RNA, 22 nt, Human
ggagcugaaggggugggcucag

SEQ ID NO: 156642 - RNA, 22 nt, Human
auguacacaugcaugcaugugc

SEQ ID NO: 156643 - RNA, 22 nt, Human
ggacccugggcuugcuccuggg

SEQ ID NO: 156644 - RNA, 22 nt, Human
ccagguggaaggucugugcucu

SEQ ID NO: 156645 - RNA, 22 nt, Human
aaggcacugaaaaauugugugu

SEQ ID NO: 156646 - RNA, 22 nt, Human
acuaaggaauaugacaaacuca

SEQ ID NO: 156647 - RNA, 22 nt, Human
ggcucuggugaggguaggagau

SEQ ID NO: 156648 - RNA, 22 nt, Human
cugauuccugauucaugcucuu

SEQ ID NO: 156649 - RNA, 22 nt, Human
gcucucugccuuucucaaugac

SEQ ID NO: 156650 - RNA, 22 nt, Human
guguggcuaccucagaggagca

SEQ ID NO: 156651 - RNA, 22 nt, Human
gcagagccaugggagguuuuug

SEQ ID NO: 156652 - RNA, 22 nt, Human
gcacugcagccucagauggugg

SEQ ID NO: 156653 - RNA, 18 nt, Human
uacaugcauaaaugaagc

SEQ ID NO: 156654 - RNA, 22 nt, Human
gggugggccugucuggccaugu

SEQ ID NO: 156655 - RNA, 22 nt, Human
aaaucaguuagugguaggauug

SEQ ID NO: 156656 - RNA, 22 nt, Human
uggcuuccugcauggauccucu

SEQ ID NO: 156657 - RNA, 22 nt, Human
ugaggcaggaguucaggcugcg

SEQ ID NO: 156658 - RNA, 22 nt, Human
cugugcaagacuuacuuuaaua

SEQ ID NO: 156659 - RNA, 18 nt, Human
aggcuucuuggcucaguc

SEQ ID NO: 156660 - RNA, 22 nt, Human
gccuaggaguacagaaugguuu

SEQ ID NO: 156661 - RNA, 22 nt, Human
ugggugcuucgucagcucugag

SEQ ID NO: 156662 - RNA, 22 nt, Human
guugggaaggcaagaaguagaa

SEQ ID NO: 156663 - RNA, 22 nt, Human
uggcaguguauagguggcuccu

SEQ ID NO: 156664 - RNA, 22 nt, Human
ucucaggggccuggaguccugg

SEQ ID NO: 156665 - RNA, 18 nt, Human
ugggauggagaguaacug

SEQ ID NO: 156666 - RNA, 22 nt, Human
cugggguggaggagcuccccug

SEQ ID NO: 156667 - RNA, 22 nt, Human
ugucccucauugacgcugugcc

SEQ ID NO: 156668 - RNA, 22 nt, Human
uccuggaguauuucuguggugu

SEQ ID NO: 156669 - RNA, 19 nt, Human
uccuucagucagaucuggg

SEQ ID NO: 156670 - RNA, 22 nt, Human
gcagagaaaguuuuguccucag

SEQ ID NO: 156671 - RNA, 22 nt, Human
uaauccacaauagagauuaucu

SEQ ID NO: 156672 - RNA, 18 nt, Human
ccauuucaugauuauuac

SEQ ID NO: 156673 - RNA, 22 nt, Human
ggccugagcagacagcaugaug

SEQ ID NO: 156674 - RNA, 22 nt, Human
agcucccagagcucgagaguaa

SEQ ID NO: 156675 - RNA, 22 nt, Human
cauugcuuugugcauauuuaaa

SEQ ID NO: 156676 - RNA, 22 nt, Human
uggggacacagagguucguugg

SEQ ID NO: 156677 - RNA, 22 nt, Human
uacauucuacuuuuucacuccc

SEQ ID NO: 156678 - RNA, 22 nt, Human
ccugagguggcugcagcacugc

SEQ ID NO: 156679 - RNA, 22 nt, Human
acagaguaggugcugucgacug

SEQ ID NO: 156680 - RNA, 22 nt, Human
uguaugcagcaaaacaauuagu

SEQ ID NO: 156681 - RNA, 21 nt, Human
ucugucucuccacugcccugc

SEQ ID NO: 156682 - RNA, 22 nt, Human
ugggcaggaugcguugauucuu

SEQ ID NO: 156683 - RNA, 22 nt, Human
gagguggccucaagcagucuuc

SEQ ID NO: 156684 - RNA, 22 nt, Human
caugagcugcugggagccuguc

SEQ ID NO: 156685 - RNA, 22 nt, Human
agucucaggcagaggaaggcua

SEQ ID NO: 156686 - RNA, 22 nt, Human
acugucugcuggccccugguua

SEQ ID NO: 156687 - RNA, 18 nt, Human
aaaugcuaggcuacauga

SEQ ID NO: 156688 - RNA, 22 nt, Human
agagccuggacuuuucugagcc

SEQ ID NO: 156689 - RNA, 22 nt, Human
uggggcugugagacuacaggau

SEQ ID NO: 156690 - RNA, 22 nt, Human
gaggagguuccggguggagaag

SEQ ID NO: 156691 - RNA, 22 nt, Human
uguaauggaagugggauugcau

SEQ ID NO: 156692 - RNA, 22 nt, Human
cugggccucauccucagaguuu

SEQ ID NO: 156693 - RNA, 22 nt, Human
cagagcuguuacuauucaugaa

SEQ ID NO: 156694 - RNA, 18 nt, Human
aagaggaggagcagguug

SEQ ID NO: 156695 - RNA, 22 nt, Human
acagccauagaugcuuauguaa

SEQ ID NO: 156696 - RNA, 22 nt, Human
uagcugccaaaagggugggcua

SEQ ID NO: 156697 - RNA, 22 nt, Human
uccacuuuagcaaugauugaau

SEQ ID NO: 156698 - RNA, 22 nt, Human
gcuguccagagcaugggagcaa

SEQ ID NO: 156699 - RNA, 22 nt, Human
gcagcuggugcaaaugucacuc

SEQ ID NO: 156700 - RNA, 22 nt, Human
aauauuucuccuucguuauagc

SEQ ID NO: 156701 - RNA, 22 nt, Human
cugcagggcccgccugagcccu

SEQ ID NO: 156702 - RNA, 22 nt, Human
ucucagagugacaaugagaauu

SEQ ID NO: 156703 - RNA, 22 nt, Human
uaugagaaaauaaauaucuguu

SEQ ID NO: 156704 - RNA, 22 nt, Human
uuuagaaauugcagagugggug

SEQ ID NO: 156705 - RNA, 22 nt, Human
ggcagcuccuccuagucugccc

SEQ ID NO: 156706 - RNA, 22 nt, Human
augugcauuaaaugucaauguu

SEQ ID NO: 156707 - RNA, 22 nt, Human
ccagccugaaaugccucauccu

SEQ ID NO: 156708 - RNA, 22 nt, Human
agcagaacugaugagacuugag

SEQ ID NO: 156709 - RNA, 20 nt, Human
gcagagcuguucugugggga

SEQ ID NO: 156710 - RNA, 22 nt, Human
aagcugcccuguguuagaguuc

SEQ ID NO: 156711 - RNA, 22 nt, Human
auaaggcagaaauagggaaagu

SEQ ID NO: 156712 - RNA, 22 nt, Human
ucauggagacuuugagccuguu

SEQ ID NO: 156713 - RNA, 22 nt, Human
uccagggguaccggccaggcag

SEQ ID NO: 156714 - RNA, 22 nt, Human
acacaguauuacaauaggugcu

SEQ ID NO: 156715 - RNA, 22 nt, Human
uccugccucaggcucuggagua

SEQ ID NO: 156716 - RNA, 21 nt, Human
agaaaauggcguuuuagauuu

SEQ ID NO: 156717 - RNA, 22 nt, Human
ggagcuguugcgcaugcgcucg

SEQ ID NO: 156718 - RNA, 22 nt, Human
ucagaagagcuggugcugccug

SEQ ID NO: 156719 - RNA, 22 nt, Human
agcagcugucccuuaacaucag

SEQ ID NO: 156720 - RNA, 22 nt, Human
cagguggagcugacugagggca

SEQ ID NO: 156721 - RNA, 22 nt, Human
aaguucaaucagaugaaaaagc

SEQ ID NO: 156722 - RNA, 22 nt, Human
ugggaguguucuuggcuugcuu

SEQ ID NO: 156723 - RNA, 22 nt, Human
gcucccagacugaccagaggug

SEQ ID NO: 156724 - RNA, 22 nt, Human
gcacagggcugccaggcggcuu

SEQ ID NO: 156725 - RNA, 22 nt, Human
uggauaaacucacuguaaguug

SEQ ID NO: 156726 - RNA, 22 nt, Human
cuggcucacaggugagaugcau

SEQ ID NO: 156727 - RNA, 22 nt, Human
gcccugugccagucacgcugug

SEQ ID NO: 156728 - RNA, 22 nt, Human
gccugagauucccggagccgug

SEQ ID NO: 156729 - RNA, 22 nt, Human
agaggcaggaagagcugauuuu

SEQ ID NO: 156730 - RNA, 22 nt, Human
caggacagguguucuagaucag

SEQ ID NO: 156731 - RNA, 22 nt, Human
cuccagggaugagacagaguag

SEQ ID NO: 156732 - RNA, 22 nt, Human
ggaggccacgguuuagcaccga

SEQ ID NO: 156733 - RNA, 22 nt, Human
gccagagcacaggcugguagua

SEQ ID NO: 156734 - RNA, 22 nt, Human
agucucagaaaauaugcuuuuu

SEQ ID NO: 156735 - RNA, 22 nt, Human
ccagcccuugcugaaggguggc

SEQ ID NO: 156736 - RNA, 22 nt, Human
acagggcagagugaaaugcuau

SEQ ID NO: 156737 - RNA, 22 nt, Human
ugagacaguucugcagcugggu

SEQ ID NO: 156738 - RNA, 22 nt, Human
aaaguuucaauagaggaagugg

SEQ ID NO: 156739 - RNA, 22 nt, Human
ggccauggaccccgagcugacc

SEQ ID NO: 156740 - RNA, 22 nt, Human
cccuggagugugacgaggcauu

SEQ ID NO: 156741 - RNA, 22 nt, Human
gcagugggcaacaagagcugga

SEQ ID NO: 156742 - RNA, 22 nt, Human
acuuugcagagccagaagagaa

SEQ ID NO: 156743 - RNA, 22 nt, Human
gacucagugauuugacaugccu

SEQ ID NO: 156744 - RNA, 22 nt, Human
ugggacagggaaucugaucccc

SEQ ID NO: 156745 - RNA, 22 nt, Human
cagccaggacagggaaacuagu

SEQ ID NO: 156746 - RNA, 22 nt, Human
cacaggcuugucagcaugaggc

SEQ ID NO: 156747 - RNA, 22 nt, Human
cuuguacaggaauccaugguau

SEQ ID NO: 156748 - RNA, 22 nt, Human
cagagcagaagcgguccucaca

SEQ ID NO: 156749 - RNA, 22 nt, Human
aggccugaaggaagaugagcug

SEQ ID NO: 156750 - RNA, 21 nt, Human
gagcucucaggcaagaagcag

SEQ ID NO: 156751 - RNA, 22 nt, Human
ugcugucaguuggcaggaugag

SEQ ID NO: 156752 - RNA, 22 nt, Human
aagggaaaucauauggugcagu

SEQ ID NO: 156753 - RNA, 22 nt, Human
agaagcugccuacaugaccagc

SEQ ID NO: 156754 - RNA, 22 nt, Human
ggagccuguggcugcuugaagc

SEQ ID NO: 156755 - RNA, 22 nt, Human
aggagccaggaaaccugcucug

SEQ ID NO: 156756 - RNA, 22 nt, Human
gugcccugaguggguaggagag

SEQ ID NO: 156757 - RNA, 22 nt, Human
aacagcuuugcuucuggagaca

SEQ ID NO: 156758 - RNA, 22 nt, Human
uaacagaaaggggacagaaaua

SEQ ID NO: 156759 - RNA, 22 nt, Human
cugggcuccuaaccauccaggu

SEQ ID NO: 156760 - RNA, 22 nt, Human
cuggcugggagcgagcugcuca

SEQ ID NO: 156761 - RNA, 22 nt, Human
ugcccacaggaagacaccagcg

SEQ ID NO: 156762 - RNA, 22 nt, Human
aggaccagaggccagagucagc

SEQ ID NO: 156763 - RNA, 22 nt, Human
gcaggccugacuguagggggca

SEQ ID NO: 156764 - RNA, 22 nt, Human
aagaugcuuauugcuccugcag

SEQ ID NO: 156765 - RNA, 22 nt, Human
agagaggcgaguuaccugugcu

SEQ ID NO: 156766 - RNA, 22 nt, Human
ccaaggcuggagugcaguggcg

SEQ ID NO: 156767 - RNA, 22 nt, Human
cagggcucaucugugugaccag

SEQ ID NO: 156768 - RNA, 22 nt, Human
gcagggacgccagggacagcaa

SEQ ID NO: 156769 - RNA, 22 nt, Human
gaggccuggagccgccuaggcg

SEQ ID NO: 156770 - RNA, 22 nt, Human
caaugauucugcaacugugugc

SEQ ID NO: 156771 - RNA, 22 nt, Human
agcaccuucacaggcucucagg

SEQ ID NO: 156772 - RNA, 22 nt, Human
uggcagcauguuauguaaggaa

SEQ ID NO: 156773 - RNA, 22 nt, Human
ugguggcaauguccuggagaag

SEQ ID NO: 156774 - RNA, 19 nt, Human
gagaggccugugcuugaag

SEQ ID NO: 156775 - RNA, 22 nt, Human
ggcuggccucaggguccucgcu

SEQ ID NO: 156776 - RNA, 23 nt, Human
gucagggcuggggucagagugac

SEQ ID NO: 156777 - RNA, 18 nt, Human
ggagagugacagagucgu

SEQ ID NO: 156778 - RNA, 22 nt, Human
acuuccugggcaugcagagucc

SEQ ID NO: 156779 - RNA, 22 nt, Human
cacaggggcaaacuguagggga

SEQ ID NO: 156780 - RNA, 22 nt, Human
gcuggcagaagagcugguucaa

SEQ ID NO: 156781 - RNA, 22 nt, Human
ugagccagccuugcagcugugc

SEQ ID NO: 156782 - RNA, 21 nt, Human
gcugagagguugggaaguuca

SEQ ID NO: 156783 - RNA, 22 nt, Human
cugcugcugagagcucagccug

SEQ ID NO: 156784 - RNA, 23 nt, Human
uggcagcuguguaagagaaagca

SEQ ID NO: 156785 - RNA, 22 nt, Human
cccuguccuggaugggagcacu

SEQ ID NO: 156786 - RNA, 22 nt, Human
gagcagugggaaggaacagggu

SEQ ID NO: 156787 - RNA, 22 nt, Human
acagcagcacuauugacauuuu

SEQ ID NO: 156788 - RNA, 19 nt, Human
gggaaauucacuugcuucc

SEQ ID NO: 156789 - RNA, 22 nt, Human
aggagcuggaguccaggcaagu

SEQ ID NO: 156790 - RNA, 22 nt, Human
cagcagcuuugccaagucagcc

SEQ ID NO: 156791 - RNA, 19 nt, Human
caugagcugcucacuuccc

SEQ ID NO: 156792 - RNA, 22 nt, Human
cccuggcaugcaugucccuggc

SEQ ID NO: 156793 - RNA, 22 nt, Human
gcuggcugggucccugagaggc

SEQ ID NO: 156794 - RNA, 22 nt, Human
agggaucaaaaaauguacaugc

SEQ ID NO: 156795 - RNA, 22 nt, Human
uccagccaagggagguuacuag

SEQ ID NO: 156796 - RNA, 21 nt, Human
ucacuuauaauguauuugcug

SEQ ID NO: 156797 - RNA, 22 nt, Human
uccagcagcccgaaggcccauc

SEQ ID NO: 156798 - RNA, 22 nt, Human
ccugggcucaagugauccuccu

SEQ ID NO: 156799 - RNA, 22 nt, Human
cccagcagaccgcugugauggc

SEQ ID NO: 156800 - RNA, 22 nt, Human
uaaaugcaguuaguacuugcca

SEQ ID NO: 156801 - RNA, 22 nt, Human
aggcccugcccagugccacaag

SEQ ID NO: 156802 - RNA, 22 nt, Human
gcugcuucucugauggagucca

SEQ ID NO: 156803 - RNA, 22 nt, Human
gaaaugugaccuacuuccuugu

SEQ ID NO: 156804 - RNA, 19 nt, Human
ggaagagaggaaaggugga

SEQ ID NO: 156805 - RNA, 22 nt, Human
gcuggccugaccugaggcuggg

SEQ ID NO: 156806 - RNA, 22 nt, Human
gccagggcaggggagcaucugc

SEQ ID NO: 156807 - RNA, 21 nt, Human
ggucagggggugccuccaggu

SEQ ID NO: 156808 - RNA, 22 nt, Human
aggugaaguugaggaggcagaa

SEQ ID NO: 156809 - RNA, 22 nt, Human
ucucuggagcugcagauccagg

SEQ ID NO: 156810 - RNA, 22 nt, Human
agaagccaacagggcaggagag

SEQ ID NO: 156811 - RNA, 22 nt, Human
gaggugaguggaucacgagguc

SEQ ID NO: 156812 - RNA, 22 nt, Human
aguggcagagcugugucuugaa

SEQ ID NO: 156813 - RNA, 22 nt, Human
ggcugcagauagccagccacca

SEQ ID NO: 156814 - RNA, 22 nt, Human
aggcaggcucaggcccaugcuu

SEQ ID NO: 156815 - RNA, 22 nt, Human
ucucucagggggaaggcugaag

SEQ ID NO: 156816 - RNA, 22 nt, Human
cauacuuuugcccugacauucu

SEQ ID NO: 156817 - RNA, 22 nt, Human
ugucuguacaaauuuucugugu

SEQ ID NO: 156818 - RNA, 22 nt, Human
agaggccagguccagaguuugu

SEQ ID NO: 156819 - RNA, 22 nt, Human
agucccagugacuuggccagaa

SEQ ID NO: 156820 - RNA, 22 nt, Human
gagcagcuggacaggccucccu

SEQ ID NO: 156821 - RNA, 22 nt, Human
gagccagcugagcugcacuguc

SEQ ID NO: 156822 - RNA, 22 nt, Human
aaguucuacuguggguaaaaug

SEQ ID NO: 156823 - RNA, 22 nt, Human
ucagggacuaggugcugccuga

SEQ ID NO: 156824 - RNA, 22 nt, Human
gcugccagcucacucuccugag

SEQ ID NO: 156825 - RNA, 16 nt, Human
ccuuucucugccuucc

SEQ ID NO: 156826 - RNA, 22 nt, Human
cugccagcucaaagcgcagcua

SEQ ID NO: 156827 - RNA, 22 nt, Human
gccugcagaacugugaggcaau

SEQ ID NO: 156828 - RNA, 22 nt, Human
uggccugauuuugcuaagagaa

SEQ ID NO: 156829 - RNA, 22 nt, Human
guggccuggaugagcuucgaca

SEQ ID NO: 156830 - RNA, 19 nt, Human
ucaaaugccaaugucacag

SEQ ID NO: 156831 - RNA, 22 nt, Human
uagagcuggccgggacagcugg

SEQ ID NO: 156832 - RNA, 22 nt, Human
auucuguauggaaaagcacuau

SEQ ID NO: 156833 - RNA, 19 nt, Human
cacagggcaggucucaugu

SEQ ID NO: 156834 - RNA, 22 nt, Human
guccugucccccaaggcugugg

SEQ ID NO: 156835 - RNA, 22 nt, Human
agcagggcuucugugccugugc

SEQ ID NO: 156836 - RNA, 22 nt, Human
gcugagagcaguguggccuuaa

SEQ ID NO: 156837 - RNA, 22 nt, Human
agucucagaguaccugagggac

SEQ ID NO: 156838 - RNA, 22 nt, Human
gccagggggucagcaggcacuu

SEQ ID NO: 156839 - RNA, 22 nt, Human
ucgagucauguucucccauuaa

SEQ ID NO: 156840 - RNA, 22 nt, Human
gggagcuguaguccagauaccg

SEQ ID NO: 156841 - RNA, 22 nt, Human
cucccucugucuuguccagaaa

SEQ ID NO: 156842 - RNA, 22 nt, Human
uggccugacugucaggcuguau

SEQ ID NO: 156843 - RNA, 18 nt, Human
cagcugccagcucaugga

SEQ ID NO: 156844 - RNA, 17 nt, Human
ccucacagggaccagac

SEQ ID NO: 156845 - RNA, 22 nt, Human
cugugcuucgcaacuccaaggu

SEQ ID NO: 156846 - RNA, 22 nt, Human
agcagggcagguaaggaucaga

SEQ ID NO: 156847 - RNA, 21 nt, Human
auuauuauuucuguguccagc

SEQ ID NO: 156848 - RNA, 22 nt, Human
augucacagcucccauuccucc

SEQ ID NO: 156849 - RNA, 22 nt, Human
uggcaggagguuuucuccagga

SEQ ID NO: 156850 - RNA, 22 nt, Human
ggggcacacuuuugguagauau

SEQ ID NO: 156851 - RNA, 18 nt, Human
uaaaugcauguuaauaac

SEQ ID NO: 156852 - RNA, 22 nt, Human
ccacccuggacaggccucugag

SEQ ID NO: 156853 - RNA, 22 nt, Human
auaaggcagugacuucaucuau

SEQ ID NO: 156854 - RNA, 22 nt, Human
acucccacuccagaguagaagc

SEQ ID NO: 156855 - RNA, 22 nt, Human
gagaaagauguaggcugggagg

SEQ ID NO: 156856 - RNA, 22 nt, Human
caguccaggccuggaggagcca

SEQ ID NO: 156857 - RNA, 22 nt, Human
agggcacagccuaaagccuaug

SEQ ID NO: 156858 - RNA, 23 nt, Human
uggcuucugccccauucucucca

SEQ ID NO: 156859 - RNA, 22 nt, Human
ccagcugcugugcagggaggcu

SEQ ID NO: 156860 - RNA, 22 nt, Human
cuggcagcugcccgagaugccc

SEQ ID NO: 156861 - RNA, 22 nt, Human
gggagcugagcuggaagagaau

SEQ ID NO: 156862 - RNA, 22 nt, Human
auucucaaacaagugguuugau

SEQ ID NO: 156863 - RNA, 22 nt, Human
cugggagcccgcguccuggugg

SEQ ID NO: 156864 - RNA, 22 nt, Human
ugcaggcuguaaucugaggcua

SEQ ID NO: 156865 - RNA, 22 nt, Human
uggcagaguuauggguauuuau

SEQ ID NO: 156866 - RNA, 22 nt, Human
ugcagcugcuggcccaggugcu

SEQ ID NO: 156867 - RNA, 22 nt, Human
agccuggcacugaggcagggcg

SEQ ID NO: 156868 - RNA, 22 nt, Human
uugcaaaagccgaggcacucca

SEQ ID NO: 156869 - RNA, 22 nt, Human
ucugcuguaaagaauuucugcc

SEQ ID NO: 156870 - RNA, 22 nt, Human
gaggcugccccuuccucagcug

SEQ ID NO: 156871 - RNA, 22 nt, Human
augcaguauaaaucauuucugg

SEQ ID NO: 156872 - RNA, 22 nt, Human
cuggcuggccggagcgaggcgg

SEQ ID NO: 156873 - RNA, 22 nt, Human
agcagccaguucucugugguag

SEQ ID NO: 156874 - RNA, 22 nt, Human
uauguacauaacaugaaaugca

SEQ ID NO: 156875 - RNA, 22 nt, Human
auaacagauacucucugugagg

SEQ ID NO: 156876 - RNA, 22 nt, Human
ggaagagccuggggugucaggc

SEQ ID NO: 156877 - RNA, 19 nt, Human
ugcaggaggacugagcaga

SEQ ID NO: 156878 - RNA, 22 nt, Human
ucagggcacauucugcaguggc

SEQ ID NO: 156879 - RNA, 22 nt, Human
ggugaaggucuacugugugcca

SEQ ID NO: 156880 - RNA, 22 nt, Human
agcagagcccuuccauggccuu

SEQ ID NO: 156881 - RNA, 22 nt, Human
aagacaagcaucaaaucaggca

SEQ ID NO: 156882 - RNA, 22 nt, Human
uugaagcaaggcgaaucuugug

SEQ ID NO: 156883 - RNA, 22 nt, Human
uacauauuugucuuuguacugu

SEQ ID NO: 156884 - RNA, 22 nt, Human
ucccaguguggcaggccaugga

SEQ ID NO: 156885 - RNA, 22 nt, Human
uccagggacacagaguccuucu

SEQ ID NO: 156886 - RNA, 17 nt, Human
cgagggcuugcuggcuc

SEQ ID NO: 156887 - RNA, 19 nt, Human
gcugucugaugcugagguc

SEQ ID NO: 156888 - RNA, 22 nt, Human
gcugucucggggcuuucuccug

SEQ ID NO: 156889 - RNA, 22 nt, Human
cagggugcgccacucagaugua

SEQ ID NO: 156890 - RNA, 22 nt, Human
gugccugggcaugagcuuguug

SEQ ID NO: 156891 - RNA, 18 nt, Human
uggcagagugucuguucu

SEQ ID NO: 156892 - RNA, 22 nt, Human
cuguauuuaguuaaaaugcuaa

SEQ ID NO: 156893 - RNA, 22 nt, Human
gcagagccugacgggauuuuuc

SEQ ID NO: 156894 - RNA, 22 nt, Human
uagcaggguccaaugugaggca

SEQ ID NO: 156895 - RNA, 22 nt, Human
augaugguaaauucaguauccg

SEQ ID NO: 156896 - RNA, 22 nt, Human
uacuuugucauucuaaccuucc

SEQ ID NO: 156897 - RNA, 21 nt, Human
ugcccacagcaaaugcagagg

SEQ ID NO: 156898 - RNA, 22 nt, Human
uguguuuuacaaauucucuuaa

SEQ ID NO: 156899 - RNA, 22 nt, Human
gggcccacuggcugucugaccc

SEQ ID NO: 156900 - RNA, 22 nt, Human
gagcuggcaggaggcuccccga

SEQ ID NO: 156901 - RNA, 22 nt, Human
gagcugaguuaccuccagauca

SEQ ID NO: 156902 - RNA, 22 nt, Human
ccagagcccagggucaugcagg

SEQ ID NO: 156903 - RNA, 22 nt, Human
guguggcugauugacaugguca

SEQ ID NO: 156904 - RNA, 22 nt, Human
agcuuuauuugucauucacggc

SEQ ID NO: 156905 - RNA, 22 nt, Human
aggagaaagacuggacagccaa

SEQ ID NO: 156906 - RNA, 22 nt, Human
cagcaauaagguaagcuucucc

SEQ ID NO: 156907 - RNA, 22 nt, Human
ucucuucugaaaccugucuuua

SEQ ID NO: 156908 - RNA, 22 nt, Human
guuugcauuuauuagucuucug

SEQ ID NO: 156909 - RNA, 22 nt, Human
acugaaggcuuaacucuuucau

SEQ ID NO: 156910 - RNA, 22 nt, Human
auuguaaguagaaauguuaugg

SEQ ID NO: 156911 - RNA, 22 nt, Human
acaggcuucucacagaaaaggg

SEQ ID NO: 156912 - RNA, 22 nt, Human
augcaguggcagcuccuggugu

SEQ ID NO: 156913 - RNA, 22 nt, Human
acuguguccuauuuccuugaca

SEQ ID NO: 156914 - RNA, 22 nt, Human
ucccagaggcaguugguaacuu

SEQ ID NO: 156915 - RNA, 22 nt, Human
ucugccugcuaacuccugcacc

SEQ ID NO: 156916 - RNA, 22 nt, Human
caagagcugugaccucauucac

SEQ ID NO: 156917 - RNA, 18 nt, Human
acugugguuuauguguag

SEQ ID NO: 156918 - RNA, 22 nt, Human
caacagaaggaagcagggucag

SEQ ID NO: 156919 - RNA, 22 nt, Human
gggcuguggagccgcgagggcu

SEQ ID NO: 156920 - RNA, 22 nt, Human
auuuagaaguuggagggcaaga

SEQ ID NO: 156921 - RNA, 22 nt, Human
uacuuuagaaggaaauaaguuc

SEQ ID NO: 156922 - RNA, 22 nt, Human
ugcugccucagcuuccugggcu

SEQ ID NO: 156923 - RNA, 22 nt, Human
cucaggauggaagccuacagga

SEQ ID NO: 156924 - RNA, 21 nt, Human
ggccugagcaccuguccaccu

SEQ ID NO: 156925 - RNA, 22 nt, Human
cuugcaggauuuugcugcugua

SEQ ID NO: 156926 - RNA, 22 nt, Human
agauggggcucaguguggaggc

SEQ ID NO: 156927 - RNA, 22 nt, Human
ugggccugacucaccugccucc

SEQ ID NO: 156928 - RNA, 22 nt, Human
ugagcccagucugucugacaug

SEQ ID NO: 156929 - RNA, 22 nt, Human
ggagccagagucugcaguguaa

SEQ ID NO: 156930 - RNA, 22 nt, Human
cagccagguucaaguccuuaua

SEQ ID NO: 156931 - RNA, 22 nt, Human
cacacauugaauucauucuugu

SEQ ID NO: 156932 - RNA, 22 nt, Human
cagagccugccucuggcugugg

SEQ ID NO: 156933 - RNA, 22 nt, Human
uuuccuuccagguuccuaaggc

SEQ ID NO: 156934 - RNA, 22 nt, Human
ugcccagcacugugccagucac

SEQ ID NO: 156935 - RNA, 22 nt, Human
uggcuuccaaaggaaugggccu

SEQ ID NO: 156936 - RNA, 22 nt, Human
uggcuucaucugcagcacugcc

SEQ ID NO: 156937 - RNA, 22 nt, Human
ucacagggauggaauagaaaua

SEQ ID NO: 156938 - RNA, 22 nt, Human
cagccagccucucaaccaugca

SEQ ID NO: 156939 - RNA, 22 nt, Human
ccaggcugggcggggaaccugg

SEQ ID NO: 156940 - RNA, 22 nt, Human
uccugggaagagaccugagcau

SEQ ID NO: 156941 - RNA, 22 nt, Human
cauuaagauuuuuuucuacugg

SEQ ID NO: 156942 - RNA, 22 nt, Human
uggcuggggccugaauccugca

SEQ ID NO: 156943 - RNA, 22 nt, Human
ccagcuccagguagaugggcag

SEQ ID NO: 156944 - RNA, 22 nt, Human
acugucucucuagcaguucagg

SEQ ID NO: 156945 - RNA, 22 nt, Human
ugggcagaguugugaugaacug

SEQ ID NO: 156946 - RNA, 22 nt, Human
ugaaacagucuccagacuugga

SEQ ID NO: 156947 - RNA, 22 nt, Human
ggggcagagaauaaaaaccuaa

SEQ ID NO: 156948 - RNA, 22 nt, Human
auuucagcccaguaugagcccc

SEQ ID NO: 156949 - RNA, 22 nt, Human
aucaaaguuucccagaaguugu

SEQ ID NO: 156950 - RNA, 22 nt, Human
ggugcuggacacguggcacucc

SEQ ID NO: 156951 - RNA, 22 nt, Human
gccaggcauucuagaaguagug

SEQ ID NO: 156952 - RNA, 22 nt, Human
agcagcuccugccaugagugcu

SEQ ID NO: 156953 - RNA, 22 nt, Human
uaagaagcuucugcuaaugccu

SEQ ID NO: 156954 - RNA, 22 nt, Human
gcugcaggagcuggagcugugg

SEQ ID NO: 156955 - RNA, 22 nt, Human
ugggcuccucgucacucgcugu

SEQ ID NO: 156956 - RNA, 22 nt, Human
ggccaggcuggucucagacuuc

SEQ ID NO: 156957 - RNA, 22 nt, Human
cgggcuggcugcagcugcugga

SEQ ID NO: 156958 - RNA, 22 nt, Human
agccucucuccagcuuggcaga

SEQ ID NO: 156959 - RNA, 22 nt, Human
aagcccagcaucccugcaccag

SEQ ID NO: 156960 - RNA, 22 nt, Human
cugccugcugccuguggagggu

SEQ ID NO: 156961 - RNA, 22 nt, Human
guuagaaagugucugcuugggu

SEQ ID NO: 156962 - RNA, 22 nt, Human
acagagcugggaucugaaccca

SEQ ID NO: 156963 - RNA, 18 nt, Human
accugccuguucuucucu

SEQ ID NO: 156964 - RNA, 22 nt, Human
ugcagagguguugcugagauaa

SEQ ID NO: 156965 - RNA, 20 nt, Human
ggcucugcuugugagcagcc

SEQ ID NO: 156966 - RNA, 22 nt, Human
uuagggcuuuucugaauaggcc

SEQ ID NO: 156967 - RNA, 22 nt, Human
gcacagcaauuucuauaagcuc

SEQ ID NO: 156968 - RNA, 22 nt, Human
cagccaggagcucccccugcuc

SEQ ID NO: 156969 - RNA, 22 nt, Human
auacauuagcucauaugauuaa

SEQ ID NO: 156970 - RNA, 21 nt, Human
uaaagaagaugaaugugauca

SEQ ID NO: 156971 - RNA, 22 nt, Human
ggcaggugcaccugagccaucu

SEQ ID NO: 156972 - RNA, 22 nt, Human
uucaagaugucuucacaauagu

SEQ ID NO: 156973 - RNA, 19 nt, Human
cuggcucuuggguggagga

SEQ ID NO: 156974 - RNA, 22 nt, Human
ucuggcucuccagugcucuuag

SEQ ID NO: 156975 - RNA, 22 nt, Human
cucaaggaaagucuggagaaga

SEQ ID NO: 156976 - RNA, 22 nt, Human
uggggacaggagacuuacagcu

SEQ ID NO: 156977 - RNA, 22 nt, Human
uaugugaauacagcaguggaug

SEQ ID NO: 156978 - RNA, 22 nt, Human
uuggcuucuggcagucuggacg

SEQ ID NO: 156979 - RNA, 22 nt, Human
cugcagaggccucgccuccucu

SEQ ID NO: 156980 - RNA, 22 nt, Human
cagagccauuauggagacuugc

SEQ ID NO: 156981 - RNA, 22 nt, Human
gcucccagcaauugaggcagcc

SEQ ID NO: 156982 - RNA, 22 nt, Human
gggagggaggugaugcuuggcu

SEQ ID NO: 156983 - RNA, 22 nt, Human
uaacagaauagcagaaacagaa

SEQ ID NO: 156984 - RNA, 22 nt, Human
agcaccugcacaguggaggaaa

SEQ ID NO: 156985 - RNA, 21 nt, Human
ucccacucuaaauggacugaa

SEQ ID NO: 156986 - RNA, 22 nt, Human
acuuuuuacaggguguauacca

SEQ ID NO: 156987 - RNA, 22 nt, Human
ucacugggagaugugggaaggg

SEQ ID NO: 156988 - RNA, 22 nt, Human
cccuccagcucaaagcaaccgg

SEQ ID NO: 156989 - RNA, 22 nt, Human
ugcaguggcgccaucucagcuc

SEQ ID NO: 156990 - RNA, 22 nt, Human
acaugcauucucuaaaagcaaa

SEQ ID NO: 156991 - RNA, 22 nt, Human
gagagcuguguucauucuacca

SEQ ID NO: 156992 - RNA, 22 nt, Human
ccuggagcacucucccuggcug

SEQ ID NO: 156993 - RNA, 20 nt, Human
caccacagaauuggggacag

SEQ ID NO: 156994 - RNA, 22 nt, Human
cccugcagccuugcaugccuuc

SEQ ID NO: 156995 - RNA, 22 nt, Human
uggcuggcuuguucacugacug

SEQ ID NO: 156996 - RNA, 22 nt, Human
guggccagcaagugcugccucu

SEQ ID NO: 156997 - RNA, 22 nt, Human
uuuuccucugcaauaaaagcag

SEQ ID NO: 156998 - RNA, 22 nt, Human
aaaggcuccuucucccaugacc

SEQ ID NO: 156999 - RNA, 22 nt, Human
ucacaggaaccaucagagaaau

SEQ ID NO: 157000 - RNA, 22 nt, Human
ccuggcaggccccuccuggauu

SEQ ID NO: 157001 - RNA, 21 nt, Human
gaugaagcaaucuuucuguug

SEQ ID NO: 157002 - RNA, 22 nt, Human
accucugcaacccuggaauggg

SEQ ID NO: 157003 - RNA, 22 nt, Human
agcagggcuugccgcuuguccu

SEQ ID NO: 157004 - RNA, 22 nt, Human
ucaguuuucucaucuguaauuu

SEQ ID NO: 157005 - RNA, 22 nt, Human
ccagagccccugagcuucccug

SEQ ID NO: 157006 - RNA, 22 nt, Human
gcugcagcccggcgcgccugag

SEQ ID NO: 157007 - RNA, 22 nt, Human
gcuggagauaguaggauccaua

SEQ ID NO: 157008 - RNA, 22 nt, Human
cagcauggagacaaagugggca

SEQ ID NO: 157009 - RNA, 22 nt, Human
gcccccucuuuggagccagcca

SEQ ID NO: 157010 - RNA, 18 nt, Human
cccacggugcuguagggc

SEQ ID NO: 157011 - RNA, 21 nt, Human
ggcagcugaccgcgcggugca

SEQ ID NO: 157012 - RNA, 22 nt, Human
cugagagccuccuguuggcuag

SEQ ID NO: 157013 - RNA, 22 nt, Human
aaaacucugcaguuaguuucua

SEQ ID NO: 157014 - RNA, 22 nt, Human
aauguguauaugaacauacagg

SEQ ID NO: 157015 - RNA, 22 nt, Human
ggcaggcugcuugggucauguc

SEQ ID NO: 157016 - RNA, 22 nt, Human
gcagugaaucuggcaagaauuu

SEQ ID NO: 157017 - RNA, 21 nt, Human
ucucuggaguuagcagagaga

SEQ ID NO: 157018 - RNA, 22 nt, Human
agacccugucaguguuaggaaa

SEQ ID NO: 157019 - RNA, 22 nt, Human
cagguggguguaugaaugcaaa

SEQ ID NO: 157020 - RNA, 22 nt, Human
aggcacugacaauucuggacug

SEQ ID NO: 157021 - RNA, 16 nt, Human
uggaaggggucuccgg

SEQ ID NO: 157022 - RNA, 22 nt, Human
aggagccuccuucucaugugca

SEQ ID NO: 157023 - RNA, 22 nt, Human
uuaacagacauauauauuugua

SEQ ID NO: 157024 - RNA, 22 nt, Human
uaagaacaagcuggggguucca

SEQ ID NO: 157025 - RNA, 22 nt, Human
aggggccauuguucugcccgcu

SEQ ID NO: 157026 - RNA, 22 nt, Human
ucagguguuagaagaaauuuca

SEQ ID NO: 157027 - RNA, 22 nt, Human
cagggugccaaagaacaaauau

SEQ ID NO: 157028 - RNA, 22 nt, Human
ucacgagaggcacagaauagag

SEQ ID NO: 157029 - RNA, 22 nt, Human
gcugaguguaaugauggcagag

SEQ ID NO: 157030 - RNA, 22 nt, Human
cuggagcuaggaaguccaagau

SEQ ID NO: 157031 - RNA, 22 nt, Human
cuggcucaugugaugagggcaa

SEQ ID NO: 157032 - RNA, 22 nt, Human
caggugggagcgaggagcuacu

SEQ ID NO: 157033 - RNA, 22 nt, Human
gaagcagcagcuggggacaguu

SEQ ID NO: 157034 - RNA, 22 nt, Human
cuccuugguguaguacugagca

SEQ ID NO: 157035 - RNA, 20 nt, Human
agaauucuuacccuuugaug

SEQ ID NO: 157036 - RNA, 22 nt, Human
gcugucaggccaugugggccuu

SEQ ID NO: 157037 - RNA, 22 nt, Human
ggcugaguugagaggauuacuu

SEQ ID NO: 157038 - RNA, 22 nt, Human
agccugagugcuuaggacuguu

SEQ ID NO: 157039 - RNA, 22 nt, Human
ggggggugcugaucaguggagc

SEQ ID NO: 157040 - RNA, 22 nt, Human
acauguguauagccuguauaga

SEQ ID NO: 157041 - RNA, 22 nt, Human
caggaggcuccuagggcucugu

SEQ ID NO: 157042 - RNA, 22 nt, Human
uuagaaauacaagugagguuga

SEQ ID NO: 157043 - RNA, 22 nt, Human
caggccagguggcaggcaaaac

SEQ ID NO: 157044 - RNA, 22 nt, Human
cucagggccaaggaugcuguug

SEQ ID NO: 157045 - RNA, 22 nt, Human
auacauauaugguacuuccugg

SEQ ID NO: 157046 - RNA, 22 nt, Human
agaggcagcagucauacuacag

SEQ ID NO: 157047 - RNA, 21 nt, Human
agcagaacagucgagcacugc

SEQ ID NO: 157048 - RNA, 22 nt, Human
auugucuuuggugcuuccagga

SEQ ID NO: 157049 - RNA, 22 nt, Human
aaggcacucauucaaggagaua

SEQ ID NO: 157050 - RNA, 22 nt, Human
agggcucugggguggcagagau

SEQ ID NO: 157051 - RNA, 22 nt, Human
uacaguaacauguuguacaagc

SEQ ID NO: 157052 - RNA, 22 nt, Human
aagagguaaccauagcaaccac

SEQ ID NO: 157053 - RNA, 22 nt, Human
ggagccuuccagacugcccaca

SEQ ID NO: 157054 - RNA, 22 nt, Human
cauuuguauguuccuccuuagg

SEQ ID NO: 157055 - RNA, 23 nt, Human
ucaugcccaggcuccagauguca

SEQ ID NO: 157056 - RNA, 22 nt, Human
uguuaucugagcaacgucgacg

SEQ ID NO: 157057 - RNA, 22 nt, Human
agcuucuugaccaagccuguaa

SEQ ID NO: 157058 - RNA, 22 nt, Human
agcaggaguuugaugcuuuuau

SEQ ID NO: 157059 - RNA, 22 nt, Human
cugagcugcucccgcugcagcg

SEQ ID NO: 157060 - RNA, 22 nt, Human
uguacaauagcuauuaucucca

SEQ ID NO: 157061 - RNA, 22 nt, Human
ugcugccaccccucaccagagc

SEQ ID NO: 157062 - RNA, 22 nt, Human
gccuggaguacuccuugaagug

SEQ ID NO: 157063 - RNA, 22 nt, Human
ggcugcugggaauaugccagcu

SEQ ID NO: 157064 - RNA, 22 nt, Human
gagcagugacuggagcaugaga

SEQ ID NO: 157065 - RNA, 22 nt, Human
agauuucagaugcucggcaguu

SEQ ID NO: 157066 - RNA, 22 nt, Human
gugucaugcacacucaguguug

SEQ ID NO: 157067 - RNA, 22 nt, Human
uguauuuuuaggaaugcgcuau

SEQ ID NO: 157068 - RNA, 22 nt, Human
ugcaagcacucaaugcaaacag

SEQ ID NO: 157069 - RNA, 22 nt, Human
gagcugagccuggguggaccgc

SEQ ID NO: 157070 - RNA, 22 nt, Human
ggcuccuggggaggugagcuug

SEQ ID NO: 157071 - RNA, 22 nt, Human
caucagcacuaugauuaaagua

SEQ ID NO: 157072 - RNA, 22 nt, Human
cccagggacagaugggcagcua

SEQ ID NO: 157073 - RNA, 22 nt, Human
cagcagcccacgcgugcugucc

SEQ ID NO: 157074 - RNA, 22 nt, Human
gcagcagcccagggcucucaga

SEQ ID NO: 157075 - RNA, 22 nt, Human
ucaaaccaccuuguuacugggg

SEQ ID NO: 157076 - RNA, 22 nt, Human
cagcugccccuccagggcuggg

SEQ ID NO: 157077 - RNA, 22 nt, Human
cacagcugaaguagccaugugg

SEQ ID NO: 157078 - RNA, 22 nt, Human
ugagcccagagaucugagcuau

SEQ ID NO: 157079 - RNA, 20 nt, Human
ucucccaggcucagggaaga

SEQ ID NO: 157080 - RNA, 22 nt, Human
aucagcaaguccuguuaauucu

SEQ ID NO: 157081 - RNA, 22 nt, Human
agcaguggcugaagauguuccu

SEQ ID NO: 157082 - RNA, 22 nt, Human
gggugacauuucccaaugagcc

SEQ ID NO: 157083 - RNA, 20 nt, Human
uccaagcccuccuuccauuc

SEQ ID NO: 157084 - RNA, 22 nt, Human
guaacagaggguuugcagauau

SEQ ID NO: 157085 - RNA, 22 nt, Human
acccaggguagagugcaguggc

SEQ ID NO: 157086 - RNA, 22 nt, Human
augcuauacucaaagaaauuca

SEQ ID NO: 157087 - RNA, 22 nt, Human
ugcucuguauucuauggcaguu

SEQ ID NO: 157088 - RNA, 22 nt, Human
uagaaagcuugggguguuuaaa

SEQ ID NO: 157089 - RNA, 22 nt, Human
gccaggcauuuguuaggugcug

SEQ ID NO: 157090 - RNA, 22 nt, Human
augggggccugaacaggcaaaa

SEQ ID NO: 157091 - RNA, 22 nt, Human
agccugccuugggcugcuugag

SEQ ID NO: 157092 - RNA, 21 nt, Human
ugcaggcaggcagagaugcug

SEQ ID NO: 157093 - RNA, 23 nt, Human
uguagcaucucuuauuucucagc

SEQ ID NO: 157094 - RNA, 22 nt, Human
ccuggcagcaggugggcccgug

SEQ ID NO: 157095 - RNA, 20 nt, Human
ggcagcaggaguuuccucuu

SEQ ID NO: 157096 - RNA, 22 nt, Human
gagauggggucagcugggacau

SEQ ID NO: 157097 - RNA, 22 nt, Human
ucucucagucagaugcuaaaga

SEQ ID NO: 157098 - RNA, 22 nt, Human
gaaaucugcuucuugcauagua

SEQ ID NO: 157099 - RNA, 22 nt, Human
gggcugccaagccugccugccu

SEQ ID NO: 157100 - RNA, 22 nt, Human
cugcagugaaaucaggaagcaa

SEQ ID NO: 157101 - RNA, 22 nt, Human
uaacacugguauuucauuuagu

SEQ ID NO: 157102 - RNA, 22 nt, Human
agauacaugucaagagacuuau

SEQ ID NO: 157103 - RNA, 22 nt, Human
agggcagaaauauugauacugu

SEQ ID NO: 157104 - RNA, 22 nt, Human
aauguuaaaaccuucagugcuu

SEQ ID NO: 157105 - RNA, 22 nt, Human
ugccugggagugaccaagacuc

SEQ ID NO: 157106 - RNA, 22 nt, Human
ggugaaggcacaagagggcaag

SEQ ID NO: 157107 - RNA, 22 nt, Human
cagaaauguucuaaugauucag

SEQ ID NO: 157108 - RNA, 22 nt, Human
ucaucaaagucaaagaaugacu

SEQ ID NO: 157109 - RNA, 22 nt, Human
ccugccuggagcugagugugga

SEQ ID NO: 157110 - RNA, 22 nt, Human
gccuucagcccugacuggccag

SEQ ID NO: 157111 - RNA, 22 nt, Human
ccuggugcuuaccagagcuuuu

SEQ ID NO: 157112 - RNA, 22 nt, Human
caggcaggagccagggauucca

SEQ ID NO: 157113 - RNA, 22 nt, Human
uuugcauuaucucacuuauaua

SEQ ID NO: 157114 - RNA, 22 nt, Human
uucuucaaaauccagcaugauu

SEQ ID NO: 157115 - RNA, 22 nt, Human
ggcucugcuucagaaggcucau

SEQ ID NO: 157116 - RNA, 22 nt, Human
uucaagaugccagggacgcggc

SEQ ID NO: 157117 - RNA, 22 nt, Human
cgcuggccauagccuccugugu

SEQ ID NO: 157118 - RNA, 22 nt, Human
aggcucuguuauucuagagggc

SEQ ID NO: 157119 - RNA, 22 nt, Human
accaaggagaaggugcaagcuu

SEQ ID NO: 157120 - RNA, 22 nt, Human
ccuuugggugaauuccucucuu

SEQ ID NO: 157121 - RNA, 22 nt, Human
uucacauuggugauauguuucu

SEQ ID NO: 157122 - RNA, 22 nt, Human
ggcucugcaugugagugggugg

SEQ ID NO: 157123 - RNA, 22 nt, Human
gagcugugagggacacauugcu

SEQ ID NO: 157124 - RNA, 22 nt, Human
ggcuggguuauuuauggccaag

SEQ ID NO: 157125 - RNA, 22 nt, Human
ggcuggucacaccacugcaggg

SEQ ID NO: 157126 - RNA, 22 nt, Human
ugcugucuguuuacuggcuaua

SEQ ID NO: 157127 - RNA, 22 nt, Human
gagcucaggagcaucagaagaa

SEQ ID NO: 157128 - RNA, 22 nt, Human
agagaaggucacuaaggaccca

SEQ ID NO: 157129 - RNA, 22 nt, Human
ugucccaguucccaggguugcu

SEQ ID NO: 157130 - RNA, 22 nt, Human
gcucugucaacagcuagcugug

SEQ ID NO: 157131 - RNA, 22 nt, Human
acugaguguaggacuuugaguu

SEQ ID NO: 157132 - RNA, 22 nt, Human
cagcucuguaaauuccuucauc

SEQ ID NO: 157133 - RNA, 22 nt, Human
ggcucagguuuaaagugcuuua

SEQ ID NO: 157134 - RNA, 22 nt, Human
acaaaguuugugguauuccaag

SEQ ID NO: 157135 - RNA, 22 nt, Human
aggcagagcuggguuuugaaau

SEQ ID NO: 157136 - RNA, 22 nt, Human
gcagcuggggaggucgugggga

SEQ ID NO: 157137 - RNA, 22 nt, Human
agcugcagauucuaucuagaag

SEQ ID NO: 157138 - RNA, 22 nt, Human
agugcagccgagaucaggugcu

SEQ ID NO: 157139 - RNA, 22 nt, Human
ggugacugguuuaucuggcagu

SEQ ID NO: 157140 - RNA, 22 nt, Human
gcugaagcccacguggcuugua

SEQ ID NO: 157141 - RNA, 22 nt, Human
cugggagcccugacuagccugg

SEQ ID NO: 157142 - RNA, 22 nt, Human
aggcugggaaaccugaaguugu

SEQ ID NO: 157143 - RNA, 22 nt, Human
ucaguauccacaaaugcucaaa

SEQ ID NO: 157144 - RNA, 22 nt, Human
cuuaagaauauugaaguugugg

SEQ ID NO: 157145 - RNA, 22 nt, Human
gcagagccccucaagccagccu

SEQ ID NO: 157146 - RNA, 22 nt, Human
ucugccuuccccauaaucugau

SEQ ID NO: 157147 - RNA, 22 nt, Human
acccagcuggaugcauggaggc

SEQ ID NO: 157148 - RNA, 22 nt, Human
auguccuucuccucuuaccugc

SEQ ID NO: 157149 - RNA, 22 nt, Human
cagagccaggucuaggagucuc

SEQ ID NO: 157150 - RNA, 22 nt, Human
gcucaggaaggcucaaccagga

SEQ ID NO: 157151 - RNA, 22 nt, Human
auguagcagauauuugugcaca

SEQ ID NO: 157152 - RNA, 22 nt, Human
ugggcugccggcaggcucugcc

SEQ ID NO: 157153 - RNA, 21 nt, Human
ccaggguccagcugccauggu

SEQ ID NO: 157154 - RNA, 22 nt, Human
cacugcuuucacaguuuguucc

SEQ ID NO: 157155 - RNA, 22 nt, Human
acacaugagaaacaucaguugu

SEQ ID NO: 157156 - RNA, 22 nt, Human
ugcaggggcuugucugggccug

SEQ ID NO: 157157 - RNA, 18 nt, Human
gcuggcugcacuucugcu

SEQ ID NO: 157158 - RNA, 22 nt, Human
agugaaaucagguuuugacugc

SEQ ID NO: 157159 - RNA, 22 nt, Human
uugaacauuaacuucagucuau

SEQ ID NO: 157160 - RNA, 23 nt, Human
acaguuauagcugugaauaacau

SEQ ID NO: 157161 - RNA, 22 nt, Human
agccucuggcccuagacugcuu

SEQ ID NO: 157162 - RNA, 22 nt, Human
gucucccaucguuugugaggaa

SEQ ID NO: 157163 - RNA, 22 nt, Human
cugaggccucuguucaccagaa

SEQ ID NO: 157164 - RNA, 22 nt, Human
aggcugggcaccguuuugaucc

SEQ ID NO: 157165 - RNA, 20 nt, Human
gucagaggacccuagagcga

SEQ ID NO: 157166 - RNA, 22 nt, Human
ccagcagaagcucccgcugggu

SEQ ID NO: 157167 - RNA, 22 nt, Human
agcacaggaccaaggaagcugu

SEQ ID NO: 157168 - RNA, 22 nt, Human
uacaguagacaauguuaguaug

SEQ ID NO: 157169 - RNA, 22 nt, Human
uagccucucuccuccacaaccu

SEQ ID NO: 157170 - RNA, 22 nt, Human
ccuggcagacugugagggcagg

SEQ ID NO: 157171 - RNA, 22 nt, Human
cucccaggguagggagagacua

SEQ ID NO: 157172 - RNA, 22 nt, Human
aggcaggggagcuggaagggua

SEQ ID NO: 157173 - RNA, 22 nt, Human
uuccauaauaggcuuaagugaa

SEQ ID NO: 157174 - RNA, 22 nt, Human
ucucugguggcuccaucaguag

SEQ ID NO: 157175 - RNA, 22 nt, Human
uuucuaaaugguggcugcauug

SEQ ID NO: 157176 - RNA, 22 nt, Human
ugaugcugcugggaguggugcu

SEQ ID NO: 157177 - RNA, 22 nt, Human
uucuuuccccauggaguucgga

SEQ ID NO: 157178 - RNA, 22 nt, Human
ggcgcuggccacgguggcucug

SEQ ID NO: 157179 - RNA, 19 nt, Human
uggaggagaggaaaaguca

SEQ ID NO: 157180 - RNA, 22 nt, Human
agagauguucauucagcauguu

SEQ ID NO: 157181 - RNA, 22 nt, Human
ccagcugacgaugccuggucuc

SEQ ID NO: 157182 - RNA, 22 nt, Human
gaagccccaaacccucgccauc

SEQ ID NO: 157183 - RNA, 22 nt, Human
ccaaggcuccucagcuggucuu

SEQ ID NO: 157184 - RNA, 22 nt, Human
caguacuuugcaucauuccacu

SEQ ID NO: 157185 - RNA, 23 nt, Human
gcucagagguuuuucucuggaug

SEQ ID NO: 157186 - RNA, 22 nt, Human
aaguucaagucuccugaguaua

SEQ ID NO: 157187 - RNA, 20 nt, Human
cccuggagagaagcuccacg

SEQ ID NO: 157188 - RNA, 22 nt, Human
acguuuucagccuuaauguaga

SEQ ID NO: 157189 - RNA, 22 nt, Human
ugucccuggaacuauggcucca

SEQ ID NO: 157190 - RNA, 22 nt, Human
uaacagaagaaaacauauugga

SEQ ID NO: 157191 - RNA, 22 nt, Human
cugcccugccuggccagugugg

SEQ ID NO: 157192 - RNA, 22 nt, Human
aaucaguuaggguguuaaugag

SEQ ID NO: 157193 - RNA, 22 nt, Human
ugucucaggcccaagccaguaa

SEQ ID NO: 157194 - RNA, 22 nt, Human
uccaucagauucccuccugaga

SEQ ID NO: 157195 - RNA, 22 nt, Human
agagcuguucaacguagcaaug

SEQ ID NO: 157196 - RNA, 20 nt, Human
ccugccugccucggcucauu

SEQ ID NO: 157197 - RNA, 22 nt, Human
cugccuggccugaucuccacgc

SEQ ID NO: 157198 - RNA, 22 nt, Human
uggcucagauuuuuguaggcuu

SEQ ID NO: 157199 - RNA, 22 nt, Human
caccagcuuugcccacugccca

SEQ ID NO: 157200 - RNA, 22 nt, Human
uauugaaauccauuacguucuu

SEQ ID NO: 157201 - RNA, 22 nt, Human
ucagagcuuaucucuugcugga

SEQ ID NO: 157202 - RNA, 22 nt, Human
ccagaagggcuauugcagugac

SEQ ID NO: 157203 - RNA, 22 nt, Human
cugggccuagaggaagcugaca

SEQ ID NO: 157204 - RNA, 22 nt, Human
gcacccagccagcaucucagag

SEQ ID NO: 157205 - RNA, 22 nt, Human
uugucugucccagcuugugcau

SEQ ID NO: 157206 - RNA, 22 nt, Human
ucugagcuacgaugccugucac

SEQ ID NO: 157207 - RNA, 19 nt, Human
auuuacugccuaaaaucuc

SEQ ID NO: 157208 - RNA, 22 nt, Human
cagggcagccaggccccguggg

SEQ ID NO: 157209 - RNA, 22 nt, Human
aggucaaggccaaaagaguggu

SEQ ID NO: 157210 - RNA, 22 nt, Human
uaacagaaauuuuaguuagggg

SEQ ID NO: 157211 - RNA, 17 nt, Human
uagcugccccgaaugcu

SEQ ID NO: 157212 - RNA, 22 nt, Human
cucuggacagcaggugcugugg

SEQ ID NO: 157213 - RNA, 22 nt, Human
aggcuuccuggaggaagaggua

SEQ ID NO: 157214 - RNA, 22 nt, Human
gagccagcgccuugccucuggg

SEQ ID NO: 157215 - RNA, 19 nt, Human
ccuggaggugaagguucuc

SEQ ID NO: 157216 - RNA, 22 nt, Human
acagggucaagggugcuacaag

SEQ ID NO: 157217 - RNA, 22 nt, Human
aggagucauaaaugugaacaaa

SEQ ID NO: 157218 - RNA, 22 nt, Human
cuucuugcugggggccucagug

SEQ ID NO: 157219 - RNA, 22 nt, Human
agcccuagagcuggaggucagu

SEQ ID NO: 157220 - RNA, 17 nt, Human
uccuggcucugccacug

SEQ ID NO: 157221 - RNA, 22 nt, Human
ucugggagguaaccaugcugau

SEQ ID NO: 157222 - RNA, 22 nt, Human
agaaauguuacaguuguuauuu

SEQ ID NO: 157223 - RNA, 22 nt, Human
gagccugagugcugccuccccu

SEQ ID NO: 157224 - RNA, 22 nt, Human
ggugcagugguguggcaaaggg

SEQ ID NO: 157225 - RNA, 22 nt, Human
acaaaugcuuaguucaccaaaa

SEQ ID NO: 157226 - RNA, 22 nt, Human
cagguggaucucuaaggacuga

SEQ ID NO: 157227 - RNA, 22 nt, Human
ugucccagucaaggcugucauc

SEQ ID NO: 157228 - RNA, 22 nt, Human
cagcugccuucugcgggaaguc

SEQ ID NO: 157229 - RNA, 22 nt, Human
uuuuggucagguuggucucgaa

SEQ ID NO: 157230 - RNA, 22 nt, Human
gcagcugcuguggcaucaagcu

SEQ ID NO: 157231 - RNA, 22 nt, Human
acagguggaggcuuuaggaggu

SEQ ID NO: 157232 - RNA, 22 nt, Human
agggaagagcuugcaagaaacc

SEQ ID NO: 157233 - RNA, 17 nt, Human
gccuggcccagccuggc

SEQ ID NO: 157234 - RNA, 22 nt, Human
cugccuggggaaugugaggauu

SEQ ID NO: 157235 - RNA, 22 nt, Human
ggccugcugacccaaguccugu

SEQ ID NO: 157236 - RNA, 22 nt, Human
cuggggcugcgguggaggagcc

SEQ ID NO: 157237 - RNA, 22 nt, Human
caagagcucaccggagagcauu

SEQ ID NO: 157238 - RNA, 22 nt, Human
ccagcccugccucucagggccc

SEQ ID NO: 157239 - RNA, 19 nt, Human
cucugccucccuccugggu

SEQ ID NO: 157240 - RNA, 21 nt, Human
aggccucuucauggccaugau

SEQ ID NO: 157241 - RNA, 22 nt, Human
acauuucugcaucucagagcua

SEQ ID NO: 157242 - RNA, 22 nt, Human
ucucaggccccugaguuucucu

SEQ ID NO: 157243 - RNA, 22 nt, Human
ggucccaguugcccaggucagg

SEQ ID NO: 157244 - RNA, 22 nt, Human
acccagagccagggucaggagc

SEQ ID NO: 157245 - RNA, 22 nt, Human
uuaacagagaacauagaaguag

SEQ ID NO: 157246 - RNA, 22 nt, Human
caugaagcauguuuugucauga

SEQ ID NO: 157247 - RNA, 22 nt, Human
ugcacacaguucucaggaaaga

SEQ ID NO: 157248 - RNA, 22 nt, Human
uauagaaguaagcauugugaug

SEQ ID NO: 157249 - RNA, 22 nt, Human
agaaaucagaacccugaaguuc

SEQ ID NO: 157250 - RNA, 22 nt, Human
ggcaugggagugagcaaccuua

SEQ ID NO: 157251 - RNA, 22 nt, Human
gugucccacucuggaggugaag

SEQ ID NO: 157252 - RNA, 22 nt, Human
ccaaagucuggagcagcagagc

SEQ ID NO: 157253 - RNA, 22 nt, Human
cugcucugaguauuaacggagg

SEQ ID NO: 157254 - RNA, 22 nt, Human
ugggccugaaggagcugcgccc

SEQ ID NO: 157255 - RNA, 22 nt, Human
cagcagaggaaagcaaaucuaa

SEQ ID NO: 157256 - RNA, 22 nt, Human
gagcucagauucuggugucaga

SEQ ID NO: 157257 - RNA, 22 nt, Human
gaugugggguugagggaccagc

SEQ ID NO: 157258 - RNA, 22 nt, Human
ugugccaggcacuugcccaggc

SEQ ID NO: 157259 - RNA, 22 nt, Human
cacacuagucuauccauuagcu

SEQ ID NO: 157260 - RNA, 21 nt, Human
ggagucauuagucauuuccuu

SEQ ID NO: 157261 - RNA, 22 nt, Human
gccaggcucagcagucaaccug

SEQ ID NO: 157262 - RNA, 22 nt, Human
gggccuggggacaccaccauga

SEQ ID NO: 157263 - RNA, 22 nt, Human
aaagcaguauauugguaguugu

SEQ ID NO: 157264 - RNA, 22 nt, Human
ugcuggggcucugaccacucca

SEQ ID NO: 157265 - RNA, 22 nt, Human
acugaaggaaagccuuugcaug

SEQ ID NO: 157266 - RNA, 22 nt, Human
ugugacaugugucaucuuuucu

SEQ ID NO: 157267 - RNA, 22 nt, Human
aaaagagguuaaccaggugugu

SEQ ID NO: 157268 - RNA, 22 nt, Human
cccagcucaagcagagagcuaa

SEQ ID NO: 157269 - RNA, 22 nt, Human
acaugcauacaagcacauguag

SEQ ID NO: 157270 - RNA, 22 nt, Human
accagagcuggcucugagcacc

SEQ ID NO: 157271 - RNA, 23 nt, Human
gccucuggagccccagugcucag

SEQ ID NO: 157272 - RNA, 22 nt, Human
aggguggggugcuacaucuuua

SEQ ID NO: 157273 - RNA, 21 nt, Human
uucuuuccccagaggacuaaa

SEQ ID NO: 157274 - RNA, 22 nt, Human
ugggcuggcugaacuucaaccu

SEQ ID NO: 157275 - RNA, 22 nt, Human
uccucuggauauaagccucacc

SEQ ID NO: 157276 - RNA, 22 nt, Human
cccaagaucuuucgugcacuaa

SEQ ID NO: 157277 - RNA, 22 nt, Human
cagucccaucucccagguggcu

SEQ ID NO: 157278 - RNA, 22 nt, Human
gcagggugugucucauacaguu

SEQ ID NO: 157279 - RNA, 22 nt, Human
ugaggcagaaauuccuguuuuc

SEQ ID NO: 157280 - RNA, 22 nt, Human
agccucugucaagcuuuucaaa

SEQ ID NO: 157281 - RNA, 22 nt, Human
agucccagugagaugagccacg

SEQ ID NO: 157282 - RNA, 22 nt, Human
aagacauuuauuugaaucaauu

SEQ ID NO: 157283 - RNA, 22 nt, Human
caggugaccuuuguccuaaguu

SEQ ID NO: 157284 - RNA, 22 nt, Human
aagggcugaaagaccuugggca

SEQ ID NO: 157285 - RNA, 22 nt, Human
caggucccgccccgggcugacc

SEQ ID NO: 157286 - RNA, 22 nt, Human
cggcuggggcuguccccaugac

SEQ ID NO: 157287 - RNA, 22 nt, Human
caggaggaggugagguagaacu

SEQ ID NO: 157288 - RNA, 22 nt, Human
cagaguccuggacacagagaca

SEQ ID NO: 157289 - RNA, 22 nt, Human
augacagaggagugcaggugau

SEQ ID NO: 157290 - RNA, 22 nt, Human
agccugguguggggcugcagag

SEQ ID NO: 157291 - RNA, 22 nt, Human
ucccagccugacagugcaucaa

SEQ ID NO: 157292 - RNA, 22 nt, Human
ccaggcugcucacaagcugccc

SEQ ID NO: 157293 - RNA, 22 nt, Human
agcauuuauuucuuagaaauug

SEQ ID NO: 157294 - RNA, 22 nt, Human
ugggauaguggccaggaccccc

SEQ ID NO: 157295 - RNA, 22 nt, Human
acauuuaaugauccuacuguga

SEQ ID NO: 157296 - RNA, 22 nt, Human
gcugcugguccucagagcucau

SEQ ID NO: 157297 - RNA, 21 nt, Human
gccacguuucagucuucucag

SEQ ID NO: 157298 - RNA, 22 nt, Human
uucuuaaagaggcaaaacacag

SEQ ID NO: 157299 - RNA, 22 nt, Human
cagguaggauggaagggcucaa

SEQ ID NO: 157300 - RNA, 22 nt, Human
ugaaggaaugagggaguggguc

SEQ ID NO: 157301 - RNA, 22 nt, Human
gccuucugcgcucgugucuccg

SEQ ID NO: 157302 - RNA, 22 nt, Human
auguguaggugaaucgaggcug

SEQ ID NO: 157303 - RNA, 22 nt, Human
cucucugggcccaguuggcacc

SEQ ID NO: 157304 - RNA, 22 nt, Human
cucagagucccuucccucgugg

SEQ ID NO: 157305 - RNA, 22 nt, Human
aggacucaucccugcuugucag

SEQ ID NO: 157306 - RNA, 22 nt, Human
uggcaccugaacuuagaggugu

SEQ ID NO: 157307 - RNA, 22 nt, Human
caggagacaaguuagcagcuga

SEQ ID NO: 157308 - RNA, 22 nt, Human
uuccauaacugaccgaaugcau

SEQ ID NO: 157309 - RNA, 22 nt, Human
guuugcauaaaguggaugcagg

SEQ ID NO: 157310 - RNA, 22 nt, Human
agagugauucuaguuagggaau

SEQ ID NO: 157311 - RNA, 22 nt, Human
uacaguuuguuacauuguuagu

SEQ ID NO: 157312 - RNA, 22 nt, Human
uaaggcacccauguucauacag

SEQ ID NO: 157313 - RNA, 22 nt, Human
gcugaaggaggcucugguacua

SEQ ID NO: 157314 - RNA, 20 nt, Human
ugaugguucuuuccggguug

SEQ ID NO: 157315 - RNA, 22 nt, Human
agcagcaggcuguguggacuga

SEQ ID NO: 157316 - RNA, 20 nt, Human
cagaccugcacccacuucga

SEQ ID NO: 157317 - RNA, 22 nt, Human
gcccacacaccagcucaggagg

SEQ ID NO: 157318 - RNA, 22 nt, Human
aaguuacuggcaagggcugcag

SEQ ID NO: 157319 - RNA, 22 nt, Human
ucuuugcagaauuuaacuuugc

SEQ ID NO: 157320 - RNA, 22 nt, Human
ucucccacagucucccauggcu

SEQ ID NO: 157321 - RNA, 22 nt, Human
ggcuggcuuucucuccgcaccu

SEQ ID NO: 157322 - RNA, 20 nt, Human
ggccuuggguuucgccuguu

SEQ ID NO: 157323 - RNA, 22 nt, Human
gugaggugguacaauauuaacu

SEQ ID NO: 157324 - RNA, 22 nt, Human
ugaagcagagaauuugacaguc

SEQ ID NO: 157325 - RNA, 22 nt, Human
ucaucacucauuggacaacaga

SEQ ID NO: 157326 - RNA, 18 nt, Human
gcugucugaggucugagg

SEQ ID NO: 157327 - RNA, 22 nt, Human
gugugccaggaacuggcugcug

SEQ ID NO: 157328 - RNA, 22 nt, Human
uggcucugagacacaggcucuc

SEQ ID NO: 157329 - RNA, 22 nt, Human
aauaauuuuagcucagaguugu

SEQ ID NO: 157330 - RNA, 22 nt, Human
auucacagggacaaugggagag

SEQ ID NO: 157331 - RNA, 22 nt, Human
gagguucacaggcuaucacagu

SEQ ID NO: 157332 - RNA, 22 nt, Human
guguguccucaguaguggcaug

SEQ ID NO: 157333 - RNA, 22 nt, Human
ucauaauacaaagaguucugca

SEQ ID NO: 157334 - RNA, 22 nt, Human
cagagcugacccaaggauugaa

SEQ ID NO: 157335 - RNA, 22 nt, Human
ccucugccugcacaucauccug

SEQ ID NO: 157336 - RNA, 22 nt, Human
cugagguggaacagaggugaag

SEQ ID NO: 157337 - RNA, 22 nt, Human
uaaccauauuuuccauuaaguu

SEQ ID NO: 157338 - RNA, 22 nt, Human
guccuggcccacuggcaggcug

SEQ ID NO: 157339 - RNA, 18 nt, Human
uccugccugugccccagg

SEQ ID NO: 157340 - RNA, 22 nt, Human
ucagggcaaagggcagaguuug

SEQ ID NO: 157341 - RNA, 22 nt, Human
cagcaucuuucucuucuggagu

SEQ ID NO: 157342 - RNA, 22 nt, Human
cacugugucaguuugguuagac

SEQ ID NO: 157343 - RNA, 22 nt, Human
gcugguuagaaaacagagcuca

SEQ ID NO: 157344 - RNA, 22 nt, Human
uggccuggcucacagugagauu

SEQ ID NO: 157345 - RNA, 21 nt, Human
cugaggcagcacagcuaguca

SEQ ID NO: 157346 - RNA, 22 nt, Human
aaauguguauaugaaacaugau

SEQ ID NO: 157347 - RNA, 18 nt, Human
uggagcagguaggcauga

SEQ ID NO: 157348 - RNA, 21 nt, Human
gccagccuguuuaccuguggu

SEQ ID NO: 157349 - RNA, 22 nt, Human
cccagcaggucggugcugccug

SEQ ID NO: 157350 - RNA, 22 nt, Human
cccccuggcaggcuggccucuc

SEQ ID NO: 157351 - RNA, 22 nt, Human
auuagcugaccucuaaggagcc

SEQ ID NO: 157352 - RNA, 22 nt, Human
aaggagugcaugacucagagua

SEQ ID NO: 157353 - RNA, 22 nt, Human
agagccugcuguguaagucaca

SEQ ID NO: 157354 - RNA, 22 nt, Human
ccaguccagugccaugcauggc

SEQ ID NO: 157355 - RNA, 22 nt, Human
cauauaaauacaacauguguua

SEQ ID NO: 157356 - RNA, 22 nt, Human
cuggccuucagacucggacuga

SEQ ID NO: 157357 - RNA, 22 nt, Human
acgcagaagggccuggcgugcc

SEQ ID NO: 157358 - RNA, 22 nt, Human
gcaggcugugaggcucagaugg

SEQ ID NO: 157359 - RNA, 22 nt, Human
accuuucauuaaagucuguagu

SEQ ID NO: 157360 - RNA, 22 nt, Human
uaaauguggagacucaggaguc

SEQ ID NO: 157361 - RNA, 22 nt, Human
uucaguuucagucuugcaaaaa

SEQ ID NO: 157362 - RNA, 22 nt, Human
ucacauuuuccuugguaucugu

SEQ ID NO: 157363 - RNA, 22 nt, Human
ucugucacuuauuaagauggau

SEQ ID NO: 157364 - RNA, 22 nt, Human
agaccagcugccucccagggcc

SEQ ID NO: 157365 - RNA, 21 nt, Human
acagcaagccuuccuuucagg

SEQ ID NO: 157366 - RNA, 22 nt, Human
ugccucagucuaaagucucuca

SEQ ID NO: 157367 - RNA, 22 nt, Human
uaauuuauuucaacugccaagg

SEQ ID NO: 157368 - RNA, 22 nt, Human
gagagcacaugaacauggagga

SEQ ID NO: 157369 - RNA, 22 nt, Human
auacauguucguguacauguuc

SEQ ID NO: 157370 - RNA, 22 nt, Human
agauuuccaucuuuuucaugug

SEQ ID NO: 157371 - RNA, 22 nt, Human
gccccuggcuggccagcuccuc

SEQ ID NO: 157372 - RNA, 22 nt, Human
acagauauaugauuguguaaau

SEQ ID NO: 157373 - RNA, 22 nt, Human
ucccacucccaggcaggccucu

SEQ ID NO: 157374 - RNA, 22 nt, Human
aagggacuuugucagcuuucca

SEQ ID NO: 157375 - RNA, 22 nt, Human
aggacccagaggcagaggacgu

SEQ ID NO: 157376 - RNA, 22 nt, Human
agcugccaccucugccuuuggg

SEQ ID NO: 157377 - RNA, 22 nt, Human
aucaguuucacuugcuugcaaa

SEQ ID NO: 157378 - RNA, 22 nt, Human
agggcuggcaagggauugaaau

SEQ ID NO: 157379 - RNA, 22 nt, Human
ucagaagcaggagugugcacaa

SEQ ID NO: 157380 - RNA, 22 nt, Human
ggcugggcucgcugauuggcug

SEQ ID NO: 157381 - RNA, 22 nt, Human
gcagcacauauaaacaaagaga

SEQ ID NO: 157382 - RNA, 22 nt, Human
ugccucugaggaagauuguguu

SEQ ID NO: 157383 - RNA, 22 nt, Human
uguauuuucuucuggaagcuua

SEQ ID NO: 157384 - RNA, 22 nt, Human
aaguaugacauuuaagacaauu

SEQ ID NO: 157385 - RNA, 22 nt, Human
uucaaaggcaggauagcagcug

SEQ ID NO: 157386 - RNA, 22 nt, Human
guccucagggaauguggcgggu

SEQ ID NO: 157387 - RNA, 22 nt, Human
uauguuuuucaagugcacacua

SEQ ID NO: 157388 - RNA, 22 nt, Human
aagugacacauggcacuucuau

SEQ ID NO: 157389 - RNA, 22 nt, Human
auaucacaaacaagucuguacu

SEQ ID NO: 157390 - RNA, 22 nt, Human
aagccucuggggccucaucugu

SEQ ID NO: 157391 - RNA, 22 nt, Human
gcaggguaggugacagguaguc

SEQ ID NO: 157392 - RNA, 22 nt, Human
cagagccacugucugccaggca

SEQ ID NO: 157393 - RNA, 22 nt, Human
auuuauuaugggauuuggcaca

SEQ ID NO: 157394 - RNA, 22 nt, Human
cugucuguuuuaccuucuccag

SEQ ID NO: 157395 - RNA, 22 nt, Human
ggcucagguuaccagucccucc

SEQ ID NO: 157396 - RNA, 22 nt, Human
auuuuuccaauuaggauaaaga

SEQ ID NO: 157397 - RNA, 21 nt, Human
ucuguacaucauugagucccc

SEQ ID NO: 157398 - RNA, 22 nt, Human
uugcucugacuggagugcagug

SEQ ID NO: 157399 - RNA, 19 nt, Human
ugucuuaauuaacucagag

SEQ ID NO: 157400 - RNA, 22 nt, Human
uagcagggccaggcugggaacc

SEQ ID NO: 157401 - RNA, 22 nt, Human
ggagggagcauccccuugcuga

SEQ ID NO: 157402 - RNA, 23 nt, Human
aaguucaagucacagccugucuu

SEQ ID NO: 157403 - RNA, 22 nt, Human
uugaaaggccuguuuauccagc

SEQ ID NO: 157404 - RNA, 22 nt, Human
ccaggagcaacuugaaggcaag

SEQ ID NO: 157405 - RNA, 22 nt, Human
gccuggagacaaggacaaaggg

SEQ ID NO: 157406 - RNA, 22 nt, Human
agcucucaagauaagaaagaac

SEQ ID NO: 157407 - RNA, 22 nt, Human
cagccaucccagccugugguuc

SEQ ID NO: 157408 - RNA, 22 nt, Human
agcaauauuuaaagguuugcaa

SEQ ID NO: 157409 - RNA, 22 nt, Human
ucagagugaggcgucaacauga

SEQ ID NO: 157410 - RNA, 22 nt, Human
ccagggcacguugggacaguac

SEQ ID NO: 157411 - RNA, 22 nt, Human
caggcugcagaggccuuucaug

SEQ ID NO: 157412 - RNA, 22 nt, Human
cauuucuguucucuuccuguac

SEQ ID NO: 157413 - RNA, 20 nt, Human
cugggcagguguuugaucuc

SEQ ID NO: 157414 - RNA, 18 nt, Human
uccagcgugcuccagggc

SEQ ID NO: 157415 - RNA, 22 nt, Human
ucaggggagguugaaucgucuc

SEQ ID NO: 157416 - RNA, 18 nt, Human
gcuccuggaccaggucac

SEQ ID NO: 157417 - RNA, 22 nt, Human
ccagggcaaaugagaucauagc

SEQ ID NO: 157418 - RNA, 22 nt, Human
cagugcaugaaacaauaugcag

SEQ ID NO: 157419 - RNA, 22 nt, Human
cuucaagagaaugcagggaugu

SEQ ID NO: 157420 - RNA, 22 nt, Human
ucucauguauugcccuggugug

SEQ ID NO: 157421 - RNA, 22 nt, Human
auaauuuaaauuaguaugugau

SEQ ID NO: 157422 - RNA, 22 nt, Human
ugucuucaguaaaauacacuau

SEQ ID NO: 157423 - RNA, 22 nt, Human
agugaaaugauucugagcaaga

SEQ ID NO: 157424 - RNA, 21 nt, Human
agcugccacccuagcuucuga

SEQ ID NO: 157425 - RNA, 22 nt, Human
gccugggagugcacagugaggu

SEQ ID NO: 157426 - RNA, 22 nt, Human
agccuucaaccuagcuagagca

SEQ ID NO: 157427 - RNA, 22 nt, Human
acagagguaggacaugagauau

SEQ ID NO: 157428 - RNA, 22 nt, Human
ggggcccagcaccccuccucgc

SEQ ID NO: 157429 - RNA, 22 nt, Human
gcagcguggggcugagucagcu

SEQ ID NO: 157430 - RNA, 22 nt, Human
uccagggagauacuggcugcca

SEQ ID NO: 157431 - RNA, 22 nt, Human
ccuggcagcgccgaagcuggcc

SEQ ID NO: 157432 - RNA, 22 nt, Human
ccuggcagcuguuuggcuuggc

SEQ ID NO: 157433 - RNA, 22 nt, Human
aagagcugcccaaggugaacag

SEQ ID NO: 157434 - RNA, 22 nt, Human
ccucaggggugcccacagcugc

SEQ ID NO: 157435 - RNA, 22 nt, Human
ucaaggaggugcuuggcuucac

SEQ ID NO: 157436 - RNA, 22 nt, Human
cagcuggaucccugcagaacuu

SEQ ID NO: 157437 - RNA, 22 nt, Human
guggcucuaggugagcauggag

SEQ ID NO: 157438 - RNA, 22 nt, Human
ugccuuccuggagcugaaggcu

SEQ ID NO: 157439 - RNA, 21 nt, Human
ccuauugaauauaggaagauu

SEQ ID NO: 157440 - RNA, 23 nt, Human
uccuuccuuugagaggcuccauc

SEQ ID NO: 157441 - RNA, 22 nt, Human
acauugaugaaaagguaucauu

SEQ ID NO: 157442 - RNA, 22 nt, Human
accugagggcccaaacuuggua

SEQ ID NO: 157443 - RNA, 22 nt, Human
ccucccaccguaucucaguggc

SEQ ID NO: 157444 - RNA, 22 nt, Human
aagauacugaugauguaggcua

SEQ ID NO: 157445 - RNA, 22 nt, Human
acaggcugcccgcuccccaccu

SEQ ID NO: 157446 - RNA, 22 nt, Human
gcuccaggagagggaagcagau

SEQ ID NO: 157447 - RNA, 22 nt, Human
uuagucaauagugaauauagag

SEQ ID NO: 157448 - RNA, 22 nt, Human
cagagccuuccuagcagacucu

SEQ ID NO: 157449 - RNA, 22 nt, Human
caaggcaggcaguucacuugag

SEQ ID NO: 157450 - RNA, 22 nt, Human
gggcuggcgggaaaggcaauuc

SEQ ID NO: 157451 - RNA, 22 nt, Human
gggcagugguuacacagcugag

SEQ ID NO: 157452 - RNA, 22 nt, Human
ucagagugaggcccagcaaucu

SEQ ID NO: 157453 - RNA, 22 nt, Human
ugcaugcauaaauguacacaca

SEQ ID NO: 157454 - RNA, 22 nt, Human
agaugguguuuccccaggugga

SEQ ID NO: 157455 - RNA, 22 nt, Human
agagggaucacccuguuucugg

SEQ ID NO: 157456 - RNA, 22 nt, Human
acagugaaugcccaagaaaagu

SEQ ID NO: 157457 - RNA, 22 nt, Human
ucugggagagcugcugucagag

SEQ ID NO: 157458 - RNA, 22 nt, Human
ggcuuucuagaucuagcucugu

SEQ ID NO: 157459 - RNA, 22 nt, Human
ucuggcucucaacaaauauuua

SEQ ID NO: 157460 - RNA, 21 nt, Human
agcagagugcuuugacuuugu

SEQ ID NO: 157461 - RNA, 22 nt, Human
aaagguuugcauggaauuuacc

SEQ ID NO: 157462 - RNA, 20 nt, Human
ggcagcucacuacuuucugu

SEQ ID NO: 157463 - RNA, 22 nt, Human
aagagcugauuaagucaugagg

SEQ ID NO: 157464 - RNA, 22 nt, Human
agccacagagguugaugugguu

SEQ ID NO: 157465 - RNA, 22 nt, Human
gcacccagaauaaggacaggac

SEQ ID NO: 157466 - RNA, 22 nt, Human
cuauugaauagcccaaaucauu

SEQ ID NO: 157467 - RNA, 22 nt, Human
acugucuguccugcucuccgug

SEQ ID NO: 157468 - RNA, 22 nt, Human
cccagcucaucaggagccgccc

SEQ ID NO: 157469 - RNA, 22 nt, Human
uuucucugaggcuggccucccu

SEQ ID NO: 157470 - RNA, 22 nt, Human
ccaggcagcucugauuuauguc

SEQ ID NO: 157471 - RNA, 22 nt, Human
cagagacauuaagugccaugau

SEQ ID NO: 157472 - RNA, 22 nt, Human
agccuggcccugcugaacucug

SEQ ID NO: 157473 - RNA, 22 nt, Human
gcuggccugucuagagccuuac

SEQ ID NO: 157474 - RNA, 22 nt, Human
ugcucacagcccagaacauaau

SEQ ID NO: 157475 - RNA, 22 nt, Human
ugcuucaggaagaaacgccagg

SEQ ID NO: 157476 - RNA, 21 nt, Human
agcugcuuucagcuccuagag

SEQ ID NO: 157477 - RNA, 18 nt, Human
gagguccugcucuagccc

SEQ ID NO: 157478 - RNA, 22 nt, Human
ccuggguggcagagguugcagu

SEQ ID NO: 157479 - RNA, 22 nt, Human
uggcuagcccuuguggggagag

SEQ ID NO: 157480 - RNA, 22 nt, Human
gggauggcuuuguggcugacuc

SEQ ID NO: 157481 - RNA, 22 nt, Human
aagaaauuaaugugccauuacu

SEQ ID NO: 157482 - RNA, 22 nt, Human
guggaggagaggcgccuugcgg

SEQ ID NO: 157483 - RNA, 22 nt, Human
ugcagggccgcuggaggucaug

SEQ ID NO: 157484 - RNA, 22 nt, Human
agaccacagucaggcuccuggu

SEQ ID NO: 157485 - RNA, 22 nt, Human
uugcauugugauuacagaggug

SEQ ID NO: 157486 - RNA, 22 nt, Human
cugcacagagcagggcagacac

SEQ ID NO: 157487 - RNA, 22 nt, Human
cagagcagcagagcuuccaugg

SEQ ID NO: 157488 - RNA, 22 nt, Human
cucuuccucucaugcggucaua

SEQ ID NO: 157489 - RNA, 22 nt, Human
uggccucugugggagcugagca

SEQ ID NO: 157490 - RNA, 22 nt, Human
aggugccagugcuguggucccc

SEQ ID NO: 157491 - RNA, 22 nt, Human
ccagggcaucacauccaguguu

SEQ ID NO: 157492 - RNA, 22 nt, Human
aguaaaaauugaggugcaaaau

SEQ ID NO: 157493 - RNA, 18 nt, Human
uggcucagauggcuuuaa

SEQ ID NO: 157494 - RNA, 22 nt, Human
uccagggcuggguuggcucagc

SEQ ID NO: 157495 - RNA, 22 nt, Human
agcucccagaaggcccugcgcc

SEQ ID NO: 157496 - RNA, 22 nt, Human
cccuggaggcggagcuugcagu

SEQ ID NO: 157497 - RNA, 22 nt, Human
ggccucugguucguggugaccu

SEQ ID NO: 157498 - RNA, 22 nt, Human
ccugggugaaaucucuccugca

SEQ ID NO: 157499 - RNA, 22 nt, Human
aaaugguauuuacucuguauua

SEQ ID NO: 157500 - RNA, 22 nt, Human
agcugauuccacuuuuucccca

SEQ ID NO: 157501 - RNA, 22 nt, Human
ucucagagauuuauggaaaacu

SEQ ID NO: 157502 - RNA, 22 nt, Human
auaugugugccauuucagcagu

SEQ ID NO: 157503 - RNA, 22 nt, Human
cccugccugugggcaucaacau

SEQ ID NO: 157504 - RNA, 22 nt, Human
guggagccaggggcuguaggua

SEQ ID NO: 157505 - RNA, 22 nt, Human
ugaagcaggguggccagauugu

SEQ ID NO: 157506 - RNA, 20 nt, Human
acauguacuaaugaauacag

SEQ ID NO: 157507 - RNA, 22 nt, Human
gcuggggagggcgucaaggcca

SEQ ID NO: 157508 - RNA, 22 nt, Human
gccuggagacagcagaggcggc

SEQ ID NO: 157509 - RNA, 21 nt, Human
acagccugucaucucaugguc

SEQ ID NO: 157510 - RNA, 22 nt, Human
uggcagcaaaaccagaaucaga

SEQ ID NO: 157511 - RNA, 20 nt, Human
cguaaggcaagugcugcauc

SEQ ID NO: 157512 - RNA, 22 nt, Human
gcagacuguaucaaugucagua

SEQ ID NO: 157513 - RNA, 22 nt, Human
aaaaguuuaagacucauucuag

SEQ ID NO: 157514 - RNA, 22 nt, Human
ggucucagcaguugcuuugacu

SEQ ID NO: 157515 - RNA, 22 nt, Human
aucaguuuggugcuuucaguga

SEQ ID NO: 157516 - RNA, 22 nt, Human
uauuucugaauccaaaagguca

SEQ ID NO: 157517 - RNA, 18 nt, Human
uggugaaggguggaggag

SEQ ID NO: 157518 - RNA, 22 nt, Human
cuguccuugcuggccagguaug

SEQ ID NO: 157519 - RNA, 22 nt, Human
aggucauuggggacuaucuccg

SEQ ID NO: 157520 - RNA, 22 nt, Human
aaguucaagaucaagguuccag

SEQ ID NO: 157521 - RNA, 22 nt, Human
agcaggagcugugggaagaugg

SEQ ID NO: 157522 - RNA, 22 nt, Human
aguuaaagucugaaauagagaa

SEQ ID NO: 157523 - RNA, 22 nt, Human
cugugcaguaggucagggcugg

SEQ ID NO: 157524 - RNA, 22 nt, Human
gggugggccacugagcagcgug

SEQ ID NO: 157525 - RNA, 22 nt, Human
ggcacugggcaccggcugaggg

SEQ ID NO: 157526 - RNA, 22 nt, Human
uauuucuggcuuugagggugau

SEQ ID NO: 157527 - RNA, 22 nt, Human
gccauccucugagcacuaggca

SEQ ID NO: 157528 - RNA, 22 nt, Human
cccagccugucuuucccaauga

SEQ ID NO: 157529 - RNA, 22 nt, Human
gugccugugccaggggugugcu

SEQ ID NO: 157530 - RNA, 22 nt, Human
gcagggacaaggcagguguucu

SEQ ID NO: 157531 - RNA, 22 nt, Human
cagccucucuguaucucaggau

SEQ ID NO: 157532 - RNA, 22 nt, Human
ucaagaaagggcuucaccagga

SEQ ID NO: 157533 - RNA, 22 nt, Human
agucccagccuguaggauuggg

SEQ ID NO: 157534 - RNA, 22 nt, Human
ugaagccaucccucagauggcc

SEQ ID NO: 157535 - RNA, 22 nt, Human
gggagggaaggaggcgccgugu

SEQ ID NO: 157536 - RNA, 22 nt, Human
ccagggugugggcgucggcacg

SEQ ID NO: 157537 - RNA, 22 nt, Human
acaggcugcugggcuccgugcu

SEQ ID NO: 157538 - RNA, 19 nt, Human
ugggccugcaucugggucu

SEQ ID NO: 157539 - RNA, 22 nt, Human
ugccagcacuucuggcugucug

SEQ ID NO: 157540 - RNA, 22 nt, Human
uaugcauagguaucuauacuca

SEQ ID NO: 157541 - RNA, 22 nt, Human
uuguuuuggagaugagcuaaaa

SEQ ID NO: 157542 - RNA, 19 nt, Human
gccugcagaaaaggcaggg

SEQ ID NO: 157543 - RNA, 22 nt, Human
caaaugcuaacuucuuuccaaa

SEQ ID NO: 157544 - RNA, 22 nt, Human
gagccuucaucgcagccuuguu

SEQ ID NO: 157545 - RNA, 22 nt, Human
gcaggaugaaggcagaggcuga

SEQ ID NO: 157546 - RNA, 22 nt, Human
uacauggguagguuaagucaua

SEQ ID NO: 157547 - RNA, 22 nt, Human
ucucagagugguggucccucug

SEQ ID NO: 157548 - RNA, 22 nt, Human
augcacgccccacacuggugug

SEQ ID NO: 157549 - RNA, 22 nt, Human
agagucugaggcagcugcagcc

SEQ ID NO: 157550 - RNA, 20 nt, Human
agcugaggcaccugagguua

SEQ ID NO: 157551 - RNA, 22 nt, Human
cugccuuccaaccccagacucc

SEQ ID NO: 157552 - RNA, 22 nt, Human
cuggcagcccaaccuagagucu

SEQ ID NO: 157553 - RNA, 22 nt, Human
gaugaagccugacuucucggug

SEQ ID NO: 157554 - RNA, 22 nt, Human
ccucagaguaggucucagcugu

SEQ ID NO: 157555 - RNA, 22 nt, Human
uggaggcauaggccugggcccu

SEQ ID NO: 157556 - RNA, 22 nt, Human
gaugggaggaaccugggucccu

SEQ ID NO: 157557 - RNA, 22 nt, Human
gcugggagcccuggucugcucc

SEQ ID NO: 157558 - RNA, 22 nt, Human
ucagggacauuuagacacugau

SEQ ID NO: 157559 - RNA, 22 nt, Human
ugcuuaauauugugauguaaua

SEQ ID NO: 157560 - RNA, 22 nt, Human
gagcagcuccagccgcaugacu

SEQ ID NO: 157561 - RNA, 22 nt, Human
gugcagcagggggaagacagug

SEQ ID NO: 157562 - RNA, 22 nt, Human
uguagcauguaaauugguuauu

SEQ ID NO: 157563 - RNA, 22 nt, Human
gaacccaguccaggugcagccu

SEQ ID NO: 157564 - RNA, 22 nt, Human
gagugagggcagcaggggcugc

SEQ ID NO: 157565 - RNA, 22 nt, Human
accugggagucacaccugagaa

SEQ ID NO: 157566 - RNA, 22 nt, Human
aaugcacauauauguguauaca

SEQ ID NO: 157567 - RNA, 22 nt, Human
caguugaugggacucauguggg

SEQ ID NO: 157568 - RNA, 22 nt, Human
cccagcuccuuacagggccgaa

SEQ ID NO: 157569 - RNA, 22 nt, Human
aaaaauguuaucuacuguccga

SEQ ID NO: 157570 - RNA, 22 nt, Human
caagugucuauaucagugcuug

SEQ ID NO: 157571 - RNA, 22 nt, Human
cuguccuccggccaccuacagu

SEQ ID NO: 157572 - RNA, 22 nt, Human
ggcugcuguuucagagacuguu

SEQ ID NO: 157573 - RNA, 22 nt, Human
cccagcucucugcucuuagccu

SEQ ID NO: 157574 - RNA, 22 nt, Human
acugcaggagacacagcugcug

SEQ ID NO: 157575 - RNA, 18 nt, Human
agagaugguguagaguuu

SEQ ID NO: 157576 - RNA, 22 nt, Human
uggagcugggaguccugggcug

SEQ ID NO: 157577 - RNA, 22 nt, Human
cccagggucccugcucucugug

SEQ ID NO: 157578 - RNA, 22 nt, Human
cuccucccucuuugccacacau

SEQ ID NO: 157579 - RNA, 22 nt, Human
uuauugccugauugaggucauu

SEQ ID NO: 157580 - RNA, 22 nt, Human
cuggggcuucaaugcuucggug

SEQ ID NO: 157581 - RNA, 22 nt, Human
aggccuccugcagggaugagug

SEQ ID NO: 157582 - RNA, 22 nt, Human
aaagaacaucggagugggcggg

SEQ ID NO: 157583 - RNA, 22 nt, Human
ucucccaggugggugccuggag

SEQ ID NO: 157584 - RNA, 22 nt, Human
gagucccaugaugauagccaca

SEQ ID NO: 157585 - RNA, 22 nt, Human
auucuucauguugaagcuguca

SEQ ID NO: 157586 - RNA, 20 nt, Human
gagccuuccccucaccacug

SEQ ID NO: 157587 - RNA, 22 nt, Human
ugcucugugguccaagauggcu

SEQ ID NO: 157588 - RNA, 22 nt, Human
ccacugucagaggggcugugcc

SEQ ID NO: 157589 - RNA, 22 nt, Human
ucucauucauacccuacaugcu

SEQ ID NO: 157590 - RNA, 23 nt, Human
acaaaugcccauacaucuaguuc

SEQ ID NO: 157591 - RNA, 18 nt, Human
ucuggcucaggacugaac

SEQ ID NO: 157592 - RNA, 22 nt, Human
uaggcaggugugcacugcccac

SEQ ID NO: 157593 - RNA, 22 nt, Human
cagcaggcccaggugcugguga

SEQ ID NO: 157594 - RNA, 22 nt, Human
cuggugugauugagcccaggug

SEQ ID NO: 157595 - RNA, 22 nt, Human
ccauuguaaagaguauacuuug

SEQ ID NO: 157596 - RNA, 22 nt, Human
gagcccuggcagucugggaugg

SEQ ID NO: 157597 - RNA, 22 nt, Human
gcuccuggucuggagcuucaag

SEQ ID NO: 157598 - RNA, 22 nt, Human
caggcagcaucagucugcugua

SEQ ID NO: 157599 - RNA, 22 nt, Human
ugcuagaauaccuaccuggagg

SEQ ID NO: 157600 - RNA, 22 nt, Human
uuuuccucugagcuuugaauaa

SEQ ID NO: 157601 - RNA, 16 nt, Human
uguuagcugugcauua

SEQ ID NO: 157602 - RNA, 19 nt, Human
uuagaaacuguugacacug

SEQ ID NO: 157603 - RNA, 21 nt, Human
guuugcaugaacaagucagcc

SEQ ID NO: 157604 - RNA, 22 nt, Human
cggcuggguagaggugccgggu

SEQ ID NO: 157605 - RNA, 22 nt, Human
gucccagaggcuuuggccacag

SEQ ID NO: 157606 - RNA, 22 nt, Human
gccugaaguuucaugccucuau

SEQ ID NO: 157607 - RNA, 22 nt, Human
cuggagcccaggccuggugucu

SEQ ID NO: 157608 - RNA, 22 nt, Human
ucuagaaaaaaacugcugugga

SEQ ID NO: 157609 - RNA, 22 nt, Human
cugccugcuucugagccagagg

SEQ ID NO: 157610 - RNA, 22 nt, Human
gccugcagauauauaggauggu

SEQ ID NO: 157611 - RNA, 22 nt, Human
ucugagggugggagaaggagcu

SEQ ID NO: 157612 - RNA, 22 nt, Human
ucagagugaccuuacauggucu

SEQ ID NO: 157613 - RNA, 22 nt, Human
agccugagagccaagcugugca

SEQ ID NO: 157614 - RNA, 22 nt, Human
ccaaaugcuccacugacuuugg

SEQ ID NO: 157615 - RNA, 23 nt, Human
agcuggguggccugcgugaagcu

SEQ ID NO: 157616 - RNA, 22 nt, Human
ucuuugcaaauguuauuaucuu

SEQ ID NO: 157617 - RNA, 22 nt, Human
cuugcuuuguccagaaauucag

SEQ ID NO: 157618 - RNA, 22 nt, Human
aguaacuaugcuugagaaucag

SEQ ID NO: 157619 - RNA, 22 nt, Human
cuggcagggugggcuuugcuuu

SEQ ID NO: 157620 - RNA, 22 nt, Human
agaugauggccauguccucucc

SEQ ID NO: 157621 - RNA, 22 nt, Human
ggcagugguuagaaacaugagc

SEQ ID NO: 157622 - RNA, 22 nt, Human
uguguauuaccauuuuacagcu

SEQ ID NO: 157623 - RNA, 22 nt, Human
gcuggagccaagcugcucuugg

SEQ ID NO: 157624 - RNA, 22 nt, Human
ugcagcagcagggaggaggcuc

SEQ ID NO: 157625 - RNA, 22 nt, Human
ggggcuguuuuuggaauggcug

SEQ ID NO: 157626 - RNA, 22 nt, Human
cuggucugagggcucuugaggc

SEQ ID NO: 157627 - RNA, 22 nt, Human
uuccaugugaguacacugugau

SEQ ID NO: 157628 - RNA, 22 nt, Human
aagggcagcugacagaugcuua

SEQ ID NO: 157629 - RNA, 22 nt, Human
acagguggcuuauuggcugauu

SEQ ID NO: 157630 - RNA, 18 nt, Human
ccugcagcccaggaggcc

SEQ ID NO: 157631 - RNA, 22 nt, Human
auucuaggcuugaaacaugaag

SEQ ID NO: 157632 - RNA, 22 nt, Human
agaaaugcucuuccugaccaga

SEQ ID NO: 157633 - RNA, 18 nt, Human
gcugagguggugucagag

SEQ ID NO: 157634 - RNA, 22 nt, Human
gaccagagaaaggcacuggaag

SEQ ID NO: 157635 - RNA, 22 nt, Human
ucaaauguucccuguacuggcc

SEQ ID NO: 157636 - RNA, 22 nt, Human
ucuggcucaaaauacguacucu

SEQ ID NO: 157637 - RNA, 22 nt, Human
auaaggcaagcugucaguuugu

SEQ ID NO: 157638 - RNA, 22 nt, Human
uggcagggaauacagauguuua

SEQ ID NO: 157639 - RNA, 22 nt, Human
acagccuguguaccagcuggga

SEQ ID NO: 157640 - RNA, 22 nt, Human
aggcacugaagugguaaaugua

SEQ ID NO: 157641 - RNA, 21 nt, Human
ugagccaggcugacggcugug

SEQ ID NO: 157642 - RNA, 22 nt, Human
uggagcaggugcucaggguaau

SEQ ID NO: 157643 - RNA, 22 nt, Human
gccugccuagaauugcagcuuu

SEQ ID NO: 157644 - RNA, 22 nt, Human
gaaugcagauggcugguguaug

SEQ ID NO: 157645 - RNA, 22 nt, Human
gagcacagccaaaguaagaagg

SEQ ID NO: 157646 - RNA, 22 nt, Human
aaauguguuuagaugguuuauu

SEQ ID NO: 157647 - RNA, 22 nt, Human
uucugggacaucuggacaguuu

SEQ ID NO: 157648 - RNA, 22 nt, Human
ggcuccagggaguggagagaag

SEQ ID NO: 157649 - RNA, 22 nt, Human
gaauuguagagggaacagaagc

SEQ ID NO: 157650 - RNA, 22 nt, Human
gcccaggcuagcguagagugca

SEQ ID NO: 157651 - RNA, 22 nt, Human
agcccccaaaagugcuuaugau

SEQ ID NO: 157652 - RNA, 22 nt, Human
gucccuggaucugggacagcug

SEQ ID NO: 157653 - RNA, 22 nt, Human
agccaagcaccacuggcacucg

SEQ ID NO: 157654 - RNA, 22 nt, Human
ucuggccuuaucuguccaagcc

SEQ ID NO: 157655 - RNA, 22 nt, Human
gagccagccuucuucugagguc

SEQ ID NO: 157656 - RNA, 22 nt, Human
acauuugucuucuuucagauua

SEQ ID NO: 157657 - RNA, 21 nt, Human
aagcuucccugcucuccaggg

SEQ ID NO: 157658 - RNA, 22 nt, Human
aggaggugacagccugcaucug

SEQ ID NO: 157659 - RNA, 22 nt, Human
uugcaccauuucacuuccauua

SEQ ID NO: 157660 - RNA, 22 nt, Human
cagguggggcgcccucaggcag

SEQ ID NO: 157661 - RNA, 22 nt, Human
acagcagcgucaacuuaaaauu

SEQ ID NO: 157662 - RNA, 22 nt, Human
ucccagagacaucauuucuccg

SEQ ID NO: 157663 - RNA, 22 nt, Human
uucacaggugacuggggauaac

SEQ ID NO: 157664 - RNA, 22 nt, Human
caggaggcccaaagggcgcaga

SEQ ID NO: 157665 - RNA, 22 nt, Human
caggcuggagugcaguugugca

SEQ ID NO: 157666 - RNA, 22 nt, Human
cagucccacuagugccaauacc

SEQ ID NO: 157667 - RNA, 22 nt, Human
uucugaggcacuggcucuccca

SEQ ID NO: 157668 - RNA, 22 nt, Human
uuaggaaauuaugguuucagau

SEQ ID NO: 157669 - RNA, 22 nt, Human
uaguaucuauuaguaacaagag

SEQ ID NO: 157670 - RNA, 22 nt, Human
gccuuggccuuccuaggccuga

SEQ ID NO: 157671 - RNA, 22 nt, Human
ccagaggucuccugcacgggau

SEQ ID NO: 157672 - RNA, 23 nt, Human
ccuggcagcaaacgaggagguua

SEQ ID NO: 157673 - RNA, 22 nt, Human
gcacccagggacuuggcuggcc

SEQ ID NO: 157674 - RNA, 22 nt, Human
aggccuccuggcuccaggccuu

SEQ ID NO: 157675 - RNA, 22 nt, Human
uugcauaaagauuuuauugcau

SEQ ID NO: 157676 - RNA, 21 nt, Human
ucuggagcccuaagcugagaa

SEQ ID NO: 157677 - RNA, 18 nt, Human
uuccauaauguauguaac

SEQ ID NO: 157678 - RNA, 22 nt, Human
augacagaaggccucccugaca

SEQ ID NO: 157679 - RNA, 21 nt, Human
gccugcagaccccaccaggcu

SEQ ID NO: 157680 - RNA, 22 nt, Human
auuguaucuugucauuaugcau

SEQ ID NO: 157681 - RNA, 22 nt, Human
ggagcagagcucuucaucugca

SEQ ID NO: 157682 - RNA, 22 nt, Human
gcugggcuucucaaugcugccu

SEQ ID NO: 157683 - RNA, 22 nt, Human
gcagcaaucuucacagugucau

SEQ ID NO: 157684 - RNA, 21 nt, Human
uggcucaguugcugggcacag

SEQ ID NO: 157685 - RNA, 22 nt, Human
gccuggugaaaggcagagagcg

SEQ ID NO: 157686 - RNA, 20 nt, Human
agaggcuuccuugggaggag

SEQ ID NO: 157687 - RNA, 20 nt, Human
aggaacuggaagggaggaaa

SEQ ID NO: 157688 - RNA, 22 nt, Human
agcagcuuacauguggccuauc

SEQ ID NO: 157689 - RNA, 19 nt, Human
gaaggagagcugaguuagg

SEQ ID NO: 157690 - RNA, 22 nt, Human
aaaguuuuagaacuaggaagca

SEQ ID NO: 157691 - RNA, 22 nt, Human
gggugggaacaggaugccagga

SEQ ID NO: 157692 - RNA, 22 nt, Human
uaaaugugucuuuuuaaggccu

SEQ ID NO: 157693 - RNA, 22 nt, Human
aaagccuugggauuugugauca

SEQ ID NO: 157694 - RNA, 17 nt, Human
agaugcuggccacaugu

SEQ ID NO: 157695 - RNA, 22 nt, Human
cugcagcuccccugagaucaag

SEQ ID NO: 157696 - RNA, 19 nt, Human
uggcagaggcaguuuguac

SEQ ID NO: 157697 - RNA, 22 nt, Human
ugccuucaaucaggauggucuc

SEQ ID NO: 157698 - RNA, 22 nt, Human
gcugccugggcaggaggcgcug

SEQ ID NO: 157699 - RNA, 22 nt, Human
agcagagaagacacaggcuuca

SEQ ID NO: 157700 - RNA, 22 nt, Human
gggcacugaaugccaagcuagg

SEQ ID NO: 157701 - RNA, 22 nt, Human
acagggccauuaucuguucuag

SEQ ID NO: 157702 - RNA, 23 nt, Human
gcugcagcuguggauguucucag

SEQ ID NO: 157703 - RNA, 17 nt, Human
cccugccaccaggaagc

SEQ ID NO: 157704 - RNA, 19 nt, Human
cagaccuguccagccugug

SEQ ID NO: 157705 - RNA, 22 nt, Human
aggggccugguuggccucuguu

SEQ ID NO: 157706 - RNA, 22 nt, Human
ugccugggccuucccaccucug

SEQ ID NO: 157707 - RNA, 22 nt, Human
uggcucagucuggguugacuga

SEQ ID NO: 157708 - RNA, 22 nt, Human
auaaggaaugauguaucaguuu

SEQ ID NO: 157709 - RNA, 22 nt, Human
cauugacaucaggcuuggccaa

SEQ ID NO: 157710 - RNA, 22 nt, Human
cuugaaagucacaugcagcccu

SEQ ID NO: 157711 - RNA, 22 nt, Human
uggcagcaaguucuugggaggu

SEQ ID NO: 157712 - RNA, 21 nt, Human
cugguguagcacucaggugcu

SEQ ID NO: 157713 - RNA, 23 nt, Human
acuuuagauaaauuaugugcaca

SEQ ID NO: 157714 - RNA, 22 nt, Human
aagauuucagaguuugggggaa

SEQ ID NO: 157715 - RNA, 22 nt, Human
aggagcugggcugcugcuggga

SEQ ID NO: 157716 - RNA, 22 nt, Human
ucaaaguuuuugagaauuacau

SEQ ID NO: 157717 - RNA, 22 nt, Human
ucaguuuucucauuuaugagau

SEQ ID NO: 157718 - RNA, 22 nt, Human
auuguaauuuuagagaaagugg

SEQ ID NO: 157719 - RNA, 22 nt, Human
uagcagagcagggaucagagcc

SEQ ID NO: 157720 - RNA, 22 nt, Human
acacaggggaaaguggagcuga

SEQ ID NO: 157721 - RNA, 22 nt, Human
aagggcagagggaaucccacau

SEQ ID NO: 157722 - RNA, 21 nt, Human
aguguccuugaucuugccuug

SEQ ID NO: 157723 - RNA, 22 nt, Human
gaggaugugucuggucugggca

SEQ ID NO: 157724 - RNA, 22 nt, Human
ucuguucuauuggucuaugugu

SEQ ID NO: 157725 - RNA, 22 nt, Human
ccagcccuccuccaucagagga

SEQ ID NO: 157726 - RNA, 22 nt, Human
aaacaugagcaucucuucaagc

SEQ ID NO: 157727 - RNA, 22 nt, Human
ugggccugggucuuugcugcca

SEQ ID NO: 157728 - RNA, 22 nt, Human
gugccugccccacuccucagca

SEQ ID NO: 157729 - RNA, 21 nt, Human
gagugcaggucugaugccauc

SEQ ID NO: 157730 - RNA, 22 nt, Human
ucuggaguccagauccauuugg

SEQ ID NO: 157731 - RNA, 22 nt, Human
aaggcccuggccccagcuucuu

SEQ ID NO: 157732 - RNA, 21 nt, Human
gcagacugcccugcugucccc

SEQ ID NO: 157733 - RNA, 22 nt, Human
cuggggcccaucgagggcugag

SEQ ID NO: 157734 - RNA, 22 nt, Human
agaggucagaacaggaaagugu

SEQ ID NO: 157735 - RNA, 22 nt, Human
auuguauuagcacaauacaauu

SEQ ID NO: 157736 - RNA, 22 nt, Human
cagaaauguuuauauguggugu

SEQ ID NO: 157737 - RNA, 22 nt, Human
aguggcaggaaaguggaagaga

SEQ ID NO: 157738 - RNA, 22 nt, Human
ccagcugguuaaaauagagaaa

SEQ ID NO: 157739 - RNA, 22 nt, Human
uccauguggccagacacuggca

SEQ ID NO: 157740 - RNA, 22 nt, Human
aaggcucucugauggcagcagu

SEQ ID NO: 157741 - RNA, 22 nt, Human
acauuucuuagccuaguuccag

SEQ ID NO: 157742 - RNA, 22 nt, Human
ggggaugguagaccggugacgu

SEQ ID NO: 157743 - RNA, 22 nt, Human
uugcauugaucccagcuugggc

SEQ ID NO: 157744 - RNA, 22 nt, Human
agaauccugaugaaaaggagag

SEQ ID NO: 157745 - RNA, 19 nt, Human
uggcucugucgaaggcaca

SEQ ID NO: 157746 - RNA, 22 nt, Human
gaagaacaccugcugcccagug

SEQ ID NO: 157747 - RNA, 22 nt, Human
ccagagccucuuaugaagaucg

SEQ ID NO: 157748 - RNA, 22 nt, Human
aguguuccugcucucaggaagc

SEQ ID NO: 157749 - RNA, 22 nt, Human
ccacagcaugcaggccugacac

SEQ ID NO: 157750 - RNA, 22 nt, Human
ggaggccuugaggccaggagcu

SEQ ID NO: 157751 - RNA, 22 nt, Human
uaugcacagaaguuugcugaau

SEQ ID NO: 157752 - RNA, 22 nt, Human
agcucccugagaugccacagca

SEQ ID NO: 157753 - RNA, 22 nt, Human
cugaaggaagcagguggccugu

SEQ ID NO: 157754 - RNA, 22 nt, Human
cacuguguaagaagaugggcuu

SEQ ID NO: 157755 - RNA, 22 nt, Human
aaagucauguaaugauaugauu

SEQ ID NO: 157756 - RNA, 22 nt, Human
caggacaguauaggcuuuagga

SEQ ID NO: 157757 - RNA, 22 nt, Human
caggguggggcuggcuaucaaa

SEQ ID NO: 157758 - RNA, 22 nt, Human
uccuugaauggacauuacacug

SEQ ID NO: 157759 - RNA, 22 nt, Human
uggacucagugcugccauuccc

SEQ ID NO: 157760 - RNA, 22 nt, Human
aagcaauaagccagauuuggau

SEQ ID NO: 157761 - RNA, 22 nt, Human
agccagcuggagaccacuguuu

SEQ ID NO: 157762 - RNA, 22 nt, Human
ucugcugcacaaauucaucucu

SEQ ID NO: 157763 - RNA, 20 nt, Human
ucugucucugagcuagacuu

SEQ ID NO: 157764 - RNA, 22 nt, Human
gugcauuggugcgccacuucac

SEQ ID NO: 157765 - RNA, 22 nt, Human
augagcugggccauccagugau

SEQ ID NO: 157766 - RNA, 22 nt, Human
ugcucuggaguggcuugugcac

SEQ ID NO: 157767 - RNA, 22 nt, Human
ggcagcucugugucugggaagc

SEQ ID NO: 157768 - RNA, 22 nt, Human
cagggccagcgucucgggcuau

SEQ ID NO: 157769 - RNA, 22 nt, Human
acuuggagagcauugcugggga

SEQ ID NO: 157770 - RNA, 22 nt, Human
agucaguguucuccggagaggc

SEQ ID NO: 157771 - RNA, 22 nt, Human
cuggagccggcgagccccagcc

SEQ ID NO: 157772 - RNA, 22 nt, Human
uagaaaugcccagauucugcua

SEQ ID NO: 157773 - RNA, 22 nt, Human
uccuccagugucuggggccuug

SEQ ID NO: 157774 - RNA, 22 nt, Human
agaggcuguuacacucccagau

SEQ ID NO: 157775 - RNA, 22 nt, Human
gaggagagagggacugucugca

SEQ ID NO: 157776 - RNA, 22 nt, Human
uaggacaggugaggggcugugg

SEQ ID NO: 157777 - RNA, 22 nt, Human
cagaguacugggagaacagaag

SEQ ID NO: 157778 - RNA, 22 nt, Human
gagauggggaauaggagcaagc

SEQ ID NO: 157779 - RNA, 22 nt, Human
augcaguagauaggcacuuuua

SEQ ID NO: 157780 - RNA, 22 nt, Human
uguggccucaaggcugcccuca

SEQ ID NO: 157781 - RNA, 22 nt, Human
caggaaaaaugccaggagucag

SEQ ID NO: 157782 - RNA, 22 nt, Human
gagcagagacaguacaacuggc

SEQ ID NO: 157783 - RNA, 22 nt, Human
cgggcagauugggaagguucau

SEQ ID NO: 157784 - RNA, 22 nt, Human
agucucugagguucagaugccu

SEQ ID NO: 157785 - RNA, 22 nt, Human
agcaugcacaugacuggcuuaa

SEQ ID NO: 157786 - RNA, 22 nt, Human
cuggcccagagagcagagcuua

SEQ ID NO: 157787 - RNA, 22 nt, Human
ccagcuccaaguuugggcauca

SEQ ID NO: 157788 - RNA, 22 nt, Human
ucucugauguauaucagagaac

SEQ ID NO: 157789 - RNA, 22 nt, Human
ucagaagcugguguccuuugaa

SEQ ID NO: 157790 - RNA, 22 nt, Human
ucucaggaagauuagggcuaag

SEQ ID NO: 157791 - RNA, 22 nt, Human
ugauuaacugucuauuaaucau

SEQ ID NO: 157792 - RNA, 17 nt, Human
gguggccugcaguggcu

SEQ ID NO: 157793 - RNA, 23 nt, Human
aagcugccagucugaagccuggg

SEQ ID NO: 157794 - RNA, 22 nt, Human
gggcucugcgcucagcuccagc

SEQ ID NO: 157795 - RNA, 22 nt, Human
caagaacauugugaucacuuca

SEQ ID NO: 157796 - RNA, 22 nt, Human
uguuaaauguuccuuuacugga

SEQ ID NO: 157797 - RNA, 22 nt, Human
aucaguuuauacuuauaaaucu

SEQ ID NO: 157798 - RNA, 22 nt, Human
uugcagggcaggaccauggaca

SEQ ID NO: 157799 - RNA, 22 nt, Human
ggcugccuacuuucccagaguu

SEQ ID NO: 157800 - RNA, 22 nt, Human
ggagcugggguuggcaucuucc

SEQ ID NO: 157801 - RNA, 22 nt, Human
cuggcucuaucuccaaggcugg

SEQ ID NO: 157802 - RNA, 22 nt, Human
ucccagggcagcuguccagaag

SEQ ID NO: 157803 - RNA, 22 nt, Human
cagcuggccugaucccuguggc

SEQ ID NO: 157804 - RNA, 22 nt, Human
cugguuuagcuguaagguuccc

SEQ ID NO: 157805 - RNA, 23 nt, Human
cuuuccuuucuuugacacccagc

SEQ ID NO: 157806 - RNA, 22 nt, Human
uaacagaagagcaggcagcccu

SEQ ID NO: 157807 - RNA, 22 nt, Human
agcaauauuucagcuagcaggu

SEQ ID NO: 157808 - RNA, 22 nt, Human
agccacagucugaugccugaga

SEQ ID NO: 157809 - RNA, 22 nt, Human
ucugaggcuucagacuguacug

SEQ ID NO: 157810 - RNA, 22 nt, Human
uguauacauuuaacuagauaga

SEQ ID NO: 157811 - RNA, 22 nt, Human
gaggcucugugaugugccaggc

SEQ ID NO: 157812 - RNA, 22 nt, Human
agccuggaggaggaguugagca

SEQ ID NO: 157813 - RNA, 22 nt, Human
gauuucaaccuaacaguaugac

SEQ ID NO: 157814 - RNA, 22 nt, Human
auagaaaacagauguccuuaaa

SEQ ID NO: 157815 - RNA, 22 nt, Human
gcagcugccgugagcucacgcc

SEQ ID NO: 157816 - RNA, 22 nt, Human
ucucagaguuuagagcugagcc

SEQ ID NO: 157817 - RNA, 22 nt, Human
agagcugggacuuggacucaau

SEQ ID NO: 157818 - RNA, 22 nt, Human
ggccucaguuucuucaacugua

SEQ ID NO: 157819 - RNA, 22 nt, Human
cccagcagaaucugaugagggc

SEQ ID NO: 157820 - RNA, 22 nt, Human
gcucaggacuggaggagcgggg

SEQ ID NO: 157821 - RNA, 22 nt, Human
agagaggcugggcguagggcuu

SEQ ID NO: 157822 - RNA, 22 nt, Human
caggggcuuuuccucuauaagg

SEQ ID NO: 157823 - RNA, 22 nt, Human
ccaaggcuucccagagaugcuc

SEQ ID NO: 157824 - RNA, 23 nt, Human
aacaccaaggcucagagagauaa

SEQ ID NO: 157825 - RNA, 22 nt, Human
agggccagaaucccucagucua

SEQ ID NO: 157826 - RNA, 22 nt, Human
agagcagagggcucugggacaa

SEQ ID NO: 157827 - RNA, 22 nt, Human
auggauaauggugauaguugca

SEQ ID NO: 157828 - RNA, 22 nt, Human
agugaggcuaauaggcaauggu

SEQ ID NO: 157829 - RNA, 18 nt, Human
caggaugagugaugggga

SEQ ID NO: 157830 - RNA, 22 nt, Human
ccugggaagagcugacaggagg

SEQ ID NO: 157831 - RNA, 22 nt, Human
caggaugggauguagugggccc

SEQ ID NO: 157832 - RNA, 21 nt, Human
cagaggggcuagccuggcugc

SEQ ID NO: 157833 - RNA, 22 nt, Human
aaaaguucccugguuagaaaag

SEQ ID NO: 157834 - RNA, 22 nt, Human
gcaaggcugcugccacccaucu

SEQ ID NO: 157835 - RNA, 22 nt, Human
uaagaacagauaaaguuucccc

SEQ ID NO: 157836 - RNA, 22 nt, Human
guguaauuauauaaagaucuac

SEQ ID NO: 157837 - RNA, 22 nt, Human
agcagcucugagaggccagcac

SEQ ID NO: 157838 - RNA, 22 nt, Human
uugaagcauuugcuauagcauu

SEQ ID NO: 157839 - RNA, 22 nt, Human
gugcuucucuucacacccaacu

SEQ ID NO: 157840 - RNA, 22 nt, Human
gcagcagaguuugggagauggu

SEQ ID NO: 157841 - RNA, 18 nt, Human
cauuguacaaugcuuuau

SEQ ID NO: 157842 - RNA, 22 nt, Human
gggcuucuagaccagcagugag

SEQ ID NO: 157843 - RNA, 22 nt, Human
uuggcugagagaggaaaagggc

SEQ ID NO: 157844 - RNA, 22 nt, Human
uaucuuuaacuugcaguauuua

SEQ ID NO: 157845 - RNA, 22 nt, Human
aaaugcacaauaaaguaaaggc

SEQ ID NO: 157846 - RNA, 18 nt, Human
gagaggcccggcugugcc

SEQ ID NO: 157847 - RNA, 22 nt, Human
ccugccuggaucagccauccug

SEQ ID NO: 157848 - RNA, 22 nt, Human
uagaaaucagcaggcauaugua

SEQ ID NO: 157849 - RNA, 22 nt, Human
ccugugcccucagccuggcucu

SEQ ID NO: 157850 - RNA, 22 nt, Human
uggcuccuaggauggugccugg

SEQ ID NO: 157851 - RNA, 22 nt, Human
ccagggugugagaaggaaguag

SEQ ID NO: 157852 - RNA, 22 nt, Human
aagauuuagggccaguuuacau

SEQ ID NO: 157853 - RNA, 22 nt, Human
ggcagucagugugguucauaaa

SEQ ID NO: 157854 - RNA, 23 nt, Human
aggcuuccuaucuuagagcuggg

SEQ ID NO: 157855 - RNA, 22 nt, Human
agaggcaggagguugacuugag

SEQ ID NO: 157856 - RNA, 22 nt, Human
uccuggccugucuggaguagcu

SEQ ID NO: 157857 - RNA, 22 nt, Human
cugagaaggaagccuccacucu

SEQ ID NO: 157858 - RNA, 22 nt, Human
ugaagcaguucucagaaguggg

SEQ ID NO: 157859 - RNA, 22 nt, Human
gaaaugcagaaccugagaccau

SEQ ID NO: 157860 - RNA, 22 nt, Human
uccuugaaugaauguucucucc

SEQ ID NO: 157861 - RNA, 22 nt, Human
aaucaguucuacaucuuaucca

SEQ ID NO: 157862 - RNA, 22 nt, Human
gcucacagccggcuggcagggg

SEQ ID NO: 157863 - RNA, 22 nt, Human
ggcaccuggagguuuacuggau

SEQ ID NO: 157864 - RNA, 22 nt, Human
cugggcuacguguugacagcau

SEQ ID NO: 157865 - RNA, 22 nt, Human
ggaggccaguccuggccgggcu

SEQ ID NO: 157866 - RNA, 22 nt, Human
ggccaggaagggaagaucagca

SEQ ID NO: 157867 - RNA, 22 nt, Human
uggcucagcagguuagaaacua

SEQ ID NO: 157868 - RNA, 22 nt, Human
uaaaugcaagugcuccugggag

SEQ ID NO: 157869 - RNA, 23 nt, Human
uguaaaaugggguaguguuacca

SEQ ID NO: 157870 - RNA, 22 nt, Human
ccaggcugcuuagccuuaucuu

SEQ ID NO: 157871 - RNA, 21 nt, Human
aggcagcucaggcccagagag

SEQ ID NO: 157872 - RNA, 22 nt, Human
aagagcauauuaauaguggaga

SEQ ID NO: 157873 - RNA, 22 nt, Human
cuggagccggaccagggacggu

SEQ ID NO: 157874 - RNA, 22 nt, Human
gcagacagcauguugggcuauu

SEQ ID NO: 157875 - RNA, 22 nt, Human
uucagcagucguccaggaaaag

SEQ ID NO: 157876 - RNA, 22 nt, Human
ucucaagcuuguugguauguuu

SEQ ID NO: 157877 - RNA, 22 nt, Human
accugagcaugccaggagagug

SEQ ID NO: 157878 - RNA, 22 nt, Human
caggccugauacacugaacucu

SEQ ID NO: 157879 - RNA, 22 nt, Human
agggggaggcugugcugcgucu

SEQ ID NO: 157880 - RNA, 22 nt, Human
uguguuccuucgucuucccuuc

SEQ ID NO: 157881 - RNA, 17 nt, Human
cccagcuggcagugccg

SEQ ID NO: 157882 - RNA, 18 nt, Human
ccgggcuuuggugacaca

SEQ ID NO: 157883 - RNA, 22 nt, Human
uggagcugacucacaccagcua

SEQ ID NO: 157884 - RNA, 20 nt, Human
aagcagaagcugcucucagc

SEQ ID NO: 157885 - RNA, 22 nt, Human
gcugugugcucacguaguggaa

SEQ ID NO: 157886 - RNA, 22 nt, Human
gcugccugauguccagcaggac

SEQ ID NO: 157887 - RNA, 22 nt, Human
ccagaggcauguucaaagcaau

SEQ ID NO: 157888 - RNA, 23 nt, Human
ccugaagggucaggguccucagc

SEQ ID NO: 157889 - RNA, 22 nt, Human
ccaggaggcggaagguacagug

SEQ ID NO: 157890 - RNA, 22 nt, Human
ucacagugaugacgugggagca

SEQ ID NO: 157891 - RNA, 22 nt, Human
cucuuuccaggguaccccaggu

SEQ ID NO: 157892 - RNA, 22 nt, Human
cauacuuugggauaagagugga

SEQ ID NO: 157893 - RNA, 22 nt, Human
auugaaagauaggcuacugugg

SEQ ID NO: 157894 - RNA, 22 nt, Human
acuuccuggcugggugaccugg

SEQ ID NO: 157895 - RNA, 22 nt, Human
uaguccagccuuggguguagcc

SEQ ID NO: 157896 - RNA, 22 nt, Human
ucagcugaaguggagaagcaga

SEQ ID NO: 157897 - RNA, 17 nt, Human
agcuccugcccauggcu

SEQ ID NO: 157898 - RNA, 22 nt, Human
acuccugggugcugaccagcgu

SEQ ID NO: 157899 - RNA, 22 nt, Human
aacuagaaaacaagaugcugau

SEQ ID NO: 157900 - RNA, 22 nt, Human
ggcacugauaauguccucucuc

SEQ ID NO: 157901 - RNA, 22 nt, Human
ggagccugcgggagcucccauu

SEQ ID NO: 157902 - RNA, 22 nt, Human
acucugagcaucccaagucuua

SEQ ID NO: 157903 - RNA, 19 nt, Human
ucauaaggagagaggaaau

SEQ ID NO: 157904 - RNA, 20 nt, Human
ugugcccaauguccagguuc

SEQ ID NO: 157905 - RNA, 22 nt, Human
cagacagacagccguggccacc

SEQ ID NO: 157906 - RNA, 22 nt, Human
cagcugccugcaacacaagcuu

SEQ ID NO: 157907 - RNA, 22 nt, Human
gagaggagucccuaucacaguu

SEQ ID NO: 157908 - RNA, 22 nt, Human
ccaucagcaugggagcaugggc

SEQ ID NO: 157909 - RNA, 22 nt, Human
uuguggaaauacagacuccaag

SEQ ID NO: 157910 - RNA, 22 nt, Human
ggcucugcugguaagaugccuc

SEQ ID NO: 157911 - RNA, 22 nt, Human
ccagcuggcacuguggcugccc

SEQ ID NO: 157912 - RNA, 19 nt, Human
ugucacugucauggcccag

SEQ ID NO: 157913 - RNA, 22 nt, Human
uccaggagguuuggaggaagca

SEQ ID NO: 157914 - RNA, 22 nt, Human
gcaggagcugcucuccugacga

SEQ ID NO: 157915 - RNA, 22 nt, Human
cagaaagaccugggcucaagag

SEQ ID NO: 157916 - RNA, 22 nt, Human
cccauuuagauaacaguucaaa

SEQ ID NO: 157917 - RNA, 22 nt, Human
gcaggagccacuucagggaugc

SEQ ID NO: 157918 - RNA, 22 nt, Human
uguauguguauguacauaugca

SEQ ID NO: 157919 - RNA, 22 nt, Human
aaauuguugaucuacaguaagg

SEQ ID NO: 157920 - RNA, 22 nt, Human
cugaaggauguguggugggagu

SEQ ID NO: 157921 - RNA, 22 nt, Human
gugugccagacaugaugcuaug

SEQ ID NO: 157922 - RNA, 22 nt, Human
cauugucacccaaagcucauag

SEQ ID NO: 157923 - RNA, 22 nt, Human
agagaugaaaaguggagacugg

SEQ ID NO: 157924 - RNA, 22 nt, Human
cucaggaugaaagucaugguga

SEQ ID NO: 157925 - RNA, 22 nt, Human
gaaugugugacucuauugagca

SEQ ID NO: 157926 - RNA, 19 nt, Human
gaagaagcuugagaaguag

SEQ ID NO: 157927 - RNA, 22 nt, Human
cuggccuuggugcuugcagaca

SEQ ID NO: 157928 - RNA, 22 nt, Human
cacaaaaguaggaggcaggcgg

SEQ ID NO: 157929 - RNA, 19 nt, Human
accucugcagagauguuua

SEQ ID NO: 157930 - RNA, 22 nt, Human
gcccucugcacagcucugagca

SEQ ID NO: 157931 - RNA, 19 nt, Human
cagagcugcuggccucguc

SEQ ID NO: 157932 - RNA, 22 nt, Human
uuccauaauuaaguggagagaa

SEQ ID NO: 157933 - RNA, 22 nt, Human
cagcaguguggaagcugagggg

SEQ ID NO: 157934 - RNA, 22 nt, Human
uccuuuuuaagucguuguggua

SEQ ID NO: 157935 - RNA, 22 nt, Human
uaucuuugcaaauaucucuaag

SEQ ID NO: 157936 - RNA, 23 nt, Human
uccuccuuuugcuugugcuuccc

SEQ ID NO: 157937 - RNA, 22 nt, Human
agcucccagcagagcuggccac

SEQ ID NO: 157938 - RNA, 21 nt, Human
gcaggaugcaucuuggugucu

SEQ ID NO: 157939 - RNA, 22 nt, Human
ugcugccauggucgcugguguc

SEQ ID NO: 157940 - RNA, 22 nt, Human
ucccagaggacuguuggugcua

SEQ ID NO: 157941 - RNA, 22 nt, Human
gguggcagcgucuaucugacau

SEQ ID NO: 157942 - RNA, 22 nt, Human
cagcagugucuccagcaucaca

SEQ ID NO: 157943 - RNA, 22 nt, Human
aaguuugacagaaguuucuaau

SEQ ID NO: 157944 - RNA, 22 nt, Human
cugcccugucugcagccuggcu

SEQ ID NO: 157945 - RNA, 22 nt, Human
ggccuugggcuggcugcaguau

SEQ ID NO: 157946 - RNA, 22 nt, Human
ccucccacuucuugcugagguc

SEQ ID NO: 157947 - RNA, 22 nt, Human
uccugccugagcguggaggagg

SEQ ID NO: 157948 - RNA, 19 nt, Human
ugccuggcaccagcuccac

SEQ ID NO: 157949 - RNA, 22 nt, Human
cacugccuggaaggagagacau

SEQ ID NO: 157950 - RNA, 19 nt, Human
gagguggguccccgcagcc

SEQ ID NO: 157951 - RNA, 22 nt, Human
ucaucaaagcgcuuggaguagg

SEQ ID NO: 157952 - RNA, 22 nt, Human
acacuuuacagcuuccuuugca

SEQ ID NO: 157953 - RNA, 22 nt, Human
cagggccugcuuccuucuuguu

SEQ ID NO: 157954 - RNA, 20 nt, Human
ccugucuggagacaaagaga

SEQ ID NO: 157955 - RNA, 22 nt, Human
aggcagaaaauagucauccaaa

SEQ ID NO: 157956 - RNA, 22 nt, Human
ggaggccaaggcagguggaucg

SEQ ID NO: 157957 - RNA, 22 nt, Human
cagagcuguugcggggcuuggc

SEQ ID NO: 157958 - RNA, 22 nt, Human
gggcaagcucuucagaagcucu

SEQ ID NO: 157959 - RNA, 22 nt, Human
uuuucuuacugucugugauccu

SEQ ID NO: 157960 - RNA, 22 nt, Human
uuugcaauuugugcugcaaaug

SEQ ID NO: 157961 - RNA, 22 nt, Human
ccagccucacuggcaucaccua

SEQ ID NO: 157962 - RNA, 22 nt, Human
agccuggauccauguggcuacc

SEQ ID NO: 157963 - RNA, 22 nt, Human
ucagugucuugggcuugaaugc

SEQ ID NO: 157964 - RNA, 22 nt, Human
gaggccuggaauuccagccugg

SEQ ID NO: 157965 - RNA, 22 nt, Human
cagggcaguuuuacuucucucu

SEQ ID NO: 157966 - RNA, 22 nt, Human
ucugggugaugaaaugcacugu

SEQ ID NO: 157967 - RNA, 22 nt, Human
guguacauauugagucugcuga

SEQ ID NO: 157968 - RNA, 22 nt, Human
auuuaugacuggugaauagaac

SEQ ID NO: 157969 - RNA, 22 nt, Human
ggagccagugcccucuggugga

SEQ ID NO: 157970 - RNA, 22 nt, Human
ugggcacuauggcucugugcac

SEQ ID NO: 157971 - RNA, 22 nt, Human
uauucacagcugccgcacucag

SEQ ID NO: 157972 - RNA, 22 nt, Human
guguccagagaaacucacagcu

SEQ ID NO: 157973 - RNA, 22 nt, Human
ucacaggacccugaggguggcg

SEQ ID NO: 157974 - RNA, 22 nt, Human
accccaagacaguagaagagaa

SEQ ID NO: 157975 - RNA, 22 nt, Human
gaugcugaagugaagugaucuu

SEQ ID NO: 157976 - RNA, 22 nt, Human
ugccagcacaaguuaagagauc

SEQ ID NO: 157977 - RNA, 22 nt, Human
aggcacugaagaacucuuuuug

SEQ ID NO: 157978 - RNA, 19 nt, Human
agggaaggauucugucauu

SEQ ID NO: 157979 - RNA, 22 nt, Human
ugagcccaggaguuggagaccg

SEQ ID NO: 157980 - RNA, 22 nt, Human
ugcagaagaaugagcuuggagu

SEQ ID NO: 157981 - RNA, 22 nt, Human
ugccugcugcuaagcucuuugu

SEQ ID NO: 157982 - RNA, 22 nt, Human
ucuggagcuuccucauuuacag

SEQ ID NO: 157983 - RNA, 22 nt, Human
uagcagcugugaguaaaagcca

SEQ ID NO: 157984 - RNA, 18 nt, Human
cucugcuaaugggcagcu

SEQ ID NO: 157985 - RNA, 22 nt, Human
uggcuucugcuuucaguggagg

SEQ ID NO: 157986 - RNA, 22 nt, Human
aacaugaaaguugcuaagugca

SEQ ID NO: 157987 - RNA, 22 nt, Human
cagcccugccauggagccuccu

SEQ ID NO: 157988 - RNA, 22 nt, Human
gaaaggucaguuccacuuccau

SEQ ID NO: 157989 - RNA, 22 nt, Human
uggcucucagcucccagcagcc

SEQ ID NO: 157990 - RNA, 18 nt, Human
cagagcagagguggagcg

SEQ ID NO: 157991 - RNA, 22 nt, Human
agccaggauuggcugagccuua

SEQ ID NO: 157992 - RNA, 22 nt, Human
aagagcuggucacagguccauu

SEQ ID NO: 157993 - RNA, 22 nt, Human
ucuggcucuaacuaggcaucag

SEQ ID NO: 157994 - RNA, 19 nt, Human
cuggggcuuugguacugcc

SEQ ID NO: 157995 - RNA, 22 nt, Human
gaaaugcauggaucuuggcaga

SEQ ID NO: 157996 - RNA, 23 nt, Human
cccuguagcccaggacaggcuuu

SEQ ID NO: 157997 - RNA, 22 nt, Human
gcucucugucguuaugcuucau

SEQ ID NO: 157998 - RNA, 20 nt, Human
ggagagcagggaagacagua

SEQ ID NO: 157999 - RNA, 22 nt, Human
gcugucugucucugucccacca

SEQ ID NO: 158000 - RNA, 22 nt, Human
uauuucugaggcccaggaagug

SEQ ID NO: 158001 - RNA, 22 nt, Human
ggccuagggaguggccaugccu

SEQ ID NO: 158002 - RNA, 22 nt, Human
ugggcaaguaucggacucugag

SEQ ID NO: 158003 - RNA, 22 nt, Human
acugugcaaugaguaauaaacu

SEQ ID NO: 158004 - RNA, 21 nt, Human
acaugcauagagagauuucug

SEQ ID NO: 158005 - RNA, 22 nt, Human
uaacagaaauagaaaugagagu

SEQ ID NO: 158006 - RNA, 22 nt, Human
uucaagaucgaguuuaaaguga

SEQ ID NO: 158007 - RNA, 17 nt, Human
uccagagcacagagcuc

SEQ ID NO: 158008 - RNA, 22 nt, Human
aaaugcuguguuuuaacauaga

SEQ ID NO: 158009 - RNA, 20 nt, Human
gcacugaaauucaauguuug

SEQ ID NO: 158010 - RNA, 22 nt, Human
gaugcagaaaguagacaccauc

SEQ ID NO: 158011 - RNA, 17 nt, Human
auuuccucagggcugag

SEQ ID NO: 158012 - RNA, 22 nt, Human
gaaaugcauaaucuuaguagau

SEQ ID NO: 158013 - RNA, 17 nt, Human
cugagcauccgugcucu

SEQ ID NO: 158014 - RNA, 22 nt, Human
gccaguuccuguggagucagag

SEQ ID NO: 158015 - RNA, 22 nt, Human
ggagggcugccagguggagcgg

SEQ ID NO: 158016 - RNA, 22 nt, Human
agagccagcaacucuagcccug

SEQ ID NO: 158017 - RNA, 22 nt, Human
agaaaugugaauuucauuuccu

SEQ ID NO: 158018 - RNA, 17 nt, Human
uucaagauauugaaaug

SEQ ID NO: 158019 - RNA, 22 nt, Human
gaggccuggcucugcccuccug

SEQ ID NO: 158020 - RNA, 22 nt, Human
augcaguaaauguuaagaaaaa

SEQ ID NO: 158021 - RNA, 22 nt, Human
ggcaguggguggaucucaggga

SEQ ID NO: 158022 - RNA, 21 nt, Human
gggugcuguggucaugcagga

SEQ ID NO: 158023 - RNA, 22 nt, Human
ucucagaguaauucuuuaaggu

SEQ ID NO: 158024 - RNA, 22 nt, Human
uggaggaugccuggggaggccu

SEQ ID NO: 158025 - RNA, 22 nt, Human
gagagcuguaauagucaugucu

SEQ ID NO: 158026 - RNA, 22 nt, Human
ugcaugcagcuggugauaagaa

SEQ ID NO: 158027 - RNA, 22 nt, Human
ggggcagauggaacagagcaca

SEQ ID NO: 158028 - RNA, 22 nt, Human
aucuucaaagcacaucguuugu

SEQ ID NO: 158029 - RNA, 22 nt, Human
agccuggaagaaccugaagucu

SEQ ID NO: 158030 - RNA, 22 nt, Human
ccugcagguugcagaggcggaa

SEQ ID NO: 158031 - RNA, 22 nt, Human
aagaacaacugcuuuaaaagca

SEQ ID NO: 158032 - RNA, 22 nt, Human
gcuggccagggcugcucgcgga

SEQ ID NO: 158033 - RNA, 22 nt, Human
cagagacagaaaauggaucuag

SEQ ID NO: 158034 - RNA, 22 nt, Human
ucuuggagaauggcagagaagc

SEQ ID NO: 158035 - RNA, 22 nt, Human
ccaggcccugcuccucacacca

SEQ ID NO: 158036 - RNA, 22 nt, Human
uggugcaagucucugaggaggg

SEQ ID NO: 158037 - RNA, 19 nt, Human
ccaggccaucccaguuccc

SEQ ID NO: 158038 - RNA, 22 nt, Human
cagggcaggaauuugacauugc

SEQ ID NO: 158039 - RNA, 22 nt, Human
guggccuggauagacuccaucu

SEQ ID NO: 158040 - RNA, 22 nt, Human
acagggcagaaauguugcaucu

SEQ ID NO: 158041 - RNA, 22 nt, Human
cacagggcagaggguccguggc

SEQ ID NO: 158042 - RNA, 22 nt, Human
cagagcuggagggaacccuggc

SEQ ID NO: 158043 - RNA, 22 nt, Human
cuggcuuccucaggagcagugg

SEQ ID NO: 158044 - RNA, 19 nt, Human
uuucaauggcuuagagaaa

SEQ ID NO: 158045 - RNA, 22 nt, Human
gcucuguguccacagcuggaaa

SEQ ID NO: 158046 - RNA, 22 nt, Human
gcgaaaaauguguaaauauguu

SEQ ID NO: 158047 - RNA, 22 nt, Human
cagcuggcaaguggagcagggu

SEQ ID NO: 158048 - RNA, 22 nt, Human
uccuggagaauccugccaccug

SEQ ID NO: 158049 - RNA, 22 nt, Human
uacaaagucaccagcuucuugc

SEQ ID NO: 158050 - RNA, 22 nt, Human
gccugaugagcuuccagcugag

SEQ ID NO: 158051 - RNA, 19 nt, Human
cccagcuugaccaccugcu

SEQ ID NO: 158052 - RNA, 22 nt, Human
acagcagccugcagcccugugu

SEQ ID NO: 158053 - RNA, 22 nt, Human
uuccauaaucaccuuauucuuu

SEQ ID NO: 158054 - RNA, 22 nt, Human
ucuguaguagguuguaguucuu

SEQ ID NO: 158055 - RNA, 22 nt, Human
cugugccuaagaugcaugucuc

SEQ ID NO: 158056 - RNA, 21 nt, Human
ucagcagcaucugccuagagu

SEQ ID NO: 158057 - RNA, 22 nt, Human
auuugucuagugguauucacgu

SEQ ID NO: 158058 - RNA, 22 nt, Human
cacaggugcuccucggggagcu

SEQ ID NO: 158059 - RNA, 22 nt, Human
uggccugccugggagcagcagg

SEQ ID NO: 158060 - RNA, 21 nt, Human
uccauuguuuucccaggguuu

SEQ ID NO: 158061 - RNA, 22 nt, Human
agugcuguccaguuucacaggu

SEQ ID NO: 158062 - RNA, 22 nt, Human
guggaggacaaaagaagccuuu

SEQ ID NO: 158063 - RNA, 22 nt, Human
ggaggccaccugaccugcuguu

SEQ ID NO: 158064 - RNA, 20 nt, Human
cacugaagacuucuugcuca

SEQ ID NO: 158065 - RNA, 22 nt, Human
gcuuagucaauuauaaauaggc

SEQ ID NO: 158066 - RNA, 22 nt, Human
cagucacauggaugauggauag

SEQ ID NO: 158067 - RNA, 22 nt, Human
cccugccuugggguccacaccg

SEQ ID NO: 158068 - RNA, 22 nt, Human
cucagcagugacaagagaguau

SEQ ID NO: 158069 - RNA, 22 nt, Human
acugcuuuuagaaaucuauaga

SEQ ID NO: 158070 - RNA, 20 nt, Human
aacagggggcugcagagggc

SEQ ID NO: 158071 - RNA, 22 nt, Human
uuuugaaagggugauuuggcuu

SEQ ID NO: 158072 - RNA, 22 nt, Human
ugggcacaggggaauggaugaa

SEQ ID NO: 158073 - RNA, 22 nt, Human
ccucagccuuggccccaggcag

SEQ ID NO: 158074 - RNA, 22 nt, Human
gucucagggacugcuucugggg

SEQ ID NO: 158075 - RNA, 22 nt, Human
uggccuccccuaacagccucuu

SEQ ID NO: 158076 - RNA, 22 nt, Human
acugaaggucucagcaaggaug

SEQ ID NO: 158077 - RNA, 22 nt, Human
cagccagguaugggcgugcggg

SEQ ID NO: 158078 - RNA, 22 nt, Human
gggagcuggagcuggaagacuc

SEQ ID NO: 158079 - RNA, 21 nt, Human
ucugggcccaugcugccucac

SEQ ID NO: 158080 - RNA, 22 nt, Human
guggcugcuacagagcuggagg

SEQ ID NO: 158081 - RNA, 19 nt, Human
gcagccaggugcucuaccu

SEQ ID NO: 158082 - RNA, 22 nt, Human
ccuggccugugaaucugagagc

SEQ ID NO: 158083 - RNA, 22 nt, Human
uuucuggcagcgggacaggggu

SEQ ID NO: 158084 - RNA, 22 nt, Human
auccaaaccuggacaugagugg

SEQ ID NO: 158085 - RNA, 17 nt, Human
guccugggaggagagag

SEQ ID NO: 158086 - RNA, 21 nt, Human
gcagcaguguucuagaauacu

SEQ ID NO: 158087 - RNA, 22 nt, Human
uaugcacaauaugaucuauuug

SEQ ID NO: 158088 - RNA, 22 nt, Human
ugugccagccucuggcuguguc

SEQ ID NO: 158089 - RNA, 22 nt, Human
gauccuugcacuugacuuggca

SEQ ID NO: 158090 - RNA, 22 nt, Human
ugcagugguugagagcccagac

SEQ ID NO: 158091 - RNA, 22 nt, Human
ccaaaguccuuucuccaccugc

SEQ ID NO: 158092 - RNA, 22 nt, Human
agcagccauuuaaaaugaauug

SEQ ID NO: 158093 - RNA, 20 nt, Human
ccuccuggucaggugugcag

SEQ ID NO: 158094 - RNA, 23 nt, Human
uagagcagggaaaucugucagag

SEQ ID NO: 158095 - RNA, 22 nt, Human
ggacagcccauacacaugucug

SEQ ID NO: 158096 - RNA, 22 nt, Human
agagcugugaaaaugagguuug

SEQ ID NO: 158097 - RNA, 21 nt, Human
gccauuguuuucuaccuggag

SEQ ID NO: 158098 - RNA, 22 nt, Human
aaaguguacuaugucaugaaca

SEQ ID NO: 158099 - RNA, 22 nt, Human
ucagcagugcagggugaggcag

SEQ ID NO: 158100 - RNA, 22 nt, Human
ccuguguggaaaccgcaugacg

SEQ ID NO: 158101 - RNA, 22 nt, Human
aagcagaugggacuccaaggca

SEQ ID NO: 158102 - RNA, 22 nt, Human
ccuggcugggccugauuucuca

SEQ ID NO: 158103 - RNA, 22 nt, Human
gugggugauguacuggaggcca

SEQ ID NO: 158104 - RNA, 19 nt, Human
augauggucccauucaccu

SEQ ID NO: 158105 - RNA, 22 nt, Human
uugugugguagcuucauugaac

SEQ ID NO: 158106 - RNA, 18 nt, Human
uggagccagcucuaggau

SEQ ID NO: 158107 - RNA, 23 nt, Human
ucugucaccuauggcugcucuuc

SEQ ID NO: 158108 - RNA, 22 nt, Human
ucauucagguugggcaaguguc

SEQ ID NO: 158109 - RNA, 22 nt, Human
gagagaagaauguuccgaggcc

SEQ ID NO: 158110 - RNA, 21 nt, Human
aggcugcuggcucaggguccu

SEQ ID NO: 158111 - RNA, 22 nt, Human
gcccugugcgacucuagagguu

SEQ ID NO: 158112 - RNA, 22 nt, Human
aucccuggacggcgccucccca

SEQ ID NO: 158113 - RNA, 22 nt, Human
ccacacagggggaugaguuauu

SEQ ID NO: 158114 - RNA, 22 nt, Human
agcucacagaaauccugcagga

SEQ ID NO: 158115 - RNA, 22 nt, Human
cccuggagggacagcugcucua

SEQ ID NO: 158116 - RNA, 22 nt, Human
gcugcccauuccacuggauggu

SEQ ID NO: 158117 - RNA, 22 nt, Human
ucuggagcuggcagggcccugg

SEQ ID NO: 158118 - RNA, 22 nt, Human
agcugcuccuuuccugcaggcg

SEQ ID NO: 158119 - RNA, 22 nt, Human
aguucacauuccgagguacugg

SEQ ID NO: 158120 - RNA, 22 nt, Human
gccagguggucuggcuccagag

SEQ ID NO: 158121 - RNA, 22 nt, Human
cagggcuguggcuuugugcugu

SEQ ID NO: 158122 - RNA, 22 nt, Human
ucugucacuauuggccagaaca

SEQ ID NO: 158123 - RNA, 22 nt, Human
gagcugggcacacgccacuuga

SEQ ID NO: 158124 - RNA, 22 nt, Human
gccuggaggggccaggguggua

SEQ ID NO: 158125 - RNA, 18 nt, Human
ggcugugcguggaggcug

SEQ ID NO: 158126 - RNA, 22 nt, Human
agucaaagcuacaggcauuuga

SEQ ID NO: 158127 - RNA, 22 nt, Human
cugcagcuauauuuucccacag

SEQ ID NO: 158128 - RNA, 22 nt, Human
gccucucucuacccaguaugau

SEQ ID NO: 158129 - RNA, 23 nt, Human
ugcugguguuuuugggaccaggg

SEQ ID NO: 158130 - RNA, 22 nt, Human
ucagaggagaaguugggaaaau

SEQ ID NO: 158131 - RNA, 20 nt, Human
cugagcugagcuccaugggu

SEQ ID NO: 158132 - RNA, 22 nt, Human
ugggcagauguggcucuccuug

SEQ ID NO: 158133 - RNA, 22 nt, Human
agccuggagguaaugaggaaac

SEQ ID NO: 158134 - RNA, 22 nt, Human
uguaugugcuugagaagguggg

SEQ ID NO: 158135 - RNA, 22 nt, Human
agggcugcaucugccuggugaa

SEQ ID NO: 158136 - RNA, 22 nt, Human
aaggcugagggcuguaccuggc

SEQ ID NO: 158137 - RNA, 22 nt, Human
caggaguggugugagggacucc

SEQ ID NO: 158138 - RNA, 22 nt, Human
gaaagaagcuuuagauggcuau

SEQ ID NO: 158139 - RNA, 22 nt, Human
ucucuucuuguguuuuccugcc

SEQ ID NO: 158140 - RNA, 22 nt, Human
cuuucacaguccugacugagcg

SEQ ID NO: 158141 - RNA, 22 nt, Human
acagaacugggaaaugcacaua

SEQ ID NO: 158142 - RNA, 22 nt, Human
ccugccagugaagcugacgggc

SEQ ID NO: 158143 - RNA, 22 nt, Human
agguccagcuguugcagccucc

SEQ ID NO: 158144 - RNA, 22 nt, Human
ccugaggacacacgcugcagga

SEQ ID NO: 158145 - RNA, 22 nt, Human
uggccuggcccugaggcccugu

SEQ ID NO: 158146 - RNA, 18 nt, Human
agcagcugucagaaugcc

SEQ ID NO: 158147 - RNA, 22 nt, Human
uggaaagaaaaacaggccauga

SEQ ID NO: 158148 - RNA, 22 nt, Human
gccugcuggcuguccauugcag

SEQ ID NO: 158149 - RNA, 18 nt, Human
ucuuggaguaaugaucaa

SEQ ID NO: 158150 - RNA, 22 nt, Human
aagacagagggaagcaaugaug

SEQ ID NO: 158151 - RNA, 22 nt, Human
gaggcugcuuugaugacaggag

SEQ ID NO: 158152 - RNA, 22 nt, Human
caaauccagaucccagucguag

SEQ ID NO: 158153 - RNA, 22 nt, Human
aaggcugauuagacugauagcu

SEQ ID NO: 158154 - RNA, 22 nt, Human
aaaagguaguugccaaauaagg

SEQ ID NO: 158155 - RNA, 22 nt, Human
cagcugaguuuccaagucugcc

SEQ ID NO: 158156 - RNA, 21 nt, Human
aagccucaagcagaagacaga

SEQ ID NO: 158157 - RNA, 21 nt, Human
uucaaugaaaacaaagugagg

SEQ ID NO: 158158 - RNA, 22 nt, Human
uggggacacagagccaaacuau

SEQ ID NO: 158159 - RNA, 23 nt, Human
uggcucugagcuuccugguggcc

SEQ ID NO: 158160 - RNA, 22 nt, Human
ucccagggacugggcuaggcuu

SEQ ID NO: 158161 - RNA, 22 nt, Human
ccagcugggauuaagggaaaau

SEQ ID NO: 158162 - RNA, 22 nt, Human
gacacagagauaggccuguguu

SEQ ID NO: 158163 - RNA, 22 nt, Human
agagccaggaugucuucugggg

SEQ ID NO: 158164 - RNA, 22 nt, Human
uuaaaguucauuaaaugagcca

SEQ ID NO: 158165 - RNA, 22 nt, Human
gugcaguggcagauccuagcuc

SEQ ID NO: 158166 - RNA, 22 nt, Human
agagcaggcauaaagcuuugaa

SEQ ID NO: 158167 - RNA, 22 nt, Human
gcuggccugcaaagcccggcug

SEQ ID NO: 158168 - RNA, 22 nt, Human
aagaugauguuguguuuucacu

SEQ ID NO: 158169 - RNA, 22 nt, Human
ugggcucauggcccagcacugg

SEQ ID NO: 158170 - RNA, 22 nt, Human
gccugccugaaggcuguaccag

SEQ ID NO: 158171 - RNA, 22 nt, Human
aggcugggcuccgcccaacucc

SEQ ID NO: 158172 - RNA, 22 nt, Human
cccucagcuucucccugcagcu

SEQ ID NO: 158173 - RNA, 22 nt, Human
agcugguggauuaugcuguaca

SEQ ID NO: 158174 - RNA, 22 nt, Human
uagaaauguugguauuaacauu

SEQ ID NO: 158175 - RNA, 22 nt, Human
cauugcacuccacccuaggcaa

SEQ ID NO: 158176 - RNA, 19 nt, Human
aguguguacugaaagcacu

SEQ ID NO: 158177 - RNA, 22 nt, Human
ggcaggugugagaucgaggcca

SEQ ID NO: 158178 - RNA, 22 nt, Human
gcagccacccucaaggcugaau

SEQ ID NO: 158179 - RNA, 22 nt, Human
cacccaggcuagagugcagugg

SEQ ID NO: 158180 - RNA, 22 nt, Human
gaaugcacacgugugugcaugc

SEQ ID NO: 158181 - RNA, 22 nt, Human
ggcugccaggagggaggccagu

SEQ ID NO: 158182 - RNA, 22 nt, Human
gcugcucugaaaaugacuguug

SEQ ID NO: 158183 - RNA, 22 nt, Human
gcccaucaucacuguggaggcu

SEQ ID NO: 158184 - RNA, 23 nt, Human
uggggcugauggagacggaccag

SEQ ID NO: 158185 - RNA, 22 nt, Human
auggccuggccagagcucugcu

SEQ ID NO: 158186 - RNA, 23 nt, Human
uggaccugaaccagugccucugu

SEQ ID NO: 158187 - RNA, 21 nt, Human
gcucccuggcugugugaccug

SEQ ID NO: 158188 - RNA, 22 nt, Human
gguuugcacgauauuuccaugg

SEQ ID NO: 158189 - RNA, 22 nt, Human
gcugggaggaucucucccuguc

SEQ ID NO: 158190 - RNA, 22 nt, Human
gagccuggggacccuccugagu

SEQ ID NO: 158191 - RNA, 22 nt, Human
augcaguacagauaauucuaca

SEQ ID NO: 158192 - RNA, 22 nt, Human
gugcaugucggggugcauguca

SEQ ID NO: 158193 - RNA, 22 nt, Human
ggcucugcagugacuugagggg

SEQ ID NO: 158194 - RNA, 22 nt, Human
gcacugcaucuacuggcaagua

SEQ ID NO: 158195 - RNA, 22 nt, Human
ugagugaggaagcgguggagga

SEQ ID NO: 158196 - RNA, 22 nt, Human
ucagggcacaggccuguggguu

SEQ ID NO: 158197 - RNA, 22 nt, Human
ugguggccaauucacagggcuc

SEQ ID NO: 158198 - RNA, 21 nt, Human
ggcagcccgcccucuccuggc

SEQ ID NO: 158199 - RNA, 22 nt, Human
agcucccauuaucuucugaaac

SEQ ID NO: 158200 - RNA, 22 nt, Human
ugggaugggaucucgcuguguc

SEQ ID NO: 158201 - RNA, 20 nt, Human
cucugcagcaaggccugggu

SEQ ID NO: 158202 - RNA, 22 nt, Human
ucucagaguuuacggggcugaa

SEQ ID NO: 158203 - RNA, 22 nt, Human
cagacuggccacaucugcacug

SEQ ID NO: 158204 - RNA, 22 nt, Human
ccaggccuggccaggggaugcc

SEQ ID NO: 158205 - RNA, 22 nt, Human
ucaggacagccagggugcagac

SEQ ID NO: 158206 - RNA, 22 nt, Human
cagccugcauuuguaucuguau

SEQ ID NO: 158207 - RNA, 18 nt, Human
acauuucuaggugaaagc

SEQ ID NO: 158208 - RNA, 20 nt, Human
gcagcugaaaguaugacacc

SEQ ID NO: 158209 - RNA, 22 nt, Human
ucacagaauagcacuguaagcg

SEQ ID NO: 158210 - RNA, 22 nt, Human
acagccagguaaaggcauggca

SEQ ID NO: 158211 - RNA, 22 nt, Human
gcugagagcggccagcugggaa

SEQ ID NO: 158212 - RNA, 22 nt, Human
cagggguguuuuuggccaggag

SEQ ID NO: 158213 - RNA, 23 nt, Human
agggguggucaguacccgcagug

SEQ ID NO: 158214 - RNA, 22 nt, Human
acauguggucaaucuguguagg

SEQ ID NO: 158215 - RNA, 22 nt, Human
uuguuuucacagcuuugcccgg

SEQ ID NO: 158216 - RNA, 22 nt, Human
augggaggaugcucgggugcuc

SEQ ID NO: 158217 - RNA, 22 nt, Human
uguagaaagaauauguuucaua

SEQ ID NO: 158218 - RNA, 19 nt, Human
ucugucacuggggguauuc

SEQ ID NO: 158219 - RNA, 22 nt, Human
aggcagcccacaggacacagga

SEQ ID NO: 158220 - RNA, 22 nt, Human
uggcccuguguccugcugccag

SEQ ID NO: 158221 - RNA, 22 nt, Human
uccucacauggugagccacaca

SEQ ID NO: 158222 - RNA, 22 nt, Human
aggagaaguaaggcuagaugau

SEQ ID NO: 158223 - RNA, 21 nt, Human
cauuucuauugaugagaaaag

SEQ ID NO: 158224 - RNA, 22 nt, Human
ccagucccgcaugguccagaau

SEQ ID NO: 158225 - RNA, 22 nt, Human
ccaggaguuggagguugcagug

SEQ ID NO: 158226 - RNA, 22 nt, Human
uaauguguccugaaagcuucug

SEQ ID NO: 158227 - RNA, 21 nt, Human
ugucagaaauaagcaugugau

SEQ ID NO: 158228 - RNA, 22 nt, Human
acacugcucacuucuucccuug

SEQ ID NO: 158229 - RNA, 22 nt, Human
aaaugugugcacaaagacagcu

SEQ ID NO: 158230 - RNA, 22 nt, Human
cccaggagguagagguugcagu

SEQ ID NO: 158231 - RNA, 22 nt, Human
ggaggcccagagaggugaagug

SEQ ID NO: 158232 - RNA, 22 nt, Human
aggcacugugcugaugucuuau

SEQ ID NO: 158233 - RNA, 22 nt, Human
gagacaaaaguuggagugcaag

SEQ ID NO: 158234 - RNA, 22 nt, Human
aaaugugucaguuucauucucu

SEQ ID NO: 158235 - RNA, 22 nt, Human
ggccugcugcuaugacuuccug

SEQ ID NO: 158236 - RNA, 22 nt, Human
gagcagugguugaacagaggca

SEQ ID NO: 158237 - RNA, 23 nt, Human
agcuggaggcugucuacucccaa

SEQ ID NO: 158238 - RNA, 22 nt, Human
accccagcccugcuucugggag

SEQ ID NO: 158239 - RNA, 19 nt, Human
cagcucaguuugauucucu

SEQ ID NO: 158240 - RNA, 22 nt, Human
agguggggugagcugcagacua

SEQ ID NO: 158241 - RNA, 22 nt, Human
ugaugggaggugcugcaggacc

SEQ ID NO: 158242 - RNA, 22 nt, Human
cuggaagaggaagccagcugga

SEQ ID NO: 158243 - RNA, 22 nt, Human
caaaguauauuggauugaaugg

SEQ ID NO: 158244 - RNA, 22 nt, Human
cugggagggguagccaauccua

SEQ ID NO: 158245 - RNA, 22 nt, Human
accuggccauccagcuggcauc

SEQ ID NO: 158246 - RNA, 22 nt, Human
gagggauggugugagaggcuca

SEQ ID NO: 158247 - RNA, 22 nt, Human
cagccuucugaaugaacguacu

SEQ ID NO: 158248 - RNA, 22 nt, Human
gcagggagguuugcugaccugg

SEQ ID NO: 158249 - RNA, 22 nt, Human
ugccucagcugaggccgcucca

SEQ ID NO: 158250 - RNA, 22 nt, Human
uugaaggacaucuuguuucuag

SEQ ID NO: 158251 - RNA, 22 nt, Human
cagcucugggugacaggagggc

SEQ ID NO: 158252 - RNA, 19 nt, Human
ucucagagcccuagaggcc

SEQ ID NO: 158253 - RNA, 22 nt, Human
gagugaaaaaggaagggccaua

SEQ ID NO: 158254 - RNA, 22 nt, Human
agcagccaagguaaccugugcu

SEQ ID NO: 158255 - RNA, 22 nt, Human
agguacaguagacagacaguua

SEQ ID NO: 158256 - RNA, 22 nt, Human
uaaauucccaacucugcucuuc

SEQ ID NO: 158257 - RNA, 19 nt, Human
ugucucugaaagaugagcu

SEQ ID NO: 158258 - RNA, 22 nt, Human
gccuggguuccaugaucuccag

SEQ ID NO: 158259 - RNA, 22 nt, Human
aaugcacagcguuccaugcuug

SEQ ID NO: 158260 - RNA, 22 nt, Human
aagcccagaugggagcauuuca

SEQ ID NO: 158261 - RNA, 22 nt, Human
uggaggagggcuggugucugua

SEQ ID NO: 158262 - RNA, 22 nt, Human
acuggaagccaguugacaauca

SEQ ID NO: 158263 - RNA, 22 nt, Human
gcaagcaagcagguagagcuga

SEQ ID NO: 158264 - RNA, 22 nt, Human
gagggcaguagccucguacccu

SEQ ID NO: 158265 - RNA, 21 nt, Human
uugaagcaaggguggcucuga

SEQ ID NO: 158266 - RNA, 22 nt, Human
gccuggugugcgccgcgcagcu

SEQ ID NO: 158267 - RNA, 22 nt, Human
cccagcacaggcaauuccauac

SEQ ID NO: 158268 - RNA, 22 nt, Human
agcaggcuuguuaugucugaga

SEQ ID NO: 158269 - RNA, 22 nt, Human
uggcucaguggcagccgcagcu

SEQ ID NO: 158270 - RNA, 22 nt, Human
cagcauugaucccaggcugugg

SEQ ID NO: 158271 - RNA, 22 nt, Human
gcaguggggaaugcuggggaga

SEQ ID NO: 158272 - RNA, 22 nt, Human
agcugcaggcccaugcucaguc

SEQ ID NO: 158273 - RNA, 22 nt, Human
ugcagcauucuuggccacuacu

SEQ ID NO: 158274 - RNA, 22 nt, Human
uaaauucugaucaaguuccuuc

SEQ ID NO: 158275 - RNA, 22 nt, Human
ggccagggggcuucagacucca

SEQ ID NO: 158276 - RNA, 22 nt, Human
cagcagcugauggggaagugau

SEQ ID NO: 158277 - RNA, 22 nt, Human
gcucagaggaugcuccuuuaug

SEQ ID NO: 158278 - RNA, 22 nt, Human
aaaaaguuucaacugccaacuc

SEQ ID NO: 158279 - RNA, 22 nt, Human
ccuccaggcugaauaucuagaa

SEQ ID NO: 158280 - RNA, 22 nt, Human
cccaccaguacagaugguagau

SEQ ID NO: 158281 - RNA, 22 nt, Human
ccacagaguuacaaaacaguca

SEQ ID NO: 158282 - RNA, 22 nt, Human
ucuuuacaaucuaagcauaguu

SEQ ID NO: 158283 - RNA, 22 nt, Human
uuaagucacuuaucuaaagaca

SEQ ID NO: 158284 - RNA, 22 nt, Human
ucagagaugcagugccaccuac

SEQ ID NO: 158285 - RNA, 22 nt, Human
gcccagcacagcuggaagaguc

SEQ ID NO: 158286 - RNA, 22 nt, Human
cacauggggcgcugcauuggcc

SEQ ID NO: 158287 - RNA, 22 nt, Human
ugucccagcagcuggguucucu

SEQ ID NO: 158288 - RNA, 22 nt, Human
uuugggcaguagauguaucacu

SEQ ID NO: 158289 - RNA, 22 nt, Human
gaagcagccacggggagacaga

SEQ ID NO: 158290 - RNA, 22 nt, Human
auggccugggcccgcuucagau

SEQ ID NO: 158291 - RNA, 22 nt, Human
gaguggggucugggcaucaguc

SEQ ID NO: 158292 - RNA, 22 nt, Human
acuggcagcuguaggaugcaug

SEQ ID NO: 158293 - RNA, 22 nt, Human
ugugccagaaaauaugcugagg

SEQ ID NO: 158294 - RNA, 22 nt, Human
caggaccuggaaugcuugugaa

SEQ ID NO: 158295 - RNA, 22 nt, Human
cuggcugcgucugcucugacag

SEQ ID NO: 158296 - RNA, 22 nt, Human
ggcaguggcuccucucuacucc

SEQ ID NO: 158297 - RNA, 21 nt, Human
ucuuuccugcccaguugcccu

SEQ ID NO: 158298 - RNA, 18 nt, Human
cccucuccugcuaguggg

SEQ ID NO: 158299 - RNA, 22 nt, Human
uccucugcuggaagggcaagag

SEQ ID NO: 158300 - RNA, 22 nt, Human
uuuuugcaccaaccuaauagaa

SEQ ID NO: 158301 - RNA, 22 nt, Human
aagaggucauaccagauaaggg

SEQ ID NO: 158302 - RNA, 22 nt, Human
ggauccuucuuugaccucacag

SEQ ID NO: 158303 - RNA, 22 nt, Human
cagcagcucccauccgcugagc

SEQ ID NO: 158304 - RNA, 22 nt, Human
cugagauggaguuucgcucuuc

SEQ ID NO: 158305 - RNA, 22 nt, Human
aggccucacucucagagcuucu

SEQ ID NO: 158306 - RNA, 22 nt, Human
ucuccucaccaccagcagcaga

SEQ ID NO: 158307 - RNA, 22 nt, Human
gaguguggugaacaggagcacc

SEQ ID NO: 158308 - RNA, 22 nt, Human
agcagggccaacaguaaacacc

SEQ ID NO: 158309 - RNA, 22 nt, Human
agggcagacuaggauggaagug

SEQ ID NO: 158310 - RNA, 22 nt, Human
acuuccugcagcuucucagccc

SEQ ID NO: 158311 - RNA, 22 nt, Human
ugcaggcaggggaugagcagcc

SEQ ID NO: 158312 - RNA, 22 nt, Human
ugccagggcugcuacuggcuga

SEQ ID NO: 158313 - RNA, 20 nt, Human
ccagcugagccaaggggaga

SEQ ID NO: 158314 - RNA, 22 nt, Human
ucaggcugcccguucagggcuc

SEQ ID NO: 158315 - RNA, 22 nt, Human
ccaaagagcuagaauuauaggc

SEQ ID NO: 158316 - RNA, 22 nt, Human
ggcucugcccagaugaagagga

SEQ ID NO: 158317 - RNA, 22 nt, Human
agucucugugagcucccaaugg

SEQ ID NO: 158318 - RNA, 23 nt, Human
uacauuguggauggaguccuggg

SEQ ID NO: 158319 - RNA, 21 nt, Human
uggccucccacacuuccaugg

SEQ ID NO: 158320 - RNA, 22 nt, Human
cugaggcucaagggcagguggg

SEQ ID NO: 158321 - RNA, 22 nt, Human
agauggggcagaauggagccau

SEQ ID NO: 158322 - RNA, 22 nt, Human
gaggccuggcugggaggaggug

SEQ ID NO: 158323 - RNA, 22 nt, Human
ucugggcuuuacacugugcuua

SEQ ID NO: 158324 - RNA, 22 nt, Human
aauguguagauguugcauuccu

SEQ ID NO: 158325 - RNA, 18 nt, Human
acauacauucugucugca

SEQ ID NO: 158326 - RNA, 22 nt, Human
gcagggccagugcagagaggaa

SEQ ID NO: 158327 - RNA, 22 nt, Human
cagagccagcuguccuuggcau

SEQ ID NO: 158328 - RNA, 22 nt, Human
gauuuauuggucuuucauuggu

SEQ ID NO: 158329 - RNA, 22 nt, Human
ggcugugccucaaggcuacuca

SEQ ID NO: 158330 - RNA, 22 nt, Human
cccuggaggucagaggccuggg

SEQ ID NO: 158331 - RNA, 22 nt, Human
cucccaggcacagggaggagcc

SEQ ID NO: 158332 - RNA, 22 nt, Human
gcugagcugcuguucauccugc

SEQ ID NO: 158333 - RNA, 22 nt, Human
uggagcaggaagucuauggcug

SEQ ID NO: 158334 - RNA, 21 nt, Human
ugcuccuuagcugccccugcc

SEQ ID NO: 158335 - RNA, 21 nt, Human
aggcacuguuugugguuuggg

SEQ ID NO: 158336 - RNA, 22 nt, Human
uuuccucugagugagcugggag

SEQ ID NO: 158337 - RNA, 22 nt, Human
guauuuauaggggaaugagagu

SEQ ID NO: 158338 - RNA, 22 nt, Human
gcaggcaguuugcuuuucccuc

SEQ ID NO: 158339 - RNA, 22 nt, Human
ccucccacauugaggacaugcu

SEQ ID NO: 158340 - RNA, 22 nt, Human
cucugaacucuugggcagcaug

SEQ ID NO: 158341 - RNA, 22 nt, Human
ucuggagauaagacagacagau

SEQ ID NO: 158342 - RNA, 22 nt, Human
uggagcaggugggaugucguga

SEQ ID NO: 158343 - RNA, 22 nt, Human
gcuggcccagggucaccuagga

SEQ ID NO: 158344 - RNA, 22 nt, Human
cccagcuugcccaggacugagg

SEQ ID NO: 158345 - RNA, 22 nt, Human
aaaguguggagauugaacuaaa

SEQ ID NO: 158346 - RNA, 22 nt, Human
uucaagaugcacaguggcauuc

SEQ ID NO: 158347 - RNA, 22 nt, Human
gugggaugcaguggugaguggc

SEQ ID NO: 158348 - RNA, 22 nt, Human
agggacagaugaaugacugagu

SEQ ID NO: 158349 - RNA, 22 nt, Human
gcagagcugggucuguauccaa

SEQ ID NO: 158350 - RNA, 22 nt, Human
cacccaggcagguggcugagaa

SEQ ID NO: 158351 - RNA, 22 nt, Human
aguaaugucccuuaaauguggu

SEQ ID NO: 158352 - RNA, 22 nt, Human
auccuugaacuuagacacuagg

SEQ ID NO: 158353 - RNA, 22 nt, Human
ugggcagaauugugguaguuaa

SEQ ID NO: 158354 - RNA, 22 nt, Human
acaaaugccauauauaaauucu

SEQ ID NO: 158355 - RNA, 22 nt, Human
uaugagcuuccaguguugcaug

SEQ ID NO: 158356 - RNA, 22 nt, Human
gcccuggaaucucuccauggga

SEQ ID NO: 158357 - RNA, 18 nt, Human
ucugucuguacaaguauc

SEQ ID NO: 158358 - RNA, 22 nt, Human
ugaugcugagccugggacugac

SEQ ID NO: 158359 - RNA, 22 nt, Human
ugcugcucaaugagaugccauc

SEQ ID NO: 158360 - RNA, 22 nt, Human
aaggcagccgugugacugcaug

SEQ ID NO: 158361 - RNA, 22 nt, Human
aggagcugcuuaaaugguuggu

SEQ ID NO: 158362 - RNA, 22 nt, Human
gaacagcuucuugggagcuggg

SEQ ID NO: 158363 - RNA, 22 nt, Human
aagucacacuagacaacugagg

SEQ ID NO: 158364 - RNA, 22 nt, Human
gagacagcagggccagggccug

SEQ ID NO: 158365 - RNA, 22 nt, Human
uggcuuccgccgcgggccucgg

SEQ ID NO: 158366 - RNA, 22 nt, Human
cagaggccccagaacuagcucu

SEQ ID NO: 158367 - RNA, 22 nt, Human
gagagugucgggggccccagga

SEQ ID NO: 158368 - RNA, 22 nt, Human
cucugcugcccaggccugcuag

SEQ ID NO: 158369 - RNA, 23 nt, Human
acagcaagaggaccagaugugag

SEQ ID NO: 158370 - RNA, 22 nt, Human
gggcacugcuuugcucugucac

SEQ ID NO: 158371 - RNA, 22 nt, Human
ggcacugagcugccuuggggca

SEQ ID NO: 158372 - RNA, 22 nt, Human
gucccagaggacagggucacau

SEQ ID NO: 158373 - RNA, 22 nt, Human
acauuucugcuagaauagguga

SEQ ID NO: 158374 - RNA, 22 nt, Human
ucagggcagccuaaggcaccuc

SEQ ID NO: 158375 - RNA, 20 nt, Human
aggaaaaauggaaacuggag

SEQ ID NO: 158376 - RNA, 22 nt, Human
ucccagagcugauaagccuuua

SEQ ID NO: 158377 - RNA, 22 nt, Human
gggcugucaugugucagugacc

SEQ ID NO: 158378 - RNA, 22 nt, Human
gcagaggcuccauuuuacagau

SEQ ID NO: 158379 - RNA, 22 nt, Human
uaugcacauuaucuaauccauu

SEQ ID NO: 158380 - RNA, 18 nt, Human
cagaugagaugcaaucuc

SEQ ID NO: 158381 - RNA, 22 nt, Human
uggcuuccugcacagugucugc

SEQ ID NO: 158382 - RNA, 22 nt, Human
agggcagcauugccuuucucca

SEQ ID NO: 158383 - RNA, 22 nt, Human
ucagcaauccucccacaggugg

SEQ ID NO: 158384 - RNA, 22 nt, Human
agcagggcagcugaugcgcacg

SEQ ID NO: 158385 - RNA, 22 nt, Human
aaaucaaaagacauguguuuua

SEQ ID NO: 158386 - RNA, 22 nt, Human
cauacauuuugcauauuuacca

SEQ ID NO: 158387 - RNA, 22 nt, Human
ccugccucaucaacuugucgug

SEQ ID NO: 158388 - RNA, 22 nt, Human
ggcugccugggagcccuccucu

SEQ ID NO: 158389 - RNA, 22 nt, Human
aaggaaagacauauaaaugacu

SEQ ID NO: 158390 - RNA, 22 nt, Human
ucaugucaguuucuucuauaaa

SEQ ID NO: 158391 - RNA, 22 nt, Human
uccucugccccagaugaaauuu

SEQ ID NO: 158392 - RNA, 22 nt, Human
ggcagcuggggcagugcccugu

SEQ ID NO: 158393 - RNA, 22 nt, Human
gggcguggauggucagugcagg

SEQ ID NO: 158394 - RNA, 22 nt, Human
uuugcauucuagaaaaauuucu

SEQ ID NO: 158395 - RNA, 22 nt, Human
gaaaauguuuguccggagcuga

SEQ ID NO: 158396 - RNA, 22 nt, Human
ccacaggaccagaggagaucac

SEQ ID NO: 158397 - RNA, 22 nt, Human
agcaccugcuaugugucaggga

SEQ ID NO: 158398 - RNA, 22 nt, Human
uaguuuuuucaacaaauggugc

SEQ ID NO: 158399 - RNA, 22 nt, Human
aguuucuaccgguacauucagg

SEQ ID NO: 158400 - RNA, 19 nt, Human
ggcccaaguacugagugcc

SEQ ID NO: 158401 - RNA, 18 nt, Human
cguuuuuccgggauugca

SEQ ID NO: 158402 - RNA, 22 nt, Human
cccuggagcaucucugcugucu

SEQ ID NO: 158403 - RNA, 22 nt, Human
uccagccuuucuacucacugag

SEQ ID NO: 158404 - RNA, 22 nt, Human
uggggaagggcacccuggagac

SEQ ID NO: 158405 - RNA, 18 nt, Human
gggcccuggcguccgccc

SEQ ID NO: 158406 - RNA, 22 nt, Human
uaagcuauuccugaagaagguu

SEQ ID NO: 158407 - RNA, 19 nt, Human
gccaggagggcucuggcug

SEQ ID NO: 158408 - RNA, 22 nt, Human
gagaaggggugauguggguaau

SEQ ID NO: 158409 - RNA, 22 nt, Human
uacauuaacuuacguccacaug

SEQ ID NO: 158410 - RNA, 19 nt, Human
ggcugccuuuccuuaccag

SEQ ID NO: 158411 - RNA, 22 nt, Human
agaugaaaagauaagcagcaau

SEQ ID NO: 158412 - RNA, 22 nt, Human
ugugcagcuaguccuggacuug

SEQ ID NO: 158413 - RNA, 22 nt, Human
cacuggggaaaacaggcuucuu

SEQ ID NO: 158414 - RNA, 22 nt, Human
augggaggaagagaagaugucu

SEQ ID NO: 158415 - RNA, 22 nt, Human
uggggugguaauacaccguucu

SEQ ID NO: 158416 - RNA, 22 nt, Human
aguggcaguagaugagcugguu

SEQ ID NO: 158417 - RNA, 22 nt, Human
cuuccucccggcccaugcucug

SEQ ID NO: 158418 - RNA, 22 nt, Human
caaaggcaguuacugaaugaag

SEQ ID NO: 158419 - RNA, 22 nt, Human
ccagaagucaggaaugagucuu

SEQ ID NO: 158420 - RNA, 22 nt, Human
ucccagagguugagucacuuau

SEQ ID NO: 158421 - RNA, 22 nt, Human
ccagugcaggugagcaccaggu

SEQ ID NO: 158422 - RNA, 22 nt, Human
agcagcugggcucagagcuggg

SEQ ID NO: 158423 - RNA, 22 nt, Human
acagccagaggagccaggcugg

SEQ ID NO: 158424 - RNA, 22 nt, Human
gggugcaggcagcccaggcagg

SEQ ID NO: 158425 - RNA, 22 nt, Human
accagagcagacuacuggaggu

SEQ ID NO: 158426 - RNA, 22 nt, Human
gucccaggcagagucaggaggg

SEQ ID NO: 158427 - RNA, 22 nt, Human
cuggggugugcucagagcaggg

SEQ ID NO: 158428 - RNA, 22 nt, Human
ccucuggucccagcucugcugc

SEQ ID NO: 158429 - RNA, 22 nt, Human
agaggcaguauacaauccgagc

SEQ ID NO: 158430 - RNA, 22 nt, Human
cugaaugucgaucagcuugggu

SEQ ID NO: 158431 - RNA, 22 nt, Human
uuagaaaggagcuuauuucuuu

SEQ ID NO: 158432 - RNA, 22 nt, Human
aaggaggaauuucagggugaau

SEQ ID NO: 158433 - RNA, 22 nt, Human
ugacacauuaaaugcucacaaa

SEQ ID NO: 158434 - RNA, 22 nt, Human
agagcugggugaagugccauca

SEQ ID NO: 158435 - RNA, 22 nt, Human
ucaaaugcacguagagaaaaua

SEQ ID NO: 158436 - RNA, 22 nt, Human
aaaugcuguaacugauauucug

SEQ ID NO: 158437 - RNA, 22 nt, Human
aggcacugacagauucuguguc

SEQ ID NO: 158438 - RNA, 22 nt, Human
cccuggaggaaaaucugaggcu

SEQ ID NO: 158439 - RNA, 22 nt, Human
cacugcagcaccaugcagggcu

SEQ ID NO: 158440 - RNA, 22 nt, Human
aagaggaaaugauugacuauau

SEQ ID NO: 158441 - RNA, 22 nt, Human
acugcaucugaaacauggguca

SEQ ID NO: 158442 - RNA, 22 nt, Human
ccagggcaggggcuggaguuca

SEQ ID NO: 158443 - RNA, 22 nt, Human
ugucauuuaguccucugugugu

SEQ ID NO: 158444 - RNA, 22 nt, Human
auguaacuucugugaaucugac

SEQ ID NO: 158445 - RNA, 22 nt, Human
cuuggcagagggcugggcucag

SEQ ID NO: 158446 - RNA, 22 nt, Human
agcccucauggaacagcuccua

SEQ ID NO: 158447 - RNA, 22 nt, Human
cuagaaaugcucaagagaaagu

SEQ ID NO: 158448 - RNA, 22 nt, Human
ggaggcucugcuccguguguuc

SEQ ID NO: 158449 - RNA, 22 nt, Human
cagcaauauacacagucuaugg

SEQ ID NO: 158450 - RNA, 22 nt, Human
agaaaacauuacauaggugugu

SEQ ID NO: 158451 - RNA, 20 nt, Human
agugucuggugcagggccuc

SEQ ID NO: 158452 - RNA, 22 nt, Human
agggcagagauuaauuaagaca

SEQ ID NO: 158453 - RNA, 22 nt, Human
uggcucuguuuguuaacuagac

SEQ ID NO: 158454 - RNA, 22 nt, Human
caggcagcaggagcccugcucg

SEQ ID NO: 158455 - RNA, 18 nt, Human
aaugcacacauuuacucc

SEQ ID NO: 158456 - RNA, 22 nt, Human
cagcugcccauccugggaaaug

SEQ ID NO: 158457 - RNA, 20 nt, Human
aguguuccggaagacuggca

SEQ ID NO: 158458 - RNA, 22 nt, Human
uuagaaacccagacucuuaggu

SEQ ID NO: 158459 - RNA, 22 nt, Human
gggccaggucggugaaugguca

SEQ ID NO: 158460 - RNA, 22 nt, Human
agggcugccugacuccagagcc

SEQ ID NO: 158461 - RNA, 22 nt, Human
gggagggauuaguucugccugg

SEQ ID NO: 158462 - RNA, 22 nt, Human
augauugaccaucugcugggcu

SEQ ID NO: 158463 - RNA, 22 nt, Human
uccuugaaaggggcugcagggc

SEQ ID NO: 158464 - RNA, 22 nt, Human
auugaaagauuuugggcucaug

SEQ ID NO: 158465 - RNA, 22 nt, Human
cuucacauguuggaguccuuug

SEQ ID NO: 158466 - RNA, 22 nt, Human
ucuuuccuaggugauaugcaau

SEQ ID NO: 158467 - RNA, 22 nt, Human
agagcugcccacacagcagauu

SEQ ID NO: 158468 - RNA, 22 nt, Human
gcucaggaaaacagucuaguaa

SEQ ID NO: 158469 - RNA, 22 nt, Human
cagcugccccauaaaucacagu

SEQ ID NO: 158470 - RNA, 22 nt, Human
caggguagacaguaggugucug

SEQ ID NO: 158471 - RNA, 22 nt, Human
uuuugucuaagaacuuugcaaa

SEQ ID NO: 158472 - RNA, 22 nt, Human
acagagcugggugcccccugga

SEQ ID NO: 158473 - RNA, 22 nt, Human
cucuggccagagccugcgggaa

SEQ ID NO: 158474 - RNA, 22 nt, Human
cuggagagggagcccuggcagu

SEQ ID NO: 158475 - RNA, 22 nt, Human
gcccuggccuucaucucagaca

SEQ ID NO: 158476 - RNA, 22 nt, Human
uccuuuuugguccaaggugacc

SEQ ID NO: 158477 - RNA, 22 nt, Human
cacucugacuggcccugcagga

SEQ ID NO: 158478 - RNA, 22 nt, Human
ugauuuccuaggucuggagaag

SEQ ID NO: 158479 - RNA, 22 nt, Human
ugaaggcauugaugaaggaauc

SEQ ID NO: 158480 - RNA, 22 nt, Human
gcuggccuccugcuagauggaa

SEQ ID NO: 158481 - RNA, 22 nt, Human
ucacaugcccuguauuuaccag

SEQ ID NO: 158482 - RNA, 22 nt, Human
gagcugcuucugugugccgggu

SEQ ID NO: 158483 - RNA, 22 nt, Human
ucuggccacccgaggccccugc

SEQ ID NO: 158484 - RNA, 22 nt, Human
gcuuggaaguaggauugggaga

SEQ ID NO: 158485 - RNA, 22 nt, Human
gcagcugaauguccauugcugc

SEQ ID NO: 158486 - RNA, 22 nt, Human
ccucgaccuccccaggcucagg

SEQ ID NO: 158487 - RNA, 22 nt, Human
ccuggaaggugaugguacagca

SEQ ID NO: 158488 - RNA, 22 nt, Human
gggagagagagcucauguugaa

SEQ ID NO: 158489 - RNA, 22 nt, Human
agaaugcauuuuguguagcuau

SEQ ID NO: 158490 - RNA, 22 nt, Human
uguauuagaucugagaacuucu

SEQ ID NO: 158491 - RNA, 23 nt, Human
uggcucucucagugcugcagagg

SEQ ID NO: 158492 - RNA, 22 nt, Human
cuccucacacccacugcaacca

SEQ ID NO: 158493 - RNA, 22 nt, Human
gcacagccagcaucugagggau

SEQ ID NO: 158494 - RNA, 22 nt, Human
gcagccagaagacucagaacaa

SEQ ID NO: 158495 - RNA, 20 nt, Human
ggccuuggccucuuugcagc

SEQ ID NO: 158496 - RNA, 22 nt, Human
agaucaaagccaugagagauuu

SEQ ID NO: 158497 - RNA, 22 nt, Human
gaggaagcagggcuuggcugag

SEQ ID NO: 158498 - RNA, 22 nt, Human
uccucagggaagaugagccuca

SEQ ID NO: 158499 - RNA, 22 nt, Human
auccaguuuaugucauauucuu

SEQ ID NO: 158500 - RNA, 19 nt, Human
uggggccuccugucccugg

SEQ ID NO: 158501 - RNA, 22 nt, Human
cugucucuguugccuguaggug

SEQ ID NO: 158502 - RNA, 22 nt, Human
uggcccgaccucugcucaugca

SEQ ID NO: 158503 - RNA, 22 nt, Human
ugcucuguaaggucagaaaagg

SEQ ID NO: 158504 - RNA, 22 nt, Human
uggagcagcuaagccucugaga

SEQ ID NO: 158505 - RNA, 22 nt, Human
ucccagaguucaaugggaaggu

SEQ ID NO: 158506 - RNA, 17 nt, Human
aggccucccuccaggcc

SEQ ID NO: 158507 - RNA, 22 nt, Human
gcucucuggaggccauggacag

SEQ ID NO: 158508 - RNA, 22 nt, Human
ucccagcauuaaugccugucag

SEQ ID NO: 158509 - RNA, 22 nt, Human
ccugggcucuauccugacccag

SEQ ID NO: 158510 - RNA, 22 nt, Human
aucuacagcugucugcacagua

SEQ ID NO: 158511 - RNA, 22 nt, Human
agccuccaguagcugaagagac

SEQ ID NO: 158512 - RNA, 22 nt, Human
caagcagacaguaggccuagaa

SEQ ID NO: 158513 - RNA, 22 nt, Human
cagugcuccugauguacccuug

SEQ ID NO: 158514 - RNA, 22 nt, Human
acagggcccuugccagcacaag

SEQ ID NO: 158515 - RNA, 22 nt, Human
aggcccuguccauggugcugaa

SEQ ID NO: 158516 - RNA, 22 nt, Human
uggaagggggaagacagcucug

SEQ ID NO: 158517 - RNA, 22 nt, Human
uuccuguaugucagugaagagc

SEQ ID NO: 158518 - RNA, 22 nt, Human
acauuucugagcagggagcugu

SEQ ID NO: 158519 - RNA, 22 nt, Human
gugccugguuuggggaguguuc

SEQ ID NO: 158520 - RNA, 21 nt, Human
ucagggcagugggagguuccu

SEQ ID NO: 158521 - RNA, 22 nt, Human
gcagcuggagccagccagacac

SEQ ID NO: 158522 - RNA, 18 nt, Human
uggccuggagacaacucu

SEQ ID NO: 158523 - RNA, 22 nt, Human
ggagccagagggaugcaguuga

SEQ ID NO: 158524 - RNA, 22 nt, Human
ugugcugguacaugugaggaug

SEQ ID NO: 158525 - RNA, 22 nt, Human
ugugaugguucacugggcauga

SEQ ID NO: 158526 - RNA, 22 nt, Human
cugcaagauuggaagaugcaau

SEQ ID NO: 158527 - RNA, 22 nt, Human
gcuguccucuuggacucagggc

SEQ ID NO: 158528 - RNA, 22 nt, Human
ccagggagccuggugugucagc

SEQ ID NO: 158529 - RNA, 22 nt, Human
ggugccaggcucccagcucagg

SEQ ID NO: 158530 - RNA, 22 nt, Human
agauuuccugcacugccuuuga

SEQ ID NO: 158531 - RNA, 22 nt, Human
cagcucugaggaacacuccuuu

SEQ ID NO: 158532 - RNA, 22 nt, Human
ccccuuccuuccucagacagcc

SEQ ID NO: 158533 - RNA, 22 nt, Human
gaggcuggcagaaaagcacagg

SEQ ID NO: 158534 - RNA, 22 nt, Human
aagugacaaaaggguauccaaa

SEQ ID NO: 158535 - RNA, 22 nt, Human
ucagggcaccaaaaaagaugcc

SEQ ID NO: 158536 - RNA, 22 nt, Human
cagucccacaagaucuccacaa

SEQ ID NO: 158537 - RNA, 22 nt, Human
cucccuggcuuuguccugaggc

SEQ ID NO: 158538 - RNA, 22 nt, Human
ucacuuaaaaauucuaguuaug

SEQ ID NO: 158539 - RNA, 22 nt, Human
uuuccucuuugugacacagcug

SEQ ID NO: 158540 - RNA, 22 nt, Human
gcagagcuucuguccuucagga

SEQ ID NO: 158541 - RNA, 22 nt, Human
ucagagagccucaggcacugcc

SEQ ID NO: 158542 - RNA, 22 nt, Human
uuagcugcauuaucaaaguuau

SEQ ID NO: 158543 - RNA, 20 nt, Human
aggcacuggggauagguaag

SEQ ID NO: 158544 - RNA, 22 nt, Human
cuccucuggcuuccuggaggca

SEQ ID NO: 158545 - RNA, 22 nt, Human
agcagggggaguuagacuagau

SEQ ID NO: 158546 - RNA, 22 nt, Human
ugagaggcagaauggugccugc

SEQ ID NO: 158547 - RNA, 22 nt, Human
uuguuaaaaugcauauucuggu

SEQ ID NO: 158548 - RNA, 22 nt, Human
agguggguaucaugagagauua

SEQ ID NO: 158549 - RNA, 22 nt, Human
aggccagcuguuacuagagcca

SEQ ID NO: 158550 - RNA, 20 nt, Human
cccugagaccagagagcagc

SEQ ID NO: 158551 - RNA, 22 nt, Human
acagggccucagccagggcaga

SEQ ID NO: 158552 - RNA, 22 nt, Human
cuggagccgcauggagcaggga

SEQ ID NO: 158553 - RNA, 22 nt, Human
cccugggcaagcccuauuuucc

SEQ ID NO: 158554 - RNA, 22 nt, Human
ccugccugaaggucagccaccc

SEQ ID NO: 158555 - RNA, 22 nt, Human
cgugucaucugagccuugggcg

SEQ ID NO: 158556 - RNA, 22 nt, Human
ugugccugucacccucagagag

SEQ ID NO: 158557 - RNA, 22 nt, Human
agucccagcuacucaagaggcu

SEQ ID NO: 158558 - RNA, 22 nt, Human
augauggugggagaugacccag

SEQ ID NO: 158559 - RNA, 22 nt, Human
aauaauuuccagccaacuggaa

SEQ ID NO: 158560 - RNA, 18 nt, Human
uggcagccagcugcuccu

SEQ ID NO: 158561 - RNA, 22 nt, Human
uccuugaagcaacgugcagaca

SEQ ID NO: 158562 - RNA, 22 nt, Human
agcugcugcgccucacccuggc

SEQ ID NO: 158563 - RNA, 22 nt, Human
agagccuggcucccagcuaccg

SEQ ID NO: 158564 - RNA, 22 nt, Human
caggcugcagcagcaguggccc

SEQ ID NO: 158565 - RNA, 22 nt, Human
acuuucucaaaucagacuuuaa

SEQ ID NO: 158566 - RNA, 22 nt, Human
ccaguggguaggccauggugag

SEQ ID NO: 158567 - RNA, 22 nt, Human
uuucuagaggcuccaggggagu

SEQ ID NO: 158568 - RNA, 22 nt, Human
uauagaagagacaugugcauag

SEQ ID NO: 158569 - RNA, 22 nt, Human
cagcugucuaaguugagcagga

SEQ ID NO: 158570 - RNA, 22 nt, Human
ugggccugauucuugaauccug

SEQ ID NO: 158571 - RNA, 22 nt, Human
ggcugcucuucuuggcgaccuc

SEQ ID NO: 158572 - RNA, 20 nt, Human
ggccugagcauggcuggcag

SEQ ID NO: 158573 - RNA, 22 nt, Human
cuuaacagauacaucugugguu

SEQ ID NO: 158574 - RNA, 22 nt, Human
agaaugcaguuugaaauaaggu

SEQ ID NO: 158575 - RNA, 22 nt, Human
agcugccagaugacagugcuau

SEQ ID NO: 158576 - RNA, 19 nt, Human
auaaggcagugacuuuuuu

SEQ ID NO: 158577 - RNA, 22 nt, Human
ggccugcucugcagccucuaca

SEQ ID NO: 158578 - RNA, 22 nt, Human
guucccauacaguaucagugcu

SEQ ID NO: 158579 - RNA, 22 nt, Human
ggcagauggaagaggcuggguc

SEQ ID NO: 158580 - RNA, 22 nt, Human
gaguuguucaacgugugugaaa

SEQ ID NO: 158581 - RNA, 22 nt, Human
gggucagcugcugggggcugac

SEQ ID NO: 158582 - RNA, 22 nt, Human
cucaggaggaggaaguucauug

SEQ ID NO: 158583 - RNA, 22 nt, Human
cagcccuggugccaagguuccc

SEQ ID NO: 158584 - RNA, 22 nt, Human
gccuggucucuuucaugucagu

SEQ ID NO: 158585 - RNA, 22 nt, Human
cagguacacucccuugugcuga

SEQ ID NO: 158586 - RNA, 22 nt, Human
gccagaaacauacacaucacuu

SEQ ID NO: 158587 - RNA, 22 nt, Human
gcugugcacuaccuauacaucc

SEQ ID NO: 158588 - RNA, 22 nt, Human
auaauaacaccugaauaggaaa

SEQ ID NO: 158589 - RNA, 22 nt, Human
ccuggaagauucaccacuacca

SEQ ID NO: 158590 - RNA, 18 nt, Human
ugacucacccugucagug

SEQ ID NO: 158591 - RNA, 23 nt, Human
cagcugaagcagccugggcugga

SEQ ID NO: 158592 - RNA, 22 nt, Human
gggagccuugggagugccagcc

SEQ ID NO: 158593 - RNA, 22 nt, Human
gcaggaugggagcuucacuuug

SEQ ID NO: 158594 - RNA, 22 nt, Human
gcugugcagccaagugccucug

SEQ ID NO: 158595 - RNA, 22 nt, Human
ucaggggcugugcauuucccag

SEQ ID NO: 158596 - RNA, 22 nt, Human
ggagcagagcauuucacagccu

SEQ ID NO: 158597 - RNA, 22 nt, Human
aggcucagauccuuguguccug

SEQ ID NO: 158598 - RNA, 22 nt, Human
gaauucuuuucuuucugaaagu

SEQ ID NO: 158599 - RNA, 22 nt, Human
aguguuguaugggaugacugcu

SEQ ID NO: 158600 - RNA, 22 nt, Human
auugcaccuuggguuuugaaag

SEQ ID NO: 158601 - RNA, 22 nt, Human
agagcagauggagcuggaagag

SEQ ID NO: 158602 - RNA, 22 nt, Human
ucugcaggaggcuggcugcagg

SEQ ID NO: 158603 - RNA, 22 nt, Human
gcagcagaggcccuacucuuug

SEQ ID NO: 158604 - RNA, 22 nt, Human
agugucauuccagggacccucg

SEQ ID NO: 158605 - RNA, 22 nt, Human
gaaggaaaaauacucuguaagg

SEQ ID NO: 158606 - RNA, 22 nt, Human
gggaguguugagcgcccugcca

SEQ ID NO: 158607 - RNA, 22 nt, Human
cccagcuaccucugcuaggaga

SEQ ID NO: 158608 - RNA, 19 nt, Human
ccaggccuccugggagguc

SEQ ID NO: 158609 - RNA, 22 nt, Human
uaagaauuguguugaauagagu

SEQ ID NO: 158610 - RNA, 22 nt, Human
uaagaacagugucugucucaca

SEQ ID NO: 158611 - RNA, 22 nt, Human
cccagggaaugacucuggccuu

SEQ ID NO: 158612 - RNA, 22 nt, Human
gccuccccugcaauuguccuug

SEQ ID NO: 158613 - RNA, 22 nt, Human
uccugccuucauacugcuguau

SEQ ID NO: 158614 - RNA, 22 nt, Human
gagauuucuuuugaugccuguc

SEQ ID NO: 158615 - RNA, 22 nt, Human
gaggcugcugagagcccuguuu

SEQ ID NO: 158616 - RNA, 22 nt, Human
aagccagguuccauggaggagc

SEQ ID NO: 158617 - RNA, 22 nt, Human
cccaggaggcagaaguugcagu

SEQ ID NO: 158618 - RNA, 22 nt, Human
aagcgccaugguuccugcgcag

SEQ ID NO: 158619 - RNA, 22 nt, Human
cccugcagccggccagcucauu

SEQ ID NO: 158620 - RNA, 22 nt, Human
uucauucccaagaguaaacaua

SEQ ID NO: 158621 - RNA, 22 nt, Human
uaacagaagaugaaacuucuuu

SEQ ID NO: 158622 - RNA, 22 nt, Human
ggccagaggccacagcuguguc

SEQ ID NO: 158623 - RNA, 22 nt, Human
caggaacauuuaaccacagggu

SEQ ID NO: 158624 - RNA, 22 nt, Human
cccagccucuguuugcuccucu

SEQ ID NO: 158625 - RNA, 22 nt, Human
auguguccacaggugugagaga

SEQ ID NO: 158626 - RNA, 22 nt, Human
ucuuacauauagcaugaguaca

SEQ ID NO: 158627 - RNA, 22 nt, Human
gaaggagagggucaaggauaau

SEQ ID NO: 158628 - RNA, 22 nt, Human
gcacagggagacagccguggcc

SEQ ID NO: 158629 - RNA, 22 nt, Human
acagaguauuggaaaggcagug

SEQ ID NO: 158630 - RNA, 23 nt, Human
ggccuccuggucuaggcuagacu

SEQ ID NO: 158631 - RNA, 22 nt, Human
ucugggcucuuaguguacccuc

SEQ ID NO: 158632 - RNA, 22 nt, Human
cacauaaguggguuccauugca

SEQ ID NO: 158633 - RNA, 22 nt, Human
aacaaauggggccuuguaugaa

SEQ ID NO: 158634 - RNA, 22 nt, Human
uuguaacaaucugucauaaaug

SEQ ID NO: 158635 - RNA, 22 nt, Human
cugcccugagggccuguguguu

SEQ ID NO: 158636 - RNA, 22 nt, Human
ugcauuaugcuacccagaagcu

SEQ ID NO: 158637 - RNA, 23 nt, Human
cuugcagggcuggaggcuuagaa

SEQ ID NO: 158638 - RNA, 22 nt, Human
cagaagcauugacuccuugcuc

SEQ ID NO: 158639 - RNA, 22 nt, Human
auguuaaaugguuuauuauuaa

SEQ ID NO: 158640 - RNA, 22 nt, Human
cuggggcucucuggaaugcuug

SEQ ID NO: 158641 - RNA, 22 nt, Human
ugggccuggacaaggccacuag

SEQ ID NO: 158642 - RNA, 19 nt, Human
agcagcuggagguggagug

SEQ ID NO: 158643 - RNA, 22 nt, Human
gagcucauucauucauugccug

SEQ ID NO: 158644 - RNA, 22 nt, Human
cagagggcucaguccugcugga

SEQ ID NO: 158645 - RNA, 22 nt, Human
ucaggcagaugcagggauggau

SEQ ID NO: 158646 - RNA, 22 nt, Human
ggcaggcaggagcgugcuuggg

SEQ ID NO: 158647 - RNA, 21 nt, Human
cagcaaaucauugggcagacu

SEQ ID NO: 158648 - RNA, 22 nt, Human
guacaugucaaaaaaugcauaa

SEQ ID NO: 158649 - RNA, 22 nt, Human
cucuucagauaaaagggauauu

SEQ ID NO: 158650 - RNA, 22 nt, Human
guggcuucacauggcauuuggc

SEQ ID NO: 158651 - RNA, 22 nt, Human
agcagaacauuuucagggcugu

SEQ ID NO: 158652 - RNA, 22 nt, Human
ggaaggaggaugcucuggccuu

SEQ ID NO: 158653 - RNA, 22 nt, Human
gugcuuccccaagccacagccu

SEQ ID NO: 158654 - RNA, 22 nt, Human
guccucuguguaggcugcagac

SEQ ID NO: 158655 - RNA, 22 nt, Human
agcagaaccugcagaccugucu

SEQ ID NO: 158656 - RNA, 22 nt, Human
gcccugcugucuucagaguaua

SEQ ID NO: 158657 - RNA, 22 nt, Human
uguaucaaaccaaauuaauucu

SEQ ID NO: 158658 - RNA, 22 nt, Human
cugggaggcggagguuguagug

SEQ ID NO: 158659 - RNA, 22 nt, Human
uggcucagcauucacuggucuu

SEQ ID NO: 158660 - RNA, 22 nt, Human
uggcugccuagugucugagcag

SEQ ID NO: 158661 - RNA, 22 nt, Human
ugagugccugaacauagaguag

SEQ ID NO: 158662 - RNA, 22 nt, Human
ccaggggaaacagggagcacuc

SEQ ID NO: 158663 - RNA, 22 nt, Human
ugccacagaggugaagcccacu

SEQ ID NO: 158664 - RNA, 22 nt, Human
agaaguuaccacauacuucucu

SEQ ID NO: 158665 - RNA, 22 nt, Human
caggugcugcguggcggagcug

SEQ ID NO: 158666 - RNA, 22 nt, Human
ucucagggccccaaaggcuagu

SEQ ID NO: 158667 - RNA, 22 nt, Human
ccuguggcucucuuuggagguc

SEQ ID NO: 158668 - RNA, 22 nt, Human
gcugccuguccugaggaguccg

SEQ ID NO: 158669 - RNA, 22 nt, Human
ccaggcuggagugcaauggugc

SEQ ID NO: 158670 - RNA, 22 nt, Human
ucauugcagcuucagguguuca

SEQ ID NO: 158671 - RNA, 22 nt, Human
ugcaauaaagugcuauaaaucc

SEQ ID NO: 158672 - RNA, 22 nt, Human
agagaagagcaaugauaaauuu

SEQ ID NO: 158673 - RNA, 22 nt, Human
uaaaaguggauaagcuguagga

SEQ ID NO: 158674 - RNA, 22 nt, Human
agaugagggguagaaaggacuu

SEQ ID NO: 158675 - RNA, 18 nt, Human
uggagcaggaagccuggc

SEQ ID NO: 158676 - RNA, 22 nt, Human
auccagggauaaaaguaagguu

SEQ ID NO: 158677 - RNA, 22 nt, Human
aaaaguauuggccaccauuucu

SEQ ID NO: 158678 - RNA, 22 nt, Human
agggcuggcaucucuaaugcug

SEQ ID NO: 158679 - RNA, 22 nt, Human
cagaccuggaaaacaggcuugc

SEQ ID NO: 158680 - RNA, 22 nt, Human
ugcugggcuaggguggagcucu

SEQ ID NO: 158681 - RNA, 22 nt, Human
gcagccacugggagugcuuaua

SEQ ID NO: 158682 - RNA, 22 nt, Human
acagguggccccgagggagugg

SEQ ID NO: 158683 - RNA, 22 nt, Human
ugcagaagaccuuccagggcug

SEQ ID NO: 158684 - RNA, 22 nt, Human
aggccuggugugccggaugcag

SEQ ID NO: 158685 - RNA, 22 nt, Human
agaauuuuugauuaucuacucg

SEQ ID NO: 158686 - RNA, 19 nt, Human
gcccugcaggagguggggc

SEQ ID NO: 158687 - RNA, 22 nt, Human
ccaggcagagggauccccaucc

SEQ ID NO: 158688 - RNA, 22 nt, Human
ggccucucucccuggcuugcag

SEQ ID NO: 158689 - RNA, 22 nt, Human
gaagaagcaggaguguguagca

SEQ ID NO: 158690 - RNA, 22 nt, Human
gagagugaggcaucaggggcag

SEQ ID NO: 158691 - RNA, 22 nt, Human
ucuguuuaggcaaaauagcuac

SEQ ID NO: 158692 - RNA, 18 nt, Human
agugugugcccuuucagg

SEQ ID NO: 158693 - RNA, 18 nt, Human
cacaggcucccagugagg

SEQ ID NO: 158694 - RNA, 22 nt, Human
ccagguggacggcgaguacagg

SEQ ID NO: 158695 - RNA, 22 nt, Human
aucauguuccagaaacagugau

SEQ ID NO: 158696 - RNA, 22 nt, Human
uuuccucugggcccugccaccc

SEQ ID NO: 158697 - RNA, 22 nt, Human
gcacugaaaauguuggauucca

SEQ ID NO: 158698 - RNA, 22 nt, Human
gggcagcucucacagcagccaa

SEQ ID NO: 158699 - RNA, 22 nt, Human
cauuuacagugagaguuuuuac

SEQ ID NO: 158700 - RNA, 22 nt, Human
gagcuuccauggacgccaucug

SEQ ID NO: 158701 - RNA, 22 nt, Human
guggccuggaguuugauguagg

SEQ ID NO: 158702 - RNA, 22 nt, Human
caggugggccaugaaaaaugac

SEQ ID NO: 158703 - RNA, 22 nt, Human
uagggcagccacccaggcugcu

SEQ ID NO: 158704 - RNA, 22 nt, Human
uuuccucuucgauuaaguuugg

SEQ ID NO: 158705 - RNA, 20 nt, Human
auaauuuacccugcaccacu

SEQ ID NO: 158706 - RNA, 22 nt, Human
uaaauguguuguggaugaaguu

SEQ ID NO: 158707 - RNA, 22 nt, Human
cccuguccuuggcugugaggcu

SEQ ID NO: 158708 - RNA, 22 nt, Human
agagccuguuuugugggagaug

SEQ ID NO: 158709 - RNA, 22 nt, Human
ggaagggcaaaagagaugaacu

SEQ ID NO: 158710 - RNA, 22 nt, Human
acacaguaccccaaggcugggc

SEQ ID NO: 158711 - RNA, 22 nt, Human
accacuguaucuccagcacauu

SEQ ID NO: 158712 - RNA, 22 nt, Human
ggucauugucagagccuguacu

SEQ ID NO: 158713 - RNA, 22 nt, Human
cuggccagcauuuuugcuuuag

SEQ ID NO: 158714 - RNA, 22 nt, Human
cugggcagccucacacaauguu

SEQ ID NO: 158715 - RNA, 22 nt, Human
aaaucugggagcagcucggcca

SEQ ID NO: 158716 - RNA, 22 nt, Human
agccacaggaaacagagacagc

SEQ ID NO: 158717 - RNA, 22 nt, Human
caagggaguuacugagggcggg

SEQ ID NO: 158718 - RNA, 22 nt, Human
agcugaguuaauucaucacuua

SEQ ID NO: 158719 - RNA, 22 nt, Human
augucccaagauacagcuagag

SEQ ID NO: 158720 - RNA, 22 nt, Human
uuuccuucaucaucugagagcu

SEQ ID NO: 158721 - RNA, 22 nt, Human
cucucuguuaugcuuucaugaa

SEQ ID NO: 158722 - RNA, 22 nt, Human
gccagcaguauguccuggcagu

SEQ ID NO: 158723 - RNA, 22 nt, Human
acuuugaaggggaacauuuuaa

SEQ ID NO: 158724 - RNA, 22 nt, Human
accaaggaagagauucucaguu

SEQ ID NO: 158725 - RNA, 22 nt, Human
cauggcagaaaccugagcugcu

SEQ ID NO: 158726 - RNA, 22 nt, Human
ugcugcacucaccaacagauaa

SEQ ID NO: 158727 - RNA, 22 nt, Human
ccugccagcccgcguucaugcc

SEQ ID NO: 158728 - RNA, 23 nt, Human
aggagaagagauuuccacaugca

SEQ ID NO: 158729 - RNA, 21 nt, Human
agugaaauugcaucagaggga

SEQ ID NO: 158730 - RNA, 22 nt, Human
gcugcucucucccuaaguuggg

SEQ ID NO: 158731 - RNA, 22 nt, Human
cccugggacccgcugcagaggc

SEQ ID NO: 158732 - RNA, 22 nt, Human
gucucagaguccuacuuauucc

SEQ ID NO: 158733 - RNA, 22 nt, Human
ucuggcucacuucaggcuucac

SEQ ID NO: 158734 - RNA, 22 nt, Human
ucugucacucccugaugaugaa

SEQ ID NO: 158735 - RNA, 22 nt, Human
uguuuuauuucuccaagaggga

SEQ ID NO: 158736 - RNA, 22 nt, Human
ucucuggaauuuugagagugac

SEQ ID NO: 158737 - RNA, 22 nt, Human
acagaccaaguuuccagcaggu

SEQ ID NO: 158738 - RNA, 22 nt, Human
gacccaggguuucugcacaggg

SEQ ID NO: 158739 - RNA, 22 nt, Human
ugaagccagcuuuggaagacac

SEQ ID NO: 158740 - RNA, 22 nt, Human
acccagaggcggagguugcagu

SEQ ID NO: 158741 - RNA, 22 nt, Human
aacagacagaaaaaugugaucu

SEQ ID NO: 158742 - RNA, 22 nt, Human
aggccaggcaacauucugaagu

SEQ ID NO: 158743 - RNA, 22 nt, Human
gggaguggagagcaauggauga

SEQ ID NO: 158744 - RNA, 22 nt, Human
aaguccaucucugccccacaca

SEQ ID NO: 158745 - RNA, 22 nt, Human
aagauucucagagugaaagaau

SEQ ID NO: 158746 - RNA, 22 nt, Human
ucucuggaagcgcagaucuguu

SEQ ID NO: 158747 - RNA, 22 nt, Human
ucauugaauuucacagcuuuau

SEQ ID NO: 158748 - RNA, 22 nt, Human
gcccucugcuggccucaccucg

SEQ ID NO: 158749 - RNA, 22 nt, Human
guucucucugcuuccaagaugg

SEQ ID NO: 158750 - RNA, 22 nt, Human
ggcucuggugggaagguuagau

SEQ ID NO: 158751 - RNA, 22 nt, Human
gacaggggucccucugggcugu

SEQ ID NO: 158752 - RNA, 23 nt, Human
cccuggccuuggggcacaggcug

SEQ ID NO: 158753 - RNA, 21 nt, Human
guggccugauuaugaaugggu

SEQ ID NO: 158754 - RNA, 22 nt, Human
cucucugguuucagcgaagggg

SEQ ID NO: 158755 - RNA, 22 nt, Human
uuacaaagagugccagagugug

SEQ ID NO: 158756 - RNA, 22 nt, Human
ugggccacaagccaugggacca

SEQ ID NO: 158757 - RNA, 22 nt, Human
uagacacaucaaguauaguuaa

SEQ ID NO: 158758 - RNA, 22 nt, Human
ggaucauuaacacauccaucac

SEQ ID NO: 158759 - RNA, 22 nt, Human
cuggagcuggcuuccuuccacu

SEQ ID NO: 158760 - RNA, 22 nt, Human
uuuauuccaugugucuaugacc

SEQ ID NO: 158761 - RNA, 22 nt, Human
gcagcuggucuggccuagagua

SEQ ID NO: 158762 - RNA, 22 nt, Human
gucacacucagaaugacuagag

SEQ ID NO: 158763 - RNA, 22 nt, Human
uggcagggucuugcuguguugc

SEQ ID NO: 158764 - RNA, 16 nt, Human
gggagggaguuggugg

SEQ ID NO: 158765 - RNA, 22 nt, Human
cugaagccaugugcucacuggu

SEQ ID NO: 158766 - RNA, 22 nt, Human
cucagcagcagggaagagguca

SEQ ID NO: 158767 - RNA, 22 nt, Human
gcuggcuguuggagguaccugc

SEQ ID NO: 158768 - RNA, 21 nt, Human
ugcuucucuagaucaacuacu

SEQ ID NO: 158769 - RNA, 22 nt, Human
gagggacagcuaaagagaaauu

SEQ ID NO: 158770 - RNA, 22 nt, Human
agaaauguuguggguuuuguua

SEQ ID NO: 158771 - RNA, 22 nt, Human
cagcucccagagugaccagcag

SEQ ID NO: 158772 - RNA, 22 nt, Human
ggucccagguugacagggagac

SEQ ID NO: 158773 - RNA, 22 nt, Human
caguguuccaggcggcagugaa

SEQ ID NO: 158774 - RNA, 22 nt, Human
augggaggguggaaaggcucug

SEQ ID NO: 158775 - RNA, 17 nt, Human
gugcagggaugaaggau

SEQ ID NO: 158776 - RNA, 22 nt, Human
gccaggcuccccggaucccugg

SEQ ID NO: 158777 - RNA, 22 nt, Human
agcccagaggcugggcgugcau

SEQ ID NO: 158778 - RNA, 22 nt, Human
uuucaaugacacaaaagagaaa

SEQ ID NO: 158779 - RNA, 22 nt, Human
acacugaaugcuguuuagaaau

SEQ ID NO: 158780 - RNA, 22 nt, Human
gcguggugcugcccugcacaca

SEQ ID NO: 158781 - RNA, 22 nt, Human
uugcacagaugagggugaugcu

SEQ ID NO: 158782 - RNA, 22 nt, Human
aggucacacuuggaucauagaa

SEQ ID NO: 158783 - RNA, 22 nt, Human
agcagcugagccccagcuguga

SEQ ID NO: 158784 - RNA, 22 nt, Human
uggcucaggguccccaaauggu

SEQ ID NO: 158785 - RNA, 20 nt, Human
cccuccagcaaccaggacuu

SEQ ID NO: 158786 - RNA, 20 nt, Human
cugccuggaggccucuaccu

SEQ ID NO: 158787 - RNA, 22 nt, Human
cagcccaaagccccaggcuaga

SEQ ID NO: 158788 - RNA, 22 nt, Human
cuccugaguaguagcauuguca

SEQ ID NO: 158789 - RNA, 22 nt, Human
uuugacagauccuuaacucagc

SEQ ID NO: 158790 - RNA, 22 nt, Human
auugacaauuagcccuuaggug

SEQ ID NO: 158791 - RNA, 22 nt, Human
caaaugcaugagaaauaagagg

SEQ ID NO: 158792 - RNA, 22 nt, Human
uugaggagcaggaugggaggcu

SEQ ID NO: 158793 - RNA, 22 nt, Human
ugcugcuccccagcacacagca

SEQ ID NO: 158794 - RNA, 22 nt, Human
agcagccauagauagcaugcaa

SEQ ID NO: 158795 - RNA, 22 nt, Human
augcacccagugucuggacuau

SEQ ID NO: 158796 - RNA, 19 nt, Human
ugagagugaggaaggcuuc

SEQ ID NO: 158797 - RNA, 22 nt, Human
aagcugccaaugguaagcugcu

SEQ ID NO: 158798 - RNA, 22 nt, Human
aagccagccagugccagucuua

SEQ ID NO: 158799 - RNA, 22 nt, Human
aagccaggcaugcuuggacagu

SEQ ID NO: 158800 - RNA, 22 nt, Human
cagcucccgccaucgggaggca

SEQ ID NO: 158801 - RNA, 22 nt, Human
ugagccuggagucguggagggg

SEQ ID NO: 158802 - RNA, 22 nt, Human
gggcacuguggggcccaugcug

SEQ ID NO: 158803 - RNA, 22 nt, Human
ucagggcaucaucaugaauaua

SEQ ID NO: 158804 - RNA, 22 nt, Human
aaggcagcaccgccuccugaaa

SEQ ID NO: 158805 - RNA, 22 nt, Human
gcacccaggcuugggcagcaac

SEQ ID NO: 158806 - RNA, 22 nt, Human
aggcacugugcagucccaagca

SEQ ID NO: 158807 - RNA, 22 nt, Human
aggcaaaauuacaaaguuauua

SEQ ID NO: 158808 - RNA, 22 nt, Human
gcugucacacauggccccagcu

SEQ ID NO: 158809 - RNA, 22 nt, Human
auaauuuaauuuucacaguggu

SEQ ID NO: 158810 - RNA, 22 nt, Human
ugaaaucuuagccauucugccu

SEQ ID NO: 158811 - RNA, 22 nt, Human
ccagucacuggaaaaugggaau

SEQ ID NO: 158812 - RNA, 22 nt, Human
agcagcauguugggaugugaaa

SEQ ID NO: 158813 - RNA, 22 nt, Human
aagaguuuucuauaaucuuggc

SEQ ID NO: 158814 - RNA, 20 nt, Human
uggagcugugguaaggagca

SEQ ID NO: 158815 - RNA, 22 nt, Human
uucagagcaucucuaaagccag

SEQ ID NO: 158816 - RNA, 19 nt, Human
ugcucauggggacuucucc

SEQ ID NO: 158817 - RNA, 17 nt, Human
gucugggcuuuagagac

SEQ ID NO: 158818 - RNA, 19 nt, Human
ccuuccuccccagggccau

SEQ ID NO: 158819 - RNA, 22 nt, Human
aaaugcauguagaauaauagag

SEQ ID NO: 158820 - RNA, 22 nt, Human
cagcagugcuucagugugagau

SEQ ID NO: 158821 - RNA, 22 nt, Human
acauuaucccuggcacaacugc

SEQ ID NO: 158822 - RNA, 22 nt, Human
uggucaggcugcucugcggcgu

SEQ ID NO: 158823 - RNA, 22 nt, Human
agggagguaggagcuucuagcu

SEQ ID NO: 158824 - RNA, 22 nt, Human
gggcagcagagcccugccgagu

SEQ ID NO: 158825 - RNA, 22 nt, Human
uggccucuuaggacauccucua

SEQ ID NO: 158826 - RNA, 22 nt, Human
ugggcagaaugugggauccaga

SEQ ID NO: 158827 - RNA, 22 nt, Human
uugcuuuguggugguucuucca

SEQ ID NO: 158828 - RNA, 22 nt, Human
aggcuggcgacaucuggcgggc

SEQ ID NO: 158829 - RNA, 22 nt, Human
uugauacauagcacaguuuagg

SEQ ID NO: 158830 - RNA, 22 nt, Human
gccugcagccucaagggcugag

SEQ ID NO: 158831 - RNA, 22 nt, Human
ucuucagauugcacugagcaag

SEQ ID NO: 158832 - RNA, 22 nt, Human
ccugccugguguaagucuaagg

SEQ ID NO: 158833 - RNA, 22 nt, Human
cuggcucauagagcagcuccaa

SEQ ID NO: 158834 - RNA, 22 nt, Human
augugugccccuuuuacucuuu

SEQ ID NO: 158835 - RNA, 22 nt, Human
cuggccuggcaggggaccucua

SEQ ID NO: 158836 - RNA, 22 nt, Human
ggcugggcaaacaagacucuuc

SEQ ID NO: 158837 - RNA, 22 nt, Human
uuucuucugagaucagggagaa

SEQ ID NO: 158838 - RNA, 22 nt, Human
gucugagaaucuugcauaucau

SEQ ID NO: 158839 - RNA, 22 nt, Human
gugcccaggcccaaggcaccac

SEQ ID NO: 158840 - RNA, 22 nt, Human
agucucagcaagcauggcuagu

SEQ ID NO: 158841 - RNA, 22 nt, Human
ucaaaguccuugcuuuuucugu

SEQ ID NO: 158842 - RNA, 22 nt, Human
auagauacauuagguaacuugu

SEQ ID NO: 158843 - RNA, 18 nt, Human
ugaacagaugaguugaag

SEQ ID NO: 158844 - RNA, 22 nt, Human
gaugcagggcuggcaggagcuu

SEQ ID NO: 158845 - RNA, 22 nt, Human
uaucuauuccaaauaucagcgu

SEQ ID NO: 158846 - RNA, 22 nt, Human
ugucuuuucuacuguaagcaua

SEQ ID NO: 158847 - RNA, 23 nt, Human
agggcugaugccauugcagcucu

SEQ ID NO: 158848 - RNA, 20 nt, Human
uaaggcuguuuuguauuccu

SEQ ID NO: 158849 - RNA, 22 nt, Human
caguagcagggauuauuuuagg

SEQ ID NO: 158850 - RNA, 22 nt, Human
ggcucagguugggucacaugac

SEQ ID NO: 158851 - RNA, 22 nt, Human
gccuggcaggccuguuggggcu

SEQ ID NO: 158852 - RNA, 22 nt, Human
agcagaugagccucaugacugg

SEQ ID NO: 158853 - RNA, 22 nt, Human
agcaggaaguagucuguaagca

SEQ ID NO: 158854 - RNA, 22 nt, Human
uuugacagacauuuacuacauu

SEQ ID NO: 158855 - RNA, 22 nt, Human
gagcugucucuauaugaaugcu

SEQ ID NO: 158856 - RNA, 22 nt, Human
aaugucugccugaacuuuauau

SEQ ID NO: 158857 - RNA, 22 nt, Human
uacauucuggaaaggcacagac

SEQ ID NO: 158858 - RNA, 22 nt, Human
uggagcugguaaacagugacau

SEQ ID NO: 158859 - RNA, 17 nt, Human
gcugagugcagggaguc

SEQ ID NO: 158860 - RNA, 22 nt, Human
uggcucagagccuugagagcug

SEQ ID NO: 158861 - RNA, 22 nt, Human
agucucagggccacccggggaa

SEQ ID NO: 158862 - RNA, 22 nt, Human
ugcuuuggccacuagaauucag

SEQ ID NO: 158863 - RNA, 22 nt, Human
cagagccaugguaugggcuugu

SEQ ID NO: 158864 - RNA, 22 nt, Human
ccagugggugcugggcucugcc

SEQ ID NO: 158865 - RNA, 22 nt, Human
aauuucaauuacuuuugcacca

SEQ ID NO: 158866 - RNA, 17 nt, Human
ucaggcugugccuggua

SEQ ID NO: 158867 - RNA, 21 nt, Human
ggagggcagcccagacuggcu

SEQ ID NO: 158868 - RNA, 22 nt, Human
ugcugccuugaccuccugggcu

SEQ ID NO: 158869 - RNA, 22 nt, Human
uagucuuuugagaaguauaucu

SEQ ID NO: 158870 - RNA, 20 nt, Human
aagcaauauagugcaaaugu

SEQ ID NO: 158871 - RNA, 22 nt, Human
cagggccuccuaaggcaucuaa

SEQ ID NO: 158872 - RNA, 23 nt, Human
ucacaggggccagcgcucugugg

SEQ ID NO: 158873 - RNA, 22 nt, Human
agcagcucuguuuaccuggagg

SEQ ID NO: 158874 - RNA, 21 nt, Human
agaagccuggguggagguggg

SEQ ID NO: 158875 - RNA, 22 nt, Human
gguggguauugaauacaggugu

SEQ ID NO: 158876 - RNA, 22 nt, Human
agucccaguucgguucuuccuc

SEQ ID NO: 158877 - RNA, 23 nt, Human
gccuggagaaaagcugcaguuca

SEQ ID NO: 158878 - RNA, 22 nt, Human
caguccuggggaccaggcugag

SEQ ID NO: 158879 - RNA, 22 nt, Human
acagaaauugggcaaauggaag

SEQ ID NO: 158880 - RNA, 22 nt, Human
ucccuggcugggggcugccuug

SEQ ID NO: 158881 - RNA, 22 nt, Human
gcucucuggguggugggcaaca

SEQ ID NO: 158882 - RNA, 22 nt, Human
ccacccugagccgcaagagcag

SEQ ID NO: 158883 - RNA, 22 nt, Human
cccagcuccuuggaugggcagg

SEQ ID NO: 158884 - RNA, 22 nt, Human
ugggaggaaugucacugagcca

SEQ ID NO: 158885 - RNA, 22 nt, Human
cucugugccucaguuuucuucu

SEQ ID NO: 158886 - RNA, 22 nt, Human
caggguggaagcuguagagugg

SEQ ID NO: 158887 - RNA, 20 nt, Human
ccuggcuuugcaucugugau

SEQ ID NO: 158888 - RNA, 22 nt, Human
cagagccaggccugcccucuuu

SEQ ID NO: 158889 - RNA, 20 nt, Human
aggaaaaggguggugguaga

SEQ ID NO: 158890 - RNA, 22 nt, Human
gcagagcaguacucucuugacu

SEQ ID NO: 158891 - RNA, 22 nt, Human
gcaugggcaagaggacuggggg

SEQ ID NO: 158892 - RNA, 22 nt, Human
ucuguggauuuuaguguucaug

SEQ ID NO: 158893 - RNA, 22 nt, Human
gagcuggugugugcccgagcac

SEQ ID NO: 158894 - RNA, 22 nt, Human
cccuggagcuagucugagcaga

SEQ ID NO: 158895 - RNA, 22 nt, Human
acugucaccaucagagcgggaa

SEQ ID NO: 158896 - RNA, 22 nt, Human
ccauuuguucgcccagcuccaa

SEQ ID NO: 158897 - RNA, 22 nt, Human
ccacagagacaggguccuugcu

SEQ ID NO: 158898 - RNA, 22 nt, Human
ccugggucacucaggcaggcgg

SEQ ID NO: 158899 - RNA, 18 nt, Human
ggagccagucugucucug

SEQ ID NO: 158900 - RNA, 22 nt, Human
cauugaaauauggaaacugaug

SEQ ID NO: 158901 - RNA, 22 nt, Human
cacugcuuaguugguaaaugug

SEQ ID NO: 158902 - RNA, 22 nt, Human
cagggccaugaggcacaggguc

SEQ ID NO: 158903 - RNA, 22 nt, Human
aucucagacauguuguccauga

SEQ ID NO: 158904 - RNA, 22 nt, Human
ugacccugcuucuuggugcagg

SEQ ID NO: 158905 - RNA, 22 nt, Human
gcaggaguguggugggacaucc

SEQ ID NO: 158906 - RNA, 22 nt, Human
uggcccugugugcaggcugcac

SEQ ID NO: 158907 - RNA, 22 nt, Human
cugagguguugaugaccuaugc

SEQ ID NO: 158908 - RNA, 22 nt, Human
agggcugcugaggaagccuugc

SEQ ID NO: 158909 - RNA, 22 nt, Human
gcuggccuuugaggaagcugcg

SEQ ID NO: 158910 - RNA, 22 nt, Human
ucagggcauucaagaggccugg

SEQ ID NO: 158911 - RNA, 22 nt, Human
aacagaauaguugauguacagu

SEQ ID NO: 158912 - RNA, 22 nt, Human
cugaggucaauuaaucaacaac

SEQ ID NO: 158913 - RNA, 21 nt, Human
ggacuuacauagguaaggggu

SEQ ID NO: 158914 - RNA, 22 nt, Human
cacugaagcuuucauucucuug

SEQ ID NO: 158915 - RNA, 22 nt, Human
gcugggagcaaagccaugcaua

SEQ ID NO: 158916 - RNA, 20 nt, Human
cagcuuggaugagaggcuga

SEQ ID NO: 158917 - RNA, 19 nt, Human
ucuggcuccugccaggcug

SEQ ID NO: 158918 - RNA, 22 nt, Human
ggaggcugcugccucacguggg

SEQ ID NO: 158919 - RNA, 22 nt, Human
uagcugccagaccauucuuacu

SEQ ID NO: 158920 - RNA, 22 nt, Human
uccauggggcccaggaugagag

SEQ ID NO: 158921 - RNA, 22 nt, Human
ugccugucuuuccucccucgua

SEQ ID NO: 158922 - RNA, 22 nt, Human
cucacagaugcugugggucagg

SEQ ID NO: 158923 - RNA, 22 nt, Human
uccuuggcagcagggagcauga

SEQ ID NO: 158924 - RNA, 22 nt, Human
uuugggaaacuuaggggucaga

SEQ ID NO: 158925 - RNA, 22 nt, Human
gcccauggacacccaagugcca

SEQ ID NO: 158926 - RNA, 22 nt, Human
acauuucuuucuauucaguagc

SEQ ID NO: 158927 - RNA, 22 nt, Human
ucuucagagacucugagccccu

SEQ ID NO: 158928 - RNA, 22 nt, Human
gccaggcuccaggcccuccuga

SEQ ID NO: 158929 - RNA, 22 nt, Human
gcagcaggcacggucucgacau

SEQ ID NO: 158930 - RNA, 22 nt, Human
cugggccauggaagucucugcc

SEQ ID NO: 158931 - RNA, 22 nt, Human
ggcagcuggguuggccagaaac

SEQ ID NO: 158932 - RNA, 22 nt, Human
guggccaggccgacugccaggc

SEQ ID NO: 158933 - RNA, 22 nt, Human
cuggagagauccuccugaaaaa

SEQ ID NO: 158934 - RNA, 22 nt, Human
auucuggauuaucaguccacca

SEQ ID NO: 158935 - RNA, 22 nt, Human
aagaaucauccugcaagagucu

SEQ ID NO: 158936 - RNA, 22 nt, Human
ccucuucugagugagacucccu

SEQ ID NO: 158937 - RNA, 22 nt, Human
gaggcaggcccugaaugaguca

SEQ ID NO: 158938 - RNA, 17 nt, Human
gcuuccucaugcaguuc

SEQ ID NO: 158939 - RNA, 22 nt, Human
aaggccugaacaugaggagaug

SEQ ID NO: 158940 - RNA, 22 nt, Human
uaaugcaguacugauauaaaca

SEQ ID NO: 158941 - RNA, 22 nt, Human
gcugcccugucugcagcaggac

SEQ ID NO: 158942 - RNA, 22 nt, Human
ccuggcagcuccuccccggcgg

SEQ ID NO: 158943 - RNA, 22 nt, Human
cagccagcuggcacugugagua

SEQ ID NO: 158944 - RNA, 22 nt, Human
cugggcagugguggcaucuuug

SEQ ID NO: 158945 - RNA, 22 nt, Human
ggccgggcaggucucagccagc

SEQ ID NO: 158946 - RNA, 20 nt, Human
cccugcagccaugggagugg

SEQ ID NO: 158947 - RNA, 22 nt, Human
gcucccagggaccgcagggcag

SEQ ID NO: 158948 - RNA, 22 nt, Human
ccucaggcuuacgggcaaugga

SEQ ID NO: 158949 - RNA, 20 nt, Human
aggagaaauucgggacaccu

SEQ ID NO: 158950 - RNA, 22 nt, Human
ggggcagaaguagugccccuga

SEQ ID NO: 158951 - RNA, 22 nt, Human
aguccaggaguugggugacauu

SEQ ID NO: 158952 - RNA, 23 nt, Human
ucagugauguugaaccuagcagu

SEQ ID NO: 158953 - RNA, 22 nt, Human
cgcugccaggauccccugccgg

SEQ ID NO: 158954 - RNA, 22 nt, Human
uggagccaggagccugggaguc

SEQ ID NO: 158955 - RNA, 22 nt, Human
uggcuuccuggacagaugcggu

SEQ ID NO: 158956 - RNA, 22 nt, Human
gggugcugacuggggccugaaa

SEQ ID NO: 158957 - RNA, 22 nt, Human
acuguacacgugucauuuacag

SEQ ID NO: 158958 - RNA, 22 nt, Human
ccugagggaaggaugcuaccca

SEQ ID NO: 158959 - RNA, 22 nt, Human
guccugggcccaggggcugccu

SEQ ID NO: 158960 - RNA, 22 nt, Human
acugccuugaaagauuguugag

SEQ ID NO: 158961 - RNA, 22 nt, Human
aaaugcacucugcuucugugac

SEQ ID NO: 158962 - RNA, 22 nt, Human
ucugucacaauuugcuuacucu

SEQ ID NO: 158963 - RNA, 22 nt, Human
cucugagagagcuggugagcac

SEQ ID NO: 158964 - RNA, 22 nt, Human
ugggauggcauccugggccuug

SEQ ID NO: 158965 - RNA, 22 nt, Human
agggccugacacccuugccagc

SEQ ID NO: 158966 - RNA, 22 nt, Human
uccucugcucagcauuccucac

SEQ ID NO: 158967 - RNA, 21 nt, Human
ccaccaggucuucugcucggg

SEQ ID NO: 158968 - RNA, 22 nt, Human
agggguggccugccuuacuccc

SEQ ID NO: 158969 - RNA, 22 nt, Human
acugagcugugacaaugcuuaa

SEQ ID NO: 158970 - RNA, 20 nt, Human
uccagcugggaacagcugau

SEQ ID NO: 158971 - RNA, 22 nt, Human
ggaggcucccacgcagcucaca

SEQ ID NO: 158972 - RNA, 22 nt, Human
acuuguguaacacagaaagaac

SEQ ID NO: 158973 - RNA, 22 nt, Human
ugcuggcuacugauggcaggcc

SEQ ID NO: 158974 - RNA, 22 nt, Human
aaagagcuucauuuccauuuau

SEQ ID NO: 158975 - RNA, 22 nt, Human
gggcucuggauggagccugcag

SEQ ID NO: 158976 - RNA, 22 nt, Human
ucccagauuguugauggcuuaa

SEQ ID NO: 158977 - RNA, 22 nt, Human
aagcagccucauuugugguaag

SEQ ID NO: 158978 - RNA, 22 nt, Human
ugggccugaguuugggaacugg

SEQ ID NO: 158979 - RNA, 22 nt, Human
aaaucuggccccuugccuauuu

SEQ ID NO: 158980 - RNA, 18 nt, Human
uggcagcaggaagccauu

SEQ ID NO: 158981 - RNA, 18 nt, Human
uggagcugagugcugugc

SEQ ID NO: 158982 - RNA, 22 nt, Human
aaggcugagagucacaguccua

SEQ ID NO: 158983 - RNA, 22 nt, Human
cugcucugaagccaggauucug

SEQ ID NO: 158984 - RNA, 22 nt, Human
aucuggcucacuuagucuagga

SEQ ID NO: 158985 - RNA, 22 nt, Human
cacugcuuuaaggcugaguaac

SEQ ID NO: 158986 - RNA, 17 nt, Human
auccccagcaucuagaa

SEQ ID NO: 158987 - RNA, 20 nt, Human
uggcuccucuuggcuguggc

SEQ ID NO: 158988 - RNA, 23 nt, Human
ucacacagcuggucagguacaga

SEQ ID NO: 158989 - RNA, 22 nt, Human
uccucugcuguucugguucuuu

SEQ ID NO: 158990 - RNA, 22 nt, Human
uacaguaaccuuauuugucauu

SEQ ID NO: 158991 - RNA, 22 nt, Human
caggccucuccuuagucuggca

SEQ ID NO: 158992 - RNA, 19 nt, Human
cucuggccucuggaugcug

SEQ ID NO: 158993 - RNA, 22 nt, Human
accugccucagugcagcuggau

SEQ ID NO: 158994 - RNA, 22 nt, Human
ggugggcaacauuuggccugag

SEQ ID NO: 158995 - RNA, 22 nt, Human
uguuccaucaguuuuugguuga

SEQ ID NO: 158996 - RNA, 22 nt, Human
agaggcuccaccuucucugucc

SEQ ID NO: 158997 - RNA, 17 nt, Human
aggugcagaggcagagc

SEQ ID NO: 158998 - RNA, 22 nt, Human
ucagaaauguaagcugaugacu

SEQ ID NO: 158999 - RNA, 22 nt, Human
cccagagcugagucugauauau

SEQ ID NO: 159000 - RNA, 22 nt, Human
uuuauguaauuucauaggugug

SEQ ID NO: 159001 - RNA, 22 nt, Human
caggagugucuccacacagcaa

SEQ ID NO: 159002 - RNA, 22 nt, Human
aggacuuagaacauuauguacu

SEQ ID NO: 159003 - RNA, 22 nt, Human
uuucuguauuuaaaagaucugg

SEQ ID NO: 159004 - RNA, 22 nt, Human
cucaggauccaucuccugcccu

SEQ ID NO: 159005 - RNA, 22 nt, Human
cagccugcagggcugccuguug

SEQ ID NO: 159006 - RNA, 22 nt, Human
gcccucuggcagccuuggcugg

SEQ ID NO: 159007 - RNA, 22 nt, Human
ggcuucagugagcugagcucac

SEQ ID NO: 159008 - RNA, 22 nt, Human
uuccuggugguggugacagcac

SEQ ID NO: 159009 - RNA, 22 nt, Human
aguuuuucuccccuggcuucau

SEQ ID NO: 159010 - RNA, 22 nt, Human
cagagagcuuagugugcugcau

SEQ ID NO: 159011 - RNA, 22 nt, Human
ccacuugugaaauaaucaaaua

SEQ ID NO: 159012 - RNA, 19 nt, Human
gagcccucuccauggccac

SEQ ID NO: 159013 - RNA, 22 nt, Human
uauguacacauacacuuguaau

SEQ ID NO: 159014 - RNA, 20 nt, Human
guggccucucacauucugag

SEQ ID NO: 159015 - RNA, 22 nt, Human
uccagccuaauguucuucccac

SEQ ID NO: 159016 - RNA, 22 nt, Human
cagagcugagaauguugaugcu

SEQ ID NO: 159017 - RNA, 22 nt, Human
cugaggccucucuccugggcuu

SEQ ID NO: 159018 - RNA, 21 nt, Human
ucuuguccuugcucucccacu

SEQ ID NO: 159019 - RNA, 22 nt, Human
gauccuugcaacucugugaggu

SEQ ID NO: 159020 - RNA, 22 nt, Human
gcagcugaagcugcaguuccag

SEQ ID NO: 159021 - RNA, 22 nt, Human
ugucuuccucuuggcuugagcu

SEQ ID NO: 159022 - RNA, 22 nt, Human
gccugccuuuguaugacccuga

SEQ ID NO: 159023 - RNA, 22 nt, Human
augcuuuacaguuuuccaaaca

SEQ ID NO: 159024 - RNA, 22 nt, Human
uuuuccucuguauuugaaaugc

SEQ ID NO: 159025 - RNA, 22 nt, Human
aggcagcaugcucugcuucuac

SEQ ID NO: 159026 - RNA, 22 nt, Human
gccuggaguagcauggcaagcc

SEQ ID NO: 159027 - RNA, 22 nt, Human
gucccugcaucaccacgggacu

SEQ ID NO: 159028 - RNA, 22 nt, Human
agagccaggcggcugggcaccu

SEQ ID NO: 159029 - RNA, 22 nt, Human
cucacaggagaaagucaugguc

SEQ ID NO: 159030 - RNA, 22 nt, Human
aacucaguucuuuccacaaugc

SEQ ID NO: 159031 - RNA, 22 nt, Human
aggguauguuuuuaucuacugu

SEQ ID NO: 159032 - RNA, 17 nt, Human
agugaaauuuacauugc

SEQ ID NO: 159033 - RNA, 22 nt, Human
ccuggugccacuagagaauguc

SEQ ID NO: 159034 - RNA, 22 nt, Human
uaaauuguuuucuagaaguugu

SEQ ID NO: 159035 - RNA, 21 nt, Human
cucaggauggcggccuggugg

SEQ ID NO: 159036 - RNA, 22 nt, Human
ucagggcaagauugguuaauaa

SEQ ID NO: 159037 - RNA, 22 nt, Human
caaagguaaagaucugcugugg

SEQ ID NO: 159038 - RNA, 22 nt, Human
uaaagguagcaugaaacugcaa

SEQ ID NO: 159039 - RNA, 22 nt, Human
gcugggcuugguuucccugcuu

SEQ ID NO: 159040 - RNA, 20 nt, Human
cagagacccaggcuucagcu

SEQ ID NO: 159041 - RNA, 22 nt, Human
uucuggaggccccuuccuucuc

SEQ ID NO: 159042 - RNA, 22 nt, Human
gcaggcagaucaccugucagga

SEQ ID NO: 159043 - RNA, 22 nt, Human
aggcaugugacccuggacucag

SEQ ID NO: 159044 - RNA, 22 nt, Human
gcagggcuaauggggcaaguag

SEQ ID NO: 159045 - RNA, 22 nt, Human
ugggcaggauaauaucucaugu

SEQ ID NO: 159046 - RNA, 22 nt, Human
ucuuccaguguagacaucugcc

SEQ ID NO: 159047 - RNA, 22 nt, Human
gagcuguccuaccaggaguccu

SEQ ID NO: 159048 - RNA, 22 nt, Human
ccuggcugggguagaagugagg

SEQ ID NO: 159049 - RNA, 22 nt, Human
ccaggacucaguggggaaaggg

SEQ ID NO: 159050 - RNA, 22 nt, Human
caguacuuuucuggcuuucuac

SEQ ID NO: 159051 - RNA, 22 nt, Human
cuggagcugcuguccuugggug

SEQ ID NO: 159052 - RNA, 22 nt, Human
augaugguuguccuaggugcau

SEQ ID NO: 159053 - RNA, 22 nt, Human
guccuggggauacagaagugaa

SEQ ID NO: 159054 - RNA, 22 nt, Human
cucuggagguugagcccagcaa

SEQ ID NO: 159055 - RNA, 22 nt, Human
ucacuuauaaaaugcaagaucu

SEQ ID NO: 159056 - RNA, 22 nt, Human
ggcucugcuggauugaggccag

SEQ ID NO: 159057 - RNA, 22 nt, Human
ccugggcaaaugccagagacaa

SEQ ID NO: 159058 - RNA, 22 nt, Human
uaaugugugucaucaguagagu

SEQ ID NO: 159059 - RNA, 22 nt, Human
cugagggcaugaacauuccaua

SEQ ID NO: 159060 - RNA, 22 nt, Human
aacagaaugcaggggaugcugc

SEQ ID NO: 159061 - RNA, 22 nt, Human
aagauuuccauuucuagcucau

SEQ ID NO: 159062 - RNA, 22 nt, Human
agagaagacuuacagccacagu

SEQ ID NO: 159063 - RNA, 17 nt, Human
gcugccaccuuuggagc

SEQ ID NO: 159064 - RNA, 22 nt, Human
ugcugggggugucucaccaggc

SEQ ID NO: 159065 - RNA, 19 nt, Human
gcagccaccgcggcggccg

SEQ ID NO: 159066 - RNA, 22 nt, Human
gggugggguucaggaaucuuca

SEQ ID NO: 159067 - RNA, 22 nt, Human
agagaacaaauuaaaggugguu

SEQ ID NO: 159068 - RNA, 22 nt, Human
ugcagccaccaccucugcugaa

SEQ ID NO: 159069 - RNA, 22 nt, Human
ccagagucuuuauauuccugaa

SEQ ID NO: 159070 - RNA, 18 nt, Human
agggaucaucacugcagc

SEQ ID NO: 159071 - RNA, 22 nt, Human
uguggcccagaugagugugcua

SEQ ID NO: 159072 - RNA, 22 nt, Human
agcaguggccuggggcucugug

SEQ ID NO: 159073 - RNA, 22 nt, Human
gcucaggacccaggugugaccu

SEQ ID NO: 159074 - RNA, 22 nt, Human
cccucugccucugaguaggaca

SEQ ID NO: 159075 - RNA, 22 nt, Human
uugaagcaugguacuuguucaa

SEQ ID NO: 159076 - RNA, 22 nt, Human
aaugcuguaaagaugcuaucug

SEQ ID NO: 159077 - RNA, 22 nt, Human
aaggccugcucagcugucugug

SEQ ID NO: 159078 - RNA, 22 nt, Human
guaacaaaguuucuaggugcug

SEQ ID NO: 159079 - RNA, 22 nt, Human
gcccagaaguugaggcugcagu

SEQ ID NO: 159080 - RNA, 22 nt, Human
acagccuggacuggcucucugc

SEQ ID NO: 159081 - RNA, 22 nt, Human
acagugucuccugguacccagu

SEQ ID NO: 159082 - RNA, 22 nt, Human
aaguuugagagccuuuaguaua

SEQ ID NO: 159083 - RNA, 22 nt, Human
uauauguaagcuauguaagagu

SEQ ID NO: 159084 - RNA, 22 nt, Human
caguuucugggcguucacaggu

SEQ ID NO: 159085 - RNA, 22 nt, Human
uugucccaggacuugcauagau

SEQ ID NO: 159086 - RNA, 22 nt, Human
ucucugcucugugccucaguuu

SEQ ID NO: 159087 - RNA, 22 nt, Human
ucuuccucucuaauugaucaga

SEQ ID NO: 159088 - RNA, 22 nt, Human
cugcugagcccuggcacaggug

SEQ ID NO: 159089 - RNA, 22 nt, Human
gcugugcuauaucucugagugu

SEQ ID NO: 159090 - RNA, 22 nt, Human
gauuucaaggaguuuucacagu

SEQ ID NO: 159091 - RNA, 22 nt, Human
gaggaccacagaugagccugca

SEQ ID NO: 159092 - RNA, 22 nt, Human
cagguggcaugacugccuacaa

SEQ ID NO: 159093 - RNA, 19 nt, Human
ccuuggaguuccaggugga

SEQ ID NO: 159094 - RNA, 22 nt, Human
ccugucuguaucgguucagagu

SEQ ID NO: 159095 - RNA, 22 nt, Human
ccuggccuuaagggcagggagc

SEQ ID NO: 159096 - RNA, 22 nt, Human
ucuggcucaggagcuguguuca

SEQ ID NO: 159097 - RNA, 22 nt, Human
ccaaggagcucauauucuuguu

SEQ ID NO: 159098 - RNA, 22 nt, Human
uaaaugugggggccacgggcuu

SEQ ID NO: 159099 - RNA, 22 nt, Human
acagaaauuagcagugaguuua

SEQ ID NO: 159100 - RNA, 22 nt, Human
guaagagcacugucuccugcug

SEQ ID NO: 159101 - RNA, 22 nt, Human
ggcugcuuuaucggcugcugaa

SEQ ID NO: 159102 - RNA, 22 nt, Human
ugaggaugacgauggcaauggc

SEQ ID NO: 159103 - RNA, 22 nt, Human
aaggcacugaacuuaaauucug

SEQ ID NO: 159104 - RNA, 22 nt, Human
ggugcccaccugucuuccugga

SEQ ID NO: 159105 - RNA, 22 nt, Human
aaucuggcucagaagaagauga

SEQ ID NO: 159106 - RNA, 22 nt, Human
gaggcaggcagauugcuugagg

SEQ ID NO: 159107 - RNA, 22 nt, Human
acaggcugacuuccugccaugu

SEQ ID NO: 159108 - RNA, 22 nt, Human
gcucccuccaugaggcagaccg

SEQ ID NO: 159109 - RNA, 22 nt, Human
ggcugggcugcugggucagagc

SEQ ID NO: 159110 - RNA, 22 nt, Human
caugugucaaaugauguagcug

SEQ ID NO: 159111 - RNA, 22 nt, Human
ggagccaguauuuaguggucuu

SEQ ID NO: 159112 - RNA, 22 nt, Human
aggccuggugaaugaaguaucu

SEQ ID NO: 159113 - RNA, 22 nt, Human
gccuggcacucacugaagaggc

SEQ ID NO: 159114 - RNA, 22 nt, Human
gccaccagggggcuccagugag

SEQ ID NO: 159115 - RNA, 22 nt, Human
gcucagagcacucagacucagc

SEQ ID NO: 159116 - RNA, 22 nt, Human
cccagcccagcguucgaggggu

SEQ ID NO: 159117 - RNA, 22 nt, Human
cucagggcaguauggcugagag

SEQ ID NO: 159118 - RNA, 22 nt, Human
uccucacaagcaagcacaggua

SEQ ID NO: 159119 - RNA, 22 nt, Human
ccagccugguucagaauuggcu

SEQ ID NO: 159120 - RNA, 21 nt, Human
acaugucucuaaucucaguga

SEQ ID NO: 159121 - RNA, 22 nt, Human
ccagcuggugggucuuucucug

SEQ ID NO: 159122 - RNA, 22 nt, Human
uuccauuuauucuuguccagau

SEQ ID NO: 159123 - RNA, 23 nt, Human
cacaccaggagccgucugggcca

SEQ ID NO: 159124 - RNA, 22 nt, Human
gggcugcuuccuggggaaugcu

SEQ ID NO: 159125 - RNA, 22 nt, Human
uuaauaaaguaugaauuggaaa

SEQ ID NO: 159126 - RNA, 22 nt, Human
cucuggagguggagguugcagu

SEQ ID NO: 159127 - RNA, 22 nt, Human
gagcucuguguagccugagggu

SEQ ID NO: 159128 - RNA, 22 nt, Human
cuugccuucuuuuccuauagaa

SEQ ID NO: 159129 - RNA, 22 nt, Human
uucauuccugagcccauauuua

SEQ ID NO: 159130 - RNA, 22 nt, Human
cuggccuuggaagggagcccgu

SEQ ID NO: 159131 - RNA, 22 nt, Human
ugguuuugcuccaguauaaaua

SEQ ID NO: 159132 - RNA, 22 nt, Human
gcagugguccaguucacaccca

SEQ ID NO: 159133 - RNA, 22 nt, Human
uucuaguguccuuggacuugcu

SEQ ID NO: 159134 - RNA, 22 nt, Human
ugaacccaggagguugcaguga

SEQ ID NO: 159135 - RNA, 22 nt, Human
ccuccugggcuccugucugcac

SEQ ID NO: 159136 - RNA, 22 nt, Human
agcuccugaaaagcgcuugcuu

SEQ ID NO: 159137 - RNA, 22 nt, Human
cacacaugaaucccuaguaccu

SEQ ID NO: 159138 - RNA, 20 nt, Human
uguugauuggugucaucuca

SEQ ID NO: 159139 - RNA, 22 nt, Human
cccaccccuggacaggugagug

SEQ ID NO: 159140 - RNA, 22 nt, Human
aguggggaagagcaugggcccu

SEQ ID NO: 159141 - RNA, 22 nt, Human
gccuuucaguuccaucaaagga

SEQ ID NO: 159142 - RNA, 22 nt, Human
cagggacauugguggccagguu

SEQ ID NO: 159143 - RNA, 22 nt, Human
ucccagggacucucugccuucc

SEQ ID NO: 159144 - RNA, 22 nt, Human
cagcuuggcuuccgcuuuacug

SEQ ID NO: 159145 - RNA, 22 nt, Human
agcugagcugcagaugacugua

SEQ ID NO: 159146 - RNA, 22 nt, Human
gugugcaguagagaaagagcag

SEQ ID NO: 159147 - RNA, 18 nt, Human
aaauguacuguccauggc

SEQ ID NO: 159148 - RNA, 22 nt, Human
uccagaggcuccaaagggagau

SEQ ID NO: 159149 - RNA, 22 nt, Human
acagaauuaucaggaaauguua

SEQ ID NO: 159150 - RNA, 22 nt, Human
cagagccagcccacuguucccg

SEQ ID NO: 159151 - RNA, 22 nt, Human
ugcucccaggcauucucuguug

SEQ ID NO: 159152 - RNA, 22 nt, Human
cagccaggccuggugaccaaag

SEQ ID NO: 159153 - RNA, 22 nt, Human
uuugacagcuuguuacaaaguu

SEQ ID NO: 159154 - RNA, 22 nt, Human
ggcccugagcugaaguacugug

SEQ ID NO: 159155 - RNA, 19 nt, Human
gcuggggccugaccagaca

SEQ ID NO: 159156 - RNA, 22 nt, Human
gcagcaggagaguuuguccugc

SEQ ID NO: 159157 - RNA, 22 nt, Human
aaggacuccaauucuuucaucu

SEQ ID NO: 159158 - RNA, 22 nt, Human
ucucagagauuuuguuucccuu

SEQ ID NO: 159159 - RNA, 22 nt, Human
cagaggccucacuuccagccag

SEQ ID NO: 159160 - RNA, 22 nt, Human
agcuggguguguaucagauaaa

SEQ ID NO: 159161 - RNA, 22 nt, Human
cucaccacagagccuguccagc

SEQ ID NO: 159162 - RNA, 22 nt, Human
agguaagggucacaguucauau

SEQ ID NO: 159163 - RNA, 22 nt, Human
agcuuuauauuuaaugaauucu

SEQ ID NO: 159164 - RNA, 22 nt, Human
uggcucagaacuacuucuaguu

SEQ ID NO: 159165 - RNA, 22 nt, Human
aagcugccaccagcccagggca

SEQ ID NO: 159166 - RNA, 22 nt, Human
cugaggcuuggaggggucuggu

SEQ ID NO: 159167 - RNA, 22 nt, Human
ccacagaaaguugucuagagua

SEQ ID NO: 159168 - RNA, 22 nt, Human
cccagcauggagugaggacuca

SEQ ID NO: 159169 - RNA, 22 nt, Human
cucugugauuuugugagccaga

SEQ ID NO: 159170 - RNA, 22 nt, Human
uuguuacacauaauaacauuuu

SEQ ID NO: 159171 - RNA, 22 nt, Human
ucccugcucagcucaccuggca

SEQ ID NO: 159172 - RNA, 22 nt, Human
cagcaguggaacuacccaggga

SEQ ID NO: 159173 - RNA, 22 nt, Human
uauaucuuauaugugcagguac

SEQ ID NO: 159174 - RNA, 22 nt, Human
guauuugauagauuucaaagga

SEQ ID NO: 159175 - RNA, 22 nt, Human
ccaccagcuucagcagccgcgg

SEQ ID NO: 159176 - RNA, 22 nt, Human
ggccucuguucugcauuccucc

SEQ ID NO: 159177 - RNA, 20 nt, Human
acagccagaggaggcagaca

SEQ ID NO: 159178 - RNA, 23 nt, Human
gggagaauaugaggaugauggug

SEQ ID NO: 159179 - RNA, 22 nt, Human
gcccagcaccucucucaggguu

SEQ ID NO: 159180 - RNA, 23 nt, Human
agcaauaagaagggauacaugug

SEQ ID NO: 159181 - RNA, 22 nt, Human
gagcagggagacaacucuggug

SEQ ID NO: 159182 - RNA, 22 nt, Human
accuuucacgguaucagacauc

SEQ ID NO: 159183 - RNA, 22 nt, Human
ugagccugggagauggaggcug

SEQ ID NO: 159184 - RNA, 22 nt, Human
agccuggcuguaaccucauggu

SEQ ID NO: 159185 - RNA, 22 nt, Human
ugaugguugauuauaaaucagu

SEQ ID NO: 159186 - RNA, 22 nt, Human
aggcacugggggaugagcaagg

SEQ ID NO: 159187 - RNA, 22 nt, Human
ucacaggguaucugggauggau

SEQ ID NO: 159188 - RNA, 22 nt, Human
ccuggcacgaagggcugagguu

SEQ ID NO: 159189 - RNA, 22 nt, Human
uguaguaagugcgcaauaaaua

SEQ ID NO: 159190 - RNA, 22 nt, Human
agaaaucugacugcugugcaca

SEQ ID NO: 159191 - RNA, 22 nt, Human
aacaaauggaacacaaaucuuu

SEQ ID NO: 159192 - RNA, 22 nt, Human
ggaagggccucgggcgugggac

SEQ ID NO: 159193 - RNA, 22 nt, Human
uggaaggcaugggaacuguucu

SEQ ID NO: 159194 - RNA, 23 nt, Human
caugggagugagaaugccagcuc

SEQ ID NO: 159195 - RNA, 22 nt, Human
ucugugacuugcgggaggagaa

SEQ ID NO: 159196 - RNA, 22 nt, Human
uuuugaaagccagguuuguaug

SEQ ID NO: 159197 - RNA, 20 nt, Human
aaaaacaguaaugcugaaga

SEQ ID NO: 159198 - RNA, 22 nt, Human
aaguugaagcaugaaccaaggu

SEQ ID NO: 159199 - RNA, 22 nt, Human
cuuauguaaaacggaaagggaa

SEQ ID NO: 159200 - RNA, 22 nt, Human
uagaaaugauuuugaugcuuca

SEQ ID NO: 159201 - RNA, 22 nt, Human
agcuggagaugcccagcaccgg

SEQ ID NO: 159202 - RNA, 22 nt, Human
uagcccagagucccaauuccag

SEQ ID NO: 159203 - RNA, 22 nt, Human
cuugcaggcagggccuccugga

SEQ ID NO: 159204 - RNA, 19 nt, Human
gcuuuuuguugucaaaggu

SEQ ID NO: 159205 - RNA, 22 nt, Human
ugcuaucucuauauccauuuau

SEQ ID NO: 159206 - RNA, 22 nt, Human
ccugacgaaaggcgugcuggag

SEQ ID NO: 159207 - RNA, 19 nt, Human
agcaaauauaauaguguuc

SEQ ID NO: 159208 - RNA, 22 nt, Human
ucugcagcuucuugccagagag

SEQ ID NO: 159209 - RNA, 20 nt, Human
agcagcuguguuuucauccu

SEQ ID NO: 159210 - RNA, 22 nt, Human
cugggcugcaucaaagaggcau

SEQ ID NO: 159211 - RNA, 23 nt, Human
uggcucagggucucuuaugaagu

SEQ ID NO: 159212 - RNA, 22 nt, Human
ccugcacuaccuggggcugcug

SEQ ID NO: 159213 - RNA, 21 nt, Human
ccuggcugcacaguugcuggu

SEQ ID NO: 159214 - RNA, 22 nt, Human
uccagagcagguggucagaagg

SEQ ID NO: 159215 - RNA, 22 nt, Human
agggaagaaaauccaucgcugc

SEQ ID NO: 159216 - RNA, 22 nt, Human
agccuggagaggcgccauacac

SEQ ID NO: 159217 - RNA, 21 nt, Human
agggaaagaaaaugagcuaau

SEQ ID NO: 159218 - RNA, 22 nt, Human
acagaaauauagaagguaggaa

SEQ ID NO: 159219 - RNA, 22 nt, Human
aggcucugaucagguggcugug

SEQ ID NO: 159220 - RNA, 22 nt, Human
gccagggagucugggccacaga

SEQ ID NO: 159221 - RNA, 22 nt, Human
auucaguaggucuagaauaaga

SEQ ID NO: 159222 - RNA, 22 nt, Human
cagagagagugggguguggauu

SEQ ID NO: 159223 - RNA, 22 nt, Human
uggcagcacaagguggcccaug

SEQ ID NO: 159224 - RNA, 22 nt, Human
gcugagggcuguaacagcagag

SEQ ID NO: 159225 - RNA, 19 nt, Human
cuggugcuugagugaguca

SEQ ID NO: 159226 - RNA, 22 nt, Human
guuauguauugggaaauccaag

SEQ ID NO: 159227 - RNA, 22 nt, Human
agccagcaggugagugcagccu

SEQ ID NO: 159228 - RNA, 22 nt, Human
uguccacaucacucacuuguca

SEQ ID NO: 159229 - RNA, 22 nt, Human
agaguguaauaagggcaagggc

SEQ ID NO: 159230 - RNA, 22 nt, Human
uguaagauauucagcuuauuga

SEQ ID NO: 159231 - RNA, 22 nt, Human
cuggcucacuagcccugcccug

SEQ ID NO: 159232 - RNA, 22 nt, Human
aagcaaagaguuuaguggguga

SEQ ID NO: 159233 - RNA, 22 nt, Human
acuguguggaaauuugugaggg

SEQ ID NO: 159234 - RNA, 22 nt, Human
agugcacagcgugauguauugg

SEQ ID NO: 159235 - RNA, 22 nt, Human
gcugccaguaguuggagcucca

SEQ ID NO: 159236 - RNA, 22 nt, Human
uucauuccuucccuaagcaacu

SEQ ID NO: 159237 - RNA, 22 nt, Human
gucucagagagcuacucucuua

SEQ ID NO: 159238 - RNA, 22 nt, Human
gaggggcuggcacgauggcugc

SEQ ID NO: 159239 - RNA, 18 nt, Human
gguggcaggucagaugcc

SEQ ID NO: 159240 - RNA, 22 nt, Human
gccaggcugcuccagggaggcc

SEQ ID NO: 159241 - RNA, 22 nt, Human
ccuggccucagccuagggcuga

SEQ ID NO: 159242 - RNA, 22 nt, Human
gcauuucuuccuggugugagcc

SEQ ID NO: 159243 - RNA, 19 nt, Human
acaagggcaggcaagguga

SEQ ID NO: 159244 - RNA, 17 nt, Human
aggcuggcucacaggga

SEQ ID NO: 159245 - RNA, 18 nt, Human
caugucugcgccacaagg

SEQ ID NO: 159246 - RNA, 22 nt, Human
cuuccuggccauugccauggca

SEQ ID NO: 159247 - RNA, 22 nt, Human
gaggccugaaaggggaccuaug

SEQ ID NO: 159248 - RNA, 23 nt, Human
auacauacagucuuacugacuuu

SEQ ID NO: 159249 - RNA, 22 nt, Human
caucacuguccucagcauucca

SEQ ID NO: 159250 - RNA, 22 nt, Human
ucuuuccuacuuuauugugaac

SEQ ID NO: 159251 - RNA, 22 nt, Human
caggccugacccugagcuucac

SEQ ID NO: 159252 - RNA, 22 nt, Human
ucuggagcuuguuucagauggu

SEQ ID NO: 159253 - RNA, 22 nt, Human
ucucagggagggcgagucagcg

SEQ ID NO: 159254 - RNA, 22 nt, Human
gggguggauuccuacaggucca

SEQ ID NO: 159255 - RNA, 22 nt, Human
ggcagccaugucccagggcuuc

SEQ ID NO: 159256 - RNA, 22 nt, Human
caaauaucuuuggcaaagagaa

SEQ ID NO: 159257 - RNA, 22 nt, Human
ccaggagcauuaagagaacaua

SEQ ID NO: 159258 - RNA, 22 nt, Human
agcagcagauccaaaaaaugug

SEQ ID NO: 159259 - RNA, 22 nt, Human
ugggcagaguagcucagaagaa

SEQ ID NO: 159260 - RNA, 22 nt, Human
gcucuccacugaccacggggca

SEQ ID NO: 159261 - RNA, 22 nt, Human
cuucaagauccauagauauugc

SEQ ID NO: 159262 - RNA, 22 nt, Human
uggcucugcugaaccuagugca

SEQ ID NO: 159263 - RNA, 22 nt, Human
ugccugggaaccaauccuggcu

SEQ ID NO: 159264 - RNA, 22 nt, Human
cugucucugucuuaacucccag

SEQ ID NO: 159265 - RNA, 22 nt, Human
aaaauaucagcaaagggugaca

SEQ ID NO: 159266 - RNA, 22 nt, Human
gggccagagcuuggcagcuggg

SEQ ID NO: 159267 - RNA, 17 nt, Human
agcugagcuggccaggg

SEQ ID NO: 159268 - RNA, 22 nt, Human
aaagauuuaugaaguucaauua

SEQ ID NO: 159269 - RNA, 22 nt, Human
ggagcugcucagagccaguccc

SEQ ID NO: 159270 - RNA, 22 nt, Human
uaagcauucaaugcuuagcacu

SEQ ID NO: 159271 - RNA, 19 nt, Human
agugucaucagcuacucag

SEQ ID NO: 159272 - RNA, 20 nt, Human
gggcuggcgcauggggaaag

SEQ ID NO: 159273 - RNA, 22 nt, Human
ccucacuuuccuuucuccuggg

SEQ ID NO: 159274 - RNA, 22 nt, Human
ggcaggguggcccuccagugag

SEQ ID NO: 159275 - RNA, 22 nt, Human
uccaggagagguguggggacug

SEQ ID NO: 159276 - RNA, 22 nt, Human
ugucucugagaugacucccacc

SEQ ID NO: 159277 - RNA, 22 nt, Human
aaauguguuucgaaaacuggug

SEQ ID NO: 159278 - RNA, 22 nt, Human
aaaucaguucucccuuucuuca

SEQ ID NO: 159279 - RNA, 20 nt, Human
agucccuuuggucagguauu

SEQ ID NO: 159280 - RNA, 22 nt, Human
guucaaagcuccugguacagua

SEQ ID NO: 159281 - RNA, 22 nt, Human
ggagcuggcuacagagaacucc

SEQ ID NO: 159282 - RNA, 22 nt, Human
agcucuccacacauaggacuag

SEQ ID NO: 159283 - RNA, 22 nt, Human
ggaugcaggaguugaagaagga

SEQ ID NO: 159284 - RNA, 22 nt, Human
uugucuuaaauggauggacaau

SEQ ID NO: 159285 - RNA, 22 nt, Human
guggagaccuccuaggaugugu

SEQ ID NO: 159286 - RNA, 19 nt, Human
uccccagcaccucugaguc

SEQ ID NO: 159287 - RNA, 22 nt, Human
ucuugccucuuccccuuuccau

SEQ ID NO: 159288 - RNA, 22 nt, Human
augcugaggacaaagagaucaa

SEQ ID NO: 159289 - RNA, 22 nt, Human
ccaggccuuucuucuuggucug

SEQ ID NO: 159290 - RNA, 22 nt, Human
acugggaggcaaagagcaagga

SEQ ID NO: 159291 - RNA, 21 nt, Human
ucaggcaggcgcagagggaag

SEQ ID NO: 159292 - RNA, 22 nt, Human
aucaaaguccaucagaagguag

SEQ ID NO: 159293 - RNA, 22 nt, Human
ugacagaacagguugggagcaa

SEQ ID NO: 159294 - RNA, 22 nt, Human
gaguuauucuagguccuuugua

SEQ ID NO: 159295 - RNA, 22 nt, Human
caauguguguguuuuucucaac

SEQ ID NO: 159296 - RNA, 22 nt, Human
ugagccagaggaggcugugugg

SEQ ID NO: 159297 - RNA, 22 nt, Human
ggaaaguggugguggaaagagg

SEQ ID NO: 159298 - RNA, 22 nt, Human
cucuccagaauaugccgccgug

SEQ ID NO: 159299 - RNA, 22 nt, Human
cagaguguuucuuugggugggu

SEQ ID NO: 159300 - RNA, 21 nt, Human
gagacagcccagugccagggc

SEQ ID NO: 159301 - RNA, 22 nt, Human
ggcuucaccgcgggguugcagg

SEQ ID NO: 159302 - RNA, 21 nt, Human
ugcaggaaagugcugcgaccc

SEQ ID NO: 159303 - RNA, 21 nt, Human
gcagccacagccaccaagcua

SEQ ID NO: 159304 - RNA, 22 nt, Human
auaugcacacucugcccacaga

SEQ ID NO: 159305 - RNA, 22 nt, Human
agcuguguagggaaucagagaa

SEQ ID NO: 159306 - RNA, 19 nt, Human
ccucccacggauuccuucc

SEQ ID NO: 159307 - RNA, 22 nt, Human
ugggccuguugggguugaguua

SEQ ID NO: 159308 - RNA, 22 nt, Human
guguuuccuaguuuaaugaaug

SEQ ID NO: 159309 - RNA, 22 nt, Human
uugacaauugggagauauaaag

SEQ ID NO: 159310 - RNA, 22 nt, Human
uggcucugucaaacugcacaca

SEQ ID NO: 159311 - RNA, 22 nt, Human
aggcugcuucagcugcagggag

SEQ ID NO: 159312 - RNA, 22 nt, Human
aauuagagaucaguucuuugac

SEQ ID NO: 159313 - RNA, 20 nt, Human
gucagugucuucaguaguga

SEQ ID NO: 159314 - RNA, 22 nt, Human
gcccucagaugggaaaggaggg

SEQ ID NO: 159315 - RNA, 22 nt, Human
gcugccugcacagagcugcuuu

SEQ ID NO: 159316 - RNA, 22 nt, Human
gugcauuugugcaugcacaugu

SEQ ID NO: 159317 - RNA, 22 nt, Human
agggcagcuaaggugcugacug

SEQ ID NO: 159318 - RNA, 22 nt, Human
ggagccagcagggugacacuga

SEQ ID NO: 159319 - RNA, 17 nt, Human
ugcugccaagucccaac

SEQ ID NO: 159320 - RNA, 23 nt, Human
agcagggccagaauacuugcugu

SEQ ID NO: 159321 - RNA, 22 nt, Human
agagccacugggagacagagca

SEQ ID NO: 159322 - RNA, 22 nt, Human
ccucugagaccagcucugcacc

SEQ ID NO: 159323 - RNA, 22 nt, Human
ugauuuccacagucaggggugc

SEQ ID NO: 159324 - RNA, 22 nt, Human
ugaacgcagguccacauggcuc

SEQ ID NO: 159325 - RNA, 22 nt, Human
ccccagccagcaggaccucuga

SEQ ID NO: 159326 - RNA, 22 nt, Human
gggcagauggggcacaggcuga

SEQ ID NO: 159327 - RNA, 22 nt, Human
gagcucuggcagggcaggucug

SEQ ID NO: 159328 - RNA, 22 nt, Human
ggagggcaucaaucaggccugg

SEQ ID NO: 159329 - RNA, 22 nt, Human
ugcauuaugcuugugcuguaua

SEQ ID NO: 159330 - RNA, 22 nt, Human
uggcuggacagugggcagugga

SEQ ID NO: 159331 - RNA, 22 nt, Human
ugggcucugcaucagugcccau

SEQ ID NO: 159332 - RNA, 22 nt, Human
ucucagagcucacaccuccugg

SEQ ID NO: 159333 - RNA, 22 nt, Human
gaggaggcuaagugggcucugg

SEQ ID NO: 159334 - RNA, 22 nt, Human
ugggccuguggcuuggcucuag

SEQ ID NO: 159335 - RNA, 22 nt, Human
acaggcuuuuuuagaaugacau

SEQ ID NO: 159336 - RNA, 22 nt, Human
acaaggcugaacagugaagccg

SEQ ID NO: 159337 - RNA, 22 nt, Human
cuucuuuacuuucuagaaauaa

SEQ ID NO: 159338 - RNA, 22 nt, Human
cugggcacuuuggggagccuac

SEQ ID NO: 159339 - RNA, 22 nt, Human
acagagcaguucuggagcuggc

SEQ ID NO: 159340 - RNA, 22 nt, Human
ugcuggcuguauaugugagagu

SEQ ID NO: 159341 - RNA, 22 nt, Human
uagggcagagcuuguacacgau

SEQ ID NO: 159342 - RNA, 22 nt, Human
cucugggcaaguuucuucauga

SEQ ID NO: 159343 - RNA, 22 nt, Human
gccucugcaauuacauugugcc

SEQ ID NO: 159344 - RNA, 22 nt, Human
aagcacuuagaagagugccugc

SEQ ID NO: 159345 - RNA, 22 nt, Human
aagagcugcaucuaagccauga

SEQ ID NO: 159346 - RNA, 22 nt, Human
ccuggagcuuggucacgcugcg

SEQ ID NO: 159347 - RNA, 22 nt, Human
accugccuauggagccacaugg

SEQ ID NO: 159348 - RNA, 22 nt, Human
gggcugugagaguggggcugcu

SEQ ID NO: 159349 - RNA, 21 nt, Human
ccugagggugguugugaagau

SEQ ID NO: 159350 - RNA, 22 nt, Human
agagugaaggccagguuacagu

SEQ ID NO: 159351 - RNA, 22 nt, Human
accagguggccccagcgugguu

SEQ ID NO: 159352 - RNA, 22 nt, Human
guacuucccugggaggcaagca

SEQ ID NO: 159353 - RNA, 22 nt, Human
aaggcacuagcagaauuaguga

SEQ ID NO: 159354 - RNA, 22 nt, Human
acaugcuuucuagguccuucug

SEQ ID NO: 159355 - RNA, 22 nt, Human
ucagaggucacacagcaaguuu

SEQ ID NO: 159356 - RNA, 22 nt, Human
gguugccggggcaggacuggaa

SEQ ID NO: 159357 - RNA, 22 nt, Human
uggccugguccuugucaaggca

SEQ ID NO: 159358 - RNA, 22 nt, Human
aaugaacaggugaaugucagau

SEQ ID NO: 159359 - RNA, 22 nt, Human
ccugggagggcaagugcugaug

SEQ ID NO: 159360 - RNA, 22 nt, Human
uucacauuaucaggauuguuuc

SEQ ID NO: 159361 - RNA, 22 nt, Human
cucuggaguucucaugaggaac

SEQ ID NO: 159362 - RNA, 22 nt, Human
cagggcaggacagauacauuac

SEQ ID NO: 159363 - RNA, 22 nt, Human
cuccucugucuaccacgagggu

SEQ ID NO: 159364 - RNA, 22 nt, Human
cacauccuucagcugagcccag

SEQ ID NO: 159365 - RNA, 22 nt, Human
agggaggaucugcuccuugucu

SEQ ID NO: 159366 - RNA, 21 nt, Human
agaaaaaccagcauguuuuca

SEQ ID NO: 159367 - RNA, 22 nt, Human
uacaaaguuugagaaugcuuuc

SEQ ID NO: 159368 - RNA, 22 nt, Human
ccagugcacagccaggcaggug

SEQ ID NO: 159369 - RNA, 22 nt, Human
ugucccaguuuugcagguuaga

SEQ ID NO: 159370 - RNA, 22 nt, Human
gucccagggagguucagggcuu

SEQ ID NO: 159371 - RNA, 22 nt, Human
gucccuaguggaaagacaugau

SEQ ID NO: 159372 - RNA, 22 nt, Human
auggaaagccaguguuccauca

SEQ ID NO: 159373 - RNA, 22 nt, Human
gcugccugccuugccuggagga

SEQ ID NO: 159374 - RNA, 22 nt, Human
ucaggcaggcagagggcaaaug

SEQ ID NO: 159375 - RNA, 22 nt, Human
gaaaccucuuagccucucuuug

SEQ ID NO: 159376 - RNA, 22 nt, Human
ugcagcuucuuguccugugauu

SEQ ID NO: 159377 - RNA, 22 nt, Human
gacagcaggagaucaugauaga

SEQ ID NO: 159378 - RNA, 22 nt, Human
caagagcugcaaauagcgugac

SEQ ID NO: 159379 - RNA, 22 nt, Human
caauguguuugcauauuaaaau

SEQ ID NO: 159380 - RNA, 22 nt, Human
gagguagccacagauagagacu

SEQ ID NO: 159381 - RNA, 22 nt, Human
ccugugccauccugagcauccc

SEQ ID NO: 159382 - RNA, 22 nt, Human
uccuucaggguugaggccgacu

SEQ ID NO: 159383 - RNA, 22 nt, Human
ugcauuguuugauaggugaauu

SEQ ID NO: 159384 - RNA, 22 nt, Human
auucaagagcccauguuuccug

SEQ ID NO: 159385 - RNA, 22 nt, Human
agagccagcauuugggcccugc

SEQ ID NO: 159386 - RNA, 22 nt, Human
gcugcaggcgccugcggucucu

SEQ ID NO: 159387 - RNA, 22 nt, Human
cauuucugugacacuuccaucu

SEQ ID NO: 159388 - RNA, 21 nt, Human
uugaaggaucacuucuguacc

SEQ ID NO: 159389 - RNA, 22 nt, Human
gagaagcaauuuccaacugugc

SEQ ID NO: 159390 - RNA, 22 nt, Human
guaacugaggcagcuuuuaaga

SEQ ID NO: 159391 - RNA, 22 nt, Human
aggaaaaagaguugcugccuuc

SEQ ID NO: 159392 - RNA, 22 nt, Human
aaaaugcaugagaaugugcucg

SEQ ID NO: 159393 - RNA, 22 nt, Human
cccucugcugccuggcuggguc

SEQ ID NO: 159394 - RNA, 21 nt, Human
agagccugagaucuuccagca

SEQ ID NO: 159395 - RNA, 19 nt, Human
ugaagcaauaccauuuuug

SEQ ID NO: 159396 - RNA, 22 nt, Human
acaggugguaaaauggacuguc

SEQ ID NO: 159397 - RNA, 22 nt, Human
cacugcucgcugcagcauggcc

SEQ ID NO: 159398 - RNA, 22 nt, Human
gagcccaggcagagguugcagu

SEQ ID NO: 159399 - RNA, 22 nt, Human
acaaagucaaauugcagccgcc

SEQ ID NO: 159400 - RNA, 22 nt, Human
aaaguuacuaucacaaugaaau

SEQ ID NO: 159401 - RNA, 22 nt, Human
uagggcaggugaagaaaagcua

SEQ ID NO: 159402 - RNA, 22 nt, Human
aagaacagauucagccugaacu

SEQ ID NO: 159403 - RNA, 22 nt, Human
ccagcagcgauagggugagugc

SEQ ID NO: 159404 - RNA, 21 nt, Human
ugggcagauggcaguguggcu

SEQ ID NO: 159405 - RNA, 22 nt, Human
ccugggagugucagacuugcuu

SEQ ID NO: 159406 - RNA, 22 nt, Human
cucugagcuccuggaagcgugc

SEQ ID NO: 159407 - RNA, 22 nt, Human
gggagggaucugcuaggcaaug

SEQ ID NO: 159408 - RNA, 22 nt, Human
agagcucaagacgcucacagua

SEQ ID NO: 159409 - RNA, 22 nt, Human
ucaaaaguuucacauagagaua

SEQ ID NO: 159410 - RNA, 22 nt, Human
ccagagccugcugagccccauu

SEQ ID NO: 159411 - RNA, 22 nt, Human
acuuucuaggucucaguccuuu

SEQ ID NO: 159412 - RNA, 22 nt, Human
guggcccucugauagggucagg

SEQ ID NO: 159413 - RNA, 22 nt, Human
accaucagucacauguagagaa

SEQ ID NO: 159414 - RNA, 22 nt, Human
caaaugugacuuuugggcuucu

SEQ ID NO: 159415 - RNA, 22 nt, Human
gaaggcuugcagcucuguggca

SEQ ID NO: 159416 - RNA, 18 nt, Human
ggaaaaggagugucuagc

SEQ ID NO: 159417 - RNA, 22 nt, Human
aggccaaguagcuagcauugaa

SEQ ID NO: 159418 - RNA, 22 nt, Human
cugcagaggucuugcugauggu

SEQ ID NO: 159419 - RNA, 22 nt, Human
ggcugcagguugguuggcagcu

SEQ ID NO: 159420 - RNA, 21 nt, Human
cugcaucucauagaacauguc

SEQ ID NO: 159421 - RNA, 22 nt, Human
aggcacugacucaagggagcca

SEQ ID NO: 159422 - RNA, 22 nt, Human
ggagaaggaagaaagcuacuau

SEQ ID NO: 159423 - RNA, 22 nt, Human
ugacagaaauaguucuuaauuu

SEQ ID NO: 159424 - RNA, 22 nt, Human
ugcugugagguugagaaggaag

SEQ ID NO: 159425 - RNA, 22 nt, Human
ggcugccacgucgaggguccaa

SEQ ID NO: 159426 - RNA, 22 nt, Human
ccagcccuguaaggaugaggca

SEQ ID NO: 159427 - RNA, 20 nt, Human
gcucccagccugcagucccc

SEQ ID NO: 159428 - RNA, 22 nt, Human
aaggcaggaugcggacccaucu

SEQ ID NO: 159429 - RNA, 17 nt, Human
aaaauucuguaaagagg

SEQ ID NO: 159430 - RNA, 22 nt, Human
ugcagggccuucuagaccaugg

SEQ ID NO: 159431 - RNA, 22 nt, Human
aggagccaugagugacaucaca

SEQ ID NO: 159432 - RNA, 22 nt, Human
gcaggagucacugacuuggucc

SEQ ID NO: 159433 - RNA, 22 nt, Human
agguggagacccagagaaggcg

SEQ ID NO: 159434 - RNA, 22 nt, Human
gaaaguuuauagguuauauaau

SEQ ID NO: 159435 - RNA, 22 nt, Human
ugugugcauucacaugcaugcc

SEQ ID NO: 159436 - RNA, 22 nt, Human
agcauugccugccuauugcuaa

SEQ ID NO: 159437 - RNA, 22 nt, Human
gcugccacuuggucaugucaug

SEQ ID NO: 159438 - RNA, 21 nt, Human
ggccugaguauaggacaggcc

SEQ ID NO: 159439 - RNA, 22 nt, Human
uaugcacauauaaccugcacug

SEQ ID NO: 159440 - RNA, 22 nt, Human
ccugccugggcucacuugccag

SEQ ID NO: 159441 - RNA, 22 nt, Human
aaggcuaugaucuuuuucauga

SEQ ID NO: 159442 - RNA, 19 nt, Human
ugagugggccccugcagac

SEQ ID NO: 159443 - RNA, 19 nt, Human
agucucaguguacagaggc

SEQ ID NO: 159444 - RNA, 22 nt, Human
ggcuggcacucuguccaguguc

SEQ ID NO: 159445 - RNA, 22 nt, Human
aaucagaaaauucaguggaauu

SEQ ID NO: 159446 - RNA, 22 nt, Human
uccuuugacuucuugcagucca

SEQ ID NO: 159447 - RNA, 22 nt, Human
ggggauggaggcgugugguccu

SEQ ID NO: 159448 - RNA, 17 nt, Human
cagugcagagcccuuuc

SEQ ID NO: 159449 - RNA, 22 nt, Human
cugcuggccuagcccauccucu

SEQ ID NO: 159450 - RNA, 22 nt, Human
cccucccaagcacucugacaua

SEQ ID NO: 159451 - RNA, 22 nt, Human
gcugucuggguugagggcccug

SEQ ID NO: 159452 - RNA, 22 nt, Human
ggucaugcugugaaucagugcu

SEQ ID NO: 159453 - RNA, 20 nt, Human
gcugggggugugcugaguga

SEQ ID NO: 159454 - RNA, 17 nt, Human
uuuucucucuuggauuc

SEQ ID NO: 159455 - RNA, 22 nt, Human
ugagccaguggaagauggcagu

SEQ ID NO: 159456 - RNA, 22 nt, Human
cucccagggccaucgagucacu

SEQ ID NO: 159457 - RNA, 22 nt, Human
aguacuucagaggcugcccagg

SEQ ID NO: 159458 - RNA, 22 nt, Human
cagguggggagaguguggagca

SEQ ID NO: 159459 - RNA, 22 nt, Human
ucccagagugagccaggggcag

SEQ ID NO: 159460 - RNA, 22 nt, Human
ccaggaguuugaggcugcagug

SEQ ID NO: 159461 - RNA, 22 nt, Human
gccugcagugagugcagaaggu

SEQ ID NO: 159462 - RNA, 22 nt, Human
agcacagaguugcagagagcgu

SEQ ID NO: 159463 - RNA, 22 nt, Human
gggcagagacucagaaacagaa

SEQ ID NO: 159464 - RNA, 22 nt, Human
caggggccggcuguccgugccc

SEQ ID NO: 159465 - RNA, 22 nt, Human
ccugucucuuucaaucugagag

SEQ ID NO: 159466 - RNA, 22 nt, Human
ucagagccaaucauggugcauu

SEQ ID NO: 159467 - RNA, 22 nt, Human
agucugcacucagguggagguc

SEQ ID NO: 159468 - RNA, 17 nt, Human
gccuuccuuccuccaca

SEQ ID NO: 159469 - RNA, 22 nt, Human
ccaggagcagggcuggcugcac

SEQ ID NO: 159470 - RNA, 22 nt, Human
ugcugccagggcucugcccaca

SEQ ID NO: 159471 - RNA, 22 nt, Human
uccuugaagcuuguaucuaaua

SEQ ID NO: 159472 - RNA, 23 nt, Human
gccucugcagccuaguuaguguc

SEQ ID NO: 159473 - RNA, 22 nt, Human
ggcggggguccaggagccugca

SEQ ID NO: 159474 - RNA, 22 nt, Human
acauuuacagugcuagacaauc

SEQ ID NO: 159475 - RNA, 22 nt, Human
ucccucuguguugggcaugccu

SEQ ID NO: 159476 - RNA, 22 nt, Human
ggggacugccuuccacagacac

SEQ ID NO: 159477 - RNA, 22 nt, Human
auggacaggaacucccuuggca

SEQ ID NO: 159478 - RNA, 22 nt, Human
cagaguggcagucccaggccca

SEQ ID NO: 159479 - RNA, 22 nt, Human
ucuggagccacaaaccucagcu

SEQ ID NO: 159480 - RNA, 22 nt, Human
aagcagggugucuugacccaug

SEQ ID NO: 159481 - RNA, 22 nt, Human
cugagcuggucuauggacuugg

SEQ ID NO: 159482 - RNA, 22 nt, Human
cccaggcagagagcuggugagc

SEQ ID NO: 159483 - RNA, 19 nt, Human
ggagccuggagcacgugcc

SEQ ID NO: 159484 - RNA, 22 nt, Human
agaauucuguucuucgggugug

SEQ ID NO: 159485 - RNA, 22 nt, Human
ccagcuccgggaguugcugcug

SEQ ID NO: 159486 - RNA, 22 nt, Human
uacaaagugagcaaccucuuuu

SEQ ID NO: 159487 - RNA, 22 nt, Human
ucucagggcgcagugaggcagu

SEQ ID NO: 159488 - RNA, 22 nt, Human
aagccaagaguuaacuauuugu

SEQ ID NO: 159489 - RNA, 22 nt, Human
cccagagcuccgguccugccca

SEQ ID NO: 159490 - RNA, 22 nt, Human
uucaggagcuggcugcgaagga

SEQ ID NO: 159491 - RNA, 20 nt, Human
ugcagggcugccucccagcu

SEQ ID NO: 159492 - RNA, 22 nt, Human
gccugagauucugcauuucuaa

SEQ ID NO: 159493 - RNA, 22 nt, Human
gccagccugugcuuggccaggc

SEQ ID NO: 159494 - RNA, 22 nt, Human
uuuauguacauauccacaagga

SEQ ID NO: 159495 - RNA, 22 nt, Human
gugauugcccagcaccauuguu

SEQ ID NO: 159496 - RNA, 22 nt, Human
gggggcuguccugugcauugua

SEQ ID NO: 159497 - RNA, 22 nt, Human
acccacgaagaugagcggcaug

SEQ ID NO: 159498 - RNA, 19 nt, Human
uugguggugguuuugguuc

SEQ ID NO: 159499 - RNA, 15 nt, Human
aggcacugugggacc

SEQ ID NO: 159500 - RNA, 22 nt, Human
uggagcuggaauuugagcugga

SEQ ID NO: 159501 - RNA, 22 nt, Human
acaaaaauuagcugggcauggu

SEQ ID NO: 159502 - RNA, 22 nt, Human
ucucagagcaucauuuucuuag

SEQ ID NO: 159503 - RNA, 22 nt, Human
ucugcaggacugaggccuguuu

SEQ ID NO: 159504 - RNA, 22 nt, Human
ggccugugucugugccuguccu

SEQ ID NO: 159505 - RNA, 22 nt, Human
gucccaggugggcuccaccucu

SEQ ID NO: 159506 - RNA, 22 nt, Human
agcucauggugcuaucucaggg

SEQ ID NO: 159507 - RNA, 22 nt, Human
caguuucuacgacuuaagcaca

SEQ ID NO: 159508 - RNA, 21 nt, Human
agcagcagaucuggugagggc

SEQ ID NO: 159509 - RNA, 22 nt, Human
gggcaugagagggcagcuggca

SEQ ID NO: 159510 - RNA, 22 nt, Human
cugccuguuuucugauagauuu

SEQ ID NO: 159511 - RNA, 22 nt, Human
uucuggagaucugccuauggga

SEQ ID NO: 159512 - RNA, 22 nt, Human
agagccuugaagaucuggaaaa

SEQ ID NO: 159513 - RNA, 22 nt, Human
cagagcagugaggaguugugua

SEQ ID NO: 159514 - RNA, 22 nt, Human
acagaaggcggggacaaggcgg

SEQ ID NO: 159515 - RNA, 18 nt, Human
ccugagcccugcuuacuu

SEQ ID NO: 159516 - RNA, 22 nt, Human
cagcagagcugugugggaaggg

SEQ ID NO: 159517 - RNA, 22 nt, Human
gaagcucucaaacucuccccuu

SEQ ID NO: 159518 - RNA, 22 nt, Human
ggugaaggaggaagcugaugga

SEQ ID NO: 159519 - RNA, 22 nt, Human
acauuucucuugaugucucuau

SEQ ID NO: 159520 - RNA, 22 nt, Human
ucucaggggauucacuggcacc

SEQ ID NO: 159521 - RNA, 22 nt, Human
cugcuuugaggggcucuguaua

SEQ ID NO: 159522 - RNA, 22 nt, Human
cucagaguccauaguuuacagu

SEQ ID NO: 159523 - RNA, 22 nt, Human
cucuggccugcuuccucaggua

SEQ ID NO: 159524 - RNA, 22 nt, Human
aaggagucucagcugggccuga

SEQ ID NO: 159525 - RNA, 22 nt, Human
uguucuugggaaucuuacaguu

SEQ ID NO: 159526 - RNA, 22 nt, Human
uuuccucuuauacaguguuuau

SEQ ID NO: 159527 - RNA, 22 nt, Human
agcagacaacccagaugaccca

SEQ ID NO: 159528 - RNA, 20 nt, Human
ucagaggcugccagcugggg

SEQ ID NO: 159529 - RNA, 22 nt, Human
gccuccugaaaggaagagcucc

SEQ ID NO: 159530 - RNA, 22 nt, Human
cagaauuuagcacaauguaugg

SEQ ID NO: 159531 - RNA, 22 nt, Human
cuguguccugcgucaagccaau

SEQ ID NO: 159532 - RNA, 21 nt, Human
uccuccuucaaguccuggccu

SEQ ID NO: 159533 - RNA, 22 nt, Human
guuauguaugagggaaugauua

SEQ ID NO: 159534 - RNA, 22 nt, Human
caggguccggcugccuggcugu

SEQ ID NO: 159535 - RNA, 22 nt, Human
uggcucuguugagguauggauu

SEQ ID NO: 159536 - RNA, 22 nt, Human
gggcuggggcucaauaauuugu

SEQ ID NO: 159537 - RNA, 22 nt, Human
ucaaagucacaacucucuaauu

SEQ ID NO: 159538 - RNA, 22 nt, Human
ugugugccugagccgugccugg

SEQ ID NO: 159539 - RNA, 22 nt, Human
agcugccaaguuucucaguuua

SEQ ID NO: 159540 - RNA, 20 nt, Human
ccaggcacugucccaugcag

SEQ ID NO: 159541 - RNA, 17 nt, Human
agccccucagcgucacc

SEQ ID NO: 159542 - RNA, 22 nt, Human
uggggcuguggauucucacgaa

SEQ ID NO: 159543 - RNA, 22 nt, Human
cagcaauaaugucuacaaaucu

SEQ ID NO: 159544 - RNA, 22 nt, Human
uugggaaggcguggaagcagaa

SEQ ID NO: 159545 - RNA, 22 nt, Human
gaggagagggcugcgggcccac

SEQ ID NO: 159546 - RNA, 22 nt, Human
acagggcagagaggcaggcuug

SEQ ID NO: 159547 - RNA, 22 nt, Human
uaccuugggguuuuguugcucu

SEQ ID NO: 159548 - RNA, 22 nt, Human
gcucucugggugugucuagaua

SEQ ID NO: 159549 - RNA, 17 nt, Human
cuggagccuccaacucc

SEQ ID NO: 159550 - RNA, 20 nt, Human
ucacaggggaccaggagcag

SEQ ID NO: 159551 - RNA, 22 nt, Human
ggugggcacccgagacuggauc

SEQ ID NO: 159552 - RNA, 21 nt, Human
cuggacugaggagacagucgc

SEQ ID NO: 159553 - RNA, 22 nt, Human
gccugccucaaaaucccaguuc

SEQ ID NO: 159554 - RNA, 22 nt, Human
ugcucuggagggugaagcuuuu

SEQ ID NO: 159555 - RNA, 23 nt, Human
uggcccugugcaugcugcuuccc

SEQ ID NO: 159556 - RNA, 22 nt, Human
gaggcugggaaguccaagacca

SEQ ID NO: 159557 - RNA, 22 nt, Human
auuugucugcuugcugccuucc

SEQ ID NO: 159558 - RNA, 22 nt, Human
ugggcagaggacagggaagauc

SEQ ID NO: 159559 - RNA, 22 nt, Human
cagggcagaaggcacucuacuc

SEQ ID NO: 159560 - RNA, 22 nt, Human
gccagcugguaggcaccuagcc

SEQ ID NO: 159561 - RNA, 22 nt, Human
ucacaggagggagagacaccca

SEQ ID NO: 159562 - RNA, 22 nt, Human
gccucugcgccucagccgaccu

SEQ ID NO: 159563 - RNA, 23 nt, Human
agggaaaguaguaauggccuuug

SEQ ID NO: 159564 - RNA, 22 nt, Human
acaccagggccuagccagggcg

SEQ ID NO: 159565 - RNA, 22 nt, Human
aagcccagcugaaagcauuuuu

SEQ ID NO: 159566 - RNA, 22 nt, Human
ggcucacgcaauuaucccggcc

SEQ ID NO: 159567 - RNA, 22 nt, Human
ugcugcucuucaccauggccuc

SEQ ID NO: 159568 - RNA, 20 nt, Human
gccugagcuccgccuccugu

SEQ ID NO: 159569 - RNA, 22 nt, Human
acuuucuccagaaaaccaagga

SEQ ID NO: 159570 - RNA, 22 nt, Human
gcagccagccccucugaccucu

SEQ ID NO: 159571 - RNA, 22 nt, Human
gugucccaaucuacuuuucccu

SEQ ID NO: 159572 - RNA, 22 nt, Human
aggccagagaggggaccagccu

SEQ ID NO: 159573 - RNA, 22 nt, Human
cagcuucucagaaagcugaggu

SEQ ID NO: 159574 - RNA, 22 nt, Human
aacauacagugagcaguggacu

SEQ ID NO: 159575 - RNA, 22 nt, Human
ugggaggcuuccagaccuugcu

SEQ ID NO: 159576 - RNA, 23 nt, Human
uuugcaaauuggacacaaccaca

SEQ ID NO: 159577 - RNA, 22 nt, Human
uaccaggcagcugcacagaggc

SEQ ID NO: 159578 - RNA, 22 nt, Human
agagugaaguuuuugaaaguga

SEQ ID NO: 159579 - RNA, 22 nt, Human
agguggcuccucccauggcugg

SEQ ID NO: 159580 - RNA, 22 nt, Human
ugucucaguucccuucucugga

SEQ ID NO: 159581 - RNA, 22 nt, Human
cuguagcagugugcucuuuuuc

SEQ ID NO: 159582 - RNA, 22 nt, Human
ugcagccauuuucugccaaugc

SEQ ID NO: 159583 - RNA, 22 nt, Human
uccuuucaccaaaaaguguugu

SEQ ID NO: 159584 - RNA, 22 nt, Human
cggcagagacggcgcuuugaac

SEQ ID NO: 159585 - RNA, 22 nt, Human
augggaggcagacacuaaguuc

SEQ ID NO: 159586 - RNA, 22 nt, Human
ucagcagggaggcucugugccc

SEQ ID NO: 159587 - RNA, 22 nt, Human
uauguacaguccuuaacuuaaa

SEQ ID NO: 159588 - RNA, 22 nt, Human
auguaucagauaaagcaugugg

SEQ ID NO: 159589 - RNA, 22 nt, Human
gaggcuggugguuaguuccauu

SEQ ID NO: 159590 - RNA, 22 nt, Human
uuacauuagacccacuuucaug

SEQ ID NO: 159591 - RNA, 22 nt, Human
agagccugugauugucaucacc

SEQ ID NO: 159592 - RNA, 18 nt, Human
gaggauggaaggagaugc

SEQ ID NO: 159593 - RNA, 22 nt, Human
agaaaucaugacuaagagcagu

SEQ ID NO: 159594 - RNA, 22 nt, Human
uuuauucuugagagugagaaga

SEQ ID NO: 159595 - RNA, 22 nt, Human
uccaggagaggccugaccaggu

SEQ ID NO: 159596 - RNA, 22 nt, Human
uuccuguauucuaaagggaaag

SEQ ID NO: 159597 - RNA, 22 nt, Human
uuuaguaaguucacugcaaagc

SEQ ID NO: 159598 - RNA, 22 nt, Human
ggccugcuuuccgagccugcag

SEQ ID NO: 159599 - RNA, 22 nt, Human
uagcagggguagauagagugug

SEQ ID NO: 159600 - RNA, 22 nt, Human
guuuacaaauauuuuaaauggu

SEQ ID NO: 159601 - RNA, 22 nt, Human
acauuucuucccuuuagcagaa

SEQ ID NO: 159602 - RNA, 22 nt, Human
cucucccagucaggcucaggau

SEQ ID NO: 159603 - RNA, 22 nt, Human
cacccagcagcacuuaagacua

SEQ ID NO: 159604 - RNA, 22 nt, Human
acugaaggguaaugugggagcc

SEQ ID NO: 159605 - RNA, 22 nt, Human
caggccuggggcuggcuuccag

SEQ ID NO: 159606 - RNA, 22 nt, Human
ugugcucuggaguugccuucac

SEQ ID NO: 159607 - RNA, 22 nt, Human
caguacuugggggguucuaagu

SEQ ID NO: 159608 - RNA, 22 nt, Human
ucagagguaagggcugagagga

SEQ ID NO: 159609 - RNA, 22 nt, Human
uauccuuguacuauaguauuua

SEQ ID NO: 159610 - RNA, 22 nt, Human
ucagacaguuugcagugugccu

SEQ ID NO: 159611 - RNA, 20 nt, Human
uccaguuuuggagacauucu

SEQ ID NO: 159612 - RNA, 22 nt, Human
gcugccuuugugagccaagggg

SEQ ID NO: 159613 - RNA, 22 nt, Human
aguagaaagaaggcacugggcc

SEQ ID NO: 159614 - RNA, 22 nt, Human
gcugcccugugguccagcaggu

SEQ ID NO: 159615 - RNA, 22 nt, Human
gaugccugcauuucaggagagu

SEQ ID NO: 159616 - RNA, 22 nt, Human
gaaaucugcccagugcacuggu

SEQ ID NO: 159617 - RNA, 22 nt, Human
gccuggagugcaguggcgugau

SEQ ID NO: 159618 - RNA, 21 nt, Human
uccucagggccccagagcacu

SEQ ID NO: 159619 - RNA, 22 nt, Human
cauaacuagagugaaauguuga

SEQ ID NO: 159620 - RNA, 22 nt, Human
ugggaauggaugcuaagugcua

SEQ ID NO: 159621 - RNA, 22 nt, Human
uuagcuaaacuguaacuagaau

SEQ ID NO: 159622 - RNA, 22 nt, Human
cugggcacauuuugacuagugu

SEQ ID NO: 159623 - RNA, 22 nt, Human
ugcucuggguccugggccuccu

SEQ ID NO: 159624 - RNA, 22 nt, Human
cagcucucuaaggucuugcuuu

SEQ ID NO: 159625 - RNA, 22 nt, Human
cccacaggcuagggguagggca

SEQ ID NO: 159626 - RNA, 22 nt, Human
uggcagagaauaaaucuugacu

SEQ ID NO: 159627 - RNA, 23 nt, Human
aggaggaaaaguuaucugcugag

SEQ ID NO: 159628 - RNA, 22 nt, Human
aaaugucugagacuucugaacu

SEQ ID NO: 159629 - RNA, 22 nt, Human
gaugguuuaugauagaugggaa

SEQ ID NO: 159630 - RNA, 22 nt, Human
cacccacccacugcucauuggc

SEQ ID NO: 159631 - RNA, 22 nt, Human
agucccagugagaugaaccagg

SEQ ID NO: 159632 - RNA, 22 nt, Human
ucuggcucaggucagacaggga

SEQ ID NO: 159633 - RNA, 22 nt, Human
cccaggcugaugggaugggcca

SEQ ID NO: 159634 - RNA, 22 nt, Human
gcuggccacacugcugauggag

SEQ ID NO: 159635 - RNA, 22 nt, Human
ggcuucucucuucacauggcuu

SEQ ID NO: 159636 - RNA, 22 nt, Human
uacaugcucaguaacuuucagu

SEQ ID NO: 159637 - RNA, 22 nt, Human
uggaagcacuuggguuuuguug

SEQ ID NO: 159638 - RNA, 22 nt, Human
ucugucaggagauuggcagcug

SEQ ID NO: 159639 - RNA, 22 nt, Human
auguguacaaccaagcacuaaa

SEQ ID NO: 159640 - RNA, 22 nt, Human
gcagagacuccacugucuugug

SEQ ID NO: 159641 - RNA, 22 nt, Human
acagggcaccugagguaggaag

SEQ ID NO: 159642 - RNA, 22 nt, Human
acagaaagaagguguauuugag

SEQ ID NO: 159643 - RNA, 22 nt, Human
cugggcagugcagcuauagaac

SEQ ID NO: 159644 - RNA, 22 nt, Human
agcugccagcaucccggaaggg

SEQ ID NO: 159645 - RNA, 22 nt, Human
aggacagaccuaggacuggagc

SEQ ID NO: 159646 - RNA, 22 nt, Human
acagccugagaguggagcuggc

SEQ ID NO: 159647 - RNA, 22 nt, Human
uggcagggccugcucaucaucc

SEQ ID NO: 159648 - RNA, 22 nt, Human
gcugggcaccggagagacccca

SEQ ID NO: 159649 - RNA, 22 nt, Human
agggcagcucucaccucuggcc

SEQ ID NO: 159650 - RNA, 22 nt, Human
ugagcaguaggucugaauagug

SEQ ID NO: 159651 - RNA, 22 nt, Human
ucaaagucauggcuaguaauga

SEQ ID NO: 159652 - RNA, 22 nt, Human
gagguuagaggucagugcaguc

SEQ ID NO: 159653 - RNA, 22 nt, Human
ggccuugggcagacacgucaca

SEQ ID NO: 159654 - RNA, 22 nt, Human
acagguggggaggcugagguuc

SEQ ID NO: 159655 - RNA, 22 nt, Human
aguauacauauauuagccuucg

SEQ ID NO: 159656 - RNA, 22 nt, Human
cccagcuccgagcuccgagccg

SEQ ID NO: 159657 - RNA, 22 nt, Human
acuggagcccguggaggcgcag

SEQ ID NO: 159658 - RNA, 22 nt, Human
gugggaugguagguagguaaua

SEQ ID NO: 159659 - RNA, 22 nt, Human
cuggcugcuggccugaggaugc

SEQ ID NO: 159660 - RNA, 22 nt, Human
gcagcugcuggaaguuccugcc

SEQ ID NO: 159661 - RNA, 21 nt, Human
auggagccuaagaguggaggu

SEQ ID NO: 159662 - RNA, 22 nt, Human
ucucugcugagaagggcuggca

SEQ ID NO: 159663 - RNA, 22 nt, Human
gcugucaggaacaugccuuggu

SEQ ID NO: 159664 - RNA, 22 nt, Human
gguggccucgguggugcacagg

SEQ ID NO: 159665 - RNA, 22 nt, Human
gccuggguccacugaucaugcu

SEQ ID NO: 159666 - RNA, 22 nt, Human
uccuucagaggacggcagccag

SEQ ID NO: 159667 - RNA, 22 nt, Human
ugggaaauguguuucuggacca

SEQ ID NO: 159668 - RNA, 22 nt, Human
gcagcagagaacacaaugaugg

SEQ ID NO: 159669 - RNA, 22 nt, Human
ucucuggccgagagucccuggg

SEQ ID NO: 159670 - RNA, 22 nt, Human
gcucccucugcucaggcacuug

SEQ ID NO: 159671 - RNA, 17 nt, Human
ggaaaaggaugauacag

SEQ ID NO: 159672 - RNA, 22 nt, Human
acagaagagcacauuuaguaug

SEQ ID NO: 159673 - RNA, 22 nt, Human
uggguagaggaauugggcuacc

SEQ ID NO: 159674 - RNA, 22 nt, Human
uucaaugagcccggggccauag

SEQ ID NO: 159675 - RNA, 22 nt, Human
aaaaaugaauucuucaguggca

SEQ ID NO: 159676 - RNA, 22 nt, Human
guggagacgggacagaagcuaa

SEQ ID NO: 159677 - RNA, 22 nt, Human
cagaggaggccaccgcauaggc

SEQ ID NO: 159678 - RNA, 22 nt, Human
ucugcagcuugcacaggcaggc

SEQ ID NO: 159679 - RNA, 22 nt, Human
aauguguauacuggcaauuaag

SEQ ID NO: 159680 - RNA, 22 nt, Human
aaggcugagacagcacaggucc

SEQ ID NO: 159681 - RNA, 22 nt, Human
uguaggauuuucaccagaccuu

SEQ ID NO: 159682 - RNA, 22 nt, Human
cugccuggcauggagaagagaa

SEQ ID NO: 159683 - RNA, 22 nt, Human
cagauggccagaggcagcugca

SEQ ID NO: 159684 - RNA, 23 nt, Human
uugcuucugugcaauucaguacu

SEQ ID NO: 159685 - RNA, 17 nt, Human
gagauggguggaucacc

SEQ ID NO: 159686 - RNA, 22 nt, Human
gcuggcaccugcaccaagcagg

SEQ ID NO: 159687 - RNA, 21 nt, Human
gcuccuggugcugcguggcgc

SEQ ID NO: 159688 - RNA, 22 nt, Human
uagccggguguugugucaugca

SEQ ID NO: 159689 - RNA, 22 nt, Human
ccaggcaucacgggcauguggc

SEQ ID NO: 159690 - RNA, 22 nt, Human
ggccaugguuggggaagacaug

SEQ ID NO: 159691 - RNA, 22 nt, Human
cauuguauugaggauacuuaag

SEQ ID NO: 159692 - RNA, 22 nt, Human
ugaaaucuccucuuuauauauc

SEQ ID NO: 159693 - RNA, 22 nt, Human
cucuuucaguucugauagucuc

SEQ ID NO: 159694 - RNA, 22 nt, Human
cagagaccccgcugcccuucug

SEQ ID NO: 159695 - RNA, 22 nt, Human
uuagaaaggaaucuucauuuca

SEQ ID NO: 159696 - RNA, 22 nt, Human
aaugggagagaacacaaagucc

SEQ ID NO: 159697 - RNA, 22 nt, Human
agcaggcuaagggaccuguuua

SEQ ID NO: 159698 - RNA, 22 nt, Human
ucugugcucuucucaguaucac

SEQ ID NO: 159699 - RNA, 23 nt, Human
ggcacugaagcuacaauggugag

SEQ ID NO: 159700 - RNA, 19 nt, Human
gcugcuggcucuggcugga

SEQ ID NO: 159701 - RNA, 22 nt, Human
gacccugccaugagugacaggg

SEQ ID NO: 159702 - RNA, 22 nt, Human
uaacagaauuugcuaaacuccg

SEQ ID NO: 159703 - RNA, 22 nt, Human
caggcugccgugaagcaggccu

SEQ ID NO: 159704 - RNA, 22 nt, Human
uggcucugcaccucaguguacc

SEQ ID NO: 159705 - RNA, 22 nt, Human
gcucucugguuccagucaggaa

SEQ ID NO: 159706 - RNA, 22 nt, Human
cuuucucuguguuucacaugcu

SEQ ID NO: 159707 - RNA, 22 nt, Human
cccuggaggagcuuagagcuug

SEQ ID NO: 159708 - RNA, 22 nt, Human
acagccugcugccugcuucuug

SEQ ID NO: 159709 - RNA, 22 nt, Human
gaaaugcaggcuuggauucagc

SEQ ID NO: 159710 - RNA, 22 nt, Human
cugacccauauaagaguggagg

SEQ ID NO: 159711 - RNA, 18 nt, Human
aggccagcccugcuacug

SEQ ID NO: 159712 - RNA, 22 nt, Human
agggcagcacaaggcauggacu

SEQ ID NO: 159713 - RNA, 22 nt, Human
gcuggaaggcuaggcucaguug

SEQ ID NO: 159714 - RNA, 22 nt, Human
gaguuauuggguggaaagguag

SEQ ID NO: 159715 - RNA, 22 nt, Human
gaagcagcuaggaucuucauuu

SEQ ID NO: 159716 - RNA, 22 nt, Human
ggcuccuguggcaagacagcuu

SEQ ID NO: 159717 - RNA, 22 nt, Human
uggccaggggaguuccccucca

SEQ ID NO: 159718 - RNA, 22 nt, Human
ugcuuccuugagcucuccaauc

SEQ ID NO: 159719 - RNA, 22 nt, Human
ccucccacauccuagcucugcu

SEQ ID NO: 159720 - RNA, 22 nt, Human
agagguagagguugcagugagc

SEQ ID NO: 159721 - RNA, 22 nt, Human
ccagggcagcagaauuggggca

SEQ ID NO: 159722 - RNA, 22 nt, Human
gaggggcuggguagggcaaccc

SEQ ID NO: 159723 - RNA, 22 nt, Human
uggcagagcuggcugcggauga

SEQ ID NO: 159724 - RNA, 22 nt, Human
cugcugcugcuaucuacccagg

SEQ ID NO: 159725 - RNA, 22 nt, Human
gccuugccucagccauggaaac

SEQ ID NO: 159726 - RNA, 22 nt, Human
agaggggcucauauccugucau

SEQ ID NO: 159727 - RNA, 22 nt, Human
auaugaagucagacaaacuggg

SEQ ID NO: 159728 - RNA, 22 nt, Human
uuacuuuggauggucaagaaag

SEQ ID NO: 159729 - RNA, 22 nt, Human
uggagcccagggugagaaggag

SEQ ID NO: 159730 - RNA, 22 nt, Human
aguuucauauuaccaugucacc

SEQ ID NO: 159731 - RNA, 22 nt, Human
uuccauauuuguguggcaaaag

SEQ ID NO: 159732 - RNA, 22 nt, Human
gagguagcaugcuggaagggac

SEQ ID NO: 159733 - RNA, 20 nt, Human
aagagaagaagucuuugaaa

SEQ ID NO: 159734 - RNA, 22 nt, Human
cugcuuuguggaaucacacugg

SEQ ID NO: 159735 - RNA, 22 nt, Human
gcaggggaguccacucuaugca

SEQ ID NO: 159736 - RNA, 22 nt, Human
aauggacaggagagcauaguca

SEQ ID NO: 159737 - RNA, 22 nt, Human
ggccuucacgugaccuggcgug

SEQ ID NO: 159738 - RNA, 22 nt, Human
gcuggccucgcaggcaggaugu

SEQ ID NO: 159739 - RNA, 22 nt, Human
gugcauuugacgaauacucacu

SEQ ID NO: 159740 - RNA, 22 nt, Human
caggcugucugaauggaggccc

SEQ ID NO: 159741 - RNA, 22 nt, Human
gggcugccuuucuucugggagc

SEQ ID NO: 159742 - RNA, 20 nt, Human
gucucaaguaucucacaguc

SEQ ID NO: 159743 - RNA, 22 nt, Human
ugacaauacagagagagcaaaa

SEQ ID NO: 159744 - RNA, 22 nt, Human
agccuccuggaguuucugggau

SEQ ID NO: 159745 - RNA, 23 nt, Human
ugcuguccaacagacuggccaug

SEQ ID NO: 159746 - RNA, 22 nt, Human
agcugcugaaugacacugcaag

SEQ ID NO: 159747 - RNA, 22 nt, Human
aagagcuggauggaaucuggga

SEQ ID NO: 159748 - RNA, 22 nt, Human
uccuggaguugugcagugcaca

SEQ ID NO: 159749 - RNA, 22 nt, Human
cagacaggcuagccagacucac

SEQ ID NO: 159750 - RNA, 22 nt, Human
gcucuguacgcaggaugagggg

SEQ ID NO: 159751 - RNA, 22 nt, Human
aagggcaggagaagacggauau

SEQ ID NO: 159752 - RNA, 22 nt, Human
aaggcacuagcaagcugccugg

SEQ ID NO: 159753 - RNA, 22 nt, Human
ggccucaguuucuccauggguu

SEQ ID NO: 159754 - RNA, 22 nt, Human
uauugacaauaggcaacugagg

SEQ ID NO: 159755 - RNA, 22 nt, Human
uccuucagaaaaccucagucuu

SEQ ID NO: 159756 - RNA, 22 nt, Human
gcagugggaagguuggcacaug

SEQ ID NO: 159757 - RNA, 22 nt, Human
gccagcagguggagagaucaag

SEQ ID NO: 159758 - RNA, 21 nt, Human
auccuugaucagaagagugcu

SEQ ID NO: 159759 - RNA, 22 nt, Human
aaacagcugucauuguuuuaaa

SEQ ID NO: 159760 - RNA, 22 nt, Human
cuggagcagguuuaggaguccc

SEQ ID NO: 159761 - RNA, 22 nt, Human
uuucacauguggaaugccaggu

SEQ ID NO: 159762 - RNA, 22 nt, Human
aggcuggcccuacuggcugccu

SEQ ID NO: 159763 - RNA, 22 nt, Human
ugagccuggguggucgaggcug

SEQ ID NO: 159764 - RNA, 19 nt, Human
accaggcuuauggucagug

SEQ ID NO: 159765 - RNA, 20 nt, Human
cacaggcuauaugagagcca

SEQ ID NO: 159766 - RNA, 22 nt, Human
cccaggaggccaagguugcagu

SEQ ID NO: 159767 - RNA, 22 nt, Human
uaaaucccuacaucuguguuuu

SEQ ID NO: 159768 - RNA, 17 nt, Human
ucugggcuucagugguc

SEQ ID NO: 159769 - RNA, 22 nt, Human
uuuccauauucugcgucugcca

SEQ ID NO: 159770 - RNA, 22 nt, Human
uccugcugagcgucugucauuu

SEQ ID NO: 159771 - RNA, 22 nt, Human
cuguguccucccgcugcaccca

SEQ ID NO: 159772 - RNA, 22 nt, Human
cccacucuggcucccuucuagu

SEQ ID NO: 159773 - RNA, 22 nt, Human
aaggccaugaccacuugcugug

SEQ ID NO: 159774 - RNA, 22 nt, Human
aagaauucacugguagagucaa

SEQ ID NO: 159775 - RNA, 22 nt, Human
gccaggugggagacagacagca

SEQ ID NO: 159776 - RNA, 22 nt, Human
gcccaugcucucaggcgggccu

SEQ ID NO: 159777 - RNA, 22 nt, Human
ccagcucuagccccauguggcu

SEQ ID NO: 159778 - RNA, 22 nt, Human
ucccaaagcuacucuucugacu

SEQ ID NO: 159779 - RNA, 22 nt, Human
aaguucuaauuuugcauucagg

SEQ ID NO: 159780 - RNA, 22 nt, Human
gcugccugguuucucagcugca

SEQ ID NO: 159781 - RNA, 22 nt, Human
uagaaacucaggauacucuucc

SEQ ID NO: 159782 - RNA, 22 nt, Human
ggcugcuucucacucauuugca

SEQ ID NO: 159783 - RNA, 22 nt, Human
cagagcugcgcuuuuuccuggu

SEQ ID NO: 159784 - RNA, 20 nt, Human
ugcagaagaacguucugguu

SEQ ID NO: 159785 - RNA, 22 nt, Human
acagcagcaauagcagugacau

SEQ ID NO: 159786 - RNA, 22 nt, Human
gcagcuggagcaucuucucauc

SEQ ID NO: 159787 - RNA, 22 nt, Human
cucagcuggcaauucuggcucc

SEQ ID NO: 159788 - RNA, 22 nt, Human
aucacaaaggcugcuucaugau

SEQ ID NO: 159789 - RNA, 22 nt, Human
acaggcagcgucauugcugcuc

SEQ ID NO: 159790 - RNA, 22 nt, Human
gcagggacaccuuugugaagcu

SEQ ID NO: 159791 - RNA, 22 nt, Human
cugggaguguucuaggucacau

SEQ ID NO: 159792 - RNA, 22 nt, Human
cugggcacaaguggcccuggau

SEQ ID NO: 159793 - RNA, 17 nt, Human
aggcauggucuggggug

SEQ ID NO: 159794 - RNA, 22 nt, Human
gagagcugcauucucagacaca

SEQ ID NO: 159795 - RNA, 22 nt, Human
uguauuagagcaguagaauuau

SEQ ID NO: 159796 - RNA, 22 nt, Human
acagcuggaggccccauugucc

SEQ ID NO: 159797 - RNA, 18 nt, Human
auccuugaugagaggucu

SEQ ID NO: 159798 - RNA, 22 nt, Human
agaguguuuuucugucaaggac

SEQ ID NO: 159799 - RNA, 22 nt, Human
agcagcugagaugguaagauuc

SEQ ID NO: 159800 - RNA, 22 nt, Human
agccacagcgaaccucucuucc

SEQ ID NO: 159801 - RNA, 22 nt, Human
gccuggagccucagcaaggagg

SEQ ID NO: 159802 - RNA, 22 nt, Human
augcuuuuccuaaaaugaugcc

SEQ ID NO: 159803 - RNA, 22 nt, Human
gcucugcuguguuuguucagca

SEQ ID NO: 159804 - RNA, 22 nt, Human
cugaagagcucuccuguccccu

SEQ ID NO: 159805 - RNA, 22 nt, Human
cccugccuuguuggagccuaug

SEQ ID NO: 159806 - RNA, 22 nt, Human
ucaguuuuucuauacuuuguag

SEQ ID NO: 159807 - RNA, 23 nt, Human
cugcagccgcguggggacgugga

SEQ ID NO: 159808 - RNA, 22 nt, Human
gccuggagggauagaaugcaag

SEQ ID NO: 159809 - RNA, 22 nt, Human
uccuuucccuuuccauccuggc

SEQ ID NO: 159810 - RNA, 22 nt, Human
aaauugugcucacacugauauu

SEQ ID NO: 159811 - RNA, 22 nt, Human
gccuggaguuguggugaagcca

SEQ ID NO: 159812 - RNA, 22 nt, Human
cagggccacuguagaugaggag

SEQ ID NO: 159813 - RNA, 22 nt, Human
cagggccaagcugcagcaucug

SEQ ID NO: 159814 - RNA, 20 nt, Human
cacguuuuuccacuagcaaa

SEQ ID NO: 159815 - RNA, 22 nt, Human
agugcauugcaucucugcuuca

SEQ ID NO: 159816 - RNA, 22 nt, Human
cucagaauuacaucccauuuua

SEQ ID NO: 159817 - RNA, 22 nt, Human
ugaacauauucaccucuaaaua

SEQ ID NO: 159818 - RNA, 22 nt, Human
uugaaggaggcuccuuuuuaaa

SEQ ID NO: 159819 - RNA, 22 nt, Human
caguagcacuagauaugugugg

SEQ ID NO: 159820 - RNA, 22 nt, Human
accauuuaauaaguauuuccau

SEQ ID NO: 159821 - RNA, 22 nt, Human
ccugagaccaaguugcagccau

SEQ ID NO: 159822 - RNA, 22 nt, Human
caagaaauuucuuaagaacuaa

SEQ ID NO: 159823 - RNA, 22 nt, Human
cccuggggcugagggauggccg

SEQ ID NO: 159824 - RNA, 22 nt, Human
gaaagagaaccugggccuagau

SEQ ID NO: 159825 - RNA, 22 nt, Human
uggaagcaucacuucuugccug

SEQ ID NO: 159826 - RNA, 22 nt, Human
ccagaccacccuggccaugcac

SEQ ID NO: 159827 - RNA, 23 nt, Human
ugcucugugaauaguuggugacu

SEQ ID NO: 159828 - RNA, 22 nt, Human
aggagagagaacacuugggucc

SEQ ID NO: 159829 - RNA, 22 nt, Human
uugcauugaaugcacauuuuua

SEQ ID NO: 159830 - RNA, 22 nt, Human
aaagguuaguucuuagaagugc

SEQ ID NO: 159831 - RNA, 22 nt, Human
cuuagaaauaaugguuucaguu

SEQ ID NO: 159832 - RNA, 22 nt, Human
aaggcagcagugcacgacugau

SEQ ID NO: 159833 - RNA, 22 nt, Human
gugcuuccaucuagagggucac

SEQ ID NO: 159834 - RNA, 22 nt, Human
uggggagugaugccucggauaa

SEQ ID NO: 159835 - RNA, 22 nt, Human
caauaugcaagcuauuaaguau

SEQ ID NO: 159836 - RNA, 20 nt, Human
ucagagucaucaaagauggu

SEQ ID NO: 159837 - RNA, 22 nt, Human
cacagggcagugcugcccacuc

SEQ ID NO: 159838 - RNA, 22 nt, Human
cugggugguuuugaugugaauu

SEQ ID NO: 159839 - RNA, 22 nt, Human
acagcuguggggacucuugccc

SEQ ID NO: 159840 - RNA, 22 nt, Human
uuugggaagaggaaucucugga

SEQ ID NO: 159841 - RNA, 22 nt, Human
guaucuuuugguggaaaaauaa

SEQ ID NO: 159842 - RNA, 20 nt, Human
cugggaggucuuccaaauca

SEQ ID NO: 159843 - RNA, 22 nt, Human
ucccacugugaauccaaggccu

SEQ ID NO: 159844 - RNA, 22 nt, Human
agacccagaaagcagcugcauu

SEQ ID NO: 159845 - RNA, 22 nt, Human
uauugaaaugaaugacagugau

SEQ ID NO: 159846 - RNA, 19 nt, Human
ggugaccaccuggucagug

SEQ ID NO: 159847 - RNA, 21 nt, Human
gccucugcugucuuauuguga

SEQ ID NO: 159848 - RNA, 22 nt, Human
gaggcaugucuggccuguccca

SEQ ID NO: 159849 - RNA, 22 nt, Human
ugcugcacgauaaauaauuucu

SEQ ID NO: 159850 - RNA, 22 nt, Human
aggacaggauugagcugaacug

SEQ ID NO: 159851 - RNA, 22 nt, Human
gaaaauguuuccuguuauuugc

SEQ ID NO: 159852 - RNA, 23 nt, Human
aggcugcagaagaauagggucau

SEQ ID NO: 159853 - RNA, 22 nt, Human
aaugcugcaagaggugaaaaga

SEQ ID NO: 159854 - RNA, 22 nt, Human
aguuacuugagacguuuaugaa

SEQ ID NO: 159855 - RNA, 22 nt, Human
cagaggcucaccagccuuucac

SEQ ID NO: 159856 - RNA, 21 nt, Human
ugccaggccugagcugggguc

SEQ ID NO: 159857 - RNA, 22 nt, Human
gcaggcaguugcaguuuucuag

SEQ ID NO: 159858 - RNA, 22 nt, Human
ugcagaagugagucaugaggaa

SEQ ID NO: 159859 - RNA, 23 nt, Human
gcauugucuccccacuucugggc

SEQ ID NO: 159860 - RNA, 22 nt, Human
agcagcauucucugguaugggg

SEQ ID NO: 159861 - RNA, 22 nt, Human
augaccccuaaaauuuacuguc

SEQ ID NO: 159862 - RNA, 22 nt, Human
ucacacgugagguucuauccug

SEQ ID NO: 159863 - RNA, 21 nt, Human
cugccuugaaugguacuggga

SEQ ID NO: 159864 - RNA, 22 nt, Human
ucccagagcaguacuccaggag

SEQ ID NO: 159865 - RNA, 22 nt, Human
aggcugaggcagguggaucauu

SEQ ID NO: 159866 - RNA, 22 nt, Human
gcuucuggaggagcugggcuga

SEQ ID NO: 159867 - RNA, 22 nt, Human
agacuuugagcucuuagagaag

SEQ ID NO: 159868 - RNA, 22 nt, Human
cagugcagaacacauggaaaau

SEQ ID NO: 159869 - RNA, 22 nt, Human
uguggcuguguccaccugcugc

SEQ ID NO: 159870 - RNA, 21 nt, Human
uucaagauauuuaaaaggugg

SEQ ID NO: 159871 - RNA, 22 nt, Human
acuuugcacuaaguuacucauu

SEQ ID NO: 159872 - RNA, 22 nt, Human
ugcuucaggagaugucaccaug

SEQ ID NO: 159873 - RNA, 22 nt, Human
uggcucuggcgugaagcccaga

SEQ ID NO: 159874 - RNA, 22 nt, Human
caguuucuuaucuucaaaauug

SEQ ID NO: 159875 - RNA, 22 nt, Human
uccagaguacggaagagucauc

SEQ ID NO: 159876 - RNA, 22 nt, Human
agggcagagacaugcuuccuga

SEQ ID NO: 159877 - RNA, 22 nt, Human
ucaucacauaugucaugauuug

SEQ ID NO: 159878 - RNA, 20 nt, Human
uugcauuggaugugcaggug

SEQ ID NO: 159879 - RNA, 22 nt, Human
gcagcugcagguggucccaugc

SEQ ID NO: 159880 - RNA, 22 nt, Human
uagaaauguuagauguauugag

SEQ ID NO: 159881 - RNA, 22 nt, Human
aacccagccguguagcugccgc

SEQ ID NO: 159882 - RNA, 22 nt, Human
uggcugggugcuauccaguacu

SEQ ID NO: 159883 - RNA, 22 nt, Human
auaugaagaauuccaauuugga

SEQ ID NO: 159884 - RNA, 22 nt, Human
gcugccucugcgacucugggcg

SEQ ID NO: 159885 - RNA, 22 nt, Human
ucaggccacggcucacugagac

SEQ ID NO: 159886 - RNA, 22 nt, Human
aucucccagccacagcauucuu

SEQ ID NO: 159887 - RNA, 22 nt, Human
ugggcuggcugaggcauucacu

SEQ ID NO: 159888 - RNA, 22 nt, Human
agccccuuccaguucucagauc

SEQ ID NO: 159889 - RNA, 22 nt, Human
uucuuuggggaauauucugguu

SEQ ID NO: 159890 - RNA, 22 nt, Human
ggguggaguagaaagaugaauu

SEQ ID NO: 159891 - RNA, 22 nt, Human
gcucugcugaagccccuugcau

SEQ ID NO: 159892 - RNA, 22 nt, Human
acaauucucucauaucuuauua

SEQ ID NO: 159893 - RNA, 22 nt, Human
cucccugggcagauguggcucu

SEQ ID NO: 159894 - RNA, 22 nt, Human
uggcucaguuugggggauugaa

SEQ ID NO: 159895 - RNA, 22 nt, Human
cagcaggcucugaguggcugcc

SEQ ID NO: 159896 - RNA, 22 nt, Human
guguguccaggcgggagucaag

SEQ ID NO: 159897 - RNA, 22 nt, Human
cuuguccuuuacuugagacuca

SEQ ID NO: 159898 - RNA, 22 nt, Human
ugaagcagaggggucuugagcu

SEQ ID NO: 159899 - RNA, 20 nt, Human
gaggaaaagcugccaggccu

SEQ ID NO: 159900 - RNA, 22 nt, Human
uggacaggaucugagacugaga

SEQ ID NO: 159901 - RNA, 23 nt, Human
ccagcucccaggucugaggacug

SEQ ID NO: 159902 - RNA, 22 nt, Human
caggcagcgcucguggccuggc

SEQ ID NO: 159903 - RNA, 22 nt, Human
auaaacaguagagaaagguggu

SEQ ID NO: 159904 - RNA, 22 nt, Human
agcaaggcagucagcuggcugg

SEQ ID NO: 159905 - RNA, 22 nt, Human
agcuggcuccagaaggagucgu

SEQ ID NO: 159906 - RNA, 22 nt, Human
agauguguuucuaguuccugca

SEQ ID NO: 159907 - RNA, 22 nt, Human
ucucaggguuuguacaagugua

SEQ ID NO: 159908 - RNA, 22 nt, Human
gucccagggaugcagacaugag

SEQ ID NO: 159909 - RNA, 20 nt, Human
gacauucauaguuauuacca

SEQ ID NO: 159910 - RNA, 22 nt, Human
ccagggcuccauugcucauccu

SEQ ID NO: 159911 - RNA, 22 nt, Human
aaguguauauaugacuuauaaa

SEQ ID NO: 159912 - RNA, 22 nt, Human
ccccagcugcauacuugccaag

SEQ ID NO: 159913 - RNA, 22 nt, Human
gcagaacauuucacaguaucuu

SEQ ID NO: 159914 - RNA, 21 nt, Human
gcagcagaggcuugacagaca

SEQ ID NO: 159915 - RNA, 20 nt, Human
ccaagagcaugcaugaggaa

SEQ ID NO: 159916 - RNA, 22 nt, Human
caggaccccauauucacugaac

SEQ ID NO: 159917 - RNA, 22 nt, Human
cucaggacccgguccagguggg

SEQ ID NO: 159918 - RNA, 22 nt, Human
caaagguaguauauauauuguu

SEQ ID NO: 159919 - RNA, 22 nt, Human
ugucucugcuuuccuugcaggg

SEQ ID NO: 159920 - RNA, 19 nt, Human
ugcagaagacacaguggug

SEQ ID NO: 159921 - RNA, 22 nt, Human
auugaaagaguuuucugcugca

SEQ ID NO: 159922 - RNA, 22 nt, Human
ucccagagauuuccucuccuuc

SEQ ID NO: 159923 - RNA, 22 nt, Human
agaggccuaaccaagauguccu

SEQ ID NO: 159924 - RNA, 22 nt, Human
cagccagggagggcaaaugaga

SEQ ID NO: 159925 - RNA, 22 nt, Human
aggggcuggaguucgagguuac

SEQ ID NO: 159926 - RNA, 22 nt, Human
uaaagaacacagggaauagcac

SEQ ID NO: 159927 - RNA, 20 nt, Human
agaguaacuggcacauaggg

SEQ ID NO: 159928 - RNA, 22 nt, Human
caguggguggcuaaguggcuga

SEQ ID NO: 159929 - RNA, 22 nt, Human
aagaaaagaaaccugaggcuuu

SEQ ID NO: 159930 - RNA, 22 nt, Human
ccaguuuuuccagugcuuucug

SEQ ID NO: 159931 - RNA, 22 nt, Human
auuaaaagcuucccaagaguua

SEQ ID NO: 159932 - RNA, 22 nt, Human
agggcagaaaucgauuacaccu

SEQ ID NO: 159933 - RNA, 20 nt, Human
gggaguggugguagccugug

SEQ ID NO: 159934 - RNA, 22 nt, Human
aggucauuccuugucuucuugc

SEQ ID NO: 159935 - RNA, 22 nt, Human
uuuuuccuagugcuuucuggua

SEQ ID NO: 159936 - RNA, 22 nt, Human
aggcuggcuggcaggggacaca

SEQ ID NO: 159937 - RNA, 22 nt, Human
acuccugguuuguguccuggcu

SEQ ID NO: 159938 - RNA, 23 nt, Human
gggcugcuccaggccaaggcugg

SEQ ID NO: 159939 - RNA, 22 nt, Human
cuggagagaccgaaagaggcug

SEQ ID NO: 159940 - RNA, 22 nt, Human
cuguucaugcugauucuguaug

SEQ ID NO: 159941 - RNA, 22 nt, Human
cagaaugcaaauuuuauaauau

SEQ ID NO: 159942 - RNA, 22 nt, Human
gccuugcuuugcuucuggacag

SEQ ID NO: 159943 - RNA, 22 nt, Human
gggacagcuguagugcuuggcu

SEQ ID NO: 159944 - RNA, 22 nt, Human
agcagagccaggucucucugua

SEQ ID NO: 159945 - RNA, 17 nt, Human
ggugagaccucccacuc

SEQ ID NO: 159946 - RNA, 21 nt, Human
ccagccucagaucagggagcu

SEQ ID NO: 159947 - RNA, 22 nt, Human
uccuucagggcugaccacaggc

SEQ ID NO: 159948 - RNA, 22 nt, Human
gcauaauauacaugcuugaucc

SEQ ID NO: 159949 - RNA, 22 nt, Human
augagcuucccagacaggaugg

SEQ ID NO: 159950 - RNA, 22 nt, Human
guccucugggcuuugagcaguc

SEQ ID NO: 159951 - RNA, 22 nt, Human
guggccaggacauugccaggca

SEQ ID NO: 159952 - RNA, 22 nt, Human
agccaucauuucugucacuggc

SEQ ID NO: 159953 - RNA, 21 nt, Human
uuuauguacuucauagaguag

SEQ ID NO: 159954 - RNA, 22 nt, Human
guccugggaaggaagccaggga

SEQ ID NO: 159955 - RNA, 22 nt, Human
gcuggccaggugcuuugguucu

SEQ ID NO: 159956 - RNA, 22 nt, Human
ccuuuggguucaaucucggucu

SEQ ID NO: 159957 - RNA, 23 nt, Human
aaggucacagaacuuagcaagcc

SEQ ID NO: 159958 - RNA, 22 nt, Human
cagucccaggguugguucagcu

SEQ ID NO: 159959 - RNA, 22 nt, Human
acagagccuccaggagugcugg

SEQ ID NO: 159960 - RNA, 22 nt, Human
uggcucaguuucaguccugguu

SEQ ID NO: 159961 - RNA, 22 nt, Human
ggagccuguggccgucacgacu

SEQ ID NO: 159962 - RNA, 22 nt, Human
augaagucugcacaugcaugug

SEQ ID NO: 159963 - RNA, 22 nt, Human
ccuggggcucaagauggcgccg

SEQ ID NO: 159964 - RNA, 22 nt, Human
gcugucugggaggccuccacuu

SEQ ID NO: 159965 - RNA, 18 nt, Human
uguuccaaggaaggaauc

SEQ ID NO: 159966 - RNA, 22 nt, Human
cucuggaaaaccacuagcagga

SEQ ID NO: 159967 - RNA, 22 nt, Human
agaauguagucuuggagauuua

SEQ ID NO: 159968 - RNA, 22 nt, Human
uccagccaugacucggacagug

SEQ ID NO: 159969 - RNA, 22 nt, Human
uccuggcccacuaugccagcau

SEQ ID NO: 159970 - RNA, 18 nt, Human
acauuucucucugcguga

SEQ ID NO: 159971 - RNA, 22 nt, Human
gcuggcagucccaucagcuggg

SEQ ID NO: 159972 - RNA, 22 nt, Human
cucucuggaagggggagcugau

SEQ ID NO: 159973 - RNA, 22 nt, Human
caggcacuagcagaaugaggcu

SEQ ID NO: 159974 - RNA, 22 nt, Human
gccagcaguccugcugugugcc

SEQ ID NO: 159975 - RNA, 22 nt, Human
cugugggcugaaagugcucccg

SEQ ID NO: 159976 - RNA, 22 nt, Human
cuggagcccugaaugggcagga

SEQ ID NO: 159977 - RNA, 22 nt, Human
cugaaggauucaaaauggcagg

SEQ ID NO: 159978 - RNA, 22 nt, Human
gcagagcccuggggguauggug

SEQ ID NO: 159979 - RNA, 20 nt, Human
auugucagccuucagaggag

SEQ ID NO: 159980 - RNA, 22 nt, Human
augucccagcugagagacaacu

SEQ ID NO: 159981 - RNA, 22 nt, Human
aaggagaguacaggaguuggua

SEQ ID NO: 159982 - RNA, 22 nt, Human
ccugagacaugaaccaggcucc

SEQ ID NO: 159983 - RNA, 22 nt, Human
cugcaggcucgaagacacggau

SEQ ID NO: 159984 - RNA, 22 nt, Human
cagcugccacaccucuuucucu

SEQ ID NO: 159985 - RNA, 22 nt, Human
aguggcagagcaggugcuggaa

SEQ ID NO: 159986 - RNA, 22 nt, Human
cagagggcucuuggcugccugc

SEQ ID NO: 159987 - RNA, 22 nt, Human
uccugccuguuuaccuguacuu

SEQ ID NO: 159988 - RNA, 22 nt, Human
aaaguggucaccuucucauuuc

SEQ ID NO: 159989 - RNA, 22 nt, Human
uguacuuccccaaugacagcac

SEQ ID NO: 159990 - RNA, 22 nt, Human
aagcacagaaaaggagcaugga

SEQ ID NO: 159991 - RNA, 22 nt, Human
cagggagaggcaucauagggaa

SEQ ID NO: 159992 - RNA, 22 nt, Human
ugcagcuucuccaucuccuugu

SEQ ID NO: 159993 - RNA, 22 nt, Human
aggugccagcucucaggcagga

SEQ ID NO: 159994 - RNA, 22 nt, Human
gcaggcagagagggguuuccag

SEQ ID NO: 159995 - RNA, 22 nt, Human
caaauguguuuuuucuucuaca

SEQ ID NO: 159996 - RNA, 22 nt, Human
cagcaugguggagcugcucuuu

SEQ ID NO: 159997 - RNA, 22 nt, Human
cagagguacaagcuaaguuggg

SEQ ID NO: 159998 - RNA, 22 nt, Human
ccaggugggaggaaagcagaga

SEQ ID NO: 159999 - RNA, 23 nt, Human
uugaaggagaaagcuuucuuggu

SEQ ID NO: 160000 - RNA, 22 nt, Human
augguguagcaugugauaugac

SEQ ID NO: 160001 - RNA, 22 nt, Human
ccggggacuuaaagugaaggaa

SEQ ID NO: 160002 - RNA, 22 nt, Human
ggcucaggcuggagugcagugg

SEQ ID NO: 160003 - RNA, 22 nt, Human
gcugggagaggcccugaaguga

SEQ ID NO: 160004 - RNA, 22 nt, Human
ccugcagguccccggaugcgca

SEQ ID NO: 160005 - RNA, 22 nt, Human
acugucugcccugagaugccag

SEQ ID NO: 160006 - RNA, 22 nt, Human
ggguguguuccuaaggaaacca

SEQ ID NO: 160007 - RNA, 22 nt, Human
acagggcaaccucugggagacu

SEQ ID NO: 160008 - RNA, 22 nt, Human
ucugucacucuagagauggcag

SEQ ID NO: 160009 - RNA, 22 nt, Human
gccugccuuuuggaggcacauu

SEQ ID NO: 160010 - RNA, 22 nt, Human
uggcucuggugcgggcuccugc

SEQ ID NO: 160011 - RNA, 22 nt, Human
ccuggcugucguuuugugaaau

SEQ ID NO: 160012 - RNA, 22 nt, Human
gcugucuggaggcucugaggga

SEQ ID NO: 160013 - RNA, 20 nt, Human
ugacucugcaaccgucucuc

SEQ ID NO: 160014 - RNA, 19 nt, Human
uacuuuuucaggacagagu

SEQ ID NO: 160015 - RNA, 22 nt, Human
cugugucggacgugggcagcag

SEQ ID NO: 160016 - RNA, 22 nt, Human
cugggcacagcguugggcucuu

SEQ ID NO: 160017 - RNA, 22 nt, Human
aaguaacaaugcuguugaauug

SEQ ID NO: 160018 - RNA, 22 nt, Human
ccuggcaguggugaagaagagg

SEQ ID NO: 160019 - RNA, 20 nt, Human
gucaucgccggcagcaaaga

SEQ ID NO: 160020 - RNA, 22 nt, Human
acuauacauugaauguuaaggu

SEQ ID NO: 160021 - RNA, 22 nt, Human
gccuggcaggccucaugagggg

SEQ ID NO: 160022 - RNA, 22 nt, Human
cacagugcaugaugggcagaag

SEQ ID NO: 160023 - RNA, 22 nt, Human
ucccagcauaacaaacugcccg

SEQ ID NO: 160024 - RNA, 22 nt, Human
uuuccucugucaugacagcuga

SEQ ID NO: 160025 - RNA, 22 nt, Human
gggcugcuguagagaacauguu

SEQ ID NO: 160026 - RNA, 22 nt, Human
cagcagagcuuauguuggguca

SEQ ID NO: 160027 - RNA, 22 nt, Human
aggagcugcagauucugccuug

SEQ ID NO: 160028 - RNA, 21 nt, Human
aggcccagcuuuccucuugcu

SEQ ID NO: 160029 - RNA, 22 nt, Human
ucauacauaacuuguacaguga

SEQ ID NO: 160030 - RNA, 22 nt, Human
ucaggggacuuaggagagaagu

SEQ ID NO: 160031 - RNA, 22 nt, Human
ggccucugguucacagggagga

SEQ ID NO: 160032 - RNA, 22 nt, Human
uguguuuugaacucaucuacug

SEQ ID NO: 160033 - RNA, 22 nt, Human
cugagcucuaaugucagccuug

SEQ ID NO: 160034 - RNA, 22 nt, Human
agcagugggggaguguuaguuu

SEQ ID NO: 160035 - RNA, 22 nt, Human
cugccucuccccagaguggccc

SEQ ID NO: 160036 - RNA, 22 nt, Human
uggccugaggcucggcaugggu

SEQ ID NO: 160037 - RNA, 22 nt, Human
ucccagggacaccaagcuguuu

SEQ ID NO: 160038 - RNA, 22 nt, Human
caguaugucuacuggacaaagu

SEQ ID NO: 160039 - RNA, 22 nt, Human
ugcacagagagaugagacacgu

SEQ ID NO: 160040 - RNA, 17 nt, Human
ucagcaaagacaaagga

SEQ ID NO: 160041 - RNA, 22 nt, Human
uuuuaauacugcuauuguagga

SEQ ID NO: 160042 - RNA, 22 nt, Human
ccagcuccccucagcagguaau

SEQ ID NO: 160043 - RNA, 22 nt, Human
cuaucuuucgauucuagcuuaa

SEQ ID NO: 160044 - RNA, 22 nt, Human
ccaggcugugguuuagauagag

SEQ ID NO: 160045 - RNA, 22 nt, Human
uugcuuccaguccaagucuguu

SEQ ID NO: 160046 - RNA, 19 nt, Human
gggaugggcccucacccuc

SEQ ID NO: 160047 - RNA, 22 nt, Human
cagggcagggauguugcggcag

SEQ ID NO: 160048 - RNA, 22 nt, Human
ccuuccaggagucucugcaggu

SEQ ID NO: 160049 - RNA, 22 nt, Human
ggucccugcugaagccuuggug

SEQ ID NO: 160050 - RNA, 22 nt, Human
ugcuggagaucauuaauguuca

SEQ ID NO: 160051 - RNA, 22 nt, Human
cugccagcucgccacaaugaca

SEQ ID NO: 160052 - RNA, 22 nt, Human
gacagaggcaagaccagaagcc

SEQ ID NO: 160053 - RNA, 22 nt, Human
gcccagcagaucucagugucuc

SEQ ID NO: 160054 - RNA, 22 nt, Human
gcagagccaggcuggggcaggu

SEQ ID NO: 160055 - RNA, 22 nt, Human
cucagcccagcccaggaccagg

SEQ ID NO: 160056 - RNA, 19 nt, Human
uugaggggccaggggagau

SEQ ID NO: 160057 - RNA, 22 nt, Human
auauuucuccaaauguuuucaa

SEQ ID NO: 160058 - RNA, 22 nt, Human
gccaccucggcuuucucugcuc

SEQ ID NO: 160059 - RNA, 22 nt, Human
agugguaacuaaguccugcuua

SEQ ID NO: 160060 - RNA, 21 nt, Human
ugcaugcuauguuuuuauuuc

SEQ ID NO: 160061 - RNA, 22 nt, Human
aaguuucauguggagguagacu

SEQ ID NO: 160062 - RNA, 22 nt, Human
uccagccaacugccuagggagc

SEQ ID NO: 160063 - RNA, 22 nt, Human
agagcccugaagcagagcuaaa

SEQ ID NO: 160064 - RNA, 22 nt, Human
gggcugagucugcugccuguca

SEQ ID NO: 160065 - RNA, 22 nt, Human
aauguguguucggggcccagag

SEQ ID NO: 160066 - RNA, 20 nt, Human
aggcugccaggucucacauc

SEQ ID NO: 160067 - RNA, 23 nt, Human
aaucuggcugauguuuuuucucu

SEQ ID NO: 160068 - RNA, 22 nt, Human
uggcagaggagaauuaagauua

SEQ ID NO: 160069 - RNA, 21 nt, Human
ggugucaguuuuggucauuag

SEQ ID NO: 160070 - RNA, 22 nt, Human
aggggcugccuggcuuggcacu

SEQ ID NO: 160071 - RNA, 22 nt, Human
acucucucacagcuuggcugau

SEQ ID NO: 160072 - RNA, 20 nt, Human
ugucaugcauuagaugaaga

SEQ ID NO: 160073 - RNA, 22 nt, Human
uaaaucaguuucucuuauuggu

SEQ ID NO: 160074 - RNA, 22 nt, Human
ggcagaggagcuggaaacaugg

SEQ ID NO: 160075 - RNA, 22 nt, Human
aagugaguggccuggagaggug

SEQ ID NO: 160076 - RNA, 20 nt, Human
gcagcugcccccagucccug

SEQ ID NO: 160077 - RNA, 23 nt, Human
gguggcaggaguggaugcugagc

SEQ ID NO: 160078 - RNA, 22 nt, Human
uccucaggcggugaggaggggc

SEQ ID NO: 160079 - RNA, 22 nt, Human
gcagaaggucuggcacuucagg

SEQ ID NO: 160080 - RNA, 20 nt, Human
gcuuccuucccagcccccac

SEQ ID NO: 160081 - RNA, 22 nt, Human
gaugauggacaaagcauuggug

SEQ ID NO: 160082 - RNA, 22 nt, Human
gaaaucugaacucuguauccuu

SEQ ID NO: 160083 - RNA, 22 nt, Human
uucacauugugcagauuauggu

SEQ ID NO: 160084 - RNA, 22 nt, Human
ugucugagugugccugggcauu

SEQ ID NO: 160085 - RNA, 21 nt, Human
gcagccagacgggauucaguu

SEQ ID NO: 160086 - RNA, 22 nt, Human
agggagaaugaccaagguauau

SEQ ID NO: 160087 - RNA, 21 nt, Human
ucucuacacuuucacuaggcu

SEQ ID NO: 160088 - RNA, 22 nt, Human
ggcuggaaguccaagaucaaga

SEQ ID NO: 160089 - RNA, 20 nt, Human
ccacaggaguccagucgacc

SEQ ID NO: 160090 - RNA, 22 nt, Human
agccucugcuuaugcaaaggua

SEQ ID NO: 160091 - RNA, 21 nt, Human
uagggcaggcauuggaagaga

SEQ ID NO: 160092 - RNA, 22 nt, Human
cagcugcccugccuugcccuua

SEQ ID NO: 160093 - RNA, 22 nt, Human
uggaccugcuggaugggcaggu

SEQ ID NO: 160094 - RNA, 22 nt, Human
cugugcaagcccaagauaaaac

SEQ ID NO: 160095 - RNA, 22 nt, Human
ucauugcaccccagucccagcu

SEQ ID NO: 160096 - RNA, 23 nt, Human
uucuuucaagaaguucacagugc

SEQ ID NO: 160097 - RNA, 22 nt, Human
gggcagagaaauggacaguugg

SEQ ID NO: 160098 - RNA, 22 nt, Human
caaggaaaaagcgagcucgggg

SEQ ID NO: 160099 - RNA, 22 nt, Human
uaaacagaaagcagauguacuu

SEQ ID NO: 160100 - RNA, 22 nt, Human
ggggcagagucuggacuguugu

SEQ ID NO: 160101 - RNA, 22 nt, Human
ucaaggcuaaacuuucagagua

SEQ ID NO: 160102 - RNA, 22 nt, Human
cagccagcuucagauccaagcc

SEQ ID NO: 160103 - RNA, 22 nt, Human
cagaguguauucugcaguugca

SEQ ID NO: 160104 - RNA, 19 nt, Human
aucagcaagguaggaugug

SEQ ID NO: 160105 - RNA, 20 nt, Human
agagaauucccuuuggagau

SEQ ID NO: 160106 - RNA, 22 nt, Human
cagggcaguuugugccuaugag

SEQ ID NO: 160107 - RNA, 22 nt, Human
aagccuuccugagugcaaggcc

SEQ ID NO: 160108 - RNA, 22 nt, Human
ccuuccaggugcaggcaagccu

SEQ ID NO: 160109 - RNA, 22 nt, Human
cugggcaggagggcucuaugga

SEQ ID NO: 160110 - RNA, 22 nt, Human
cugggcugcagcgggagcgacg

SEQ ID NO: 160111 - RNA, 22 nt, Human
gagcagugagugaauguugccu

SEQ ID NO: 160112 - RNA, 22 nt, Human
gcaggagagucugugccagguu

SEQ ID NO: 160113 - RNA, 22 nt, Human
uugaggaguguuuagggugagg

SEQ ID NO: 160114 - RNA, 22 nt, Human
uaaacaugugagugugcauaua

SEQ ID NO: 160115 - RNA, 23 nt, Human
gugcaugugucuuuacaguagca

SEQ ID NO: 160116 - RNA, 22 nt, Human
ucccagagaaagucaaggucuu

SEQ ID NO: 160117 - RNA, 23 nt, Human
uggccuggagagaaaagaugagu

SEQ ID NO: 160118 - RNA, 23 nt, Human
uccugagaugagacagugcugcc

SEQ ID NO: 160119 - RNA, 22 nt, Human
aaguucaauggaaaagcuuuag

SEQ ID NO: 160120 - RNA, 22 nt, Human
ugcuggccgugagcucucggga

SEQ ID NO: 160121 - RNA, 22 nt, Human
gcugagguggcugccuuaguaa

SEQ ID NO: 160122 - RNA, 21 nt, Human
acagaguaguugaaacagaga

SEQ ID NO: 160123 - RNA, 22 nt, Human
ugaagcaguuacuggguguuaa

SEQ ID NO: 160124 - RNA, 22 nt, Human
auauuucuugagcaccugguau

SEQ ID NO: 160125 - RNA, 22 nt, Human
cugcccuggucccauggcugau

SEQ ID NO: 160126 - RNA, 22 nt, Human
ucccagccauuccuuuaggugu

SEQ ID NO: 160127 - RNA, 17 nt, Human
gagagcugcugcuuccg

SEQ ID NO: 160128 - RNA, 22 nt, Human
gaagagcugcaguuuccugggc

SEQ ID NO: 160129 - RNA, 22 nt, Human
acagggcaugugcaagagacau

SEQ ID NO: 160130 - RNA, 22 nt, Human
uuuauuguuguuagucauaagu

SEQ ID NO: 160131 - RNA, 22 nt, Human
aggaagcccuugucauuucugu

SEQ ID NO: 160132 - RNA, 22 nt, Human
ucuggccugaaaguccaugcuu

SEQ ID NO: 160133 - RNA, 22 nt, Human
gccuggcacauugcaguggauu

SEQ ID NO: 160134 - RNA, 22 nt, Human
aaaagguuuugaguacaaauau

SEQ ID NO: 160135 - RNA, 22 nt, Human
gggcuggugaggcugcccugca

SEQ ID NO: 160136 - RNA, 23 nt, Human
agacccagagacuggcucugcuc

SEQ ID NO: 160137 - RNA, 21 nt, Human
auugaaagucaacaaucaguu

SEQ ID NO: 160138 - RNA, 22 nt, Human
cagugguggaaugaggaauugu

SEQ ID NO: 160139 - RNA, 20 nt, Human
aauuuacucacagaaugaau

SEQ ID NO: 160140 - RNA, 22 nt, Human
agcagcuggugagcaagcucag

SEQ ID NO: 160141 - RNA, 22 nt, Human
gccugguguccagaggcgagug

SEQ ID NO: 160142 - RNA, 20 nt, Human
gcugaggucauuaugccuca

SEQ ID NO: 160143 - RNA, 22 nt, Human
ggccucuggcaggcaggcccuc

SEQ ID NO: 160144 - RNA, 22 nt, Human
uggcagggaguugcaggauuuc

SEQ ID NO: 160145 - RNA, 22 nt, Human
caccugagugucaguauucuca

SEQ ID NO: 160146 - RNA, 22 nt, Human
ugcauauugugaaaauguagau

SEQ ID NO: 160147 - RNA, 22 nt, Human
acugcagccuuugggcucauaa

SEQ ID NO: 160148 - RNA, 22 nt, Human
agcagccagagaaugaugcagu

SEQ ID NO: 160149 - RNA, 22 nt, Human
aaaguguaaaagcauguuaggg

SEQ ID NO: 160150 - RNA, 22 nt, Human
aaguucaaguguaaucuuuauu

SEQ ID NO: 160151 - RNA, 22 nt, Human
ggggcagagagaaggaagcuug

SEQ ID NO: 160152 - RNA, 22 nt, Human
guaaaugugcuucuuuuaacuu

SEQ ID NO: 160153 - RNA, 22 nt, Human
uguguacucaauugagccauuu

SEQ ID NO: 160154 - RNA, 22 nt, Human
uuggcuucucuuaacccuaaag

SEQ ID NO: 160155 - RNA, 22 nt, Human
guggcagcugguaugcagacag

SEQ ID NO: 160156 - RNA, 22 nt, Human
gcucugcugagauaucugggag

SEQ ID NO: 160157 - RNA, 22 nt, Human
aggcuggcuuggcucuccugug

SEQ ID NO: 160158 - RNA, 20 nt, Human
aagaaacuugaaaguacaag

SEQ ID NO: 160159 - RNA, 22 nt, Human
gcucugagagugggugauucug

SEQ ID NO: 160160 - RNA, 22 nt, Human
ccacagggcucuaggcgcuucc

SEQ ID NO: 160161 - RNA, 22 nt, Human
gauuuccuagacauggggcaga

SEQ ID NO: 160162 - RNA, 22 nt, Human
ccaccagcuuugccacccugcu

SEQ ID NO: 160163 - RNA, 22 nt, Human
cacagcuucuccuugauaucgc

SEQ ID NO: 160164 - RNA, 22 nt, Human
cacagcuuccauuagaaugaga

SEQ ID NO: 160165 - RNA, 22 nt, Human
ggaccugccagaacucaggcua

SEQ ID NO: 160166 - RNA, 22 nt, Human
uagugaaauuuaugcacagcua

SEQ ID NO: 160167 - RNA, 22 nt, Human
gggauggacuuggggacuccag

SEQ ID NO: 160168 - RNA, 22 nt, Human
ggcucugcccagguggacagca

SEQ ID NO: 160169 - RNA, 22 nt, Human
aaggugucacugggacaggaaa

SEQ ID NO: 160170 - RNA, 22 nt, Human
uuugcagcaaggagagagcauu

SEQ ID NO: 160171 - RNA, 22 nt, Human
ucauugcagugauguuguaugu

SEQ ID NO: 160172 - RNA, 22 nt, Human
cacauguuuggcaugucaccaa

SEQ ID NO: 160173 - RNA, 22 nt, Human
uuuccucuuuguaccuugacua

SEQ ID NO: 160174 - RNA, 22 nt, Human
acucugccuuucagcagaugaa

SEQ ID NO: 160175 - RNA, 22 nt, Human
uggcccuguggaggucagugag

SEQ ID NO: 160176 - RNA, 17 nt, Human
gcugcagcgguaggcag

SEQ ID NO: 160177 - RNA, 22 nt, Human
ggcucuggagacauguggagag

SEQ ID NO: 160178 - RNA, 22 nt, Human
ugucaccagcugcuccucagga

SEQ ID NO: 160179 - RNA, 19 nt, Human
gguaaaagugagcuucagg

SEQ ID NO: 160180 - RNA, 22 nt, Human
ccaaaguccauaguuuacauua

SEQ ID NO: 160181 - RNA, 22 nt, Human
gcagaagcccggucagcgcacg

SEQ ID NO: 160182 - RNA, 19 nt, Human
guaagggcuaauggacuau

SEQ ID NO: 160183 - RNA, 19 nt, Human
gaguuauugccagggcaug

SEQ ID NO: 160184 - RNA, 22 nt, Human
uccugggcccaggcugccaggg

SEQ ID NO: 160185 - RNA, 22 nt, Human
aauaauuuugagagccuggaaa

SEQ ID NO: 160186 - RNA, 22 nt, Human
caaugauguuuagauaaaaucc

SEQ ID NO: 160187 - RNA, 22 nt, Human
uggcugccuuucaccucaucuc

SEQ ID NO: 160188 - RNA, 22 nt, Human
ugcuccuuccucauccugugca

SEQ ID NO: 160189 - RNA, 22 nt, Human
uccagugguuugaaaggggugu

SEQ ID NO: 160190 - RNA, 23 nt, Human
gggagccauggguggucauggag

SEQ ID NO: 160191 - RNA, 22 nt, Human
acaggcugcugagccauuugcu

SEQ ID NO: 160192 - RNA, 22 nt, Human
cugcuuugcauagcugccagag

SEQ ID NO: 160193 - RNA, 22 nt, Human
cuuauguauaauguuccacaua

SEQ ID NO: 160194 - RNA, 22 nt, Human
agucccagaugacccagcuacu

SEQ ID NO: 160195 - RNA, 21 nt, Human
gcacagcaugaguguuggcau

SEQ ID NO: 160196 - RNA, 22 nt, Human
gaaggagacccugaagaugcug

SEQ ID NO: 160197 - RNA, 22 nt, Human
cgcagcagccccgugguaggug

SEQ ID NO: 160198 - RNA, 22 nt, Human
agccaagcacucaacuccugga

SEQ ID NO: 160199 - RNA, 20 nt, Human
cuguaucagguuacaaagua

SEQ ID NO: 160200 - RNA, 22 nt, Human
aguguuucccaguaggaugaaa

SEQ ID NO: 160201 - RNA, 22 nt, Human
auguacauuuagaucauuucug

SEQ ID NO: 160202 - RNA, 21 nt, Human
uaaaugugagcagggcugggc

SEQ ID NO: 160203 - RNA, 22 nt, Human
agcuguccuggcucaggcugug

SEQ ID NO: 160204 - RNA, 22 nt, Human
acaggugugagaacaugccuug

SEQ ID NO: 160205 - RNA, 22 nt, Human
cagcuggggcagccacgugcgg

SEQ ID NO: 160206 - RNA, 22 nt, Human
gccugugcuuaacugacgugag

SEQ ID NO: 160207 - RNA, 22 nt, Human
uucacaggauauaugugcaggg

SEQ ID NO: 160208 - RNA, 22 nt, Human
caaaugcaaaauauaacccugu

SEQ ID NO: 160209 - RNA, 22 nt, Human
ucagggcauggcugcacuuggc

SEQ ID NO: 160210 - RNA, 22 nt, Human
uagaaaguaaaucaguuuuauu

SEQ ID NO: 160211 - RNA, 21 nt, Human
agcuggcagauauggugucug

SEQ ID NO: 160212 - RNA, 22 nt, Human
auuuuuccaugauacuuaucug

SEQ ID NO: 160213 - RNA, 22 nt, Human
acuuucucccacccacccgucu

SEQ ID NO: 160214 - RNA, 22 nt, Human
agccaggaauuggacaacacau

SEQ ID NO: 160215 - RNA, 21 nt, Human
aggcuguccuuugccagcccu

SEQ ID NO: 160216 - RNA, 22 nt, Human
gcacagaaguaaaauacaaguc

SEQ ID NO: 160217 - RNA, 22 nt, Human
ccugucugcaugaucccugcca

SEQ ID NO: 160218 - RNA, 21 nt, Human
gagccuucccucugcccuuuc

SEQ ID NO: 160219 - RNA, 22 nt, Human
caaggaaacaugaaaugcauug

SEQ ID NO: 160220 - RNA, 22 nt, Human
aaaugcagauugucauucagga

SEQ ID NO: 160221 - RNA, 22 nt, Human
caugggcuacagaagcaugcug

SEQ ID NO: 160222 - RNA, 22 nt, Human
ucuggcagggguucugcacuug

SEQ ID NO: 160223 - RNA, 22 nt, Human
ugcaggagcagagauggcugga

SEQ ID NO: 160224 - RNA, 22 nt, Human
cagcugccacuugcucucggcu

SEQ ID NO: 160225 - RNA, 22 nt, Human
acagcagcuaaaggugucuccu

SEQ ID NO: 160226 - RNA, 22 nt, Human
ugagagugaaaugucacauguc

SEQ ID NO: 160227 - RNA, 22 nt, Human
ggcagcuccaaaaggaaacacu

SEQ ID NO: 160228 - RNA, 22 nt, Human
aauaugcauguauacaugugua

SEQ ID NO: 160229 - RNA, 22 nt, Human
ucccagagaagagcuggaugga

SEQ ID NO: 160230 - RNA, 22 nt, Human
ugaagcaggugaauggaugucg

SEQ ID NO: 160231 - RNA, 22 nt, Human
ugagguggcuagggaggcacuc

SEQ ID NO: 160232 - RNA, 22 nt, Human
ggagugacucucggggccacua

SEQ ID NO: 160233 - RNA, 22 nt, Human
acuuccugcuaugagcuucugu

SEQ ID NO: 160234 - RNA, 22 nt, Human
gaggggcuugaggcccugaugg

SEQ ID NO: 160235 - RNA, 22 nt, Human
uggcagcuugaaugcagucuuu

SEQ ID NO: 160236 - RNA, 22 nt, Human
acaaacuaccuacagauguuca

SEQ ID NO: 160237 - RNA, 22 nt, Human
gcagccacuaguuuuccuguuu

SEQ ID NO: 160238 - RNA, 22 nt, Human
cuucugugcuucacaguugcca

SEQ ID NO: 160239 - RNA, 22 nt, Human
augaaauaucuugaagaaauuc

SEQ ID NO: 160240 - RNA, 22 nt, Human
gaggguccccaugcagagcuca

SEQ ID NO: 160241 - RNA, 22 nt, Human
acacagggcggaaagcaugaga

SEQ ID NO: 160242 - RNA, 22 nt, Human
agggagcucaguuggaagcggu

SEQ ID NO: 160243 - RNA, 22 nt, Human
ccaaaauguuugaaugcaugug

SEQ ID NO: 160244 - RNA, 21 nt, Human
cagagguggccugaccucuga

SEQ ID NO: 160245 - RNA, 22 nt, Human
ggggaugguggcauuuguaaaa

SEQ ID NO: 160246 - RNA, 22 nt, Human
ccaggccugauugggaaucuug

SEQ ID NO: 160247 - RNA, 17 nt, Human
ccagagcuacugagacu

SEQ ID NO: 160248 - RNA, 22 nt, Human
uggccagguguggguucucaga

SEQ ID NO: 160249 - RNA, 22 nt, Human
cccagcauccucagggagcggg

SEQ ID NO: 160250 - RNA, 20 nt, Human
accucugcaucaauccuuug

SEQ ID NO: 160251 - RNA, 17 nt, Human
gcacugaacaauccugu

SEQ ID NO: 160252 - RNA, 22 nt, Human
ucaagagagugcugcuuggggu

SEQ ID NO: 160253 - RNA, 22 nt, Human
gcagagcagugcuugcccagcg

SEQ ID NO: 160254 - RNA, 22 nt, Human
ggagauggcucugcaaggucua

SEQ ID NO: 160255 - RNA, 19 nt, Human
ccagcagacacagcugccc

SEQ ID NO: 160256 - RNA, 22 nt, Human
ggcagccauggacacuggcuag

SEQ ID NO: 160257 - RNA, 22 nt, Human
aucaguuuguauaugaaacacu

SEQ ID NO: 160258 - RNA, 22 nt, Human
acucacauuucaucaggccaag

SEQ ID NO: 160259 - RNA, 22 nt, Human
ucagggcucaccagccucugcc

SEQ ID NO: 160260 - RNA, 22 nt, Human
cucucugcuguauccuuaggcu

SEQ ID NO: 160261 - RNA, 22 nt, Human
uuaaacagucccagaggcugac

SEQ ID NO: 160262 - RNA, 22 nt, Human
agcagcugcagagggcuccccc

SEQ ID NO: 160263 - RNA, 22 nt, Human
ugcugcucuguaaagugaugag

SEQ ID NO: 160264 - RNA, 22 nt, Human
acauuucucuuagaguuggacu

SEQ ID NO: 160265 - RNA, 22 nt, Human
uugaaaggugcugugugcugau

SEQ ID NO: 160266 - RNA, 22 nt, Human
caggcagaagaaguggaaggac

SEQ ID NO: 160267 - RNA, 22 nt, Human
gcucccugcacucugcagcccu

SEQ ID NO: 160268 - RNA, 19 nt, Human
cugcugggugcugagggag

SEQ ID NO: 160269 - RNA, 22 nt, Human
cuggcccuucucuugcuuccug

SEQ ID NO: 160270 - RNA, 22 nt, Human
auaagaaacauuauucuuucca

SEQ ID NO: 160271 - RNA, 22 nt, Human
ggcgaggccgggacaggcugga

SEQ ID NO: 160272 - RNA, 22 nt, Human
ugccuggcaacuguggugggcu

SEQ ID NO: 160273 - RNA, 22 nt, Human
uccuggagggaggcggugcuac

SEQ ID NO: 160274 - RNA, 22 nt, Human
uuuccucugaugcugacuugga

SEQ ID NO: 160275 - RNA, 22 nt, Human
augggaggaucacuugaggcca

SEQ ID NO: 160276 - RNA, 22 nt, Human
ugggcacuguagcuggugcugg

SEQ ID NO: 160277 - RNA, 20 nt, Human
aguaccuuuuguauguuacc

SEQ ID NO: 160278 - RNA, 22 nt, Human
gcacagggaggcuggccuggcc

SEQ ID NO: 160279 - RNA, 20 nt, Human
aucuggcucagauccugcag

SEQ ID NO: 160280 - RNA, 22 nt, Human
ucaguuuucauuucaugagcag

SEQ ID NO: 160281 - RNA, 22 nt, Human
gcccugucggaacugcgaccuc

SEQ ID NO: 160282 - RNA, 22 nt, Human
guggguggaucaccugagguca

SEQ ID NO: 160283 - RNA, 22 nt, Human
agggacagucuacuguucacug

SEQ ID NO: 160284 - RNA, 22 nt, Human
aaagccuugcccgucacuggga

SEQ ID NO: 160285 - RNA, 22 nt, Human
guuagaaacacauucuuauuga

SEQ ID NO: 160286 - RNA, 22 nt, Human
gcagggacaacugugcaccuga

SEQ ID NO: 160287 - RNA, 22 nt, Human
uuuccucuccaccaggaggucu

SEQ ID NO: 160288 - RNA, 22 nt, Human
agguuuucagcuguauccugag

SEQ ID NO: 160289 - RNA, 22 nt, Human
cgagaguggacagggcgcagcu

SEQ ID NO: 160290 - RNA, 22 nt, Human
uuaacagagugccuggcaugua

SEQ ID NO: 160291 - RNA, 22 nt, Human
auaaacagcuccauuuagugcc

SEQ ID NO: 160292 - RNA, 22 nt, Human
cagccuccugggacacucaccg

SEQ ID NO: 160293 - RNA, 22 nt, Human
acagugucaugucguguucccc

SEQ ID NO: 160294 - RNA, 22 nt, Human
aggcacugaauauccaguaaaa

SEQ ID NO: 160295 - RNA, 19 nt, Human
gcucugagaggggcauggg

SEQ ID NO: 160296 - RNA, 22 nt, Human
uacauucaacaugucacuaugu

SEQ ID NO: 160297 - RNA, 19 nt, Human
ggaugagggucaggcauag

SEQ ID NO: 160298 - RNA, 22 nt, Human
acugggccggugcagaguaguu

SEQ ID NO: 160299 - RNA, 22 nt, Human
guuugcauguauuaagucaaua

SEQ ID NO: 160300 - RNA, 22 nt, Human
ugaccaaagaguugcuuguauu

SEQ ID NO: 160301 - RNA, 23 nt, Human
aggagccaggaaccagcuucccc

SEQ ID NO: 160302 - RNA, 22 nt, Human
ggcugccugcucaggugcggcg

SEQ ID NO: 160303 - RNA, 22 nt, Human
cucuggagcaccgggcuaucca

SEQ ID NO: 160304 - RNA, 22 nt, Human
uugcuuccucgaggccagcgug

SEQ ID NO: 160305 - RNA, 19 nt, Human
uuacaucugcaacacuggu

SEQ ID NO: 160306 - RNA, 22 nt, Human
aucaguuugauaauaaggcuug

SEQ ID NO: 160307 - RNA, 23 nt, Human
ugcaggggaggcuuaaagcaggu

SEQ ID NO: 160308 - RNA, 22 nt, Human
ugaccaaaggugguuuauuugg

SEQ ID NO: 160309 - RNA, 22 nt, Human
ggccugggcccacugucaagag

SEQ ID NO: 160310 - RNA, 22 nt, Human
gagagugaugaaugguuaaaca

SEQ ID NO: 160311 - RNA, 22 nt, Human
aaauucuuucauggcuaauaag

SEQ ID NO: 160312 - RNA, 22 nt, Human
caaaugcuggcccugcuacuua

SEQ ID NO: 160313 - RNA, 20 nt, Human
uccugcaguuccuaggaggg

SEQ ID NO: 160314 - RNA, 22 nt, Human
ugggaccaagucauuucuuuag

SEQ ID NO: 160315 - RNA, 22 nt, Human
gcccagcuccucugcagacccu

SEQ ID NO: 160316 - RNA, 22 nt, Human
cugagccaguagucagggacaa

SEQ ID NO: 160317 - RNA, 22 nt, Human
uuuuccucaggaaugcuaagcu

SEQ ID NO: 160318 - RNA, 22 nt, Human
cugcagcuguagaggacagugg

SEQ ID NO: 160319 - RNA, 22 nt, Human
ugggcccaagagagucuccaac

SEQ ID NO: 160320 - RNA, 22 nt, Human
ucccuggagauaacuucuggga

SEQ ID NO: 160321 - RNA, 22 nt, Human
cuuuauguuggggugucuuagu

SEQ ID NO: 160322 - RNA, 22 nt, Human
cuggugggagcagcaggcagcu

SEQ ID NO: 160323 - RNA, 22 nt, Human
ggcucaggccuguaauccuagc

SEQ ID NO: 160324 - RNA, 22 nt, Human
ucucuucuugauuuucacugga

SEQ ID NO: 160325 - RNA, 22 nt, Human
aaauugugagcuauagaucuag

SEQ ID NO: 160326 - RNA, 22 nt, Human
augaagauaagaccaggcugga

SEQ ID NO: 160327 - RNA, 22 nt, Human
ugggaggacuugugggcuucau

SEQ ID NO: 160328 - RNA, 22 nt, Human
uucaaugauuuuuagggaucau

SEQ ID NO: 160329 - RNA, 22 nt, Human
acauuucuccuugcaggaguca

SEQ ID NO: 160330 - RNA, 22 nt, Human
ggaagaagggucauuggcagcc

SEQ ID NO: 160331 - RNA, 20 nt, Human
gcauugaguauagacagaug

SEQ ID NO: 160332 - RNA, 22 nt, Human
ugaaagguuauuuaggucugcu

SEQ ID NO: 160333 - RNA, 22 nt, Human
auccaguucucagugcuuacag

SEQ ID NO: 160334 - RNA, 22 nt, Human
gcagcugaaagggaucucuaca

SEQ ID NO: 160335 - RNA, 22 nt, Human
cucagagucugcauuucuguca

SEQ ID NO: 160336 - RNA, 22 nt, Human
ugcuggcccaguauggacugca

SEQ ID NO: 160337 - RNA, 22 nt, Human
aacugcauuugcauaaguccau

SEQ ID NO: 160338 - RNA, 22 nt, Human
gcacacagauuaggaaacagaa

SEQ ID NO: 160339 - RNA, 22 nt, Human
aaugcugcucucauaauuauag

SEQ ID NO: 160340 - RNA, 22 nt, Human
ggcugccuccucgagacaggau

SEQ ID NO: 160341 - RNA, 20 nt, Human
uagaaaucuuauaaaagacu

SEQ ID NO: 160342 - RNA, 23 nt, Human
uggagcugggcucagacccuggg

SEQ ID NO: 160343 - RNA, 22 nt, Human
gggcagagagcuggaacuccuu

SEQ ID NO: 160344 - RNA, 22 nt, Human
uuaagaauggaaugaggaauuu

SEQ ID NO: 160345 - RNA, 22 nt, Human
aaaagcucuuucugcuguagau

SEQ ID NO: 160346 - RNA, 22 nt, Human
aggguggcaguuacuggagcaa

SEQ ID NO: 160347 - RNA, 22 nt, Human
ucuuuccuagaggcugaugagu

SEQ ID NO: 160348 - RNA, 22 nt, Human
auccugggaagcugacauugaa

SEQ ID NO: 160349 - RNA, 22 nt, Human
ccuauugacaauucucuucucc

SEQ ID NO: 160350 - RNA, 22 nt, Human
cuccauugaacauccucucaga

SEQ ID NO: 160351 - RNA, 22 nt, Human
cucugagcccgcugcagcccca

SEQ ID NO: 160352 - RNA, 22 nt, Human
gagcucauccccaugguccguc

SEQ ID NO: 160353 - RNA, 22 nt, Human
gucuuucuuaauucaagugcuu

SEQ ID NO: 160354 - RNA, 22 nt, Human
gagguacaugaggauacacagg

SEQ ID NO: 160355 - RNA, 22 nt, Human
gagcucccuggagguucagaua

SEQ ID NO: 160356 - RNA, 18 nt, Human
agcuggcccuggcugccg

SEQ ID NO: 160357 - RNA, 22 nt, Human
aggaagccuggggcugcccucg

SEQ ID NO: 160358 - RNA, 22 nt, Human
augacacaauuuuagagcugaa

SEQ ID NO: 160359 - RNA, 22 nt, Human
cuggcagguggauggggacucc

SEQ ID NO: 160360 - RNA, 22 nt, Human
uaacagaaauauuuccagguga

SEQ ID NO: 160361 - RNA, 22 nt, Human
uauccaauucaccauugauggg

SEQ ID NO: 160362 - RNA, 22 nt, Human
ugggccuggcccuguggaggag

SEQ ID NO: 160363 - RNA, 22 nt, Human
gcugucuccauagcuguguguc

SEQ ID NO: 160364 - RNA, 22 nt, Human
guccucagucaguuuggugggg

SEQ ID NO: 160365 - RNA, 22 nt, Human
augaagcugguuuuggcuuggg

SEQ ID NO: 160366 - RNA, 22 nt, Human
ugggccugugaugcugggcuau

SEQ ID NO: 160367 - RNA, 22 nt, Human
ugucucuggcccaugagcagag

SEQ ID NO: 160368 - RNA, 22 nt, Human
acauuucucagggaguuuugcu

SEQ ID NO: 160369 - RNA, 22 nt, Human
aaggccaggacaccaggggacu

SEQ ID NO: 160370 - RNA, 22 nt, Human
ugcugucuuccaggauggugaa

SEQ ID NO: 160371 - RNA, 22 nt, Human
ugggcugcugcggugcucuugg

SEQ ID NO: 160372 - RNA, 22 nt, Human
gcagggcucugcuguaguccua

SEQ ID NO: 160373 - RNA, 22 nt, Human
cccugagcccauaguugacauu

SEQ ID NO: 160374 - RNA, 22 nt, Human
auucuccagcucacuguccaua

SEQ ID NO: 160375 - RNA, 22 nt, Human
agccagaggccagccugccuca

SEQ ID NO: 160376 - RNA, 20 nt, Human
ugcugcaguuucaugggacu

SEQ ID NO: 160377 - RNA, 22 nt, Human
cuggccgguauuugccucuggg

SEQ ID NO: 160378 - RNA, 19 nt, Human
cagucccaaauucuuguca

SEQ ID NO: 160379 - RNA, 22 nt, Human
ccagagccagagaggugccugc

SEQ ID NO: 160380 - RNA, 22 nt, Human
agcuggcccucgagagccaauu

SEQ ID NO: 160381 - RNA, 22 nt, Human
ucuccucugcgcggcagugccc

SEQ ID NO: 160382 - RNA, 22 nt, Human
cugggacagcugagacaggaga

SEQ ID NO: 160383 - RNA, 19 nt, Human
cagcugccuuuucuuugca

SEQ ID NO: 160384 - RNA, 22 nt, Human
cuccucuggaaauuccucugcc

SEQ ID NO: 160385 - RNA, 22 nt, Human
ccacaaguuucagcacccagag

SEQ ID NO: 160386 - RNA, 22 nt, Human
agcaggugaauuccuggaugug

SEQ ID NO: 160387 - RNA, 22 nt, Human
caugaagcacagcucucuuuuu

SEQ ID NO: 160388 - RNA, 21 nt, Human
ugccagcauuaaacagucauu

SEQ ID NO: 160389 - RNA, 22 nt, Human
gcucccacgcaauucuuuucag

SEQ ID NO: 160390 - RNA, 21 nt, Human
caggaaaagcggaagucuagc

SEQ ID NO: 160391 - RNA, 22 nt, Human
acaggugaccugcucauaugaa

SEQ ID NO: 160392 - RNA, 22 nt, Human
gcaccugcaggaugagccaggg

SEQ ID NO: 160393 - RNA, 22 nt, Human
agagcugcaccuaugcagaccu

SEQ ID NO: 160394 - RNA, 22 nt, Human
cugugcuuaccugcccagguga

SEQ ID NO: 160395 - RNA, 22 nt, Human
ugggcugcugagaaugagagag

SEQ ID NO: 160396 - RNA, 19 nt, Human
acauuuagaauguacuugc

SEQ ID NO: 160397 - RNA, 22 nt, Human
cugcccugggaguaccuguccu

SEQ ID NO: 160398 - RNA, 22 nt, Human
augccagucaaagaagaugaca

SEQ ID NO: 160399 - RNA, 22 nt, Human
cucucugaggaaggagcaucug

SEQ ID NO: 160400 - RNA, 22 nt, Human
uggcugcugcuuggucuucuuc

SEQ ID NO: 160401 - RNA, 22 nt, Human
gagcuuggugaugccuccuggu

SEQ ID NO: 160402 - RNA, 22 nt, Human
cucugugggggagaggcagcug

SEQ ID NO: 160403 - RNA, 22 nt, Human
cucucugaggcaggccuguggg

SEQ ID NO: 160404 - RNA, 22 nt, Human
ucagcaaugagaacuggcauuu

SEQ ID NO: 160405 - RNA, 22 nt, Human
ugcucugcaagcaggagcaaga

SEQ ID NO: 160406 - RNA, 22 nt, Human
ugauuuccaauaaggagaaugu

SEQ ID NO: 160407 - RNA, 22 nt, Human
aaaaaugcugugguagcugugu

SEQ ID NO: 160408 - RNA, 22 nt, Human
uuuucauuguaaaucaggaaac

SEQ ID NO: 160409 - RNA, 22 nt, Human
ggggcggggcucugagaagcau

SEQ ID NO: 160410 - RNA, 22 nt, Human
ccugccagcauggcuuaucucc

SEQ ID NO: 160411 - RNA, 22 nt, Human
cagggcagcuuccuuuguuagg

SEQ ID NO: 160412 - RNA, 22 nt, Human
ugggcacaaacaucugccuguu

SEQ ID NO: 160413 - RNA, 22 nt, Human
aucuggcuggauucuuagcguu

SEQ ID NO: 160414 - RNA, 22 nt, Human
agaugaagacucaggagcaggu

SEQ ID NO: 160415 - RNA, 21 nt, Human
gcucccugcucagcuccuggg

SEQ ID NO: 160416 - RNA, 22 nt, Human
ccugccuggcuuccagaagaga

SEQ ID NO: 160417 - RNA, 22 nt, Human
aggccugacuugaauuuagggc

SEQ ID NO: 160418 - RNA, 22 nt, Human
gagcagcucgagaaggaagcag

SEQ ID NO: 160419 - RNA, 22 nt, Human
cccagcaucccagugggcagca

SEQ ID NO: 160420 - RNA, 22 nt, Human
cuuguauuccccuaucucuaaa

SEQ ID NO: 160421 - RNA, 22 nt, Human
ucaguguaaguuauguagaugu

SEQ ID NO: 160422 - RNA, 22 nt, Human
agucauaauuauaaacaucagu

SEQ ID NO: 160423 - RNA, 22 nt, Human
ggcuggagugggcuccagaguu

SEQ ID NO: 160424 - RNA, 22 nt, Human
uguaugcuuguguauaauauaa

SEQ ID NO: 160425 - RNA, 21 nt, Human
cucuggaggcaagggagagug

SEQ ID NO: 160426 - RNA, 22 nt, Human
agggcugcuccuccuucaggcc

SEQ ID NO: 160427 - RNA, 22 nt, Human
ugcugccacaaauucagcugcc

SEQ ID NO: 160428 - RNA, 18 nt, Human
cauuaugugguuauagaa

SEQ ID NO: 160429 - RNA, 20 nt, Human
aggagcugaauuagaggguu

SEQ ID NO: 160430 - RNA, 22 nt, Human
ugaaauauuuagagaguaaguu

SEQ ID NO: 160431 - RNA, 22 nt, Human
ucccagccuuucuuuucugcug

SEQ ID NO: 160432 - RNA, 22 nt, Human
acaaagucuuuuacaacaguca

SEQ ID NO: 160433 - RNA, 22 nt, Human
gccugagcuacuagggagucug

SEQ ID NO: 160434 - RNA, 21 nt, Human
uuaagagcuuagcaguaggcc

SEQ ID NO: 160435 - RNA, 22 nt, Human
gcaggggaguggaugauggauu

SEQ ID NO: 160436 - RNA, 22 nt, Human
ucuggcuccugaguccaugcuc

SEQ ID NO: 160437 - RNA, 22 nt, Human
acauuucuaguuguucaucucc

SEQ ID NO: 160438 - RNA, 22 nt, Human
ucccaggacaggccacauggaa

SEQ ID NO: 160439 - RNA, 22 nt, Human
gcacagggcaacaggucuguua

SEQ ID NO: 160440 - RNA, 22 nt, Human
cacagcagagggagccauugaa

SEQ ID NO: 160441 - RNA, 22 nt, Human
gaugguuuggaaugaaguagcu

SEQ ID NO: 160442 - RNA, 22 nt, Human
gcuuccuucuaccacaucaugc

SEQ ID NO: 160443 - RNA, 22 nt, Human
gagaccaggaaguacagcagcc

SEQ ID NO: 160444 - RNA, 22 nt, Human
gaugcacuuucuuuucaacagu

SEQ ID NO: 160445 - RNA, 22 nt, Human
uaguuacagcaggcaggauaua

SEQ ID NO: 160446 - RNA, 22 nt, Human
aggugcagcugacaccaugugg

SEQ ID NO: 160447 - RNA, 22 nt, Human
ccagcagcccucuuccaagacu

SEQ ID NO: 160448 - RNA, 22 nt, Human
ugugcuucaucacuucucaguu

SEQ ID NO: 160449 - RNA, 17 nt, Human
aggugcuggagcaucag

SEQ ID NO: 160450 - RNA, 22 nt, Human
agagcugagaauguggcuuccu

SEQ ID NO: 160451 - RNA, 22 nt, Human
ccugccaggccagugagcuucc

SEQ ID NO: 160452 - RNA, 23 nt, Human
agaggccaacuucuugccccucc

SEQ ID NO: 160453 - RNA, 22 nt, Human
cuccagggagcuuggaaagacc

SEQ ID NO: 160454 - RNA, 17 nt, Human
acaagcaguggccaugg

SEQ ID NO: 160455 - RNA, 22 nt, Human
uccaugugccaaggggcagagg

SEQ ID NO: 160456 - RNA, 22 nt, Human
aaauauguauggaguucaugaa

SEQ ID NO: 160457 - RNA, 22 nt, Human
uggcugccuagucccucagccu

SEQ ID NO: 160458 - RNA, 22 nt, Human
uugcucaggcuuagagcuacua

SEQ ID NO: 160459 - RNA, 22 nt, Human
ggcucuggugugaagcagccuc

SEQ ID NO: 160460 - RNA, 22 nt, Human
gccugucugcgucacgcuuauu

SEQ ID NO: 160461 - RNA, 22 nt, Human
uggguagagcaggcuggggcuu

SEQ ID NO: 160462 - RNA, 22 nt, Human
accagagcuggcagaguaucaa

SEQ ID NO: 160463 - RNA, 22 nt, Human
auguuuuauauuuugcagcagu

SEQ ID NO: 160464 - RNA, 22 nt, Human
agcugccugggcuuguacaccu

SEQ ID NO: 160465 - RNA, 22 nt, Human
gggccacauugaagggugggua

SEQ ID NO: 160466 - RNA, 22 nt, Human
cagcagggaagcugugcuguuu

SEQ ID NO: 160467 - RNA, 22 nt, Human
uacauuguuuuuucuugccauc

SEQ ID NO: 160468 - RNA, 21 nt, Human
cgggcuggccgggcccucacc

SEQ ID NO: 160469 - RNA, 22 nt, Human
aagauuuccuucaguagagcua

SEQ ID NO: 160470 - RNA, 22 nt, Human
cagagcagaaaccugggugauu

SEQ ID NO: 160471 - RNA, 23 nt, Human
gcucugagggcuuaucccuccca

SEQ ID NO: 160472 - RNA, 22 nt, Human
ugcagugggccggaggccaggg

SEQ ID NO: 160473 - RNA, 20 nt, Human
uccagcugucuuucagagac

SEQ ID NO: 160474 - RNA, 22 nt, Human
ggagccuugggcgcucucccau

SEQ ID NO: 160475 - RNA, 18 nt, Human
ugcuggcaacuacuauug

SEQ ID NO: 160476 - RNA, 19 nt, Human
ucaaggcucccugagggau

SEQ ID NO: 160477 - RNA, 22 nt, Human
uacaugcuccacuuucuccugu

SEQ ID NO: 160478 - RNA, 22 nt, Human
ccucagcucuucccugugcaca

SEQ ID NO: 160479 - RNA, 22 nt, Human
aggaggcuguggagcacuccau

SEQ ID NO: 160480 - RNA, 22 nt, Human
ggguacaaagauuucauaagau

SEQ ID NO: 160481 - RNA, 22 nt, Human
agagccuggucugagauaggac

SEQ ID NO: 160482 - RNA, 22 nt, Human
gcuccugggcucuaccuugcua

SEQ ID NO: 160483 - RNA, 22 nt, Human
auugaaagauauacuguucuca

SEQ ID NO: 160484 - RNA, 17 nt, Human
agcugccagggagugug

SEQ ID NO: 160485 - RNA, 22 nt, Human
uguaugcagggcuuguaugcag

SEQ ID NO: 160486 - RNA, 22 nt, Human
ucagggcagaauccaaagaauu

SEQ ID NO: 160487 - RNA, 22 nt, Human
ccagcugcagguguuccagaug

SEQ ID NO: 160488 - RNA, 22 nt, Human
uccauaagcagguucuuccuga

SEQ ID NO: 160489 - RNA, 22 nt, Human
gacagccaugcacuucugcugu

SEQ ID NO: 160490 - RNA, 21 nt, Human
aguucauacugaguaacaaaa

SEQ ID NO: 160491 - RNA, 22 nt, Human
uuguaacagcuguuuauauagu

SEQ ID NO: 160492 - RNA, 22 nt, Human
acaaggaggucuggggggcccu

SEQ ID NO: 160493 - RNA, 19 nt, Human
ucccuuccugucgggcucc

SEQ ID NO: 160494 - RNA, 22 nt, Human
gcauuuaaauuugaacuucaga

SEQ ID NO: 160495 - RNA, 22 nt, Human
cuggcagcuuccuuugcaucug

SEQ ID NO: 160496 - RNA, 22 nt, Human
ugcagaguaaaagcagaugcua

SEQ ID NO: 160497 - RNA, 22 nt, Human
uacauaguauucacauuguuuu

SEQ ID NO: 160498 - RNA, 22 nt, Human
gcucugugccacaugcaguguu

SEQ ID NO: 160499 - RNA, 22 nt, Human
cagggccuuuuagcaucuucuc

SEQ ID NO: 160500 - RNA, 22 nt, Human
ggaggagacaguaaaaagcacg

SEQ ID NO: 160501 - RNA, 22 nt, Human
uggcucagcaagacauugaccu

SEQ ID NO: 160502 - RNA, 22 nt, Human
ggcagugacuguucagacgucc

SEQ ID NO: 160503 - RNA, 22 nt, Human
aggagucauugagagggguccu

SEQ ID NO: 160504 - RNA, 22 nt, Human
caggcagcagaggaguguggga

SEQ ID NO: 160505 - RNA, 21 nt, Human
uccagggaacuucucaggaau

SEQ ID NO: 160506 - RNA, 19 nt, Human
agaaaucucgagauuuguu

SEQ ID NO: 160507 - RNA, 22 nt, Human
uuggcuuccaggaucucagcag

SEQ ID NO: 160508 - RNA, 19 nt, Human
agacacacuugauaugugu

SEQ ID NO: 160509 - RNA, 22 nt, Human
uccuggagagugggcgagcaca

SEQ ID NO: 160510 - RNA, 22 nt, Human
uggugugggcguggcaggcaag

SEQ ID NO: 160511 - RNA, 22 nt, Human
cccagccaaggugcugguguug

SEQ ID NO: 160512 - RNA, 22 nt, Human
uguaugcaaauuuauuagcaca

SEQ ID NO: 160513 - RNA, 22 nt, Human
uuagaaaaaggcuguggucuua

SEQ ID NO: 160514 - RNA, 22 nt, Human
gggggcucugacucccucagcu

SEQ ID NO: 160515 - RNA, 21 nt, Human
gaggccacuaauaggggcaga

SEQ ID NO: 160516 - RNA, 22 nt, Human
agcccaagcuaugaggugaccu

SEQ ID NO: 160517 - RNA, 22 nt, Human
uaccuugggcuauuaucuuuga

SEQ ID NO: 160518 - RNA, 22 nt, Human
ggcagcuccucucagcaaaaga

SEQ ID NO: 160519 - RNA, 22 nt, Human
acauuucuugaugccucuguga

SEQ ID NO: 160520 - RNA, 22 nt, Human
ucagccuggcaggauggccugg

SEQ ID NO: 160521 - RNA, 22 nt, Human
acauacuaugaauacauguguc

SEQ ID NO: 160522 - RNA, 22 nt, Human
auucuuggagcagucaaagaag

SEQ ID NO: 160523 - RNA, 22 nt, Human
uggagcaggugccaggugugug

SEQ ID NO: 160524 - RNA, 22 nt, Human
ugcaaacaggagaguaaguaua

SEQ ID NO: 160525 - RNA, 22 nt, Human
ugcaguggaaagacucagacuu

SEQ ID NO: 160526 - RNA, 22 nt, Human
aaggcagcccuggcucagccug

SEQ ID NO: 160527 - RNA, 19 nt, Human
agcagagcagggccguggg

SEQ ID NO: 160528 - RNA, 22 nt, Human
cugucccucaucaccucugggu

SEQ ID NO: 160529 - RNA, 22 nt, Human
gagcagcugguaggugaaccca

SEQ ID NO: 160530 - RNA, 19 nt, Human
uugcauuguaguuggacug

SEQ ID NO: 160531 - RNA, 17 nt, Human
cauguguaugugggagu

SEQ ID NO: 160532 - RNA, 22 nt, Human
agcugucuccagauacaggauu

SEQ ID NO: 160533 - RNA, 22 nt, Human
caggccugaguguggaagucuu

SEQ ID NO: 160534 - RNA, 23 nt, Human
ccagcccuccaccagcucuaggc

SEQ ID NO: 160535 - RNA, 19 nt, Human
acccucucagugccugagg

SEQ ID NO: 160536 - RNA, 22 nt, Human
agggcugagacuaaggccagau

SEQ ID NO: 160537 - RNA, 22 nt, Human
acagaggccccgugggagagcc

SEQ ID NO: 160538 - RNA, 22 nt, Human
ugacacagaaauuaagcuguca

SEQ ID NO: 160539 - RNA, 22 nt, Human
cuggugccuccucccugugcuu

SEQ ID NO: 160540 - RNA, 22 nt, Human
cagccucuaagcacagccucuc

SEQ ID NO: 160541 - RNA, 22 nt, Human
caaagaugcugauguuggauca

SEQ ID NO: 160542 - RNA, 22 nt, Human
accagagcgcucaagccuuccc

SEQ ID NO: 160543 - RNA, 22 nt, Human
gugaccaucagagaauaacaaa

SEQ ID NO: 160544 - RNA, 22 nt, Human
caagcuccuuacauccacaggg

SEQ ID NO: 160545 - RNA, 22 nt, Human
agaacagaagggaggaaggccu

SEQ ID NO: 160546 - RNA, 22 nt, Human
gagagcugggcuuugggugaag

SEQ ID NO: 160547 - RNA, 22 nt, Human
cuacauuuuucaccgagccucu

SEQ ID NO: 160548 - RNA, 22 nt, Human
cugcugcauuccucuuuaugag

SEQ ID NO: 160549 - RNA, 22 nt, Human
gacaucauagggugggaggaaa

SEQ ID NO: 160550 - RNA, 22 nt, Human
cagcugccaugacauguccugc

SEQ ID NO: 160551 - RNA, 22 nt, Human
ucaaagucucugcuucuguaac

SEQ ID NO: 160552 - RNA, 22 nt, Human
augugaaacugaagcauccaua

SEQ ID NO: 160553 - RNA, 22 nt, Human
cugaggcuggggaagggaagug

SEQ ID NO: 160554 - RNA, 22 nt, Human
gcucuguguugucagaggcacc

SEQ ID NO: 160555 - RNA, 22 nt, Human
auaaggcagucacuggaauguu

SEQ ID NO: 160556 - RNA, 22 nt, Human
cuggcagguuuggugucuggug

SEQ ID NO: 160557 - RNA, 20 nt, Human
guccugggagccacagcaca

SEQ ID NO: 160558 - RNA, 22 nt, Human
ggcccaucucuugcucuggguu

SEQ ID NO: 160559 - RNA, 19 nt, Human
gcuucccaccagccagccc

SEQ ID NO: 160560 - RNA, 22 nt, Human
gaggcagcugaaggagugacag

SEQ ID NO: 160561 - RNA, 22 nt, Human
ccugggcauucuuugaguucuc

SEQ ID NO: 160562 - RNA, 22 nt, Human
gcugucacaagcaucuggggca

SEQ ID NO: 160563 - RNA, 22 nt, Human
augauacaucuucaugucagug

SEQ ID NO: 160564 - RNA, 22 nt, Human
aagggaggccagagguuuugca

SEQ ID NO: 160565 - RNA, 22 nt, Human
cuggaaugccucccugucagag

SEQ ID NO: 160566 - RNA, 22 nt, Human
ggcccaaggcccaggucgagcu

SEQ ID NO: 160567 - RNA, 22 nt, Human
ucugaaaguaucuggaucuuuu

SEQ ID NO: 160568 - RNA, 22 nt, Human
gcaccuggcugcccagguggag

SEQ ID NO: 160569 - RNA, 22 nt, Human
gcugguccacucccuggaggcu

SEQ ID NO: 160570 - RNA, 20 nt, Human
uggggccuguuucugugguu

SEQ ID NO: 160571 - RNA, 22 nt, Human
cucauggauauaagaacuguuu

SEQ ID NO: 160572 - RNA, 17 nt, Human
cucuccuuccucugagg

SEQ ID NO: 160573 - RNA, 22 nt, Human
agauuuagacugccuuaaucau

SEQ ID NO: 160574 - RNA, 22 nt, Human
cuuucauucuuagauauuagug

SEQ ID NO: 160575 - RNA, 22 nt, Human
cccuggaguccggagcucaccu

SEQ ID NO: 160576 - RNA, 22 nt, Human
acacugaauaauugagaguuga

SEQ ID NO: 160577 - RNA, 22 nt, Human
cagaagcauuccagcaaauagu

SEQ ID NO: 160578 - RNA, 22 nt, Human
cacagcagaaauaugaaggcag

SEQ ID NO: 160579 - RNA, 22 nt, Human
aaaguucugggggagaagaacg

SEQ ID NO: 160580 - RNA, 22 nt, Human
aaugcacauguuguaauaaaua

SEQ ID NO: 160581 - RNA, 22 nt, Human
ggcugccauaacugauaccaua

SEQ ID NO: 160582 - RNA, 22 nt, Human
gagagcccugcuccuaucccag

SEQ ID NO: 160583 - RNA, 22 nt, Human
ucagugcuucggcgagcaccua

SEQ ID NO: 160584 - RNA, 22 nt, Human
agcaggugcauggcgagcgcgg

SEQ ID NO: 160585 - RNA, 22 nt, Human
gcucagagggaacaaggggcug

SEQ ID NO: 160586 - RNA, 22 nt, Human
acacaguaugaaaagucuaguu

SEQ ID NO: 160587 - RNA, 22 nt, Human
uagaaaucauuuagaaguauug

SEQ ID NO: 160588 - RNA, 22 nt, Human
gugcagugacccuggagagcug

SEQ ID NO: 160589 - RNA, 22 nt, Human
cugccaggacugacgucuucag

SEQ ID NO: 160590 - RNA, 22 nt, Human
ucagggcaaaagggaaaccauu

SEQ ID NO: 160591 - RNA, 22 nt, Human
aagcugcccaagacugaagcau

SEQ ID NO: 160592 - RNA, 22 nt, Human
cugggccugucagggcuuuuug

SEQ ID NO: 160593 - RNA, 22 nt, Human
cuucccagaccuuagagugcag

SEQ ID NO: 160594 - RNA, 22 nt, Human
uggccuggggaccugugagacc

SEQ ID NO: 160595 - RNA, 22 nt, Human
ggugggcagcucuuggcaggca

SEQ ID NO: 160596 - RNA, 22 nt, Human
gcauugucaaaagugguaugac

SEQ ID NO: 160597 - RNA, 22 nt, Human
aaaaaugucauuauggaacuga

SEQ ID NO: 160598 - RNA, 22 nt, Human
ccugggugaugugcugcccucg

SEQ ID NO: 160599 - RNA, 22 nt, Human
acguuuucuagagaauaugcag

SEQ ID NO: 160600 - RNA, 22 nt, Human
gcagcugagagaagaacagggc

SEQ ID NO: 160601 - RNA, 22 nt, Human
agaugcugccucuccucacaag

SEQ ID NO: 160602 - RNA, 22 nt, Human
agaguguuauuugcucuguauu

SEQ ID NO: 160603 - RNA, 22 nt, Human
gcuggccugggcucaagaccag

SEQ ID NO: 160604 - RNA, 22 nt, Human
uugaaucauuacaauagauaag

SEQ ID NO: 160605 - RNA, 23 nt, Human
ucaguuuuggcuguucaguguug

SEQ ID NO: 160606 - RNA, 22 nt, Human
uuugcauuuugauaagaucacu

SEQ ID NO: 160607 - RNA, 22 nt, Human
gccugcagaggugcugcuagcu

SEQ ID NO: 160608 - RNA, 22 nt, Human
guccucuggaagaugaguucuu

SEQ ID NO: 160609 - RNA, 22 nt, Human
agugugcugcuuaaacaguugu

SEQ ID NO: 160610 - RNA, 22 nt, Human
ccugugugcugaugacgacaga

SEQ ID NO: 160611 - RNA, 22 nt, Human
gagagcuggccagcuucaguau

SEQ ID NO: 160612 - RNA, 22 nt, Human
aguuuguaucaauuugcuuuau

SEQ ID NO: 160613 - RNA, 19 nt, Human
gcagcugugggaagagcca

SEQ ID NO: 160614 - RNA, 22 nt, Human
agaugcugcuccacaggccagg

SEQ ID NO: 160615 - RNA, 22 nt, Human
cuggcaggucucgcugacgugu

SEQ ID NO: 160616 - RNA, 22 nt, Human
gagggcagaaaauuaugcggug

SEQ ID NO: 160617 - RNA, 22 nt, Human
caguguguggauccucccagga

SEQ ID NO: 160618 - RNA, 22 nt, Human
auccuugagaaaauaaaugacc

SEQ ID NO: 160619 - RNA, 22 nt, Human
uggcucagaguucaucuuuuag

SEQ ID NO: 160620 - RNA, 22 nt, Human
agcugcugagccaggcugaugu

SEQ ID NO: 160621 - RNA, 22 nt, Human
acaagagauuaucuacagauga

SEQ ID NO: 160622 - RNA, 22 nt, Human
cuucagaacuauaaaaaguacu

SEQ ID NO: 160623 - RNA, 22 nt, Human
aauaauguugacgauagucuua

SEQ ID NO: 160624 - RNA, 19 nt, Human
agcauccagucaugggauc

SEQ ID NO: 160625 - RNA, 22 nt, Human
uggccuuguguuuuagagaaag

SEQ ID NO: 160626 - RNA, 23 nt, Human
ccagccucugggucuucauccag

SEQ ID NO: 160627 - RNA, 22 nt, Human
aggggugaaagagggcccucaa

SEQ ID NO: 160628 - RNA, 22 nt, Human
ccugucauacuaacguaguggg

SEQ ID NO: 160629 - RNA, 22 nt, Human
cucuccuugcagauggcugccu

SEQ ID NO: 160630 - RNA, 22 nt, Human
aagccagauagaagaacucauu

SEQ ID NO: 160631 - RNA, 22 nt, Human
cugcugagcaucagggcugccc

SEQ ID NO: 160632 - RNA, 22 nt, Human
cugaggugagcuucccugggcu

SEQ ID NO: 160633 - RNA, 22 nt, Human
ucaagagacaggacguguuuca

SEQ ID NO: 160634 - RNA, 22 nt, Human
uggcagaguuggagguggaaga

SEQ ID NO: 160635 - RNA, 22 nt, Human
uccuucaguuaucacaguacug

SEQ ID NO: 160636 - RNA, 22 nt, Human
gcuguauuccugcacuguauag

SEQ ID NO: 160637 - RNA, 22 nt, Human
ucaacacuauccaggcaaucuu

SEQ ID NO: 160638 - RNA, 22 nt, Human
uccuucaguucaauuaguccgu

SEQ ID NO: 160639 - RNA, 22 nt, Human
gagcccagguucugcuuccagc

SEQ ID NO: 160640 - RNA, 22 nt, Human
auuguggugucaguuauaggca

SEQ ID NO: 160641 - RNA, 22 nt, Human
ggcuccuguccuccuggagcuc

SEQ ID NO: 160642 - RNA, 22 nt, Human
uuuuccucuguuauuaguguga

SEQ ID NO: 160643 - RNA, 22 nt, Human
cagcuggcccuuugguagccuu

SEQ ID NO: 160644 - RNA, 22 nt, Human
cuggcagcuuagcacucugguu

SEQ ID NO: 160645 - RNA, 22 nt, Human
ccaggccuagccccugagggua

SEQ ID NO: 160646 - RNA, 22 nt, Human
caguagccacuagacacaugua

SEQ ID NO: 160647 - RNA, 22 nt, Human
aggcugaggcagguggaucacu

SEQ ID NO: 160648 - RNA, 22 nt, Human
aaagcucacaguaauacaaggc

SEQ ID NO: 160649 - RNA, 22 nt, Human
aucagcaaggcaaucacugcag

SEQ ID NO: 160650 - RNA, 22 nt, Human
ugcugccacauuuaaagagggg

SEQ ID NO: 160651 - RNA, 22 nt, Human
ugcuugggaauguggagucaga

SEQ ID NO: 160652 - RNA, 22 nt, Human
caggcacucauucagagaggug

SEQ ID NO: 160653 - RNA, 22 nt, Human
ccaggagucaauaaaggaagcu

SEQ ID NO: 160654 - RNA, 22 nt, Human
aaugcacauaaauauggucuua

SEQ ID NO: 160655 - RNA, 22 nt, Human
ugcagcauuauucacaguagcc

SEQ ID NO: 160656 - RNA, 22 nt, Human
uuauguauggauggcugaaagu

SEQ ID NO: 160657 - RNA, 22 nt, Human
gcucccugcagcugagaguucc

SEQ ID NO: 160658 - RNA, 22 nt, Human
ugucucaguauacgaaacacuu

SEQ ID NO: 160659 - RNA, 22 nt, Human
gcugccucccccauggcuggaa

SEQ ID NO: 160660 - RNA, 22 nt, Human
guggcuugaccaucccugcuac

SEQ ID NO: 160661 - RNA, 22 nt, Human
aacaaauguguggcaguguggg

SEQ ID NO: 160662 - RNA, 22 nt, Human
caagggccuccaccuugcucgu

SEQ ID NO: 160663 - RNA, 22 nt, Human
ucccaggguccucuucuggaau

SEQ ID NO: 160664 - RNA, 22 nt, Human
aaaaguguccagauuaugaaga

SEQ ID NO: 160665 - RNA, 22 nt, Human
ggcugccuugacccuggcuccg

SEQ ID NO: 160666 - RNA, 21 nt, Human
agaugcugugcuccaggagca

SEQ ID NO: 160667 - RNA, 22 nt, Human
uaaaauguagcuucuaggcugg

SEQ ID NO: 160668 - RNA, 22 nt, Human
aguggcagaagucacuggguag

SEQ ID NO: 160669 - RNA, 22 nt, Human
aagggcagggaguuugugucua

SEQ ID NO: 160670 - RNA, 22 nt, Human
aaucuuucccuauuaaaugugg

SEQ ID NO: 160671 - RNA, 22 nt, Human
uauuuagaacagacaauagaaa

SEQ ID NO: 160672 - RNA, 22 nt, Human
ucuggagccuuggaugggaaag

SEQ ID NO: 160673 - RNA, 22 nt, Human
gggcagcagaggaucccuuaau

SEQ ID NO: 160674 - RNA, 21 nt, Human
ggagucagggucuggcugggg

SEQ ID NO: 160675 - RNA, 22 nt, Human
ccaggagcaggagcuggacaga

SEQ ID NO: 160676 - RNA, 22 nt, Human
gggcuucucuuuagugagcuga

SEQ ID NO: 160677 - RNA, 22 nt, Human
ccagccagucccgcaugaccgc

SEQ ID NO: 160678 - RNA, 22 nt, Human
aagacagaccacgugacagggc

SEQ ID NO: 160679 - RNA, 23 nt, Human
aggugccaacugagagcugagag

SEQ ID NO: 160680 - RNA, 22 nt, Human
ucagaguguuuuacuaaacaag

SEQ ID NO: 160681 - RNA, 22 nt, Human
cacaagucuguggucuccaaca

SEQ ID NO: 160682 - RNA, 22 nt, Human
ccagcuuguuugaagcucguca

SEQ ID NO: 160683 - RNA, 22 nt, Human
cccuggaagguucucuggcuca

SEQ ID NO: 160684 - RNA, 22 nt, Human
ucccagagcucugacaccagcu

SEQ ID NO: 160685 - RNA, 22 nt, Human
gagggguguggagccaucaguu

SEQ ID NO: 160686 - RNA, 22 nt, Human
aagccaggaagagagccuucac

SEQ ID NO: 160687 - RNA, 23 nt, Human
ggggccugcaccggucugcgcgg

SEQ ID NO: 160688 - RNA, 22 nt, Human
ccuggcagcauugguagagauu

SEQ ID NO: 160689 - RNA, 22 nt, Human
aaaaacugcaauuacuuuuguc

SEQ ID NO: 160690 - RNA, 22 nt, Human
guguaaggugaaaucaacaaau

SEQ ID NO: 160691 - RNA, 17 nt, Human
uuccccugaccaagccu

SEQ ID NO: 160692 - RNA, 18 nt, Human
acaaauguagugucuuaa

SEQ ID NO: 160693 - RNA, 22 nt, Human
ggcucccugccuguccucaguc

SEQ ID NO: 160694 - RNA, 18 nt, Human
agccuggaggguugaagu

SEQ ID NO: 160695 - RNA, 22 nt, Human
ccaggccaaauucagucagcag

SEQ ID NO: 160696 - RNA, 23 nt, Human
ccugugugcccuuaauucacagc

SEQ ID NO: 160697 - RNA, 22 nt, Human
gggcacugcuggaggcucccug

SEQ ID NO: 160698 - RNA, 22 nt, Human
gggcccuggggccugauuugca

SEQ ID NO: 160699 - RNA, 20 nt, Human
ucuggcucuuugcuccuccc

SEQ ID NO: 160700 - RNA, 22 nt, Human
aagaauguggguggauaugaug

SEQ ID NO: 160701 - RNA, 20 nt, Human
gccuggaggcagagauaaag

SEQ ID NO: 160702 - RNA, 22 nt, Human
caagaauuguacaaacugggug

SEQ ID NO: 160703 - RNA, 22 nt, Human
agggacugagcuaggaucuagu

SEQ ID NO: 160704 - RNA, 22 nt, Human
cuggcccagucucagaguguca

SEQ ID NO: 160705 - RNA, 22 nt, Human
agggcuggccacaugauuuggu

SEQ ID NO: 160706 - RNA, 22 nt, Human
gagggagagugauggaccauug

SEQ ID NO: 160707 - RNA, 19 nt, Human
gugaggauacugcucagag

SEQ ID NO: 160708 - RNA, 22 nt, Human
ucucagagaccugaacucccug

SEQ ID NO: 160709 - RNA, 22 nt, Human
ugccaggcccugugcuggaugc

SEQ ID NO: 160710 - RNA, 22 nt, Human
agccccaggcccggacgccucu

SEQ ID NO: 160711 - RNA, 22 nt, Human
ugaaaucuuuaguuucuguccc

SEQ ID NO: 160712 - RNA, 22 nt, Human
agaggcugcacuugcucaugau

SEQ ID NO: 160713 - RNA, 20 nt, Human
uaggcagagcugugcagccu

SEQ ID NO: 160714 - RNA, 22 nt, Human
gggcacugugcuaggugcugag

SEQ ID NO: 160715 - RNA, 22 nt, Human
ucccagagcccaaguuggagag

SEQ ID NO: 160716 - RNA, 22 nt, Human
ucuggcuccguguccgcuccca

SEQ ID NO: 160717 - RNA, 22 nt, Human
agagugauggguugugcugacc

SEQ ID NO: 160718 - RNA, 21 nt, Human
gugcucugggcagcagagggc

SEQ ID NO: 160719 - RNA, 22 nt, Human
aaacucuggagauguuuaugca

SEQ ID NO: 160720 - RNA, 22 nt, Human
gaaggaagucauuagugcagac

SEQ ID NO: 160721 - RNA, 19 nt, Human
uggcagcauugguaccuug

SEQ ID NO: 160722 - RNA, 23 nt, Human
uccagcagccaagaaggguagaa

SEQ ID NO: 160723 - RNA, 22 nt, Human
uacagggguaacaguggggaau

SEQ ID NO: 160724 - RNA, 22 nt, Human
uccugccuugccugggacauca

SEQ ID NO: 160725 - RNA, 22 nt, Human
aucaguuuuuauuaauguagcu

SEQ ID NO: 160726 - RNA, 22 nt, Human
uggcugcuuguuuuagugaggc

SEQ ID NO: 160727 - RNA, 22 nt, Human
ggaggccaaggcaggcggauca

SEQ ID NO: 160728 - RNA, 22 nt, Human
ucucagggugaggaaagaauuu

SEQ ID NO: 160729 - RNA, 22 nt, Human
cuguuuauuacacuggauagca

SEQ ID NO: 160730 - RNA, 22 nt, Human
cacugggcaauucugagccuaa

SEQ ID NO: 160731 - RNA, 22 nt, Human
gcuuccugagaaacaaucugau

SEQ ID NO: 160732 - RNA, 22 nt, Human
cuggagagaaaugacaaagcua

SEQ ID NO: 160733 - RNA, 22 nt, Human
aauuaacaaauguagcugugau

SEQ ID NO: 160734 - RNA, 22 nt, Human
gaggcagcaugguaccuuggag

SEQ ID NO: 160735 - RNA, 22 nt, Human
ccuuucucuggcagcaggacag

SEQ ID NO: 160736 - RNA, 22 nt, Human
acagauugaucuugagaauuau

SEQ ID NO: 160737 - RNA, 22 nt, Human
guggcagcggcccaggccgucu

SEQ ID NO: 160738 - RNA, 22 nt, Human
uggcaggguuggccaccuuacc

SEQ ID NO: 160739 - RNA, 22 nt, Human
ggcugcagggcagcuggugugg

SEQ ID NO: 160740 - RNA, 18 nt, Human
ucagcuggggcugcagcc

SEQ ID NO: 160741 - RNA, 22 nt, Human
ucacauacacuaggauauuuuu

SEQ ID NO: 160742 - RNA, 18 nt, Human
gaaaggagagacaguagg

SEQ ID NO: 160743 - RNA, 22 nt, Human
acaaagucugaaaccugaggca

SEQ ID NO: 160744 - RNA, 22 nt, Human
ccacagggccuuuccugcuggc

SEQ ID NO: 160745 - RNA, 22 nt, Human
gugagcagaacagguggcuucu

SEQ ID NO: 160746 - RNA, 22 nt, Human
gagugguaggcaguguuaggaa

SEQ ID NO: 160747 - RNA, 22 nt, Human
auauaaaguguuuagaaagcug

SEQ ID NO: 160748 - RNA, 22 nt, Human
ucccagacaaucauuggccacc

SEQ ID NO: 160749 - RNA, 22 nt, Human
ugcugcuccugccuggcuccca

SEQ ID NO: 160750 - RNA, 23 nt, Human
ugucccagagggagggauaggcu

SEQ ID NO: 160751 - RNA, 22 nt, Human
cuucaagaagacagcagagcau

SEQ ID NO: 160752 - RNA, 20 nt, Human
accuugaacccgccagccau

SEQ ID NO: 160753 - RNA, 22 nt, Human
acaauucuggguauuuauauag

SEQ ID NO: 160754 - RNA, 22 nt, Human
aguuuuucugcuggucucacua

SEQ ID NO: 160755 - RNA, 22 nt, Human
aagaacaguugggaggugagcc

SEQ ID NO: 160756 - RNA, 20 nt, Human
uggagccacagucagguucc

SEQ ID NO: 160757 - RNA, 22 nt, Human
ucuaggagcaugaagggaaggc

SEQ ID NO: 160758 - RNA, 22 nt, Human
gucaaguuuauccgcucauuca

SEQ ID NO: 160759 - RNA, 22 nt, Human
augauucagcaauuuuauaucu

SEQ ID NO: 160760 - RNA, 22 nt, Human
cacagcugccauggcugcacuu

SEQ ID NO: 160761 - RNA, 22 nt, Human
aggcagagcugauguucuguga

SEQ ID NO: 160762 - RNA, 22 nt, Human
ccucagcugcuucccuggagcc

SEQ ID NO: 160763 - RNA, 18 nt, Human
ccugccagucuggagcag

SEQ ID NO: 160764 - RNA, 22 nt, Human
uguacacaauucuuaacauaca

SEQ ID NO: 160765 - RNA, 23 nt, Human
cuggcuccgaagacuccaggauc

SEQ ID NO: 160766 - RNA, 22 nt, Human
auugucuguacuuuaaaaaugu

SEQ ID NO: 160767 - RNA, 22 nt, Human
caggugggaccaugauagggca

SEQ ID NO: 160768 - RNA, 20 nt, Human
ccugggcuccaggagccccg

SEQ ID NO: 160769 - RNA, 22 nt, Human
uguguccauucaggcacugacc

SEQ ID NO: 160770 - RNA, 22 nt, Human
gccucugcaugcucagcaccca

SEQ ID NO: 160771 - RNA, 20 nt, Human
ccaccuggccaaggcugugc

SEQ ID NO: 160772 - RNA, 22 nt, Human
aggggcuggcuuaucugagagu

SEQ ID NO: 160773 - RNA, 22 nt, Human
guaaaguucuacuagaaucaac

SEQ ID NO: 160774 - RNA, 22 nt, Human
aagguacaaaguauuauuuaaa

SEQ ID NO: 160775 - RNA, 22 nt, Human
cugaaggauuuaguucuuugcu

SEQ ID NO: 160776 - RNA, 22 nt, Human
ucugccuguucaagucuucuag

SEQ ID NO: 160777 - RNA, 22 nt, Human
ggaggccaucagggagggcauu

SEQ ID NO: 160778 - RNA, 22 nt, Human
aggcugggaaauguagucuucc

SEQ ID NO: 160779 - RNA, 22 nt, Human
cauucugugauucuaaaucccu

SEQ ID NO: 160780 - RNA, 22 nt, Human
agaggggcucaagcaguggucu

SEQ ID NO: 160781 - RNA, 22 nt, Human
aagaaauauugggccuuauaaa

SEQ ID NO: 160782 - RNA, 22 nt, Human
cacaugggcguaauguccaugg

SEQ ID NO: 160783 - RNA, 22 nt, Human
uggcugggcccccaccugccuc

SEQ ID NO: 160784 - RNA, 20 nt, Human
gagauggcuaagugcugaac

SEQ ID NO: 160785 - RNA, 22 nt, Human
uaagcauaacuaaaaaugauuu

SEQ ID NO: 160786 - RNA, 22 nt, Human
gcaugugucuccccaguggagg

SEQ ID NO: 160787 - RNA, 22 nt, Human
ugaaggaaugaguauacuguuu

SEQ ID NO: 160788 - RNA, 22 nt, Human
auguaaggcugccuaugacacu

SEQ ID NO: 160789 - RNA, 22 nt, Human
uagcugccuaugugauaagaga

SEQ ID NO: 160790 - RNA, 22 nt, Human
uauguacaucguugaauucaaa

SEQ ID NO: 160791 - RNA, 22 nt, Human
cauugcacuccagcuugggcaa

SEQ ID NO: 160792 - RNA, 22 nt, Human
uucacauuagugguucuauaua

SEQ ID NO: 160793 - RNA, 22 nt, Human
ugugggcucccccucacucugu

SEQ ID NO: 160794 - RNA, 22 nt, Human
aaacuguauauuuauggcaugu

SEQ ID NO: 160795 - RNA, 22 nt, Human
acauuucuaauuuaauguaaca

SEQ ID NO: 160796 - RNA, 22 nt, Human
aaaguuagaaugauaucaacga

SEQ ID NO: 160797 - RNA, 22 nt, Human
agcagcuguggaaaaguaacua

SEQ ID NO: 160798 - RNA, 22 nt, Human
uccuuuuuauaguuagagaaac

SEQ ID NO: 160799 - RNA, 19 nt, Human
ccagguggaacugagguag

SEQ ID NO: 160800 - RNA, 22 nt, Human
uccagucaagcuugagaauuuc

SEQ ID NO: 160801 - RNA, 22 nt, Human
cugucucucuaggacacugggg

SEQ ID NO: 160802 - RNA, 22 nt, Human
uggcacugggacagaugcucuc

SEQ ID NO: 160803 - RNA, 22 nt, Human
ggucccugguucccucugagcu

SEQ ID NO: 160804 - RNA, 22 nt, Human
ccucuggguaucuguggaagua

SEQ ID NO: 160805 - RNA, 20 nt, Human
agagccuugaggaagaugau

SEQ ID NO: 160806 - RNA, 22 nt, Human
gcugccuugaacuuggccuggg

SEQ ID NO: 160807 - RNA, 22 nt, Human
ccugggagagccaucuguggcc

SEQ ID NO: 160808 - RNA, 22 nt, Human
gcugaagggagugcugagucug

SEQ ID NO: 160809 - RNA, 22 nt, Human
ugcaguggaggccgugagacag

SEQ ID NO: 160810 - RNA, 20 nt, Human
ccagagcagccacugaaguu

SEQ ID NO: 160811 - RNA, 18 nt, Human
aggcacuggaauuaaggg

SEQ ID NO: 160812 - RNA, 22 nt, Human
gcuggccacauugugccguccu

SEQ ID NO: 160813 - RNA, 22 nt, Human
uggcucugaucagauguccagu

SEQ ID NO: 160814 - RNA, 22 nt, Human
ucagcaguuuuauaugcagcuu

SEQ ID NO: 160815 - RNA, 20 nt, Human
uggagcuguaaucuugucug

SEQ ID NO: 160816 - RNA, 22 nt, Human
uuagagaaauucugguaaugua

SEQ ID NO: 160817 - RNA, 22 nt, Human
cugccugugugugccugcagaa

SEQ ID NO: 160818 - RNA, 22 nt, Human
auuauguauuugguauaguuug

SEQ ID NO: 160819 - RNA, 22 nt, Human
uuugcauuuuagauuuaggccu

SEQ ID NO: 160820 - RNA, 22 nt, Human
agccaaggacacggagccuccu

SEQ ID NO: 160821 - RNA, 22 nt, Human
cagucacacaaguggacuuggg

SEQ ID NO: 160822 - RNA, 22 nt, Human
gaggcccaggucaagcagccac

SEQ ID NO: 160823 - RNA, 22 nt, Human
gcagggucgcucuaggagauca

SEQ ID NO: 160824 - RNA, 21 nt, Human
ugccagggauuuacagagccu

SEQ ID NO: 160825 - RNA, 22 nt, Human
uccuucagcuuauuucuuagga

SEQ ID NO: 160826 - RNA, 22 nt, Human
gcucuccaaacccuguggcuuu

SEQ ID NO: 160827 - RNA, 22 nt, Human
acuacuuugggccauuuguuua

SEQ ID NO: 160828 - RNA, 22 nt, Human
caggaaaggugugucaugaugg

SEQ ID NO: 160829 - RNA, 23 nt, Human
gccugccugaccugugcaaaguc

SEQ ID NO: 160830 - RNA, 22 nt, Human
guguacauagaauugugcuuug

SEQ ID NO: 160831 - RNA, 22 nt, Human
gccagcucccaagugagccccu

SEQ ID NO: 160832 - RNA, 22 nt, Human
uggaaagaaaguaaaggcguau

SEQ ID NO: 160833 - RNA, 22 nt, Human
agccacagcaacaagugcaauu

SEQ ID NO: 160834 - RNA, 18 nt, Human
ccuggcuuccaucuuggu

SEQ ID NO: 160835 - RNA, 20 nt, Human
gccuggaggcaaugggaaga

SEQ ID NO: 160836 - RNA, 22 nt, Human
acucaagauagggaaaguacaa

SEQ ID NO: 160837 - RNA, 22 nt, Human
gccuggcccagggcuccgcagg

SEQ ID NO: 160838 - RNA, 22 nt, Human
cagccccucccucaggcaggug

SEQ ID NO: 160839 - RNA, 22 nt, Human
ggcugccuggaccuccucuuuc

SEQ ID NO: 160840 - RNA, 22 nt, Human
uggcugaacuaaugugcuguuu

SEQ ID NO: 160841 - RNA, 22 nt, Human
aggcuucccaagcagcugcaaa

SEQ ID NO: 160842 - RNA, 22 nt, Human
uccuugaaaagaaugucuccau

SEQ ID NO: 160843 - RNA, 22 nt, Human
ugggcucugcugcguaccaguu

SEQ ID NO: 160844 - RNA, 23 nt, Human
ucuuuacauacugaugaguucuc

SEQ ID NO: 160845 - RNA, 22 nt, Human
cagaggcugggaccucaggcau

SEQ ID NO: 160846 - RNA, 22 nt, Human
ucagcaggcgguuccuuguggg

SEQ ID NO: 160847 - RNA, 22 nt, Human
gccugcuguuaacugcaggaau

SEQ ID NO: 160848 - RNA, 22 nt, Human
ugggagaagcagcagccaagug

SEQ ID NO: 160849 - RNA, 22 nt, Human
ucaucacuguaucauugauaga

SEQ ID NO: 160850 - RNA, 22 nt, Human
uuucauaugggcauuggcaaua

SEQ ID NO: 160851 - RNA, 22 nt, Human
guggcugguuuccugcaugcaa

SEQ ID NO: 160852 - RNA, 22 nt, Human
ggcuucuguccucuggaucugu

SEQ ID NO: 160853 - RNA, 19 nt, Human
uccuccuuacuuccucuug

SEQ ID NO: 160854 - RNA, 22 nt, Human
aggggcucaguuacuuuggcag

SEQ ID NO: 160855 - RNA, 22 nt, Human
ugcugccaggucuugcugucca

SEQ ID NO: 160856 - RNA, 22 nt, Human
ucucagagauucagggagaagu

SEQ ID NO: 160857 - RNA, 22 nt, Human
gccucugcaucuucgccgcacu

SEQ ID NO: 160858 - RNA, 22 nt, Human
ugcuguuauacuuagcugguua

SEQ ID NO: 160859 - RNA, 18 nt, Human
uggcucuggacuugcucc

SEQ ID NO: 160860 - RNA, 22 nt, Human
caauagcagcuucugaaugcaa

SEQ ID NO: 160861 - RNA, 22 nt, Human
aggccagcucacccuggcuccu

SEQ ID NO: 160862 - RNA, 22 nt, Human
aagcuuccugaaugcucauuua

SEQ ID NO: 160863 - RNA, 22 nt, Human
aggagucaggaccaaauggaaa

SEQ ID NO: 160864 - RNA, 20 nt, Human
agauggugaaggccagggag

SEQ ID NO: 160865 - RNA, 19 nt, Human
agugaaauggaguauucaa

SEQ ID NO: 160866 - RNA, 22 nt, Human
ggagcugaugacgucaccaugg

SEQ ID NO: 160867 - RNA, 22 nt, Human
aucuaagauguauugagcacuu

SEQ ID NO: 160868 - RNA, 22 nt, Human
ggcaaaaaguucccaucagugu

SEQ ID NO: 160869 - RNA, 22 nt, Human
gcucagagauguucaguagcuu

SEQ ID NO: 160870 - RNA, 22 nt, Human
agguggccggugccagccgggc

SEQ ID NO: 160871 - RNA, 22 nt, Human
uuuuaaguuaauauaauugagg

SEQ ID NO: 160872 - RNA, 22 nt, Human
ccuuucagaugggcauggaccg

SEQ ID NO: 160873 - RNA, 22 nt, Human
uuucuuauauucugucauuguu

SEQ ID NO: 160874 - RNA, 22 nt, Human
ccugccugcaaaaugggacaag

SEQ ID NO: 160875 - RNA, 22 nt, Human
guccagggcuaaaucagguucc

SEQ ID NO: 160876 - RNA, 22 nt, Human
ucccagagucuucuccuguaau

SEQ ID NO: 160877 - RNA, 22 nt, Human
ucucagggcagcaaggaagcau

SEQ ID NO: 160878 - RNA, 22 nt, Human
ugggccuggguuccuccugggc

SEQ ID NO: 160879 - RNA, 22 nt, Human
uucuuucacucaagaaggaucu

SEQ ID NO: 160880 - RNA, 23 nt, Human
gccagccuugcucuccugcagcc

SEQ ID NO: 160881 - RNA, 22 nt, Human
uuccugagggacuuuugagauu

SEQ ID NO: 160882 - RNA, 22 nt, Human
uuacaggggacauuggggacau

SEQ ID NO: 160883 - RNA, 22 nt, Human
ggccuguguccuccuugcccug

SEQ ID NO: 160884 - RNA, 22 nt, Human
auggggcugggauucuccucgg

SEQ ID NO: 160885 - RNA, 22 nt, Human
auggccuggggagcaugggaag

SEQ ID NO: 160886 - RNA, 22 nt, Human
agccucugcacgggcacgggug

SEQ ID NO: 160887 - RNA, 22 nt, Human
ugaugcuucacgcugaauaugc

SEQ ID NO: 160888 - RNA, 22 nt, Human
ccagggcagcgccccuccacgc

SEQ ID NO: 160889 - RNA, 22 nt, Human
gcucugagauugagccuuuggu

SEQ ID NO: 160890 - RNA, 22 nt, Human
aggagcugacuuguaaagcauu

SEQ ID NO: 160891 - RNA, 22 nt, Human
ccagagcugcauccagcagguu

SEQ ID NO: 160892 - RNA, 23 nt, Human
ggacagggcccugcccuauggcc

SEQ ID NO: 160893 - RNA, 20 nt, Human
ucucugcuguccacauuugc

SEQ ID NO: 160894 - RNA, 20 nt, Human
cagcaguggaugagaguuuu

SEQ ID NO: 160895 - RNA, 23 nt, Human
cauguacacacagcuguacagug

SEQ ID NO: 160896 - RNA, 22 nt, Human
auaccuuuuagacauguaguug

SEQ ID NO: 160897 - RNA, 22 nt, Human
uuuuuccuagcgauuugucagc

SEQ ID NO: 160898 - RNA, 22 nt, Human
ccaccuccaccuauugccagcc

SEQ ID NO: 160899 - RNA, 20 nt, Human
cugggcugcccagcuauggg

SEQ ID NO: 160900 - RNA, 22 nt, Human
cuguaauucacuagggucagcg

SEQ ID NO: 160901 - RNA, 22 nt, Human
aaccaggacaauuugaauagaa

SEQ ID NO: 160902 - RNA, 22 nt, Human
auacauguaacugcauuguaau

SEQ ID NO: 160903 - RNA, 22 nt, Human
ggagaguggauuccagcuguau

SEQ ID NO: 160904 - RNA, 22 nt, Human
ggcagcagggcugucucccuac

SEQ ID NO: 160905 - RNA, 22 nt, Human
ucccagaguauuagcaauugcu

SEQ ID NO: 160906 - RNA, 22 nt, Human
aaacauugcuaaauaaugcugc

SEQ ID NO: 160907 - RNA, 23 nt, Human
uugucugugcuuuuccaguugcu

SEQ ID NO: 160908 - RNA, 22 nt, Human
ucuggccauggcaagccgagug

SEQ ID NO: 160909 - RNA, 22 nt, Human
ggcuguccuuggccaaggcacu

SEQ ID NO: 160910 - RNA, 20 nt, Human
cugagcgucuaagaggugag

SEQ ID NO: 160911 - RNA, 21 nt, Human
aggagggcacaaggccaggaa

SEQ ID NO: 160912 - RNA, 23 nt, Human
ccaggccucucagagggugugcc

SEQ ID NO: 160913 - RNA, 20 nt, Human
aggcagagcgcacuuuuaga

SEQ ID NO: 160914 - RNA, 22 nt, Human
ugucacauaauuuaucuguagg

SEQ ID NO: 160915 - RNA, 22 nt, Human
uagagcaguuggcagcuguauu

SEQ ID NO: 160916 - RNA, 22 nt, Human
auagacuugguuaguaaauuug

SEQ ID NO: 160917 - RNA, 22 nt, Human
uuagaaaauuugcuucuuugga

SEQ ID NO: 160918 - RNA, 22 nt, Human
uggccuggugcucaggcaguag

SEQ ID NO: 160919 - RNA, 22 nt, Human
uucucuucaucucaguaaaugu

SEQ ID NO: 160920 - RNA, 22 nt, Human
ugcaggccucacaccuggcacc

SEQ ID NO: 160921 - RNA, 22 nt, Human
gagcugccagacaugggaauga

SEQ ID NO: 160922 - RNA, 22 nt, Human
ugcagagggacagccacagcuc

SEQ ID NO: 160923 - RNA, 22 nt, Human
aaggaagacacagaugaaguga

SEQ ID NO: 160924 - RNA, 22 nt, Human
uggccagguugggcuuugcagc

SEQ ID NO: 160925 - RNA, 20 nt, Human
accuuucaaaugauucagca

SEQ ID NO: 160926 - RNA, 22 nt, Human
uuauuuucagcuaggaaagcca

SEQ ID NO: 160927 - RNA, 18 nt, Human
guccugagcucugcugua

SEQ ID NO: 160928 - RNA, 22 nt, Human
ugccuggguguaaagggccaac

SEQ ID NO: 160929 - RNA, 22 nt, Human
cagacagaccugcaagggcaca

SEQ ID NO: 160930 - RNA, 19 nt, Human
gcugugccucucuccugcu

SEQ ID NO: 160931 - RNA, 22 nt, Human
agcaccuggucuccuggcgcug

SEQ ID NO: 160932 - RNA, 22 nt, Human
ucccuggacagccuugccuggg

SEQ ID NO: 160933 - RNA, 22 nt, Human
cugugcuggagaugggccagag

SEQ ID NO: 160934 - RNA, 22 nt, Human
ugcagaagaaaacagcugugug

SEQ ID NO: 160935 - RNA, 22 nt, Human
ggugauuuucgaguuucauguu

SEQ ID NO: 160936 - RNA, 22 nt, Human
agugauggugagugagaagcuc

SEQ ID NO: 160937 - RNA, 22 nt, Human
gggccuccggggugagcugugg

SEQ ID NO: 160938 - RNA, 22 nt, Human
agcccaaggcuucccugcuggc

SEQ ID NO: 160939 - RNA, 23 nt, Human
uuacaguaggaguuggaaaacca

SEQ ID NO: 160940 - RNA, 22 nt, Human
uagcacauaacuuagaauaguu

SEQ ID NO: 160941 - RNA, 22 nt, Human
agagccaggaucuguuuugggg

SEQ ID NO: 160942 - RNA, 22 nt, Human
cagggcugcuggccgugcccuc

SEQ ID NO: 160943 - RNA, 22 nt, Human
uggcucagugacauuccuccca

SEQ ID NO: 160944 - RNA, 22 nt, Human
guauuuucaagagcaguaguau

SEQ ID NO: 160945 - RNA, 22 nt, Human
caggccugagacaucugagaua

SEQ ID NO: 160946 - RNA, 22 nt, Human
uggcucuguuuuaugaguacca

SEQ ID NO: 160947 - RNA, 19 nt, Human
agguggucuaggcuggaga

SEQ ID NO: 160948 - RNA, 22 nt, Human
uuguccuuggaugaagcuggga

SEQ ID NO: 160949 - RNA, 21 nt, Human
ccuucuccacagggucuccgg

SEQ ID NO: 160950 - RNA, 22 nt, Human
ucauugcacuccagccugggca

SEQ ID NO: 160951 - RNA, 22 nt, Human
gcaaagguagccaaggagcuca

SEQ ID NO: 160952 - RNA, 22 nt, Human
ugugccaugaggcucugauaug

SEQ ID NO: 160953 - RNA, 19 nt, Human
ucaggacugacuugaaguc

SEQ ID NO: 160954 - RNA, 22 nt, Human
gcugggagucgcgucuguggcc

SEQ ID NO: 160955 - RNA, 22 nt, Human
caagccugucucaccagugcua

SEQ ID NO: 160956 - RNA, 22 nt, Human
cccuggagcugcuugcauguug

SEQ ID NO: 160957 - RNA, 22 nt, Human
uugaauucauuucucauugagu

SEQ ID NO: 160958 - RNA, 21 nt, Human
ggccuuggcgggggccgaauu

SEQ ID NO: 160959 - RNA, 22 nt, Human
aggcagugcagaguccucuucu

SEQ ID NO: 160960 - RNA, 22 nt, Human
cauggcaggugcagauucugug

SEQ ID NO: 160961 - RNA, 22 nt, Human
ucugccuugagguccucagcuc

SEQ ID NO: 160962 - RNA, 22 nt, Human
ugggcaagucacuucugucuuu

SEQ ID NO: 160963 - RNA, 22 nt, Human
ggcuccugggaugggacugagc

SEQ ID NO: 160964 - RNA, 22 nt, Human
acugaaagauaaaucaguuagc

SEQ ID NO: 160965 - RNA, 22 nt, Human
agggaaaguaagcauuucauua

SEQ ID NO: 160966 - RNA, 22 nt, Human
ggcugccuccugcugggcugga

SEQ ID NO: 160967 - RNA, 22 nt, Human
uagaaacauauaggauggcagg

SEQ ID NO: 160968 - RNA, 22 nt, Human
accucuggccuucaggcaucau

SEQ ID NO: 160969 - RNA, 22 nt, Human
ucaguguagcagacuuguagcc

SEQ ID NO: 160970 - RNA, 22 nt, Human
cauuuagagucuugcaauuuua

SEQ ID NO: 160971 - RNA, 22 nt, Human
uggcucagcugacucggcuucu

SEQ ID NO: 160972 - RNA, 22 nt, Human
uuuagaguugaguauucauugg

SEQ ID NO: 160973 - RNA, 22 nt, Human
ucugagaguacgggcugcgcgc

SEQ ID NO: 160974 - RNA, 22 nt, Human
uacaaaguauauuucuagcugu

SEQ ID NO: 160975 - RNA, 22 nt, Human
aaagaauuuguacacccuacua

SEQ ID NO: 160976 - RNA, 17 nt, Human
aagacagaagccaugag

SEQ ID NO: 160977 - RNA, 22 nt, Human
ucugucuccucugaggugccag

SEQ ID NO: 160978 - RNA, 18 nt, Human
ccucaggggaccuggcag

SEQ ID NO: 160979 - RNA, 22 nt, Human
gaggcagaaguugcagugagca

SEQ ID NO: 160980 - RNA, 22 nt, Human
cuggcagcguguuuaugaacau

SEQ ID NO: 160981 - RNA, 22 nt, Human
aagcccagaugugagaacugag

SEQ ID NO: 160982 - RNA, 22 nt, Human
gcugucuguucgagcguguguu

SEQ ID NO: 160983 - RNA, 22 nt, Human
agagaacacgugcaucugcaau

SEQ ID NO: 160984 - RNA, 22 nt, Human
auaguacacauccuacaauguu

SEQ ID NO: 160985 - RNA, 22 nt, Human
cucccuggaggugagcuggcac

SEQ ID NO: 160986 - RNA, 22 nt, Human
ugauuuccuggcuuuggaguuc

SEQ ID NO: 160987 - RNA, 22 nt, Human
agucaguguagaaagcccaggc

SEQ ID NO: 160988 - RNA, 22 nt, Human
cugcagccuccugggguacaug

SEQ ID NO: 160989 - RNA, 22 nt, Human
ugcauuguugaccaguugugca

SEQ ID NO: 160990 - RNA, 22 nt, Human
agauuuagugguggaauuuugg

SEQ ID NO: 160991 - RNA, 22 nt, Human
acuuugcaauacuuaauacaaa

SEQ ID NO: 160992 - RNA, 22 nt, Human
acugugcuuucucuggaggcau

SEQ ID NO: 160993 - RNA, 22 nt, Human
agacaacaccaaaugcuagugu

SEQ ID NO: 160994 - RNA, 22 nt, Human
ugucccaggccucauguugcca

SEQ ID NO: 160995 - RNA, 22 nt, Human
ucccacugcuuugcucugcuca

SEQ ID NO: 160996 - RNA, 22 nt, Human
cucacugcccugaaguuggguu

SEQ ID NO: 160997 - RNA, 22 nt, Human
guccucugcuucaugcccugau

SEQ ID NO: 160998 - RNA, 22 nt, Human
ggacuggacucucaggcucaca

SEQ ID NO: 160999 - RNA, 22 nt, Human
cuggcugcaggaugaggcugcc

SEQ ID NO: 161000 - RNA, 20 nt, Human
ccugucuccucuuaccuggc

SEQ ID NO: 161001 - RNA, 22 nt, Human
aguuuuaugcaguguucugaua

SEQ ID NO: 161002 - RNA, 22 nt, Human
agaagaaacugucggggauauu

SEQ ID NO: 161003 - RNA, 22 nt, Human
ccucagagguuuucauucugua

SEQ ID NO: 161004 - RNA, 22 nt, Human
ccagggcaauuauuuggagggu

SEQ ID NO: 161005 - RNA, 22 nt, Human
uuaugcuaaaugaaucaaguca

SEQ ID NO: 161006 - RNA, 23 nt, Human
ucugagagaacaaugccuccuau

SEQ ID NO: 161007 - RNA, 22 nt, Human
aucuggcuuuuacugaauugcu

SEQ ID NO: 161008 - RNA, 22 nt, Human
agccagagcugaugucauucuc

SEQ ID NO: 161009 - RNA, 22 nt, Human
cuccccagguucaggagguggg

SEQ ID NO: 161010 - RNA, 22 nt, Human
ggucaggguuccagguaucuuc

SEQ ID NO: 161011 - RNA, 22 nt, Human
aguuuauguaaaauuaguaaug

SEQ ID NO: 161012 - RNA, 20 nt, Human
acaauagauuugagcaaagu

SEQ ID NO: 161013 - RNA, 22 nt, Human
auugucgcuuauuuaggugcuu

SEQ ID NO: 161014 - RNA, 22 nt, Human
ccucuggggguccucagagucu

SEQ ID NO: 161015 - RNA, 22 nt, Human
auguccuuccauuuugaucugu

SEQ ID NO: 161016 - RNA, 22 nt, Human
acagccaggaauucuggagaag

SEQ ID NO: 161017 - RNA, 22 nt, Human
uccugagagcagaguccaggug

SEQ ID NO: 161018 - RNA, 22 nt, Human
caugcuuuaccaaagcagugau

SEQ ID NO: 161019 - RNA, 22 nt, Human
gccuggaggaauguagcugagg

SEQ ID NO: 161020 - RNA, 18 nt, Human
agcagagcccaugcauuc

SEQ ID NO: 161021 - RNA, 22 nt, Human
guggccagaagacugcaaugcu

SEQ ID NO: 161022 - RNA, 22 nt, Human
cugcucuggcuguguacuucag

SEQ ID NO: 161023 - RNA, 22 nt, Human
uagaaauccccagucucauagu

SEQ ID NO: 161024 - RNA, 22 nt, Human
auguguaaaaagugcuuaauau

SEQ ID NO: 161025 - RNA, 22 nt, Human
cugccuugaggagguuguggga

SEQ ID NO: 161026 - RNA, 22 nt, Human
ccaggcaggcgauggugcagug

SEQ ID NO: 161027 - RNA, 22 nt, Human
augauggugagguugagcacag

SEQ ID NO: 161028 - RNA, 22 nt, Human
ccugggaggcuguuuccagccu

SEQ ID NO: 161029 - RNA, 22 nt, Human
cuggacagaaagggcugcugug

SEQ ID NO: 161030 - RNA, 22 nt, Human
gaaguucaggugggaauugagc

SEQ ID NO: 161031 - RNA, 22 nt, Human
cugucugucaaguucaucucca

SEQ ID NO: 161032 - RNA, 22 nt, Human
ucuccuggucaccucagaaguc

SEQ ID NO: 161033 - RNA, 22 nt, Human
auccuugagccaaugacugauu

SEQ ID NO: 161034 - RNA, 22 nt, Human
agcaggcuccuuccuucucugg

SEQ ID NO: 161035 - RNA, 22 nt, Human
cuggcugccacuucagggucuu

SEQ ID NO: 161036 - RNA, 20 nt, Human
ugaagcagccuugauucugu

SEQ ID NO: 161037 - RNA, 22 nt, Human
uguccugggaaugggaugcagu

SEQ ID NO: 161038 - RNA, 19 nt, Human
gagcacagcggcauuuggu

SEQ ID NO: 161039 - RNA, 22 nt, Human
agaaauguacgauguuaugcag

SEQ ID NO: 161040 - RNA, 22 nt, Human
auuuugaaaagcauuugaguaa

SEQ ID NO: 161041 - RNA, 22 nt, Human
gggccuguguguucaggagccu

SEQ ID NO: 161042 - RNA, 22 nt, Human
cacagggccuggggcagcugcu

SEQ ID NO: 161043 - RNA, 22 nt, Human
gccagcccagcuccaggggaaa

SEQ ID NO: 161044 - RNA, 22 nt, Human
gggggcuggacuuucccacaca

SEQ ID NO: 161045 - RNA, 22 nt, Human
gagguggguguaucacagguca

SEQ ID NO: 161046 - RNA, 22 nt, Human
ggagaccagaaggaagcuucga

SEQ ID NO: 161047 - RNA, 22 nt, Human
cacagaggacuguagcggggag

SEQ ID NO: 161048 - RNA, 22 nt, Human
ugccuggcaagaggggcuggcu

SEQ ID NO: 161049 - RNA, 22 nt, Human
aucuuucaguuucauaccaauu

SEQ ID NO: 161050 - RNA, 22 nt, Human
gaagagcugacagugucauccu

SEQ ID NO: 161051 - RNA, 21 nt, Human
agcugcuccagggagcucagg

SEQ ID NO: 161052 - RNA, 20 nt, Human
agagccuggaaaaagacauc

SEQ ID NO: 161053 - RNA, 22 nt, Human
agccucugguccucccucagcu

SEQ ID NO: 161054 - RNA, 22 nt, Human
agcugcccuggcggagcugcuc

SEQ ID NO: 161055 - RNA, 22 nt, Human
acaggggcuccgaaggugaggg

SEQ ID NO: 161056 - RNA, 22 nt, Human
cugcugcucagugucaucaugu

SEQ ID NO: 161057 - RNA, 22 nt, Human
ccagggcauguaacuaauggug

SEQ ID NO: 161058 - RNA, 22 nt, Human
cuuaacagcaagaucuguguca

SEQ ID NO: 161059 - RNA, 22 nt, Human
guggauggauuuugaggaaugg

SEQ ID NO: 161060 - RNA, 22 nt, Human
uaauuuacuugcaaauaacaau

SEQ ID NO: 161061 - RNA, 22 nt, Human
acccuggggguggccagugcca

SEQ ID NO: 161062 - RNA, 20 nt, Human
gugcuucagaagccauugcu

SEQ ID NO: 161063 - RNA, 22 nt, Human
gguagcacauugcauuaggaga

SEQ ID NO: 161064 - RNA, 16 nt, Human
ccaccugcagcucuca

SEQ ID NO: 161065 - RNA, 22 nt, Human
cagcugccuguauuguccucau

SEQ ID NO: 161066 - RNA, 22 nt, Human
gccugucucuuggaacuuggua

SEQ ID NO: 161067 - RNA, 22 nt, Human
ccagguggugaaagugggcccu

SEQ ID NO: 161068 - RNA, 22 nt, Human
gccucugcucggacuuugccuc

SEQ ID NO: 161069 - RNA, 21 nt, Human
ucagaacaauuccaugccucc

SEQ ID NO: 161070 - RNA, 22 nt, Human
uuuuucaugagacuagaaguca

SEQ ID NO: 161071 - RNA, 22 nt, Human
cagggcugagaauuuagagaca

SEQ ID NO: 161072 - RNA, 22 nt, Human
gcugggagugggcaagaugaga

SEQ ID NO: 161073 - RNA, 22 nt, Human
cagaaauggaauuuuccaucac

SEQ ID NO: 161074 - RNA, 22 nt, Human
gccuaggagacaagcgugaaag

SEQ ID NO: 161075 - RNA, 22 nt, Human
gugucaugggguuuguuauaca

SEQ ID NO: 161076 - RNA, 22 nt, Human
gacagcauggugucuguucagg

SEQ ID NO: 161077 - RNA, 23 nt, Human
gggaccagcuagggcugugaccu

SEQ ID NO: 161078 - RNA, 23 nt, Human
cauuucugggagauuuauaaaau

SEQ ID NO: 161079 - RNA, 21 nt, Human
ucauuuuuauugcuaccuugc

SEQ ID NO: 161080 - RNA, 21 nt, Human
cacaggugggucagugaggcc

SEQ ID NO: 161081 - RNA, 22 nt, Human
gagggugguggcuuaaggugcu

SEQ ID NO: 161082 - RNA, 22 nt, Human
acaggggaauuuacugucauua

SEQ ID NO: 161083 - RNA, 22 nt, Human
uauuuauaaucugccaaagaga

SEQ ID NO: 161084 - RNA, 22 nt, Human
uggccacagccucugccaguuc

SEQ ID NO: 161085 - RNA, 22 nt, Human
ugaggaggucagagucuggcug

SEQ ID NO: 161086 - RNA, 22 nt, Human
ggucauugaaaucagaaggguu

SEQ ID NO: 161087 - RNA, 22 nt, Human
ccaguugguuucaaugggacag

SEQ ID NO: 161088 - RNA, 22 nt, Human
ccuggcucuguccucgcgcaaa

SEQ ID NO: 161089 - RNA, 18 nt, Human
ucagagguacagaaaagu

SEQ ID NO: 161090 - RNA, 22 nt, Human
ucugagaggauuccugucccga

SEQ ID NO: 161091 - RNA, 22 nt, Human
ucucccacgguacaggauaaac

SEQ ID NO: 161092 - RNA, 22 nt, Human
ggagccugugggaugagaugug

SEQ ID NO: 161093 - RNA, 22 nt, Human
agggugcagaaggagccuagga

SEQ ID NO: 161094 - RNA, 22 nt, Human
augcagguugggcaaguguggg

SEQ ID NO: 161095 - RNA, 23 nt, Human
cccagcuuucccacugccgagag

SEQ ID NO: 161096 - RNA, 20 nt, Human
cacaggccuugugagcagac

SEQ ID NO: 161097 - RNA, 22 nt, Human
ccuaagaauuaaugaauacacc

SEQ ID NO: 161098 - RNA, 22 nt, Human
cguuggagacacuugaggacuu

SEQ ID NO: 161099 - RNA, 22 nt, Human
cagcccuggaacagcugacuca

SEQ ID NO: 161100 - RNA, 21 nt, Human
aacaaagggaugcucaucuuu

SEQ ID NO: 161101 - RNA, 22 nt, Human
uccccagccgugaaggagagga

SEQ ID NO: 161102 - RNA, 17 nt, Human
uucaaugauuaaugcau

SEQ ID NO: 161103 - RNA, 22 nt, Human
uguauuuucugaagauaaucaa

SEQ ID NO: 161104 - RNA, 22 nt, Human
uuugcauuccugccugcauuca

SEQ ID NO: 161105 - RNA, 22 nt, Human
guggccugccagcagauggcgc

SEQ ID NO: 161106 - RNA, 22 nt, Human
cagagagagucaaaucuuugcu

SEQ ID NO: 161107 - RNA, 22 nt, Human
ugcaauaaguuguguuaucacu

SEQ ID NO: 161108 - RNA, 22 nt, Human
agaauuguugggguaauaaaag

SEQ ID NO: 161109 - RNA, 19 nt, Human
cuguccuuggcugcacugu

SEQ ID NO: 161110 - RNA, 22 nt, Human
aaaagggacuacucucagcucc

SEQ ID NO: 161111 - RNA, 23 nt, Human
aggcccugccugucccucuuuuu

SEQ ID NO: 161112 - RNA, 22 nt, Human
ccagggcaauaggaacacuuuu

SEQ ID NO: 161113 - RNA, 22 nt, Human
cacacaugucucuccaugcucu

SEQ ID NO: 161114 - RNA, 18 nt, Human
ucugagggugcgggagcu

SEQ ID NO: 161115 - RNA, 22 nt, Human
augguuuguaacccaauacucc

SEQ ID NO: 161116 - RNA, 22 nt, Human
gggggcuggaauauccaucaac

SEQ ID NO: 161117 - RNA, 22 nt, Human
uuuauguaaguggaaugaugcc

SEQ ID NO: 161118 - RNA, 22 nt, Human
cagggcccauggcucagguagg

SEQ ID NO: 161119 - RNA, 22 nt, Human
aggcugggaaauguauuccagc

SEQ ID NO: 161120 - RNA, 22 nt, Human
cugggccugggaggccaggucu

SEQ ID NO: 161121 - RNA, 22 nt, Human
auggauaagucaaagaguaucc

SEQ ID NO: 161122 - RNA, 22 nt, Human
cugggaugucuauagaacacuu

SEQ ID NO: 161123 - RNA, 22 nt, Human
ggcugccauaacagaguaccac

SEQ ID NO: 161124 - RNA, 22 nt, Human
uggcucuguucgccaucaggag

SEQ ID NO: 161125 - RNA, 22 nt, Human
ucaaaugcugccuuugugugcc

SEQ ID NO: 161126 - RNA, 22 nt, Human
gcaagcaguuguggcuucugag

SEQ ID NO: 161127 - RNA, 22 nt, Human
aaggcacuugcccagagcugca

SEQ ID NO: 161128 - RNA, 22 nt, Human
ccugccuguaagauggguacaa

SEQ ID NO: 161129 - RNA, 22 nt, Human
acagacagauuuugucugaugu

SEQ ID NO: 161130 - RNA, 22 nt, Human
ucuugggauugcccugcaguuc

SEQ ID NO: 161131 - RNA, 23 nt, Human
cagaagcaccuguugacugcugc

SEQ ID NO: 161132 - RNA, 22 nt, Human
uuccaguuaaggaagcuauucu

SEQ ID NO: 161133 - RNA, 22 nt, Human
ggcugccugccuccaagccggg

SEQ ID NO: 161134 - RNA, 22 nt, Human
caauauucaguggaaaagccau

SEQ ID NO: 161135 - RNA, 22 nt, Human
cagcuggcagcccuggcccugc

SEQ ID NO: 161136 - RNA, 22 nt, Human
uuucaauguaacauuuccaggc

SEQ ID NO: 161137 - RNA, 22 nt, Human
uuugcauuugcaaauaaugaaa

SEQ ID NO: 161138 - RNA, 20 nt, Human
uaacagaaguagaagugggu

SEQ ID NO: 161139 - RNA, 22 nt, Human
uccucaggauguggaguagaau

SEQ ID NO: 161140 - RNA, 22 nt, Human
uccagcagguccgagacaaguu

SEQ ID NO: 161141 - RNA, 22 nt, Human
ggggccuguagagcuucaggga

SEQ ID NO: 161142 - RNA, 22 nt, Human
caaauguguagagcuuuugggg

SEQ ID NO: 161143 - RNA, 22 nt, Human
ucucuucuagcuucuugugguu

SEQ ID NO: 161144 - RNA, 22 nt, Human
ccagaggugcugggagaggucu

SEQ ID NO: 161145 - RNA, 20 nt, Human
acugccuugguucaguaggu

SEQ ID NO: 161146 - RNA, 22 nt, Human
agagauucauguuuacuguagg

SEQ ID NO: 161147 - RNA, 22 nt, Human
uauacagaaccgccugaagucu

SEQ ID NO: 161148 - RNA, 22 nt, Human
gccucugcacuguggcacacca

SEQ ID NO: 161149 - RNA, 22 nt, Human
uagucaaaccucagaauacccc

SEQ ID NO: 161150 - RNA, 19 nt, Human
ccagcagcuuugauucucu

SEQ ID NO: 161151 - RNA, 22 nt, Human
gaagagcugugauucaggcuua

SEQ ID NO: 161152 - RNA, 22 nt, Human
uccagcucuaacaugcugggcc

SEQ ID NO: 161153 - RNA, 22 nt, Human
gccaccagguuagauccagccu

SEQ ID NO: 161154 - RNA, 22 nt, Human
cagcuggcauaccugggcccgg

SEQ ID NO: 161155 - RNA, 22 nt, Human
agagccaggacugugucucacu

SEQ ID NO: 161156 - RNA, 21 nt, Human
ugauccuuucccccauguugc

SEQ ID NO: 161157 - RNA, 22 nt, Human
gcucccagaaccaaggcugggg

SEQ ID NO: 161158 - RNA, 22 nt, Human
uucaagaucuggguuuucagcu

SEQ ID NO: 161159 - RNA, 22 nt, Human
cuggggccacaacggcgcacgc

SEQ ID NO: 161160 - RNA, 17 nt, Human
uuagcaaaauagcacuu

SEQ ID NO: 161161 - RNA, 22 nt, Human
aggagccccucuucaguccugg

SEQ ID NO: 161162 - RNA, 22 nt, Human
acugaaggaagcgggcaggggu

SEQ ID NO: 161163 - RNA, 23 nt, Human
uuacuuuugcaccaaccuaauau

SEQ ID NO: 161164 - RNA, 22 nt, Human
ucccagaggcuccagucucuau

SEQ ID NO: 161165 - RNA, 22 nt, Human
uaaaauguguuucuguaugguu

SEQ ID NO: 161166 - RNA, 21 nt, Human
gggcuggacaugguggcucau

SEQ ID NO: 161167 - RNA, 22 nt, Human
cugguccuugacgcgugggagg

SEQ ID NO: 161168 - RNA, 22 nt, Human
ugcugccaaaugcgagcucugu

SEQ ID NO: 161169 - RNA, 22 nt, Human
uucuaacucuguuauguguuuc

SEQ ID NO: 161170 - RNA, 22 nt, Human
guguuccauguuugagguaguu

SEQ ID NO: 161171 - RNA, 22 nt, Human
ucacuuagauggggaucaucac

SEQ ID NO: 161172 - RNA, 22 nt, Human
gccugagagucugcauuucuaa

SEQ ID NO: 161173 - RNA, 22 nt, Human
uccugagauucugcauuucuaa

SEQ ID NO: 161174 - RNA, 22 nt, Human
guggcugcagagccagcaagcu

SEQ ID NO: 161175 - RNA, 22 nt, Human
accaaggaguuugguauuuuag

SEQ ID NO: 161176 - RNA, 22 nt, Human
gccagcuggagacuggcagggg

SEQ ID NO: 161177 - RNA, 22 nt, Human
guuuuuccugcugacuuggguc

SEQ ID NO: 161178 - RNA, 22 nt, Human
acucugggccccagguggagcu

SEQ ID NO: 161179 - RNA, 22 nt, Human
uccucagggcggccuccgucuu

SEQ ID NO: 161180 - RNA, 22 nt, Human
gccccagcucugccacaacuag

SEQ ID NO: 161181 - RNA, 22 nt, Human
aggaugggccugggauaugcuu

SEQ ID NO: 161182 - RNA, 22 nt, Human
ggguuggggcccagcagucugc

SEQ ID NO: 161183 - RNA, 22 nt, Human
uuugaacaugcugcaugauaau

SEQ ID NO: 161184 - RNA, 22 nt, Human
acuucauuguaauauuauagca

SEQ ID NO: 161185 - RNA, 22 nt, Human
cuggcagcaguuaugaaacaau

SEQ ID NO: 161186 - RNA, 22 nt, Human
gguggguuuggaagagcaggcu

SEQ ID NO: 161187 - RNA, 22 nt, Human
gcagcuuggugaaaggugaugg

SEQ ID NO: 161188 - RNA, 22 nt, Human
agggagcugcucugcuuccgug

SEQ ID NO: 161189 - RNA, 22 nt, Human
agaaaagguugaaaguaggauu

SEQ ID NO: 161190 - RNA, 22 nt, Human
uggcagaaguacacaagcaugc

SEQ ID NO: 161191 - RNA, 22 nt, Human
uccagccaagccuugguagcug

SEQ ID NO: 161192 - RNA, 22 nt, Human
guaucuuucccaccaaucacaa

SEQ ID NO: 161193 - RNA, 22 nt, Human
caugggaggucugcaaggugcu

SEQ ID NO: 161194 - RNA, 22 nt, Human
agccuguccagaggacagggcu

SEQ ID NO: 161195 - RNA, 22 nt, Human
cgcugggggaacagcgagggug

SEQ ID NO: 161196 - RNA, 22 nt, Human
gcucugggugaacuuggagcaa

SEQ ID NO: 161197 - RNA, 22 nt, Human
cccaggaguuugaguucagcau

SEQ ID NO: 161198 - RNA, 22 nt, Human
accaguccgcggagcuccgggg

SEQ ID NO: 161199 - RNA, 22 nt, Human
cuggaaggucuguccccacugc

SEQ ID NO: 161200 - RNA, 22 nt, Human
ccagcuggagcucgcagauagg

SEQ ID NO: 161201 - RNA, 17 nt, Human
ugaaggaaggaugaugu

SEQ ID NO: 161202 - RNA, 22 nt, Human
acucccagguugccuggcaggc

SEQ ID NO: 161203 - RNA, 22 nt, Human
gaagccaagugcaaaugccuua

SEQ ID NO: 161204 - RNA, 22 nt, Human
uuuggaaaguugucacuuuaga

SEQ ID NO: 161205 - RNA, 22 nt, Human
gccuggagcuacuggacacuga

SEQ ID NO: 161206 - RNA, 22 nt, Human
ugcuggggauccguaccaaccc

SEQ ID NO: 161207 - RNA, 22 nt, Human
uaacacacugaaggugagaugg

SEQ ID NO: 161208 - RNA, 22 nt, Human
uccagagccuauauguucaacu

SEQ ID NO: 161209 - RNA, 22 nt, Human
gccugguggugugcucaagugg

SEQ ID NO: 161210 - RNA, 22 nt, Human
gcucccagggcagcgcagaaga

SEQ ID NO: 161211 - RNA, 22 nt, Human
aggauccugcgcuuugggggag

SEQ ID NO: 161212 - RNA, 22 nt, Human
agggagaacaguugcagcagac

SEQ ID NO: 161213 - RNA, 22 nt, Human
gauggcagucaaccaggugagg

SEQ ID NO: 161214 - RNA, 23 nt, Human
ugcagcugccucuggcgggccgg

SEQ ID NO: 161215 - RNA, 22 nt, Human
uggcugucagcugccuggugcg

SEQ ID NO: 161216 - RNA, 23 nt, Human
aggugcagcccuggaccugcccc

SEQ ID NO: 161217 - RNA, 22 nt, Human
uccuucaaagcuccuagugagc

SEQ ID NO: 161218 - RNA, 22 nt, Human
cucagcagagaccagggaggaa

SEQ ID NO: 161219 - RNA, 22 nt, Human
agggcuggaggguacuaguuua

SEQ ID NO: 161220 - RNA, 22 nt, Human
agccaggacguugcucagcucc

SEQ ID NO: 161221 - RNA, 22 nt, Human
acuggcagccacaacuggcagg

SEQ ID NO: 161222 - RNA, 23 nt, Human
ucugucacuuucugcuguggagu

SEQ ID NO: 161223 - RNA, 22 nt, Human
cugcugcucgaccagucccagg

SEQ ID NO: 161224 - RNA, 22 nt, Human
uuuuuccuaagcaguggagcug

SEQ ID NO: 161225 - RNA, 22 nt, Human
gcuugggauaugcugauguaaa

SEQ ID NO: 161226 - RNA, 22 nt, Human
ggcugccaggagaagcucagug

SEQ ID NO: 161227 - RNA, 21 nt, Human
auacuuugaauuacagccuug

SEQ ID NO: 161228 - RNA, 22 nt, Human
ggugaagggccuuaggagacag

SEQ ID NO: 161229 - RNA, 22 nt, Human
cugccucuggccucaggcccag

SEQ ID NO: 161230 - RNA, 22 nt, Human
agccuucacugggaccuuggau

SEQ ID NO: 161231 - RNA, 22 nt, Human
gggccucugugcagaggggccu

SEQ ID NO: 161232 - RNA, 22 nt, Human
gcucugaggcugugaggugcug

SEQ ID NO: 161233 - RNA, 22 nt, Human
uuuccucugacugcuccccugc

SEQ ID NO: 161234 - RNA, 20 nt, Human
ccagagcugauggcugcccg

SEQ ID NO: 161235 - RNA, 21 nt, Human
agaggccuuacaggauagacc

SEQ ID NO: 161236 - RNA, 22 nt, Human
ccuggcuguggcggugcucuca

SEQ ID NO: 161237 - RNA, 22 nt, Human
ccacucugauuuuggcuccacu

SEQ ID NO: 161238 - RNA, 22 nt, Human
aaauguguguauguacauauau

SEQ ID NO: 161239 - RNA, 22 nt, Human
augcugcacaagccacauguag

SEQ ID NO: 161240 - RNA, 21 nt, Human
gccaccucgucucggagcagc

SEQ ID NO: 161241 - RNA, 22 nt, Human
uggcucugucacugugagcuau

SEQ ID NO: 161242 - RNA, 22 nt, Human
cuuguggcccauggcuuccugc

SEQ ID NO: 161243 - RNA, 22 nt, Human
cccagcaucuccaggcauggcc

SEQ ID NO: 161244 - RNA, 22 nt, Human
cacauguacagaagcaggcugg

SEQ ID NO: 161245 - RNA, 22 nt, Human
augcaguaaauguucuaguuug

SEQ ID NO: 161246 - RNA, 22 nt, Human
caggaacaauguaagucucauu

SEQ ID NO: 161247 - RNA, 22 nt, Human
ucuccuuugaaaguuaggacug

SEQ ID NO: 161248 - RNA, 20 nt, Human
cugccaugauugauagagug

SEQ ID NO: 161249 - RNA, 22 nt, Human
cagacacagauaugcauauggc

SEQ ID NO: 161250 - RNA, 22 nt, Human
ucaugccacuuacaaaauaaug

SEQ ID NO: 161251 - RNA, 18 nt, Human
ucacagugcucuugccua

SEQ ID NO: 161252 - RNA, 22 nt, Human
ccuucucuacuccugaugcaug

SEQ ID NO: 161253 - RNA, 22 nt, Human
ggcacagggaggcccuggugug

SEQ ID NO: 161254 - RNA, 17 nt, Human
uuccuggaagucauucc

SEQ ID NO: 161255 - RNA, 22 nt, Human
uucuuuccaaccagauauuggu

SEQ ID NO: 161256 - RNA, 22 nt, Human
aggccuggcuuugguuugcuga

SEQ ID NO: 161257 - RNA, 22 nt, Human
ucuggccaacaaaaacuaaguc

SEQ ID NO: 161258 - RNA, 22 nt, Human
cuggccugagaaugcuacccuu

SEQ ID NO: 161259 - RNA, 22 nt, Human
aaaguucagauuagacucaaga

SEQ ID NO: 161260 - RNA, 22 nt, Human
gcugucugucucugugacuuaa

SEQ ID NO: 161261 - RNA, 22 nt, Human
gucccuuggcucacaaacagcu

SEQ ID NO: 161262 - RNA, 22 nt, Human
ccauuugucaccucugcacucc

SEQ ID NO: 161263 - RNA, 22 nt, Human
ggucccagaauugguuagcaca

SEQ ID NO: 161264 - RNA, 22 nt, Human
uguucuuucaguuagacacagu

SEQ ID NO: 161265 - RNA, 22 nt, Human
cagagccaaaugcugugguuau

SEQ ID NO: 161266 - RNA, 21 nt, Human
gugucaugguugacuuuggca

SEQ ID NO: 161267 - RNA, 22 nt, Human
uguacaguauauuucaaagcca

SEQ ID NO: 161268 - RNA, 22 nt, Human
uucuuccucagcagggcugccu

SEQ ID NO: 161269 - RNA, 19 nt, Human
cagaacagaggucauggcc

SEQ ID NO: 161270 - RNA, 22 nt, Human
gcuggguggaucggaggcucug

SEQ ID NO: 161271 - RNA, 22 nt, Human
uauuucugauugcucaugaggc

SEQ ID NO: 161272 - RNA, 22 nt, Human
uuucaaagguggaagagugaau

SEQ ID NO: 161273 - RNA, 22 nt, Human
auuuuucucuuuccacugagau

SEQ ID NO: 161274 - RNA, 22 nt, Human
caccagggcucugagcucugaa

SEQ ID NO: 161275 - RNA, 21 nt, Human
accucaagcaacaaccaaggu

SEQ ID NO: 161276 - RNA, 22 nt, Human
agagcuggacgucugagcccua

SEQ ID NO: 161277 - RNA, 22 nt, Human
augugacaauauuuggucuuau

SEQ ID NO: 161278 - RNA, 22 nt, Human
ggcugcugaguuggccaggaga

SEQ ID NO: 161279 - RNA, 22 nt, Human
gcuggccuugugucugaggaag

SEQ ID NO: 161280 - RNA, 17 nt, Human
uccuucagugccucugc

SEQ ID NO: 161281 - RNA, 22 nt, Human
gccugugcauagcagcggacuc

SEQ ID NO: 161282 - RNA, 22 nt, Human
cagccccucacagagcuguccu

SEQ ID NO: 161283 - RNA, 22 nt, Human
uucaagauccagcacaacagug

SEQ ID NO: 161284 - RNA, 22 nt, Human
cugggcagcuaccaccacugcu

SEQ ID NO: 161285 - RNA, 22 nt, Human
acuggcucagaguuccuagaga

SEQ ID NO: 161286 - RNA, 22 nt, Human
gggccuggcaugcagccccguu

SEQ ID NO: 161287 - RNA, 22 nt, Human
uggaaggagcuaaggaccuggg

SEQ ID NO: 161288 - RNA, 22 nt, Human
cugagccaaggggacagugaca

SEQ ID NO: 161289 - RNA, 22 nt, Human
augcccgauaccuaguuaacuc

SEQ ID NO: 161290 - RNA, 22 nt, Human
cuuggcagcuuuuggaggagcc

SEQ ID NO: 161291 - RNA, 22 nt, Human
uggacaggugagugacucaggg

SEQ ID NO: 161292 - RNA, 22 nt, Human
ggccucugccucaucugggcac

SEQ ID NO: 161293 - RNA, 22 nt, Human
aguacauuuauuaaugguaaaa

SEQ ID NO: 161294 - RNA, 22 nt, Human
guucuccauucagcuuccugug

SEQ ID NO: 161295 - RNA, 22 nt, Human
ugcagccuugccuccucccagc

SEQ ID NO: 161296 - RNA, 22 nt, Human
ugguaucagagccaucuguauu

SEQ ID NO: 161297 - RNA, 22 nt, Human
ugaaagaacuagcaucuucaag

SEQ ID NO: 161298 - RNA, 22 nt, Human
uaauuuaauccaaguguuacau

SEQ ID NO: 161299 - RNA, 22 nt, Human
cagugucuccagaugcuccaau

SEQ ID NO: 161300 - RNA, 22 nt, Human
uggagcagagaugggagcccaa

SEQ ID NO: 161301 - RNA, 22 nt, Human
ggagcugcacgcucugaagccu

SEQ ID NO: 161302 - RNA, 22 nt, Human
gagcagcugcagugcagacccu

SEQ ID NO: 161303 - RNA, 22 nt, Human
cagggacagccuugggguggcg

SEQ ID NO: 161304 - RNA, 22 nt, Human
gccuggagugguccugcugccc

SEQ ID NO: 161305 - RNA, 21 nt, Human
augacagaugcugcagaucgu

SEQ ID NO: 161306 - RNA, 22 nt, Human
cugccugggccggccacccucu

SEQ ID NO: 161307 - RNA, 22 nt, Human
ucaggaguccugccugcagccu

SEQ ID NO: 161308 - RNA, 22 nt, Human
gaagcccacguuuggugaugua

SEQ ID NO: 161309 - RNA, 22 nt, Human
ucagaggacaagcucccuggug

SEQ ID NO: 161310 - RNA, 22 nt, Human
ucucagaggcccgacguucucc

SEQ ID NO: 161311 - RNA, 22 nt, Human
acugccuuauaugcugugugug

SEQ ID NO: 161312 - RNA, 21 nt, Human
uggaaagauucaaagaccagg

SEQ ID NO: 161313 - RNA, 22 nt, Human
cuggagccugcaguuuucacuu

SEQ ID NO: 161314 - RNA, 22 nt, Human
cagcccugagaaggaggaucuc

SEQ ID NO: 161315 - RNA, 22 nt, Human
ccugccugucccucaguccaca

SEQ ID NO: 161316 - RNA, 22 nt, Human
gagcaggcauucuaguggcuga

SEQ ID NO: 161317 - RNA, 22 nt, Human
gccuggagaagauggaacuagc

SEQ ID NO: 161318 - RNA, 22 nt, Human
aucuggcuuggguguggguagc

SEQ ID NO: 161319 - RNA, 22 nt, Human
uuacuuuguucucaagauaugu

SEQ ID NO: 161320 - RNA, 22 nt, Human
cugaggugcuauggaggauacg

SEQ ID NO: 161321 - RNA, 20 nt, Human
agucucuguagugccugaga

SEQ ID NO: 161322 - RNA, 22 nt, Human
ggcagcacugcagcuuguuggg

SEQ ID NO: 161323 - RNA, 19 nt, Human
ugggcuuccccagggcaga

SEQ ID NO: 161324 - RNA, 22 nt, Human
aaaaaugaaacggcugguuggc

SEQ ID NO: 161325 - RNA, 22 nt, Human
auccuucaaggggcugacagcu

SEQ ID NO: 161326 - RNA, 22 nt, Human
uccugccuagcaggugaccuau

SEQ ID NO: 161327 - RNA, 22 nt, Human
ccagcucuuggugcacuuacau

SEQ ID NO: 161328 - RNA, 22 nt, Human
gucaugccagcggagcucggga

SEQ ID NO: 161329 - RNA, 22 nt, Human
cgggcagaucacacagggcuug

SEQ ID NO: 161330 - RNA, 22 nt, Human
uggcagagguauauugggagga

SEQ ID NO: 161331 - RNA, 22 nt, Human
gcucuggacuggggccugagaa

SEQ ID NO: 161332 - RNA, 22 nt, Human
cacagaauuaagggagaaauau

SEQ ID NO: 161333 - RNA, 22 nt, Human
gcugccugaagugucuacacug

SEQ ID NO: 161334 - RNA, 22 nt, Human
uggugaagucagcggagcccgg

SEQ ID NO: 161335 - RNA, 22 nt, Human
ucugucaccauucagcuugaau

SEQ ID NO: 161336 - RNA, 22 nt, Human
ccuccugggccuugcucuguga

SEQ ID NO: 161337 - RNA, 22 nt, Human
uuuucauuuuuguagaugcaag

SEQ ID NO: 161338 - RNA, 22 nt, Human
gcacugcagguggguggagagg

SEQ ID NO: 161339 - RNA, 22 nt, Human
agugaccaaucaugguuagauu

SEQ ID NO: 161340 - RNA, 22 nt, Human
ugaaccaggaggcagccagcac

SEQ ID NO: 161341 - RNA, 22 nt, Human
ggcccugggcagaggagugggc

SEQ ID NO: 161342 - RNA, 18 nt, Human
ccuggaccugucuccuuu

SEQ ID NO: 161343 - RNA, 22 nt, Human
ucugcagaaguggcugggccac

SEQ ID NO: 161344 - RNA, 22 nt, Human
uuuccucugcugccauugcccc

SEQ ID NO: 161345 - RNA, 22 nt, Human
uccucaggucaaagcaggagaa

SEQ ID NO: 161346 - RNA, 22 nt, Human
agaggccuaauugcuacccuuu

SEQ ID NO: 161347 - RNA, 22 nt, Human
ucagagugggagaaugugccaa

SEQ ID NO: 161348 - RNA, 22 nt, Human
uggcagggugggcuucagcccc

SEQ ID NO: 161349 - RNA, 22 nt, Human
agccaggcugcaguuggcuggc

SEQ ID NO: 161350 - RNA, 22 nt, Human
gcugccuccugaaagcgcucug

SEQ ID NO: 161351 - RNA, 22 nt, Human
ucugcagauuuaucagcagcug

SEQ ID NO: 161352 - RNA, 22 nt, Human
ggaggccaugaggcucuaggug

SEQ ID NO: 161353 - RNA, 22 nt, Human
caggucagagucccccuguccu

SEQ ID NO: 161354 - RNA, 22 nt, Human
uaccugagcccagugcagcaua

SEQ ID NO: 161355 - RNA, 22 nt, Human
ugucaccucuuuggcugcagcu

SEQ ID NO: 161356 - RNA, 22 nt, Human
caugucuguguacacaugcaca

SEQ ID NO: 161357 - RNA, 20 nt, Human
caggaggcaaggucaagguc

SEQ ID NO: 161358 - RNA, 22 nt, Human
ucugcagcgugcaggcuggugc

SEQ ID NO: 161359 - RNA, 22 nt, Human
cagggcagagccaggauuucaa

SEQ ID NO: 161360 - RNA, 22 nt, Human
agagccagguguagucucggag

SEQ ID NO: 161361 - RNA, 22 nt, Human
acauuuaaauaugccuuauauu

SEQ ID NO: 161362 - RNA, 22 nt, Human
ggaggcuccacugcucuuccug

SEQ ID NO: 161363 - RNA, 22 nt, Human
guucagggagggacagaugaag

SEQ ID NO: 161364 - RNA, 22 nt, Human
ccugggcuuucaaaaccagccu

SEQ ID NO: 161365 - RNA, 22 nt, Human
gccugugacucgucuugggcca

SEQ ID NO: 161366 - RNA, 22 nt, Human
uaauacuuuugccuuguauuca

SEQ ID NO: 161367 - RNA, 22 nt, Human
ucuaggagaaccaucagggagg

SEQ ID NO: 161368 - RNA, 22 nt, Human
ccagggcuggguuugucggugu

SEQ ID NO: 161369 - RNA, 21 nt, Human
ucccagggccaggugccauca

SEQ ID NO: 161370 - RNA, 22 nt, Human
guguccaucagcagccacugug

SEQ ID NO: 161371 - RNA, 22 nt, Human
cuggccugcugggugagguccu

SEQ ID NO: 161372 - RNA, 22 nt, Human
uaacagaaaagaacugaguuug

SEQ ID NO: 161373 - RNA, 22 nt, Human
ugcaccccauuuuacauuuaca

SEQ ID NO: 161374 - RNA, 21 nt, Human
gggagcuggaaacugggugac

SEQ ID NO: 161375 - RNA, 22 nt, Human
ucagaggagccaaaguucugag

SEQ ID NO: 161376 - RNA, 22 nt, Human
ugacaugcuuguuuuccuugaa

SEQ ID NO: 161377 - RNA, 22 nt, Human
ggaggccaaggagggcggauca

SEQ ID NO: 161378 - RNA, 22 nt, Human
cagcccuggccccagguggucu

SEQ ID NO: 161379 - RNA, 22 nt, Human
ucaggcagaggauggggagcgu

SEQ ID NO: 161380 - RNA, 22 nt, Human
ucugucucaaguucuugcacuc

SEQ ID NO: 161381 - RNA, 22 nt, Human
ccugucugcagauaucucaggu

SEQ ID NO: 161382 - RNA, 22 nt, Human
acugcuuuucuaagauucugug

SEQ ID NO: 161383 - RNA, 22 nt, Human
agaggucauaucucagaagaga

SEQ ID NO: 161384 - RNA, 22 nt, Human
ucuuugcaugcauuuucccuua

SEQ ID NO: 161385 - RNA, 22 nt, Human
agucucugcaugccugcugugc

SEQ ID NO: 161386 - RNA, 22 nt, Human
gcccacagcucguuccucuccu

SEQ ID NO: 161387 - RNA, 22 nt, Human
ccagguggaggugugagguccu

SEQ ID NO: 161388 - RNA, 20 nt, Human
gccuguccugagugucaugg

SEQ ID NO: 161389 - RNA, 22 nt, Human
agugaaauuuguuuagauaggu

SEQ ID NO: 161390 - RNA, 22 nt, Human
auaacagaugugaagugcuaau

SEQ ID NO: 161391 - RNA, 22 nt, Human
ucugccuuuucacugccacuaa

SEQ ID NO: 161392 - RNA, 22 nt, Human
uauuucuguaugcauaaaagga

SEQ ID NO: 161393 - RNA, 22 nt, Human
cagccagagaaagggcacugcc

SEQ ID NO: 161394 - RNA, 18 nt, Human
gggcucugauccuucacc

SEQ ID NO: 161395 - RNA, 22 nt, Human
caguguggagggagagagccug

SEQ ID NO: 161396 - RNA, 22 nt, Human
gugcuuccugccuggugccuuu

SEQ ID NO: 161397 - RNA, 22 nt, Human
uuguccuuaccucaaucuggaa

SEQ ID NO: 161398 - RNA, 22 nt, Human
gguuugcaugugauguugggca

SEQ ID NO: 161399 - RNA, 22 nt, Human
aggucccaggcauagcuggucu

SEQ ID NO: 161400 - RNA, 22 nt, Human
aagugaaacauguaucucuuua

SEQ ID NO: 161401 - RNA, 22 nt, Human
aagcaaaagguuacacuucugg

SEQ ID NO: 161402 - RNA, 22 nt, Human
uccuucagggggccgccugcac

SEQ ID NO: 161403 - RNA, 22 nt, Human
acaguaauaaguguuggugagg

SEQ ID NO: 161404 - RNA, 23 nt, Human
agccuucaggcaaugucaguaga

SEQ ID NO: 161405 - RNA, 22 nt, Human
aggcaguguauugcuagcggcu

SEQ ID NO: 161406 - RNA, 22 nt, Human
aggcagagagcaguggccgucu

SEQ ID NO: 161407 - RNA, 22 nt, Human
cuggugccauucuguggccuag

SEQ ID NO: 161408 - RNA, 22 nt, Human
cugggccugguagggcuugaaa

SEQ ID NO: 161409 - RNA, 22 nt, Human
ugcucccaaacgaccuacugug

SEQ ID NO: 161410 - RNA, 22 nt, Human
uauguacauguuaaagggcaaa

SEQ ID NO: 161411 - RNA, 22 nt, Human
caaaguccauaguuuacaauag

SEQ ID NO: 161412 - RNA, 22 nt, Human
ccagucagccaagcugcagcgg

SEQ ID NO: 161413 - RNA, 22 nt, Human
guuuagaauucuaacuuuaagg

SEQ ID NO: 161414 - RNA, 22 nt, Human
uaugcacacaggcuuaauucau

SEQ ID NO: 161415 - RNA, 22 nt, Human
agcuggugcugaagcucuugag

SEQ ID NO: 161416 - RNA, 22 nt, Human
gccuucaguagugucagcugua

SEQ ID NO: 161417 - RNA, 22 nt, Human
gguguccaucaggcugugcuuc

SEQ ID NO: 161418 - RNA, 22 nt, Human
uccugccuuagagcaaggaaaa

SEQ ID NO: 161419 - RNA, 22 nt, Human
acauuucuuccacaugcugcug

SEQ ID NO: 161420 - RNA, 22 nt, Human
augccuguaaucccagugcuuu

SEQ ID NO: 161421 - RNA, 22 nt, Human
uuuccucuucuucccaugucau

SEQ ID NO: 161422 - RNA, 18 nt, Human
gcucugcccaggcugccc

SEQ ID NO: 161423 - RNA, 22 nt, Human
gccaggggacgcggagcgacga

SEQ ID NO: 161424 - RNA, 22 nt, Human
ugugucagaaggcaauggggau

SEQ ID NO: 161425 - RNA, 22 nt, Human
ugucucugugagaucugacgau

SEQ ID NO: 161426 - RNA, 19 nt, Human
ugccagcauuaggcugaag

SEQ ID NO: 161427 - RNA, 19 nt, Human
uccuuugaauaucaguuga

SEQ ID NO: 161428 - RNA, 22 nt, Human
gcuggcuguguuccuucugcca

SEQ ID NO: 161429 - RNA, 22 nt, Human
ucugggcucugucagcaccucu

SEQ ID NO: 161430 - RNA, 22 nt, Human
gggcuugcugauuugggcagga

SEQ ID NO: 161431 - RNA, 22 nt, Human
ggcagggaaacagcugauccca

SEQ ID NO: 161432 - RNA, 21 nt, Human
uccugccuuaguccagagcag

SEQ ID NO: 161433 - RNA, 22 nt, Human
uucuuucccuuccagcagcucc

SEQ ID NO: 161434 - RNA, 22 nt, Human
gaggcugcccaacuggagugga

SEQ ID NO: 161435 - RNA, 23 nt, Human
aggagccaggugcagcccuugug

SEQ ID NO: 161436 - RNA, 19 nt, Human
ccugugugggguagagauc

SEQ ID NO: 161437 - RNA, 22 nt, Human
gcccagaguucaaggcugcagu

SEQ ID NO: 161438 - RNA, 22 nt, Human
ucucacugggucacagcagagg

SEQ ID NO: 161439 - RNA, 20 nt, Human
agccagaagaaggcuggaga

SEQ ID NO: 161440 - RNA, 22 nt, Human
uaaucacaucaggguaaauggg

SEQ ID NO: 161441 - RNA, 22 nt, Human
uccagucaggcugaauucaagg

SEQ ID NO: 161442 - RNA, 22 nt, Human
ggggcugguggugguuucucca

SEQ ID NO: 161443 - RNA, 22 nt, Human
agcucccaggcagucaugagga

SEQ ID NO: 161444 - RNA, 22 nt, Human
ucccagagugugggcaucaagg

SEQ ID NO: 161445 - RNA, 22 nt, Human
uccagccaugcaugacaaucac

SEQ ID NO: 161446 - RNA, 22 nt, Human
cacugcagaucagaggcugaga

SEQ ID NO: 161447 - RNA, 22 nt, Human
ggaugcugcuaucaggcuucga

SEQ ID NO: 161448 - RNA, 22 nt, Human
ccugggucuugguucaugcucu

SEQ ID NO: 161449 - RNA, 22 nt, Human
ggcaaaaaccacaauuacuuuu

SEQ ID NO: 161450 - RNA, 22 nt, Human
agcuggcauacuuugcuaggaa

SEQ ID NO: 161451 - RNA, 22 nt, Human
ccagccuggguguuagaagaca

SEQ ID NO: 161452 - RNA, 20 nt, Human
aaaguguaagcauauaauua

SEQ ID NO: 161453 - RNA, 22 nt, Human
uugcauugggagugaggagacc

SEQ ID NO: 161454 - RNA, 22 nt, Human
cagaagcagugagagaugugca

SEQ ID NO: 161455 - RNA, 22 nt, Human
ucacaugcuacugagccagacc

SEQ ID NO: 161456 - RNA, 22 nt, Human
gcugagcuagcuaucucagucu

SEQ ID NO: 161457 - RNA, 22 nt, Human
cugagccaugagccugcgccca

SEQ ID NO: 161458 - RNA, 22 nt, Human
aggagcugagggagcgcccuug

SEQ ID NO: 161459 - RNA, 22 nt, Human
uuacaaagaguguucuuuucca

SEQ ID NO: 161460 - RNA, 22 nt, Human
cugggcagaauuuuaggauggc

SEQ ID NO: 161461 - RNA, 23 nt, Human
ggaaagagaggaguugugcauag

SEQ ID NO: 161462 - RNA, 23 nt, Human
aggauccugguacaggagcagag

SEQ ID NO: 161463 - RNA, 22 nt, Human
uuccaaagucauguugcugaua

SEQ ID NO: 161464 - RNA, 22 nt, Human
cugccagcaaugugaccaugcu

SEQ ID NO: 161465 - RNA, 22 nt, Human
ggguaauuggggccuugcagug

SEQ ID NO: 161466 - RNA, 22 nt, Human
cucagaguggggcucccugagg

SEQ ID NO: 161467 - RNA, 22 nt, Human
uaauacuuaccuugcagagucu

SEQ ID NO: 161468 - RNA, 22 nt, Human
cagagcugcucaugguggccag

SEQ ID NO: 161469 - RNA, 22 nt, Human
uguccucaaggagcuucagucu

SEQ ID NO: 161470 - RNA, 22 nt, Human
ucuggcucuuugggugauugua

SEQ ID NO: 161471 - RNA, 22 nt, Human
ggagucaggagcaggcugggcu

SEQ ID NO: 161472 - RNA, 22 nt, Human
cucaggauagcugcgcagccug

SEQ ID NO: 161473 - RNA, 22 nt, Human
auccccagaaaauaggugccua

SEQ ID NO: 161474 - RNA, 22 nt, Human
aggccuuccucggagacaggga

SEQ ID NO: 161475 - RNA, 22 nt, Human
gugucauguagaaauugaugaa

SEQ ID NO: 161476 - RNA, 22 nt, Human
gauuucuguaacacuucagaua

SEQ ID NO: 161477 - RNA, 22 nt, Human
augauacaagcaaaacuaauca

SEQ ID NO: 161478 - RNA, 22 nt, Human
gcauuccugagaaugcagagug

SEQ ID NO: 161479 - RNA, 22 nt, Human
agcugguaugaacaggauagga

SEQ ID NO: 161480 - RNA, 22 nt, Human
ucugggcuugguuagggcuguu

SEQ ID NO: 161481 - RNA, 23 nt, Human
ucccuggaggcagguccagggcc

SEQ ID NO: 161482 - RNA, 22 nt, Human
agggauggaagcucgucugcaa

SEQ ID NO: 161483 - RNA, 22 nt, Human
aagaaugucguugguauuuuaa

SEQ ID NO: 161484 - RNA, 22 nt, Human
accugccuaguugguucugccc

SEQ ID NO: 161485 - RNA, 22 nt, Human
agagccagccuucucagcuuac

SEQ ID NO: 161486 - RNA, 22 nt, Human
aagaacugugcuccaggcucca

SEQ ID NO: 161487 - RNA, 20 nt, Human
cagcccuccaguggaggcag

SEQ ID NO: 161488 - RNA, 22 nt, Human
cugagcugggacucaguagcaa

SEQ ID NO: 161489 - RNA, 22 nt, Human
acagacagggcaccugccuccu

SEQ ID NO: 161490 - RNA, 22 nt, Human
acagaauucuaguauguggcuu

SEQ ID NO: 161491 - RNA, 22 nt, Human
uaguacuuaucucugucauugu

SEQ ID NO: 161492 - RNA, 22 nt, Human
uccuucagauuccugcuucugg

SEQ ID NO: 161493 - RNA, 22 nt, Human
auacaaguugugauaauguaaa

SEQ ID NO: 161494 - RNA, 22 nt, Human
cagcccaggccgacaguuccuc

SEQ ID NO: 161495 - RNA, 22 nt, Human
aagaugcagcuuccacuuuugc

SEQ ID NO: 161496 - RNA, 22 nt, Human
ggagacagugacuuagagacug

SEQ ID NO: 161497 - RNA, 22 nt, Human
uagugauuaaaggcagaauguu

SEQ ID NO: 161498 - RNA, 22 nt, Human
cugagaggcacaaggcauuucg

SEQ ID NO: 161499 - RNA, 17 nt, Human
cacaggugugguuugag

SEQ ID NO: 161500 - RNA, 22 nt, Human
uaaacauggauucugaucacag

SEQ ID NO: 161501 - RNA, 20 nt, Human
ucauugcacauaauggaagc

SEQ ID NO: 161502 - RNA, 22 nt, Human
ucuggagcuggagggcaaggca

SEQ ID NO: 161503 - RNA, 22 nt, Human
aggcacugaaagguggccagag

SEQ ID NO: 161504 - RNA, 22 nt, Human
gggcugggauugcuugcuguga

SEQ ID NO: 161505 - RNA, 22 nt, Human
aggucaaguuuagauagaguua

SEQ ID NO: 161506 - RNA, 22 nt, Human
ccugggcagguguggcuucccc

SEQ ID NO: 161507 - RNA, 22 nt, Human
uuccauaaaggugauaguauac

SEQ ID NO: 161508 - RNA, 22 nt, Human
acagggcauuuccucuaugugu

SEQ ID NO: 161509 - RNA, 22 nt, Human
gugcugucaauugcuuucagua

SEQ ID NO: 161510 - RNA, 22 nt, Human
ccuggcucucugcagauccugg

SEQ ID NO: 161511 - RNA, 22 nt, Human
gcugguuaggugagggugcgcc

SEQ ID NO: 161512 - RNA, 19 nt, Human
ggcugucucggcccagcca

SEQ ID NO: 161513 - RNA, 22 nt, Human
cccuuccucccaggcuucugug

SEQ ID NO: 161514 - RNA, 22 nt, Human
auccaaagcccuaaguuaacug

SEQ ID NO: 161515 - RNA, 22 nt, Human
gcuguauuuaacaacuggcuca

SEQ ID NO: 161516 - RNA, 20 nt, Human
gagauuuccaaucaugccca

SEQ ID NO: 161517 - RNA, 22 nt, Human
caaggcaggaagccugucuuau

SEQ ID NO: 161518 - RNA, 22 nt, Human
uaagugcaauguuuuacuuaaa

SEQ ID NO: 161519 - RNA, 22 nt, Human
uccagucauuuccauuguuccc

SEQ ID NO: 161520 - RNA, 22 nt, Human
acucugaggcaggucagggcag

SEQ ID NO: 161521 - RNA, 22 nt, Human
ugcugugcuggcggcagaggcc

SEQ ID NO: 161522 - RNA, 22 nt, Human
ggcagggugccuggcuccuguu

SEQ ID NO: 161523 - RNA, 22 nt, Human
auauguguacgugcaguauaua

SEQ ID NO: 161524 - RNA, 22 nt, Human
cuggcucaccuccgcuccagca

SEQ ID NO: 161525 - RNA, 22 nt, Human
ggccugugagcccuugcaugua

SEQ ID NO: 161526 - RNA, 22 nt, Human
ccaggagucuggaugagguguc

SEQ ID NO: 161527 - RNA, 22 nt, Human
gccugagcaggcguggaccaug

SEQ ID NO: 161528 - RNA, 22 nt, Human
ugggcugcuguuacaggggcug

SEQ ID NO: 161529 - RNA, 22 nt, Human
ccuggcugccgagugugcagcg

SEQ ID NO: 161530 - RNA, 22 nt, Human
acccugagggguauagcagaag

SEQ ID NO: 161531 - RNA, 22 nt, Human
ugaggcagcuuuuucugugugu

SEQ ID NO: 161532 - RNA, 22 nt, Human
gagcccucucuguaggcaagua

SEQ ID NO: 161533 - RNA, 22 nt, Human
gcuggcucagggacuagaguuu

SEQ ID NO: 161534 - RNA, 20 nt, Human
ggaccagguggggcgguggc

SEQ ID NO: 161535 - RNA, 22 nt, Human
cuuccugaacaaugccaucaau

SEQ ID NO: 161536 - RNA, 22 nt, Human
aagggagguaaagcuauuuaaa

SEQ ID NO: 161537 - RNA, 22 nt, Human
gcagggccuuagcagcggcugc

SEQ ID NO: 161538 - RNA, 22 nt, Human
agcugagcucaggcugauguaa

SEQ ID NO: 161539 - RNA, 22 nt, Human
uggcccugcuuaugucucucuu

SEQ ID NO: 161540 - RNA, 20 nt, Human
acagaauaugcugguugugg

SEQ ID NO: 161541 - RNA, 22 nt, Human
caggagcagaggguggucagca

SEQ ID NO: 161542 - RNA, 22 nt, Human
uggcucaguagcagugugguca

SEQ ID NO: 161543 - RNA, 22 nt, Human
ggccccugcggacugccuagag

SEQ ID NO: 161544 - RNA, 22 nt, Human
cugggcacuugcucacagcucu

SEQ ID NO: 161545 - RNA, 22 nt, Human
uucagucagugacuaagcaguu

SEQ ID NO: 161546 - RNA, 22 nt, Human
ccuggcugguggcagcgacaag

SEQ ID NO: 161547 - RNA, 22 nt, Human
gggcagccucggugccugcugc

SEQ ID NO: 161548 - RNA, 22 nt, Human
aggagagaauguuccaggcuug

SEQ ID NO: 161549 - RNA, 22 nt, Human
ugcccaaguccuccaccgaggu

SEQ ID NO: 161550 - RNA, 22 nt, Human
gcugccuggagcucagccugcc

SEQ ID NO: 161551 - RNA, 22 nt, Human
uggcucugugcuucuaguaucu

SEQ ID NO: 161552 - RNA, 22 nt, Human
acaauguaggauauguacuugu

SEQ ID NO: 161553 - RNA, 23 nt, Human
gggauauggaccuuggaggaguc

SEQ ID NO: 161554 - RNA, 22 nt, Human
cugcccugaccugccucagagu

SEQ ID NO: 161555 - RNA, 22 nt, Human
caaaguuaucaacugcaacauu

SEQ ID NO: 161556 - RNA, 22 nt, Human
agcucccagucuccucuccaug

SEQ ID NO: 161557 - RNA, 22 nt, Human
uggcucagauaauucaaggggc

SEQ ID NO: 161558 - RNA, 22 nt, Human
ucagaguguggugagaugugca

SEQ ID NO: 161559 - RNA, 22 nt, Human
cuuccagagauagggccucaag

SEQ ID NO: 161560 - RNA, 22 nt, Human
cccuucagcugagugggacagc

SEQ ID NO: 161561 - RNA, 22 nt, Human
auccugggcagugugucacucu

SEQ ID NO: 161562 - RNA, 18 nt, Human
gagacacaagggccugga

SEQ ID NO: 161563 - RNA, 22 nt, Human
ugcagaaguauuccaggcccca

SEQ ID NO: 161564 - RNA, 22 nt, Human
cugguucauccccuuccaggaa

SEQ ID NO: 161565 - RNA, 22 nt, Human
gugccagcaguuauggugauuu

SEQ ID NO: 161566 - RNA, 22 nt, Human
aucccugcccucauggagcuua

SEQ ID NO: 161567 - RNA, 22 nt, Human
gggauggggagcuggaaagggg

SEQ ID NO: 161568 - RNA, 22 nt, Human
ucagagugugagacauauugga

SEQ ID NO: 161569 - RNA, 22 nt, Human
gaggaguguauuccacaccacu

SEQ ID NO: 161570 - RNA, 23 nt, Human
gagagcugacugucaagacuguu

SEQ ID NO: 161571 - RNA, 22 nt, Human
gcucugcuggagggaaagagaa

SEQ ID NO: 161572 - RNA, 17 nt, Human
ucagcaggggccaagcu

SEQ ID NO: 161573 - RNA, 22 nt, Human
cagaguguaucuguguaagcau

SEQ ID NO: 161574 - RNA, 22 nt, Human
cccagccugugacagccguccu

SEQ ID NO: 161575 - RNA, 22 nt, Human
ggcacugaauuucuuggcaucu

SEQ ID NO: 161576 - RNA, 20 nt, Human
agcuggccuguccuaggccu

SEQ ID NO: 161577 - RNA, 16 nt, Human
ugggcagaugagaaga

SEQ ID NO: 161578 - RNA, 22 nt, Human
ggcugcucugccuuccagcugg

SEQ ID NO: 161579 - RNA, 22 nt, Human
uauuaguagcuugaaauuggug

SEQ ID NO: 161580 - RNA, 20 nt, Human
acaggagaucugaggaaagg

SEQ ID NO: 161581 - RNA, 22 nt, Human
ugccaggcgugguggugcgcac

SEQ ID NO: 161582 - RNA, 22 nt, Human
cgcaccacugaauuccagccug

SEQ ID NO: 161583 - RNA, 22 nt, Human
cugcuucuaagaaccugcagcu

SEQ ID NO: 161584 - RNA, 22 nt, Human
uggccuggccacauccagcagg

SEQ ID NO: 161585 - RNA, 22 nt, Human
uggcccugcuaugauccugcaa

SEQ ID NO: 161586 - RNA, 20 nt, Human
cugugccuaaaccuccgggu

SEQ ID NO: 161587 - RNA, 22 nt, Human
ggcagccaugcacgcugccugg

SEQ ID NO: 161588 - RNA, 22 nt, Human
gggguugguuuaaaugcuugag

SEQ ID NO: 161589 - RNA, 22 nt, Human
cagucccaguuugagacucugg

SEQ ID NO: 161590 - RNA, 22 nt, Human
uggagaagucaaagugaacagg

SEQ ID NO: 161591 - RNA, 22 nt, Human
ucaagauaccaccauuauaugu

SEQ ID NO: 161592 - RNA, 22 nt, Human
auuauguagcuaaaaauugugu

SEQ ID NO: 161593 - RNA, 22 nt, Human
gccuggagaauuaaaaggaagg

SEQ ID NO: 161594 - RNA, 22 nt, Human
ucaguuuuuacggucacaggga

SEQ ID NO: 161595 - RNA, 22 nt, Human
uuguaacaggcacucugugcca

SEQ ID NO: 161596 - RNA, 23 nt, Human
aaaguguagccagguuaagaacc

SEQ ID NO: 161597 - RNA, 22 nt, Human
aguggcagaucucuggucugga

SEQ ID NO: 161598 - RNA, 22 nt, Human
gagaggucaucucccaucagca

SEQ ID NO: 161599 - RNA, 21 nt, Human
ccugcagcaccagaaggagau

SEQ ID NO: 161600 - RNA, 22 nt, Human
ugucccagcacuuugggagucu

SEQ ID NO: 161601 - RNA, 22 nt, Human
agcugucagugcugugccugua

SEQ ID NO: 161602 - RNA, 22 nt, Human
cugcccuggcagccuaccaugg

SEQ ID NO: 161603 - RNA, 22 nt, Human
gucagcagugucagcucugggg

SEQ ID NO: 161604 - RNA, 22 nt, Human
agggcagagggugccucaccug

SEQ ID NO: 161605 - RNA, 22 nt, Human
cucaggagaugacagaagguau

SEQ ID NO: 161606 - RNA, 21 nt, Human
aagggagauaggaaucaggcc

SEQ ID NO: 161607 - RNA, 22 nt, Human
agggccaggaacaccugaaggg

SEQ ID NO: 161608 - RNA, 21 nt, Human
agugaaaugaaguguaugcuc

SEQ ID NO: 161609 - RNA, 22 nt, Human
cuggagccauguauagccuaug

SEQ ID NO: 161610 - RNA, 23 nt, Human
cuccucguaacucuguggugggu

SEQ ID NO: 161611 - RNA, 22 nt, Human
cuggcucccguuguccuugaag

SEQ ID NO: 161612 - RNA, 22 nt, Human
uaaugcacagaauugacauggg

SEQ ID NO: 161613 - RNA, 22 nt, Human
ugccugaggagucagggcaggu

SEQ ID NO: 161614 - RNA, 21 nt, Human
agacagaacaacugcucucca

SEQ ID NO: 161615 - RNA, 22 nt, Human
ccagggcagugggagaaggugc

SEQ ID NO: 161616 - RNA, 22 nt, Human
ccgggcgggggcucucgucacc

SEQ ID NO: 161617 - RNA, 22 nt, Human
ugcccacauggugccauggcca

SEQ ID NO: 161618 - RNA, 22 nt, Human
ucccugggcaucacguugcuuc

SEQ ID NO: 161619 - RNA, 22 nt, Human
gucuuuauuugagauugucauu

SEQ ID NO: 161620 - RNA, 21 nt, Human
ucaggggcuguguuuuccauc

SEQ ID NO: 161621 - RNA, 22 nt, Human
gauuuccuugcauauugguaau

SEQ ID NO: 161622 - RNA, 19 nt, Human
uguggccaugguucagcug

SEQ ID NO: 161623 - RNA, 22 nt, Human
cugggccagauccagccucaca

SEQ ID NO: 161624 - RNA, 22 nt, Human
aaaugcauaucaaagacuugaa

SEQ ID NO: 161625 - RNA, 22 nt, Human
cugggccuuggauugacacugu

SEQ ID NO: 161626 - RNA, 20 nt, Human
cccagccccuaccuguugcc

SEQ ID NO: 161627 - RNA, 22 nt, Human
ccugucuggccaccagggcgau

SEQ ID NO: 161628 - RNA, 22 nt, Human
gcucagaggagcaucauaagga

SEQ ID NO: 161629 - RNA, 19 nt, Human
cagaguacaccagauagga

SEQ ID NO: 161630 - RNA, 22 nt, Human
ugcagggcuuccucuuggaguu

SEQ ID NO: 161631 - RNA, 19 nt, Human
ugucccagacuccgugucu

SEQ ID NO: 161632 - RNA, 22 nt, Human
guguggcugugggagauguuca

SEQ ID NO: 161633 - RNA, 22 nt, Human
acauuucucauaggagagccac

SEQ ID NO: 161634 - RNA, 22 nt, Human
cuagagggauguuaggauagca

SEQ ID NO: 161635 - RNA, 22 nt, Human
ucugaggcauaaccuguucugc

SEQ ID NO: 161636 - RNA, 17 nt, Human
ucuguccagggagugug

SEQ ID NO: 161637 - RNA, 22 nt, Human
uggccugguuguugcugccguu

SEQ ID NO: 161638 - RNA, 22 nt, Human
augcucugggcaggagcccugg

SEQ ID NO: 161639 - RNA, 22 nt, Human
ccucccucuuucagucccacag

SEQ ID NO: 161640 - RNA, 22 nt, Human
agccagcugccuuucacaucug

SEQ ID NO: 161641 - RNA, 22 nt, Human
gacucugcuacaggccgagguu

SEQ ID NO: 161642 - RNA, 22 nt, Human
ugucucagaauggcucauaaua

SEQ ID NO: 161643 - RNA, 22 nt, Human
gcuggcuuugcacugggugcau

SEQ ID NO: 161644 - RNA, 22 nt, Human
uggccugcuuucauuugaugcu

SEQ ID NO: 161645 - RNA, 22 nt, Human
ucaggagaaucagggcuguccu

SEQ ID NO: 161646 - RNA, 22 nt, Human
ccaaggagcugcaggcacuugu

SEQ ID NO: 161647 - RNA, 22 nt, Human
aagggcugcuguagaagcagag

SEQ ID NO: 161648 - RNA, 22 nt, Human
agccagcagggcuuagaggaca

SEQ ID NO: 161649 - RNA, 17 nt, Human
agguggcugcugcgccu

SEQ ID NO: 161650 - RNA, 22 nt, Human
cagaaauucccauuucagauuc

SEQ ID NO: 161651 - RNA, 22 nt, Human
ccaggacuuauuacaguauaac

SEQ ID NO: 161652 - RNA, 19 nt, Human
uggcagggagaguuugaag

SEQ ID NO: 161653 - RNA, 22 nt, Human
uguaacaguaagccugugagcu

SEQ ID NO: 161654 - RNA, 22 nt, Human
guggagcccugccuugcucaug

SEQ ID NO: 161655 - RNA, 22 nt, Human
gaaggagcuaaagggagcccug

SEQ ID NO: 161656 - RNA, 22 nt, Human
uagaacagaggguugcccagau

SEQ ID NO: 161657 - RNA, 22 nt, Human
agcuuuauucaugauuucaggg

SEQ ID NO: 161658 - RNA, 22 nt, Human
uuuuauuggagugauaccaagc

SEQ ID NO: 161659 - RNA, 22 nt, Human
aggaggccgggauucuggagau

SEQ ID NO: 161660 - RNA, 22 nt, Human
gccuccugguugcuucuccaac

SEQ ID NO: 161661 - RNA, 18 nt, Human
caaagcucacguuccauc

SEQ ID NO: 161662 - RNA, 22 nt, Human
ucuccugugcacccucccugug

SEQ ID NO: 161663 - RNA, 22 nt, Human
acaaaugcaaguuuuaugucaa

SEQ ID NO: 161664 - RNA, 22 nt, Human
gcuccagguauuugcccuuuua

SEQ ID NO: 161665 - RNA, 22 nt, Human
ugcugggggcuuucuggauacc

SEQ ID NO: 161666 - RNA, 22 nt, Human
cccugaggggaguggugaggug

SEQ ID NO: 161667 - RNA, 17 nt, Human
cagggcugucugccuag

SEQ ID NO: 161668 - RNA, 22 nt, Human
gcugccaguguggcaugaugca

SEQ ID NO: 161669 - RNA, 22 nt, Human
gcagcuuggauuucuguaguuu

SEQ ID NO: 161670 - RNA, 22 nt, Human
gccuggcccagggcucuuguug

SEQ ID NO: 161671 - RNA, 22 nt, Human
ugucaugcccaggagcaaggua

SEQ ID NO: 161672 - RNA, 22 nt, Human
gugggcuggacccuccugcucc

SEQ ID NO: 161673 - RNA, 22 nt, Human
gugccuggcaugcgccggugcu

SEQ ID NO: 161674 - RNA, 19 nt, Human
cuggcagccugucuguguc

SEQ ID NO: 161675 - RNA, 22 nt, Human
ggcagcagggucuagauugaug

SEQ ID NO: 161676 - RNA, 22 nt, Human
ugguggcuucugaggauggcga

SEQ ID NO: 161677 - RNA, 22 nt, Human
uagggaggcuacuucuuguagg

SEQ ID NO: 161678 - RNA, 22 nt, Human
cagacacaccaggcccauucug

SEQ ID NO: 161679 - RNA, 22 nt, Human
gccagcuggagugagagugggc

SEQ ID NO: 161680 - RNA, 23 nt, Human
gcugagguacauuuacaggaaga

SEQ ID NO: 161681 - RNA, 21 nt, Human
acaguucaugauaacuccauc

SEQ ID NO: 161682 - RNA, 22 nt, Human
uggcucuggauuaaucuaggaa

SEQ ID NO: 161683 - RNA, 22 nt, Human
cugaaggagcauagucaguuuu

SEQ ID NO: 161684 - RNA, 22 nt, Human
uaaggcagaaauaugagcaggg

SEQ ID NO: 161685 - RNA, 22 nt, Human
gccuuugccugcgacguggcug

SEQ ID NO: 161686 - RNA, 22 nt, Human
uccuggagccacggagcuuuca

SEQ ID NO: 161687 - RNA, 22 nt, Human
ggccaccuuccaguugccugca

SEQ ID NO: 161688 - RNA, 22 nt, Human
cacaggcugcccgcagcuggga

SEQ ID NO: 161689 - RNA, 22 nt, Human
gccugucaauuuuguguacaau

SEQ ID NO: 161690 - RNA, 22 nt, Human
ugcuggccaacaaggcuccaag

SEQ ID NO: 161691 - RNA, 23 nt, Human
agucucagcuggaaacauguguc

SEQ ID NO: 161692 - RNA, 21 nt, Human
gccacugcacuccagccuggg

SEQ ID NO: 161693 - RNA, 22 nt, Human
gggucuggcaugcugagaugga

SEQ ID NO: 161694 - RNA, 22 nt, Human
gcugccugccuaguuccacagu

SEQ ID NO: 161695 - RNA, 21 nt, Human
ccaggcagagcugugaguucu

SEQ ID NO: 161696 - RNA, 22 nt, Human
uggcugggagcuggaacugggc

SEQ ID NO: 161697 - RNA, 22 nt, Human
ucucaggaguagugggauccau

SEQ ID NO: 161698 - RNA, 22 nt, Human
cugugcuugacagugggaagca

SEQ ID NO: 161699 - RNA, 22 nt, Human
ccacagggaacaugacagccuu

SEQ ID NO: 161700 - RNA, 22 nt, Human
ggcacugauuccauucaugaag

SEQ ID NO: 161701 - RNA, 22 nt, Human
cugugucccuugucccagagcc

SEQ ID NO: 161702 - RNA, 22 nt, Human
gcaggccuuggcaaugagccug

SEQ ID NO: 161703 - RNA, 18 nt, Human
gaaaugugauucuagggc

SEQ ID NO: 161704 - RNA, 22 nt, Human
cagcaggguagguuguaucagu

SEQ ID NO: 161705 - RNA, 22 nt, Human
gccuuggccaacaccuugcaaa

SEQ ID NO: 161706 - RNA, 22 nt, Human
ccagcugaggcagccacacagg

SEQ ID NO: 161707 - RNA, 22 nt, Human
agcaggaggguuuuguagaguc

SEQ ID NO: 161708 - RNA, 22 nt, Human
uggcaggguggcaacuuuuggu

SEQ ID NO: 161709 - RNA, 22 nt, Human
gagauguacaauguguauuaau

SEQ ID NO: 161710 - RNA, 22 nt, Human
ucucagaguuccucuggagucc

SEQ ID NO: 161711 - RNA, 19 nt, Human
aggguccagggagcggcuc

SEQ ID NO: 161712 - RNA, 22 nt, Human
ucucacuggguauaaaugagua

SEQ ID NO: 161713 - RNA, 22 nt, Human
ccaggcucaggugcgagagaca

SEQ ID NO: 161714 - RNA, 22 nt, Human
aggcucagcugguggugaucgc

SEQ ID NO: 161715 - RNA, 22 nt, Human
aggccagguggucaugcuugcu

SEQ ID NO: 161716 - RNA, 22 nt, Human
ccacugggggcugcaggcacuc

SEQ ID NO: 161717 - RNA, 22 nt, Human
aaugcacagcuaaagugguucc

SEQ ID NO: 161718 - RNA, 18 nt, Human
gcugccugcauuccucac

SEQ ID NO: 161719 - RNA, 22 nt, Human
ggguggcuccuaugggcauagc

SEQ ID NO: 161720 - RNA, 23 nt, Human
ccacagagcugccaauuccugug

SEQ ID NO: 161721 - RNA, 22 nt, Human
cccaggagagaggccaguuggc

SEQ ID NO: 161722 - RNA, 22 nt, Human
cccagcaguuguuggugcacau

SEQ ID NO: 161723 - RNA, 22 nt, Human
gccugcagggugaugggcugcc

SEQ ID NO: 161724 - RNA, 22 nt, Human
auggaaaggcuguggaaacuua

SEQ ID NO: 161725 - RNA, 22 nt, Human
ccuggcagcagcacaugccuuc

SEQ ID NO: 161726 - RNA, 22 nt, Human
ugccagcuccgaggagcugcag

SEQ ID NO: 161727 - RNA, 22 nt, Human
aguaucaaggaucuccagcacc

SEQ ID NO: 161728 - RNA, 22 nt, Human
aggugcagaaaaaaguccuuua

SEQ ID NO: 161729 - RNA, 22 nt, Human
ugagccuggggccugggcagcg

SEQ ID NO: 161730 - RNA, 22 nt, Human
ucagcagcagcucagcauguuu

SEQ ID NO: 161731 - RNA, 22 nt, Human
gcugaagcugcagcaggaggaa

SEQ ID NO: 161732 - RNA, 22 nt, Human
ugucacagggauaccauggggc

SEQ ID NO: 161733 - RNA, 22 nt, Human
gcugucccgaaccccugguaau

SEQ ID NO: 161734 - RNA, 22 nt, Human
gucccugcccuccugggacuca

SEQ ID NO: 161735 - RNA, 19 nt, Human
ugucucagugucccuuccu

SEQ ID NO: 161736 - RNA, 22 nt, Human
acaggccugacacacagagggc

SEQ ID NO: 161737 - RNA, 22 nt, Human
uggcccugacugauguggaggg

SEQ ID NO: 161738 - RNA, 22 nt, Human
uuccuguccgcaauggccuggg

SEQ ID NO: 161739 - RNA, 22 nt, Human
gcaggccagcugugcagauggg

SEQ ID NO: 161740 - RNA, 22 nt, Human
gcugccacauuuucaggacuaa

SEQ ID NO: 161741 - RNA, 22 nt, Human
uucauguauuuaucauguaaau

SEQ ID NO: 161742 - RNA, 22 nt, Human
cuguacauauacauuuuuuucc

SEQ ID NO: 161743 - RNA, 22 nt, Human
augugcaugcacuuacaugugu

SEQ ID NO: 161744 - RNA, 22 nt, Human
ucugaggccccugggcaggaug

SEQ ID NO: 161745 - RNA, 22 nt, Human
gggccccuuguaucucuggcuc

SEQ ID NO: 161746 - RNA, 22 nt, Human
ccucuccuugcacccgucccgc

SEQ ID NO: 161747 - RNA, 22 nt, Human
ugggugggagcgcccugucugg

SEQ ID NO: 161748 - RNA, 22 nt, Human
gcucaggaucagccaccucuuu

SEQ ID NO: 161749 - RNA, 22 nt, Human
uggcucugggaaucuguugcuu

SEQ ID NO: 161750 - RNA, 22 nt, Human
gccugagacagugugguccaau

SEQ ID NO: 161751 - RNA, 22 nt, Human
gcagcccaaaaaagagguagau

SEQ ID NO: 161752 - RNA, 22 nt, Human
cucagagaaaaggagcaagggu

SEQ ID NO: 161753 - RNA, 22 nt, Human
acaaagucacaauaauuaaccu

SEQ ID NO: 161754 - RNA, 19 nt, Human
gcuggcagauguggccgug

SEQ ID NO: 161755 - RNA, 22 nt, Human
caaaugcauaguuuauaagaag

SEQ ID NO: 161756 - RNA, 22 nt, Human
gucccagaaacauauugcuggu

SEQ ID NO: 161757 - RNA, 22 nt, Human
agcugcuguccuaggcacugua

SEQ ID NO: 161758 - RNA, 22 nt, Human
uccugccucuuuucuuauucca

SEQ ID NO: 161759 - RNA, 22 nt, Human
cucucuucccgugaguguugca

SEQ ID NO: 161760 - RNA, 22 nt, Human
gaacagaauuaccgaagaucug

SEQ ID NO: 161761 - RNA, 22 nt, Human
cccagggacagcuagguggggc

SEQ ID NO: 161762 - RNA, 22 nt, Human
uuucaugugcaauuagcaauau

SEQ ID NO: 161763 - RNA, 22 nt, Human
aaaagguagauucuccuucuau

SEQ ID NO: 161764 - RNA, 17 nt, Human
ucaugcccaacuauuac

SEQ ID NO: 161765 - RNA, 22 nt, Human
aguucuuuugugaacauaugcu

SEQ ID NO: 161766 - RNA, 20 nt, Human
cccucugcacauggcugugg

SEQ ID NO: 161767 - RNA, 22 nt, Human
gcaguaaaaaaggauaugugca

SEQ ID NO: 161768 - RNA, 22 nt, Human
gggacagaaggaagugagcaca

SEQ ID NO: 161769 - RNA, 22 nt, Human
cagggcuguuagcugcugcucu

SEQ ID NO: 161770 - RNA, 22 nt, Human
ucacauuuucuacuacuguacg

SEQ ID NO: 161771 - RNA, 22 nt, Human
ccugcucugguuuagucagucu

SEQ ID NO: 161772 - RNA, 22 nt, Human
ggcccagcugugcuuccagccc

SEQ ID NO: 161773 - RNA, 22 nt, Human
cagccugggcuccagagucccu

SEQ ID NO: 161774 - RNA, 22 nt, Human
aggugccaauuuucagugaaca

SEQ ID NO: 161775 - RNA, 22 nt, Human
cucaguuucuucauauuguagg

SEQ ID NO: 161776 - RNA, 22 nt, Human
uacauugugauguuucaauaca

SEQ ID NO: 161777 - RNA, 20 nt, Human
aggcacuguugucuguaucc

SEQ ID NO: 161778 - RNA, 22 nt, Human
cucuccuccaacagcccugccg

SEQ ID NO: 161779 - RNA, 22 nt, Human
agugagggaugaagaacugcgg

SEQ ID NO: 161780 - RNA, 22 nt, Human
cugggcacacagugacucugca

SEQ ID NO: 161781 - RNA, 22 nt, Human
cugcagagcuaggcugagugaa

SEQ ID NO: 161782 - RNA, 22 nt, Human
uagggcagcugcaucaggcacu

SEQ ID NO: 161783 - RNA, 22 nt, Human
cuggugcaggaaggagcuggca

SEQ ID NO: 161784 - RNA, 19 nt, Human
agcaccugugagagccugg

SEQ ID NO: 161785 - RNA, 22 nt, Human
ccaggcaggcagcguucucagg

SEQ ID NO: 161786 - RNA, 22 nt, Human
ugagguaggugguaagagauac

SEQ ID NO: 161787 - RNA, 17 nt, Human
agcagcugaagcagcca

SEQ ID NO: 161788 - RNA, 22 nt, Human
ggcuccugauaggagaaugcgg

SEQ ID NO: 161789 - RNA, 22 nt, Human
aucaguuugagugcugugucaa

SEQ ID NO: 161790 - RNA, 22 nt, Human
guggugcaggccagcaggggcg

SEQ ID NO: 161791 - RNA, 22 nt, Human
ugucugucugcaagccagaaag

SEQ ID NO: 161792 - RNA, 22 nt, Human
agagacaggguuuugucguguu

SEQ ID NO: 161793 - RNA, 22 nt, Human
ugaaggaauggaggaucagagc

SEQ ID NO: 161794 - RNA, 22 nt, Human
auaauuuacuaagcucuaccuu

SEQ ID NO: 161795 - RNA, 17 nt, Human
cagacagauauccuggg

SEQ ID NO: 161796 - RNA, 22 nt, Human
aacagcaauagcacuauucauu

SEQ ID NO: 161797 - RNA, 22 nt, Human
cuggcucaggguggucuggguc

SEQ ID NO: 161798 - RNA, 22 nt, Human
uccugccugcaaucccagcacu

SEQ ID NO: 161799 - RNA, 22 nt, Human
ccucucauagucuguauccuuu

SEQ ID NO: 161800 - RNA, 22 nt, Human
agggggcaggagagaccugcug

SEQ ID NO: 161801 - RNA, 22 nt, Human
aggaguggaauuacuggguucu

SEQ ID NO: 161802 - RNA, 19 nt, Human
agccuggagggcuggucac

SEQ ID NO: 161803 - RNA, 22 nt, Human
ggauccuuaacuaucacaguga

SEQ ID NO: 161804 - RNA, 22 nt, Human
auaaagaggauguauuuacagc

SEQ ID NO: 161805 - RNA, 22 nt, Human
ucccugggccacagcugugagc

SEQ ID NO: 161806 - RNA, 20 nt, Human
aguaggggaaugcaagagca

SEQ ID NO: 161807 - RNA, 17 nt, Human
ccuuucucuuucaucuc

SEQ ID NO: 161808 - RNA, 22 nt, Human
uggaaagaauuccuaugguuca

SEQ ID NO: 161809 - RNA, 22 nt, Human
uggggacauagccagucuggcu

SEQ ID NO: 161810 - RNA, 22 nt, Human
aggggacacggcuucuccaggg

SEQ ID NO: 161811 - RNA, 22 nt, Human
gcacagagggcagugagccucu

SEQ ID NO: 161812 - RNA, 19 nt, Human
ggucucagugcagcugcag

SEQ ID NO: 161813 - RNA, 22 nt, Human
acacagaaccucauagccucuc

SEQ ID NO: 161814 - RNA, 22 nt, Human
aggccugggacgggagccguga

SEQ ID NO: 161815 - RNA, 22 nt, Human
agcugcccccagggcugugcuu

SEQ ID NO: 161816 - RNA, 22 nt, Human
cagagguaccagcagccucugg

SEQ ID NO: 161817 - RNA, 22 nt, Human
gcugagaggcacuaucuccgga

SEQ ID NO: 161818 - RNA, 22 nt, Human
uucuguguggguagcuccuguu

SEQ ID NO: 161819 - RNA, 22 nt, Human
ucuggcucccuggagcuccaca

SEQ ID NO: 161820 - RNA, 22 nt, Human
gcagagccgugaauggauuuca

SEQ ID NO: 161821 - RNA, 22 nt, Human
uuucauguuuucuuaaauggca

SEQ ID NO: 161822 - RNA, 22 nt, Human
ggagggcucaauugacuccuga

SEQ ID NO: 161823 - RNA, 22 nt, Human
uggagaugaauauguguaccug

SEQ ID NO: 161824 - RNA, 18 nt, Human
agcuggggccucuggucc

SEQ ID NO: 161825 - RNA, 22 nt, Human
uugucugugaaauggaaauagu

SEQ ID NO: 161826 - RNA, 21 nt, Human
agaaaaguagaguuuucagag

SEQ ID NO: 161827 - RNA, 22 nt, Human
uucacauuauaaucaguucugc

SEQ ID NO: 161828 - RNA, 22 nt, Human
auguagcaucuauccugauaaa

SEQ ID NO: 161829 - RNA, 22 nt, Human
cagagcugcagauugaaggcau

SEQ ID NO: 161830 - RNA, 22 nt, Human
ucagcagauggguuguguuggc

SEQ ID NO: 161831 - RNA, 22 nt, Human
gaggaguggaguugcuggguug

SEQ ID NO: 161832 - RNA, 22 nt, Human
aaaggucaagcuggacucaggu

SEQ ID NO: 161833 - RNA, 22 nt, Human
cugucagcacucuacuacagau

SEQ ID NO: 161834 - RNA, 22 nt, Human
acugggaggcaucuggagcuga

SEQ ID NO: 161835 - RNA, 22 nt, Human
aguuuagaguucaaauuaguuc

SEQ ID NO: 161836 - RNA, 22 nt, Human
acagagaaagugggcugaagau

SEQ ID NO: 161837 - RNA, 22 nt, Human
aaaaugugcaguuuuuaagcug

SEQ ID NO: 161838 - RNA, 20 nt, Human
cuccagggaacagacuggag

SEQ ID NO: 161839 - RNA, 19 nt, Human
aggugaugugacucuagaa

SEQ ID NO: 161840 - RNA, 22 nt, Human
gagcugcccugagcuuugcaug

SEQ ID NO: 161841 - RNA, 19 nt, Human
acuuucuccaggaccuguu

SEQ ID NO: 161842 - RNA, 22 nt, Human
ugugucagagguagagauggca

SEQ ID NO: 161843 - RNA, 22 nt, Human
gacauucacaguuuccgauggu

SEQ ID NO: 161844 - RNA, 21 nt, Human
aaugugugcuauuuaucuuuu

SEQ ID NO: 161845 - RNA, 22 nt, Human
cagagcugcaaaugccccuccg

SEQ ID NO: 161846 - RNA, 22 nt, Human
gcuguccucugaucucuggagg

SEQ ID NO: 161847 - RNA, 22 nt, Human
cuucucucccuggcacucagac

SEQ ID NO: 161848 - RNA, 22 nt, Human
gggcugcuuuuaagggucucag

SEQ ID NO: 161849 - RNA, 22 nt, Human
uuccuucucagcccucgaggau

SEQ ID NO: 161850 - RNA, 22 nt, Human
ugagccuggcggaagcagcgug

SEQ ID NO: 161851 - RNA, 22 nt, Human
uaauuuaauuccauggauucua

SEQ ID NO: 161852 - RNA, 22 nt, Human
cuacauuaaauuggcuuacuua

SEQ ID NO: 161853 - RNA, 22 nt, Human
aggguggagggagucccugagc

SEQ ID NO: 161854 - RNA, 22 nt, Human
ccagcaccuugaucuuggaguu

SEQ ID NO: 161855 - RNA, 22 nt, Human
cagcuccccaugguuccugaag

SEQ ID NO: 161856 - RNA, 22 nt, Human
acuggcugaaguuuacuuuuug

SEQ ID NO: 161857 - RNA, 22 nt, Human
caggagcccguugcuccggcgg

SEQ ID NO: 161858 - RNA, 22 nt, Human
guuuuauaggugaaauauuacu

SEQ ID NO: 161859 - RNA, 22 nt, Human
cugccucaugcugccugcagcc

SEQ ID NO: 161860 - RNA, 22 nt, Human
uggcugcugagaaggcagcugu

SEQ ID NO: 161861 - RNA, 22 nt, Human
aucaguuuggaacauucaggcc

SEQ ID NO: 161862 - RNA, 22 nt, Human
guaggaagcucugaggcuaguu

SEQ ID NO: 161863 - RNA, 22 nt, Human
ucaggcugccuaucagacugug

SEQ ID NO: 161864 - RNA, 22 nt, Human
aaaagagucuuaggcagucaua

SEQ ID NO: 161865 - RNA, 22 nt, Human
gcuggcagaauuucuucuugcu

SEQ ID NO: 161866 - RNA, 22 nt, Human
cagugcauagauccugaggccu

SEQ ID NO: 161867 - RNA, 20 nt, Human
cuuccacacaagaagcacag

SEQ ID NO: 161868 - RNA, 22 nt, Human
ucugggcagcagcagcuaguag

SEQ ID NO: 161869 - RNA, 22 nt, Human
ugcagggcuacaggacuacaac

SEQ ID NO: 161870 - RNA, 22 nt, Human
gccagcagccacagaagucacu

SEQ ID NO: 161871 - RNA, 22 nt, Human
auagugguuggauaugucagag

SEQ ID NO: 161872 - RNA, 21 nt, Human
uggcucugaaagagugcugca

SEQ ID NO: 161873 - RNA, 22 nt, Human
uccugugccuccaccugcuccg

SEQ ID NO: 161874 - RNA, 22 nt, Human
gauuucaaggauguuagaggug

SEQ ID NO: 161875 - RNA, 22 nt, Human
cacucugcagcugaagggcugg

SEQ ID NO: 161876 - RNA, 20 nt, Human
ucccuggaggugguggcauc

SEQ ID NO: 161877 - RNA, 22 nt, Human
aaugaugguuucaucacuugaa

SEQ ID NO: 161878 - RNA, 22 nt, Human
cugggaggacaacuuggagcuc

SEQ ID NO: 161879 - RNA, 22 nt, Human
caggcagcucgaugccuuguug

SEQ ID NO: 161880 - RNA, 22 nt, Human
auaugucgcuacaucauuagau

SEQ ID NO: 161881 - RNA, 22 nt, Human
gccaccucuuugucucugccgc

SEQ ID NO: 161882 - RNA, 22 nt, Human
ugucccagacacaguaugcgcu

SEQ ID NO: 161883 - RNA, 22 nt, Human
caguacuucuuggaaacuggau

SEQ ID NO: 161884 - RNA, 22 nt, Human
ggucagggggaucugugaggua

SEQ ID NO: 161885 - RNA, 22 nt, Human
uauguacauggagagcaauuga

SEQ ID NO: 161886 - RNA, 22 nt, Human
gguuggaggugggaauagcuag

SEQ ID NO: 161887 - RNA, 22 nt, Human
agucucugcacaguaagaagca

SEQ ID NO: 161888 - RNA, 22 nt, Human
ugcuagaaaucugaaacuagca

SEQ ID NO: 161889 - RNA, 22 nt, Human
aguggcagccgagcaggagaug

SEQ ID NO: 161890 - RNA, 22 nt, Human
gcuuccuggagggagagagcug

SEQ ID NO: 161891 - RNA, 22 nt, Human
uuaaacagguuuuugaauggcc

SEQ ID NO: 161892 - RNA, 22 nt, Human
ggggcagcucccgagggcagga

SEQ ID NO: 161893 - RNA, 22 nt, Human
gagggcagagacagugauucac

SEQ ID NO: 161894 - RNA, 22 nt, Human
ucagagugcagcgggaggcugg

SEQ ID NO: 161895 - RNA, 22 nt, Human
uggcacugaccccaggccugug

SEQ ID NO: 161896 - RNA, 22 nt, Human
ucaggagagaaagaauacaauu

SEQ ID NO: 161897 - RNA, 22 nt, Human
uggcucaggcuugaaaauagau

SEQ ID NO: 161898 - RNA, 22 nt, Human
ggucagggcucuuccaguggcu

SEQ ID NO: 161899 - RNA, 22 nt, Human
uucacagggcagcagcugagcc

SEQ ID NO: 161900 - RNA, 22 nt, Human
auagaacagaaacagaugcaca

SEQ ID NO: 161901 - RNA, 22 nt, Human
cacuggggugggccugguagag

SEQ ID NO: 161902 - RNA, 18 nt, Human
gccugggaggaggaaaug

SEQ ID NO: 161903 - RNA, 22 nt, Human
gcuuuuucaaaugaaagcuggu

SEQ ID NO: 161904 - RNA, 22 nt, Human
gcagcuuuguggagaggcccau

SEQ ID NO: 161905 - RNA, 19 nt, Human
ccucugccagcccgccucu

SEQ ID NO: 161906 - RNA, 22 nt, Human
ucuggcccagccccugagguca

SEQ ID NO: 161907 - RNA, 22 nt, Human
aagcagccaccucaucuccacu

SEQ ID NO: 161908 - RNA, 17 nt, Human
gagaguguauuggaugc

SEQ ID NO: 161909 - RNA, 22 nt, Human
ggaggaccccagcagcucccca

SEQ ID NO: 161910 - RNA, 22 nt, Human
cucccugguguccccuccagga

SEQ ID NO: 161911 - RNA, 22 nt, Human
gcugccuggcuuuaguccacuu

SEQ ID NO: 161912 - RNA, 22 nt, Human
ggcugccucaaagcucaagcuc

SEQ ID NO: 161913 - RNA, 22 nt, Human
gccucugggcucugccccuggc

SEQ ID NO: 161914 - RNA, 22 nt, Human
caggcuugggagcagagccacu

SEQ ID NO: 161915 - RNA, 22 nt, Human
ccugucaguugcugucagggau

SEQ ID NO: 161916 - RNA, 22 nt, Human
ccaggccuguguuguguggagg

SEQ ID NO: 161917 - RNA, 22 nt, Human
ucugucugcgcuugcccuggug

SEQ ID NO: 161918 - RNA, 22 nt, Human
aucuauuaugcugagaaacugu

SEQ ID NO: 161919 - RNA, 22 nt, Human
cauugcacaucugagaagagau

SEQ ID NO: 161920 - RNA, 22 nt, Human
gcagggcugcugaaacuuguuu

SEQ ID NO: 161921 - RNA, 22 nt, Human
ggaccagagcucgggcuucuca

SEQ ID NO: 161922 - RNA, 22 nt, Human
guggcugcuaagucuccuuccu

SEQ ID NO: 161923 - RNA, 21 nt, Human
ugguuugcggccaaaguuaaa

SEQ ID NO: 161924 - RNA, 22 nt, Human
aaagauuuaagaauaauuugug

SEQ ID NO: 161925 - RNA, 21 nt, Human
ugauuuccagaaaauuggccc

SEQ ID NO: 161926 - RNA, 22 nt, Human
uccagggagauggcagaggcug

SEQ ID NO: 161927 - RNA, 21 nt, Human
cugcuuuacuucagaggaucu

SEQ ID NO: 161928 - RNA, 22 nt, Human
gugccuggcacacagaaggcaa

SEQ ID NO: 161929 - RNA, 22 nt, Human
gaaaucugucuuuguuugaaua

SEQ ID NO: 161930 - RNA, 22 nt, Human
agcccaugcaacaggccuagcg

SEQ ID NO: 161931 - RNA, 22 nt, Human
aagcagccuggcaugaugcuuu

SEQ ID NO: 161932 - RNA, 22 nt, Human
agccuggagcuugaguuaugag

SEQ ID NO: 161933 - RNA, 20 nt, Human
ugaaaaggucaggagacaug

SEQ ID NO: 161934 - RNA, 22 nt, Human
ugggaggaucgcuugagcccag

SEQ ID NO: 161935 - RNA, 22 nt, Human
gcuggcuguaucaccuggccag

SEQ ID NO: 161936 - RNA, 22 nt, Human
gagcuuugcuggaagccugggg

SEQ ID NO: 161937 - RNA, 23 nt, Human
ugggccuggccucccaguccagc

SEQ ID NO: 161938 - RNA, 22 nt, Human
gagagugagauaauuucacaua

SEQ ID NO: 161939 - RNA, 22 nt, Human
caaaggcaacauauacuuguuu

SEQ ID NO: 161940 - RNA, 22 nt, Human
gcugucugcugggucgcucagg

SEQ ID NO: 161941 - RNA, 22 nt, Human
ucaggggcccuucccucagcag

SEQ ID NO: 161942 - RNA, 20 nt, Human
cccagggaccugagcuccau

SEQ ID NO: 161943 - RNA, 22 nt, Human
cauugaaaccuaacauaggcug

SEQ ID NO: 161944 - RNA, 22 nt, Human
ggucccaggagaauaggugcaa

SEQ ID NO: 161945 - RNA, 22 nt, Human
agaaacauuuagauuauauguc

SEQ ID NO: 161946 - RNA, 22 nt, Human
gcagcccagagcgcaggacccc

SEQ ID NO: 161947 - RNA, 22 nt, Human
cacagagagcuacgugcagcgu

SEQ ID NO: 161948 - RNA, 22 nt, Human
ucaaauaugugauagaagcuaa

SEQ ID NO: 161949 - RNA, 22 nt, Human
agccuucauaaucuugggcuuu

SEQ ID NO: 161950 - RNA, 22 nt, Human
cagaagcacuaggaggaaacgu

SEQ ID NO: 161951 - RNA, 21 nt, Human
gcaggcuggucaaaccucagu

SEQ ID NO: 161952 - RNA, 22 nt, Human
cagcugggagcuccauuagaua

SEQ ID NO: 161953 - RNA, 22 nt, Human
gagcagggccacuucuguaccu

SEQ ID NO: 161954 - RNA, 22 nt, Human
cagccaggcccccgagucguug

SEQ ID NO: 161955 - RNA, 22 nt, Human
cagcugagaccagaaugcaggu

SEQ ID NO: 161956 - RNA, 21 nt, Human
uauacaugugugcauacgugu

SEQ ID NO: 161957 - RNA, 22 nt, Human
agugacagcugggaaggugaaa

SEQ ID NO: 161958 - RNA, 22 nt, Human
guggcagagguuccucagugug

SEQ ID NO: 161959 - RNA, 22 nt, Human
gggcacuggaaggcucucaggc

SEQ ID NO: 161960 - RNA, 22 nt, Human
gccuggcuccuaaggacuggcu

SEQ ID NO: 161961 - RNA, 22 nt, Human
aagggaggggauguaagccugg

SEQ ID NO: 161962 - RNA, 22 nt, Human
acaugucaauuuaguacucuua

SEQ ID NO: 161963 - RNA, 22 nt, Human
uuauuauugugaccugagaaug

SEQ ID NO: 161964 - RNA, 22 nt, Human
gcugccugucccaggaugagga

SEQ ID NO: 161965 - RNA, 22 nt, Human
cuguuuaucccuuuggucagca

SEQ ID NO: 161966 - RNA, 21 nt, Human
guggcccugguguggcugcac

SEQ ID NO: 161967 - RNA, 22 nt, Human
ugggugggagcacccugucugg

SEQ ID NO: 161968 - RNA, 22 nt, Human
agacccugcaccucucgugggc

SEQ ID NO: 161969 - RNA, 22 nt, Human
uggcagcuguguccagguagaa

SEQ ID NO: 161970 - RNA, 22 nt, Human
uuaaguccuugguaauuuucuu

SEQ ID NO: 161971 - RNA, 22 nt, Human
ucacugcagacaaccucaguca

SEQ ID NO: 161972 - RNA, 22 nt, Human
cugcucugcaaggcacagugau

SEQ ID NO: 161973 - RNA, 22 nt, Human
cccaggagguggagguugcagc

SEQ ID NO: 161974 - RNA, 21 nt, Human
uccacaaguuagaaggaaauu

SEQ ID NO: 161975 - RNA, 22 nt, Human
caggcugaggcaguaggguuug

SEQ ID NO: 161976 - RNA, 22 nt, Human
gcuggagccuucugcucuguug

SEQ ID NO: 161977 - RNA, 22 nt, Human
auacaguauuaccuguucagga

SEQ ID NO: 161978 - RNA, 19 nt, Human
ccauggcaaugaucugaug

SEQ ID NO: 161979 - RNA, 18 nt, Human
caggucagccuggccuca

SEQ ID NO: 161980 - RNA, 22 nt, Human
auugaaaguccuaucuaaggga

SEQ ID NO: 161981 - RNA, 22 nt, Human
gcaggccucuguugagggccuu

SEQ ID NO: 161982 - RNA, 22 nt, Human
augucuaaaagauaaaguuuaa

SEQ ID NO: 161983 - RNA, 22 nt, Human
agcaguggcuggauggugugcu

SEQ ID NO: 161984 - RNA, 22 nt, Human
accagagcuuacaugcuagaaa

SEQ ID NO: 161985 - RNA, 22 nt, Human
uuauuuuuaaaaguucacacag

SEQ ID NO: 161986 - RNA, 22 nt, Human
agcagggcuuugcagacuuggg

SEQ ID NO: 161987 - RNA, 22 nt, Human
auaaggcacacauagauagggu

SEQ ID NO: 161988 - RNA, 22 nt, Human
gccagcucagugccaggccccu

SEQ ID NO: 161989 - RNA, 22 nt, Human
aaaucugguucaguaaguccuc

SEQ ID NO: 161990 - RNA, 22 nt, Human
gauggguggucucagacuugcc

SEQ ID NO: 161991 - RNA, 22 nt, Human
caagggaccugagauggucucu

SEQ ID NO: 161992 - RNA, 22 nt, Human
cugugcauugucuugucuguag

SEQ ID NO: 161993 - RNA, 22 nt, Human
gccaggcagauaugugagcuua

SEQ ID NO: 161994 - RNA, 22 nt, Human
ucaugacaacuauauuauucca

SEQ ID NO: 161995 - RNA, 22 nt, Human
uggcuggcgccgggcuagccac

SEQ ID NO: 161996 - RNA, 22 nt, Human
uacaaaguuugggguccucaaa

SEQ ID NO: 161997 - RNA, 22 nt, Human
aggcacugcuucuaaguaggaa

SEQ ID NO: 161998 - RNA, 22 nt, Human
uacauguaauuuucauaguaag

SEQ ID NO: 161999 - RNA, 22 nt, Human
uggcagcuccuggggccagcac

SEQ ID NO: 162000 - RNA, 22 nt, Human
gcuguccugggaacaggcacua

SEQ ID NO: 162001 - RNA, 18 nt, Human
ucaagacaucaugaaaua

SEQ ID NO: 162002 - RNA, 22 nt, Human
agugugugcaugcauucgugca

SEQ ID NO: 162003 - RNA, 18 nt, Human
ccagagcuggcuccucgc

SEQ ID NO: 162004 - RNA, 22 nt, Human
ggcccugggaugcucagcagug

SEQ ID NO: 162005 - RNA, 22 nt, Human
cugcccugugaggguccuuggg

SEQ ID NO: 162006 - RNA, 22 nt, Human
agggagacacaugaggaaguca

SEQ ID NO: 162007 - RNA, 22 nt, Human
uaggcagggauuaggguugauu

SEQ ID NO: 162008 - RNA, 22 nt, Human
cagucccagacccagaaggugg

SEQ ID NO: 162009 - RNA, 21 nt, Human
ccucuggcuugugcugugccc

SEQ ID NO: 162010 - RNA, 22 nt, Human
gugggacucuucuuuggcagug

SEQ ID NO: 162011 - RNA, 22 nt, Human
agagugaaguaauuguuaggau

SEQ ID NO: 162012 - RNA, 20 nt, Human
ccuaggcaugcugagucucc

SEQ ID NO: 162013 - RNA, 22 nt, Human
cuggccagacuacacaugugug

SEQ ID NO: 162014 - RNA, 22 nt, Human
uuccaaaggaauggggagcuau

SEQ ID NO: 162015 - RNA, 22 nt, Human
uggcagggugccaguugcgagu

SEQ ID NO: 162016 - RNA, 22 nt, Human
guggagccaggaucuccgcaca

SEQ ID NO: 162017 - RNA, 22 nt, Human
aggccuggccuuuauguucaag

SEQ ID NO: 162018 - RNA, 22 nt, Human
gugcccugguccccagcauaua

SEQ ID NO: 162019 - RNA, 22 nt, Human
cuggagcauccaugcccagggu

SEQ ID NO: 162020 - RNA, 22 nt, Human
cucaccaggaacagcugcggag

SEQ ID NO: 162021 - RNA, 22 nt, Human
gcccagcaggacagagugguuu

SEQ ID NO: 162022 - RNA, 22 nt, Human
gggcuuggcacaugggcucagc

SEQ ID NO: 162023 - RNA, 22 nt, Human
cugaggcucccucgggucugcu

SEQ ID NO: 162024 - RNA, 22 nt, Human
gaugguuugguaaaaguauguu

SEQ ID NO: 162025 - RNA, 22 nt, Human
uccauuuucaucucauguauaa

SEQ ID NO: 162026 - RNA, 22 nt, Human
gcuccugucuuggggcacuggc

SEQ ID NO: 162027 - RNA, 22 nt, Human
cguguacagucuaucuuuuuuc

SEQ ID NO: 162028 - RNA, 22 nt, Human
ggcuccucucuggccgcucccg

SEQ ID NO: 162029 - RNA, 20 nt, Human
uucaggauucuagaccacac

SEQ ID NO: 162030 - RNA, 22 nt, Human
uucaaucauuuuuacauagucc

SEQ ID NO: 162031 - RNA, 19 nt, Human
cagcugcaccgugaccauc

SEQ ID NO: 162032 - RNA, 22 nt, Human
gauggcagguaguggucucauc

SEQ ID NO: 162033 - RNA, 18 nt, Human
gcccugguggagcuggug

SEQ ID NO: 162034 - RNA, 18 nt, Human
cucucuggucuggauccc

SEQ ID NO: 162035 - RNA, 22 nt, Human
ccaaggagaaugacaccaugga

SEQ ID NO: 162036 - RNA, 22 nt, Human
ucucagagaagugaugagcaau

SEQ ID NO: 162037 - RNA, 22 nt, Human
ugagagucucagaccuccuggu

SEQ ID NO: 162038 - RNA, 22 nt, Human
uggacagguugaguaggaggag

SEQ ID NO: 162039 - RNA, 22 nt, Human
ggacagaggguugacagaguau

SEQ ID NO: 162040 - RNA, 22 nt, Human
ggcuuccuuucacuacccucag

SEQ ID NO: 162041 - RNA, 19 nt, Human
ccuggguccacucagacua

SEQ ID NO: 162042 - RNA, 21 nt, Human
acagagccgggcacaaagcug

SEQ ID NO: 162043 - RNA, 22 nt, Human
cacaggaggaggccagagcgua

SEQ ID NO: 162044 - RNA, 22 nt, Human
gcagggacugugaucucacaga

SEQ ID NO: 162045 - RNA, 22 nt, Human
gcaggagagccagcaggcuucc

SEQ ID NO: 162046 - RNA, 17 nt, Human
ggcagcugccacuuuuu

SEQ ID NO: 162047 - RNA, 19 nt, Human
cgcaggagccgaggugacc

SEQ ID NO: 162048 - RNA, 21 nt, Human
ugcuuuaugggaaaaauguca

SEQ ID NO: 162049 - RNA, 22 nt, Human
gcccaugcacuuucugugaugg

SEQ ID NO: 162050 - RNA, 22 nt, Human
cagauaaaggcuuacuaguagu

SEQ ID NO: 162051 - RNA, 22 nt, Human
cagggagggacaauugucaccu

SEQ ID NO: 162052 - RNA, 22 nt, Human
cuauugaauuaacuauuaaagu

SEQ ID NO: 162053 - RNA, 22 nt, Human
cagccugcuagggcaaugccuu

SEQ ID NO: 162054 - RNA, 22 nt, Human
ucuggcuccuggcuccacugcc

SEQ ID NO: 162055 - RNA, 17 nt, Human
acagagguuauacagac

SEQ ID NO: 162056 - RNA, 20 nt, Human
ucugaggcugagcucuacuu

SEQ ID NO: 162057 - RNA, 22 nt, Human
aaggagagagcuuugcuggaac

SEQ ID NO: 162058 - RNA, 22 nt, Human
acagcugggugcugcucagagc

SEQ ID NO: 162059 - RNA, 22 nt, Human
gggagggaggugcugguucacg

SEQ ID NO: 162060 - RNA, 22 nt, Human
agcuucuguucaucuuccaggc

SEQ ID NO: 162061 - RNA, 22 nt, Human
aaauugcaaaaguacuuuuagg

SEQ ID NO: 162062 - RNA, 22 nt, Human
ccucugggagacugcuacugag

SEQ ID NO: 162063 - RNA, 20 nt, Human
aauguauauuuuaugccagg

SEQ ID NO: 162064 - RNA, 22 nt, Human
caaggcugcugcgggucgcacc

SEQ ID NO: 162065 - RNA, 22 nt, Human
cuugaaagcuuugcgucuucua

SEQ ID NO: 162066 - RNA, 22 nt, Human
ugaagcagcaccauuuuagagc

SEQ ID NO: 162067 - RNA, 22 nt, Human
ugcagcccuuccuuccucuggg

SEQ ID NO: 162068 - RNA, 22 nt, Human
gcaggcucuucuuucugcccag

SEQ ID NO: 162069 - RNA, 18 nt, Human
gccugccuagagcuugcc

SEQ ID NO: 162070 - RNA, 22 nt, Human
auugaaaggcaaaguaggaagc

SEQ ID NO: 162071 - RNA, 22 nt, Human
caguuucuguuuuaaauagcag

SEQ ID NO: 162072 - RNA, 22 nt, Human
ccugcccuagagaugacacaau

SEQ ID NO: 162073 - RNA, 22 nt, Human
aagggagacaguugugugagga

SEQ ID NO: 162074 - RNA, 22 nt, Human
ucucucagcuuugagaccugcu

SEQ ID NO: 162075 - RNA, 22 nt, Human
aggcccagggcugcucucugaa

SEQ ID NO: 162076 - RNA, 22 nt, Human
ucaccuuagcuagaggaagaga

SEQ ID NO: 162077 - RNA, 22 nt, Human
uggcucugaccagguagaggag

SEQ ID NO: 162078 - RNA, 22 nt, Human
ugucucugaacagcuuacuaaa

SEQ ID NO: 162079 - RNA, 22 nt, Human
ccugcaggggagagacuucuag

SEQ ID NO: 162080 - RNA, 22 nt, Human
gcagcugauggaaguccuauug

SEQ ID NO: 162081 - RNA, 22 nt, Human
cagggagaagucuggucagucc

SEQ ID NO: 162082 - RNA, 22 nt, Human
cccagccuggugcacugugggg

SEQ ID NO: 162083 - RNA, 22 nt, Human
uuagaaaugauuucaccucuuu

SEQ ID NO: 162084 - RNA, 23 nt, Human
ggaguuggauuguacuugcugcu

SEQ ID NO: 162085 - RNA, 20 nt, Human
uacuugaauguugcagcagu

SEQ ID NO: 162086 - RNA, 22 nt, Human
uggggcuguccuuagucugaga

SEQ ID NO: 162087 - RNA, 22 nt, Human
gaagagcuuagacagaaucaaa

SEQ ID NO: 162088 - RNA, 19 nt, Human
cugaagucuuuucagcugg

SEQ ID NO: 162089 - RNA, 22 nt, Human
agauggguaacuggagucugcu

SEQ ID NO: 162090 - RNA, 21 nt, Human
ccagaggccucucuuggccac

SEQ ID NO: 162091 - RNA, 22 nt, Human
gcucaggagcucuugguggcgc

SEQ ID NO: 162092 - RNA, 18 nt, Human
uggcucugcagccagaug

SEQ ID NO: 162093 - RNA, 22 nt, Human
cccagcucucucaguucugcuu

SEQ ID NO: 162094 - RNA, 22 nt, Human
guagaagugaugucauguuaua

SEQ ID NO: 162095 - RNA, 22 nt, Human
auaguaacuggcauguuuauga

SEQ ID NO: 162096 - RNA, 22 nt, Human
ccaggaagccucagaugcugag

SEQ ID NO: 162097 - RNA, 22 nt, Human
ggcaggcuggcuuuguuccagg

SEQ ID NO: 162098 - RNA, 21 nt, Human
uagagaaaagaagcuguuccu

SEQ ID NO: 162099 - RNA, 22 nt, Human
uguguacaggccuugcuagacu

SEQ ID NO: 162100 - RNA, 22 nt, Human
gcagcuggacccacacggcuua

SEQ ID NO: 162101 - RNA, 20 nt, Human
agguggcuccugcugggggu

SEQ ID NO: 162102 - RNA, 22 nt, Human
agggucugacaaugugacuuag

SEQ ID NO: 162103 - RNA, 22 nt, Human
guaaaguucuauuugaauuuag

SEQ ID NO: 162104 - RNA, 22 nt, Human
caugucuggguauaugcauaug

SEQ ID NO: 162105 - RNA, 22 nt, Human
ccugggcaucucaugcaccugc

SEQ ID NO: 162106 - RNA, 21 nt, Human
gacaggggaagaagcaaggag

SEQ ID NO: 162107 - RNA, 22 nt, Human
cacagcagaaaguguaggagga

SEQ ID NO: 162108 - RNA, 22 nt, Human
uauucacaggcuggagugaugu

SEQ ID NO: 162109 - RNA, 22 nt, Human
auaaguucagguaaagaaauca

SEQ ID NO: 162110 - RNA, 22 nt, Human
caggagcugggucuggaagcag

SEQ ID NO: 162111 - RNA, 22 nt, Human
acuuugcaaugggcagaaccca

SEQ ID NO: 162112 - RNA, 22 nt, Human
agguuauaugucauacugaagu

SEQ ID NO: 162113 - RNA, 22 nt, Human
cuguacaucucugaggacagua

SEQ ID NO: 162114 - RNA, 22 nt, Human
aagagcuggagcugcuacagga

SEQ ID NO: 162115 - RNA, 22 nt, Human
uccuuuccagccucaccucagc

SEQ ID NO: 162116 - RNA, 22 nt, Human
uccugucagugaggcagaugaa

SEQ ID NO: 162117 - RNA, 22 nt, Human
uuccuuguuuguagcucuggga

SEQ ID NO: 162118 - RNA, 22 nt, Human
gagcuggugaucagcuggagga

SEQ ID NO: 162119 - RNA, 22 nt, Human
ucggagcuguagaugaaacccu

SEQ ID NO: 162120 - RNA, 22 nt, Human
ugcaggugccucuugagcuugu

SEQ ID NO: 162121 - RNA, 22 nt, Human
auaugccauuagcuagaaauaa

SEQ ID NO: 162122 - RNA, 22 nt, Human
aaaagaggagugguuuaugaca

SEQ ID NO: 162123 - RNA, 21 nt, Human
ggucuuccaaauaaggagaaa

SEQ ID NO: 162124 - RNA, 22 nt, Human
ggagauagacuuggugagccac

SEQ ID NO: 162125 - RNA, 22 nt, Human
gcuggcauuacaggagagaacc

SEQ ID NO: 162126 - RNA, 19 nt, Human
ccaguagagacagcugcag

SEQ ID NO: 162127 - RNA, 21 nt, Human
uccaggaguggcugggcaggg

SEQ ID NO: 162128 - RNA, 22 nt, Human
gagggcugaugcuuacuuauuu

SEQ ID NO: 162129 - RNA, 21 nt, Human
guggcccugccgcagugucca

SEQ ID NO: 162130 - RNA, 22 nt, Human
uguggccuccccacuucugggg

SEQ ID NO: 162131 - RNA, 22 nt, Human
uagggcagaguccaggaugggc

SEQ ID NO: 162132 - RNA, 22 nt, Human
gccagagcugagugagguucuu

SEQ ID NO: 162133 - RNA, 22 nt, Human
cuacauuuugugauuaugaaau

SEQ ID NO: 162134 - RNA, 22 nt, Human
uggaaagacauucagccgcugg

SEQ ID NO: 162135 - RNA, 22 nt, Human
ugccacccagccaggaguggga

SEQ ID NO: 162136 - RNA, 22 nt, Human
ucccagagucagagguggggcc

SEQ ID NO: 162137 - RNA, 22 nt, Human
ggcacugaucugauuucccucc

SEQ ID NO: 162138 - RNA, 22 nt, Human
aggucauuccagccauuccccu

SEQ ID NO: 162139 - RNA, 22 nt, Human
ccagcuugaagaugugcugguu

SEQ ID NO: 162140 - RNA, 22 nt, Human
aggaccugacuggcuccugcuu

SEQ ID NO: 162141 - RNA, 22 nt, Human
ccagggcacuuaggcccagccc

SEQ ID NO: 162142 - RNA, 22 nt, Human
cagcauuggguuaccuuuguuu

SEQ ID NO: 162143 - RNA, 22 nt, Human
uucacagggccacuggcaggag

SEQ ID NO: 162144 - RNA, 20 nt, Human
cagcugccuggcucugggau

SEQ ID NO: 162145 - RNA, 22 nt, Human
auuuaaaugcuuaagaggguuu

SEQ ID NO: 162146 - RNA, 20 nt, Human
auaaaauaacugccacaaga

SEQ ID NO: 162147 - RNA, 22 nt, Human
cuucuugcaauuuucaucuuau

SEQ ID NO: 162148 - RNA, 22 nt, Human
cauugcacucuggcuggaacgg

SEQ ID NO: 162149 - RNA, 21 nt, Human
aggucccagguuugggcagca

SEQ ID NO: 162150 - RNA, 22 nt, Human
cacagaauaaauugguaucaga

SEQ ID NO: 162151 - RNA, 22 nt, Human
ccugucugaaggcagggggaug

SEQ ID NO: 162152 - RNA, 22 nt, Human
ucugucugcucauuuaccucag

SEQ ID NO: 162153 - RNA, 22 nt, Human
gaagcccaggcuuccuuggcuu

SEQ ID NO: 162154 - RNA, 22 nt, Human
cacaagagagugcgcguugcaa

SEQ ID NO: 162155 - RNA, 22 nt, Human
acagggcagguggcuacugguc

SEQ ID NO: 162156 - RNA, 22 nt, Human
cauugaaaaacguugacugagu

SEQ ID NO: 162157 - RNA, 22 nt, Human
ggcuggagauaugucuggaaca

SEQ ID NO: 162158 - RNA, 22 nt, Human
uacuuuuagccuauuugauucu

SEQ ID NO: 162159 - RNA, 22 nt, Human
ccagucacagguguguuuauau

SEQ ID NO: 162160 - RNA, 22 nt, Human
accucaggauguggacacagaa

SEQ ID NO: 162161 - RNA, 22 nt, Human
ucagagugcagggaguagcagc

SEQ ID NO: 162162 - RNA, 22 nt, Human
cuggggaggcagggcugccccu

SEQ ID NO: 162163 - RNA, 22 nt, Human
ucuagaaacaugacauugaucu

SEQ ID NO: 162164 - RNA, 22 nt, Human
gggcucugguacuuccuggcuc

SEQ ID NO: 162165 - RNA, 22 nt, Human
ccaggccauucccagaguugcu

SEQ ID NO: 162166 - RNA, 22 nt, Human
aacaggagaguaaauauaugau

SEQ ID NO: 162167 - RNA, 19 nt, Human
cuugguuaugguaugaugc

SEQ ID NO: 162168 - RNA, 22 nt, Human
auuguggcuagacagucacaau

SEQ ID NO: 162169 - RNA, 22 nt, Human
ugauuuccccagucuugcugcu

SEQ ID NO: 162170 - RNA, 22 nt, Human
uggucucuucuuccaagauggc

SEQ ID NO: 162171 - RNA, 22 nt, Human
augcacuugcguguuugcaaau

SEQ ID NO: 162172 - RNA, 22 nt, Human
agcucccaauugacuugaacua

SEQ ID NO: 162173 - RNA, 22 nt, Human
ucagaggaaaggucagauggcu

SEQ ID NO: 162174 - RNA, 22 nt, Human
aaaguguugauaugugacaucc

SEQ ID NO: 162175 - RNA, 22 nt, Human
aaucacaauuacuuuugcacca

SEQ ID NO: 162176 - RNA, 23 nt, Human
aggaacugaggccuagggaggua

SEQ ID NO: 162177 - RNA, 22 nt, Human
ucagagcugcccaugcaagggg

SEQ ID NO: 162178 - RNA, 22 nt, Human
ugggcuggcccaccacaccucg

SEQ ID NO: 162179 - RNA, 21 nt, Human
cagaggcagguccugggacgg

SEQ ID NO: 162180 - RNA, 20 nt, Human
cugcugugugugccucagcc

SEQ ID NO: 162181 - RNA, 22 nt, Human
aaucuggcauuugagaguagga

SEQ ID NO: 162182 - RNA, 22 nt, Human
gccaggcuguggggaacuugaa

SEQ ID NO: 162183 - RNA, 22 nt, Human
uaugaagauauaucugaucucu

SEQ ID NO: 162184 - RNA, 22 nt, Human
auagaaauggcagcuggugcua

SEQ ID NO: 162185 - RNA, 21 nt, Human
acagggcaugcagcuggcugu

SEQ ID NO: 162186 - RNA, 18 nt, Human
gucaccuggaucagauua

SEQ ID NO: 162187 - RNA, 22 nt, Human
gcugccuucaguucugauucau

SEQ ID NO: 162188 - RNA, 22 nt, Human
gggcagagguucaacuucaaca

SEQ ID NO: 162189 - RNA, 22 nt, Human
gccuuugcaccaucagugcaau

SEQ ID NO: 162190 - RNA, 18 nt, Human
ugugguggagcugccuuc

SEQ ID NO: 162191 - RNA, 22 nt, Human
ugcuggggucauggggcgcccg

SEQ ID NO: 162192 - RNA, 18 nt, Human
cucucugggugaggacaa

SEQ ID NO: 162193 - RNA, 22 nt, Human
cuuuggaagugaccacaauccu

SEQ ID NO: 162194 - RNA, 20 nt, Human
ccagucccugagcaccaggg

SEQ ID NO: 162195 - RNA, 22 nt, Human
cuccagggagcugcgggagcca

SEQ ID NO: 162196 - RNA, 22 nt, Human
gggcugugcugaguaggaggug

SEQ ID NO: 162197 - RNA, 22 nt, Human
cacucaggcugugucaggagga

SEQ ID NO: 162198 - RNA, 22 nt, Human
ccugccagucacuaugucaccu

SEQ ID NO: 162199 - RNA, 22 nt, Human
aggcuauuuccacucuucucau

SEQ ID NO: 162200 - RNA, 22 nt, Human
ccucagggaggccucuguggcu

SEQ ID NO: 162201 - RNA, 20 nt, Human
ccugccuguguuugugauga

SEQ ID NO: 162202 - RNA, 22 nt, Human
guaagcaucugucucuucugca

SEQ ID NO: 162203 - RNA, 22 nt, Human
gcagagccaggagcccaggauc

SEQ ID NO: 162204 - RNA, 22 nt, Human
uggcuuucucccccagcuucuc

SEQ ID NO: 162205 - RNA, 22 nt, Human
gucauuucuguuucuucagugc

SEQ ID NO: 162206 - RNA, 22 nt, Human
acucugaggagugacuagaggu

SEQ ID NO: 162207 - RNA, 22 nt, Human
uggcagcacuugaacuugagcc

SEQ ID NO: 162208 - RNA, 22 nt, Human
cagcaggguauacagggaauuu

SEQ ID NO: 162209 - RNA, 22 nt, Human
uacauuugcuuugauuuucagc

SEQ ID NO: 162210 - RNA, 22 nt, Human
uuucaguggguuuauuucaugu

SEQ ID NO: 162211 - RNA, 22 nt, Human
aagccagcauuuucccauuccu

SEQ ID NO: 162212 - RNA, 22 nt, Human
gaggagggagcuggaagcucuu

SEQ ID NO: 162213 - RNA, 22 nt, Human
cagcaggcugcgauugcucauu

SEQ ID NO: 162214 - RNA, 22 nt, Human
gcugucugcaagccaggaaaug

SEQ ID NO: 162215 - RNA, 22 nt, Human
aagcagccuggacuugggcugg

SEQ ID NO: 162216 - RNA, 22 nt, Human
ccaggcauccauugcuuccucu

SEQ ID NO: 162217 - RNA, 22 nt, Human
aacuagaacgucuaguugcugg

SEQ ID NO: 162218 - RNA, 22 nt, Human
gggagggaaggaccuuaugaau

SEQ ID NO: 162219 - RNA, 22 nt, Human
agcugggucuugggccaggaga

SEQ ID NO: 162220 - RNA, 22 nt, Human
guuugcauaucugugaaaugga

SEQ ID NO: 162221 - RNA, 22 nt, Human
agccccaguaagggagggccug

SEQ ID NO: 162222 - RNA, 21 nt, Human
ucagggcagcugcucuucaga

SEQ ID NO: 162223 - RNA, 22 nt, Human
ucaacagaagugauagcuauua

SEQ ID NO: 162224 - RNA, 22 nt, Human
aggcuucuacguggucccaggg

SEQ ID NO: 162225 - RNA, 22 nt, Human
cccaggagguggagguugcagu

SEQ ID NO: 162226 - RNA, 22 nt, Human
ugaugggaaaaugaggccuggg

SEQ ID NO: 162227 - RNA, 22 nt, Human
aaaagacauaugugggcauucu

SEQ ID NO: 162228 - RNA, 22 nt, Human
uggggcugucccgguuuggcga

SEQ ID NO: 162229 - RNA, 22 nt, Human
agauuucagguuggggcagaag

SEQ ID NO: 162230 - RNA, 22 nt, Human
aaaguuuccugcuaagugcuau

SEQ ID NO: 162231 - RNA, 21 nt, Human
gcucuuggaaggggcucagcu

SEQ ID NO: 162232 - RNA, 22 nt, Human
cugagauggaguuuugcucuug

SEQ ID NO: 162233 - RNA, 22 nt, Human
gccugccuuugugaggaagcgg

SEQ ID NO: 162234 - RNA, 22 nt, Human
uggcucaguuaggucagaaaca

SEQ ID NO: 162235 - RNA, 20 nt, Human
uggagccaaggugugucugg

SEQ ID NO: 162236 - RNA, 22 nt, Human
gggaaauugucaacacucucaa

SEQ ID NO: 162237 - RNA, 22 nt, Human
ccagcagcucccucaggguccg

SEQ ID NO: 162238 - RNA, 22 nt, Human
agggucccgaaggagacagcaa

SEQ ID NO: 162239 - RNA, 22 nt, Human
ucccuggguccugcuugcucuc

SEQ ID NO: 162240 - RNA, 23 nt, Human
ucuuuccucagcacacaccaaga

SEQ ID NO: 162241 - RNA, 22 nt, Human
ggggcugggauuugaacccagg

SEQ ID NO: 162242 - RNA, 22 nt, Human
gcugaagagagaugcguccagc

SEQ ID NO: 162243 - RNA, 19 nt, Human
ucaaagcaagcauguucug

SEQ ID NO: 162244 - RNA, 22 nt, Human
aucaauucuuaggaaaauagcu

SEQ ID NO: 162245 - RNA, 22 nt, Human
ggccugcuucucagugagcuug

SEQ ID NO: 162246 - RNA, 22 nt, Human
ggugaggcagguggcugcugag

SEQ ID NO: 162247 - RNA, 22 nt, Human
ccaaggaggccccaggucagcu

SEQ ID NO: 162248 - RNA, 22 nt, Human
ccugaagagcacucuagaguug

SEQ ID NO: 162249 - RNA, 22 nt, Human
auguaguguagagauuagucuc

SEQ ID NO: 162250 - RNA, 22 nt, Human
aaugagcuagaccugcuuccuc

SEQ ID NO: 162251 - RNA, 22 nt, Human
gagggcaggggucuugcacggu

SEQ ID NO: 162252 - RNA, 22 nt, Human
gucccagaugucuggaacuccc

SEQ ID NO: 162253 - RNA, 22 nt, Human
uuugcauuuguuuagaaccuga

SEQ ID NO: 162254 - RNA, 22 nt, Human
agcaguggaccucagugcuauu

SEQ ID NO: 162255 - RNA, 22 nt, Human
ccaggcugagcaugauuggagc

SEQ ID NO: 162256 - RNA, 17 nt, Human
agcagcuggguugaucu

SEQ ID NO: 162257 - RNA, 22 nt, Human
ucugagccguauggcuuggcua

SEQ ID NO: 162258 - RNA, 22 nt, Human
acagaaugcguagugcauguug

SEQ ID NO: 162259 - RNA, 23 nt, Human
acagagguccaaacaguauaagc

SEQ ID NO: 162260 - RNA, 22 nt, Human
ggagaagggacagacucagcuu

SEQ ID NO: 162261 - RNA, 22 nt, Human
gcaggcagucaucuuucauauu

SEQ ID NO: 162262 - RNA, 22 nt, Human
gggcuacagacaugcucuaagc

SEQ ID NO: 162263 - RNA, 22 nt, Human
uucagagccacuucaagucuaa

SEQ ID NO: 162264 - RNA, 22 nt, Human
auuuguaauuucuuaucugugu

SEQ ID NO: 162265 - RNA, 22 nt, Human
aggcagaggagaaugaucuucc

SEQ ID NO: 162266 - RNA, 22 nt, Human
gagucacauuaauuuaauuuua

SEQ ID NO: 162267 - RNA, 21 nt, Human
ucugucugguuuuagaguggc

SEQ ID NO: 162268 - RNA, 22 nt, Human
gcugucuguggugucagcugac

SEQ ID NO: 162269 - RNA, 22 nt, Human
cagggagcuggcuggcgugagu

SEQ ID NO: 162270 - RNA, 22 nt, Human
agaauaguggcaaugacugcac

SEQ ID NO: 162271 - RNA, 22 nt, Human
ccagcagcuguggcuuugccuc

SEQ ID NO: 162272 - RNA, 22 nt, Human
aggagcagaccguaguccugca

SEQ ID NO: 162273 - RNA, 22 nt, Human
agugugaccuuauuuggaaaca

SEQ ID NO: 162274 - RNA, 22 nt, Human
aaaugcauugguuucuacuugu

SEQ ID NO: 162275 - RNA, 22 nt, Human
cuggugggaggcaagguggaag

SEQ ID NO: 162276 - RNA, 22 nt, Human
ggcauggcuggguucuggugag

SEQ ID NO: 162277 - RNA, 22 nt, Human
gccaggcuggccagcaccuucu

SEQ ID NO: 162278 - RNA, 22 nt, Human
agcugccacugagggugcacag

SEQ ID NO: 162279 - RNA, 21 nt, Human
cugugcuuuuuaagugugaug

SEQ ID NO: 162280 - RNA, 22 nt, Human
ccagcuccaggacugggagcug

SEQ ID NO: 162281 - RNA, 22 nt, Human
cccuggagggauuucucaauca

SEQ ID NO: 162282 - RNA, 22 nt, Human
cuggcugcuuguagacucgacu

SEQ ID NO: 162283 - RNA, 23 nt, Human
gccucagagaaacagcugcacac

SEQ ID NO: 162284 - RNA, 22 nt, Human
cuggccucauagccaagcugug

SEQ ID NO: 162285 - RNA, 22 nt, Human
caggggcaggugugagaucauc

SEQ ID NO: 162286 - RNA, 22 nt, Human
ugcagugccucggcagugcagc

SEQ ID NO: 162287 - RNA, 22 nt, Human
aggcaucugaguuugcaagcuu

SEQ ID NO: 162288 - RNA, 22 nt, Human
ccagccaggcauugcaaacuga

SEQ ID NO: 162289 - RNA, 23 nt, Human
ugcagccacucaggagcucagug

SEQ ID NO: 162290 - RNA, 22 nt, Human
uguaugcaccauuguauuaccu

SEQ ID NO: 162291 - RNA, 22 nt, Human
aacccuggggcagcugcuaggg

SEQ ID NO: 162292 - RNA, 20 nt, Human
ugagugauggaggcggguca

SEQ ID NO: 162293 - RNA, 22 nt, Human
aggucauuaaaguuaaaugagg

SEQ ID NO: 162294 - RNA, 22 nt, Human
agggaguguaaauggugcucag

SEQ ID NO: 162295 - RNA, 22 nt, Human
uuucacaauuuuaaggagcaaa

SEQ ID NO: 162296 - RNA, 22 nt, Human
ugagcugggcugggcugagcug

SEQ ID NO: 162297 - RNA, 22 nt, Human
ugcaggcuuuagccccauggcu

SEQ ID NO: 162298 - RNA, 22 nt, Human
gagacacacacaggagguggca

SEQ ID NO: 162299 - RNA, 22 nt, Human
gucaaacaaauuaacauaucca

SEQ ID NO: 162300 - RNA, 22 nt, Human
ggcagugaaaaaguauguuucc

SEQ ID NO: 162301 - RNA, 22 nt, Human
uuguuuguaugcugagaagaau

SEQ ID NO: 162302 - RNA, 22 nt, Human
ggcagcagaacuggcccuguau

SEQ ID NO: 162303 - RNA, 22 nt, Human
uagcugugagcacccaggcugu

SEQ ID NO: 162304 - RNA, 21 nt, Human
uggcagaguugaguaguuaug

SEQ ID NO: 162305 - RNA, 20 nt, Human
gauuucaaagcagaguggcc

SEQ ID NO: 162306 - RNA, 22 nt, Human
cuuccugcaggacagccaucug

SEQ ID NO: 162307 - RNA, 22 nt, Human
ugcagcugguuuagaacuagau

SEQ ID NO: 162308 - RNA, 22 nt, Human
ucccagccuuccagucugguuu

SEQ ID NO: 162309 - RNA, 22 nt, Human
agggcagagcacugaauuggga

SEQ ID NO: 162310 - RNA, 22 nt, Human
gaagcagcuggugagauggagc

SEQ ID NO: 162311 - RNA, 22 nt, Human
agaaauguauucuguauguuuu

SEQ ID NO: 162312 - RNA, 22 nt, Human
gcagaagcugggcagcgaggug

SEQ ID NO: 162313 - RNA, 22 nt, Human
uggccugcagcucucagggaag

SEQ ID NO: 162314 - RNA, 22 nt, Human
cagcugagcaucacuagucugg

SEQ ID NO: 162315 - RNA, 22 nt, Human
acaaaugcagcauaaagugaac

SEQ ID NO: 162316 - RNA, 20 nt, Human
cucucuggaaggugggagcc

SEQ ID NO: 162317 - RNA, 22 nt, Human
uauguacaugauuucauuugcu

SEQ ID NO: 162318 - RNA, 22 nt, Human
uuacugaaaauucuucaggauu

SEQ ID NO: 162319 - RNA, 22 nt, Human
augccuggacugacaugcacug

SEQ ID NO: 162320 - RNA, 22 nt, Human
agguggaacguucaggugcuag

SEQ ID NO: 162321 - RNA, 22 nt, Human
gaaaugugcagaauguguuaga

SEQ ID NO: 162322 - RNA, 22 nt, Human
gugcagugagcagugcagcacc

SEQ ID NO: 162323 - RNA, 22 nt, Human
gagaaccucuccacaagucugg

SEQ ID NO: 162324 - RNA, 22 nt, Human
gucuugaucuccugaccuugug

SEQ ID NO: 162325 - RNA, 22 nt, Human
auaaggcagaaaugauucuagu

SEQ ID NO: 162326 - RNA, 22 nt, Human
ucucagaggucuucagccucug

SEQ ID NO: 162327 - RNA, 22 nt, Human
agaaagcacucugucuuuuacc

SEQ ID NO: 162328 - RNA, 22 nt, Human
cuccuggacauggagcggagga

SEQ ID NO: 162329 - RNA, 22 nt, Human
ucuuccucuagaucugaggccc

SEQ ID NO: 162330 - RNA, 22 nt, Human
gaaaggugccccauaggcagga

SEQ ID NO: 162331 - RNA, 22 nt, Human
auaucuuuguuuuugccaagau

SEQ ID NO: 162332 - RNA, 22 nt, Human
cuucuggggauggagcccagaa

SEQ ID NO: 162333 - RNA, 22 nt, Human
ugaaggugucuuugugaacauc

SEQ ID NO: 162334 - RNA, 22 nt, Human
ugggcagaaaucaguaucagau

SEQ ID NO: 162335 - RNA, 22 nt, Human
ccagcagagcauggggaggaag

SEQ ID NO: 162336 - RNA, 22 nt, Human
ucucuggguuuuuguccuguac

SEQ ID NO: 162337 - RNA, 22 nt, Human
ugacacaggcagcucccagcac

SEQ ID NO: 162338 - RNA, 22 nt, Human
ggcacugaaccaggacacaagc

SEQ ID NO: 162339 - RNA, 22 nt, Human
gaaaugugggucaugacccauu

SEQ ID NO: 162340 - RNA, 22 nt, Human
gaguggggcccacugcugggug

SEQ ID NO: 162341 - RNA, 22 nt, Human
ugccuguccugaggaugagggu

SEQ ID NO: 162342 - RNA, 22 nt, Human
gcagugaaacaauaggaucaaa

SEQ ID NO: 162343 - RNA, 22 nt, Human
gaggcaggguguugauuacaga

SEQ ID NO: 162344 - RNA, 22 nt, Human
uggccugucuuguugugcuaga

SEQ ID NO: 162345 - RNA, 17 nt, Human
uugggagagaaagguau

SEQ ID NO: 162346 - RNA, 22 nt, Human
ucccaagugucuuggaccaggg

SEQ ID NO: 162347 - RNA, 22 nt, Human
ugcauauuauguguaucugucu

SEQ ID NO: 162348 - RNA, 22 nt, Human
gcacuaaaccaacauguaauaa

SEQ ID NO: 162349 - RNA, 22 nt, Human
uggugcuguggaggggcagaag

SEQ ID NO: 162350 - RNA, 22 nt, Human
gcugggagcaaguacucaucuu

SEQ ID NO: 162351 - RNA, 22 nt, Human
uggcagcaauuugugauguuga

SEQ ID NO: 162352 - RNA, 22 nt, Human
uguacaaugccagggaacacca

SEQ ID NO: 162353 - RNA, 22 nt, Human
ugcacuggggucccagcgcacg

SEQ ID NO: 162354 - RNA, 22 nt, Human
cugccacuagcuuucacaucuu

SEQ ID NO: 162355 - RNA, 22 nt, Human
uggagccuguguuucugcccag

SEQ ID NO: 162356 - RNA, 22 nt, Human
cccaagcagggugcagaggcau

SEQ ID NO: 162357 - RNA, 22 nt, Human
aggugauguccacagcuugcag

SEQ ID NO: 162358 - RNA, 22 nt, Human
acacugcagaugaaagcauaag

SEQ ID NO: 162359 - RNA, 22 nt, Human
aaguuauugcagcaauccaagu

SEQ ID NO: 162360 - RNA, 22 nt, Human
aagagggcugcaaucuuauugc

SEQ ID NO: 162361 - RNA, 19 nt, Human
ugaagcaggcagagaagau

SEQ ID NO: 162362 - RNA, 22 nt, Human
aucuggcucucucauuuacaaa

SEQ ID NO: 162363 - RNA, 22 nt, Human
gcagggcugcagagggcacugu

SEQ ID NO: 162364 - RNA, 22 nt, Human
caaagugcuaggauuacaggcc

SEQ ID NO: 162365 - RNA, 22 nt, Human
cagcagcaaaucuagaagagga

SEQ ID NO: 162366 - RNA, 20 nt, Human
aggagaugauccagagucag

SEQ ID NO: 162367 - RNA, 22 nt, Human
uccucaggcugccuggaagacu

SEQ ID NO: 162368 - RNA, 22 nt, Human
ugauuuccacgugcacccaggu

SEQ ID NO: 162369 - RNA, 22 nt, Human
cucuggaguuagugaucugggc

SEQ ID NO: 162370 - RNA, 22 nt, Human
uaaauguguuagucaugguuuu

SEQ ID NO: 162371 - RNA, 22 nt, Human
uaugcacacauuagcacagggu

SEQ ID NO: 162372 - RNA, 23 nt, Human
cagggcugggcuugguguuaggc

SEQ ID NO: 162373 - RNA, 22 nt, Human
caguagcauguaauaaagacag

SEQ ID NO: 162374 - RNA, 22 nt, Human
gcucccagcauugcugcugaau

SEQ ID NO: 162375 - RNA, 22 nt, Human
ucaggcacugcuuucugauaug

SEQ ID NO: 162376 - RNA, 22 nt, Human
cucuugaagcaggggccaguuc

SEQ ID NO: 162377 - RNA, 22 nt, Human
ucauugcagacuaacaaucuca

SEQ ID NO: 162378 - RNA, 22 nt, Human
cccccaaggccaggcugagacc

SEQ ID NO: 162379 - RNA, 22 nt, Human
cacucugagaaguacaagcucc

SEQ ID NO: 162380 - RNA, 18 nt, Human
ggcugccuguuccugaag

SEQ ID NO: 162381 - RNA, 22 nt, Human
agucccagcuucccccaugcag

SEQ ID NO: 162382 - RNA, 22 nt, Human
ugcacacacgcggcacaucugu

SEQ ID NO: 162383 - RNA, 22 nt, Human
gugucccaggccucuggaauua

SEQ ID NO: 162384 - RNA, 22 nt, Human
gcugucuugcucacucuugcag

SEQ ID NO: 162385 - RNA, 22 nt, Human
uccuugaagagugggcggucga

SEQ ID NO: 162386 - RNA, 20 nt, Human
cagccuccacucacucagcu

SEQ ID NO: 162387 - RNA, 22 nt, Human
gagcagaacaggccggguggga

SEQ ID NO: 162388 - RNA, 22 nt, Human
cacauuuaauccuuuauaagua

SEQ ID NO: 162389 - RNA, 22 nt, Human
caguacuuaguucucaugguuu

SEQ ID NO: 162390 - RNA, 22 nt, Human
agaagcaguuauuuuuugcaca

SEQ ID NO: 162391 - RNA, 21 nt, Human
ggggcagagcuaggcccugca

SEQ ID NO: 162392 - RNA, 22 nt, Human
gcugcagcuguaggacacaauu

SEQ ID NO: 162393 - RNA, 22 nt, Human
uaccuuggguugaguucauucu

SEQ ID NO: 162394 - RNA, 21 nt, Human
acagaugggaugagcacacug

SEQ ID NO: 162395 - RNA, 20 nt, Human
ggucccugcccucugucauc

SEQ ID NO: 162396 - RNA, 20 nt, Human
uacagaaacaggacuuuugg

SEQ ID NO: 162397 - RNA, 20 nt, Human
ugcagcuucaccugugucau

SEQ ID NO: 162398 - RNA, 22 nt, Human
accucccagcucugagcuuggg

SEQ ID NO: 162399 - RNA, 22 nt, Human
ccaggguguagggauuccagau

SEQ ID NO: 162400 - RNA, 22 nt, Human
ucaggaucggccuuuuuuuaag

SEQ ID NO: 162401 - RNA, 22 nt, Human
ucccaggaucugagggcagaga

SEQ ID NO: 162402 - RNA, 22 nt, Human
ucugcugcugagcacacuccua

SEQ ID NO: 162403 - RNA, 22 nt, Human
cuccuuccccuacucagcaucc

SEQ ID NO: 162404 - RNA, 22 nt, Human
ccuuucucuuggauaccgauug

SEQ ID NO: 162405 - RNA, 22 nt, Human
ggagccugacagugcccagcau

SEQ ID NO: 162406 - RNA, 22 nt, Human
guguccagggccguguugucuu

SEQ ID NO: 162407 - RNA, 20 nt, Human
uccagggcuagggagcucau

SEQ ID NO: 162408 - RNA, 22 nt, Human
ugaagcaacuggacaaguuggc

SEQ ID NO: 162409 - RNA, 22 nt, Human
gaguguucccacaccccaguug

SEQ ID NO: 162410 - RNA, 22 nt, Human
caucacuguccaaaguucaguu

SEQ ID NO: 162411 - RNA, 23 nt, Human
caggcaggaugaggacuacacuc

SEQ ID NO: 162412 - RNA, 22 nt, Human
uacauggugguggcacuugacu

SEQ ID NO: 162413 - RNA, 22 nt, Human
aacagcagggggaccugcuggu

SEQ ID NO: 162414 - RNA, 22 nt, Human
gcugggagccguaccugucacg

SEQ ID NO: 162415 - RNA, 22 nt, Human
accugaggcuguuagucuaggu

SEQ ID NO: 162416 - RNA, 19 nt, Human
gccugccuggguuucugag

SEQ ID NO: 162417 - RNA, 22 nt, Human
agcagccacagucugggacagg

SEQ ID NO: 162418 - RNA, 22 nt, Human
cugcucuggggaagccagaugu

SEQ ID NO: 162419 - RNA, 22 nt, Human
ucccagggucaguggugaggcc

SEQ ID NO: 162420 - RNA, 22 nt, Human
aggccugggucucgugccuacc

SEQ ID NO: 162421 - RNA, 22 nt, Human
aggagagucuugagucacuggu

SEQ ID NO: 162422 - RNA, 22 nt, Human
gcaagcugcuuaagcucauugu

SEQ ID NO: 162423 - RNA, 22 nt, Human
cugcagaggguuugagcauccu

SEQ ID NO: 162424 - RNA, 22 nt, Human
uuauguaccugaauuaguaaag

SEQ ID NO: 162425 - RNA, 22 nt, Human
ucaaaugcaggucuggucuugg

SEQ ID NO: 162426 - RNA, 22 nt, Human
ucaggaucaggggccuuuccuu

SEQ ID NO: 162427 - RNA, 22 nt, Human
uugugucugggggagugacauc

SEQ ID NO: 162428 - RNA, 22 nt, Human
ccaaaguccacaguuuacauua

SEQ ID NO: 162429 - RNA, 20 nt, Human
ucacauccucucccaacaug

SEQ ID NO: 162430 - RNA, 22 nt, Human
agugaaauugcuguaagaggaa

SEQ ID NO: 162431 - RNA, 23 nt, Human
gagguacagcaccagugaauagg

SEQ ID NO: 162432 - RNA, 22 nt, Human
ucucagagaggggccgggccuu

SEQ ID NO: 162433 - RNA, 22 nt, Human
aaauacagaguugcuuaaaagc

SEQ ID NO: 162434 - RNA, 22 nt, Human
augcaguaaaauaggagguaau

SEQ ID NO: 162435 - RNA, 22 nt, Human
agccuggacagcuacggagaac

SEQ ID NO: 162436 - RNA, 22 nt, Human
agcagccagaaauccagaggug

SEQ ID NO: 162437 - RNA, 22 nt, Human
caugccaguuuugagaugcacc

SEQ ID NO: 162438 - RNA, 22 nt, Human
auuugucuuuggaccugugaga

SEQ ID NO: 162439 - RNA, 22 nt, Human
uggcucagcugucacagccugg

SEQ ID NO: 162440 - RNA, 22 nt, Human
agagggcccauguugggcugcu

SEQ ID NO: 162441 - RNA, 22 nt, Human
gcaugguggccuuaggguagcc

SEQ ID NO: 162442 - RNA, 22 nt, Human
agccaacuaggagauuaaggua

SEQ ID NO: 162443 - RNA, 22 nt, Human
ggucucagcccucgccagcagc

SEQ ID NO: 162444 - RNA, 22 nt, Human
gguuugcauucugaaaggcuca

SEQ ID NO: 162445 - RNA, 22 nt, Human
acugugcaugaaccgaaacaaa

SEQ ID NO: 162446 - RNA, 21 nt, Human
ugggagagggcucagcuaccc

SEQ ID NO: 162447 - RNA, 22 nt, Human
auggauaagaacaaauaucuga

SEQ ID NO: 162448 - RNA, 22 nt, Human
gcugucagcgcccaaggagcuc

SEQ ID NO: 162449 - RNA, 22 nt, Human
uagagaaauaagcuuugccuug

SEQ ID NO: 162450 - RNA, 22 nt, Human
uugcucagcacuggagccagcu

SEQ ID NO: 162451 - RNA, 22 nt, Human
ggagccugugcccaagcccaga

SEQ ID NO: 162452 - RNA, 22 nt, Human
gagcuguccgccccugggccga

SEQ ID NO: 162453 - RNA, 22 nt, Human
gccugccuguuggcugaggugc

SEQ ID NO: 162454 - RNA, 22 nt, Human
ucuggccaggauggcaagacca

SEQ ID NO: 162455 - RNA, 22 nt, Human
uuuaccaagcuuuaauuacaua

SEQ ID NO: 162456 - RNA, 22 nt, Human
ccucugcucccuggugucugag

SEQ ID NO: 162457 - RNA, 22 nt, Human
gguggccuccagggcauaggug

SEQ ID NO: 162458 - RNA, 22 nt, Human
uaaggucauggugaauaauaag

SEQ ID NO: 162459 - RNA, 22 nt, Human
uuugcauugcagugguuuacag

SEQ ID NO: 162460 - RNA, 22 nt, Human
cugggagauugcuagagaugca

SEQ ID NO: 162461 - RNA, 22 nt, Human
cacaaugcguacauauaucaaa

SEQ ID NO: 162462 - RNA, 22 nt, Human
gcagggugccgacuucagggau

SEQ ID NO: 162463 - RNA, 21 nt, Human
gccagggaagagaguuggcug

SEQ ID NO: 162464 - RNA, 22 nt, Human
cugagcugcggcaggcaccugg

SEQ ID NO: 162465 - RNA, 19 nt, Human
uuggaaggagccagagugg

SEQ ID NO: 162466 - RNA, 19 nt, Human
cugugcaggccgggcugag

SEQ ID NO: 162467 - RNA, 22 nt, Human
gagaagguggaccugaaggagc

SEQ ID NO: 162468 - RNA, 22 nt, Human
ucuguaucuaauuuuacaguag

SEQ ID NO: 162469 - RNA, 22 nt, Human
aggcugcuggcaggcguggacg

SEQ ID NO: 162470 - RNA, 22 nt, Human
ccuggagccccucuggccagcc

SEQ ID NO: 162471 - RNA, 22 nt, Human
uaccuuuugcuuauuaugacac

SEQ ID NO: 162472 - RNA, 22 nt, Human
ggcuagaacuuuacacuuugca

SEQ ID NO: 162473 - RNA, 19 nt, Human
ucucagaggaaaaauugcu

SEQ ID NO: 162474 - RNA, 22 nt, Human
ugcagcucauugguguccuggu

SEQ ID NO: 162475 - RNA, 22 nt, Human
aggugagugugacugcaagaga

SEQ ID NO: 162476 - RNA, 22 nt, Human
ccucagagaaagguauggcuga

SEQ ID NO: 162477 - RNA, 22 nt, Human
aagauguaucaguuaagucuuc

SEQ ID NO: 162478 - RNA, 23 nt, Human
ggcagagagcauggcuggggccc

SEQ ID NO: 162479 - RNA, 22 nt, Human
caggcagcagccacucugguau

SEQ ID NO: 162480 - RNA, 19 nt, Human
caucuggaugauucuccug

SEQ ID NO: 162481 - RNA, 20 nt, Human
agaaucugacccagagagac

SEQ ID NO: 162482 - RNA, 22 nt, Human
gccuccuggccuuugcuccuca

SEQ ID NO: 162483 - RNA, 19 nt, Human
agcuggggcgguguguguu

SEQ ID NO: 162484 - RNA, 22 nt, Human
ugggggugaaagucuggacagu

SEQ ID NO: 162485 - RNA, 22 nt, Human
cauuauguucaguagcuuaaaa

SEQ ID NO: 162486 - RNA, 22 nt, Human
uuucauaaugucacagucaaaa

SEQ ID NO: 162487 - RNA, 22 nt, Human
caggaaagaaaugagaacacca

SEQ ID NO: 162488 - RNA, 22 nt, Human
uccuggaggcaaaugaagacuc

SEQ ID NO: 162489 - RNA, 22 nt, Human
gcccaggcuggagugcaguagc

SEQ ID NO: 162490 - RNA, 22 nt, Human
auuucacucuuaauugcuuccu

SEQ ID NO: 162491 - RNA, 22 nt, Human
gcagagugggagcccagggcug

SEQ ID NO: 162492 - RNA, 22 nt, Human
aaauguauccuacuuccugagu

SEQ ID NO: 162493 - RNA, 22 nt, Human
ggaggguuagcaaaggcacaga

SEQ ID NO: 162494 - RNA, 22 nt, Human
ccagcucuggcuucuugcuggg

SEQ ID NO: 162495 - RNA, 22 nt, Human
ggcucagggaaugaggaagaau

SEQ ID NO: 162496 - RNA, 22 nt, Human
cucaggguaaugaaagacgaau

SEQ ID NO: 162497 - RNA, 22 nt, Human
ugccucugugugcaggugagca

SEQ ID NO: 162498 - RNA, 22 nt, Human
ggcucuggugcccuggcuccca

SEQ ID NO: 162499 - RNA, 22 nt, Human
uuguuucagcuguaugcuaugu

SEQ ID NO: 162500 - RNA, 22 nt, Human
ucagggcaagucucagaagguu

SEQ ID NO: 162501 - RNA, 22 nt, Human
uccuucagccaugggcucucca

SEQ ID NO: 162502 - RNA, 22 nt, Human
gaggggcugggcagucccugga

SEQ ID NO: 162503 - RNA, 22 nt, Human
uuuauugcauacacaaauguca

SEQ ID NO: 162504 - RNA, 17 nt, Human
uccuucagggccucaca

SEQ ID NO: 162505 - RNA, 22 nt, Human
ccugccaggcuuugggcuucug

SEQ ID NO: 162506 - RNA, 22 nt, Human
cuggccugaucucaugcugucc

SEQ ID NO: 162507 - RNA, 22 nt, Human
accccagaggcggaggcugcag

SEQ ID NO: 162508 - RNA, 22 nt, Human
gcuggccauggggagugaggag

SEQ ID NO: 162509 - RNA, 22 nt, Human
ggcuggcuugccaagcucaggg

SEQ ID NO: 162510 - RNA, 22 nt, Human
accucugcucaagaccccuccg

SEQ ID NO: 162511 - RNA, 21 nt, Human
uuuuuucuugcgugaggccug

SEQ ID NO: 162512 - RNA, 22 nt, Human
cagagcagguaucuuuggugaa

SEQ ID NO: 162513 - RNA, 22 nt, Human
cuggagcaggcuugucccagcu

SEQ ID NO: 162514 - RNA, 22 nt, Human
aggggugugcauccuggaggau

SEQ ID NO: 162515 - RNA, 22 nt, Human
ugggccaggauuucaagacccu

SEQ ID NO: 162516 - RNA, 22 nt, Human
cugcugggcagaggcugcauga

SEQ ID NO: 162517 - RNA, 21 nt, Human
gggccuggcugcgcaggacgg

SEQ ID NO: 162518 - RNA, 22 nt, Human
cagggcugaaaucaagguguag

SEQ ID NO: 162519 - RNA, 22 nt, Human
caggagugcagguggugaggca

SEQ ID NO: 162520 - RNA, 22 nt, Human
ggccugcuauuggugggcagac

SEQ ID NO: 162521 - RNA, 22 nt, Human
uuugaguugcuuauuuaauagg

SEQ ID NO: 162522 - RNA, 22 nt, Human
ccugggcuggaguacagcagug

SEQ ID NO: 162523 - RNA, 22 nt, Human
gccuggcaaggcccuguugacu

SEQ ID NO: 162524 - RNA, 22 nt, Human
ucaugcaaggcugaaacauggu

SEQ ID NO: 162525 - RNA, 22 nt, Human
gccaggcagcaggaagccagug

SEQ ID NO: 162526 - RNA, 22 nt, Human
caggcugggcagccuccccggc

SEQ ID NO: 162527 - RNA, 22 nt, Human
uuguaacagguacuaaauaacu

SEQ ID NO: 162528 - RNA, 22 nt, Human
uuuaaaaaacuagucugagucu

SEQ ID NO: 162529 - RNA, 22 nt, Human
gcuggccugggcagccugucgg

SEQ ID NO: 162530 - RNA, 22 nt, Human
ugugucccuuggaaccucagcu

SEQ ID NO: 162531 - RNA, 22 nt, Human
cuuauuauaaaauccuguuuga

SEQ ID NO: 162532 - RNA, 22 nt, Human
gcuggcuccucuguccucacgg

SEQ ID NO: 162533 - RNA, 22 nt, Human
gccucaggacuggcauacucau

SEQ ID NO: 162534 - RNA, 22 nt, Human
guggcccaggcuuggcgcuggc

SEQ ID NO: 162535 - RNA, 22 nt, Human
gucccuggaauggacucugcgc

SEQ ID NO: 162536 - RNA, 22 nt, Human
agagcuuagaauuucagaugau

SEQ ID NO: 162537 - RNA, 22 nt, Human
uagcagggaagaugaucagaau

SEQ ID NO: 162538 - RNA, 22 nt, Human
ugugcaguuucuauguugucca

SEQ ID NO: 162539 - RNA, 22 nt, Human
gccuucaguaguauccucauga

SEQ ID NO: 162540 - RNA, 22 nt, Human
ugcaguggaagagguggagauc

SEQ ID NO: 162541 - RNA, 22 nt, Human
aguguugucaaacggcucagca

SEQ ID NO: 162542 - RNA, 21 nt, Human
agaaauguaucauucuuuucc

SEQ ID NO: 162543 - RNA, 22 nt, Human
agggcagaaaccaccuugaugg

SEQ ID NO: 162544 - RNA, 22 nt, Human
ucaaugauuagaguuuagugug

SEQ ID NO: 162545 - RNA, 21 nt, Human
ucucugggcccuccugugggg

SEQ ID NO: 162546 - RNA, 22 nt, Human
aaaugucuuucuucugcuacgu

SEQ ID NO: 162547 - RNA, 22 nt, Human
aaaguguaaggaauuuaaguaa

SEQ ID NO: 162548 - RNA, 22 nt, Human
cccucagcuccacccucagcag

SEQ ID NO: 162549 - RNA, 22 nt, Human
caggggacaguaugguggauga

SEQ ID NO: 162550 - RNA, 23 nt, Human
ucacagggcacuggcugggguug

SEQ ID NO: 162551 - RNA, 22 nt, Human
ugcugccaagcccgugcuccug

SEQ ID NO: 162552 - RNA, 22 nt, Human
uuuuuaagcuccuuugauguca

SEQ ID NO: 162553 - RNA, 22 nt, Human
gcagcuguggguuccaagucua

SEQ ID NO: 162554 - RNA, 22 nt, Human
acauuucuccuacuuguuauuu

SEQ ID NO: 162555 - RNA, 22 nt, Human
caugcuccaaaaacaagagaau

SEQ ID NO: 162556 - RNA, 22 nt, Human
agggcuggcuaggugcguuccc

SEQ ID NO: 162557 - RNA, 22 nt, Human
ugaaaguuacaggaaaacagau

SEQ ID NO: 162558 - RNA, 22 nt, Human
gaggccagaaugagcugaaugc

SEQ ID NO: 162559 - RNA, 22 nt, Human
ggucucagacuggcaggcagug

SEQ ID NO: 162560 - RNA, 21 nt, Human
acagcagggcuggcaugacag

SEQ ID NO: 162561 - RNA, 22 nt, Human
guggccuggcgagcuggcgcgg

SEQ ID NO: 162562 - RNA, 22 nt, Human
uccucuggcccagcugccucug

SEQ ID NO: 162563 - RNA, 22 nt, Human
ucaguuuuuaaaugauauaauu

SEQ ID NO: 162564 - RNA, 22 nt, Human
agcaccaucagaugcaauaucu

SEQ ID NO: 162565 - RNA, 22 nt, Human
ucacaggcuccagggccuggau

SEQ ID NO: 162566 - RNA, 22 nt, Human
acagagcuuaggaugacuccca

SEQ ID NO: 162567 - RNA, 22 nt, Human
gugggccucuugaggguggcua

SEQ ID NO: 162568 - RNA, 23 nt, Human
ucuggcuccauccuuggggaucc

SEQ ID NO: 162569 - RNA, 22 nt, Human
gugacucacacaggccugggcu

SEQ ID NO: 162570 - RNA, 22 nt, Human
gcacaugagcugcugggauggg

SEQ ID NO: 162571 - RNA, 22 nt, Human
gaggaggaaacccuguuccucu

SEQ ID NO: 162572 - RNA, 22 nt, Human
ggcaguggaggacccugugucu

SEQ ID NO: 162573 - RNA, 22 nt, Human
ugguuucccauuaucugcagga

SEQ ID NO: 162574 - RNA, 19 nt, Human
uccaaaggacccaccucca

SEQ ID NO: 162575 - RNA, 22 nt, Human
aaauguguuccuuugcuacaga

SEQ ID NO: 162576 - RNA, 22 nt, Human
agggcugcccagugugagagcu

SEQ ID NO: 162577 - RNA, 22 nt, Human
acccaggccugagagacaggag

SEQ ID NO: 162578 - RNA, 22 nt, Human
ccccuuccgucucuugaguguc

SEQ ID NO: 162579 - RNA, 22 nt, Human
ggccucucuccuuggcuugcag

SEQ ID NO: 162580 - RNA, 22 nt, Human
ugcucccagggacucuggcugg

SEQ ID NO: 162581 - RNA, 22 nt, Human
acuguacuguguauuguagaau

SEQ ID NO: 162582 - RNA, 22 nt, Human
cacauugaaaugacccaauaau

SEQ ID NO: 162583 - RNA, 22 nt, Human
agcauggggcuccgcaaugaac

SEQ ID NO: 162584 - RNA, 22 nt, Human
ggccuuggggaggauggugucc

SEQ ID NO: 162585 - RNA, 22 nt, Human
ucuggcucaucucuccagguaa

SEQ ID NO: 162586 - RNA, 22 nt, Human
acacagggggcauucuaggagu

SEQ ID NO: 162587 - RNA, 22 nt, Human
gaggccuguagucauggaugua

SEQ ID NO: 162588 - RNA, 22 nt, Human
gugauuucagguuuuucauacu

SEQ ID NO: 162589 - RNA, 20 nt, Human
ggcugugcccuuccguggcc

SEQ ID NO: 162590 - RNA, 22 nt, Human
ugcauuugucuugucucaugaa

SEQ ID NO: 162591 - RNA, 22 nt, Human
ccugguguugugaaguagccgu

SEQ ID NO: 162592 - RNA, 20 nt, Human
cuggcaggagcgagucuacc

SEQ ID NO: 162593 - RNA, 22 nt, Human
uccagggaaggugugaggcugg

SEQ ID NO: 162594 - RNA, 22 nt, Human
uguacaguguagucaugagguu

SEQ ID NO: 162595 - RNA, 22 nt, Human
agagccugucugccuuucuacc

SEQ ID NO: 162596 - RNA, 22 nt, Human
cccucuggcucuucucaggccg

SEQ ID NO: 162597 - RNA, 22 nt, Human
aauuaacagagggcuuauuacu

SEQ ID NO: 162598 - RNA, 22 nt, Human
cucuguagaaacagggcagaag

SEQ ID NO: 162599 - RNA, 22 nt, Human
ggaguuggugagcaccaggcuu

SEQ ID NO: 162600 - RNA, 23 nt, Human
cuggccuccgacacuggccaaga

SEQ ID NO: 162601 - RNA, 20 nt, Human
cagagccaagagcagcaucu

SEQ ID NO: 162602 - RNA, 22 nt, Human
cccagccucagcuuuacuucca

SEQ ID NO: 162603 - RNA, 22 nt, Human
ugggcagaggcagcagaaaccu

SEQ ID NO: 162604 - RNA, 22 nt, Human
gugcgccagcucaaggggaggc

SEQ ID NO: 162605 - RNA, 18 nt, Human
acagaggcagacauguau

SEQ ID NO: 162606 - RNA, 22 nt, Human
ggcucagaaacuaaaggcgcug

SEQ ID NO: 162607 - RNA, 22 nt, Human
cugccacuuacuaggcauggug

SEQ ID NO: 162608 - RNA, 22 nt, Human
aucuggguucaccaugcuccug

SEQ ID NO: 162609 - RNA, 22 nt, Human
gcaggcaguuauuuaguagaau

SEQ ID NO: 162610 - RNA, 22 nt, Human
caggcagccugagggaucuggg

SEQ ID NO: 162611 - RNA, 22 nt, Human
gccuggagagcacugugcgcuu

SEQ ID NO: 162612 - RNA, 21 nt, Human
gugguuauuuucauuagcauc

SEQ ID NO: 162613 - RNA, 21 nt, Human
aggaaguggccagauugggaa

SEQ ID NO: 162614 - RNA, 22 nt, Human
agucccagacuccaguuuucug

SEQ ID NO: 162615 - RNA, 21 nt, Human
agccuggcccagggggaggcu

SEQ ID NO: 162616 - RNA, 22 nt, Human
ugguccugccccgugcacagag

SEQ ID NO: 162617 - RNA, 22 nt, Human
cagagguagaaggcaugcagug

SEQ ID NO: 162618 - RNA, 22 nt, Human
gcaguggcuaagcucgcaugca

SEQ ID NO: 162619 - RNA, 22 nt, Human
uuuaaauaggacuccugggggu

SEQ ID NO: 162620 - RNA, 17 nt, Human
ggagagugggaauggcc

SEQ ID NO: 162621 - RNA, 19 nt, Human
auuugaaagcugugcuugc

SEQ ID NO: 162622 - RNA, 22 nt, Human
cugaggucuagacaccccaggg

SEQ ID NO: 162623 - RNA, 22 nt, Human
accugaggccuccccagcagac

SEQ ID NO: 162624 - RNA, 22 nt, Human
uauuacugagguuuuauggagu

SEQ ID NO: 162625 - RNA, 22 nt, Human
gaagcagcaaaucugcaguauc

SEQ ID NO: 162626 - RNA, 22 nt, Human
ugcagaggagucagccugggca

SEQ ID NO: 162627 - RNA, 22 nt, Human
gauuucaccugaucuugucauc

SEQ ID NO: 162628 - RNA, 22 nt, Human
uuuaaucaggcaaagcauaaua

SEQ ID NO: 162629 - RNA, 21 nt, Human
aaaguucaugcuuuaauauuc

SEQ ID NO: 162630 - RNA, 22 nt, Human
uggcagaguaggauggcccugu

SEQ ID NO: 162631 - RNA, 22 nt, Human
guuugauucaagaacaaagagu

SEQ ID NO: 162632 - RNA, 22 nt, Human
uuucucaucuggaaacagugcu

SEQ ID NO: 162633 - RNA, 22 nt, Human
ggcucuggucagugaggggccu

SEQ ID NO: 162634 - RNA, 22 nt, Human
cugggcugucccaaccccaucc

SEQ ID NO: 162635 - RNA, 22 nt, Human
acauugaucagccucccaugca

SEQ ID NO: 162636 - RNA, 22 nt, Human
cagggugccuguccucagcaaa

SEQ ID NO: 162637 - RNA, 22 nt, Human
guggggggacguuggucacuuu

SEQ ID NO: 162638 - RNA, 22 nt, Human
uuugcauugccucugacuuaug

SEQ ID NO: 162639 - RNA, 22 nt, Human
uguauauucugccuaaaagcuu

SEQ ID NO: 162640 - RNA, 22 nt, Human
gccucacugcagccccaggaag

SEQ ID NO: 162641 - RNA, 22 nt, Human
ccagccuccauguagauagcug

SEQ ID NO: 162642 - RNA, 22 nt, Human
caguggguaggaaaggcucuuc

SEQ ID NO: 162643 - RNA, 22 nt, Human
ccagcgcuucccaucagggagg

SEQ ID NO: 162644 - RNA, 22 nt, Human
cacaguggauugggugaugccc

SEQ ID NO: 162645 - RNA, 22 nt, Human
acagaauugauggaaaucucag

SEQ ID NO: 162646 - RNA, 22 nt, Human
gaguccaguuguucacagaggc

SEQ ID NO: 162647 - RNA, 19 nt, Human
cagagcagugguuccugaa

SEQ ID NO: 162648 - RNA, 22 nt, Human
gcccucagcuccuggacacaug

SEQ ID NO: 162649 - RNA, 22 nt, Human
cugggaggugaacagaaaaacu

SEQ ID NO: 162650 - RNA, 22 nt, Human
ccuccuggugggcgcuucuggc

SEQ ID NO: 162651 - RNA, 22 nt, Human
gcaggguauaauacuuagguga

SEQ ID NO: 162652 - RNA, 22 nt, Human
uccucagacacccugcuggcuu

SEQ ID NO: 162653 - RNA, 22 nt, Human
cuggugcuggagccuagucccu

SEQ ID NO: 162654 - RNA, 17 nt, Human
auuucacuuagcaugag

SEQ ID NO: 162655 - RNA, 22 nt, Human
cacauuuaaagguugaagcuga

SEQ ID NO: 162656 - RNA, 22 nt, Human
uaguaacagauuuauacagucu

SEQ ID NO: 162657 - RNA, 22 nt, Human
uggcccugucccuggagccugg

SEQ ID NO: 162658 - RNA, 22 nt, Human
auguacaguggaaacuaacaaa

SEQ ID NO: 162659 - RNA, 22 nt, Human
aggaaagcucccaguagggcuc

SEQ ID NO: 162660 - RNA, 22 nt, Human
acuguguggaccacucugaggc

SEQ ID NO: 162661 - RNA, 22 nt, Human
uggcuuccacugugugcccccu

SEQ ID NO: 162662 - RNA, 22 nt, Human
gauggcacacagacauccccgc

SEQ ID NO: 162663 - RNA, 22 nt, Human
ccagcuggaagagugcagaacu

SEQ ID NO: 162664 - RNA, 22 nt, Human
gcucugagaggugcagcaguaa

SEQ ID NO: 162665 - RNA, 22 nt, Human
cugugcccuggccaggccucuc

SEQ ID NO: 162666 - RNA, 22 nt, Human
cuggcuggcaaguagaacacaa

SEQ ID NO: 162667 - RNA, 22 nt, Human
aggucaaaccacagcucuaggc

SEQ ID NO: 162668 - RNA, 22 nt, Human
ugccaggaggaggugggacaga

SEQ ID NO: 162669 - RNA, 22 nt, Human
uuucacauacaguguauaguag

SEQ ID NO: 162670 - RNA, 22 nt, Human
gcucagagauggggaaugaaaa

SEQ ID NO: 162671 - RNA, 22 nt, Human
uagagcuagcuucaaaaugcga

SEQ ID NO: 162672 - RNA, 22 nt, Human
ugcaucuguucagagcugucga

SEQ ID NO: 162673 - RNA, 22 nt, Human
uguacaguaggaacuuguuauu

SEQ ID NO: 162674 - RNA, 22 nt, Human
ugguccagaugccuuggcuuua

SEQ ID NO: 162675 - RNA, 22 nt, Human
aaugagcugcugcuguuccacc

SEQ ID NO: 162676 - RNA, 22 nt, Human
agcucagcuuccucuccaugcu

SEQ ID NO: 162677 - RNA, 18 nt, Human
ugucucugaauuccagug

SEQ ID NO: 162678 - RNA, 22 nt, Human
auacauguuguaccauauguuu

SEQ ID NO: 162679 - RNA, 22 nt, Human
acuuaguauuuuucagcuuuga

SEQ ID NO: 162680 - RNA, 22 nt, Human
uucagagaugacaccugguguu

SEQ ID NO: 162681 - RNA, 22 nt, Human
ucagagucucccccaguuuggg

SEQ ID NO: 162682 - RNA, 22 nt, Human
aggcugccuguuccaaucuccu

SEQ ID NO: 162683 - RNA, 22 nt, Human
acagaggaaggcugagcugccc

SEQ ID NO: 162684 - RNA, 22 nt, Human
gagcucugacugcugggugaca

SEQ ID NO: 162685 - RNA, 22 nt, Human
aggaaaaauaaggcagcagggc

SEQ ID NO: 162686 - RNA, 22 nt, Human
cagcucugcugggaggaugcag

SEQ ID NO: 162687 - RNA, 22 nt, Human
ggcaguagccagggacuggcag

SEQ ID NO: 162688 - RNA, 22 nt, Human
gauuuccuaauguggaucucug

SEQ ID NO: 162689 - RNA, 22 nt, Human
cugagccauaagggaggcuggg

SEQ ID NO: 162690 - RNA, 22 nt, Human
ggaggccaaggcgggcggauca

SEQ ID NO: 162691 - RNA, 22 nt, Human
auugaaagcauggauuuggauu

SEQ ID NO: 162692 - RNA, 22 nt, Human
aaggcacuuuucuaaagaccuu

SEQ ID NO: 162693 - RNA, 22 nt, Human
cagggcuccccgcaccgcagcc

SEQ ID NO: 162694 - RNA, 22 nt, Human
cucuggagggaggcugagcugg

SEQ ID NO: 162695 - RNA, 22 nt, Human
aguguccaacucagcuugucaa

SEQ ID NO: 162696 - RNA, 22 nt, Human
auaucuuuuagagcaagcuugu

SEQ ID NO: 162697 - RNA, 22 nt, Human
aggugcuuggcucgugcacaca

SEQ ID NO: 162698 - RNA, 21 nt, Human
aacugcuggucuuuucugucu

SEQ ID NO: 162699 - RNA, 19 nt, Human
gggcuuggggcugaagccu

SEQ ID NO: 162700 - RNA, 22 nt, Human
uggaggugagugugguacagca

SEQ ID NO: 162701 - RNA, 22 nt, Human
ccagcugagaaguguaaaguga

SEQ ID NO: 162702 - RNA, 22 nt, Human
ccacagccauuccagggaggcu

SEQ ID NO: 162703 - RNA, 22 nt, Human
agaggagguggugaugcuuuaa

SEQ ID NO: 162704 - RNA, 22 nt, Human
ucacguuuuacugagugagaua

SEQ ID NO: 162705 - RNA, 22 nt, Human
aacuuuaaggcuauaaauuaug

SEQ ID NO: 162706 - RNA, 22 nt, Human
uauuuuguuaauaauccagucc

SEQ ID NO: 162707 - RNA, 22 nt, Human
cauugcacagcccuguggugau

SEQ ID NO: 162708 - RNA, 22 nt, Human
cuguuuauaaauagaggggagu

SEQ ID NO: 162709 - RNA, 22 nt, Human
uccaagaagucaucuaaacugu

SEQ ID NO: 162710 - RNA, 22 nt, Human
ugacagggcuagaggcaaugca

SEQ ID NO: 162711 - RNA, 22 nt, Human
cuccucccugcgauugcucugc

SEQ ID NO: 162712 - RNA, 22 nt, Human
uggcagcuacagacagagguga

SEQ ID NO: 162713 - RNA, 22 nt, Human
cccucugaccuccugccacagu

SEQ ID NO: 162714 - RNA, 17 nt, Human
agauggcaggaggcaga

SEQ ID NO: 162715 - RNA, 22 nt, Human
uccuugaauugugccacuuacc

SEQ ID NO: 162716 - RNA, 22 nt, Human
auugaaagguuuugagcagaua

SEQ ID NO: 162717 - RNA, 22 nt, Human
aggaccaguaugagagcaucug

SEQ ID NO: 162718 - RNA, 22 nt, Human
agcccuccucacaucagcgucc

SEQ ID NO: 162719 - RNA, 22 nt, Human
auucuguauuucuaauaagauc

SEQ ID NO: 162720 - RNA, 22 nt, Human
agggacacacuccaguguuauu

SEQ ID NO: 162721 - RNA, 22 nt, Human
cagaggcuaagaugagugggug

SEQ ID NO: 162722 - RNA, 20 nt, Human
uccuugaaagugggguauau

SEQ ID NO: 162723 - RNA, 22 nt, Human
guccucugggcagcugccccac

SEQ ID NO: 162724 - RNA, 22 nt, Human
gcagggcaugggcccugucugc

SEQ ID NO: 162725 - RNA, 22 nt, Human
gugggcaaggucccugccagcu

SEQ ID NO: 162726 - RNA, 22 nt, Human
ucaaaugcucuuugcagagagg

SEQ ID NO: 162727 - RNA, 22 nt, Human
aaauuuaagaagugugugcgug

SEQ ID NO: 162728 - RNA, 22 nt, Human
uuuuccuauaugcaaagaaugc

SEQ ID NO: 162729 - RNA, 22 nt, Human
gcagggcuauuggaaggagaug

SEQ ID NO: 162730 - RNA, 22 nt, Human
agcugcucucacuggacgccug

SEQ ID NO: 162731 - RNA, 21 nt, Human
uccuuccuugagguccuuucc

SEQ ID NO: 162732 - RNA, 22 nt, Human
cagccugacaccagcuuugggc

SEQ ID NO: 162733 - RNA, 23 nt, Human
gagcugggauacaggcuuacugc

SEQ ID NO: 162734 - RNA, 23 nt, Human
aguuccagaaaaaugcucaagca

SEQ ID NO: 162735 - RNA, 22 nt, Human
cccaguccuaaagcagacgcca

SEQ ID NO: 162736 - RNA, 22 nt, Human
ccaggagcaaagaucacuggga

SEQ ID NO: 162737 - RNA, 22 nt, Human
gaggcagcaucuauggugggaa

SEQ ID NO: 162738 - RNA, 22 nt, Human
cccuggaguagcacugggucgc

SEQ ID NO: 162739 - RNA, 22 nt, Human
agaggcuggauugagcauagac

SEQ ID NO: 162740 - RNA, 22 nt, Human
aaggccuggauuuagguuguga

SEQ ID NO: 162741 - RNA, 20 nt, Human
cagcaggaaaagugccucag

SEQ ID NO: 162742 - RNA, 22 nt, Human
gcagugcugaucccauggcaga

SEQ ID NO: 162743 - RNA, 22 nt, Human
ccucuggcaacuucacagccca

SEQ ID NO: 162744 - RNA, 22 nt, Human
cuggccugggagcugcuagcgu

SEQ ID NO: 162745 - RNA, 22 nt, Human
caggugcccagcuccugcugug

SEQ ID NO: 162746 - RNA, 22 nt, Human
acagggucauuuuaugaucugu

SEQ ID NO: 162747 - RNA, 22 nt, Human
gaggggcugggguugacuccaa

SEQ ID NO: 162748 - RNA, 22 nt, Human
uuauuauuuuguguacagcaaa

SEQ ID NO: 162749 - RNA, 22 nt, Human
ucagaacaauugggaaccauua

SEQ ID NO: 162750 - RNA, 19 nt, Human
ccagcccugucacuucuug

SEQ ID NO: 162751 - RNA, 22 nt, Human
aguuauauuccauagauucaga

SEQ ID NO: 162752 - RNA, 22 nt, Human
cgcagaagagguugucuagucc

SEQ ID NO: 162753 - RNA, 22 nt, Human
ggcuggcacugaggagagcucu

SEQ ID NO: 162754 - RNA, 20 nt, Human
gcaaauggaucccacaagcc

SEQ ID NO: 162755 - RNA, 22 nt, Human
ggcaaaaaccgcaauaacuucu

SEQ ID NO: 162756 - RNA, 22 nt, Human
cccucugccugcgcccuggugu

SEQ ID NO: 162757 - RNA, 22 nt, Human
gagaagcaaucaguggccaccc

SEQ ID NO: 162758 - RNA, 22 nt, Human
ucugucacccagagugcagugg

SEQ ID NO: 162759 - RNA, 22 nt, Human
ucugguaaccuuuaucccuccu

SEQ ID NO: 162760 - RNA, 20 nt, Human
cuuggccuacuuagcuuugu

SEQ ID NO: 162761 - RNA, 21 nt, Human
cucacaggaugcaguguuacu

SEQ ID NO: 162762 - RNA, 22 nt, Human
ccaggcagagugcuccagaaag

SEQ ID NO: 162763 - RNA, 22 nt, Human
cagcaggguuaagugacucacc

SEQ ID NO: 162764 - RNA, 22 nt, Human
gagaggcugacuggcuguccug

SEQ ID NO: 162765 - RNA, 21 nt, Human
ugcugccauagaccugaggga

SEQ ID NO: 162766 - RNA, 22 nt, Human
ggagagugggagcaacuguugc

SEQ ID NO: 162767 - RNA, 22 nt, Human
ugagccugguugcagugucugg

SEQ ID NO: 162768 - RNA, 22 nt, Human
gagcccuccauggagccaggca

SEQ ID NO: 162769 - RNA, 22 nt, Human
aguguuucuggcaaaugaaagu

SEQ ID NO: 162770 - RNA, 22 nt, Human
aggcccugaagucggccccuca

SEQ ID NO: 162771 - RNA, 22 nt, Human
caggucagaggcgcagccccca

SEQ ID NO: 162772 - RNA, 22 nt, Human
uccucugccaaagggaguugcc

SEQ ID NO: 162773 - RNA, 22 nt, Human
gccugggaagacuaagugggag

SEQ ID NO: 162774 - RNA, 22 nt, Human
ggcuucccagcagagggcgcac

SEQ ID NO: 162775 - RNA, 22 nt, Human
auuuguacaaauuuauguuagu

SEQ ID NO: 162776 - RNA, 22 nt, Human
agucagugaaggcauugcucaa

SEQ ID NO: 162777 - RNA, 22 nt, Human
gggagggaagguaccuguguga

SEQ ID NO: 162778 - RNA, 22 nt, Human
uccaguggugguuugaagggca

SEQ ID NO: 162779 - RNA, 22 nt, Human
aauguguagggugccuguuuuu

SEQ ID NO: 162780 - RNA, 22 nt, Human
uaagaacaguagaacaguaggu

SEQ ID NO: 162781 - RNA, 22 nt, Human
uggcucagugaagagauaacuu

SEQ ID NO: 162782 - RNA, 22 nt, Human
ucucuggggauggaccugggag

SEQ ID NO: 162783 - RNA, 22 nt, Human
gcuggccuucugcagaguucug

SEQ ID NO: 162784 - RNA, 22 nt, Human
cugcaggcugagcgccugccgg

SEQ ID NO: 162785 - RNA, 22 nt, Human
ccugaggcccuggcugugcuga

SEQ ID NO: 162786 - RNA, 22 nt, Human
ccuggcagguggcgcccucggc

SEQ ID NO: 162787 - RNA, 22 nt, Human
gccucugcaccaguacugugcc

SEQ ID NO: 162788 - RNA, 22 nt, Human
gcaguggauccaaugguaucuu

SEQ ID NO: 162789 - RNA, 22 nt, Human
aggauccuuuuucugcuguuug

SEQ ID NO: 162790 - RNA, 22 nt, Human
uuguuacagcagugauuucaga

SEQ ID NO: 162791 - RNA, 21 nt, Human
uggcugcuggcccucucucca

SEQ ID NO: 162792 - RNA, 20 nt, Human
agggucaguagcacagagcu

SEQ ID NO: 162793 - RNA, 20 nt, Human
gggguuggcuggcacaggga

SEQ ID NO: 162794 - RNA, 22 nt, Human
gggcucuguccauuccuucaua

SEQ ID NO: 162795 - RNA, 22 nt, Human
gaggucaggggagaggcugaug

SEQ ID NO: 162796 - RNA, 22 nt, Human
ugguccagacauuucugaggua

SEQ ID NO: 162797 - RNA, 22 nt, Human
auucaguuaaaaacuguacuuc

SEQ ID NO: 162798 - RNA, 22 nt, Human
cuucaagauauuucuagaauca

SEQ ID NO: 162799 - RNA, 22 nt, Human
ugucuucaucuccaugcacaga

SEQ ID NO: 162800 - RNA, 22 nt, Human
ucaaacuagccugacugguauu

SEQ ID NO: 162801 - RNA, 22 nt, Human
acugucuccucaucaugccugg

SEQ ID NO: 162802 - RNA, 22 nt, Human
cagcucccaguggcagcuccuu

SEQ ID NO: 162803 - RNA, 22 nt, Human
ccgggccucgggacaccgggua

SEQ ID NO: 162804 - RNA, 22 nt, Human
acagaauacuacagacugguua

SEQ ID NO: 162805 - RNA, 22 nt, Human
caguuuuugccauuaagaguaa

SEQ ID NO: 162806 - RNA, 22 nt, Human
uagcaguggaaucuuuugucca

SEQ ID NO: 162807 - RNA, 22 nt, Human
cugacucagcagcugaugaucc

SEQ ID NO: 162808 - RNA, 22 nt, Human
gcuggggcugggcugaggaaga

SEQ ID NO: 162809 - RNA, 21 nt, Human
ugcagccauucagcccuaugc

SEQ ID NO: 162810 - RNA, 22 nt, Human
caagaugccccugguagggauc

SEQ ID NO: 162811 - RNA, 22 nt, Human
uugcaccaaaugaguuaaaauu

SEQ ID NO: 162812 - RNA, 22 nt, Human
agucccuguacuuuccacugcc

SEQ ID NO: 162813 - RNA, 22 nt, Human
cccuggaggaccccaauguggc

SEQ ID NO: 162814 - RNA, 22 nt, Human
cuagucacucagcacugacaaa

SEQ ID NO: 162815 - RNA, 22 nt, Human
gagccucguggcggccacugcg

SEQ ID NO: 162816 - RNA, 22 nt, Human
ucagugcagaauagugaugcau

SEQ ID NO: 162817 - RNA, 22 nt, Human
gagggcugauaacaggaauaca

SEQ ID NO: 162818 - RNA, 22 nt, Human
cggcuggguucggcugcaggcc

SEQ ID NO: 162819 - RNA, 22 nt, Human
cuccugggaauuuaguugugag

SEQ ID NO: 162820 - RNA, 22 nt, Human
agcagcugaucaaagcacuuau

SEQ ID NO: 162821 - RNA, 22 nt, Human
ugaaggaagaauaggcaguguu

SEQ ID NO: 162822 - RNA, 22 nt, Human
cugggacacccaaggaaagagc

SEQ ID NO: 162823 - RNA, 22 nt, Human
ccuggcagguggagguugcagu

SEQ ID NO: 162824 - RNA, 22 nt, Human
uccaguucuaggucacucucug

SEQ ID NO: 162825 - RNA, 19 nt, Human
agaggcugucaccuguagc

SEQ ID NO: 162826 - RNA, 22 nt, Human
uccuuccuggggucucugcugc

SEQ ID NO: 162827 - RNA, 22 nt, Human
cagagcugggaucccaugggcg

SEQ ID NO: 162828 - RNA, 22 nt, Human
uucucauucugacucaguguag

SEQ ID NO: 162829 - RNA, 22 nt, Human
uccuucagucuucugagccaua

SEQ ID NO: 162830 - RNA, 22 nt, Human
acauacuuuuuaaaagauugcu

SEQ ID NO: 162831 - RNA, 22 nt, Human
cauuacaugguccaggauauau

SEQ ID NO: 162832 - RNA, 22 nt, Human
cucuuccuacagucugcuaugc

SEQ ID NO: 162833 - RNA, 22 nt, Human
gcucagagaaucagcagacacc

SEQ ID NO: 162834 - RNA, 22 nt, Human
aauucuagcauugugaaaauau

SEQ ID NO: 162835 - RNA, 22 nt, Human
aagucauugguagcuugauagg

SEQ ID NO: 162836 - RNA, 22 nt, Human
ugcugccuuugggaccuggccu

SEQ ID NO: 162837 - RNA, 22 nt, Human
ucaagagauugaauaauaacug

SEQ ID NO: 162838 - RNA, 23 nt, Human
uggcucagcuaguuuuccauuuc

SEQ ID NO: 162839 - RNA, 22 nt, Human
uccagccacucagcagggauug

SEQ ID NO: 162840 - RNA, 22 nt, Human
guuauguacuuuuuaaaucuug

SEQ ID NO: 162841 - RNA, 22 nt, Human
ggcucugcgcgguaaagugacu

SEQ ID NO: 162842 - RNA, 22 nt, Human
agcaucuggucaugagugagaa

SEQ ID NO: 162843 - RNA, 22 nt, Human
ggccagagagccgcuguuagga

SEQ ID NO: 162844 - RNA, 19 nt, Human
uguagcaguuuaaaacaac

SEQ ID NO: 162845 - RNA, 22 nt, Human
cugagucucccggcaguggagg

SEQ ID NO: 162846 - RNA, 21 nt, Human
agcagaggggacauguuugau

SEQ ID NO: 162847 - RNA, 22 nt, Human
agcuguguggugucugacagcu

SEQ ID NO: 162848 - RNA, 22 nt, Human
ucuggcuccacaccucacugca

SEQ ID NO: 162849 - RNA, 17 nt, Human
uggagcugcguguguuc

SEQ ID NO: 162850 - RNA, 22 nt, Human
agagccuggaccugagcuacaa

SEQ ID NO: 162851 - RNA, 22 nt, Human
agaaauguggaucguuuuaaaa

SEQ ID NO: 162852 - RNA, 22 nt, Human
gaggccuggaccagccacagag

SEQ ID NO: 162853 - RNA, 22 nt, Human
gagccaggguuugaaacuagac

SEQ ID NO: 162854 - RNA, 22 nt, Human
cacaggcucuucucacuugauu

SEQ ID NO: 162855 - RNA, 22 nt, Human
cccuggcauaaaacuucuccag

SEQ ID NO: 162856 - RNA, 22 nt, Human
aaauguguuucuuugugaaugg

SEQ ID NO: 162857 - RNA, 20 nt, Human
uuccuguauacaaagaguuc

SEQ ID NO: 162858 - RNA, 22 nt, Human
cagucccaccaggaucgcucuu

SEQ ID NO: 162859 - RNA, 22 nt, Human
gagcaggcuugcagagaagggg

SEQ ID NO: 162860 - RNA, 22 nt, Human
agguacagcaauauaagagguc

SEQ ID NO: 162861 - RNA, 22 nt, Human
ugccuaggaaaccucaugcuuc

SEQ ID NO: 162862 - RNA, 22 nt, Human
uuguggcucgugagauguuagg

SEQ ID NO: 162863 - RNA, 22 nt, Human
gcugccacucugagcuugcuuc

SEQ ID NO: 162864 - RNA, 22 nt, Human
cuggcuggccggaggcaucccu

SEQ ID NO: 162865 - RNA, 22 nt, Human
gcugggcagccccuacagagag

SEQ ID NO: 162866 - RNA, 22 nt, Human
gggccugacugagagcuccuca

SEQ ID NO: 162867 - RNA, 22 nt, Human
gauuucaaguaucuugggcgag

SEQ ID NO: 162868 - RNA, 22 nt, Human
cuuagaaaugcagauucucagg

SEQ ID NO: 162869 - RNA, 22 nt, Human
uaaagguagugugacauauugu

SEQ ID NO: 162870 - RNA, 22 nt, Human
agcagcugcagggagggucugc

SEQ ID NO: 162871 - RNA, 22 nt, Human
ccugucuggccuuccacggggg

SEQ ID NO: 162872 - RNA, 22 nt, Human
gccuggcuccuaagagcacaac

SEQ ID NO: 162873 - RNA, 22 nt, Human
agguaacacuacuuaguauacu

SEQ ID NO: 162874 - RNA, 22 nt, Human
agcauuuaugacuaauguaaaa

SEQ ID NO: 162875 - RNA, 22 nt, Human
acugaaggaaacuuuuguguuu

SEQ ID NO: 162876 - RNA, 19 nt, Human
auagaaaggguuaaagaca

SEQ ID NO: 162877 - RNA, 22 nt, Human
cugagccaaccacagcaggagc

SEQ ID NO: 162878 - RNA, 22 nt, Human
ugggggucaggaugaggccuug

SEQ ID NO: 162879 - RNA, 22 nt, Human
ugccugcucuuaccacucuccc

SEQ ID NO: 162880 - RNA, 22 nt, Human
cacagcuugggcucugacaaua

SEQ ID NO: 162881 - RNA, 23 nt, Human
gcagagcugcccuauugccuugg

SEQ ID NO: 162882 - RNA, 22 nt, Human
aacucagucauaaagcgaaugc

SEQ ID NO: 162883 - RNA, 23 nt, Human
aagcugccuucgcaguuggucug

SEQ ID NO: 162884 - RNA, 18 nt, Human
gucauugcaacauacugu

SEQ ID NO: 162885 - RNA, 22 nt, Human
acagauauaaacuauaguagug

SEQ ID NO: 162886 - RNA, 22 nt, Human
gccucccuggcccacagcagcg

SEQ ID NO: 162887 - RNA, 22 nt, Human
agcaugcugguguucauggcag

SEQ ID NO: 162888 - RNA, 20 nt, Human
uggagcuccagcguccaugu

SEQ ID NO: 162889 - RNA, 22 nt, Human
aaugcacacauuugguacugaa

SEQ ID NO: 162890 - RNA, 22 nt, Human
accuuaaaacugacacauggag

SEQ ID NO: 162891 - RNA, 22 nt, Human
gugugccaacaaaagacagugc

SEQ ID NO: 162892 - RNA, 22 nt, Human
ccagcuggugacauccccaacc

SEQ ID NO: 162893 - RNA, 22 nt, Human
uagcagggaaggugugcugagc

SEQ ID NO: 162894 - RNA, 22 nt, Human
uggagcugaacuuugaggccag

SEQ ID NO: 162895 - RNA, 22 nt, Human
ugccugggguuggcaaacugcu

SEQ ID NO: 162896 - RNA, 22 nt, Human
cuggcuccuccaaggccuggag

SEQ ID NO: 162897 - RNA, 17 nt, Human
uggcuucccugggccac

SEQ ID NO: 162898 - RNA, 22 nt, Human
aggaggccgauuucagaggucg

SEQ ID NO: 162899 - RNA, 22 nt, Human
ccuggagcgcgggucaagcugg

SEQ ID NO: 162900 - RNA, 21 nt, Human
uaaauaauaaguugcugagau

SEQ ID NO: 162901 - RNA, 22 nt, Human
gccuucugauugcuggacugac

SEQ ID NO: 162902 - RNA, 22 nt, Human
ccagagaccagaacauggggau

SEQ ID NO: 162903 - RNA, 22 nt, Human
ucucuuccaguaagagucuuua

SEQ ID NO: 162904 - RNA, 22 nt, Human
uaugaagacaaugauagcauga

SEQ ID NO: 162905 - RNA, 22 nt, Human
gcucccaggaagagaagggcca

SEQ ID NO: 162906 - RNA, 22 nt, Human
acaaugcaccagcaucuucacc

SEQ ID NO: 162907 - RNA, 22 nt, Human
ccuggcugaaccaaugaagugg

SEQ ID NO: 162908 - RNA, 22 nt, Human
auuuacagaugaugcuauuuga

SEQ ID NO: 162909 - RNA, 22 nt, Human
ccugaagaugcuguggccuggu

SEQ ID NO: 162910 - RNA, 22 nt, Human
uagagcugauaaugaggccaag

SEQ ID NO: 162911 - RNA, 22 nt, Human
auacaaagacaaaucucaaucu

SEQ ID NO: 162912 - RNA, 22 nt, Human
cuggaaggcucugcugccuguc

SEQ ID NO: 162913 - RNA, 22 nt, Human
uugcauuguaggauguuagaag

SEQ ID NO: 162914 - RNA, 22 nt, Human
gccaggcuggcaaaaggaaacc

SEQ ID NO: 162915 - RNA, 22 nt, Human
aaagauuugaaauuaggcauca

SEQ ID NO: 162916 - RNA, 22 nt, Human
ugcuggcccuggcucagggaac

SEQ ID NO: 162917 - RNA, 22 nt, Human
gccugagccgccugagcggcgg

SEQ ID NO: 162918 - RNA, 22 nt, Human
caguggcaugguugacugcagu

SEQ ID NO: 162919 - RNA, 20 nt, Human
ggcagagcuaugucuguugc

SEQ ID NO: 162920 - RNA, 22 nt, Human
cugcugcaggaugggcacucug

SEQ ID NO: 162921 - RNA, 22 nt, Human
cugccugugccaccgccucauu

SEQ ID NO: 162922 - RNA, 22 nt, Human
ccaaggagaaaugcugugcuuu

SEQ ID NO: 162923 - RNA, 22 nt, Human
ggcagcugugaagugccucaca

SEQ ID NO: 162924 - RNA, 22 nt, Human
uugaacaguuuugucagguuca

SEQ ID NO: 162925 - RNA, 22 nt, Human
gugcaugugcauccauguguac

SEQ ID NO: 162926 - RNA, 22 nt, Human
aguguuccuugcuuucccagag

SEQ ID NO: 162927 - RNA, 22 nt, Human
gcucaggaaauaguuuaguguu

SEQ ID NO: 162928 - RNA, 22 nt, Human
gggcugagggguaucucauggg

SEQ ID NO: 162929 - RNA, 22 nt, Human
uguguacuugaaagggcagguc

SEQ ID NO: 162930 - RNA, 22 nt, Human
ccugcugugaaacuggcauaug

SEQ ID NO: 162931 - RNA, 22 nt, Human
guucauuuaugauguaacaugu

SEQ ID NO: 162932 - RNA, 19 nt, Human
ucauucaggaccaguggau

SEQ ID NO: 162933 - RNA, 22 nt, Human
cagagugagggccugcaccugc

SEQ ID NO: 162934 - RNA, 22 nt, Human
gcaggaugagugaguacauuua

SEQ ID NO: 162935 - RNA, 22 nt, Human
gcucaggaucccaggggugugc

SEQ ID NO: 162936 - RNA, 22 nt, Human
ggcccacuugaaauggagcuca

SEQ ID NO: 162937 - RNA, 22 nt, Human
ucauugcaguagggagagaccc

SEQ ID NO: 162938 - RNA, 20 nt, Human
auacaaagagauugauguau

SEQ ID NO: 162939 - RNA, 22 nt, Human
cccuggaguccuggcaguugau

SEQ ID NO: 162940 - RNA, 22 nt, Human
aacaguaaugugguguuggguu

SEQ ID NO: 162941 - RNA, 20 nt, Human
gcugaccccugcugucaugc

SEQ ID NO: 162942 - RNA, 22 nt, Human
ugcuggaggggccugaccagga

SEQ ID NO: 162943 - RNA, 22 nt, Human
aggcccaguagugcugccuuua

SEQ ID NO: 162944 - RNA, 22 nt, Human
uugaaaggugaacaugaugcac

SEQ ID NO: 162945 - RNA, 22 nt, Human
gccaggcacaguucuaggugcu

SEQ ID NO: 162946 - RNA, 22 nt, Human
gagcagcuagauaaagcccuuc

SEQ ID NO: 162947 - RNA, 22 nt, Human
uugggugcugucauggggcacg

SEQ ID NO: 162948 - RNA, 22 nt, Human
aggggcugacuggaaagugcca

SEQ ID NO: 162949 - RNA, 22 nt, Human
cagaagaauggugucugagcuc

SEQ ID NO: 162950 - RNA, 22 nt, Human
ggugcagcugcagccugggagc

SEQ ID NO: 162951 - RNA, 22 nt, Human
gguacaaggagugaagguuugg

SEQ ID NO: 162952 - RNA, 22 nt, Human
uuugugaagggaacagaagugu

SEQ ID NO: 162953 - RNA, 22 nt, Human
cuggagcucuccagagccccgu

SEQ ID NO: 162954 - RNA, 22 nt, Human
gggugggguguaucggauccua

SEQ ID NO: 162955 - RNA, 22 nt, Human
gagcagcuguccccaaagcuuc

SEQ ID NO: 162956 - RNA, 22 nt, Human
augaacacauguacacauuucu

SEQ ID NO: 162957 - RNA, 22 nt, Human
ggcucuggagcacagacgucug

SEQ ID NO: 162958 - RNA, 22 nt, Human
ccuuuuucccuggagggacagc

SEQ ID NO: 162959 - RNA, 22 nt, Human
gguggggccugcuccagcggcc

SEQ ID NO: 162960 - RNA, 22 nt, Human
agcauuuaauuacaguuuaauu

SEQ ID NO: 162961 - RNA, 22 nt, Human
cucagaguccccaguggguuug

SEQ ID NO: 162962 - RNA, 23 nt, Human
ugucacauuuaguuggcauuguu

SEQ ID NO: 162963 - RNA, 22 nt, Human
aucuggcugagcgaggcccaca

SEQ ID NO: 162964 - RNA, 18 nt, Human
gaugggagcaagagaaga

SEQ ID NO: 162965 - RNA, 20 nt, Human
gaggccucagccucagcucc

SEQ ID NO: 162966 - RNA, 22 nt, Human
agcauggggcaaugcaugugcu

SEQ ID NO: 162967 - RNA, 20 nt, Human
cacaagagaauacacacugg

SEQ ID NO: 162968 - RNA, 22 nt, Human
gggcagcucuggcugugggaag

SEQ ID NO: 162969 - RNA, 22 nt, Human
uauauagaaaagcagauguugg

SEQ ID NO: 162970 - RNA, 22 nt, Human
uccagccaccaccuugauugcc

SEQ ID NO: 162971 - RNA, 23 nt, Human
uugauacagaagaaucaguuugu

SEQ ID NO: 162972 - RNA, 22 nt, Human
ccucugaguccucccugguugc

SEQ ID NO: 162973 - RNA, 22 nt, Human
agcuggaggggccagcaggugu

SEQ ID NO: 162974 - RNA, 22 nt, Human
guuuuguugcugcagagcucaa

SEQ ID NO: 162975 - RNA, 22 nt, Human
cuugccuucuguuccuauagaa

SEQ ID NO: 162976 - RNA, 22 nt, Human
uuaugacaggaaaaucacagaa

SEQ ID NO: 162977 - RNA, 22 nt, Human
uucaagaugacccagucacacg

SEQ ID NO: 162978 - RNA, 22 nt, Human
acagagccacuuuggugccuac

SEQ ID NO: 162979 - RNA, 22 nt, Human
aggagggugauccgggcugguc

SEQ ID NO: 162980 - RNA, 22 nt, Human
gcagacaggcccaguggaggga

SEQ ID NO: 162981 - RNA, 22 nt, Human
gcaggugguccccguggagugg

SEQ ID NO: 162982 - RNA, 22 nt, Human
caguggccugagccaggcuucc

SEQ ID NO: 162983 - RNA, 22 nt, Human
guggcugcagcccagcggcacg

SEQ ID NO: 162984 - RNA, 18 nt, Human
gugacagcugcuagcuca

SEQ ID NO: 162985 - RNA, 22 nt, Human
auucccaucgucaacuucacug

SEQ ID NO: 162986 - RNA, 22 nt, Human
agccuggaccaggggccucaga

SEQ ID NO: 162987 - RNA, 22 nt, Human
uaucuacuccucuuucagaugc

SEQ ID NO: 162988 - RNA, 20 nt, Human
caagcccucuuuagccugcc

SEQ ID NO: 162989 - RNA, 22 nt, Human
agugucugccagcugccaggug

SEQ ID NO: 162990 - RNA, 22 nt, Human
ccuccugggacaggcuggcaca

SEQ ID NO: 162991 - RNA, 22 nt, Human
ugguccaggguguaguacagag

SEQ ID NO: 162992 - RNA, 22 nt, Human
cugccuggaccggcagcccucc

SEQ ID NO: 162993 - RNA, 22 nt, Human
gcaggggcugcugggaacucgg

SEQ ID NO: 162994 - RNA, 22 nt, Human
ccugucucccuggcauggcuca

SEQ ID NO: 162995 - RNA, 22 nt, Human
caggccuccacuccacgcagac

SEQ ID NO: 162996 - RNA, 22 nt, Human
gagcucugggaaacaaagugua

SEQ ID NO: 162997 - RNA, 22 nt, Human
aaaugcauuuuuaauuagaccc

SEQ ID NO: 162998 - RNA, 22 nt, Human
agcagggcucuguggagggugg

SEQ ID NO: 162999 - RNA, 22 nt, Human
agaaaguucugugaguuguuca

SEQ ID NO: 163000 - RNA, 22 nt, Human
uauuucaugugcaccauaauuc

SEQ ID NO: 163001 - RNA, 20 nt, Human
gacaucauguacacauugcc

SEQ ID NO: 163002 - RNA, 22 nt, Human
aaaggugacacucugccagcug

SEQ ID NO: 163003 - RNA, 22 nt, Human
uuguuuucuccacugcaucuua

SEQ ID NO: 163004 - RNA, 22 nt, Human
ccucaggggcuuuucguuguug

SEQ ID NO: 163005 - RNA, 22 nt, Human
cacaggaggaggugcccgggcc

SEQ ID NO: 163006 - RNA, 22 nt, Human
ugggcuacucugggagccuaac

SEQ ID NO: 163007 - RNA, 22 nt, Human
cucccacuccuggcucaccaca

SEQ ID NO: 163008 - RNA, 22 nt, Human
aacagaaaagguagguggcuuu

SEQ ID NO: 163009 - RNA, 23 nt, Human
aggcacugaaugugucagugagu

SEQ ID NO: 163010 - RNA, 22 nt, Human
ugucucagauacgccaucaagg

SEQ ID NO: 163011 - RNA, 22 nt, Human
uuguuuugcuaaagggucauca

SEQ ID NO: 163012 - RNA, 22 nt, Human
caggaaauaucuccuggcagag

SEQ ID NO: 163013 - RNA, 22 nt, Human
guuauguaugggggccuuauga

SEQ ID NO: 163014 - RNA, 22 nt, Human
gaggucaggcuugcagcagggu

SEQ ID NO: 163015 - RNA, 23 nt, Human
aucaagauaauccagaugaccua

SEQ ID NO: 163016 - RNA, 22 nt, Human
auucuccacacauccagaccuu

SEQ ID NO: 163017 - RNA, 22 nt, Human
ccuggccucgugcucacggcuc

SEQ ID NO: 163018 - RNA, 22 nt, Human
agccucucuguuagucacuggg

SEQ ID NO: 163019 - RNA, 23 nt, Human
ugcugggcagagcuggugcugag

SEQ ID NO: 163020 - RNA, 22 nt, Human
gaggcaggcacuguuaucagca

SEQ ID NO: 163021 - RNA, 22 nt, Human
uggccuggaaccuggcagggac

SEQ ID NO: 163022 - RNA, 22 nt, Human
gcuguggccaacaaaccacuuu

SEQ ID NO: 163023 - RNA, 22 nt, Human
gaaaauguuagcuucauaguca

SEQ ID NO: 163024 - RNA, 22 nt, Human
aaucaguuaaauauugaguaca

SEQ ID NO: 163025 - RNA, 22 nt, Human
aggagcugcaaauauuaguaau

SEQ ID NO: 163026 - RNA, 22 nt, Human
acccuggguucccgcagcacca

SEQ ID NO: 163027 - RNA, 22 nt, Human
cccuggaggcaaagguugcagu

SEQ ID NO: 163028 - RNA, 22 nt, Human
cuggccuggagccucugggugg

SEQ ID NO: 163029 - RNA, 22 nt, Human
ugcacacaaguuggagaaugaa

SEQ ID NO: 163030 - RNA, 22 nt, Human
ucucccaggcugcccuguggac

SEQ ID NO: 163031 - RNA, 22 nt, Human
gcugauccuuuuaugucuagcu

SEQ ID NO: 163032 - RNA, 22 nt, Human
uggcucagccagcccuaggaac

SEQ ID NO: 163033 - RNA, 22 nt, Human
ccacugucuuuuccaggcugaa

SEQ ID NO: 163034 - RNA, 22 nt, Human
aaaguucagugccuucuauaca

SEQ ID NO: 163035 - RNA, 22 nt, Human
cagcugccaagaaucuuuucua

SEQ ID NO: 163036 - RNA, 22 nt, Human
gcugggagccccgagccagcgc

SEQ ID NO: 163037 - RNA, 22 nt, Human
ucugggagacguguguugucag

SEQ ID NO: 163038 - RNA, 22 nt, Human
cucuggagcauuucaccuacau

SEQ ID NO: 163039 - RNA, 22 nt, Human
acagcagagugugagauagcca

SEQ ID NO: 163040 - RNA, 22 nt, Human
aaggucauugguucugaauucu

SEQ ID NO: 163041 - RNA, 22 nt, Human
caggcaggugcagauuccucuu

SEQ ID NO: 163042 - RNA, 22 nt, Human
ccuggggagaagagcuuccccc

SEQ ID NO: 163043 - RNA, 22 nt, Human
guaauugacucagcucuguuca

SEQ ID NO: 163044 - RNA, 22 nt, Human
agggcagauggaacuuccccga

SEQ ID NO: 163045 - RNA, 22 nt, Human
ucucugggauaaacugggccag

SEQ ID NO: 163046 - RNA, 20 nt, Human
cugcucugcuuugcaggugg

SEQ ID NO: 163047 - RNA, 19 nt, Human
ucugaggguccagaugcau

SEQ ID NO: 163048 - RNA, 18 nt, Human
cagcagagacauucaaaa

SEQ ID NO: 163049 - RNA, 22 nt, Human
caguuaaaggcccaauaucugg

SEQ ID NO: 163050 - RNA, 22 nt, Human
ugcucccaggcucuguggucug

SEQ ID NO: 163051 - RNA, 22 nt, Human
gcugcuccgucugagcucuggu

SEQ ID NO: 163052 - RNA, 22 nt, Human
uaucuuuagaggaagagaaucu

SEQ ID NO: 163053 - RNA, 22 nt, Human
gcuaggagauugagcucugaag

SEQ ID NO: 163054 - RNA, 22 nt, Human
agccaagcugaucuccugcuga

SEQ ID NO: 163055 - RNA, 22 nt, Human
aggagaaggaagugcaucacua

SEQ ID NO: 163056 - RNA, 22 nt, Human
ugucucagaguaucccugaacu

SEQ ID NO: 163057 - RNA, 22 nt, Human
ugguaaaguguacugaauauga

SEQ ID NO: 163058 - RNA, 22 nt, Human
ucucacugcaaauauuauguau

SEQ ID NO: 163059 - RNA, 22 nt, Human
cagcuuggaggaggaucuaaga

SEQ ID NO: 163060 - RNA, 22 nt, Human
ggaagagagggcugggccucaa

SEQ ID NO: 163061 - RNA, 22 nt, Human
uggaggaaucagggcuuaggcu

SEQ ID NO: 163062 - RNA, 22 nt, Human
ugcacacaaaugugaacgugcc

SEQ ID NO: 163063 - RNA, 22 nt, Human
uuugcaaauaccaugaaacuug

SEQ ID NO: 163064 - RNA, 18 nt, Human
ugucucaggcugaaacag

SEQ ID NO: 163065 - RNA, 15 nt, Human
ugggcagaucacuug

SEQ ID NO: 163066 - RNA, 22 nt, Human
aggcugagauagguggaucauu

SEQ ID NO: 163067 - RNA, 22 nt, Human
uccagggauguccuguagcacu

SEQ ID NO: 163068 - RNA, 23 nt, Human
aguuuuucugcaugguucuguau

SEQ ID NO: 163069 - RNA, 22 nt, Human
augaaaacggaccagagcuauu

SEQ ID NO: 163070 - RNA, 22 nt, Human
gggcaugguggugcacaccugu

SEQ ID NO: 163071 - RNA, 22 nt, Human
caccagcuacagacuacugugu

SEQ ID NO: 163072 - RNA, 22 nt, Human
gccucugcaggugcgguuaucc

SEQ ID NO: 163073 - RNA, 22 nt, Human
ugagccugcugucgcuggaccc

SEQ ID NO: 163074 - RNA, 22 nt, Human
cuugcugggguaagucugugcu

SEQ ID NO: 163075 - RNA, 22 nt, Human
cagagcaguccuugucaaucag

SEQ ID NO: 163076 - RNA, 22 nt, Human
uacuuagagcgauaauuuauac

SEQ ID NO: 163077 - RNA, 22 nt, Human
uggagcagagaugguggccuuc

SEQ ID NO: 163078 - RNA, 19 nt, Human
uggcuccugccugccuucu

SEQ ID NO: 163079 - RNA, 22 nt, Human
ccaaaguccauaguuuacuuua

SEQ ID NO: 163080 - RNA, 22 nt, Human
cccuggagggcagacagaugcc

SEQ ID NO: 163081 - RNA, 22 nt, Human
gacacauagaucuaucucacuc

SEQ ID NO: 163082 - RNA, 21 nt, Human
gggugggaggacacagcaggc

SEQ ID NO: 163083 - RNA, 22 nt, Human
cugggccuagcaacagaggagu

SEQ ID NO: 163084 - RNA, 22 nt, Human
cugagccacugcuuguucagug

SEQ ID NO: 163085 - RNA, 22 nt, Human
aaaugcaauuguauguacucca

SEQ ID NO: 163086 - RNA, 22 nt, Human
agucucugcaugaugcagcaca

SEQ ID NO: 163087 - RNA, 22 nt, Human
gaacagcccuguuaagucuguu

SEQ ID NO: 163088 - RNA, 22 nt, Human
ggcagugaaugaaacagaggcu

SEQ ID NO: 163089 - RNA, 19 nt, Human
gcaggcacagcccugggug

SEQ ID NO: 163090 - RNA, 22 nt, Human
aaugauggauuuagacaagcug

SEQ ID NO: 163091 - RNA, 22 nt, Human
gcugucaccaaagcaggcacug

SEQ ID NO: 163092 - RNA, 17 nt, Human
ucugccgacugccagcu

SEQ ID NO: 163093 - RNA, 22 nt, Human
cugggcuggcgcauccgacacg

SEQ ID NO: 163094 - RNA, 22 nt, Human
gcagagugagccgaggcugcuc

SEQ ID NO: 163095 - RNA, 22 nt, Human
aagcugccugggaggaagggcu

SEQ ID NO: 163096 - RNA, 23 nt, Human
aggcagagccaaggucaaaaccc

SEQ ID NO: 163097 - RNA, 22 nt, Human
ugaggccaggaucccaggcucu

SEQ ID NO: 163098 - RNA, 23 nt, Human
uggcucugagagguucagaugcu

SEQ ID NO: 163099 - RNA, 22 nt, Human
agccagacauggcuccugcucc

SEQ ID NO: 163100 - RNA, 22 nt, Human
gcugccuguggcccuucugggu

SEQ ID NO: 163101 - RNA, 22 nt, Human
gcccagccuccaagcuccaagg

SEQ ID NO: 163102 - RNA, 22 nt, Human
cagaauaugacaagauuuuccu

SEQ ID NO: 163103 - RNA, 22 nt, Human
ugggacaguuguccuccacucu

SEQ ID NO: 163104 - RNA, 23 nt, Human
ugcauuauccucucugaagacca

SEQ ID NO: 163105 - RNA, 22 nt, Human
ugaaauguuugaagaccacuga

SEQ ID NO: 163106 - RNA, 22 nt, Human
uauguacagggauagaacuuga

SEQ ID NO: 163107 - RNA, 19 nt, Human
gcacugaagaguuggucac

SEQ ID NO: 163108 - RNA, 22 nt, Human
cucuggaguucuucaagcuacu

SEQ ID NO: 163109 - RNA, 22 nt, Human
caaaguccuagaacagugcuug

SEQ ID NO: 163110 - RNA, 22 nt, Human
uguguacaagaguguuuacugu

SEQ ID NO: 163111 - RNA, 22 nt, Human
guucacauccuugugaggauuu

SEQ ID NO: 163112 - RNA, 22 nt, Human
caguuuuucaaaauuacaugau

SEQ ID NO: 163113 - RNA, 22 nt, Human
uucagaaagugaaucuuguuau

SEQ ID NO: 163114 - RNA, 22 nt, Human
auguacaguuucuagacucaaa

SEQ ID NO: 163115 - RNA, 22 nt, Human
gagccuggauagccuuguucca

SEQ ID NO: 163116 - RNA, 22 nt, Human
gcaaaaaaugcuuguugcuuag

SEQ ID NO: 163117 - RNA, 21 nt, Human
gcagggacaaagcuucaggag

SEQ ID NO: 163118 - RNA, 22 nt, Human
gagcucccaggccccagcaagg

SEQ ID NO: 163119 - RNA, 22 nt, Human
ccugggcagggcuggacucuca

SEQ ID NO: 163120 - RNA, 22 nt, Human
aagcaucucuauguggagagug

SEQ ID NO: 163121 - RNA, 22 nt, Human
agagaauuacagaagaauguca

SEQ ID NO: 163122 - RNA, 22 nt, Human
ugccucugugggccuuccuggc

SEQ ID NO: 163123 - RNA, 22 nt, Human
agacaaagacagcaucucaggu

SEQ ID NO: 163124 - RNA, 22 nt, Human
gccaggcaaauuaaggaaugca

SEQ ID NO: 163125 - RNA, 22 nt, Human
augcagcaguuuacaaagcaau

SEQ ID NO: 163126 - RNA, 22 nt, Human
uagcauuuauggucaugugucc

SEQ ID NO: 163127 - RNA, 22 nt, Human
gagcaggcucugccuguguguc

SEQ ID NO: 163128 - RNA, 23 nt, Human
ugcugggguaguuuguggcacag

SEQ ID NO: 163129 - RNA, 22 nt, Human
ccuguguggccaggcuggaguc

SEQ ID NO: 163130 - RNA, 22 nt, Human
uguuacuuaucucacgugaugc

SEQ ID NO: 163131 - RNA, 23 nt, Human
gggugggccaaauuagguagccu

SEQ ID NO: 163132 - RNA, 23 nt, Human
uugugggcagauuccauggggag

SEQ ID NO: 163133 - RNA, 22 nt, Human
cacaugggugugccuggaggaa

SEQ ID NO: 163134 - RNA, 22 nt, Human
ucugcgcugccuugauccuugg

SEQ ID NO: 163135 - RNA, 22 nt, Human
ggagaggugaauggcugcucua

SEQ ID NO: 163136 - RNA, 22 nt, Human
aaguucaaggugauaguggcag

SEQ ID NO: 163137 - RNA, 22 nt, Human
ggaugcaggacggcauggaugu

SEQ ID NO: 163138 - RNA, 22 nt, Human
uccagggaugccagccauguug

SEQ ID NO: 163139 - RNA, 20 nt, Human
cagggccacgcuccaaggca

SEQ ID NO: 163140 - RNA, 22 nt, Human
uggccuggcagagcaaggccug

SEQ ID NO: 163141 - RNA, 22 nt, Human
gggccacacagaaccuccuggu

SEQ ID NO: 163142 - RNA, 22 nt, Human
cggagcugccugccaagccugc

SEQ ID NO: 163143 - RNA, 22 nt, Human
agagccaggcaggcaauguuga

SEQ ID NO: 163144 - RNA, 22 nt, Human
uagauuuccucuuccucauucc

SEQ ID NO: 163145 - RNA, 22 nt, Human
gcaguggcaccgcuggcucugg

SEQ ID NO: 163146 - RNA, 22 nt, Human
ucugccuggauuccauucucca

SEQ ID NO: 163147 - RNA, 21 nt, Human
aagagcuggaucaaggauaag

SEQ ID NO: 163148 - RNA, 22 nt, Human
gaaaagcuaggccaguucagcu

SEQ ID NO: 163149 - RNA, 22 nt, Human
caggcagccugcggucugcaca

SEQ ID NO: 163150 - RNA, 22 nt, Human
uccugcagccacugcaggcaga

SEQ ID NO: 163151 - RNA, 22 nt, Human
ugggccuggagcccuggagagu

SEQ ID NO: 163152 - RNA, 17 nt, Human
ggccuuggggccucagu

SEQ ID NO: 163153 - RNA, 22 nt, Human
gaugauuuuaugucuugucauu

SEQ ID NO: 163154 - RNA, 22 nt, Human
ugggcagagucguggggaauag

SEQ ID NO: 163155 - RNA, 22 nt, Human
gcugccugaucauacaccaggg

SEQ ID NO: 163156 - RNA, 22 nt, Human
ugccugccaugcagaaagcuga

SEQ ID NO: 163157 - RNA, 22 nt, Human
cugagggccuuggcuccugccc

SEQ ID NO: 163158 - RNA, 22 nt, Human
ggcacugaaguggguguugggu

SEQ ID NO: 163159 - RNA, 22 nt, Human
agaggagcugggaggcccucgu

SEQ ID NO: 163160 - RNA, 22 nt, Human
ugggcagauguccucugaagug

SEQ ID NO: 163161 - RNA, 22 nt, Human
uuacauuuuaguuaaccuguga

SEQ ID NO: 163162 - RNA, 22 nt, Human
uucuuuccucccagccuuugga

SEQ ID NO: 163163 - RNA, 22 nt, Human
ucugcuggccuuagcaggucua

SEQ ID NO: 163164 - RNA, 22 nt, Human
agauuucccucuuguauuugca

SEQ ID NO: 163165 - RNA, 23 nt, Human
cugcagucgccggccugggugcc

SEQ ID NO: 163166 - RNA, 18 nt, Human
uccauuguucuacuguga

SEQ ID NO: 163167 - RNA, 22 nt, Human
uagcagcucacagccucccauu

SEQ ID NO: 163168 - RNA, 22 nt, Human
acagaaauauucguggugcuug

SEQ ID NO: 163169 - RNA, 22 nt, Human
ugugugccagccuacgaggagc

SEQ ID NO: 163170 - RNA, 22 nt, Human
uacaagagguauauagaaacag

SEQ ID NO: 163171 - RNA, 22 nt, Human
aggggugauuugggacaggaca

SEQ ID NO: 163172 - RNA, 22 nt, Human
gcuggcagagacaagaagacua

SEQ ID NO: 163173 - RNA, 23 nt, Human
cagugcagggcaacucagacucc

SEQ ID NO: 163174 - RNA, 22 nt, Human
cugggcagugguggcccuuccc

SEQ ID NO: 163175 - RNA, 20 nt, Human
gcugucuggauuagaagccu

SEQ ID NO: 163176 - RNA, 22 nt, Human
augggaggaaggaggcccuuga

SEQ ID NO: 163177 - RNA, 22 nt, Human
agaaagaacgcacuugugcugc

SEQ ID NO: 163178 - RNA, 22 nt, Human
cauugcccaguaggaucaccag

SEQ ID NO: 163179 - RNA, 22 nt, Human
aaugcuagugugauauguaagg

SEQ ID NO: 163180 - RNA, 22 nt, Human
uggcucugugucucccagcagc

SEQ ID NO: 163181 - RNA, 22 nt, Human
uggcagagaacacggcugaucu

SEQ ID NO: 163182 - RNA, 20 nt, Human
ucagugauuaucucugagug

SEQ ID NO: 163183 - RNA, 22 nt, Human
agccaaggagugcagguggcuu

SEQ ID NO: 163184 - RNA, 22 nt, Human
ugcagaggaccauuguccugga

SEQ ID NO: 163185 - RNA, 22 nt, Human
ggccucgcggcuucugguggcu

SEQ ID NO: 163186 - RNA, 22 nt, Human
agaggcuccuucacucuggcac

SEQ ID NO: 163187 - RNA, 22 nt, Human
ccaggacuuuaaguccagcacu

SEQ ID NO: 163188 - RNA, 22 nt, Human
uggccugccucccggcuucuuu

SEQ ID NO: 163189 - RNA, 21 nt, Human
cagagcuguccaaacccugac

SEQ ID NO: 163190 - RNA, 22 nt, Human
ucauccaguucacauggugagu

SEQ ID NO: 163191 - RNA, 22 nt, Human
uagccaggcgaggucagugucg

SEQ ID NO: 163192 - RNA, 22 nt, Human
uucaagauaauaggaaugaaaa

SEQ ID NO: 163193 - RNA, 22 nt, Human
aggccucagugaucaucaucag

SEQ ID NO: 163194 - RNA, 22 nt, Human
uuuucuuauggugaagcacaaa

SEQ ID NO: 163195 - RNA, 22 nt, Human
ggcccagcacagugcuuggggg

SEQ ID NO: 163196 - RNA, 19 nt, Human
gccugagccagccaugcaa

SEQ ID NO: 163197 - RNA, 22 nt, Human
ucacugaagacugggcucuaaa

SEQ ID NO: 163198 - RNA, 22 nt, Human
gggagcugguuccugcccucca

SEQ ID NO: 163199 - RNA, 22 nt, Human
gccugagcccaggugugcagag

SEQ ID NO: 163200 - RNA, 22 nt, Human
uggcucagaggggaagugguuu

SEQ ID NO: 163201 - RNA, 22 nt, Human
cauugcugugggcauuugcugc

SEQ ID NO: 163202 - RNA, 22 nt, Human
gccuucugauaucucuuggcau

SEQ ID NO: 163203 - RNA, 22 nt, Human
ccugggaggcggagguugcagg

SEQ ID NO: 163204 - RNA, 22 nt, Human
uuggccuucccuaccugggcca

SEQ ID NO: 163205 - RNA, 22 nt, Human
uuagucuucuuccuuauauguu

SEQ ID NO: 163206 - RNA, 22 nt, Human
gcugucucauacaaggcccugc

SEQ ID NO: 163207 - RNA, 22 nt, Human
aggcugaggcagguggaucacc

SEQ ID NO: 163208 - RNA, 22 nt, Human
agucagugaaaacuagaauguu

SEQ ID NO: 163209 - RNA, 22 nt, Human
gccuggagaggaagccggugga

SEQ ID NO: 163210 - RNA, 22 nt, Human
ggcucugguugaccaugauggc

SEQ ID NO: 163211 - RNA, 18 nt, Human
cagaagcaggcagugcag

SEQ ID NO: 163212 - RNA, 22 nt, Human
agauuucacaugcugcucuauu

SEQ ID NO: 163213 - RNA, 22 nt, Human
cagagugaaaacugagcucaaa

SEQ ID NO: 163214 - RNA, 22 nt, Human
guguauaacuaucuaucuagua

SEQ ID NO: 163215 - RNA, 22 nt, Human
ccugggaggcugugggucugcu

SEQ ID NO: 163216 - RNA, 22 nt, Human
aauugugcuaugauuaugaaag

SEQ ID NO: 163217 - RNA, 18 nt, Human
gagcugccauauuuaguu

SEQ ID NO: 163218 - RNA, 22 nt, Human
gagcuuccacucuagaaggagu

SEQ ID NO: 163219 - RNA, 21 nt, Human
ccaggcuccugaggcugguca

SEQ ID NO: 163220 - RNA, 22 nt, Human
ggaggccauaguuugggaguca

SEQ ID NO: 163221 - RNA, 22 nt, Human
ccaagggcugcugaggugucca

SEQ ID NO: 163222 - RNA, 22 nt, Human
agccagcuggugggucagcugg

SEQ ID NO: 163223 - RNA, 22 nt, Human
agcuucuggaagccuggcagca

SEQ ID NO: 163224 - RNA, 22 nt, Human
ggcaaaguuuucaucucauaac

SEQ ID NO: 163225 - RNA, 22 nt, Human
ccagcagcccacaggcgucccu

SEQ ID NO: 163226 - RNA, 22 nt, Human
ggaugcugggagacagcaggca

SEQ ID NO: 163227 - RNA, 22 nt, Human
uaaguucagaguucucauuugu

SEQ ID NO: 163228 - RNA, 22 nt, Human
ccuggcuccugccucugcaggg

SEQ ID NO: 163229 - RNA, 20 nt, Human
ugggagcuggugaggucuca

SEQ ID NO: 163230 - RNA, 22 nt, Human
uugaaaggguuaaagugguaaa

SEQ ID NO: 163231 - RNA, 22 nt, Human
caggaugugaggaggccauuug

SEQ ID NO: 163232 - RNA, 22 nt, Human
cugcugggaaggucugcucagu

SEQ ID NO: 163233 - RNA, 22 nt, Human
aggagcccugcgggaggcagag

SEQ ID NO: 163234 - RNA, 22 nt, Human
gaugagggccugguggcugugc

SEQ ID NO: 163235 - RNA, 22 nt, Human
gcagccugaugaucuggguugu

SEQ ID NO: 163236 - RNA, 22 nt, Human
gcagggacagggcagggccuuu

SEQ ID NO: 163237 - RNA, 22 nt, Human
agccagggauggcagugcccag

SEQ ID NO: 163238 - RNA, 22 nt, Human
cacagguguucuugcagugaaa

SEQ ID NO: 163239 - RNA, 22 nt, Human
uugggcugaacccugcagcuga

SEQ ID NO: 163240 - RNA, 22 nt, Human
cacagggcagagaccugggugc

SEQ ID NO: 163241 - RNA, 19 nt, Human
uagucuuuauucuuaauuu

SEQ ID NO: 163242 - RNA, 22 nt, Human
cuggccuuuuguuucuggagaa

SEQ ID NO: 163243 - RNA, 22 nt, Human
ccucuggggugagugggccacu

SEQ ID NO: 163244 - RNA, 22 nt, Human
cagucacauugcccugcauuua

SEQ ID NO: 163245 - RNA, 20 nt, Human
gagggcaggcacccauuuca

SEQ ID NO: 163246 - RNA, 21 nt, Human
ggagcugcaggagccgaaggc

SEQ ID NO: 163247 - RNA, 22 nt, Human
ccagcuccugggucuuagucag

SEQ ID NO: 163248 - RNA, 22 nt, Human
agucucagccacacagaccuau

SEQ ID NO: 163249 - RNA, 22 nt, Human
uuuccauauuuggucuuuggga

SEQ ID NO: 163250 - RNA, 22 nt, Human
acuggcaguggcagcagaaaga

SEQ ID NO: 163251 - RNA, 22 nt, Human
cucuggaguggguggccgggag

SEQ ID NO: 163252 - RNA, 22 nt, Human
ucugcaggaaaaaagugccugg

SEQ ID NO: 163253 - RNA, 23 nt, Human
gcugucugucaucucugcgggag

SEQ ID NO: 163254 - RNA, 22 nt, Human
ccagcugcuugggaaaaugucu

SEQ ID NO: 163255 - RNA, 22 nt, Human
cagggcagggagcuuagaauga

SEQ ID NO: 163256 - RNA, 23 nt, Human
ccugucugugcuggguggacaca

SEQ ID NO: 163257 - RNA, 22 nt, Human
aggcucugcagaccccagcugu

SEQ ID NO: 163258 - RNA, 22 nt, Human
ugcagggcuaagucagagccug

SEQ ID NO: 163259 - RNA, 22 nt, Human
ggguggggcccaggaaaucuau

SEQ ID NO: 163260 - RNA, 22 nt, Human
uagcagggucucaggagucagg

SEQ ID NO: 163261 - RNA, 22 nt, Human
caggcagagugagguggucuaa

SEQ ID NO: 163262 - RNA, 22 nt, Human
ucuggcugcugcgugagugcuu

SEQ ID NO: 163263 - RNA, 22 nt, Human
uccucagaaaccccugugaggu

SEQ ID NO: 163264 - RNA, 22 nt, Human
acagcacaaucugagucccaga

SEQ ID NO: 163265 - RNA, 22 nt, Human
aaauguauugcauaggauauuu

SEQ ID NO: 163266 - RNA, 22 nt, Human
ugggacacccucacgccugcac

SEQ ID NO: 163267 - RNA, 23 nt, Human
cuguggcugaguccuguuggagu

SEQ ID NO: 163268 - RNA, 21 nt, Human
gcaugccugcaucuuaguguu

SEQ ID NO: 163269 - RNA, 22 nt, Human
aauguguagcauuuaaugcagu

SEQ ID NO: 163270 - RNA, 22 nt, Human
uugcagagaucagcagguuuga

SEQ ID NO: 163271 - RNA, 21 nt, Human
gcccucaggggaggauggccu

SEQ ID NO: 163272 - RNA, 22 nt, Human
ccagggugaggaggcucccacg

SEQ ID NO: 163273 - RNA, 22 nt, Human
gcuggggaggcagcagagaaca

SEQ ID NO: 163274 - RNA, 22 nt, Human
aggccuagaggaauggccaggg

SEQ ID NO: 163275 - RNA, 22 nt, Human
aaaugugucauauucaaaguca

SEQ ID NO: 163276 - RNA, 20 nt, Human
ggaagcagagaacuguuuuc

SEQ ID NO: 163277 - RNA, 22 nt, Human
auucuccaucaccacuggcacu

SEQ ID NO: 163278 - RNA, 22 nt, Human
uagcugccuuugggcuccugcu

SEQ ID NO: 163279 - RNA, 22 nt, Human
cagcccuguccagcagagggug

SEQ ID NO: 163280 - RNA, 22 nt, Human
ggcaggaggaagaguuagcacc

SEQ ID NO: 163281 - RNA, 21 nt, Human
aaguaaaucagagaaauaacc

SEQ ID NO: 163282 - RNA, 22 nt, Human
ggcagagguagcuggaaccagg

SEQ ID NO: 163283 - RNA, 22 nt, Human
ugcccugugugugcaagcacug

SEQ ID NO: 163284 - RNA, 22 nt, Human
ugggcagagucauacaggagac

SEQ ID NO: 163285 - RNA, 22 nt, Human
ccugccugcggcccgcggggag

SEQ ID NO: 163286 - RNA, 22 nt, Human
ccagggugggguccaggaacca

SEQ ID NO: 163287 - RNA, 22 nt, Human
ugcuggggguucagaugaguaa

SEQ ID NO: 163288 - RNA, 21 nt, Human
cagagcagcguucugcugugg

SEQ ID NO: 163289 - RNA, 22 nt, Human
cccagguggguuggccucuguc

SEQ ID NO: 163290 - RNA, 18 nt, Human
acaggccucaguccugca

SEQ ID NO: 163291 - RNA, 22 nt, Human
uggagcugggguuugaaucugg

SEQ ID NO: 163292 - RNA, 22 nt, Human
ccugucagaugaaguaauugug

SEQ ID NO: 163293 - RNA, 15 nt, Human
cagucccagggaccc

SEQ ID NO: 163294 - RNA, 22 nt, Human
gagcagcucugggugacccagu

SEQ ID NO: 163295 - RNA, 22 nt, Human
cuuugcauacaauuuuuagaaa

SEQ ID NO: 163296 - RNA, 22 nt, Human
auacauacguacauacguaugu

SEQ ID NO: 163297 - RNA, 22 nt, Human
uacaguauuaugagugauugaa

SEQ ID NO: 163298 - RNA, 22 nt, Human
uuggagcccugaggaucuggau

SEQ ID NO: 163299 - RNA, 22 nt, Human
ugcucucucaggccuggcccac

SEQ ID NO: 163300 - RNA, 22 nt, Human
caaagucccagcugcuuagaga

SEQ ID NO: 163301 - RNA, 22 nt, Human
ugucuagggagcugcucaggcu

SEQ ID NO: 163302 - RNA, 22 nt, Human
gggcugcuuuuuucuuagcaga

SEQ ID NO: 163303 - RNA, 22 nt, Human
aagaaauuaaggaaugcaacga

SEQ ID NO: 163304 - RNA, 22 nt, Human
caaggagaaaacggcuucugaa

SEQ ID NO: 163305 - RNA, 22 nt, Human
auuuagaaauuccaaaaguauu

SEQ ID NO: 163306 - RNA, 22 nt, Human
caggaaccuaaugaaggcucac

SEQ ID NO: 163307 - RNA, 22 nt, Human
gucugucucucuccagagugca

SEQ ID NO: 163308 - RNA, 22 nt, Human
agagcagccugugaugaugcac

SEQ ID NO: 163309 - RNA, 22 nt, Human
gcugcugcgcuugucuacuguu

SEQ ID NO: 163310 - RNA, 22 nt, Human
ugcacccucaucagucaaaugg

SEQ ID NO: 163311 - RNA, 22 nt, Human
gcugcagcuuuaggauccagug

SEQ ID NO: 163312 - RNA, 22 nt, Human
ccagggccucguguucugagug

SEQ ID NO: 163313 - RNA, 20 nt, Human
acagaaagagagaaugucag

SEQ ID NO: 163314 - RNA, 22 nt, Human
gccacccccaaguagguggucu

SEQ ID NO: 163315 - RNA, 22 nt, Human
cccagacuccucuggcuggugg

SEQ ID NO: 163316 - RNA, 22 nt, Human
ggcagccuccagggcacuggug

SEQ ID NO: 163317 - RNA, 22 nt, Human
aggccucuucagggagcaugga

SEQ ID NO: 163318 - RNA, 18 nt, Human
ucaaagucuggcuccacu

SEQ ID NO: 163319 - RNA, 22 nt, Human
aggcuccuuguucaucauccau

SEQ ID NO: 163320 - RNA, 22 nt, Human
cuucccacuaguaucacagagc

SEQ ID NO: 163321 - RNA, 22 nt, Human
cauuccuuaacguggggagucu

SEQ ID NO: 163322 - RNA, 22 nt, Human
caggccuggcugcagcucgccu

SEQ ID NO: 163323 - RNA, 22 nt, Human
ccacugaaggucaacauagagc

SEQ ID NO: 163324 - RNA, 21 nt, Human
uggcagggguaguaguacagc

SEQ ID NO: 163325 - RNA, 22 nt, Human
ugcucuggggagcuccucugcg

SEQ ID NO: 163326 - RNA, 22 nt, Human
ucucagagccuaacuaaccuaa

SEQ ID NO: 163327 - RNA, 22 nt, Human
uccugucugcucacagagcugg

SEQ ID NO: 163328 - RNA, 22 nt, Human
ucccagagccucugccacucug

SEQ ID NO: 163329 - RNA, 22 nt, Human
auguaucaauuaucugucugca

SEQ ID NO: 163330 - RNA, 22 nt, Human
aggccugcagcaggagcaaacc

SEQ ID NO: 163331 - RNA, 22 nt, Human
cagcaucuaaucuucaugccgg

SEQ ID NO: 163332 - RNA, 22 nt, Human
aagggcagcuauuaucgucauc

SEQ ID NO: 163333 - RNA, 22 nt, Human
gcugagguggagauugcaguga

SEQ ID NO: 163334 - RNA, 22 nt, Human
agggccugcucuaucacucuca

SEQ ID NO: 163335 - RNA, 19 nt, Human
ucuggagcugaugcaggug

SEQ ID NO: 163336 - RNA, 18 nt, Human
ccuggcagccaugcgcgc

SEQ ID NO: 163337 - RNA, 22 nt, Human
ccucucucuccugcacacacac

SEQ ID NO: 163338 - RNA, 22 nt, Human
aaaugcacagguuuuaaauccu

SEQ ID NO: 163339 - RNA, 22 nt, Human
cugggcugcaggaguggggcaa

SEQ ID NO: 163340 - RNA, 22 nt, Human
cugaaggacuuggugauaguug

SEQ ID NO: 163341 - RNA, 22 nt, Human
acagagcuuaauucaggagcuu

SEQ ID NO: 163342 - RNA, 22 nt, Human
ccagagugacgugaagugugaa

SEQ ID NO: 163343 - RNA, 22 nt, Human
guacucucuugaaggccuuucu

SEQ ID NO: 163344 - RNA, 22 nt, Human
ucacaacuugaagcugauuuaa

SEQ ID NO: 163345 - RNA, 22 nt, Human
cagaggcagaggucaucucugg

SEQ ID NO: 163346 - RNA, 22 nt, Human
aaggcacugcuuugcugcgccc

SEQ ID NO: 163347 - RNA, 22 nt, Human
caaggagaguaauugaaugaga

SEQ ID NO: 163348 - RNA, 22 nt, Human
ucucagagaugucaagagucua

SEQ ID NO: 163349 - RNA, 22 nt, Human
gccuuggcugaugugcgaauga

SEQ ID NO: 163350 - RNA, 22 nt, Human
acaaaggugcgucccuucagcu

SEQ ID NO: 163351 - RNA, 22 nt, Human
ugacaccacaacuagccauuga

SEQ ID NO: 163352 - RNA, 22 nt, Human
cccagagccucauucuguuggg

SEQ ID NO: 163353 - RNA, 18 nt, Human
aggaagcaggaggaaggc

SEQ ID NO: 163354 - RNA, 19 nt, Human
uguuggugcggauguggag

SEQ ID NO: 163355 - RNA, 22 nt, Human
caccaggcuggagugcagaggu

SEQ ID NO: 163356 - RNA, 22 nt, Human
augcaucauggaaaacucaguu

SEQ ID NO: 163357 - RNA, 22 nt, Human
ucaccaggcuggaaugcagugg

SEQ ID NO: 163358 - RNA, 22 nt, Human
gaagagcuauguccagggagca

SEQ ID NO: 163359 - RNA, 22 nt, Human
ccucaugguacuuacuguagcu

SEQ ID NO: 163360 - RNA, 22 nt, Human
ugccugucuucaggagugucac

SEQ ID NO: 163361 - RNA, 22 nt, Human
ccuuggcccuagccucaggcaa

SEQ ID NO: 163362 - RNA, 22 nt, Human
cagcaaaagccagcauaagcuc

SEQ ID NO: 163363 - RNA, 22 nt, Human
uaagaacaguguuucaucucua

SEQ ID NO: 163364 - RNA, 22 nt, Human
gguggccucugcaggccucgac

SEQ ID NO: 163365 - RNA, 22 nt, Human
auugacaagacaauggcucuua

SEQ ID NO: 163366 - RNA, 22 nt, Human
cagagcuggagaaguggauuua

SEQ ID NO: 163367 - RNA, 22 nt, Human
ugcaccauacccauuccccucu

SEQ ID NO: 163368 - RNA, 22 nt, Human
cuggcuccauccuugagcucug

SEQ ID NO: 163369 - RNA, 22 nt, Human
caugggagcuaucuccaucacu

SEQ ID NO: 163370 - RNA, 22 nt, Human
augauuuccaguuguugcuaag

SEQ ID NO: 163371 - RNA, 22 nt, Human
agggcugccauuucuggcccaa

SEQ ID NO: 163372 - RNA, 22 nt, Human
gaaggaaaacagaucugccuga

SEQ ID NO: 163373 - RNA, 22 nt, Human
cagcuggcguggagugauugca

SEQ ID NO: 163374 - RNA, 22 nt, Human
ggucccagcuggucacugucag

SEQ ID NO: 163375 - RNA, 22 nt, Human
ucagcagggccuccuugugcag

SEQ ID NO: 163376 - RNA, 22 nt, Human
auauacuuggagacuaucauug

SEQ ID NO: 163377 - RNA, 22 nt, Human
caggugggccgggguuuguucu

SEQ ID NO: 163378 - RNA, 22 nt, Human
cucaggaugcaggucacaggac

SEQ ID NO: 163379 - RNA, 21 nt, Human
agagaauugccuuagauguuc

SEQ ID NO: 163380 - RNA, 22 nt, Human
gcuguauuuauuuucuaggguu

SEQ ID NO: 163381 - RNA, 22 nt, Human
agcugggagcagagccacagcc

SEQ ID NO: 163382 - RNA, 22 nt, Human
uaguaaaaguuuaguugaaagu

SEQ ID NO: 163383 - RNA, 17 nt, Human
ccugggaggaguuauga

SEQ ID NO: 163384 - RNA, 22 nt, Human
aagaauguuaguuucugauaca

SEQ ID NO: 163385 - RNA, 18 nt, Human
ucugucucuguccuugcu

SEQ ID NO: 163386 - RNA, 23 nt, Human
aguacauucgaaaaauucuguga

SEQ ID NO: 163387 - RNA, 22 nt, Human
caggcaccccaggugagcacug

SEQ ID NO: 163388 - RNA, 22 nt, Human
agaauaaaucaaauguccugag

SEQ ID NO: 163389 - RNA, 22 nt, Human
gaaaucugaaucuucuguuggu

SEQ ID NO: 163390 - RNA, 22 nt, Human
cagaggcugcucuggguggcau

SEQ ID NO: 163391 - RNA, 22 nt, Human
ugcagggcacacgcacgggugu

SEQ ID NO: 163392 - RNA, 22 nt, Human
aaggacagaaacagauugcugg

SEQ ID NO: 163393 - RNA, 20 nt, Human
ugcuguaagauuagagagcu

SEQ ID NO: 163394 - RNA, 22 nt, Human
aaugcacaugucuuggccucac

SEQ ID NO: 163395 - RNA, 22 nt, Human
aaggcccuaauagagcacauau

SEQ ID NO: 163396 - RNA, 22 nt, Human
gcacccagaggucagcagugcu

SEQ ID NO: 163397 - RNA, 22 nt, Human
cugcccugucuuuuucugauga

SEQ ID NO: 163398 - RNA, 22 nt, Human
agcuugaguuuuggaugaagug

SEQ ID NO: 163399 - RNA, 22 nt, Human
gggagggaaagcuugaucuguc

SEQ ID NO: 163400 - RNA, 22 nt, Human
uacaaaugaguuguaugaacca

SEQ ID NO: 163401 - RNA, 22 nt, Human
guguggcugccagccaagaggc

SEQ ID NO: 163402 - RNA, 22 nt, Human
uuacaucuaaacugugaacaau

SEQ ID NO: 163403 - RNA, 22 nt, Human
aguggccagugcugcucugggg

SEQ ID NO: 163404 - RNA, 21 nt, Human
agagaagaggacuuucucaca

SEQ ID NO: 163405 - RNA, 22 nt, Human
augcaccugaacuccaucagcu

SEQ ID NO: 163406 - RNA, 21 nt, Human
augaagucuaugcuucugugu

SEQ ID NO: 163407 - RNA, 22 nt, Human
cucugugcccuacugcucagcu

SEQ ID NO: 163408 - RNA, 22 nt, Human
guuugucuuaauuaggcaucga

SEQ ID NO: 163409 - RNA, 21 nt, Human
ugauuuccaucuuaaaauaaa

SEQ ID NO: 163410 - RNA, 18 nt, Human
caggagcaggaguugaac

SEQ ID NO: 163411 - RNA, 23 nt, Human
gugagcagcccacuaggaaugcc

SEQ ID NO: 163412 - RNA, 19 nt, Human
aggcucugagcuccuggag

SEQ ID NO: 163413 - RNA, 22 nt, Human
guacuuccguggacuaauuguu

SEQ ID NO: 163414 - RNA, 22 nt, Human
ugaaaaggaguccuuguuuuca

SEQ ID NO: 163415 - RNA, 22 nt, Human
uaaaaguuuuaguuguacauaa

SEQ ID NO: 163416 - RNA, 22 nt, Human
ugucaugcagguuuguuauaga

SEQ ID NO: 163417 - RNA, 22 nt, Human
gccuggcaggccugggccagca

SEQ ID NO: 163418 - RNA, 18 nt, Human
ccagcaugccagaggcug

SEQ ID NO: 163419 - RNA, 22 nt, Human
uccucaggaugugggguagaau

SEQ ID NO: 163420 - RNA, 22 nt, Human
ucugcaggccucgacaaggcca

SEQ ID NO: 163421 - RNA, 22 nt, Human
aaucaguuagaaggaagagaau

SEQ ID NO: 163422 - RNA, 22 nt, Human
aaaugguguuucuaaugcuaga

SEQ ID NO: 163423 - RNA, 22 nt, Human
cacagcuuaugccacugauugg

SEQ ID NO: 163424 - RNA, 22 nt, Human
uggaagagggagcuggguggcc

SEQ ID NO: 163425 - RNA, 22 nt, Human
cuuccaaagcacuuuauggacc

SEQ ID NO: 163426 - RNA, 22 nt, Human
agugaaauagcauuuaugaagc

SEQ ID NO: 163427 - RNA, 22 nt, Human
aagggcugaaugaaggguugaa

SEQ ID NO: 163428 - RNA, 22 nt, Human
ccucuugccaaucagcuacaga

SEQ ID NO: 163429 - RNA, 18 nt, Human
gguggccuugacuucucu

SEQ ID NO: 163430 - RNA, 21 nt, Human
agcagccauuucacagagacu

SEQ ID NO: 163431 - RNA, 22 nt, Human
uauuucuugaguggucaguuuc

SEQ ID NO: 163432 - RNA, 22 nt, Human
cacugaguucccugacauuuca

SEQ ID NO: 163433 - RNA, 22 nt, Human
gcacagggcccugugcguaggu

SEQ ID NO: 163434 - RNA, 22 nt, Human
ggcacagggagccgcaguugca

SEQ ID NO: 163435 - RNA, 22 nt, Human
cugaggagagaucacguggugu

SEQ ID NO: 163436 - RNA, 22 nt, Human
acugcuuuucagagucugccug

SEQ ID NO: 163437 - RNA, 22 nt, Human
agaacagcaguuaugguucauu

SEQ ID NO: 163438 - RNA, 22 nt, Human
gggcagaggggcgcuucccucu

SEQ ID NO: 163439 - RNA, 22 nt, Human
augugaaagagguguucagugg

SEQ ID NO: 163440 - RNA, 22 nt, Human
ugagccuguccugugcauguga

SEQ ID NO: 163441 - RNA, 22 nt, Human
ucucagggccucccucuguuuc

SEQ ID NO: 163442 - RNA, 19 nt, Human
ucaaagucugagucacuuu

SEQ ID NO: 163443 - RNA, 22 nt, Human
acuuuggaucugauguaaucag

SEQ ID NO: 163444 - RNA, 22 nt, Human
agugaccaacaaugcugagaag

SEQ ID NO: 163445 - RNA, 22 nt, Human
gggcccagcgugguuccaucug

SEQ ID NO: 163446 - RNA, 22 nt, Human
ggaggccaaggcagguggauca

SEQ ID NO: 163447 - RNA, 22 nt, Human
cagggccacccucugcugggug

SEQ ID NO: 163448 - RNA, 22 nt, Human
uggggguguccuggugcacaca

SEQ ID NO: 163449 - RNA, 22 nt, Human
uggcuggggccacaguuuuccu

SEQ ID NO: 163450 - RNA, 22 nt, Human
gcuggcagguccaagauagagc

SEQ ID NO: 163451 - RNA, 22 nt, Human
ucugucuccugccagugccucu

SEQ ID NO: 163452 - RNA, 22 nt, Human
uggggcuggcacagucucuauu

SEQ ID NO: 163453 - RNA, 22 nt, Human
aggugagguuugggagguguca

SEQ ID NO: 163454 - RNA, 22 nt, Human
gcagccacagaggagggaugca

SEQ ID NO: 163455 - RNA, 19 nt, Human
ugaaggagggggauggcca

SEQ ID NO: 163456 - RNA, 22 nt, Human
ggccugagcucuggggaggcaa

SEQ ID NO: 163457 - RNA, 22 nt, Human
ccagggugcucuguggcgucgc

SEQ ID NO: 163458 - RNA, 22 nt, Human
ugauuuuuagcuauucugaaga

SEQ ID NO: 163459 - RNA, 22 nt, Human
uggaaagaugaagauguuuaag

SEQ ID NO: 163460 - RNA, 22 nt, Human
agaggcugaaugaugucaucau

SEQ ID NO: 163461 - RNA, 22 nt, Human
guggccugaugccagcccugug

SEQ ID NO: 163462 - RNA, 22 nt, Human
acaggugauucaggcucuggga

SEQ ID NO: 163463 - RNA, 22 nt, Human
aagcagcauaauugcuauuuua

SEQ ID NO: 163464 - RNA, 22 nt, Human
gcaguggggcgcugggaguugg

SEQ ID NO: 163465 - RNA, 22 nt, Human
auucuucacuguuucagaauga

SEQ ID NO: 163466 - RNA, 22 nt, Human
uugcauguuauuuaaucuguau

SEQ ID NO: 163467 - RNA, 22 nt, Human
uucuucaauuauuggaaagaaa

SEQ ID NO: 163468 - RNA, 22 nt, Human
uguguauucagcaagcgaaaca

SEQ ID NO: 163469 - RNA, 21 nt, Human
ugcuggccucaagggugacuu

SEQ ID NO: 163470 - RNA, 22 nt, Human
ugaagcagcaaaugaugggaga

SEQ ID NO: 163471 - RNA, 22 nt, Human
uugagucaguaauuccauuucu

SEQ ID NO: 163472 - RNA, 22 nt, Human
aaaucaguuguuauauuaaaga

SEQ ID NO: 163473 - RNA, 22 nt, Human
cugccuggguucaaguccuguu

SEQ ID NO: 163474 - RNA, 22 nt, Human
uuacauuuggcuauguccucua

SEQ ID NO: 163475 - RNA, 22 nt, Human
uguggccagcagguggcugugu

SEQ ID NO: 163476 - RNA, 22 nt, Human
gugccagggggcacugaacaga

SEQ ID NO: 163477 - RNA, 22 nt, Human
uuaugcuaguauaguccuuaga

SEQ ID NO: 163478 - RNA, 22 nt, Human
ggcugcaguuugucuuuugcuu

SEQ ID NO: 163479 - RNA, 22 nt, Human
acugcagccuugaacucugggc

SEQ ID NO: 163480 - RNA, 22 nt, Human
gaggcccuccagcugucagcug

SEQ ID NO: 163481 - RNA, 22 nt, Human
auacaagacucagcacagacgg

SEQ ID NO: 163482 - RNA, 22 nt, Human
gccugucugcagggcugucauu

SEQ ID NO: 163483 - RNA, 22 nt, Human
aguggggacuuaugccagcauu

SEQ ID NO: 163484 - RNA, 19 nt, Human
gcucugugaugcugagggg

SEQ ID NO: 163485 - RNA, 22 nt, Human
aaguucaagucugcaucuuuuu

SEQ ID NO: 163486 - RNA, 22 nt, Human
gagggcugcaaugagacagaga

SEQ ID NO: 163487 - RNA, 22 nt, Human
ggcuggccuguguggccgccac

SEQ ID NO: 163488 - RNA, 19 nt, Human
gucacauuugucucccagg

SEQ ID NO: 163489 - RNA, 22 nt, Human
cugcugcauuacucuucucaag

SEQ ID NO: 163490 - RNA, 22 nt, Human
uuuugaaagaguccugcuacag

SEQ ID NO: 163491 - RNA, 17 nt, Human
gaaagguccuagaaauc

SEQ ID NO: 163492 - RNA, 22 nt, Human
cugggugaguugaugaaggaga

SEQ ID NO: 163493 - RNA, 20 nt, Human
gccagcccugacacaggagc

SEQ ID NO: 163494 - RNA, 22 nt, Human
ggugggugagcccugggagcug

SEQ ID NO: 163495 - RNA, 22 nt, Human
caggggcucugagauugucuaa

SEQ ID NO: 163496 - RNA, 22 nt, Human
uaaaugugcacagguuagaagg

SEQ ID NO: 163497 - RNA, 22 nt, Human
cagcaggcguugggagaaagac

SEQ ID NO: 163498 - RNA, 22 nt, Human
agggcccuccccgcucagggca

SEQ ID NO: 163499 - RNA, 22 nt, Human
auugucugaauccaaagcucug

SEQ ID NO: 163500 - RNA, 22 nt, Human
ggagacagugguagggccuaag

SEQ ID NO: 163501 - RNA, 22 nt, Human
ggcagcuccucaaaaaauuaaa

SEQ ID NO: 163502 - RNA, 22 nt, Human
auguaucagaaauagcauuggc

SEQ ID NO: 163503 - RNA, 22 nt, Human
gucugcugcagagcauggcuuu

SEQ ID NO: 163504 - RNA, 22 nt, Human
uggccuguggcuuaaggucugu

SEQ ID NO: 163505 - RNA, 22 nt, Human
ccugcccagcuucaccucaggc

SEQ ID NO: 163506 - RNA, 22 nt, Human
uaaaugugagugaugcggugaa

SEQ ID NO: 163507 - RNA, 22 nt, Human
gcuggcucccauugguccuucc

SEQ ID NO: 163508 - RNA, 23 nt, Human
agccagggcacugguggagauug

SEQ ID NO: 163509 - RNA, 22 nt, Human
cagggccaagccccuuuggcug

SEQ ID NO: 163510 - RNA, 22 nt, Human
agggcagccugagugcuggccc

SEQ ID NO: 163511 - RNA, 22 nt, Human
uaggccaggacagagcuuccag

SEQ ID NO: 163512 - RNA, 22 nt, Human
aggcacuguggaagacaugguu

SEQ ID NO: 163513 - RNA, 22 nt, Human
cugccaaggcuggggaggacaa

SEQ ID NO: 163514 - RNA, 22 nt, Human
agcugucugucuccugaggaga

SEQ ID NO: 163515 - RNA, 22 nt, Human
gcauucaucuuccuccaugcag

SEQ ID NO: 163516 - RNA, 22 nt, Human
uccagugguaguaaagaggucu

SEQ ID NO: 163517 - RNA, 20 nt, Human
aagggcagagggaacagacu

SEQ ID NO: 163518 - RNA, 22 nt, Human
ugauuuccaaaaggcuucuaag

SEQ ID NO: 163519 - RNA, 22 nt, Human
aagcaauauacugauaugauua

SEQ ID NO: 163520 - RNA, 22 nt, Human
uaugcauauagaugcacacaca

SEQ ID NO: 163521 - RNA, 22 nt, Human
guccucugaaguugugcaaugc

SEQ ID NO: 163522 - RNA, 22 nt, Human
uggccaggcagguagaacggcc

SEQ ID NO: 163523 - RNA, 22 nt, Human
aaacaaguguaaacuagucugu

SEQ ID NO: 163524 - RNA, 22 nt, Human
ucccuguccugggcaaucccag

SEQ ID NO: 163525 - RNA, 22 nt, Human
agagccuggggauuggcaaggg

SEQ ID NO: 163526 - RNA, 22 nt, Human
uccagggcugacuugggagagg

SEQ ID NO: 163527 - RNA, 22 nt, Human
ugcccugucuaagcugucagua

SEQ ID NO: 163528 - RNA, 22 nt, Human
cuggugucugcucccucacagc

SEQ ID NO: 163529 - RNA, 22 nt, Human
ucccagccggugccuggguccc

SEQ ID NO: 163530 - RNA, 22 nt, Human
ggugccaggcuguagucagggu

SEQ ID NO: 163531 - RNA, 22 nt, Human
ggcagcaggagccaucugguag

SEQ ID NO: 163532 - RNA, 22 nt, Human
aggcugcuuccuuacguggcug

SEQ ID NO: 163533 - RNA, 22 nt, Human
auugucuucuggucuuaucuuu

SEQ ID NO: 163534 - RNA, 22 nt, Human
aaugcagugagccauuaaaugg

SEQ ID NO: 163535 - RNA, 22 nt, Human
cucaaguaagaaacagaauugg

SEQ ID NO: 163536 - RNA, 22 nt, Human
cuaaaugccuuuccuaccuaac

SEQ ID NO: 163537 - RNA, 22 nt, Human
cagcauggugccagugagucca

SEQ ID NO: 163538 - RNA, 22 nt, Human
cuggcucaguucuugguuuuca

SEQ ID NO: 163539 - RNA, 22 nt, Human
ggaaaaggccacagggacacau

SEQ ID NO: 163540 - RNA, 22 nt, Human
uuuuccucugcagagcaguuag

SEQ ID NO: 163541 - RNA, 22 nt, Human
uugugcauuucucugagugugu

SEQ ID NO: 163542 - RNA, 22 nt, Human
agguggagaagagaugggcagu

SEQ ID NO: 163543 - RNA, 17 nt, Human
ucaggauccaggguucu

SEQ ID NO: 163544 - RNA, 22 nt, Human
gccaccaggagcccaguccaaa

SEQ ID NO: 163545 - RNA, 22 nt, Human
aggcacugaaggaagcuugcgc

SEQ ID NO: 163546 - RNA, 22 nt, Human
acaguaccugcucucaagcaaa

SEQ ID NO: 163547 - RNA, 20 nt, Human
ugggccuguggcagaagucu

SEQ ID NO: 163548 - RNA, 22 nt, Human
ccuggaugauccaugucaugga

SEQ ID NO: 163549 - RNA, 22 nt, Human
agaauucuccuucagggcagga

SEQ ID NO: 163550 - RNA, 22 nt, Human
ucuuuacaguccucugucaauc

SEQ ID NO: 163551 - RNA, 20 nt, Human
cucugcugcccgccggcugc

SEQ ID NO: 163552 - RNA, 20 nt, Human
gugaccagaagacagugggu

SEQ ID NO: 163553 - RNA, 20 nt, Human
cucaggauugucuagccccu

SEQ ID NO: 163554 - RNA, 22 nt, Human
gcugcaggggggucuggacuug

SEQ ID NO: 163555 - RNA, 22 nt, Human
ggccucggcccacugcugcggu

SEQ ID NO: 163556 - RNA, 22 nt, Human
cuccagggaggucugcaggacu

SEQ ID NO: 163557 - RNA, 22 nt, Human
ccugagagagaagcgaccuggu

SEQ ID NO: 163558 - RNA, 19 nt, Human
gcaggcaguggcauucgga

SEQ ID NO: 163559 - RNA, 19 nt, Human
guggccugcgcugggugcg

SEQ ID NO: 163560 - RNA, 22 nt, Human
uacaaaugaaccaacuuugaug

SEQ ID NO: 163561 - RNA, 22 nt, Human
gugggggcaggcagugcuagga

SEQ ID NO: 163562 - RNA, 22 nt, Human
ugcccuguuaucuuggaagagu

SEQ ID NO: 163563 - RNA, 20 nt, Human
agcaggaaugaugcuuucau

SEQ ID NO: 163564 - RNA, 22 nt, Human
cuggcccauggugagcucuggg

SEQ ID NO: 163565 - RNA, 22 nt, Human
gcagaggcauuucugacgcugc

SEQ ID NO: 163566 - RNA, 22 nt, Human
uagagcugcuggacuguaacag

SEQ ID NO: 163567 - RNA, 19 nt, Human
auaaggcaggaggaaauuu

SEQ ID NO: 163568 - RNA, 22 nt, Human
cagcucugugggagcguaugug

SEQ ID NO: 163569 - RNA, 22 nt, Human
ccucugcaccauagccuucagc

SEQ ID NO: 163570 - RNA, 22 nt, Human
gcugagucuugagcacugagca

SEQ ID NO: 163571 - RNA, 22 nt, Human
caagagcuggagaggcagucua

SEQ ID NO: 163572 - RNA, 22 nt, Human
uuccauaaugagauucccagcc

SEQ ID NO: 163573 - RNA, 20 nt, Human
agugugcauuuagagucugc

SEQ ID NO: 163574 - RNA, 22 nt, Human
cccagccagccucuucccauau

SEQ ID NO: 163575 - RNA, 22 nt, Human
gcagguggauuaucagaagugc

SEQ ID NO: 163576 - RNA, 22 nt, Human
cauugcucaggcccagcaggaa

SEQ ID NO: 163577 - RNA, 22 nt, Human
ccacagcugaccgcaggugagc

SEQ ID NO: 163578 - RNA, 22 nt, Human
ggccuguccagccugccuggcu

SEQ ID NO: 163579 - RNA, 22 nt, Human
agugcugucccgacaacugagg

SEQ ID NO: 163580 - RNA, 22 nt, Human
accucugcaguagggcugugcc

SEQ ID NO: 163581 - RNA, 22 nt, Human
uagcacaucuggcgcuuauagg

SEQ ID NO: 163582 - RNA, 22 nt, Human
ugaaagcucugucaucauuccu

SEQ ID NO: 163583 - RNA, 22 nt, Human
gccuucccacccugcgaggcug

SEQ ID NO: 163584 - RNA, 22 nt, Human
ggaggggccggcugccugccac

SEQ ID NO: 163585 - RNA, 22 nt, Human
uagaaaucuacuuagacuuucu

SEQ ID NO: 163586 - RNA, 22 nt, Human
cugggcuguucugccccugggu

SEQ ID NO: 163587 - RNA, 21 nt, Human
uuagcaaagcaaacacaugcu

SEQ ID NO: 163588 - RNA, 20 nt, Human
gcugccuguuucuguaagua

SEQ ID NO: 163589 - RNA, 23 nt, Human
uaagaacagacaagcauuuacau

SEQ ID NO: 163590 - RNA, 22 nt, Human
cccagacauaacagcagagagg

SEQ ID NO: 163591 - RNA, 22 nt, Human
cccucugccugggaccaagucc

SEQ ID NO: 163592 - RNA, 19 nt, Human
ucucuggggacacuuucac

SEQ ID NO: 163593 - RNA, 22 nt, Human
aggagcugagucagcccgacag

SEQ ID NO: 163594 - RNA, 22 nt, Human
gaaagaggaaggagauguauua

SEQ ID NO: 163595 - RNA, 22 nt, Human
gccuggugguauccuggcaaga

SEQ ID NO: 163596 - RNA, 22 nt, Human
agcagcucuggcacuguagcau

SEQ ID NO: 163597 - RNA, 22 nt, Human
cuggcucccagcuuucagggag

SEQ ID NO: 163598 - RNA, 22 nt, Human
auccuugagccuuaucuuuugu

SEQ ID NO: 163599 - RNA, 22 nt, Human
ccuggcuggcaagaucgugaag

SEQ ID NO: 163600 - RNA, 22 nt, Human
caagaacaguuugccaaauugg

SEQ ID NO: 163601 - RNA, 22 nt, Human
agcugccacaugcccaagggca

SEQ ID NO: 163602 - RNA, 22 nt, Human
augaugugugcugaucaagcuu

SEQ ID NO: 163603 - RNA, 22 nt, Human
uacuuucuagcucuccccaguu

SEQ ID NO: 163604 - RNA, 22 nt, Human
uccucaggaucuaggagugcuu

SEQ ID NO: 163605 - RNA, 22 nt, Human
gugucccagccccacaggccug

SEQ ID NO: 163606 - RNA, 22 nt, Human
cauguuuucuaggcuuucacaa

SEQ ID NO: 163607 - RNA, 22 nt, Human
agccacagugcaagagagaaaa

SEQ ID NO: 163608 - RNA, 22 nt, Human
agagacaggguuuugccauguu

SEQ ID NO: 163609 - RNA, 22 nt, Human
aagugguagacaaagauaauug

SEQ ID NO: 163610 - RNA, 22 nt, Human
uccugggccuguacuccauccg

SEQ ID NO: 163611 - RNA, 22 nt, Human
auuauaggcuugagccaccgug

SEQ ID NO: 163612 - RNA, 22 nt, Human
gugggcuucuguuagggaggcu

SEQ ID NO: 163613 - RNA, 22 nt, Human
ugcagcaggcacaggacggaag

SEQ ID NO: 163614 - RNA, 22 nt, Human
aaucagaauuuauugaaucuuu

SEQ ID NO: 163615 - RNA, 22 nt, Human
agcacagauucugaagaguccu

SEQ ID NO: 163616 - RNA, 17 nt, Human
gcuggcugacccaugcc

SEQ ID NO: 163617 - RNA, 22 nt, Human
cagaggccaccuguggccacug

SEQ ID NO: 163618 - RNA, 22 nt, Human
ucacugaauacuugucucaucc

SEQ ID NO: 163619 - RNA, 22 nt, Human
cuuauguauauuuggaacguac

SEQ ID NO: 163620 - RNA, 19 nt, Human
ggcugccuggagcgagggc

SEQ ID NO: 163621 - RNA, 22 nt, Human
aagccucaccuuuuagaagcua

SEQ ID NO: 163622 - RNA, 21 nt, Human
gggcagaggggccuccugggu

SEQ ID NO: 163623 - RNA, 22 nt, Human
ucuggccuauuucugucagauc

SEQ ID NO: 163624 - RNA, 22 nt, Human
uccaggaggguuuucugccuuc

SEQ ID NO: 163625 - RNA, 22 nt, Human
ucugccuuggcaaccacagcuu

SEQ ID NO: 163626 - RNA, 22 nt, Human
agccacgucccugucaggguca

SEQ ID NO: 163627 - RNA, 22 nt, Human
guggccugggguuuguucugag

SEQ ID NO: 163628 - RNA, 19 nt, Human
aagggcugggcaccucacu

SEQ ID NO: 163629 - RNA, 23 nt, Human
uccagcagagccuuccaggaggg

SEQ ID NO: 163630 - RNA, 22 nt, Human
caaggagauaaaauguugagcu

SEQ ID NO: 163631 - RNA, 21 nt, Human
uucagcaguccucuagagaua

SEQ ID NO: 163632 - RNA, 22 nt, Human
aauaacaggcucaucagaugcu

SEQ ID NO: 163633 - RNA, 22 nt, Human
ucucccacuggccuuguaugau

SEQ ID NO: 163634 - RNA, 22 nt, Human
cugggagucuggccucuggucc

SEQ ID NO: 163635 - RNA, 22 nt, Human
ucauguaaguauagaaagcagu

SEQ ID NO: 163636 - RNA, 22 nt, Human
gcagugacagggcugcugccuu

SEQ ID NO: 163637 - RNA, 22 nt, Human
caguacuuuucaaccaguauga

SEQ ID NO: 163638 - RNA, 22 nt, Human
ugggcugcacccucagccucug

SEQ ID NO: 163639 - RNA, 22 nt, Human
agccauugaauuuagugccuuu

SEQ ID NO: 163640 - RNA, 22 nt, Human
agcuuccugaugcaagagggcu

SEQ ID NO: 163641 - RNA, 22 nt, Human
ugucagaacucuauugaugucc

SEQ ID NO: 163642 - RNA, 22 nt, Human
caaagguauaaguuaauauaca

SEQ ID NO: 163643 - RNA, 22 nt, Human
gaaggccuagggaugcucugcg

SEQ ID NO: 163644 - RNA, 22 nt, Human
agacagggucuugaucagagcu

SEQ ID NO: 163645 - RNA, 22 nt, Human
aagggaggaggauuuauuguac

SEQ ID NO: 163646 - RNA, 22 nt, Human
ugguuugcccacucgagugauu

SEQ ID NO: 163647 - RNA, 22 nt, Human
gcaucuucacacaaagccagug

SEQ ID NO: 163648 - RNA, 22 nt, Human
ucuuuggauaucgcuagaccgu

SEQ ID NO: 163649 - RNA, 18 nt, Human
agagcagcggcaucacac

SEQ ID NO: 163650 - RNA, 20 nt, Human
gaaaugugaccucuucugug

SEQ ID NO: 163651 - RNA, 23 nt, Human
gugauuucagggaacagaaucag

SEQ ID NO: 163652 - RNA, 22 nt, Human
uaggggugaggccaggcaucag

SEQ ID NO: 163653 - RNA, 22 nt, Human
agccagugcaacagcagugaag

SEQ ID NO: 163654 - RNA, 22 nt, Human
gccuggaguucagccaaguccc

SEQ ID NO: 163655 - RNA, 22 nt, Human
uaguccauuuucacacugcuga

SEQ ID NO: 163656 - RNA, 22 nt, Human
uggcugcucaagggaggaggcu

SEQ ID NO: 163657 - RNA, 22 nt, Human
aggcccugggcaguucuguagc

SEQ ID NO: 163658 - RNA, 22 nt, Human
aagcagaauuucccacuaguug

SEQ ID NO: 163659 - RNA, 22 nt, Human
agggcucugagugggaaagagg

SEQ ID NO: 163660 - RNA, 22 nt, Human
ugaaagcacucacuucugcucu

SEQ ID NO: 163661 - RNA, 22 nt, Human
agugggcaugaucuggugucug

SEQ ID NO: 163662 - RNA, 21 nt, Human
guguuuccuguuuauggcuug

SEQ ID NO: 163663 - RNA, 22 nt, Human
cuacauggagaagaaaauucuu

SEQ ID NO: 163664 - RNA, 22 nt, Human
cauacauaugcauguguguaua

SEQ ID NO: 163665 - RNA, 20 nt, Human
ugcuuccuggccacugcggg

SEQ ID NO: 163666 - RNA, 22 nt, Human
ggucccaggcugcgggcuggug

SEQ ID NO: 163667 - RNA, 22 nt, Human
ggcuucagugacuggugcccuc

SEQ ID NO: 163668 - RNA, 22 nt, Human
ucagcaguguaguuuaucauuc

SEQ ID NO: 163669 - RNA, 22 nt, Human
uuccuguauuuugcgaauuuuc

SEQ ID NO: 163670 - RNA, 22 nt, Human
gcugagcugggacaguccuggg

SEQ ID NO: 163671 - RNA, 22 nt, Human
gucagaggaauggaugagugau

SEQ ID NO: 163672 - RNA, 22 nt, Human
gagccaggcaccuucuguguug

SEQ ID NO: 163673 - RNA, 20 nt, Human
ccuggaagagcuccccaggc

SEQ ID NO: 163674 - RNA, 22 nt, Human
cugcccugacugaccuuuugaa

SEQ ID NO: 163675 - RNA, 22 nt, Human
auguuacagaaagcaaagauga

SEQ ID NO: 163676 - RNA, 21 nt, Human
agaugaggauacugaggccua

SEQ ID NO: 163677 - RNA, 22 nt, Human
ccagcccuucccaacuggccag

SEQ ID NO: 163678 - RNA, 22 nt, Human
agagccagcaagugaauaguga

SEQ ID NO: 163679 - RNA, 22 nt, Human
aggcucugguuggcaaguaaag

SEQ ID NO: 163680 - RNA, 22 nt, Human
uacaaagugugcccaugcugag

SEQ ID NO: 163681 - RNA, 21 nt, Human
aucuuuauuacgcagagaaga

SEQ ID NO: 163682 - RNA, 22 nt, Human
aagauuucucuccuggaaagca

SEQ ID NO: 163683 - RNA, 22 nt, Human
ccaggagguggagauugcagug

SEQ ID NO: 163684 - RNA, 21 nt, Human
ucccugcuuucuggcccaguc

SEQ ID NO: 163685 - RNA, 22 nt, Human
cuggguggcagagccugcagug

SEQ ID NO: 163686 - RNA, 17 nt, Human
ccagguggaaucgugga

SEQ ID NO: 163687 - RNA, 22 nt, Human
ggcagggcuugucucugugaug

SEQ ID NO: 163688 - RNA, 22 nt, Human
auaaaaacugacccauccuuug

SEQ ID NO: 163689 - RNA, 17 nt, Human
gccaaaggguuccaauc

SEQ ID NO: 163690 - RNA, 22 nt, Human
ucuggcaggcaaucggcucugg

SEQ ID NO: 163691 - RNA, 22 nt, Human
cuuggccucuucucaggguggg

SEQ ID NO: 163692 - RNA, 22 nt, Human
gaaggaaaucugugauuuaugc

SEQ ID NO: 163693 - RNA, 22 nt, Human
cagggugccucccgcucgccgg

SEQ ID NO: 163694 - RNA, 22 nt, Human
aaaugcacugaacacauguugu

SEQ ID NO: 163695 - RNA, 19 nt, Human
acacagggcuagaguuaca

SEQ ID NO: 163696 - RNA, 20 nt, Human
gacaggagaguuagguaggu

SEQ ID NO: 163697 - RNA, 22 nt, Human
aggguggccaugagggagagau

SEQ ID NO: 163698 - RNA, 22 nt, Human
uccacugcagcuucugauggaa

SEQ ID NO: 163699 - RNA, 22 nt, Human
uucuugauuucaugcaguuaag

SEQ ID NO: 163700 - RNA, 22 nt, Human
augaagcuaaacccugcagcca

SEQ ID NO: 163701 - RNA, 22 nt, Human
ugcaguggaaucuggagagcag

SEQ ID NO: 163702 - RNA, 22 nt, Human
ccagcccucacugaggccucuc

SEQ ID NO: 163703 - RNA, 22 nt, Human
acagaauugaaaguauaaucug

SEQ ID NO: 163704 - RNA, 22 nt, Human
ucaguuuuuguuugccagauag

SEQ ID NO: 163705 - RNA, 22 nt, Human
ugcucuccggcuuccguggccu

SEQ ID NO: 163706 - RNA, 22 nt, Human
aagaaaugcagaaaugugcugg

SEQ ID NO: 163707 - RNA, 22 nt, Human
aggcccugcccagagcuccucg

SEQ ID NO: 163708 - RNA, 22 nt, Human
aagaaauguagagccuaguaaa

SEQ ID NO: 163709 - RNA, 22 nt, Human
ucaggagauggucuuuauaggc

SEQ ID NO: 163710 - RNA, 22 nt, Human
ccaggccucuggcugcuuaguc

SEQ ID NO: 163711 - RNA, 22 nt, Human
cugcagcuuuggaaaccuguuu

SEQ ID NO: 163712 - RNA, 22 nt, Human
agcugcagucaagcugggccac

SEQ ID NO: 163713 - RNA, 22 nt, Human
uggcagcagccauggaaggccc

SEQ ID NO: 163714 - RNA, 22 nt, Human
ccagggcagccaacccagaugc

SEQ ID NO: 163715 - RNA, 22 nt, Human
cuguuuuugugcugugucuccc

SEQ ID NO: 163716 - RNA, 22 nt, Human
gagaugaauguaaacaaaggca

SEQ ID NO: 163717 - RNA, 21 nt, Human
agauuguauggaggugagagg

SEQ ID NO: 163718 - RNA, 22 nt, Human
ucaggggaaaucucucagcgaa

SEQ ID NO: 163719 - RNA, 22 nt, Human
uagagcuguaucaaagagccuu

SEQ ID NO: 163720 - RNA, 22 nt, Human
acuucucuucauagguggcaau

SEQ ID NO: 163721 - RNA, 22 nt, Human
ucccacacagcccgcucaccgg

SEQ ID NO: 163722 - RNA, 22 nt, Human
cuguggcugcagccuugguccu

SEQ ID NO: 163723 - RNA, 22 nt, Human
ggcaucuguccaucucuccagc

SEQ ID NO: 163724 - RNA, 22 nt, Human
gaaucacgguauucugcacggg

SEQ ID NO: 163725 - RNA, 22 nt, Human
aggagcuguuuuguucagcaaa

SEQ ID NO: 163726 - RNA, 22 nt, Human
cuuggcagauccaaaaaugaca

SEQ ID NO: 163727 - RNA, 22 nt, Human
gcugcccaguucugcugcugcc

SEQ ID NO: 163728 - RNA, 22 nt, Human
uggcagcuggagggcaauggcc

SEQ ID NO: 163729 - RNA, 22 nt, Human
acauuucucauucuccccuaac

SEQ ID NO: 163730 - RNA, 22 nt, Human
agcucccagggcugggcaaguu

SEQ ID NO: 163731 - RNA, 22 nt, Human
uagggcagauucgguggaguuu

SEQ ID NO: 163732 - RNA, 22 nt, Human
caagaaauguuuacugagcauc

SEQ ID NO: 163733 - RNA, 22 nt, Human
uucaagauggcaccagugagug

SEQ ID NO: 163734 - RNA, 22 nt, Human
gugucccaggagaggagacaau

SEQ ID NO: 163735 - RNA, 22 nt, Human
accucugccaagaugugcuccc

SEQ ID NO: 163736 - RNA, 22 nt, Human
ggugggcaggucacucugccuc

SEQ ID NO: 163737 - RNA, 22 nt, Human
uggcagcugaggggaggcuuug

SEQ ID NO: 163738 - RNA, 20 nt, Human
gcaaggcacagugaggaggg

SEQ ID NO: 163739 - RNA, 22 nt, Human
ugagaauuacaaaugagucaca

SEQ ID NO: 163740 - RNA, 22 nt, Human
caaacugagcaucagaaaguuu

SEQ ID NO: 163741 - RNA, 22 nt, Human
gccccucccagucaggagcacu

SEQ ID NO: 163742 - RNA, 19 nt, Human
ccugucugucuucagcuag

SEQ ID NO: 163743 - RNA, 22 nt, Human
uucauucccuuauauuagcauu

SEQ ID NO: 163744 - RNA, 22 nt, Human
uagucccauuuugagguauuug

SEQ ID NO: 163745 - RNA, 22 nt, Human
gcugagugagguccagagcuug

SEQ ID NO: 163746 - RNA, 22 nt, Human
gcucagggaacuuuuugcaggc

SEQ ID NO: 163747 - RNA, 23 nt, Human
aaguaacagggauaauagcaguu

SEQ ID NO: 163748 - RNA, 22 nt, Human
ucagagugguagccuauuuucu

SEQ ID NO: 163749 - RNA, 22 nt, Human
aauacaaucaaauucacuagca

SEQ ID NO: 163750 - RNA, 22 nt, Human
ugcucugggcaacagccucccu

SEQ ID NO: 163751 - RNA, 22 nt, Human
cugucuccagggcaggugcagg

SEQ ID NO: 163752 - RNA, 22 nt, Human
ugucucagggcagcagcagggg

SEQ ID NO: 163753 - RNA, 22 nt, Human
auaauaaaccaggaugggucug

SEQ ID NO: 163754 - RNA, 22 nt, Human
gaggcagcagggcugguuccuu

SEQ ID NO: 163755 - RNA, 22 nt, Human
ggucccaguccucucccugcua

SEQ ID NO: 163756 - RNA, 22 nt, Human
uauuuugucuucugcucaucac

SEQ ID NO: 163757 - RNA, 22 nt, Human
aaggccugggaguacugggaca

SEQ ID NO: 163758 - RNA, 22 nt, Human
uucucuagguuuuagaugaaga

SEQ ID NO: 163759 - RNA, 22 nt, Human
aaaucaguuggaacacaagcag

SEQ ID NO: 163760 - RNA, 22 nt, Human
gugacagaguuuuagaucucau

SEQ ID NO: 163761 - RNA, 22 nt, Human
auuuaguguguauugcuauuau

SEQ ID NO: 163762 - RNA, 22 nt, Human
agggcagagagaugaaugggau

SEQ ID NO: 163763 - RNA, 22 nt, Human
ugugccuggcauucugggcuuc

SEQ ID NO: 163764 - RNA, 22 nt, Human
augcugagacuggagcagcugg

SEQ ID NO: 163765 - RNA, 22 nt, Human
gcugugcagguccccacugccu

SEQ ID NO: 163766 - RNA, 22 nt, Human
gagaggccaccugacgagcagu

SEQ ID NO: 163767 - RNA, 22 nt, Human
ccuggagcuuuuccauccugga

SEQ ID NO: 163768 - RNA, 18 nt, Human
aaguaacagaagagcaca

SEQ ID NO: 163769 - RNA, 22 nt, Human
cggcagcuccgcgccguaggac

SEQ ID NO: 163770 - RNA, 16 nt, Human
gggcugggggauucug

SEQ ID NO: 163771 - RNA, 22 nt, Human
uacaguaucuucuggcaagcau

SEQ ID NO: 163772 - RNA, 22 nt, Human
ugggaggagcccucugggaagg

SEQ ID NO: 163773 - RNA, 19 nt, Human
gggcucuggccucaguggg

SEQ ID NO: 163774 - RNA, 22 nt, Human
ucugccagaaguucugagagua

SEQ ID NO: 163775 - RNA, 20 nt, Human
uaugaagauaugugaacagc

SEQ ID NO: 163776 - RNA, 20 nt, Human
gccuggcacccggggcuggc

SEQ ID NO: 163777 - RNA, 22 nt, Human
gcaggcugaugacuggaguugg

SEQ ID NO: 163778 - RNA, 22 nt, Human
uuuuaagaugcuaguauuucag

SEQ ID NO: 163779 - RNA, 22 nt, Human
ucacugcagagaccucuaguca

SEQ ID NO: 163780 - RNA, 22 nt, Human
cugagcugggaguagagacucu

SEQ ID NO: 163781 - RNA, 21 nt, Human
ucaaagcacauauuugcacau

SEQ ID NO: 163782 - RNA, 22 nt, Human
auuguacaugcagugagucauc

SEQ ID NO: 163783 - RNA, 22 nt, Human
ggucucagaucuuuauuaaggc

SEQ ID NO: 163784 - RNA, 21 nt, Human
agagcugggacuugccugaga

SEQ ID NO: 163785 - RNA, 22 nt, Human
aggcacugaccugcuuccuuga

SEQ ID NO: 163786 - RNA, 22 nt, Human
aggacccugagcgggcaugccg

SEQ ID NO: 163787 - RNA, 22 nt, Human
guggccucugugcuccugccua

SEQ ID NO: 163788 - RNA, 22 nt, Human
agggaaagguagugaggucaca

SEQ ID NO: 163789 - RNA, 22 nt, Human
ggcugcagaaguacuuccggau

SEQ ID NO: 163790 - RNA, 22 nt, Human
ccucucuguguggccucuccau

SEQ ID NO: 163791 - RNA, 22 nt, Human
uccugagaugagacagugcugc

SEQ ID NO: 163792 - RNA, 22 nt, Human
ugaacagaucaauagaacugac

SEQ ID NO: 163793 - RNA, 22 nt, Human
cccagcagccagaaugaggagc

SEQ ID NO: 163794 - RNA, 22 nt, Human
acagcuguggccacuugcaucc

SEQ ID NO: 163795 - RNA, 22 nt, Human
ugagcccagagcccuuguaggg

SEQ ID NO: 163796 - RNA, 22 nt, Human
cagccacguagcccuuggccgu

SEQ ID NO: 163797 - RNA, 17 nt, Human
ugcauuguaggcuagcc

SEQ ID NO: 163798 - RNA, 22 nt, Human
cucugcagaggcccaaggcuga

SEQ ID NO: 163799 - RNA, 22 nt, Human
cugggcuucucccccuggcaga

SEQ ID NO: 163800 - RNA, 22 nt, Human
ucacaugcuugaggaaagaaaa

SEQ ID NO: 163801 - RNA, 22 nt, Human
gagcacaggcuuugguggacac

SEQ ID NO: 163802 - RNA, 22 nt, Human
uacauauacugagugauuugcu

SEQ ID NO: 163803 - RNA, 22 nt, Human
gaaaaugugccuuuggguauug

SEQ ID NO: 163804 - RNA, 22 nt, Human
aaguauauuuuuugaagcauau

SEQ ID NO: 163805 - RNA, 22 nt, Human
uccaggacuagcauuucugaua

SEQ ID NO: 163806 - RNA, 22 nt, Human
uuguauuagcuguaaauuuucu

SEQ ID NO: 163807 - RNA, 22 nt, Human
aggcucaggcaggaauggcgga

SEQ ID NO: 163808 - RNA, 22 nt, Human
gacccagcuuaagucacauguu

SEQ ID NO: 163809 - RNA, 22 nt, Human
auacaucuuccuuuuaaaaugc

SEQ ID NO: 163810 - RNA, 22 nt, Human
uauaauccauucauugauuucu

SEQ ID NO: 163811 - RNA, 22 nt, Human
ugaaggaaaugacggcagaaga

SEQ ID NO: 163812 - RNA, 19 nt, Human
uccauaagcuuguguucau

SEQ ID NO: 163813 - RNA, 22 nt, Human
ucuuugcaugugcuucuuggcc

SEQ ID NO: 163814 - RNA, 22 nt, Human
gaucaaaagcuggguucuaaaa

SEQ ID NO: 163815 - RNA, 22 nt, Human
cuggggugucucgucugccauu

SEQ ID NO: 163816 - RNA, 22 nt, Human
uggccugcccagagcagcucug

SEQ ID NO: 163817 - RNA, 22 nt, Human
gcacagggccuggcacauaaga

SEQ ID NO: 163818 - RNA, 22 nt, Human
uuucagauggagguuuaggaca

SEQ ID NO: 163819 - RNA, 22 nt, Human
ccaggguggggcaggcccacug

SEQ ID NO: 163820 - RNA, 22 nt, Human
uuuucacacaaggugauaaguu

SEQ ID NO: 163821 - RNA, 22 nt, Human
gcugcccaggguggagccggcu

SEQ ID NO: 163822 - RNA, 22 nt, Human
agucccagcucagaaccacuag

SEQ ID NO: 163823 - RNA, 22 nt, Human
ccuggaggagcgcugaccagcu

SEQ ID NO: 163824 - RNA, 22 nt, Human
ucugugaacaucacauugacag

SEQ ID NO: 163825 - RNA, 22 nt, Human
aggucacauggauaaugaucag

SEQ ID NO: 163826 - RNA, 22 nt, Human
ccagagcuucggggcggcugua

SEQ ID NO: 163827 - RNA, 22 nt, Human
uaaaguucuggugagagguaag

SEQ ID NO: 163828 - RNA, 22 nt, Human
ugcccaagcagaggagugauuc

SEQ ID NO: 163829 - RNA, 22 nt, Human
gcaggguccauggaggcagccc

SEQ ID NO: 163830 - RNA, 22 nt, Human
gucagcaggguccccuugagug

SEQ ID NO: 163831 - RNA, 22 nt, Human
agcagcucuuaacaaagcaugg

SEQ ID NO: 163832 - RNA, 22 nt, Human
aaagccuucaaguagauguaag

SEQ ID NO: 163833 - RNA, 22 nt, Human
auggggcuguucucugcccugc

SEQ ID NO: 163834 - RNA, 22 nt, Human
ggucacaggggagaagagugau

SEQ ID NO: 163835 - RNA, 22 nt, Human
gacagggcauggugcagaguuc

SEQ ID NO: 163836 - RNA, 22 nt, Human
cuagaaauacaggcacgugcca

SEQ ID NO: 163837 - RNA, 22 nt, Human
ugcagaagcugcaggucagugg

SEQ ID NO: 163838 - RNA, 22 nt, Human
gagggcagugaauuuugaagcu

SEQ ID NO: 163839 - RNA, 22 nt, Human
cagggcugguuugucgaagaaa

SEQ ID NO: 163840 - RNA, 22 nt, Human
uagggcuauucugaguaauaau

SEQ ID NO: 163841 - RNA, 22 nt, Human
cccugcaggggaccugcagccu

SEQ ID NO: 163842 - RNA, 22 nt, Human
ccuggcaggcuggggacagugc

SEQ ID NO: 163843 - RNA, 22 nt, Human
aucagcaaaaaugccuucagaa

SEQ ID NO: 163844 - RNA, 22 nt, Human
ggcaggagggcggacaaugacc

SEQ ID NO: 163845 - RNA, 22 nt, Human
ucacaugcucaccuaagccaca

SEQ ID NO: 163846 - RNA, 22 nt, Human
uagaggugacacugagaccaua

SEQ ID NO: 163847 - RNA, 21 nt, Human
ccugccaggaaacugaguguc

SEQ ID NO: 163848 - RNA, 22 nt, Human
uaaauguaccuucugccuuacu

SEQ ID NO: 163849 - RNA, 22 nt, Human
aaaaagauguccugaaguuuag

SEQ ID NO: 163850 - RNA, 22 nt, Human
aagccgggccugagaaaugaca

SEQ ID NO: 163851 - RNA, 22 nt, Human
uccucaugccgggucucacgcu

SEQ ID NO: 163852 - RNA, 19 nt, Human
cugaggcccauguaccaug

SEQ ID NO: 163853 - RNA, 22 nt, Human
ucugaggcauacccaggccccc

SEQ ID NO: 163854 - RNA, 22 nt, Human
gggaguggguuuggccuaggcc

SEQ ID NO: 163855 - RNA, 22 nt, Human
gcaggcaggagcccaacugccu

SEQ ID NO: 163856 - RNA, 22 nt, Human
gugauuucuaaucaucugaaug

SEQ ID NO: 163857 - RNA, 21 nt, Human
uggcugccuacaugcugcagg

SEQ ID NO: 163858 - RNA, 22 nt, Human
cugcagccucaaccuccugagc

SEQ ID NO: 163859 - RNA, 22 nt, Human
ucucagagaacaguuggugcuu

SEQ ID NO: 163860 - RNA, 22 nt, Human
cuccagggagcuguggagguuu

SEQ ID NO: 163861 - RNA, 22 nt, Human
cccccaggcucugacacaggag

SEQ ID NO: 163862 - RNA, 22 nt, Human
ugcaggugaaaauuaugaggau

SEQ ID NO: 163863 - RNA, 17 nt, Human
ugagacagggcaggccc

SEQ ID NO: 163864 - RNA, 22 nt, Human
uucaaagugcauguuccucaga

SEQ ID NO: 163865 - RNA, 20 nt, Human
agacccuguguccuguggcc

SEQ ID NO: 163866 - RNA, 23 nt, Human
gcagacagagcagacuaagacaa

SEQ ID NO: 163867 - RNA, 19 nt, Human
gugauuucuuuccacaagc

SEQ ID NO: 163868 - RNA, 22 nt, Human
gucaggggccaugggccaagga

SEQ ID NO: 163869 - RNA, 22 nt, Human
uuccaggaauucagcucucagu

SEQ ID NO: 163870 - RNA, 22 nt, Human
cuucagggugacgcaggcugca

SEQ ID NO: 163871 - RNA, 22 nt, Human
ugcaccauuuugucaggcuacu

SEQ ID NO: 163872 - RNA, 22 nt, Human
uaauaaaugaaagugcuggcau

SEQ ID NO: 163873 - RNA, 22 nt, Human
ggcugggccagggccuguggac

SEQ ID NO: 163874 - RNA, 22 nt, Human
ucugccugagggagcugaggaa

SEQ ID NO: 163875 - RNA, 22 nt, Human
ccacagaggacaacugccuggc

SEQ ID NO: 163876 - RNA, 22 nt, Human
acuguguguuugucuagcacag

SEQ ID NO: 163877 - RNA, 22 nt, Human
uuuccuuccaaaugcccgggag

SEQ ID NO: 163878 - RNA, 22 nt, Human
cauugcacuucugcuuuuccuc

SEQ ID NO: 163879 - RNA, 22 nt, Human
agcuggagcuucaagcagguaa

SEQ ID NO: 163880 - RNA, 22 nt, Human
ccaggccuuccaguacgcagaa

SEQ ID NO: 163881 - RNA, 22 nt, Human
gagccuggccuccugccucagc

SEQ ID NO: 163882 - RNA, 22 nt, Human
ugucucugccagcuagcagaau

SEQ ID NO: 163883 - RNA, 22 nt, Human
guggagcccugguagggacccc

SEQ ID NO: 163884 - RNA, 22 nt, Human
aggagcugcauggauaccuggu

SEQ ID NO: 163885 - RNA, 23 nt, Human
cucugcaggagagugggcagggc

SEQ ID NO: 163886 - RNA, 20 nt, Human
cccucccagaugcuucccaa

SEQ ID NO: 163887 - RNA, 22 nt, Human
guaagggauuugaacauagguu

SEQ ID NO: 163888 - RNA, 22 nt, Human
gaagagcuaaaggcacaggcuu

SEQ ID NO: 163889 - RNA, 23 nt, Human
ccucccaccuauuucacuuucuu

SEQ ID NO: 163890 - RNA, 22 nt, Human
gcagcuggcucagagagguggg

SEQ ID NO: 163891 - RNA, 21 nt, Human
ccagcagcucaaggaucucuu

SEQ ID NO: 163892 - RNA, 22 nt, Human
gcugagcugaggcagggcuggg

SEQ ID NO: 163893 - RNA, 22 nt, Human
gcagauggcugagccugcagau

SEQ ID NO: 163894 - RNA, 22 nt, Human
cugaggccuaagacaugaauga

SEQ ID NO: 163895 - RNA, 20 nt, Human
uucauucauuccacaacuuc

SEQ ID NO: 163896 - RNA, 22 nt, Human
gcccuuccuuagacagcaggau

SEQ ID NO: 163897 - RNA, 22 nt, Human
ggaaagagcuaaaagggugaga

SEQ ID NO: 163898 - RNA, 20 nt, Human
auuccauaguuggcacuuuu

SEQ ID NO: 163899 - RNA, 17 nt, Human
uggcucugaggcugaau

SEQ ID NO: 163900 - RNA, 22 nt, Human
ggcagaagaaaggcuaagucuc

SEQ ID NO: 163901 - RNA, 22 nt, Human
uggcuggcaguaggcuaguggc

SEQ ID NO: 163902 - RNA, 22 nt, Human
gcagagcucaagguguucagcu

SEQ ID NO: 163903 - RNA, 21 nt, Human
cagaggccucaugcucugugc

SEQ ID NO: 163904 - RNA, 22 nt, Human
agcugccuguccuaggccauca

SEQ ID NO: 163905 - RNA, 22 nt, Human
gcccugggauuggguggaggcu

SEQ ID NO: 163906 - RNA, 22 nt, Human
gcagauggaaagugcuugaggg

SEQ ID NO: 163907 - RNA, 22 nt, Human
uccugccuaccuugcggaggug

SEQ ID NO: 163908 - RNA, 22 nt, Human
gaggucaauaauaugugcuuua

SEQ ID NO: 163909 - RNA, 22 nt, Human
agggagagguugaaaccucagu

SEQ ID NO: 163910 - RNA, 22 nt, Human
ccagccagcugcccuuggggcc

SEQ ID NO: 163911 - RNA, 22 nt, Human
aggagucacucagggcuucauc

SEQ ID NO: 163912 - RNA, 22 nt, Human
acaacaggguaaggcaggccau

SEQ ID NO: 163913 - RNA, 22 nt, Human
aaaaugaggucaauauccuuuu

SEQ ID NO: 163914 - RNA, 22 nt, Human
agauaugacuagaagcucauuu

SEQ ID NO: 163915 - RNA, 22 nt, Human
ggccuuggugccauggccaguu

SEQ ID NO: 163916 - RNA, 22 nt, Human
cagcuggaugggagaccauguu

SEQ ID NO: 163917 - RNA, 19 nt, Human
gcuguauuaaagauacaug

SEQ ID NO: 163918 - RNA, 22 nt, Human
cagcugaggucaaagaagcagg

SEQ ID NO: 163919 - RNA, 22 nt, Human
ugcucugguaacucacuuccau

SEQ ID NO: 163920 - RNA, 22 nt, Human
gccucugcugacaagauggaca

SEQ ID NO: 163921 - RNA, 22 nt, Human
aauguacaaaagucagccaacu

SEQ ID NO: 163922 - RNA, 21 nt, Human
cagcuuugucugucuucgggg

SEQ ID NO: 163923 - RNA, 23 nt, Human
ugggccuggaaagccuuagagag

SEQ ID NO: 163924 - RNA, 22 nt, Human
gcagggcagccacaggcccccu

SEQ ID NO: 163925 - RNA, 21 nt, Human
cagugcucaaucugacagugg

SEQ ID NO: 163926 - RNA, 22 nt, Human
gcaaaugcuaaaguguagagac

SEQ ID NO: 163927 - RNA, 20 nt, Human
gugggcagcaggcauacugg

SEQ ID NO: 163928 - RNA, 22 nt, Human
gcaaggcugagcacauuugcau

SEQ ID NO: 163929 - RNA, 22 nt, Human
ggcuucaccaggugcaugcaug

SEQ ID NO: 163930 - RNA, 22 nt, Human
augucuuuauaaauguauaaug

SEQ ID NO: 163931 - RNA, 22 nt, Human
gcucaggaaacagcagggcuug

SEQ ID NO: 163932 - RNA, 22 nt, Human
gaggggcucuuuaauaguaaca

SEQ ID NO: 163933 - RNA, 22 nt, Human
aggucauugaaguuauuuucuu

SEQ ID NO: 163934 - RNA, 22 nt, Human
cagagccaaaccucagggcccg

SEQ ID NO: 163935 - RNA, 22 nt, Human
ugauuucauaguauauacauga

SEQ ID NO: 163936 - RNA, 22 nt, Human
gaggucagucagaccaggguuu

SEQ ID NO: 163937 - RNA, 22 nt, Human
ugcaagaggaauucuagaagca

SEQ ID NO: 163938 - RNA, 22 nt, Human
agagucuuccaggcagccugag

SEQ ID NO: 163939 - RNA, 22 nt, Human
gcagugcuuuagucuguccuuu

SEQ ID NO: 163940 - RNA, 22 nt, Human
ccucccuuggccauagccagcc

SEQ ID NO: 163941 - RNA, 22 nt, Human
cagcaggggaacugugggccag

SEQ ID NO: 163942 - RNA, 22 nt, Human
ccugucuguauugguuugcuau

SEQ ID NO: 163943 - RNA, 22 nt, Human
cuuuggcaugguccucacuaua

SEQ ID NO: 163944 - RNA, 22 nt, Human
aagauuucugcuccugagagaa

SEQ ID NO: 163945 - RNA, 22 nt, Human
uguaaucauuacaguacaugga

SEQ ID NO: 163946 - RNA, 22 nt, Human
gggcuggaggugagcaggacag

SEQ ID NO: 163947 - RNA, 22 nt, Human
aagcugcccucauucccagugc

SEQ ID NO: 163948 - RNA, 22 nt, Human
gggugggagucuggcccucaaa

SEQ ID NO: 163949 - RNA, 18 nt, Human
gugagcagagagcaucac

SEQ ID NO: 163950 - RNA, 20 nt, Human
uccaggagaacugggagccg

SEQ ID NO: 163951 - RNA, 22 nt, Human
cacccagccuucacacaggagu

SEQ ID NO: 163952 - RNA, 22 nt, Human
uggcagcauuuuuuccagaaca

SEQ ID NO: 163953 - RNA, 22 nt, Human
augcaguacauacaaacacuga

SEQ ID NO: 163954 - RNA, 22 nt, Human
auuuccucaugaucauaaugca

SEQ ID NO: 163955 - RNA, 22 nt, Human
caggcacugugcugagcucugc

SEQ ID NO: 163956 - RNA, 22 nt, Human
uggccugaauuauggcagaucu

SEQ ID NO: 163957 - RNA, 22 nt, Human
agcuaggaaauugaggcugaga

SEQ ID NO: 163958 - RNA, 22 nt, Human
auguauguuaguguauuaucua

SEQ ID NO: 163959 - RNA, 22 nt, Human
uccuugaauauaauaacaguag

SEQ ID NO: 163960 - RNA, 22 nt, Human
gaggcagaggaagguggucucu

SEQ ID NO: 163961 - RNA, 22 nt, Human
aucaaaaugcuccagugauggu

SEQ ID NO: 163962 - RNA, 21 nt, Human
agagucugcauuucugacaag

SEQ ID NO: 163963 - RNA, 22 nt, Human
ucccaggcuaggccucugcguu

SEQ ID NO: 163964 - RNA, 22 nt, Human
aagccaggcugcacuugcuggg

SEQ ID NO: 163965 - RNA, 22 nt, Human
cugagaggugacagcgugcugg

SEQ ID NO: 163966 - RNA, 22 nt, Human
ucuggagcaacagagcaggaca

SEQ ID NO: 163967 - RNA, 18 nt, Human
acagaacucaggggcacc

SEQ ID NO: 163968 - RNA, 22 nt, Human
gcugagagugagcacuggauau

SEQ ID NO: 163969 - RNA, 22 nt, Human
aaggcugaggagggccugcagg

SEQ ID NO: 163970 - RNA, 22 nt, Human
caggggcucccugggugccagu

SEQ ID NO: 163971 - RNA, 18 nt, Human
gggcaucauucacaaagu

SEQ ID NO: 163972 - RNA, 22 nt, Human
auguagcaugaggcacugugcc

SEQ ID NO: 163973 - RNA, 22 nt, Human
ugguggccuugauggcaucugc

SEQ ID NO: 163974 - RNA, 22 nt, Human
uccuuccucggggacccagauc

SEQ ID NO: 163975 - RNA, 22 nt, Human
ggccucugaggacagccuuggc

SEQ ID NO: 163976 - RNA, 22 nt, Human
ugucacauugaauaugauuuau

SEQ ID NO: 163977 - RNA, 20 nt, Human
uacauucaaaacaaacucug

SEQ ID NO: 163978 - RNA, 22 nt, Human
gcagauggcagcccaggcuggg

SEQ ID NO: 163979 - RNA, 22 nt, Human
aaaugaacucuuccugcauccc

SEQ ID NO: 163980 - RNA, 22 nt, Human
agcugccacauggugucacugu

SEQ ID NO: 163981 - RNA, 23 nt, Human
gccugggacucaggaggagcuca

SEQ ID NO: 163982 - RNA, 22 nt, Human
ugggaggcagguaggugaugau

SEQ ID NO: 163983 - RNA, 21 nt, Human
gcccagcaaggugagaaggcc

SEQ ID NO: 163984 - RNA, 22 nt, Human
ucagccugcuccaagugcugcc

SEQ ID NO: 163985 - RNA, 22 nt, Human
agcuggguggagggcccacggu

SEQ ID NO: 163986 - RNA, 22 nt, Human
gagccuggauugaagugggugg

SEQ ID NO: 163987 - RNA, 22 nt, Human
acagggccaggugagaggugcu

SEQ ID NO: 163988 - RNA, 22 nt, Human
cuggagccacugggucuuguau

SEQ ID NO: 163989 - RNA, 22 nt, Human
ugaaaucuuauacuuugguagu

SEQ ID NO: 163990 - RNA, 18 nt, Human
acauuucuccuucugacc

SEQ ID NO: 163991 - RNA, 22 nt, Human
aagcugcagacccccugucuca

SEQ ID NO: 163992 - RNA, 22 nt, Human
aacagaacccgagugugaaucu

SEQ ID NO: 163993 - RNA, 22 nt, Human
ccaggguggcguagaugcuggg

SEQ ID NO: 163994 - RNA, 22 nt, Human
uugccaggagcucaucugaggg

SEQ ID NO: 163995 - RNA, 22 nt, Human
agccuggaauuaaggaaaugca

SEQ ID NO: 163996 - RNA, 22 nt, Human
aucuuucagagcuccaucaggg

SEQ ID NO: 163997 - RNA, 22 nt, Human
ucauccaguaccauggaaggca

SEQ ID NO: 163998 - RNA, 22 nt, Human
auuccaguucuccucucuaaag

SEQ ID NO: 163999 - RNA, 22 nt, Human
uucucuuauucuggauaugcag

SEQ ID NO: 164000 - RNA, 22 nt, Human
uuugcauuuguucaaguauuga

SEQ ID NO: 164001 - RNA, 22 nt, Human
augaguaaaaccacuauuuaca

SEQ ID NO: 164002 - RNA, 22 nt, Human
agcugcccugggucuugcugcu

SEQ ID NO: 164003 - RNA, 22 nt, Human
ccuucagaccuagacaggaauc

SEQ ID NO: 164004 - RNA, 22 nt, Human
gcagcugccccgacugugaguc

SEQ ID NO: 164005 - RNA, 22 nt, Human
agccacagcccacaggacucuu

SEQ ID NO: 164006 - RNA, 22 nt, Human
aggaccagccuccaggucucuu

SEQ ID NO: 164007 - RNA, 22 nt, Human
caggagcucucaucgucagggc

SEQ ID NO: 164008 - RNA, 22 nt, Human
uugacagcaaagauugugccua

SEQ ID NO: 164009 - RNA, 22 nt, Human
cagguccccuccccuaccaggc

SEQ ID NO: 164010 - RNA, 20 nt, Human
gugggcagaugugugcaugg

SEQ ID NO: 164011 - RNA, 22 nt, Human
caggcugcggucggcucugguc

SEQ ID NO: 164012 - RNA, 22 nt, Human
agugaaauaugcccauugcugu

SEQ ID NO: 164013 - RNA, 23 nt, Human
cccuggaguaaauucuuggaagg

SEQ ID NO: 164014 - RNA, 22 nt, Human
ugcagcugauuaaagggcagac

SEQ ID NO: 164015 - RNA, 22 nt, Human
ggaggccaaggaggagcuugcc

SEQ ID NO: 164016 - RNA, 22 nt, Human
aguccuucaagaaaucuggaaa

SEQ ID NO: 164017 - RNA, 22 nt, Human
cccugccuacaggguuuucuuu

SEQ ID NO: 164018 - RNA, 22 nt, Human
ccuuccuggagcccaugcagau

SEQ ID NO: 164019 - RNA, 22 nt, Human
aucuggcuauugacauguuaua

SEQ ID NO: 164020 - RNA, 23 nt, Human
uugaaagguagcuggcagcuaga

SEQ ID NO: 164021 - RNA, 22 nt, Human
uauuuguauuucaugcaguaaa

SEQ ID NO: 164022 - RNA, 22 nt, Human
acagaacuuccugcuggagugg

SEQ ID NO: 164023 - RNA, 22 nt, Human
gugcauugcgaugcagacgacc

SEQ ID NO: 164024 - RNA, 22 nt, Human
agaugcugugucuguucccuug

SEQ ID NO: 164025 - RNA, 22 nt, Human
uucccaggcugugcuaccagag

SEQ ID NO: 164026 - RNA, 22 nt, Human
ucagaagccggaagugcuccuc

SEQ ID NO: 164027 - RNA, 22 nt, Human
uagaaacugauagucuugugcu

SEQ ID NO: 164028 - RNA, 22 nt, Human
uggcagccacaucucguggauu

SEQ ID NO: 164029 - RNA, 22 nt, Human
ugugacagaucuuuaaauaaug

SEQ ID NO: 164030 - RNA, 22 nt, Human
uaaguuuaaauguacaugaagc

SEQ ID NO: 164031 - RNA, 19 nt, Human
agauggggaagagugugag

SEQ ID NO: 164032 - RNA, 22 nt, Human
ggcuucugaaaucucugugcgu

SEQ ID NO: 164033 - RNA, 22 nt, Human
agaggcugucccuugcuauucc

SEQ ID NO: 164034 - RNA, 22 nt, Human
caccagggacaaugcuaggggu

SEQ ID NO: 164035 - RNA, 22 nt, Human
guacauguugguuguuuccagu

SEQ ID NO: 164036 - RNA, 22 nt, Human
cagggccaguucucgcagcagu

SEQ ID NO: 164037 - RNA, 22 nt, Human
ggcccagccggcgagucucgcg

SEQ ID NO: 164038 - RNA, 22 nt, Human
aaugugguuaacccauuuaaga

SEQ ID NO: 164039 - RNA, 22 nt, Human
gaagcagcuuucuggugaggag

SEQ ID NO: 164040 - RNA, 22 nt, Human
ugcaaacuauugguagagaugg

SEQ ID NO: 164041 - RNA, 22 nt, Human
uacacuuuuuacuacagauucu

SEQ ID NO: 164042 - RNA, 22 nt, Human
agaacagaugugggcagaccug

SEQ ID NO: 164043 - RNA, 20 nt, Human
guggccuguccuguuguggg

SEQ ID NO: 164044 - RNA, 21 nt, Human
ucucuggaauuagaccauguu

SEQ ID NO: 164045 - RNA, 22 nt, Human
gugugccaccagucaaggugaa

SEQ ID NO: 164046 - RNA, 22 nt, Human
uagagcuauuuagagcauuuua

SEQ ID NO: 164047 - RNA, 22 nt, Human
uggcccugcugggucagagcug

SEQ ID NO: 164048 - RNA, 22 nt, Human
uacaaagccugguagauaucug

SEQ ID NO: 164049 - RNA, 20 nt, Human
gcugccuuguccugcuuggu

SEQ ID NO: 164050 - RNA, 22 nt, Human
uuccucucgcucuccggggccc

SEQ ID NO: 164051 - RNA, 23 nt, Human
uggagcugacagucagagggagg

SEQ ID NO: 164052 - RNA, 22 nt, Human
aaaguguugggauuacaggugu

SEQ ID NO: 164053 - RNA, 22 nt, Human
uaaguucauaagcuuauucuua

SEQ ID NO: 164054 - RNA, 22 nt, Human
ggcagaggaaggaugaauucac

SEQ ID NO: 164055 - RNA, 17 nt, Human
agaaagaggauccacag

SEQ ID NO: 164056 - RNA, 22 nt, Human
ugcugucccuaagucucuucaa

SEQ ID NO: 164057 - RNA, 22 nt, Human
gaguuauuuguagggauuauau

SEQ ID NO: 164058 - RNA, 22 nt, Human
ggcugcugugaccucaggugau

SEQ ID NO: 164059 - RNA, 22 nt, Human
gggacagacccaugggccaggu

SEQ ID NO: 164060 - RNA, 22 nt, Human
uugcauaaaugcuuaaaauuug

SEQ ID NO: 164061 - RNA, 22 nt, Human
caucagcagucacaugaugcug

SEQ ID NO: 164062 - RNA, 20 nt, Human
cucaguguggccugaguguu

SEQ ID NO: 164063 - RNA, 21 nt, Human
gagugcagcaagguagagucu

SEQ ID NO: 164064 - RNA, 22 nt, Human
ccaggccuccugugaguggacc

SEQ ID NO: 164065 - RNA, 22 nt, Human
ggauaagaaaauuguaauaacu

SEQ ID NO: 164066 - RNA, 22 nt, Human
cugugucccccucagccaggug

SEQ ID NO: 164067 - RNA, 22 nt, Human
agcugaaggcuagaacagcugg

SEQ ID NO: 164068 - RNA, 22 nt, Human
cagagccagaacuagaccuugu

SEQ ID NO: 164069 - RNA, 22 nt, Human
gcagagccagaauggccaggac

SEQ ID NO: 164070 - RNA, 22 nt, Human
uuccauauguauauagcuguua

SEQ ID NO: 164071 - RNA, 22 nt, Human
uggugcugauaauggcaggauu

SEQ ID NO: 164072 - RNA, 22 nt, Human
ugccagugggugugcagagacu

SEQ ID NO: 164073 - RNA, 19 nt, Human
ucaaugcaugaaaucagcc

SEQ ID NO: 164074 - RNA, 22 nt, Human
ugaugguuuuauuaauaggacc

SEQ ID NO: 164075 - RNA, 19 nt, Human
acagaagcauagaaaagga

SEQ ID NO: 164076 - RNA, 22 nt, Human
gauacaaauucaugucugaauu

SEQ ID NO: 164077 - RNA, 22 nt, Human
gcugucacucaccaggccugca

SEQ ID NO: 164078 - RNA, 22 nt, Human
uguucuugagccuuuagaccua

SEQ ID NO: 164079 - RNA, 22 nt, Human
gccagcagggcccaaaugcugg

SEQ ID NO: 164080 - RNA, 20 nt, Human
uccaagggcagcagaaucag

SEQ ID NO: 164081 - RNA, 19 nt, Human
caguggagauuggaggagg

SEQ ID NO: 164082 - RNA, 22 nt, Human
uaacagaaguuguucauugugg

SEQ ID NO: 164083 - RNA, 22 nt, Human
uaugcauaugaccccaagcuug

SEQ ID NO: 164084 - RNA, 22 nt, Human
uuucagugcuucuguuuaccgg

SEQ ID NO: 164085 - RNA, 22 nt, Human
uaaggcaccauaauauauuuaa

SEQ ID NO: 164086 - RNA, 22 nt, Human
aagcaagacagaaguuacugcc

SEQ ID NO: 164087 - RNA, 22 nt, Human
ccugccagggccuuggaagaaa

SEQ ID NO: 164088 - RNA, 22 nt, Human
aagggcagccugacucacgguc

SEQ ID NO: 164089 - RNA, 22 nt, Human
acuguguccucauguggcagaa

SEQ ID NO: 164090 - RNA, 22 nt, Human
cccugcagaaccacagacaaac

SEQ ID NO: 164091 - RNA, 22 nt, Human
cugagcugguggaagcaugcag

SEQ ID NO: 164092 - RNA, 22 nt, Human
aggugcagcaugaguccaacgg

SEQ ID NO: 164093 - RNA, 22 nt, Human
cuggccuguccugacccagccu

SEQ ID NO: 164094 - RNA, 22 nt, Human
ugagaggccccagcucuuggcc

SEQ ID NO: 164095 - RNA, 22 nt, Human
cuggcugcaggaaggagugggc

SEQ ID NO: 164096 - RNA, 22 nt, Human
uucucucauucaaauuaaagug

SEQ ID NO: 164097 - RNA, 22 nt, Human
agauaacuuuuggguauucaug

SEQ ID NO: 164098 - RNA, 23 nt, Human
cccagcagauuguaaagugucca

SEQ ID NO: 164099 - RNA, 22 nt, Human
gcauccagagguagccacugug

SEQ ID NO: 164100 - RNA, 22 nt, Human
acugggccuugccauggcagcc

SEQ ID NO: 164101 - RNA, 22 nt, Human
agcagccacagcagaucugagu

SEQ ID NO: 164102 - RNA, 22 nt, Human
augaugguggguaauguguaaa

SEQ ID NO: 164103 - RNA, 22 nt, Human
agaaacuucagcuauucuuuug

SEQ ID NO: 164104 - RNA, 22 nt, Human
cagaggcugaugugggaugggc

SEQ ID NO: 164105 - RNA, 22 nt, Human
gguggcaggcccugagcauccc

SEQ ID NO: 164106 - RNA, 17 nt, Human
aguggcaggcagauggg

SEQ ID NO: 164107 - RNA, 21 nt, Human
accaggcuugugggagggagc

SEQ ID NO: 164108 - RNA, 22 nt, Human
gccaggcagcugggagggugcc

SEQ ID NO: 164109 - RNA, 21 nt, Human
aacauuucugggagaacucac

SEQ ID NO: 164110 - RNA, 22 nt, Human
aauaugugagguauguucagug

SEQ ID NO: 164111 - RNA, 22 nt, Human
agaggccaguggcugugcuguc

SEQ ID NO: 164112 - RNA, 22 nt, Human
agcauuuaggagaauuugagaa

SEQ ID NO: 164113 - RNA, 22 nt, Human
uauuugaaaguguacaaaaacu

SEQ ID NO: 164114 - RNA, 22 nt, Human
ugccuggcaaugccagaagcca

SEQ ID NO: 164115 - RNA, 22 nt, Human
gaaaggucuuccggucuuccag

SEQ ID NO: 164116 - RNA, 22 nt, Human
cugggagcuagcucugagcuga

SEQ ID NO: 164117 - RNA, 22 nt, Human
uggagccaugccuggccuuucc

SEQ ID NO: 164118 - RNA, 22 nt, Human
ccuggccucuccgaguaaccug

SEQ ID NO: 164119 - RNA, 22 nt, Human
ggagccuggcaaugcugcgucc

SEQ ID NO: 164120 - RNA, 22 nt, Human
ccacccagccagaugcaggaag

SEQ ID NO: 164121 - RNA, 22 nt, Human
cuggagaggccccaagauauuu

SEQ ID NO: 164122 - RNA, 22 nt, Human
uuguaacagcugcuuaauagag

SEQ ID NO: 164123 - RNA, 22 nt, Human
caguagcaggcaggugcuuuug

SEQ ID NO: 164124 - RNA, 22 nt, Human
ugcuuuuaagaacaaugcugcu

SEQ ID NO: 164125 - RNA, 22 nt, Human
aggugcagcugguggagucugg

SEQ ID NO: 164126 - RNA, 22 nt, Human
cagcccugcacgcugccuccgc

SEQ ID NO: 164127 - RNA, 22 nt, Human
cagagguagccgagugcaaucg

SEQ ID NO: 164128 - RNA, 22 nt, Human
cuggguggaucgcagccccagg

SEQ ID NO: 164129 - RNA, 22 nt, Human
gucaccagugcuaagaggugga

SEQ ID NO: 164130 - RNA, 22 nt, Human
aggcagcaaagaaaugaugcug

SEQ ID NO: 164131 - RNA, 21 nt, Human
ccugugugucugacugggcua

SEQ ID NO: 164132 - RNA, 22 nt, Human
auuauaaagaacaugugugugg

SEQ ID NO: 164133 - RNA, 22 nt, Human
uugcucuguaauaaucuggggu

SEQ ID NO: 164134 - RNA, 22 nt, Human
ugcugguggagaaaguggaggu

SEQ ID NO: 164135 - RNA, 22 nt, Human
gauaccagacagggagggagaa

SEQ ID NO: 164136 - RNA, 22 nt, Human
cuggccuuuaaaaugaccuuau

SEQ ID NO: 164137 - RNA, 22 nt, Human
ggccucugcaacuggcuguggc

SEQ ID NO: 164138 - RNA, 22 nt, Human
cacugcuuuuuuggcuauguac

SEQ ID NO: 164139 - RNA, 22 nt, Human
cuuacauugugugcaugagggg

SEQ ID NO: 164140 - RNA, 22 nt, Human
uggcuggcaaggcuggagucag

SEQ ID NO: 164141 - RNA, 20 nt, Human
ucucaggguucagcaaagua

SEQ ID NO: 164142 - RNA, 22 nt, Human
aacaaaugauuguugguuggag

SEQ ID NO: 164143 - RNA, 22 nt, Human
ccagccuucugagcugccugga

SEQ ID NO: 164144 - RNA, 22 nt, Human
uguuucagucccuguguucaau

SEQ ID NO: 164145 - RNA, 22 nt, Human
caaaguuuggcucucaugacau

SEQ ID NO: 164146 - RNA, 22 nt, Human
ugggccacggggguggagagcu

SEQ ID NO: 164147 - RNA, 22 nt, Human
cugagccagggccacacaugga

SEQ ID NO: 164148 - RNA, 22 nt, Human
gaagcagcuagcccacuaguca

SEQ ID NO: 164149 - RNA, 22 nt, Human
cugucaggggcggguggagcgg

SEQ ID NO: 164150 - RNA, 22 nt, Human
aggcugcagugcagguaggauu

SEQ ID NO: 164151 - RNA, 22 nt, Human
acugccuugucucuugccuguu

SEQ ID NO: 164152 - RNA, 22 nt, Human
acagagcauauaaagugcuuug

SEQ ID NO: 164153 - RNA, 22 nt, Human
ugucaccaugccagcuucugcc

SEQ ID NO: 164154 - RNA, 21 nt, Human
caugaagccgguucccuguuu

SEQ ID NO: 164155 - RNA, 22 nt, Human
gcucagaaaagugaggcucagu

SEQ ID NO: 164156 - RNA, 22 nt, Human
ugcugccacugguagucucauu

SEQ ID NO: 164157 - RNA, 22 nt, Human
uggcucaggggucuggcucugu

SEQ ID NO: 164158 - RNA, 19 nt, Human
ccugggagucagcugaagg

SEQ ID NO: 164159 - RNA, 22 nt, Human
gaaggagagagacaucgucccu

SEQ ID NO: 164160 - RNA, 19 nt, Human
aucuuacagagcagaguac

SEQ ID NO: 164161 - RNA, 22 nt, Human
gggaggucagggugccugcugg

SEQ ID NO: 164162 - RNA, 22 nt, Human
agccccaguccgcugcgggcgg

SEQ ID NO: 164163 - RNA, 23 nt, Human
uggccugcagaguuucugcuggg

SEQ ID NO: 164164 - RNA, 22 nt, Human
cugaggcaugaaugugggcuuu

SEQ ID NO: 164165 - RNA, 22 nt, Human
aggaccuguaccucagcaucua

SEQ ID NO: 164166 - RNA, 22 nt, Human
cacacaggagagugcuggaggu

SEQ ID NO: 164167 - RNA, 22 nt, Human
ucagcagggcugugguguggcu

SEQ ID NO: 164168 - RNA, 21 nt, Human
gccagagcaguacaaugaggu

SEQ ID NO: 164169 - RNA, 22 nt, Human
agauacauagcugugagcacac

SEQ ID NO: 164170 - RNA, 22 nt, Human
agaaaugugagccccuuaucaa

SEQ ID NO: 164171 - RNA, 22 nt, Human
uggcucagucauggaugaguaa

SEQ ID NO: 164172 - RNA, 22 nt, Human
ccauaaggagccagacauucca

SEQ ID NO: 164173 - RNA, 22 nt, Human
ccuuucucuuugcugaucaugu

SEQ ID NO: 164174 - RNA, 22 nt, Human
agggaggauaguagucaguuua

SEQ ID NO: 164175 - RNA, 22 nt, Human
aucauaaagugcuaucugauug

SEQ ID NO: 164176 - RNA, 22 nt, Human
gggagguucuguucgcacuuga

SEQ ID NO: 164177 - RNA, 22 nt, Human
ccaggaggcagagguuacagug

SEQ ID NO: 164178 - RNA, 22 nt, Human
uggccugguuauauugcuauca

SEQ ID NO: 164179 - RNA, 22 nt, Human
ccagcuccuucugucuguggag

SEQ ID NO: 164180 - RNA, 22 nt, Human
gcuggccucuacaggccggcca

SEQ ID NO: 164181 - RNA, 22 nt, Human
acugcagcaaagcccgugucuu

SEQ ID NO: 164182 - RNA, 21 nt, Human
gcagagccugagguucuugag

SEQ ID NO: 164183 - RNA, 22 nt, Human
ugauuuccaguugcugggugcu

SEQ ID NO: 164184 - RNA, 22 nt, Human
cagggcacaguuauggaggugg

SEQ ID NO: 164185 - RNA, 22 nt, Human
ucucagagggaggauuacugcc

SEQ ID NO: 164186 - RNA, 22 nt, Human
gaaaucugcggugaggccugag

SEQ ID NO: 164187 - RNA, 22 nt, Human
cuagaaaaauacuuuauuguga

SEQ ID NO: 164188 - RNA, 22 nt, Human
ugggcugcagggguugagagcu

SEQ ID NO: 164189 - RNA, 23 nt, Human
uggagaugccccacucccugucu

SEQ ID NO: 164190 - RNA, 22 nt, Human
ucagggcauguauguuucuuua

SEQ ID NO: 164191 - RNA, 23 nt, Human
agaauuguaaauagaauauaccu

SEQ ID NO: 164192 - RNA, 22 nt, Human
cuuacauuuaaucaugugucau

SEQ ID NO: 164193 - RNA, 22 nt, Human
aggucauuuccuuagaggcaga

SEQ ID NO: 164194 - RNA, 22 nt, Human
aggcagggucuugcuauguugc

SEQ ID NO: 164195 - RNA, 22 nt, Human
gggaaccagccgcuuccgccuc

SEQ ID NO: 164196 - RNA, 22 nt, Human
gggcuacauugugagagaaguu

SEQ ID NO: 164197 - RNA, 22 nt, Human
cagggcaguaccgcccucuggc

SEQ ID NO: 164198 - RNA, 22 nt, Human
ucagagucauugcaaguagaag

SEQ ID NO: 164199 - RNA, 22 nt, Human
caggagcaaggagcagugggau

SEQ ID NO: 164200 - RNA, 22 nt, Human
aggcuucuaggguuggcagcgg

SEQ ID NO: 164201 - RNA, 22 nt, Human
aagaauguucuuguagucauga

SEQ ID NO: 164202 - RNA, 22 nt, Human
ucccagaaaaaggaggcuauga

SEQ ID NO: 164203 - RNA, 22 nt, Human
caugggcuuuggaggcuggagg

SEQ ID NO: 164204 - RNA, 22 nt, Human
cugugcugauucagcacaggcc

SEQ ID NO: 164205 - RNA, 22 nt, Human
gucugaggaagaugcaggggga

SEQ ID NO: 164206 - RNA, 22 nt, Human
acagacauuuucuguauugccu

SEQ ID NO: 164207 - RNA, 22 nt, Human
uggagcugagaaguggagcucu

SEQ ID NO: 164208 - RNA, 19 nt, Human
aagcagcccuggcaagagc

SEQ ID NO: 164209 - RNA, 22 nt, Human
cugagccuuauucaccagcccu

SEQ ID NO: 164210 - RNA, 22 nt, Human
caagggugguauugggagcaua

SEQ ID NO: 164211 - RNA, 19 nt, Human
ugcagccacgugagagacu

SEQ ID NO: 164212 - RNA, 21 nt, Human
gagugucuaauccaggcuguc

SEQ ID NO: 164213 - RNA, 22 nt, Human
agcugucuaccugcagaguccu

SEQ ID NO: 164214 - RNA, 22 nt, Human
uguggcuuaagaaugccuuuaa

SEQ ID NO: 164215 - RNA, 19 nt, Human
auagucuuuccaauuauac

SEQ ID NO: 164216 - RNA, 22 nt, Human
gagcuuaggccagggacaggga

SEQ ID NO: 164217 - RNA, 22 nt, Human
cagacuuucaaggagugaaggc

SEQ ID NO: 164218 - RNA, 22 nt, Human
cauuucugggagacaugcuaga

SEQ ID NO: 164219 - RNA, 22 nt, Human
cgucccaguuccagccgcgcug

SEQ ID NO: 164220 - RNA, 22 nt, Human
gcagagccuugcgucaugugcc

SEQ ID NO: 164221 - RNA, 22 nt, Human
acucugccaucccaggugcugu

SEQ ID NO: 164222 - RNA, 22 nt, Human
uccuucagcucucuauuuagau

SEQ ID NO: 164223 - RNA, 22 nt, Human
cagcugccagcuucucuccauc

SEQ ID NO: 164224 - RNA, 22 nt, Human
gaggcagcaaaauauaucauaa

SEQ ID NO: 164225 - RNA, 22 nt, Human
agaaacugaauuauuucugagg

SEQ ID NO: 164226 - RNA, 22 nt, Human
ggggugggcgugcagggacacc

SEQ ID NO: 164227 - RNA, 22 nt, Human
cccugggcagucugcacuucag

SEQ ID NO: 164228 - RNA, 19 nt, Human
agggcugcucuggccuggg

SEQ ID NO: 164229 - RNA, 22 nt, Human
ugagcuguagcagaugcuguug

SEQ ID NO: 164230 - RNA, 22 nt, Human
uuucaguguaagguuuccagga

SEQ ID NO: 164231 - RNA, 22 nt, Human
auugacaaggaaacuauaccag

SEQ ID NO: 164232 - RNA, 22 nt, Human
gugcucacugugagacguccug

SEQ ID NO: 164233 - RNA, 23 nt, Human
agaugaggcuucuccauguuggu

SEQ ID NO: 164234 - RNA, 22 nt, Human
gcagggucugaggccacagagg

SEQ ID NO: 164235 - RNA, 22 nt, Human
uucucuggaacugaaacaagau

SEQ ID NO: 164236 - RNA, 22 nt, Human
uggaggcaccacuggcugcccg

SEQ ID NO: 164237 - RNA, 20 nt, Human
ggguggaguugcggucugug

SEQ ID NO: 164238 - RNA, 22 nt, Human
gcucagagcuugaaguuccacu

SEQ ID NO: 164239 - RNA, 22 nt, Human
cgucuuccucuuacgaugcgcu

SEQ ID NO: 164240 - RNA, 22 nt, Human
ccugagcuggaagagcuugugc

SEQ ID NO: 164241 - RNA, 22 nt, Human
ugcuggcccaugaagacgcagu

SEQ ID NO: 164242 - RNA, 22 nt, Human
acagccaggagccaugggcagg

SEQ ID NO: 164243 - RNA, 22 nt, Human
cugaaggacacgugaggagcca

SEQ ID NO: 164244 - RNA, 22 nt, Human
uguagcucuccagccagcaagg

SEQ ID NO: 164245 - RNA, 22 nt, Human
cugugccuuuguagcugugccu

SEQ ID NO: 164246 - RNA, 22 nt, Human
cacagggcagguacucucagag

SEQ ID NO: 164247 - RNA, 22 nt, Human
agcgggugcugugucagcccuc

SEQ ID NO: 164248 - RNA, 21 nt, Human
ucagaguggaagacaguuuga

SEQ ID NO: 164249 - RNA, 22 nt, Human
cugaagcaaaggaucgagcuaa

SEQ ID NO: 164250 - RNA, 22 nt, Human
cagaaugagauaacccagauug

SEQ ID NO: 164251 - RNA, 22 nt, Human
uggcucugggcaccguguccac

SEQ ID NO: 164252 - RNA, 22 nt, Human
aaggcagccucugccagccggg

SEQ ID NO: 164253 - RNA, 22 nt, Human
aaaggucagacuuaggcugggc

SEQ ID NO: 164254 - RNA, 20 nt, Human
agggcagcuugaggagccgg

SEQ ID NO: 164255 - RNA, 18 nt, Human
gggcauggaugcagcauc

SEQ ID NO: 164256 - RNA, 22 nt, Human
gauuuccucacuaacauccauc

SEQ ID NO: 164257 - RNA, 22 nt, Human
ugcauccuuaaccagcaucacu

SEQ ID NO: 164258 - RNA, 22 nt, Human
acuucuggugucauacugcauu

SEQ ID NO: 164259 - RNA, 22 nt, Human
cugggagcggcugucacugguu

SEQ ID NO: 164260 - RNA, 22 nt, Human
cugugaggcccugggugcugga

SEQ ID NO: 164261 - RNA, 22 nt, Human
cccaggcuggauuucgguggca

SEQ ID NO: 164262 - RNA, 22 nt, Human
ugaaagguagcuggccucauag

SEQ ID NO: 164263 - RNA, 22 nt, Human
caggggacauuaaagcuccaua

SEQ ID NO: 164264 - RNA, 22 nt, Human
ucaauuaugccauugcaauauu

SEQ ID NO: 164265 - RNA, 22 nt, Human
ggccuggcauggggacuaaggg

SEQ ID NO: 164266 - RNA, 22 nt, Human
gcucccaguucccaaagugacc

SEQ ID NO: 164267 - RNA, 22 nt, Human
ucaggcugugggcacuggccau

SEQ ID NO: 164268 - RNA, 22 nt, Human
ucucaccauggugcuugcuuau

SEQ ID NO: 164269 - RNA, 22 nt, Human
guggauggacaugggcaagagg

SEQ ID NO: 164270 - RNA, 22 nt, Human
gugcucuguguauuaggauguc

SEQ ID NO: 164271 - RNA, 20 nt, Human
uucuuucaucuacacguugu

SEQ ID NO: 164272 - RNA, 22 nt, Human
gucugucaucugagauggagug

SEQ ID NO: 164273 - RNA, 22 nt, Human
ucugggagauccaagcagaacu

SEQ ID NO: 164274 - RNA, 22 nt, Human
uggcuccuucauucuccugcca

SEQ ID NO: 164275 - RNA, 22 nt, Human
ucucccacagccgugcuucaag

SEQ ID NO: 164276 - RNA, 22 nt, Human
gugccaggugcuaagcugugcu

SEQ ID NO: 164277 - RNA, 22 nt, Human
agaggcuccuagccacuggcuu

SEQ ID NO: 164278 - RNA, 22 nt, Human
gcagagcuaucuucuggauuug

SEQ ID NO: 164279 - RNA, 22 nt, Human
cucugucccagacccaccucuc

SEQ ID NO: 164280 - RNA, 22 nt, Human
aggcacuguucccaguuauccu

SEQ ID NO: 164281 - RNA, 22 nt, Human
caggugcuguccugcacauguc

SEQ ID NO: 164282 - RNA, 22 nt, Human
ugcaggugcguuuucaagccuc

SEQ ID NO: 164283 - RNA, 19 nt, Human
agccagggugagaaggagc

SEQ ID NO: 164284 - RNA, 17 nt, Human
ccucccacaccgcccug

SEQ ID NO: 164285 - RNA, 22 nt, Human
cagaggcuguguaggcagacug

SEQ ID NO: 164286 - RNA, 20 nt, Human
gccugagcuauugccaggau

SEQ ID NO: 164287 - RNA, 22 nt, Human
cugucaccuguucacugcagca

SEQ ID NO: 164288 - RNA, 18 nt, Human
aguaguggguuuagcuuc

SEQ ID NO: 164289 - RNA, 23 nt, Human
agacagaggcugaggcuggccgc

SEQ ID NO: 164290 - RNA, 22 nt, Human
aguauguauuuuauacuuacag

SEQ ID NO: 164291 - RNA, 22 nt, Human
caggagacaauggcuguggggc

SEQ ID NO: 164292 - RNA, 22 nt, Human
uauugaguuacagaaaauacuu

SEQ ID NO: 164293 - RNA, 22 nt, Human
agaacagaggccuuauguuuca

SEQ ID NO: 164294 - RNA, 22 nt, Human
uugaagcacaaugucuuuuauc

SEQ ID NO: 164295 - RNA, 22 nt, Human
ccagcugcugugaggaccacag

SEQ ID NO: 164296 - RNA, 22 nt, Human
ugagcuggucuugaguguagcu

SEQ ID NO: 164297 - RNA, 22 nt, Human
ccugggagcuguggaaaggcug

SEQ ID NO: 164298 - RNA, 22 nt, Human
agcugagcacauucaaacaggu

SEQ ID NO: 164299 - RNA, 22 nt, Human
gccuuccuuuuaccaccagcca

SEQ ID NO: 164300 - RNA, 19 nt, Human
cuguggcugaccucuggcc

SEQ ID NO: 164301 - RNA, 22 nt, Human
cacauuucucuaccucacacaa

SEQ ID NO: 164302 - RNA, 22 nt, Human
uccucuggcucuuucccuagga

SEQ ID NO: 164303 - RNA, 22 nt, Human
ggaaccaguggaaugauaugcu

SEQ ID NO: 164304 - RNA, 22 nt, Human
auaaaaguaggaccaacuuaca

SEQ ID NO: 164305 - RNA, 22 nt, Human
acagcagcuggguucccaccau

SEQ ID NO: 164306 - RNA, 22 nt, Human
ucaaaguaaaaguauagaguuu

SEQ ID NO: 164307 - RNA, 22 nt, Human
ugggcccugacuucaagcaucc

SEQ ID NO: 164308 - RNA, 22 nt, Human
ccugugugucugucacugcaca

SEQ ID NO: 164309 - RNA, 22 nt, Human
gaggccugguuuccagcauccu

SEQ ID NO: 164310 - RNA, 22 nt, Human
agggccuggcuucacuuucuca

SEQ ID NO: 164311 - RNA, 22 nt, Human
ugcuuuauuuauaaaauagcaa

SEQ ID NO: 164312 - RNA, 22 nt, Human
uccucuggggcgugguccugga

SEQ ID NO: 164313 - RNA, 22 nt, Human
caggcagcugacugucagauau

SEQ ID NO: 164314 - RNA, 22 nt, Human
uucuuuccacagaggggaugau

SEQ ID NO: 164315 - RNA, 22 nt, Human
agcagagucugugugcacuuua

SEQ ID NO: 164316 - RNA, 22 nt, Human
augaaaacuuuagccucauuag

SEQ ID NO: 164317 - RNA, 18 nt, Human
aguggucuguuauaucau

SEQ ID NO: 164318 - RNA, 22 nt, Human
cugggaggcacuauucaggagg

SEQ ID NO: 164319 - RNA, 22 nt, Human
uguccucuuccagugcuccuuc

SEQ ID NO: 164320 - RNA, 22 nt, Human
ucuggcucagggcucugaggga

SEQ ID NO: 164321 - RNA, 21 nt, Human
ccagagccugcugagcccccu

SEQ ID NO: 164322 - RNA, 22 nt, Human
agaaaucuaagaugcucaagga

SEQ ID NO: 164323 - RNA, 22 nt, Human
ggucaggguauaaucaagugag

SEQ ID NO: 164324 - RNA, 22 nt, Human
gcuggccugcugggcaccaccg

SEQ ID NO: 164325 - RNA, 22 nt, Human
cugcaggcaucuaacugugggc

SEQ ID NO: 164326 - RNA, 22 nt, Human
agggcagagaaauguaguugag

SEQ ID NO: 164327 - RNA, 22 nt, Human
gcacacaggcaguuuccagcca

SEQ ID NO: 164328 - RNA, 22 nt, Human
aaguucaaguaguguuacaugg

SEQ ID NO: 164329 - RNA, 19 nt, Human
gcucagagggcccugugcu

SEQ ID NO: 164330 - RNA, 22 nt, Human
ugucugguggguugacaggcag

SEQ ID NO: 164331 - RNA, 22 nt, Human
ucaaagcaucagucaauuuagg

SEQ ID NO: 164332 - RNA, 22 nt, Human
gccugcaguucugugcuaggca

SEQ ID NO: 164333 - RNA, 22 nt, Human
agccuggauucgugcauccaca

SEQ ID NO: 164334 - RNA, 22 nt, Human
ccugggagugugccaucucugu

SEQ ID NO: 164335 - RNA, 22 nt, Human
gugcauguuaaugguguacaaa

SEQ ID NO: 164336 - RNA, 22 nt, Human
uagcuuuacaaagugcugcacc

SEQ ID NO: 164337 - RNA, 22 nt, Human
gccaggaguucagaugcauguu

SEQ ID NO: 164338 - RNA, 22 nt, Human
cugaggaguuuggguuguucaa

SEQ ID NO: 164339 - RNA, 22 nt, Human
gggcacuguacacugugcaugg

SEQ ID NO: 164340 - RNA, 18 nt, Human
uccucucuuuccccaggg

SEQ ID NO: 164341 - RNA, 22 nt, Human
cugcucugagaggcucuuccua

SEQ ID NO: 164342 - RNA, 22 nt, Human
uuuaucuuuaggacuuugcaga

SEQ ID NO: 164343 - RNA, 22 nt, Human
ccagccuggacugggucuugug

SEQ ID NO: 164344 - RNA, 22 nt, Human
ggcucaggaccugggauugcca

SEQ ID NO: 164345 - RNA, 18 nt, Human
gggcacuggggacuggag

SEQ ID NO: 164346 - RNA, 22 nt, Human
cagggcagaacauauagauagu

SEQ ID NO: 164347 - RNA, 22 nt, Human
cucugguguccuuuagaauuua

SEQ ID NO: 164348 - RNA, 22 nt, Human
ccuuccuggcuguccgccugau

SEQ ID NO: 164349 - RNA, 22 nt, Human
caggaacacaaguucagggaug

SEQ ID NO: 164350 - RNA, 22 nt, Human
gcugagagaaaagugagguucu

SEQ ID NO: 164351 - RNA, 22 nt, Human
ugaauggucacugagcaucugu

SEQ ID NO: 164352 - RNA, 22 nt, Human
auggacaggcugagcuuccuca

SEQ ID NO: 164353 - RNA, 22 nt, Human
ggagccugggcauuaguaauuu

SEQ ID NO: 164354 - RNA, 22 nt, Human
cugucuguucagauucauuacu

SEQ ID NO: 164355 - RNA, 22 nt, Human
aaaaauagcuucucuugucccu

SEQ ID NO: 164356 - RNA, 22 nt, Human
gggccaugagagguucaucaac

SEQ ID NO: 164357 - RNA, 22 nt, Human
uuuuaucaaucauuaagacauu

SEQ ID NO: 164358 - RNA, 22 nt, Human
gaaaugcaaauucucucucgcu

SEQ ID NO: 164359 - RNA, 22 nt, Human
ccugugucagccccugccucca

SEQ ID NO: 164360 - RNA, 22 nt, Human
ucuucuccagugcuucugcaca

SEQ ID NO: 164361 - RNA, 22 nt, Human
auguuauuuuggaaaauacaaa

SEQ ID NO: 164362 - RNA, 20 nt, Human
ugccaugguaacagagugug

SEQ ID NO: 164363 - RNA, 23 nt, Human
aucagucuugguagcugugccca

SEQ ID NO: 164364 - RNA, 22 nt, Human
gggcuggaggagauccagaggc

SEQ ID NO: 164365 - RNA, 22 nt, Human
ugcaauaaggaguaauaguaaa

SEQ ID NO: 164366 - RNA, 22 nt, Human
cauggccugccuccuccuggug

SEQ ID NO: 164367 - RNA, 22 nt, Human
agcugcucuugggugacuucaa

SEQ ID NO: 164368 - RNA, 22 nt, Human
cccucaggagaugucagcugga

SEQ ID NO: 164369 - RNA, 22 nt, Human
caggagaagguuuggagugcag

SEQ ID NO: 164370 - RNA, 22 nt, Human
agcaggugacagggcuguggug

SEQ ID NO: 164371 - RNA, 22 nt, Human
agcaggcuuucaagagucuucu

SEQ ID NO: 164372 - RNA, 20 nt, Human
accccagccccucuaucuga

SEQ ID NO: 164373 - RNA, 19 nt, Human
caguggccuggaggucucu

SEQ ID NO: 164374 - RNA, 22 nt, Human
uuucuguagggauuucacaguu

SEQ ID NO: 164375 - RNA, 22 nt, Human
cccagcucucgcacuuacuagc

SEQ ID NO: 164376 - RNA, 22 nt, Human
uggcccugaggggcugugcccc

SEQ ID NO: 164377 - RNA, 22 nt, Human
ucuuagaaaugaaguucuuucu

SEQ ID NO: 164378 - RNA, 22 nt, Human
gcuggagcugcagccugggccu

SEQ ID NO: 164379 - RNA, 22 nt, Human
ugggggacugcacuggcgucag

SEQ ID NO: 164380 - RNA, 22 nt, Human
cauugcacuccaucuugggcaa

SEQ ID NO: 164381 - RNA, 22 nt, Human
gggccccaaaaugccaggcucu

SEQ ID NO: 164382 - RNA, 22 nt, Human
acaaaguccugguguauggcca

SEQ ID NO: 164383 - RNA, 22 nt, Human
uaggaaaagucuagauugauga

SEQ ID NO: 164384 - RNA, 22 nt, Human
cacugcaguaacucuaggacug

SEQ ID NO: 164385 - RNA, 22 nt, Human
gaagaacaagcagugcuuuccu

SEQ ID NO: 164386 - RNA, 20 nt, Human
ugcuggggacauacagggug

SEQ ID NO: 164387 - RNA, 22 nt, Human
cagguaagagacggauuggccc

SEQ ID NO: 164388 - RNA, 22 nt, Human
cugcucucuguuccccuggauc

SEQ ID NO: 164389 - RNA, 22 nt, Human
ucaaaugcggucauggcuuuua

SEQ ID NO: 164390 - RNA, 22 nt, Human
gcagggugaaggucacauagaa

SEQ ID NO: 164391 - RNA, 22 nt, Human
aaugauguauuaguacaacaca

SEQ ID NO: 164392 - RNA, 19 nt, Human
cugugcuuuaaacuccuau

SEQ ID NO: 164393 - RNA, 22 nt, Human
cugggaggauucauugagguga

SEQ ID NO: 164394 - RNA, 22 nt, Human
uucacauuugcccuuaugugug

SEQ ID NO: 164395 - RNA, 20 nt, Human
cagagcuguuauggaugaug

SEQ ID NO: 164396 - RNA, 22 nt, Human
aauuucaagucuugaagaagua

SEQ ID NO: 164397 - RNA, 22 nt, Human
ucaguuuucucaucugugaaau

SEQ ID NO: 164398 - RNA, 22 nt, Human
ucuguggcacgauugcacugca

SEQ ID NO: 164399 - RNA, 22 nt, Human
agccucuguagaaagcagugug

SEQ ID NO: 164400 - RNA, 22 nt, Human
cccaggcuggagugcaauggug

SEQ ID NO: 164401 - RNA, 22 nt, Human
cugcaggauucucccaguugga

SEQ ID NO: 164402 - RNA, 22 nt, Human
ccugagccugaguggugcaggg

SEQ ID NO: 164403 - RNA, 22 nt, Human
gagagcugauagaugagcuacu

SEQ ID NO: 164404 - RNA, 22 nt, Human
auacaucuugucagauucaugu

SEQ ID NO: 164405 - RNA, 22 nt, Human
cagcuccccucuguggggcagu

SEQ ID NO: 164406 - RNA, 22 nt, Human
uaagacacaugcguacaagaua

SEQ ID NO: 164407 - RNA, 22 nt, Human
agaggccuccgaaaggugggcu

SEQ ID NO: 164408 - RNA, 22 nt, Human
uucucuucuguucagugcccaa

SEQ ID NO: 164409 - RNA, 22 nt, Human
aaaauggucucagcuggcacca

SEQ ID NO: 164410 - RNA, 22 nt, Human
ucuucucaguuucucuaggaug

SEQ ID NO: 164411 - RNA, 22 nt, Human
ugcugccuucuaggcgugcccu

SEQ ID NO: 164412 - RNA, 22 nt, Human
caggagugaaaugaggcccagg

SEQ ID NO: 164413 - RNA, 23 nt, Human
ugucauugugacuacagaaccag

SEQ ID NO: 164414 - RNA, 22 nt, Human
cccaaggccucuccuuggcuug

SEQ ID NO: 164415 - RNA, 22 nt, Human
aagggcuggcccugggaagagu

SEQ ID NO: 164416 - RNA, 22 nt, Human
acagcuugcaauggcuuucaac

SEQ ID NO: 164417 - RNA, 22 nt, Human
ugauacagucagcucacaauug

SEQ ID NO: 164418 - RNA, 22 nt, Human
aaauaauugaguuggucaauau

SEQ ID NO: 164419 - RNA, 22 nt, Human
ugcucuguugugcaugugggau

SEQ ID NO: 164420 - RNA, 22 nt, Human
ugaaagcuguccacuaggcugu

SEQ ID NO: 164421 - RNA, 19 nt, Human
ugccugucaguagaucuca

SEQ ID NO: 164422 - RNA, 22 nt, Human
uaaggcacccuucugaguagag

SEQ ID NO: 164423 - RNA, 19 nt, Human
gcauuucucuuuacagcca

SEQ ID NO: 164424 - RNA, 22 nt, Human
ucaguguccggagccugagugc

SEQ ID NO: 164425 - RNA, 21 nt, Human
ggagauggguaucgccugggc

SEQ ID NO: 164426 - RNA, 22 nt, Human
aagacuuucucccaaauccuca

SEQ ID NO: 164427 - RNA, 20 nt, Human
uuguuucugcuauuuucuaa

SEQ ID NO: 164428 - RNA, 22 nt, Human
cggggcuguagcacagcugagc

SEQ ID NO: 164429 - RNA, 22 nt, Human
ucugggggcgaccagggacugc

SEQ ID NO: 164430 - RNA, 22 nt, Human
uaaaugugcacuuuacuuuuca

SEQ ID NO: 164431 - RNA, 22 nt, Human
caugaagcuugaagcaguccac

SEQ ID NO: 164432 - RNA, 21 nt, Human
uuacuuuugcaccaaccuaau

SEQ ID NO: 164433 - RNA, 22 nt, Human
uguuaacaucuuggacucguga

SEQ ID NO: 164434 - RNA, 22 nt, Human
ugcagaagcagagaguugccaa

SEQ ID NO: 164435 - RNA, 22 nt, Human
aucuacaggcugaggugggagg

SEQ ID NO: 164436 - RNA, 22 nt, Human
gauuauauaauggaagcucuug

SEQ ID NO: 164437 - RNA, 22 nt, Human
uuuaagaugguauuuuauaaag

SEQ ID NO: 164438 - RNA, 22 nt, Human
ggcugcugguagggguaggaag

SEQ ID NO: 164439 - RNA, 22 nt, Human
ggccugagaaccauggggccaa

SEQ ID NO: 164440 - RNA, 18 nt, Human
agcagcugugccacacug

SEQ ID NO: 164441 - RNA, 22 nt, Human
uggcuucuuagaccaguggccu

SEQ ID NO: 164442 - RNA, 22 nt, Human
uuauguaauuuguuugcucuuc

SEQ ID NO: 164443 - RNA, 22 nt, Human
gcugucacacaugggaucucag

SEQ ID NO: 164444 - RNA, 22 nt, Human
gcagaugguggggcaggaaaau

SEQ ID NO: 164445 - RNA, 17 nt, Human
gggcagggacuccuggg

SEQ ID NO: 164446 - RNA, 22 nt, Human
auugcacaaacacagucagacu

SEQ ID NO: 164447 - RNA, 22 nt, Human
ggcugucugugguggagcguug

SEQ ID NO: 164448 - RNA, 21 nt, Human
uuucaauguguucuuuguagu

SEQ ID NO: 164449 - RNA, 22 nt, Human
ggucccugaagaggccuggggu

SEQ ID NO: 164450 - RNA, 21 nt, Human
ugcagcagaguaagcagggga

SEQ ID NO: 164451 - RNA, 22 nt, Human
gguggccugcccugaucccugg

SEQ ID NO: 164452 - RNA, 22 nt, Human
agcagggggccacagucacagc

SEQ ID NO: 164453 - RNA, 22 nt, Human
cggcagagcuuccugcucagcg

SEQ ID NO: 164454 - RNA, 22 nt, Human
aagcgccacgagaagcuggacc

SEQ ID NO: 164455 - RNA, 22 nt, Human
cccugccucugaagcugcucag

SEQ ID NO: 164456 - RNA, 22 nt, Human
agucauauguggcauuuucuaa

SEQ ID NO: 164457 - RNA, 22 nt, Human
agcccagguugaggcugcagug

SEQ ID NO: 164458 - RNA, 22 nt, Human
ccagcccugaacccugcugcau

SEQ ID NO: 164459 - RNA, 22 nt, Human
agucaguggcuccgagccuggu

SEQ ID NO: 164460 - RNA, 22 nt, Human
aacaugaagguaggaugguuuu

SEQ ID NO: 164461 - RNA, 22 nt, Human
ugccaggccucaggagucucca

SEQ ID NO: 164462 - RNA, 22 nt, Human
gaggagcuggcagcgucuccgc

SEQ ID NO: 164463 - RNA, 22 nt, Human
uaucuugagagacaacacagca

SEQ ID NO: 164464 - RNA, 19 nt, Human
ugaagcagcaaacucucag

SEQ ID NO: 164465 - RNA, 22 nt, Human
uggcagagcccagacuccaguc

SEQ ID NO: 164466 - RNA, 22 nt, Human
cugcuuuggcucagugacauca

SEQ ID NO: 164467 - RNA, 22 nt, Human
uggaggcauuuuagguugucac

SEQ ID NO: 164468 - RNA, 22 nt, Human
uacauuuauaaggcuucucugu

SEQ ID NO: 164469 - RNA, 22 nt, Human
cuggcagcagcuucuggaucga

SEQ ID NO: 164470 - RNA, 22 nt, Human
uggcucuguugugcugagccag

SEQ ID NO: 164471 - RNA, 22 nt, Human
augggagugacagggccacugg

SEQ ID NO: 164472 - RNA, 20 nt, Human
cucuggcuccgcgugaccgc

SEQ ID NO: 164473 - RNA, 22 nt, Human
ugccugucuccucugcagggug

SEQ ID NO: 164474 - RNA, 22 nt, Human
ccugcagacacuuguccagcaa

SEQ ID NO: 164475 - RNA, 22 nt, Human
uuuacuuugugucaagucaaga

SEQ ID NO: 164476 - RNA, 22 nt, Human
acaguggagaaggcaugaggcu

SEQ ID NO: 164477 - RNA, 22 nt, Human
gagggucccgagcccugucaga

SEQ ID NO: 164478 - RNA, 22 nt, Human
caguggcgugaucucugcucac

SEQ ID NO: 164479 - RNA, 22 nt, Human
gugcagggagcccagaaggucc

SEQ ID NO: 164480 - RNA, 22 nt, Human
ugcagccaucuuucuuggagga

SEQ ID NO: 164481 - RNA, 22 nt, Human
gccaggcuggugucacaacucu

SEQ ID NO: 164482 - RNA, 23 nt, Human
auuuccuacuauaaaagagguaa

SEQ ID NO: 164483 - RNA, 18 nt, Human
aaggcuucaaagaguaga

SEQ ID NO: 164484 - RNA, 22 nt, Human
gcagauggugccaugucuugug

SEQ ID NO: 164485 - RNA, 22 nt, Human
cuggcagcgcagcaugaagucg

SEQ ID NO: 164486 - RNA, 22 nt, Human
caggaaugacugcagauggggc

SEQ ID NO: 164487 - RNA, 22 nt, Human
uccauggguagcccugguugag

SEQ ID NO: 164488 - RNA, 20 nt, Human
ucugugugccaucaccuaac

SEQ ID NO: 164489 - RNA, 19 nt, Human
caggagagcaugcacuuug

SEQ ID NO: 164490 - RNA, 22 nt, Human
ccugcagagccacgugccagcg

SEQ ID NO: 164491 - RNA, 22 nt, Human
cacauuucuaggaaauuaaaug

SEQ ID NO: 164492 - RNA, 22 nt, Human
cccagcccccgagugucuggaa

SEQ ID NO: 164493 - RNA, 22 nt, Human
aucuucaacuugaucauuugaa

SEQ ID NO: 164494 - RNA, 22 nt, Human
caguacuuaacuuauaggagag

SEQ ID NO: 164495 - RNA, 22 nt, Human
uaacagaaacagauaaguguaa

SEQ ID NO: 164496 - RNA, 22 nt, Human
agcagcaacuuauuuuucuuau

SEQ ID NO: 164497 - RNA, 22 nt, Human
gccucuggggcagcugagucau

SEQ ID NO: 164498 - RNA, 22 nt, Human
gccagagcagaauagaguggcc

SEQ ID NO: 164499 - RNA, 22 nt, Human
gagacugauggggcucccagaa

SEQ ID NO: 164500 - RNA, 22 nt, Human
aacucaguuacauauuagaaua

SEQ ID NO: 164501 - RNA, 22 nt, Human
ccagagcccagcacacggugcu

SEQ ID NO: 164502 - RNA, 22 nt, Human
ugagagagccugaaucucuuac

SEQ ID NO: 164503 - RNA, 18 nt, Human
ugagagugugugcucuug

SEQ ID NO: 164504 - RNA, 22 nt, Human
gggauggggucaacauguaccu

SEQ ID NO: 164505 - RNA, 22 nt, Human
cacugaaucucaaggggagggu

SEQ ID NO: 164506 - RNA, 22 nt, Human
uaaaugugucuauggacccgcc

SEQ ID NO: 164507 - RNA, 22 nt, Human
cugaaggagaaggccacuguuc

SEQ ID NO: 164508 - RNA, 17 nt, Human
aucuggcugcuucuaga

SEQ ID NO: 164509 - RNA, 22 nt, Human
agaaauguauagugaauuuuuc

SEQ ID NO: 164510 - RNA, 22 nt, Human
aaaugucuaucuggcauauucc

SEQ ID NO: 164511 - RNA, 22 nt, Human
ugagggcugcuuccagagcuag

SEQ ID NO: 164512 - RNA, 22 nt, Human
aaagaacaauguggaaucuccu

SEQ ID NO: 164513 - RNA, 22 nt, Human
gcugagggcauguguggcgacu

SEQ ID NO: 164514 - RNA, 22 nt, Human
uugauacagcagccugugaucc

SEQ ID NO: 164515 - RNA, 22 nt, Human
cagagccaacgccaccugccca

SEQ ID NO: 164516 - RNA, 22 nt, Human
uccaggcugggcugaagggugc

SEQ ID NO: 164517 - RNA, 22 nt, Human
ucaggggcuugaggugcauguc

SEQ ID NO: 164518 - RNA, 22 nt, Human
ugcagcucugaacagucaugaa

SEQ ID NO: 164519 - RNA, 22 nt, Human
uggcacugggaugcuacuguua

SEQ ID NO: 164520 - RNA, 22 nt, Human
ggacaggguaaguacuagugug

SEQ ID NO: 164521 - RNA, 22 nt, Human
ccucagggucugaggagaccgu

SEQ ID NO: 164522 - RNA, 22 nt, Human
aagcugccuagaguugaauguc

SEQ ID NO: 164523 - RNA, 22 nt, Human
agggcagcagcccauggcucug

SEQ ID NO: 164524 - RNA, 22 nt, Human
aaacuguaagagaauaaacuac

SEQ ID NO: 164525 - RNA, 22 nt, Human
uugaaaggugacauuguuagag

SEQ ID NO: 164526 - RNA, 22 nt, Human
gcucccugacucaguuccugag

SEQ ID NO: 164527 - RNA, 22 nt, Human
gggcagaggcucuggcccaucc

SEQ ID NO: 164528 - RNA, 22 nt, Human
ggagucagccugucagagugua

SEQ ID NO: 164529 - RNA, 17 nt, Human
acacagccagguucucc

SEQ ID NO: 164530 - RNA, 20 nt, Human
cccucugcuacacugggagc

SEQ ID NO: 164531 - RNA, 22 nt, Human
cagcugaguguuggcauguuca

SEQ ID NO: 164532 - RNA, 22 nt, Human
cccuccagagcuugaccugcug

SEQ ID NO: 164533 - RNA, 22 nt, Human
gggucuggacggcugcaggaag

SEQ ID NO: 164534 - RNA, 22 nt, Human
accucugccacuuucuaacucu

SEQ ID NO: 164535 - RNA, 22 nt, Human
cuggcagcgguuugcagccugg

SEQ ID NO: 164536 - RNA, 20 nt, Human
uccucagaagacauuugggg

SEQ ID NO: 164537 - RNA, 22 nt, Human
agaauucugacaauagaauugg

SEQ ID NO: 164538 - RNA, 22 nt, Human
agggugggcuagacucuucccc

SEQ ID NO: 164539 - RNA, 22 nt, Human
ucaaugauaucagcaggaugug

SEQ ID NO: 164540 - RNA, 22 nt, Human
cagggugggcacccagccucca

SEQ ID NO: 164541 - RNA, 22 nt, Human
agggccagcugaugagaaugag

SEQ ID NO: 164542 - RNA, 22 nt, Human
agagaaaagaguucaggcuuug

SEQ ID NO: 164543 - RNA, 22 nt, Human
aaacagaaggguagguaaacau

SEQ ID NO: 164544 - RNA, 22 nt, Human
agaagcugacagaugcagcagg

SEQ ID NO: 164545 - RNA, 22 nt, Human
ccagcagaggggcggagugcag

SEQ ID NO: 164546 - RNA, 22 nt, Human
agaugaagauaucugcaggggc

SEQ ID NO: 164547 - RNA, 22 nt, Human
guuggccugaauggucaagagg

SEQ ID NO: 164548 - RNA, 22 nt, Human
cuguccuggagggcauaggacg

SEQ ID NO: 164549 - RNA, 22 nt, Human
accuggcaugaagcaugccuua

SEQ ID NO: 164550 - RNA, 22 nt, Human
acacacagguaaaggagccugg

SEQ ID NO: 164551 - RNA, 22 nt, Human
gugucacaugguuuacugcagc

SEQ ID NO: 164552 - RNA, 22 nt, Human
ucacagcaaaagugugcagagc

SEQ ID NO: 164553 - RNA, 22 nt, Human
uucagugugugauaccugcugu

SEQ ID NO: 164554 - RNA, 22 nt, Human
cagugcagccaaggacaggcac

SEQ ID NO: 164555 - RNA, 22 nt, Human
ccugucugcggaggaguggaag

SEQ ID NO: 164556 - RNA, 22 nt, Human
cuugccuguggcuaguuggcuc

SEQ ID NO: 164557 - RNA, 22 nt, Human
ugaaaggugacauuucuuggau

SEQ ID NO: 164558 - RNA, 22 nt, Human
cuuauguaaacuacagauaaua

SEQ ID NO: 164559 - RNA, 22 nt, Human
aacagcaugcuggguaacauug

SEQ ID NO: 164560 - RNA, 18 nt, Human
uggagccauugccaccau

SEQ ID NO: 164561 - RNA, 22 nt, Human
cuccuuccugccccagugauaa

SEQ ID NO: 164562 - RNA, 22 nt, Human
uggcccugacuuggaggccuga

SEQ ID NO: 164563 - RNA, 22 nt, Human
gcaccaggcuuagagccccagg

SEQ ID NO: 164564 - RNA, 22 nt, Human
uacaguaaagcugcuaugaauu

SEQ ID NO: 164565 - RNA, 22 nt, Human
uaaagcaggccacauaugugau

SEQ ID NO: 164566 - RNA, 22 nt, Human
gcaggcagagaaggaacauuua

SEQ ID NO: 164567 - RNA, 22 nt, Human
guccuggguccccgcaggucag

SEQ ID NO: 164568 - RNA, 22 nt, Human
ggaggugaggccguagggugug

SEQ ID NO: 164569 - RNA, 22 nt, Human
ggucagguuuuuaggagugacc

SEQ ID NO: 164570 - RNA, 22 nt, Human
gcugucugcugugcacugagca

SEQ ID NO: 164571 - RNA, 22 nt, Human
uuucaauguaugucuuucugag

SEQ ID NO: 164572 - RNA, 22 nt, Human
aguguccccuccaagggccugg

SEQ ID NO: 164573 - RNA, 22 nt, Human
ggcaggugcucugugggccugg

SEQ ID NO: 164574 - RNA, 22 nt, Human
gcuuccuagaucugugguacuc

SEQ ID NO: 164575 - RNA, 22 nt, Human
gagacagaguuucacucuuguu

SEQ ID NO: 164576 - RNA, 22 nt, Human
auuucugauaaacguaagcugc

SEQ ID NO: 164577 - RNA, 22 nt, Human
aguacuuugcacuuugcucaga

SEQ ID NO: 164578 - RNA, 22 nt, Human
caggcccugggcaggaucagcc

SEQ ID NO: 164579 - RNA, 22 nt, Human
agcccuucaaccugccuacucc

SEQ ID NO: 164580 - RNA, 22 nt, Human
acugaaggcuuucccaagguca

SEQ ID NO: 164581 - RNA, 22 nt, Human
caggauccccaggucgccgucc

SEQ ID NO: 164582 - RNA, 22 nt, Human
gugcugcagagucucgugccgc

SEQ ID NO: 164583 - RNA, 22 nt, Human
uuugugaaaugaagucacaacu

SEQ ID NO: 164584 - RNA, 22 nt, Human
uuaaacaguguuucaugugggg

SEQ ID NO: 164585 - RNA, 22 nt, Human
cuggccugaggccgccuucaga

SEQ ID NO: 164586 - RNA, 22 nt, Human
ucuggcuccacucugugcaugc

SEQ ID NO: 164587 - RNA, 22 nt, Human
ugcauauuuuauaaagauggaa

SEQ ID NO: 164588 - RNA, 22 nt, Human
augcagagacagauguggcaug

SEQ ID NO: 164589 - RNA, 22 nt, Human
aagguacaguuuuaagaauaag

SEQ ID NO: 164590 - RNA, 19 nt, Human
ggccuggauuuagggcucc

SEQ ID NO: 164591 - RNA, 22 nt, Human
uuauguacaauguuaauguaaa

SEQ ID NO: 164592 - RNA, 22 nt, Human
gggacugggagauccuccuggc

SEQ ID NO: 164593 - RNA, 22 nt, Human
guuugcauggaagacagugagu

SEQ ID NO: 164594 - RNA, 22 nt, Human
caggcugcagugcaguggcuau

SEQ ID NO: 164595 - RNA, 22 nt, Human
ugggcugcuucuauuggugguc

SEQ ID NO: 164596 - RNA, 22 nt, Human
ucacuguauuugcugaugcaua

SEQ ID NO: 164597 - RNA, 21 nt, Human
ucccagagugcuugggacugc

SEQ ID NO: 164598 - RNA, 22 nt, Human
ucucuggagggcuccaggcggg

SEQ ID NO: 164599 - RNA, 22 nt, Human
ucauugaacgaagagcuccauu

SEQ ID NO: 164600 - RNA, 22 nt, Human
agggaaaggcugaugcuguggg

SEQ ID NO: 164601 - RNA, 19 nt, Human
cucagcuguagcucaugug

SEQ ID NO: 164602 - RNA, 22 nt, Human
gcaucuuucuguccauucagca

SEQ ID NO: 164603 - RNA, 22 nt, Human
ucacagugagccaugucagaga

SEQ ID NO: 164604 - RNA, 22 nt, Human
ugcuggaggccugacuguguuu

SEQ ID NO: 164605 - RNA, 22 nt, Human
ggggcagaaagcccacagagug

SEQ ID NO: 164606 - RNA, 22 nt, Human
aagagcuggcccaaucugagca

SEQ ID NO: 164607 - RNA, 22 nt, Human
uuuauuauguacaggcacuaua

SEQ ID NO: 164608 - RNA, 22 nt, Human
cagaguguuagcgcugguuggg

SEQ ID NO: 164609 - RNA, 22 nt, Human
aucuggcucgcuaggcucuggg

SEQ ID NO: 164610 - RNA, 22 nt, Human
aggcaggugggucacuugaguc

SEQ ID NO: 164611 - RNA, 22 nt, Human
gccaggcagcagcgaggauggu

SEQ ID NO: 164612 - RNA, 21 nt, Human
gcugcugccccuagugaggcc

SEQ ID NO: 164613 - RNA, 22 nt, Human
cacugaagccugggaguaagac

SEQ ID NO: 164614 - RNA, 18 nt, Human
ugcucuguuuaaugauuu

SEQ ID NO: 164615 - RNA, 22 nt, Human
cugccucuugacagaucguggc

SEQ ID NO: 164616 - RNA, 22 nt, Human
aggcuuccgaguagcugggacu

SEQ ID NO: 164617 - RNA, 22 nt, Human
agauguuccagccaaugggaau

SEQ ID NO: 164618 - RNA, 22 nt, Human
ugucuccucauacugucauauu

SEQ ID NO: 164619 - RNA, 22 nt, Human
ugucucugguauuaggugaaaa

SEQ ID NO: 164620 - RNA, 22 nt, Human
gcuggucacucugggagcugcu

SEQ ID NO: 164621 - RNA, 16 nt, Human
gccuggaguggcaggg

SEQ ID NO: 164622 - RNA, 22 nt, Human
ccugucagcugauggcuaugua

SEQ ID NO: 164623 - RNA, 17 nt, Human
gccucugcuugugucau

SEQ ID NO: 164624 - RNA, 22 nt, Human
cacauacaaugguguuauuugg

SEQ ID NO: 164625 - RNA, 22 nt, Human
ucauugcaguugaguuguguua

SEQ ID NO: 164626 - RNA, 22 nt, Human
uauagagguggaaacugagguu

SEQ ID NO: 164627 - RNA, 22 nt, Human
cugagcugggaguggauagugg

SEQ ID NO: 164628 - RNA, 22 nt, Human
cugcucuguucccccaucaucu

SEQ ID NO: 164629 - RNA, 22 nt, Human
auggggagagaagggcugagcu

SEQ ID NO: 164630 - RNA, 19 nt, Human
caagugaagccugggaugg

SEQ ID NO: 164631 - RNA, 22 nt, Human
cacucccuucaggagccuagga

SEQ ID NO: 164632 - RNA, 22 nt, Human
acauuugagaugccuuuuaggu

SEQ ID NO: 164633 - RNA, 22 nt, Human
uauguuaaauguuugauguuua

SEQ ID NO: 164634 - RNA, 22 nt, Human
gcagggccagguacaagaagca

SEQ ID NO: 164635 - RNA, 22 nt, Human
ccagaaaaugcagaacauagaa

SEQ ID NO: 164636 - RNA, 22 nt, Human
agugaaauacugucguuuuuag

SEQ ID NO: 164637 - RNA, 22 nt, Human
ccucuccaguuuuaacgugacc

SEQ ID NO: 164638 - RNA, 22 nt, Human
cagucccagcugcucagaaggc

SEQ ID NO: 164639 - RNA, 22 nt, Human
ucuucacaccgggcagcaggaa

SEQ ID NO: 164640 - RNA, 22 nt, Human
cuucuccucugaguccugggag

SEQ ID NO: 164641 - RNA, 22 nt, Human
uuaugggagcaauuggggaggu

SEQ ID NO: 164642 - RNA, 21 nt, Human
aaggagccuaggaggcucagg

SEQ ID NO: 164643 - RNA, 22 nt, Human
ccauggaguuccucuggucuau

SEQ ID NO: 164644 - RNA, 22 nt, Human
uauugaaauucuucauguccuc

SEQ ID NO: 164645 - RNA, 19 nt, Human
uagaaugcccacuuaaaaa

SEQ ID NO: 164646 - RNA, 22 nt, Human
cuggagccccaggcugugcaga

SEQ ID NO: 164647 - RNA, 19 nt, Human
acucaagucuaaugaaauc

SEQ ID NO: 164648 - RNA, 22 nt, Human
gcugcucuuuucagagaugaga

SEQ ID NO: 164649 - RNA, 22 nt, Human
agggugccugcugcagguucag

SEQ ID NO: 164650 - RNA, 22 nt, Human
cuccucugucuggcccugagcc

SEQ ID NO: 164651 - RNA, 19 nt, Human
uuuggcacucugaaguguu

SEQ ID NO: 164652 - RNA, 22 nt, Human
gaggacagugugaucugccagc

SEQ ID NO: 164653 - RNA, 22 nt, Human
uuuggaaaguguacaaauuuga

SEQ ID NO: 164654 - RNA, 22 nt, Human
caaaagauacuugcaucuaacu

SEQ ID NO: 164655 - RNA, 22 nt, Human
guaacacagaaaugaaauucca

SEQ ID NO: 164656 - RNA, 22 nt, Human
caggagcccagaguccucagcu

SEQ ID NO: 164657 - RNA, 22 nt, Human
gcuguguccucacacagccuuu

SEQ ID NO: 164658 - RNA, 22 nt, Human
uacaguaaccagucuacuuaga

SEQ ID NO: 164659 - RNA, 22 nt, Human
ggaaccaggaguuacacgaguu

SEQ ID NO: 164660 - RNA, 19 nt, Human
acagagcucucugcuucug

SEQ ID NO: 164661 - RNA, 22 nt, Human
ucugccuggguguggagcagag

SEQ ID NO: 164662 - RNA, 22 nt, Human
cuggcagcugugugaagaacug

SEQ ID NO: 164663 - RNA, 22 nt, Human
ggccucuggucaagacaagcau

SEQ ID NO: 164664 - RNA, 22 nt, Human
ggcuuccuggggccuccugcaa

SEQ ID NO: 164665 - RNA, 22 nt, Human
uaaugaauaaacuugagaguca

SEQ ID NO: 164666 - RNA, 22 nt, Human
agcagcuucuuucacuccugga

SEQ ID NO: 164667 - RNA, 20 nt, Human
ccugggguacacuggcaugu

SEQ ID NO: 164668 - RNA, 22 nt, Human
agaaaugcauuagcacauauag

SEQ ID NO: 164669 - RNA, 22 nt, Human
cuucaucaacucuaacaaaugu

SEQ ID NO: 164670 - RNA, 22 nt, Human
ugaggugaagaguggagcucag

SEQ ID NO: 164671 - RNA, 22 nt, Human
gcugccucaggcaccuccuggc

SEQ ID NO: 164672 - RNA, 22 nt, Human
cuaggaggcgggggcugcagua

SEQ ID NO: 164673 - RNA, 21 nt, Human
agcaggaggcagucacagcuc

SEQ ID NO: 164674 - RNA, 22 nt, Human
agaaaaggauugauggaucaga

SEQ ID NO: 164675 - RNA, 22 nt, Human
ggccucucuggcauggcugccc

SEQ ID NO: 164676 - RNA, 19 nt, Human
uggcuuccaucucucucau

SEQ ID NO: 164677 - RNA, 22 nt, Human
gaggcagagugcaccccaggag

SEQ ID NO: 164678 - RNA, 22 nt, Human
aaggcacucagccuugggacag

SEQ ID NO: 164679 - RNA, 22 nt, Human
cucagagcaaugaacaugcaaa

SEQ ID NO: 164680 - RNA, 22 nt, Human
uccuugaagaaugauucuugga

SEQ ID NO: 164681 - RNA, 22 nt, Human
cucuccuggggagcacacacac

SEQ ID NO: 164682 - RNA, 21 nt, Human
uaagaacauuaucuucuuccu

SEQ ID NO: 164683 - RNA, 22 nt, Human
gccagguggcugagcagcugca

SEQ ID NO: 164684 - RNA, 22 nt, Human
cuggagccagccagggcccucu

SEQ ID NO: 164685 - RNA, 22 nt, Human
aacaucagaauauccauguugg

SEQ ID NO: 164686 - RNA, 22 nt, Human
agggccucugacgcccccagcc

SEQ ID NO: 164687 - RNA, 22 nt, Human
ucccagagacagagccuccucc

SEQ ID NO: 164688 - RNA, 22 nt, Human
auaugcacauacauacauaggu

SEQ ID NO: 164689 - RNA, 22 nt, Human
ugccucagaguugucccuacca

SEQ ID NO: 164690 - RNA, 22 nt, Human
cagcuucccuuggcugagcaga

SEQ ID NO: 164691 - RNA, 22 nt, Human
uugaagcagcucaggaggcuua

SEQ ID NO: 164692 - RNA, 22 nt, Human
aguggcagagguugacugcagu

SEQ ID NO: 164693 - RNA, 22 nt, Human
aagagagagcauucuucuguua

SEQ ID NO: 164694 - RNA, 18 nt, Human
cagggcuguggggucacu

SEQ ID NO: 164695 - RNA, 22 nt, Human
guggguggaggcgucgagggca

SEQ ID NO: 164696 - RNA, 22 nt, Human
ucucagagagcuguguuuuccu

SEQ ID NO: 164697 - RNA, 22 nt, Human
augcccaaugucacaauuuuug

SEQ ID NO: 164698 - RNA, 22 nt, Human
uuguuacaucuuauguaagugg

SEQ ID NO: 164699 - RNA, 23 nt, Human
guggccuccccggaaugccucgc

SEQ ID NO: 164700 - RNA, 22 nt, Human
gcuggaccaggugugcacaggc

SEQ ID NO: 164701 - RNA, 22 nt, Human
cuggcaggcagacuucugcaag

SEQ ID NO: 164702 - RNA, 22 nt, Human
caguauguacucuuaucaugua

SEQ ID NO: 164703 - RNA, 22 nt, Human
gugcagggcuggcaccggaggc

SEQ ID NO: 164704 - RNA, 22 nt, Human
ugaggcaguucuuacuuguauu

SEQ ID NO: 164705 - RNA, 22 nt, Human
ucagcagggagaggagaaugca

SEQ ID NO: 164706 - RNA, 22 nt, Human
ucucuggaauuggcugaggcaa

SEQ ID NO: 164707 - RNA, 22 nt, Human
accaggcugugaagugagacua

SEQ ID NO: 164708 - RNA, 21 nt, Human
gcugucucuggcuccugggaa

SEQ ID NO: 164709 - RNA, 22 nt, Human
aggcagaggaaggguggauuug

SEQ ID NO: 164710 - RNA, 22 nt, Human
ggcuuccuaauacucccuacac

SEQ ID NO: 164711 - RNA, 22 nt, Human
aaagaacaaaugauauaugguu

SEQ ID NO: 164712 - RNA, 22 nt, Human
agggcuggcuccguuaccuuga

SEQ ID NO: 164713 - RNA, 22 nt, Human
cagggcagagggaaacuccuuu

SEQ ID NO: 164714 - RNA, 22 nt, Human
ugggcagacuaaggucaaagcu

SEQ ID NO: 164715 - RNA, 18 nt, Human
uccuccuuuggccuuuuc

SEQ ID NO: 164716 - RNA, 22 nt, Human
aggcucaguuugguuuccauug

SEQ ID NO: 164717 - RNA, 22 nt, Human
uguaggacauguacuuguaaca

SEQ ID NO: 164718 - RNA, 18 nt, Human
ugggcugccuggccucug

SEQ ID NO: 164719 - RNA, 18 nt, Human
uuaagagcugaaagggga

SEQ ID NO: 164720 - RNA, 22 nt, Human
uguguauuucuggaacagacua

SEQ ID NO: 164721 - RNA, 22 nt, Human
aaguuaugaaauuuggacagcu

SEQ ID NO: 164722 - RNA, 22 nt, Human
gacaaaggaucagagguuggga

SEQ ID NO: 164723 - RNA, 22 nt, Human
gaggccacagcuaucagggaca

SEQ ID NO: 164724 - RNA, 21 nt, Human
ugcaggagucugugagucagg

SEQ ID NO: 164725 - RNA, 22 nt, Human
cuggagcucuguguguuccuga

SEQ ID NO: 164726 - RNA, 22 nt, Human
ugcauuaucuuuaauguucuca

SEQ ID NO: 164727 - RNA, 22 nt, Human
ugggcuccagcaccugugcucu

SEQ ID NO: 164728 - RNA, 22 nt, Human
acagagcucccagccaucuccu

SEQ ID NO: 164729 - RNA, 22 nt, Human
cugccgagugggucaugaggca

SEQ ID NO: 164730 - RNA, 22 nt, Human
agccauugaguuuuaugugcua

SEQ ID NO: 164731 - RNA, 22 nt, Human
gcagggcaaugaucccgagagg

SEQ ID NO: 164732 - RNA, 22 nt, Human
ugccaggcuaaguggaggacuu

SEQ ID NO: 164733 - RNA, 23 nt, Human
gggggcugguugacucucugcag

SEQ ID NO: 164734 - RNA, 22 nt, Human
aguuacaaccaugacacaagca

SEQ ID NO: 164735 - RNA, 17 nt, Human
ugagaaguaggcaucau

SEQ ID NO: 164736 - RNA, 22 nt, Human
aaagacuagcauuuauauguac

SEQ ID NO: 164737 - RNA, 22 nt, Human
uggcccugcagaacuagccugg

SEQ ID NO: 164738 - RNA, 22 nt, Human
agggcucuguccccagaggccc

SEQ ID NO: 164739 - RNA, 23 nt, Human
uggauaaagcugugcugcauagg

SEQ ID NO: 164740 - RNA, 20 nt, Human
uguacacaguacuuuacaau

SEQ ID NO: 164741 - RNA, 22 nt, Human
aagugacaccucuucccuuucc

SEQ ID NO: 164742 - RNA, 22 nt, Human
cugccagcagaggccagcgcug

SEQ ID NO: 164743 - RNA, 22 nt, Human
ggcugcaggcaggguauccacu

SEQ ID NO: 164744 - RNA, 22 nt, Human
gcuuccugauauucauacuguu

SEQ ID NO: 164745 - RNA, 22 nt, Human
gcucugcucuugacuuaccagg

SEQ ID NO: 164746 - RNA, 22 nt, Human
gcuggcugaggucuagcucuuu

SEQ ID NO: 164747 - RNA, 22 nt, Human
aaaucacuaaguuauagugugg

SEQ ID NO: 164748 - RNA, 22 nt, Human
gccuucagcggccgcucgcugc

SEQ ID NO: 164749 - RNA, 22 nt, Human
uagagcuggaauuugcagcaag

SEQ ID NO: 164750 - RNA, 20 nt, Human
cucaggauacugcaaaguug

SEQ ID NO: 164751 - RNA, 22 nt, Human
acagcugugaaaauccacagga

SEQ ID NO: 164752 - RNA, 22 nt, Human
ccugggcauaaaucacuccaag

SEQ ID NO: 164753 - RNA, 22 nt, Human
gaagagcuguagccugcucuuu

SEQ ID NO: 164754 - RNA, 22 nt, Human
cugugagcuggguggccaggac

SEQ ID NO: 164755 - RNA, 22 nt, Human
cuucuaggcuucucagggggca

SEQ ID NO: 164756 - RNA, 22 nt, Human
aaaggcuaugagauagaagaua

SEQ ID NO: 164757 - RNA, 22 nt, Human
ucaggauccauagacucccaaa

SEQ ID NO: 164758 - RNA, 22 nt, Human
gccaggugcauggcugagucuc

SEQ ID NO: 164759 - RNA, 22 nt, Human
uacauaguuccauuuacaggaa

SEQ ID NO: 164760 - RNA, 22 nt, Human
cugggugguucuaacuguugau

SEQ ID NO: 164761 - RNA, 22 nt, Human
cugccuuggaaaaugugguaau

SEQ ID NO: 164762 - RNA, 22 nt, Human
ccagcugcaggggagcagugga

SEQ ID NO: 164763 - RNA, 22 nt, Human
ggucccaggcucccucuugucc

SEQ ID NO: 164764 - RNA, 22 nt, Human
acauuucuaucauccuguaaug

SEQ ID NO: 164765 - RNA, 22 nt, Human
uuugaacaagagcuucacauua

SEQ ID NO: 164766 - RNA, 22 nt, Human
agaagccauucccuguaggcuc

SEQ ID NO: 164767 - RNA, 22 nt, Human
cagggccauuggcguggcuguc

SEQ ID NO: 164768 - RNA, 22 nt, Human
uggcacuggcgcaggauggcgg

SEQ ID NO: 164769 - RNA, 22 nt, Human
ugcauuccuccaccuccugcac

SEQ ID NO: 164770 - RNA, 22 nt, Human
ucaggagucugugcaguuccac

SEQ ID NO: 164771 - RNA, 22 nt, Human
ucucagaguuuuuuuccaggac

SEQ ID NO: 164772 - RNA, 22 nt, Human
cugagccauccauaccagcuua

SEQ ID NO: 164773 - RNA, 22 nt, Human
caggcuugauuauucagacaau

SEQ ID NO: 164774 - RNA, 22 nt, Human
gccuaggaguggggauggcggu

SEQ ID NO: 164775 - RNA, 22 nt, Human
guauucuugguuaucaaaauac

SEQ ID NO: 164776 - RNA, 22 nt, Human
ggcacugggagaggugagacgg

SEQ ID NO: 164777 - RNA, 22 nt, Human
gugcugcucacaucuggaggua

SEQ ID NO: 164778 - RNA, 17 nt, Human
gcagccagugcagcagg

SEQ ID NO: 164779 - RNA, 17 nt, Human
ggccuugggcugcucuu

SEQ ID NO: 164780 - RNA, 22 nt, Human
gaauguaauagucaguagaaca

SEQ ID NO: 164781 - RNA, 22 nt, Human
aucagugcuaaagcaaaugccc

SEQ ID NO: 164782 - RNA, 22 nt, Human
uacuuacagagcuuauaaguua

SEQ ID NO: 164783 - RNA, 22 nt, Human
ugggagcaagcuggugcuggag

SEQ ID NO: 164784 - RNA, 22 nt, Human
uguuacacagcagaauagcaag

SEQ ID NO: 164785 - RNA, 22 nt, Human
acagcuggaggucugugagcac

SEQ ID NO: 164786 - RNA, 22 nt, Human
ugccucugcugcuguggcauca

SEQ ID NO: 164787 - RNA, 22 nt, Human
cuguccuguggaccugaggacg

SEQ ID NO: 164788 - RNA, 22 nt, Human
caugcuuucuguccaaauguua

SEQ ID NO: 164789 - RNA, 21 nt, Human
ggugggcacaggagagcagag

SEQ ID NO: 164790 - RNA, 22 nt, Human
aaguuauuuccucgugacugaa

SEQ ID NO: 164791 - RNA, 22 nt, Human
ugcauuauaacugaauguuguu

SEQ ID NO: 164792 - RNA, 22 nt, Human
ugcugggcuugaaagcugcuaa

SEQ ID NO: 164793 - RNA, 22 nt, Human
ucagcaaugugauacugugcaa

SEQ ID NO: 164794 - RNA, 22 nt, Human
uauauuaacacccacuugccuc

SEQ ID NO: 164795 - RNA, 22 nt, Human
ugcugucugcaacaguacuaca

SEQ ID NO: 164796 - RNA, 19 nt, Human
gcugcucugggucucaucu

SEQ ID NO: 164797 - RNA, 17 nt, Human
ugaggccugcaucagug

SEQ ID NO: 164798 - RNA, 22 nt, Human
ucucagagaaaugugucaccau

SEQ ID NO: 164799 - RNA, 18 nt, Human
caguuuuuauaucuggca

SEQ ID NO: 164800 - RNA, 22 nt, Human
uggcagagcccagaacugagca

SEQ ID NO: 164801 - RNA, 22 nt, Human
uggcuggcuagugggcaggauu

SEQ ID NO: 164802 - RNA, 22 nt, Human
ccacacagucaguuuccaagaa

SEQ ID NO: 164803 - RNA, 22 nt, Human
caggccugcaggaaaggcuccc

SEQ ID NO: 164804 - RNA, 19 nt, Human
gaucuuugccaauuuaagc

SEQ ID NO: 164805 - RNA, 22 nt, Human
ucauugcauuuauucacuggca

SEQ ID NO: 164806 - RNA, 22 nt, Human
ucccagagcucuggagguugga

SEQ ID NO: 164807 - RNA, 22 nt, Human
ugcaggccggcccuaggccuca

SEQ ID NO: 164808 - RNA, 22 nt, Human
ggccucucuccagucagugcag

SEQ ID NO: 164809 - RNA, 22 nt, Human
agagcccucuucacugccccuu

SEQ ID NO: 164810 - RNA, 22 nt, Human
gagugugucggucagcguggcg

SEQ ID NO: 164811 - RNA, 22 nt, Human
caugggagguuggcuuggcaug

SEQ ID NO: 164812 - RNA, 22 nt, Human
ccagcagccaccuucucgaaau

SEQ ID NO: 164813 - RNA, 22 nt, Human
caggcugaucagggcugggaug

SEQ ID NO: 164814 - RNA, 22 nt, Human
ugucucagaggcaggaagagcc

SEQ ID NO: 164815 - RNA, 22 nt, Human
auuuguagugaagugaaaauaa

SEQ ID NO: 164816 - RNA, 22 nt, Human
agcaggguuccaggaguugcag

SEQ ID NO: 164817 - RNA, 22 nt, Human
uagacagauuuaaaggaaugga

SEQ ID NO: 164818 - RNA, 22 nt, Human
agcugccaaguuggaguagcaa

SEQ ID NO: 164819 - RNA, 22 nt, Human
uacauagcaaggaaaugacaga

SEQ ID NO: 164820 - RNA, 22 nt, Human
cacagcugcccuacuccaugug

SEQ ID NO: 164821 - RNA, 22 nt, Human
aagaugauaggacuugcuuaag

SEQ ID NO: 164822 - RNA, 22 nt, Human
caggggcagucugugugcgugg

SEQ ID NO: 164823 - RNA, 23 nt, Human
ugcagagggacugaagccagcuu

SEQ ID NO: 164824 - RNA, 22 nt, Human
ugcccaggaucuggcgaugcuc

SEQ ID NO: 164825 - RNA, 22 nt, Human
ggccuggaagaggacagagaaa

SEQ ID NO: 164826 - RNA, 22 nt, Human
uggaagcagugauucuugucug

SEQ ID NO: 164827 - RNA, 22 nt, Human
uccucucagugugguuguggga

SEQ ID NO: 164828 - RNA, 22 nt, Human
ugagagugauugguucgaaugu

SEQ ID NO: 164829 - RNA, 22 nt, Human
agggacuggcucucugagcagg

SEQ ID NO: 164830 - RNA, 22 nt, Human
aauguauaaaguguuaauaacu

SEQ ID NO: 164831 - RNA, 22 nt, Human
gcagccaggaaagcuggacccu

SEQ ID NO: 164832 - RNA, 19 nt, Human
cauaauacaguggaucuga

SEQ ID NO: 164833 - RNA, 22 nt, Human
aagggcagaauagagaagaugg

SEQ ID NO: 164834 - RNA, 22 nt, Human
cagacacagcaauucuguguug

SEQ ID NO: 164835 - RNA, 22 nt, Human
cacugcaggucugagauggggg

SEQ ID NO: 164836 - RNA, 22 nt, Human
ccaaagugcugggguuacaggc

SEQ ID NO: 164837 - RNA, 22 nt, Human
caguauguuugggagacaugac

SEQ ID NO: 164838 - RNA, 22 nt, Human
gcucacugccauucucuagaug

SEQ ID NO: 164839 - RNA, 23 nt, Human
ugggaguguugggaucucugcuc

SEQ ID NO: 164840 - RNA, 22 nt, Human
caggggcugagaaggaacgucc

SEQ ID NO: 164841 - RNA, 22 nt, Human
uuagauaaauugcaacuugauu

SEQ ID NO: 164842 - RNA, 22 nt, Human
ggagcagacauaaccuuacaga

SEQ ID NO: 164843 - RNA, 20 nt, Human
ugcagagcuggcuggcuccu

SEQ ID NO: 164844 - RNA, 22 nt, Human
aagugagauuauauguacggga

SEQ ID NO: 164845 - RNA, 22 nt, Human
ccugagggcgccgagcucccag

SEQ ID NO: 164846 - RNA, 22 nt, Human
aaguugaaugcguacgugacau

SEQ ID NO: 164847 - RNA, 22 nt, Human
ucucugggaaugggccugggua

SEQ ID NO: 164848 - RNA, 22 nt, Human
ggcuucccaaggagccaggaug

SEQ ID NO: 164849 - RNA, 20 nt, Human
gccugcagagaaggucagag

SEQ ID NO: 164850 - RNA, 22 nt, Human
agugacugacaccuguaauccc

SEQ ID NO: 164851 - RNA, 23 nt, Human
aguguuccaguugguugagagug

SEQ ID NO: 164852 - RNA, 22 nt, Human
gggcuggaucuccugcaggcag

SEQ ID NO: 164853 - RNA, 22 nt, Human
agcugccugcuuaugagcucca

SEQ ID NO: 164854 - RNA, 22 nt, Human
aaaugucuuugaguauuucugc

SEQ ID NO: 164855 - RNA, 22 nt, Human
uauaacaguuuaggugguguca

SEQ ID NO: 164856 - RNA, 22 nt, Human
cagcccagcagggucuggcccu

SEQ ID NO: 164857 - RNA, 22 nt, Human
cagggcuggcucaugaaaaguu

SEQ ID NO: 164858 - RNA, 17 nt, Human
acacagggagagggagc

SEQ ID NO: 164859 - RNA, 22 nt, Human
ugaggcuguucuaccagggcca

SEQ ID NO: 164860 - RNA, 22 nt, Human
cuggcucagugccuucagaagu

SEQ ID NO: 164861 - RNA, 22 nt, Human
aguuuauagcccagauucaugg

SEQ ID NO: 164862 - RNA, 22 nt, Human
gucacuggggccacaugcagaa

SEQ ID NO: 164863 - RNA, 22 nt, Human
ggaaggaggggcaaagcaguuc

SEQ ID NO: 164864 - RNA, 22 nt, Human
uuugucagucaugucugcuuuu

SEQ ID NO: 164865 - RNA, 20 nt, Human
ccagguggugccuggagagg

SEQ ID NO: 164866 - RNA, 22 nt, Human
acagagauggcacagagaaggu

SEQ ID NO: 164867 - RNA, 21 nt, Human
acagacagggccagugucccc

SEQ ID NO: 164868 - RNA, 23 nt, Human
ucccagggaaggugagcgaggcu

SEQ ID NO: 164869 - RNA, 22 nt, Human
aacugcauucagaaagcucacu

SEQ ID NO: 164870 - RNA, 22 nt, Human
ugcucuucggggccacugcuug

SEQ ID NO: 164871 - RNA, 22 nt, Human
agcugccaucagccuuuggaug

SEQ ID NO: 164872 - RNA, 22 nt, Human
ccucacucugcacccugcagca

SEQ ID NO: 164873 - RNA, 22 nt, Human
ugaaagguguccaauauuucuc

SEQ ID NO: 164874 - RNA, 22 nt, Human
ccuggagcaggagcugcagagg

SEQ ID NO: 164875 - RNA, 21 nt, Human
ucuccaguauccuucucugag

SEQ ID NO: 164876 - RNA, 22 nt, Human
caggacaguuugcuuugcccug

SEQ ID NO: 164877 - RNA, 22 nt, Human
uaggccagcccuuaguccuguc

SEQ ID NO: 164878 - RNA, 22 nt, Human
ccagcagacacacaggcguggg

SEQ ID NO: 164879 - RNA, 22 nt, Human
cugggguggugcaggccucaug

SEQ ID NO: 164880 - RNA, 22 nt, Human
auauucuuccaaaacaucauuu

SEQ ID NO: 164881 - RNA, 22 nt, Human
agguaaagacagugaaagaggg

SEQ ID NO: 164882 - RNA, 22 nt, Human
caaaagcaguucuaucugaguu

SEQ ID NO: 164883 - RNA, 22 nt, Human
aggcagaauguuggaaaggaag

SEQ ID NO: 164884 - RNA, 20 nt, Human
uguuucuuuuaaugagcggc

SEQ ID NO: 164885 - RNA, 22 nt, Human
cucacugucuguacuagcugau

SEQ ID NO: 164886 - RNA, 22 nt, Human
ccaggccugcaucugcugcgca

SEQ ID NO: 164887 - RNA, 22 nt, Human
aggagcagcccacuccuguccu

SEQ ID NO: 164888 - RNA, 22 nt, Human
uauugacaauuugugaaacuau

SEQ ID NO: 164889 - RNA, 20 nt, Human
augccucuaauuuugcaaac

SEQ ID NO: 164890 - RNA, 22 nt, Human
cuggcagcauggagccugugcu

SEQ ID NO: 164891 - RNA, 22 nt, Human
cugccuggcuaaacucaagucg

SEQ ID NO: 164892 - RNA, 22 nt, Human
ugucccagauacuggacauaga

SEQ ID NO: 164893 - RNA, 22 nt, Human
uggaugcuguaggacacgcucu

SEQ ID NO: 164894 - RNA, 22 nt, Human
cugccuggucucaggcaugggg

SEQ ID NO: 164895 - RNA, 22 nt, Human
gguagcagggcugugagucaga

SEQ ID NO: 164896 - RNA, 22 nt, Human
aggcagcuggcagcacccaggg

SEQ ID NO: 164897 - RNA, 22 nt, Human
ccagcucuuuuggcugagugag

SEQ ID NO: 164898 - RNA, 22 nt, Human
agauacauugaguuuccuccug

SEQ ID NO: 164899 - RNA, 22 nt, Human
caugcacaacauacucaagagg

SEQ ID NO: 164900 - RNA, 22 nt, Human
aaaugucuuuaucucauguaac

SEQ ID NO: 164901 - RNA, 22 nt, Human
cauggcaggaggcugcuggcag

SEQ ID NO: 164902 - RNA, 22 nt, Human
ccaccagcagugugcaaggauu

SEQ ID NO: 164903 - RNA, 22 nt, Human
caaugguggugucagaagagau

SEQ ID NO: 164904 - RNA, 22 nt, Human
caggauggucagaugcauuguc

SEQ ID NO: 164905 - RNA, 23 nt, Human
cagguggcuccacgagggguggg

SEQ ID NO: 164906 - RNA, 22 nt, Human
guuccauaucacagcagacgaa

SEQ ID NO: 164907 - RNA, 22 nt, Human
uacaaaugaccauagccacuua

SEQ ID NO: 164908 - RNA, 22 nt, Human
aacagugagaagguggacagga

SEQ ID NO: 164909 - RNA, 22 nt, Human
agagacaggauaucugcucaug

SEQ ID NO: 164910 - RNA, 22 nt, Human
ugccugucagggggagugggaa

SEQ ID NO: 164911 - RNA, 19 nt, Human
ucugcuggcagaauucccu

SEQ ID NO: 164912 - RNA, 22 nt, Human
gcugagaguguaggauguuuac

SEQ ID NO: 164913 - RNA, 22 nt, Human
ugacagaaugugacucucagau

SEQ ID NO: 164914 - RNA, 22 nt, Human
acccugggcuuggccugcucag

SEQ ID NO: 164915 - RNA, 22 nt, Human
cugcccugcccaggccuugggc

SEQ ID NO: 164916 - RNA, 22 nt, Human
aagacauuacuggaaucugacu

SEQ ID NO: 164917 - RNA, 22 nt, Human
acaaagugcacaagaugagaac

SEQ ID NO: 164918 - RNA, 22 nt, Human
guaggcagucucucaggugauc

SEQ ID NO: 164919 - RNA, 22 nt, Human
ccagcuucucucugaugcagcu

SEQ ID NO: 164920 - RNA, 22 nt, Human
acuccuggguugcaguccucaa

SEQ ID NO: 164921 - RNA, 22 nt, Human
ucagugucuugaccugggugug

SEQ ID NO: 164922 - RNA, 22 nt, Human
caagagcucccagaccugggca

SEQ ID NO: 164923 - RNA, 22 nt, Human
aaguguguugacugaauugggg

SEQ ID NO: 164924 - RNA, 22 nt, Human
agcaggaaagaaaaaucugugu

SEQ ID NO: 164925 - RNA, 22 nt, Human
gucaaguuaagauaaggucaug

SEQ ID NO: 164926 - RNA, 20 nt, Human
agucccagaucaaauuucug

SEQ ID NO: 164927 - RNA, 22 nt, Human
agggagaaaauuggaugcacaa

SEQ ID NO: 164928 - RNA, 22 nt, Human
gcagccacucucauuccacgug

SEQ ID NO: 164929 - RNA, 22 nt, Human
agccagccgggggaccacagug

SEQ ID NO: 164930 - RNA, 22 nt, Human
uggcagcugauuagauggugcc

SEQ ID NO: 164931 - RNA, 21 nt, Human
ugccagcauguaggcuaguug

SEQ ID NO: 164932 - RNA, 22 nt, Human
caaagugcuggaauuacaggug

SEQ ID NO: 164933 - RNA, 22 nt, Human
ucaggcugaggucaucugcauc

SEQ ID NO: 164934 - RNA, 22 nt, Human
gggcuucucuuaugcuaacugg

SEQ ID NO: 164935 - RNA, 20 nt, Human
gcucccugguagaaauguuu

SEQ ID NO: 164936 - RNA, 22 nt, Human
aacucagcauccugcacagaga

SEQ ID NO: 164937 - RNA, 22 nt, Human
caggggcucuaaugcaugauca

SEQ ID NO: 164938 - RNA, 23 nt, Human
ggucccaguggagaggccucacc

SEQ ID NO: 164939 - RNA, 22 nt, Human
agaggugacauaggagaggcuc

SEQ ID NO: 164940 - RNA, 22 nt, Human
cccacucccugcacgccugccg

SEQ ID NO: 164941 - RNA, 22 nt, Human
gagcucagcacuaaaaucaugu

SEQ ID NO: 164942 - RNA, 22 nt, Human
uggggccuggucagagcugcac

SEQ ID NO: 164943 - RNA, 22 nt, Human
augugucaauuuucaaaugcuu

SEQ ID NO: 164944 - RNA, 22 nt, Human
caugcuuugggucagaaaugcc

SEQ ID NO: 164945 - RNA, 22 nt, Human
ccagggugaccagcuggccuag

SEQ ID NO: 164946 - RNA, 22 nt, Human
gauuucaaagguucugcaugcc

SEQ ID NO: 164947 - RNA, 18 nt, Human
cggcagagugcuucuagc

SEQ ID NO: 164948 - RNA, 22 nt, Human
ccaggccucccuuuuccagcca

SEQ ID NO: 164949 - RNA, 22 nt, Human
gccuggcaggggccugggagug

SEQ ID NO: 164950 - RNA, 22 nt, Human
aagauacauaaagguagagucu

SEQ ID NO: 164951 - RNA, 22 nt, Human
uuagauaacaguagaauaucaa

SEQ ID NO: 164952 - RNA, 22 nt, Human
uaaaugcagauuccugagccua

SEQ ID NO: 164953 - RNA, 19 nt, Human
gggcuccuugggccucucu

SEQ ID NO: 164954 - RNA, 22 nt, Human
uugcagggaccugcagaaagcu

SEQ ID NO: 164955 - RNA, 22 nt, Human
cccagggcccuggacagcuaca

SEQ ID NO: 164956 - RNA, 22 nt, Human
uagucucuggagacucuagggg

SEQ ID NO: 164957 - RNA, 22 nt, Human
gaggcucagagggagcaugguc

SEQ ID NO: 164958 - RNA, 22 nt, Human
guacuuccagccaagugagaca

SEQ ID NO: 164959 - RNA, 22 nt, Human
gcucugggauuaccagccuuag

SEQ ID NO: 164960 - RNA, 23 nt, Human
cuggcucauccugguugcagugg

SEQ ID NO: 164961 - RNA, 22 nt, Human
agggguggagaguguugccagu

SEQ ID NO: 164962 - RNA, 22 nt, Human
ucaaugauagacaagaucuaag

SEQ ID NO: 164963 - RNA, 22 nt, Human
gcucagccgaacuucagagcag

SEQ ID NO: 164964 - RNA, 22 nt, Human
gcuucucucucagacugcaagc

SEQ ID NO: 164965 - RNA, 22 nt, Human
ccacagagacagagcccagggu

SEQ ID NO: 164966 - RNA, 22 nt, Human
cuccaggagcugugucuuucuu

SEQ ID NO: 164967 - RNA, 22 nt, Human
aggcucagauucacauuugguu

SEQ ID NO: 164968 - RNA, 22 nt, Human
cagaaguaagauuacugugagu

SEQ ID NO: 164969 - RNA, 22 nt, Human
aggagcugaagucucugcacuc

SEQ ID NO: 164970 - RNA, 20 nt, Human
ccuccaggcacacccaugug

SEQ ID NO: 164971 - RNA, 22 nt, Human
uuagaaaacauaagugguaaag

SEQ ID NO: 164972 - RNA, 22 nt, Human
ggagugggcagcacugcccugu

SEQ ID NO: 164973 - RNA, 22 nt, Human
uucacaggaauguaggggucuu

SEQ ID NO: 164974 - RNA, 22 nt, Human
uccagcagaccaucaaggcuca

SEQ ID NO: 164975 - RNA, 20 nt, Human
gcagagccucacugcaaggg

SEQ ID NO: 164976 - RNA, 23 nt, Human
ggagccuggcauaugagacgcau

SEQ ID NO: 164977 - RNA, 22 nt, Human
auucagcaguuccugcuucagu

SEQ ID NO: 164978 - RNA, 22 nt, Human
gcaaugauauugaagugaugaa

SEQ ID NO: 164979 - RNA, 22 nt, Human
caagagcuacccugugccauau

SEQ ID NO: 164980 - RNA, 20 nt, Human
ugcuccaucuaaagugauua

SEQ ID NO: 164981 - RNA, 22 nt, Human
ccagggcugagcugugaccaug

SEQ ID NO: 164982 - RNA, 22 nt, Human
acugugugaaacaucaaugugu

SEQ ID NO: 164983 - RNA, 22 nt, Human
aagggcaggcagagaucauaua

SEQ ID NO: 164984 - RNA, 22 nt, Human
aagauucuacaguagguacauu

SEQ ID NO: 164985 - RNA, 22 nt, Human
ucccuggcuguguucaggugcg

SEQ ID NO: 164986 - RNA, 22 nt, Human
uaaagucaucuuuacaucuuug

SEQ ID NO: 164987 - RNA, 22 nt, Human
caucugccuaaguggcccuguu

SEQ ID NO: 164988 - RNA, 22 nt, Human
ugggacagagugagcuuuggcc

SEQ ID NO: 164989 - RNA, 22 nt, Human
uggcucagcgcggccuggucuu

SEQ ID NO: 164990 - RNA, 22 nt, Human
ggcaggagaaaggucucuucuu

SEQ ID NO: 164991 - RNA, 22 nt, Human
cugcucuggucucuucauguuu

SEQ ID NO: 164992 - RNA, 22 nt, Human
cagcugcccaggccaccuggag

SEQ ID NO: 164993 - RNA, 22 nt, Human
ccagccagccuugaucugagua

SEQ ID NO: 164994 - RNA, 22 nt, Human
uuucacaaguuucaggauucug

SEQ ID NO: 164995 - RNA, 22 nt, Human
ucugagagcuguagaagccuau

SEQ ID NO: 164996 - RNA, 22 nt, Human
agucccaggcagccgagccggu

SEQ ID NO: 164997 - RNA, 22 nt, Human
caguggguccuaaguacaguuc

SEQ ID NO: 164998 - RNA, 22 nt, Human
ggcaaaaacagcaaugacuuuu

SEQ ID NO: 164999 - RNA, 22 nt, Human
ugggcagaaggaagagccaccu

SEQ ID NO: 165000 - RNA, 22 nt, Human
agauuucaauggauauugcaag

SEQ ID NO: 165001 - RNA, 22 nt, Human
ugggcagacugagcccuguccc

SEQ ID NO: 165002 - RNA, 22 nt, Human
gagagugaaggcuucccagcaa

SEQ ID NO: 165003 - RNA, 22 nt, Human
cuguuuucaaagagagagaaug

SEQ ID NO: 165004 - RNA, 22 nt, Human
ucaucuaagagucuuacauuua

SEQ ID NO: 165005 - RNA, 22 nt, Human
cugcccagaaucacucacucga

SEQ ID NO: 165006 - RNA, 22 nt, Human
gcuggugagcaaaggagaagga

SEQ ID NO: 165007 - RNA, 22 nt, Human
aguauuuccuggcuuaucugcu

SEQ ID NO: 165008 - RNA, 22 nt, Human
uuugcauuucuaaugagcuccg

SEQ ID NO: 165009 - RNA, 22 nt, Human
caccuggcuggaagugcuccgg

SEQ ID NO: 165010 - RNA, 22 nt, Human
ugcagaagacacaagguaacgu

SEQ ID NO: 165011 - RNA, 22 nt, Human
aucuggcugcugugcuuaagcu

SEQ ID NO: 165012 - RNA, 19 nt, Human
ccagagcccgccagauggg

SEQ ID NO: 165013 - RNA, 22 nt, Human
gccaagagaaugugagagaaau

SEQ ID NO: 165014 - RNA, 22 nt, Human
cagggccagccauccugcuggg

SEQ ID NO: 165015 - RNA, 22 nt, Human
cccaggcugauguucagcgggu

SEQ ID NO: 165016 - RNA, 22 nt, Human
aaagccuuggucaucugguucc

SEQ ID NO: 165017 - RNA, 22 nt, Human
caggcagcguccugcuuccugu

SEQ ID NO: 165018 - RNA, 22 nt, Human
gcacccagcccagggcgugaug

SEQ ID NO: 165019 - RNA, 22 nt, Human
cacugccuccccaggcuccaca

SEQ ID NO: 165020 - RNA, 22 nt, Human
uccauugucuuugguccuagcc

SEQ ID NO: 165021 - RNA, 22 nt, Human
cccuggccagcucaugucugag

SEQ ID NO: 165022 - RNA, 22 nt, Human
ugggcugcagagcccggccuuc

SEQ ID NO: 165023 - RNA, 22 nt, Human
gguaacaguauguagaguaaga

SEQ ID NO: 165024 - RNA, 22 nt, Human
uguuccuaaauaugaauggaga

SEQ ID NO: 165025 - RNA, 22 nt, Human
ucugucacugagcucaggauuc

SEQ ID NO: 165026 - RNA, 23 nt, Human
uuguuuuuagagguggcaugaga

SEQ ID NO: 165027 - RNA, 22 nt, Human
ugggccugccccaggcuucagc

SEQ ID NO: 165028 - RNA, 22 nt, Human
ccucugcugcuguugagcaccg

SEQ ID NO: 165029 - RNA, 22 nt, Human
aagaggaagucuccauggagag

SEQ ID NO: 165030 - RNA, 22 nt, Human
ucaaugauaguacaaucagccu

SEQ ID NO: 165031 - RNA, 22 nt, Human
agagcccucucauuggcuuauu

SEQ ID NO: 165032 - RNA, 22 nt, Human
uacauauagacaguuacucuag

SEQ ID NO: 165033 - RNA, 22 nt, Human
gaggccugcuuuggcacucugg

SEQ ID NO: 165034 - RNA, 22 nt, Human
cugccuggaaugccagcuucuc

SEQ ID NO: 165035 - RNA, 22 nt, Human
uuggcucaggaccccugugacu

SEQ ID NO: 165036 - RNA, 22 nt, Human
guaucuuuccacaucuucagua

SEQ ID NO: 165037 - RNA, 22 nt, Human
ccuuuugcucucccauccagaa

SEQ ID NO: 165038 - RNA, 22 nt, Human
caggguggcaggcaccauggcc

SEQ ID NO: 165039 - RNA, 22 nt, Human
gggcacagagggucuugaagaa

SEQ ID NO: 165040 - RNA, 22 nt, Human
gcucccaccuccagccugaguu

SEQ ID NO: 165041 - RNA, 23 nt, Human
ccagcuccgugagccucgggcuc

SEQ ID NO: 165042 - RNA, 22 nt, Human
agguggggaggagugucucuuu

SEQ ID NO: 165043 - RNA, 22 nt, Human
gccacaggcacuuaagggcugg

SEQ ID NO: 165044 - RNA, 22 nt, Human
uggcagagaaccugggcuuugu

SEQ ID NO: 165045 - RNA, 22 nt, Human
cugagcuuggccaggaaugaau

SEQ ID NO: 165046 - RNA, 22 nt, Human
cagcugcaggaacaaaaaugug

SEQ ID NO: 165047 - RNA, 22 nt, Human
uuccucuccucccaccagguga

SEQ ID NO: 165048 - RNA, 22 nt, Human
gcugccuggaauaacggcuggc

SEQ ID NO: 165049 - RNA, 22 nt, Human
uguacauugucacucaucaagu

SEQ ID NO: 165050 - RNA, 22 nt, Human
ggcucaggagaggggcuaaaag

SEQ ID NO: 165051 - RNA, 22 nt, Human
aaugcuguauaucuuagcuaau

SEQ ID NO: 165052 - RNA, 22 nt, Human
uagggcuauaagagaauaagac

SEQ ID NO: 165053 - RNA, 22 nt, Human
uggcucagcuuuccccaucugg

SEQ ID NO: 165054 - RNA, 22 nt, Human
uggcucagagcagggacucugg

SEQ ID NO: 165055 - RNA, 22 nt, Human
gcuuuauguaaguccaaaggca

SEQ ID NO: 165056 - RNA, 22 nt, Human
ggcucaagcagucugccugccu

SEQ ID NO: 165057 - RNA, 22 nt, Human
aucagcaagacuaggggaauac

SEQ ID NO: 165058 - RNA, 22 nt, Human
ccuguguguaggccaggggagu

SEQ ID NO: 165059 - RNA, 21 nt, Human
agggagcuauuuauaguaagc

SEQ ID NO: 165060 - RNA, 21 nt, Human
aggcucagcagguguauaaag

SEQ ID NO: 165061 - RNA, 22 nt, Human
agggcuggagccacagcuggga

SEQ ID NO: 165062 - RNA, 20 nt, Human
ugggcagcacugcuggcugg

SEQ ID NO: 165063 - RNA, 22 nt, Human
auguagcagaagauguuuuccu

SEQ ID NO: 165064 - RNA, 22 nt, Human
uggcccucagucuugcuccugc

SEQ ID NO: 165065 - RNA, 18 nt, Human
agcagaauucuaggguuc

SEQ ID NO: 165066 - RNA, 22 nt, Human
gggcacagcugcuacccagugc

SEQ ID NO: 165067 - RNA, 22 nt, Human
gcucaagggaugggagugggug

SEQ ID NO: 165068 - RNA, 22 nt, Human
aggcugggaagguaaaguugua

SEQ ID NO: 165069 - RNA, 22 nt, Human
cuggagcuaauaauccaucuga

SEQ ID NO: 165070 - RNA, 22 nt, Human
uccauuuacuauucucauaucg

SEQ ID NO: 165071 - RNA, 22 nt, Human
gagucacaaagccuuucuuauu

SEQ ID NO: 165072 - RNA, 22 nt, Human
ggcuccuguccccucagcugcu

SEQ ID NO: 165073 - RNA, 22 nt, Human
ugcugcucucagccaccaggaa

SEQ ID NO: 165074 - RNA, 22 nt, Human
uugacagcuauuuugcuuugau

SEQ ID NO: 165075 - RNA, 22 nt, Human
aaguucaagcucugccuaaaau

SEQ ID NO: 165076 - RNA, 22 nt, Human
uugaaggacauccuauuucuag

SEQ ID NO: 165077 - RNA, 22 nt, Human
augaaacaugagaaauggagag

SEQ ID NO: 165078 - RNA, 22 nt, Human
accugccuucucaaggacauga

SEQ ID NO: 165079 - RNA, 22 nt, Human
auuauguagguuaggugguugu

SEQ ID NO: 165080 - RNA, 23 nt, Human
acacaaggguaacugccagccau

SEQ ID NO: 165081 - RNA, 22 nt, Human
uguguacacaaugauugcagag

SEQ ID NO: 165082 - RNA, 22 nt, Human
ccuuuuucaauauagaauugca

SEQ ID NO: 165083 - RNA, 22 nt, Human
ggcugccuucccugagccccgg

SEQ ID NO: 165084 - RNA, 22 nt, Human
cucucugagugagggacaagcu

SEQ ID NO: 165085 - RNA, 22 nt, Human
uagaaaagaauuuuauuugaua

SEQ ID NO: 165086 - RNA, 22 nt, Human
agcagagcugcaguggccugcu

SEQ ID NO: 165087 - RNA, 20 nt, Human
caggccagagguuugauggc

SEQ ID NO: 165088 - RNA, 22 nt, Human
cuguggugagcaacugacugaa

SEQ ID NO: 165089 - RNA, 22 nt, Human
cacugaagguaggaccaaggcu

SEQ ID NO: 165090 - RNA, 22 nt, Human
ccacagggcacaagggagguug

SEQ ID NO: 165091 - RNA, 22 nt, Human
cguggccuuugagugagcuccc

SEQ ID NO: 165092 - RNA, 22 nt, Human
cagggguggcugcagcagaggu

SEQ ID NO: 165093 - RNA, 22 nt, Human
acacugaauauacaaugaauau

SEQ ID NO: 165094 - RNA, 22 nt, Human
aggucagaagugccagggaauu

SEQ ID NO: 165095 - RNA, 22 nt, Human
aggagccaguuccaccccagga

SEQ ID NO: 165096 - RNA, 23 nt, Human
ccuccugggcacaggccugaugg

SEQ ID NO: 165097 - RNA, 22 nt, Human
uagccuucucaagacaaaguug

SEQ ID NO: 165098 - RNA, 22 nt, Human
ugggcucugaagucagucugcu

SEQ ID NO: 165099 - RNA, 22 nt, Human
uuaagucauuucugauuauaga

SEQ ID NO: 165100 - RNA, 22 nt, Human
auaaggcagucccuuaacaagg

SEQ ID NO: 165101 - RNA, 22 nt, Human
cugccuuugcccuugacacugu

SEQ ID NO: 165102 - RNA, 20 nt, Human
uguauauuuucugguguaaa

SEQ ID NO: 165103 - RNA, 22 nt, Human
aaauguaguauguugcauguau

SEQ ID NO: 165104 - RNA, 22 nt, Human
agcuuccuuggcgcugaggccu

SEQ ID NO: 165105 - RNA, 22 nt, Human
gagccugaugaaacaggcagac

SEQ ID NO: 165106 - RNA, 22 nt, Human
gauucugagcugguguuuuacg

SEQ ID NO: 165107 - RNA, 22 nt, Human
acagaauucucucugcagaggc

SEQ ID NO: 165108 - RNA, 22 nt, Human
ccuuagagaguacugggcugcc

SEQ ID NO: 165109 - RNA, 20 nt, Human
gccugccucagcuagcugag

SEQ ID NO: 165110 - RNA, 22 nt, Human
ugcagccaucgcagagucugua

SEQ ID NO: 165111 - RNA, 22 nt, Human
acaugcaugucuaugggcaggu

SEQ ID NO: 165112 - RNA, 22 nt, Human
gggagggacacaaagaguuccc

SEQ ID NO: 165113 - RNA, 22 nt, Human
ugucucaguacacuccgauguu

SEQ ID NO: 165114 - RNA, 22 nt, Human
aagcugccacacggugaguacu

SEQ ID NO: 165115 - RNA, 21 nt, Human
ugcucacagaugugcucagug

SEQ ID NO: 165116 - RNA, 22 nt, Human
guuguauagagggcaugaaucu

SEQ ID NO: 165117 - RNA, 21 nt, Human
aaacugaccuugccugagaca

SEQ ID NO: 165118 - RNA, 21 nt, Human
uagcacuucgcuguaauuggg

SEQ ID NO: 165119 - RNA, 22 nt, Human
gcugggaggaauuuggggaaua

SEQ ID NO: 165120 - RNA, 22 nt, Human
gcugauuauuacaugucugugg

SEQ ID NO: 165121 - RNA, 22 nt, Human
gcuggccucuggagaagggcuu

SEQ ID NO: 165122 - RNA, 22 nt, Human
ucuggcuccaccuccuuuacua

SEQ ID NO: 165123 - RNA, 22 nt, Human
ucccuggacaacagacuucacu

SEQ ID NO: 165124 - RNA, 22 nt, Human
cucaggaucgcuugcccuaggg

SEQ ID NO: 165125 - RNA, 22 nt, Human
uaggaaaaauacagaauuauau

SEQ ID NO: 165126 - RNA, 20 nt, Human
gucugaggagcagugggaaa

SEQ ID NO: 165127 - RNA, 22 nt, Human
auguacauuuguaguaauauca

SEQ ID NO: 165128 - RNA, 22 nt, Human
cagggugcagugucgcugcuag

SEQ ID NO: 165129 - RNA, 22 nt, Human
acauauuuccaugcagcauguc

SEQ ID NO: 165130 - RNA, 22 nt, Human
ggagcugcauuuagggagccuu

SEQ ID NO: 165131 - RNA, 22 nt, Human
gcuugcuggugccugcaggcuc

SEQ ID NO: 165132 - RNA, 17 nt, Human
ugcauuguuggaaauuu

SEQ ID NO: 165133 - RNA, 22 nt, Human
cagcagagacgguaagcagaac

SEQ ID NO: 165134 - RNA, 20 nt, Human
uguuccaugacuauuuggau

SEQ ID NO: 165135 - RNA, 22 nt, Human
ggccugcuccgggggcugagcu

SEQ ID NO: 165136 - RNA, 22 nt, Human
ggccugucucacccccgggugc

SEQ ID NO: 165137 - RNA, 22 nt, Human
uggaggcaucagagugcuuggc

SEQ ID NO: 165138 - RNA, 18 nt, Human
cagauccaggcagcuauu

SEQ ID NO: 165139 - RNA, 22 nt, Human
acucagaguuugcguuccauac

SEQ ID NO: 165140 - RNA, 22 nt, Human
cucacagguaccagcacccucc

SEQ ID NO: 165141 - RNA, 22 nt, Human
ugagagugguucagcucagaag

SEQ ID NO: 165142 - RNA, 22 nt, Human
uggccucugggaaagcagauuc

SEQ ID NO: 165143 - RNA, 22 nt, Human
gcagugguggagcuuacauauc

SEQ ID NO: 165144 - RNA, 19 nt, Human
ggcugggucuggcagguuc

SEQ ID NO: 165145 - RNA, 22 nt, Human
ucacugcaaccucugccuuccg

SEQ ID NO: 165146 - RNA, 22 nt, Human
aggagagagcugagcuuugcug

SEQ ID NO: 165147 - RNA, 23 nt, Human
aucaaacuggugagaaugucagu

SEQ ID NO: 165148 - RNA, 22 nt, Human
uccaggcuagguuuacaggaca

SEQ ID NO: 165149 - RNA, 22 nt, Human
gggcuggcaucaguugccgaga

SEQ ID NO: 165150 - RNA, 22 nt, Human
gggcaugguggcaggcaccugu

SEQ ID NO: 165151 - RNA, 22 nt, Human
uugcauugaugucuauacgcug

SEQ ID NO: 165152 - RNA, 22 nt, Human
ggcuagaauaauugacuucauu

SEQ ID NO: 165153 - RNA, 22 nt, Human
gagaggcuaugagguucugugu

SEQ ID NO: 165154 - RNA, 22 nt, Human
aucuggcuuaccuagggugccu

SEQ ID NO: 165155 - RNA, 18 nt, Human
acaaaggucugcaagacc

SEQ ID NO: 165156 - RNA, 22 nt, Human
ccuggaaguuggagguugcagu

SEQ ID NO: 165157 - RNA, 22 nt, Human
ggcuugcuucuuguccaggaau

SEQ ID NO: 165158 - RNA, 22 nt, Human
cuggcagguccagcuggacuca

SEQ ID NO: 165159 - RNA, 22 nt, Human
uagcugccuagacagcuauagc

SEQ ID NO: 165160 - RNA, 22 nt, Human
guccuggggaauacagaagccg

SEQ ID NO: 165161 - RNA, 22 nt, Human
cucuggccgcagcucagcucug

SEQ ID NO: 165162 - RNA, 22 nt, Human
ccugagggaggguauaggcugu

SEQ ID NO: 165163 - RNA, 22 nt, Human
gucccagagagcacuaguccau

SEQ ID NO: 165164 - RNA, 22 nt, Human
gccuucugaucgcuggacugac

SEQ ID NO: 165165 - RNA, 22 nt, Human
auggaagguccuacagagcgca

SEQ ID NO: 165166 - RNA, 22 nt, Human
uggcugggggugcuauagcugc

SEQ ID NO: 165167 - RNA, 22 nt, Human
gaggccugggagccuguccucc

SEQ ID NO: 165168 - RNA, 18 nt, Human
cagucccaaaccuuagga

SEQ ID NO: 165169 - RNA, 22 nt, Human
ugcagcugcuugauucaucuug

SEQ ID NO: 165170 - RNA, 22 nt, Human
ucuuggagacucuuguauauuu

SEQ ID NO: 165171 - RNA, 22 nt, Human
uugauaaaaugauaucuucuuu

SEQ ID NO: 165172 - RNA, 19 nt, Human
cugcucaggucagucuguc

SEQ ID NO: 165173 - RNA, 22 nt, Human
cuggguggcuguccagccagcc

SEQ ID NO: 165174 - RNA, 22 nt, Human
ccugucugagccagggugggca

SEQ ID NO: 165175 - RNA, 20 nt, Human
cagcucugggaaagaggcca

SEQ ID NO: 165176 - RNA, 22 nt, Human
gaguaagagcuggcuuuggugu

SEQ ID NO: 165177 - RNA, 22 nt, Human
caggagugaguuggggucuaca

SEQ ID NO: 165178 - RNA, 22 nt, Human
aaugaugguauugaugagcuaa

SEQ ID NO: 165179 - RNA, 22 nt, Human
cauuacauuucaaaauguuucc

SEQ ID NO: 165180 - RNA, 22 nt, Human
ccuggagggcgccgcacagucc

SEQ ID NO: 165181 - RNA, 22 nt, Human
agaaaaaucuuggcgcuugucu

SEQ ID NO: 165182 - RNA, 22 nt, Human
gcagauggcucagacacugggg

SEQ ID NO: 165183 - RNA, 22 nt, Human
uuagauaauguuauuguaauuu

SEQ ID NO: 165184 - RNA, 22 nt, Human
ccugccugcuuucugcuuugca

SEQ ID NO: 165185 - RNA, 22 nt, Human
ucauuuccucaaauucaagguu

SEQ ID NO: 165186 - RNA, 22 nt, Human
aaggccauuauucugauauauu

SEQ ID NO: 165187 - RNA, 22 nt, Human
uggcagagucugggcuugggca

SEQ ID NO: 165188 - RNA, 22 nt, Human
caagaugaaacuacagggagga

SEQ ID NO: 165189 - RNA, 22 nt, Human
ggucccaggaaucuguguucua

SEQ ID NO: 165190 - RNA, 22 nt, Human
ucaucuucuauuaauagggaga

SEQ ID NO: 165191 - RNA, 22 nt, Human
gcagggaggaagagaugcuucc

SEQ ID NO: 165192 - RNA, 22 nt, Human
ccuccaggaacuugagagacac

SEQ ID NO: 165193 - RNA, 22 nt, Human
acaguguccuuguggucccugu

SEQ ID NO: 165194 - RNA, 17 nt, Human
aggcagcucagaacauc

SEQ ID NO: 165195 - RNA, 22 nt, Human
ugaugauguuuaucuugguauu

SEQ ID NO: 165196 - RNA, 22 nt, Human
ucuuagaaugucaacugauguu

SEQ ID NO: 165197 - RNA, 22 nt, Human
cugugcuuccaggauggcagcu

SEQ ID NO: 165198 - RNA, 22 nt, Human
cugaagaggacgcagcagcaag

SEQ ID NO: 165199 - RNA, 22 nt, Human
aggccugagccccagguuuguu

SEQ ID NO: 165200 - RNA, 20 nt, Human
aauaaaagaagccuucaccc

SEQ ID NO: 165201 - RNA, 21 nt, Human
uguaugcacgcacaugcacac

SEQ ID NO: 165202 - RNA, 22 nt, Human
gacagagugcagggcuagaaga

SEQ ID NO: 165203 - RNA, 22 nt, Human
uccugagauguggagcuccaug

SEQ ID NO: 165204 - RNA, 22 nt, Human
agcugcuaugacaacaccagcc

SEQ ID NO: 165205 - RNA, 19 nt, Human
aggcagaggcuuggcuagc

SEQ ID NO: 165206 - RNA, 22 nt, Human
cugcugagguccuugcucagac

SEQ ID NO: 165207 - RNA, 22 nt, Human
gagauuggauuuaauggccaaa

SEQ ID NO: 165208 - RNA, 22 nt, Human
uagagcuggaaaacugcaggua

SEQ ID NO: 165209 - RNA, 22 nt, Human
ugccugaguuuaacccucagag

SEQ ID NO: 165210 - RNA, 22 nt, Human
cagaggccauauuucuucacuc

SEQ ID NO: 165211 - RNA, 22 nt, Human
auuuccauacacccauuucuga

SEQ ID NO: 165212 - RNA, 22 nt, Human
accucugcuucccggguucaag

SEQ ID NO: 165213 - RNA, 21 nt, Human
aauaaaacaguuggugucaau

SEQ ID NO: 165214 - RNA, 22 nt, Human
caguacuuggucaaggaagcag

SEQ ID NO: 165215 - RNA, 22 nt, Human
ugcugccaccugguggcugaag

SEQ ID NO: 165216 - RNA, 22 nt, Human
uggcacuggaaucguagccuug

SEQ ID NO: 165217 - RNA, 22 nt, Human
aauuucaaugcacucaugguug

SEQ ID NO: 165218 - RNA, 22 nt, Human
ucagaacagaagaaggaacacg

SEQ ID NO: 165219 - RNA, 22 nt, Human
ccuaugccugucacucugcgcu

SEQ ID NO: 165220 - RNA, 18 nt, Human
agcugcagaccaggaggu

SEQ ID NO: 165221 - RNA, 22 nt, Human
gacuuucucuccucccaggugu

SEQ ID NO: 165222 - RNA, 22 nt, Human
aggcuccuaucgcuuucagcaa

SEQ ID NO: 165223 - RNA, 22 nt, Human
gaggccugguagccgagcccca

SEQ ID NO: 165224 - RNA, 22 nt, Human
ugguuuauuucucugaaagguu

SEQ ID NO: 165225 - RNA, 23 nt, Human
ucugcucugaaguucggcugagc

SEQ ID NO: 165226 - RNA, 22 nt, Human
gacaggaggcagagcucaggug

SEQ ID NO: 165227 - RNA, 18 nt, Human
auuuugaacaaugcugua

SEQ ID NO: 165228 - RNA, 22 nt, Human
acagagguguuccagaccuagg

SEQ ID NO: 165229 - RNA, 22 nt, Human
uaggagcuaaaauauuuuauau

SEQ ID NO: 165230 - RNA, 22 nt, Human
gcacugaacuuuaaucauuucu

SEQ ID NO: 165231 - RNA, 20 nt, Human
acccagcucugugcccuggg

SEQ ID NO: 165232 - RNA, 22 nt, Human
agggggugcuacuuccagaguu

SEQ ID NO: 165233 - RNA, 22 nt, Human
cagaaguaagauuacugugaga

SEQ ID NO: 165234 - RNA, 22 nt, Human
ugcauuauuugcaugugccugu

SEQ ID NO: 165235 - RNA, 19 nt, Human
ccuuugaaucaggacacuu

SEQ ID NO: 165236 - RNA, 22 nt, Human
cucucaggcuugggucguggca

SEQ ID NO: 165237 - RNA, 17 nt, Human
aggcugcugggccaggg

SEQ ID NO: 165238 - RNA, 22 nt, Human
gcaaagucucaagacccaagug

SEQ ID NO: 165239 - RNA, 22 nt, Human
uaacacugauuuguucucaggg

SEQ ID NO: 165240 - RNA, 22 nt, Human
aucuuccuucacuuucucccac

SEQ ID NO: 165241 - RNA, 20 nt, Human
uaagaacaagacuaggaagc

SEQ ID NO: 165242 - RNA, 22 nt, Human
cagugcauaaucuaaauggggg

SEQ ID NO: 165243 - RNA, 22 nt, Human
uugcacuccagcccgagcaaca

SEQ ID NO: 165244 - RNA, 20 nt, Human
cagucccaauccagggccag

SEQ ID NO: 165245 - RNA, 22 nt, Human
ggcucagguuuccuucccagcu

SEQ ID NO: 165246 - RNA, 22 nt, Human
caguagcacucugucagugaag

SEQ ID NO: 165247 - RNA, 22 nt, Human
ggagcagagcugggcuuggcug

SEQ ID NO: 165248 - RNA, 22 nt, Human
aggggugaaggcccgauaggag

SEQ ID NO: 165249 - RNA, 22 nt, Human
acugucuuccaggucuggaggu

SEQ ID NO: 165250 - RNA, 22 nt, Human
cuggccaacuugcuuguuggca

SEQ ID NO: 165251 - RNA, 22 nt, Human
gagaaagacguaggcugggagg

SEQ ID NO: 165252 - RNA, 22 nt, Human
ugaaaucuucacuaagucucuu

SEQ ID NO: 165253 - RNA, 22 nt, Human
ucugguuagccaauaaugccaa

SEQ ID NO: 165254 - RNA, 22 nt, Human
cuggacuuuggcccaucugcca

SEQ ID NO: 165255 - RNA, 22 nt, Human
aaguucaagagugacauauuag

SEQ ID NO: 165256 - RNA, 17 nt, Human
cugcuuugugcaacgcu

SEQ ID NO: 165257 - RNA, 22 nt, Human
gcucugagucucagcuaccaca

SEQ ID NO: 165258 - RNA, 22 nt, Human
caggccuggguucaaaucccuu

SEQ ID NO: 165259 - RNA, 22 nt, Human
cuaauacucauuucuguaacuc

SEQ ID NO: 165260 - RNA, 22 nt, Human
agagcuguggauaguccuggau

SEQ ID NO: 165261 - RNA, 22 nt, Human
cacaugcauaaggauaauuacu

SEQ ID NO: 165262 - RNA, 22 nt, Human
ucacagaaauaagauaguuauu

SEQ ID NO: 165263 - RNA, 22 nt, Human
ggucccaggauugguugcgcag

SEQ ID NO: 165264 - RNA, 18 nt, Human
gaggccugagaaccaggu

SEQ ID NO: 165265 - RNA, 22 nt, Human
ugccuuggugcuucuucaugug

SEQ ID NO: 165266 - RNA, 22 nt, Human
cauguacacucauguaacuaua

SEQ ID NO: 165267 - RNA, 23 nt, Human
gcugucaguuguuuuugucucua

SEQ ID NO: 165268 - RNA, 22 nt, Human
ucaccugggagggcugugguag

SEQ ID NO: 165269 - RNA, 22 nt, Human
aggagguggccugagcgugccc

SEQ ID NO: 165270 - RNA, 22 nt, Human
uggcacugagcagccgcggcag

SEQ ID NO: 165271 - RNA, 22 nt, Human
aaacugaauucccaagggcaug

SEQ ID NO: 165272 - RNA, 22 nt, Human
agguacagggugaaaguuuaug

SEQ ID NO: 165273 - RNA, 22 nt, Human
cuggccuuuagccccagugucu

SEQ ID NO: 165274 - RNA, 22 nt, Human
aauaaauguuaagauugucuca

SEQ ID NO: 165275 - RNA, 22 nt, Human
cacauuucugugagucaauauu

SEQ ID NO: 165276 - RNA, 22 nt, Human
caguggcugugaccagggaccu

SEQ ID NO: 165277 - RNA, 22 nt, Human
gggcugcuuauacugaugauaa

SEQ ID NO: 165278 - RNA, 22 nt, Human
agcagccaaaugaagauuuuac

SEQ ID NO: 165279 - RNA, 18 nt, Human
cagaaaucacaccagcac

SEQ ID NO: 165280 - RNA, 22 nt, Human
cuacauuuuaauaagcugcuua

SEQ ID NO: 165281 - RNA, 22 nt, Human
ggugcugguucaggguggcugu

SEQ ID NO: 165282 - RNA, 22 nt, Human
agggccugggauguccuccuag

SEQ ID NO: 165283 - RNA, 22 nt, Human
aagcucugcucagcagacuagg

SEQ ID NO: 165284 - RNA, 22 nt, Human
gggcuucucccuaaggacucug

SEQ ID NO: 165285 - RNA, 19 nt, Human
cccuggcaggcaagccugg

SEQ ID NO: 165286 - RNA, 22 nt, Human
gcacagaacagagaaauagcca

SEQ ID NO: 165287 - RNA, 19 nt, Human
uguguaaagucugugguca

SEQ ID NO: 165288 - RNA, 21 nt, Human
ucacaugcccauuacuggagc

SEQ ID NO: 165289 - RNA, 22 nt, Human
uacuuuaaaaacugauaauuca

SEQ ID NO: 165290 - RNA, 22 nt, Human
gagugugggcacgggggccuug

SEQ ID NO: 165291 - RNA, 22 nt, Human
auaugcauaugucaaaacuuau

SEQ ID NO: 165292 - RNA, 22 nt, Human
ugagccuguggggugacaacca

SEQ ID NO: 165293 - RNA, 22 nt, Human
ccuggcaguuuugcccaggauu

SEQ ID NO: 165294 - RNA, 22 nt, Human
agaaguaggcagggcuguauca

SEQ ID NO: 165295 - RNA, 22 nt, Human
auauucguggucaaguaaggcc

SEQ ID NO: 165296 - RNA, 23 nt, Human
uggugccucagaagcagugggcu

SEQ ID NO: 165297 - RNA, 22 nt, Human
cuggggacuugcagacacaauu

SEQ ID NO: 165298 - RNA, 20 nt, Human
aggaagccaaaggcugucuu

SEQ ID NO: 165299 - RNA, 22 nt, Human
auccuugaaugacucugcccuc

SEQ ID NO: 165300 - RNA, 18 nt, Human
gucuggaggucaggagcu

SEQ ID NO: 165301 - RNA, 22 nt, Human
agccuccacagaugcaaagggc

SEQ ID NO: 165302 - RNA, 22 nt, Human
agccccucuguggcucugccuc

SEQ ID NO: 165303 - RNA, 22 nt, Human
gcaccacaucaaugaggggagc

SEQ ID NO: 165304 - RNA, 19 nt, Human
acacugaauguagaauugg

SEQ ID NO: 165305 - RNA, 22 nt, Human
gguggcuggaggagcugaugga

SEQ ID NO: 165306 - RNA, 22 nt, Human
acagcagcuaaccccugggcca

SEQ ID NO: 165307 - RNA, 22 nt, Human
aucagcaagauguaauuucuau

SEQ ID NO: 165308 - RNA, 22 nt, Human
ugcuauaagaauuauauuacuc

SEQ ID NO: 165309 - RNA, 22 nt, Human
cugagcugaaacuugagaggcu

SEQ ID NO: 165310 - RNA, 22 nt, Human
cccagguggcagaagcugcagu

SEQ ID NO: 165311 - RNA, 22 nt, Human
agucucagaaaagaagcaugga

SEQ ID NO: 165312 - RNA, 22 nt, Human
ggcugcuugcuguuucuuggau

SEQ ID NO: 165313 - RNA, 22 nt, Human
uggcucaggaucuaagcagaau

SEQ ID NO: 165314 - RNA, 22 nt, Human
aauucauccaugaacaauucca

SEQ ID NO: 165315 - RNA, 22 nt, Human
gcaggugggggucggugcaucu

SEQ ID NO: 165316 - RNA, 22 nt, Human
gcagggugauagugaggcucag

SEQ ID NO: 165317 - RNA, 22 nt, Human
gauggggaugagaagugagcag

SEQ ID NO: 165318 - RNA, 22 nt, Human
uaucuacaggugucagguaaga

SEQ ID NO: 165319 - RNA, 22 nt, Human
ccuucugcuggucaucccagug

SEQ ID NO: 165320 - RNA, 22 nt, Human
gcacagaagagcuuuggaauga

SEQ ID NO: 165321 - RNA, 22 nt, Human
cagagcugguguuacaagucca

SEQ ID NO: 165322 - RNA, 22 nt, Human
gaacagaagaggcuggugccac

SEQ ID NO: 165323 - RNA, 22 nt, Human
cauuugaugacucaacucauaa

SEQ ID NO: 165324 - RNA, 22 nt, Human
cuuucagagguuacucaggaaa

SEQ ID NO: 165325 - RNA, 21 nt, Human
aagaagcaauuuauuggaagg

SEQ ID NO: 165326 - RNA, 22 nt, Human
uggccucuuacgacauagccuu

SEQ ID NO: 165327 - RNA, 22 nt, Human
accagcucagaagccagaaaga

SEQ ID NO: 165328 - RNA, 20 nt, Human
agggcagagggauuacaggc

SEQ ID NO: 165329 - RNA, 22 nt, Human
uaaggcacccgugagcugccag

SEQ ID NO: 165330 - RNA, 22 nt, Human
uugagggucuggaucugcugcu

SEQ ID NO: 165331 - RNA, 22 nt, Human
auuucacucucccugccacuua

SEQ ID NO: 165332 - RNA, 22 nt, Human
acagugucugacacauuguagc

SEQ ID NO: 165333 - RNA, 22 nt, Human
caagcagagacuagauagcugu

SEQ ID NO: 165334 - RNA, 22 nt, Human
auaguauuuaauaguuagcuca

SEQ ID NO: 165335 - RNA, 23 nt, Human
gcaggugguucgaacagaaguuu

SEQ ID NO: 165336 - RNA, 22 nt, Human
aggccuguuccaggccccuuuu

SEQ ID NO: 165337 - RNA, 22 nt, Human
ugcaguggugguaaagaugcuc

SEQ ID NO: 165338 - RNA, 22 nt, Human
ggcucugccugcccagcagcac

SEQ ID NO: 165339 - RNA, 18 nt, Human
uccagagguguuggagcc

SEQ ID NO: 165340 - RNA, 22 nt, Human
ugugaaaggggucacagggaaa

SEQ ID NO: 165341 - RNA, 22 nt, Human
agcagggcagugcuucagcucu

SEQ ID NO: 165342 - RNA, 20 nt, Human
uauaacaguguugggugugu

SEQ ID NO: 165343 - RNA, 19 nt, Human
caaggguugggucugucau

SEQ ID NO: 165344 - RNA, 22 nt, Human
cucagggggaaucaggucacag

SEQ ID NO: 165345 - RNA, 22 nt, Human
ugaaguccuagaacuccuggua

SEQ ID NO: 165346 - RNA, 22 nt, Human
aucuaagaguuaacaucaagaa

SEQ ID NO: 165347 - RNA, 22 nt, Human
aggcacuguacuagguacaggg

SEQ ID NO: 165348 - RNA, 22 nt, Human
uggcucaggccacuucuuuuau

SEQ ID NO: 165349 - RNA, 21 nt, Human
ggccucugucauccugggaag

SEQ ID NO: 165350 - RNA, 22 nt, Human
gcugcucucagagcucaugcug

SEQ ID NO: 165351 - RNA, 22 nt, Human
gucccaggcuuauguggagcuu

SEQ ID NO: 165352 - RNA, 22 nt, Human
ugucaugccaggaaauaguccc

SEQ ID NO: 165353 - RNA, 22 nt, Human
uauucacauucucaggccuggu

SEQ ID NO: 165354 - RNA, 22 nt, Human
caggguggcacucagcgcaucu

SEQ ID NO: 165355 - RNA, 22 nt, Human
aaaagacaucuauuucaggcag

SEQ ID NO: 165356 - RNA, 22 nt, Human
cuuccucaugugcaaugcaagc

SEQ ID NO: 165357 - RNA, 23 nt, Human
uggccucuccccaccuggcagaa

SEQ ID NO: 165358 - RNA, 22 nt, Human
gcaggggcugagcaccagcggg

SEQ ID NO: 165359 - RNA, 22 nt, Human
ccagcugguguuccuuaggacc

SEQ ID NO: 165360 - RNA, 18 nt, Human
gggcuguguucaugccca

SEQ ID NO: 165361 - RNA, 22 nt, Human
aaugcacaaaaauuguauguaa

SEQ ID NO: 165362 - RNA, 23 nt, Human
cuuuuaacuugaucugagaccag

SEQ ID NO: 165363 - RNA, 22 nt, Human
caggccugggcuucggggcuga

SEQ ID NO: 165364 - RNA, 22 nt, Human
uuucacaaugcaauccuacuuc

SEQ ID NO: 165365 - RNA, 22 nt, Human
cugcccuguuuggacagcccgg

SEQ ID NO: 165366 - RNA, 22 nt, Human
uggccucuggcugaggacuaac

SEQ ID NO: 165367 - RNA, 22 nt, Human
ggccuugggaggagggucagaa

SEQ ID NO: 165368 - RNA, 22 nt, Human
aggucauuguuaagucaccaua

SEQ ID NO: 165369 - RNA, 22 nt, Human
gagccuggauugucaccgacuu

SEQ ID NO: 165370 - RNA, 22 nt, Human
ucacauuuucauauucucugag

SEQ ID NO: 165371 - RNA, 20 nt, Human
ccucucugaagaggucaucu

SEQ ID NO: 165372 - RNA, 22 nt, Human
uagggcaggggaggaaucugaa

SEQ ID NO: 165373 - RNA, 22 nt, Human
auguucaaacuuuuuacacacc

SEQ ID NO: 165374 - RNA, 22 nt, Human
aagcacaaugaacaucuuagau

SEQ ID NO: 165375 - RNA, 22 nt, Human
cccaggcagucuggcucuaaag

SEQ ID NO: 165376 - RNA, 19 nt, Human
acaggcagaauugggugug

SEQ ID NO: 165377 - RNA, 22 nt, Human
ggacuggccggcgcugaggccc

SEQ ID NO: 165378 - RNA, 22 nt, Human
ucccagccuuccuuguggugaa

SEQ ID NO: 165379 - RNA, 22 nt, Human
cugguccuccuugccuucagau

SEQ ID NO: 165380 - RNA, 22 nt, Human
cagaagcaaaugccuugcugag

SEQ ID NO: 165381 - RNA, 22 nt, Human
ucuguccucuuugaagcugcuc

SEQ ID NO: 165382 - RNA, 22 nt, Human
cuugaaagauuuggccucugug

SEQ ID NO: 165383 - RNA, 22 nt, Human
agcaaagucaguggaaccaucc

SEQ ID NO: 165384 - RNA, 22 nt, Human
ugccugucuuaauaucuggaaa

SEQ ID NO: 165385 - RNA, 22 nt, Human
uugaccauaccuccaggcaguu

SEQ ID NO: 165386 - RNA, 22 nt, Human
gcuggcagggacagcugcgugu

SEQ ID NO: 165387 - RNA, 22 nt, Human
uauucacauguacauaugcuca

SEQ ID NO: 165388 - RNA, 22 nt, Human
aggcuggggaauugaauuugcu

SEQ ID NO: 165389 - RNA, 22 nt, Human
cuucccuuggugaacagagcau

SEQ ID NO: 165390 - RNA, 22 nt, Human
gaggcagcuuggggcugugggu

SEQ ID NO: 165391 - RNA, 22 nt, Human
uggcucaguuccaucaucugga

SEQ ID NO: 165392 - RNA, 22 nt, Human
gaagcagcucagauugacugaa

SEQ ID NO: 165393 - RNA, 22 nt, Human
cugggaggauacacaagaucag

SEQ ID NO: 165394 - RNA, 22 nt, Human
ccaccaggacagcccugagggg

SEQ ID NO: 165395 - RNA, 22 nt, Human
acaaauguggacauggauaaug

SEQ ID NO: 165396 - RNA, 22 nt, Human
gcccagagagaugcuguagacc

SEQ ID NO: 165397 - RNA, 22 nt, Human
cuggccugugggcugucuccgg

SEQ ID NO: 165398 - RNA, 22 nt, Human
ggcucuggcguccaauggagcg

SEQ ID NO: 165399 - RNA, 22 nt, Human
aggauccuccuuagaaaagacc

SEQ ID NO: 165400 - RNA, 22 nt, Human
gcucucuguuauuaagaucuuu

SEQ ID NO: 165401 - RNA, 22 nt, Human
cgaugguucuggcugcuuguau

SEQ ID NO: 165402 - RNA, 22 nt, Human
ucagcaguggcucucaugcagu

SEQ ID NO: 165403 - RNA, 22 nt, Human
ccugccugauuccaggauggcu

SEQ ID NO: 165404 - RNA, 22 nt, Human
cagcccagcagucuuagccugc

SEQ ID NO: 165405 - RNA, 22 nt, Human
ggguggcacaggugcagagggu

SEQ ID NO: 165406 - RNA, 22 nt, Human
cugggcugcaguuccugguccu

SEQ ID NO: 165407 - RNA, 22 nt, Human
cuuguagaauugaaauggucuc

SEQ ID NO: 165408 - RNA, 22 nt, Human
acaugauuggacuccuuccccu

SEQ ID NO: 165409 - RNA, 23 nt, Human
uaguuauuuucucuguaauuugc

SEQ ID NO: 165410 - RNA, 22 nt, Human
cugcucuguuaauuaaacuuug

SEQ ID NO: 165411 - RNA, 19 nt, Human
ugcagcucagggcaggggc

SEQ ID NO: 165412 - RNA, 22 nt, Human
ggucucaggagacuggagagca

SEQ ID NO: 165413 - RNA, 22 nt, Human
aguugcagacgcagagauguug

SEQ ID NO: 165414 - RNA, 22 nt, Human
agacagcaggggagucugguuu

SEQ ID NO: 165415 - RNA, 22 nt, Human
uauaacacucagaaagaaucau

SEQ ID NO: 165416 - RNA, 22 nt, Human
caggaggcaucauggagcggac

SEQ ID NO: 165417 - RNA, 22 nt, Human
aucuggcucuuccuggaguucc

SEQ ID NO: 165418 - RNA, 23 nt, Human
ucucaggacacacaugucuauca

SEQ ID NO: 165419 - RNA, 22 nt, Human
agggccagagucuguguagaua

SEQ ID NO: 165420 - RNA, 22 nt, Human
gcagugggagcuuaggcagugc

SEQ ID NO: 165421 - RNA, 22 nt, Human
uagcagcuuccagagagggcag

SEQ ID NO: 165422 - RNA, 20 nt, Human
gcccuggagccuuguccugg

SEQ ID NO: 165423 - RNA, 22 nt, Human
cacugaaggcuaggauuagaug

SEQ ID NO: 165424 - RNA, 22 nt, Human
aguguauugauuggaacagccu

SEQ ID NO: 165425 - RNA, 22 nt, Human
cuccagggcagcauggcagugg

SEQ ID NO: 165426 - RNA, 22 nt, Human
ugggggagauugugcaucucua

SEQ ID NO: 165427 - RNA, 22 nt, Human
uggaaagagguagaggaucugg

SEQ ID NO: 165428 - RNA, 22 nt, Human
uggccugggccggcagauauac

SEQ ID NO: 165429 - RNA, 22 nt, Human
gcagguggcagaggugggaucu

SEQ ID NO: 165430 - RNA, 22 nt, Human
ggaggaugccaagcugugcaca

SEQ ID NO: 165431 - RNA, 22 nt, Human
ccagcagagucuaggaaggagg

SEQ ID NO: 165432 - RNA, 22 nt, Human
gccuggagcucaugugggcauu

SEQ ID NO: 165433 - RNA, 22 nt, Human
auucauucugaccucaagagaa

SEQ ID NO: 165434 - RNA, 22 nt, Human
gguggggucacgacagagggaa

SEQ ID NO: 165435 - RNA, 23 nt, Human
acugagccagggccugggucagc

SEQ ID NO: 165436 - RNA, 22 nt, Human
ucuggauggucagcucuuccug

SEQ ID NO: 165437 - RNA, 22 nt, Human
ugggcagaucuuugguggcuag

SEQ ID NO: 165438 - RNA, 23 nt, Human
acagagaucuugacuuguaugga

SEQ ID NO: 165439 - RNA, 22 nt, Human
cuuauaguaugauguugagaau

SEQ ID NO: 165440 - RNA, 22 nt, Human
agggcagagaucugagugggca

SEQ ID NO: 165441 - RNA, 22 nt, Human
gagccaggucgggccgcggcga

SEQ ID NO: 165442 - RNA, 22 nt, Human
cacagaaaaaggcuugaaaauc

SEQ ID NO: 165443 - RNA, 22 nt, Human
ugugccuuaugaauucuuucug

SEQ ID NO: 165444 - RNA, 22 nt, Human
cagucccaugagcccagaacau

SEQ ID NO: 165445 - RNA, 22 nt, Human
augggaugaacuugaucugcuu

SEQ ID NO: 165446 - RNA, 22 nt, Human
aggucaccauggcaugcuccac

SEQ ID NO: 165447 - RNA, 22 nt, Human
ccugcagguaaggcuaacugcc

SEQ ID NO: 165448 - RNA, 23 nt, Human
agaggcaggaguggcuugcccgg

SEQ ID NO: 165449 - RNA, 22 nt, Human
cuuccugcauugugccagaguu

SEQ ID NO: 165450 - RNA, 22 nt, Human
ccuggcagcuaagugcuuugag

SEQ ID NO: 165451 - RNA, 22 nt, Human
gacagaagaggaacuuggacag

SEQ ID NO: 165452 - RNA, 22 nt, Human
aaagagcuaacauugccgagau

SEQ ID NO: 165453 - RNA, 22 nt, Human
gcucccagauuucagccuugug

SEQ ID NO: 165454 - RNA, 22 nt, Human
gggccuggggugacguaccccu

SEQ ID NO: 165455 - RNA, 22 nt, Human
ggaggagacccugugucaguuu

SEQ ID NO: 165456 - RNA, 22 nt, Human
aucaguuuuguucacuacuaua

SEQ ID NO: 165457 - RNA, 22 nt, Human
cagcugaacauguagagcaucu

SEQ ID NO: 165458 - RNA, 22 nt, Human
ccuccaaguuugacucaggaca

SEQ ID NO: 165459 - RNA, 20 nt, Human
agccugccagcuggcccaga

SEQ ID NO: 165460 - RNA, 22 nt, Human
agccuccaucccaugcacaaag

SEQ ID NO: 165461 - RNA, 22 nt, Human
uuccugaugcacacagucauuu

SEQ ID NO: 165462 - RNA, 22 nt, Human
cccaaggcugcagugagcauga

SEQ ID NO: 165463 - RNA, 22 nt, Human
ucaaacuguuuacagugagaua

SEQ ID NO: 165464 - RNA, 22 nt, Human
gagcagcugagcuggaaugaga

SEQ ID NO: 165465 - RNA, 22 nt, Human
caaaauguucuggcaccuuuaa

SEQ ID NO: 165466 - RNA, 22 nt, Human
gugcucuccuggcugcccugac

SEQ ID NO: 165467 - RNA, 19 nt, Human
ugacaggcuguugccuuga

SEQ ID NO: 165468 - RNA, 22 nt, Human
ucagccagguaauguggagaug

SEQ ID NO: 165469 - RNA, 22 nt, Human
aacaaaugauaccaguucucaa

SEQ ID NO: 165470 - RNA, 22 nt, Human
uguguguauaugcauuuaucua

SEQ ID NO: 165471 - RNA, 22 nt, Human
augcuguagaucuuagccucua

SEQ ID NO: 165472 - RNA, 21 nt, Human
uaucuacuggugucuuucaga

SEQ ID NO: 165473 - RNA, 22 nt, Human
uuucacaucagagguagauuag

SEQ ID NO: 165474 - RNA, 22 nt, Human
cacaggcuuccaguccccagcu

SEQ ID NO: 165475 - RNA, 20 nt, Human
agaagcugauacugauggaa

SEQ ID NO: 165476 - RNA, 20 nt, Human
uccagccacuuccgcugguc

SEQ ID NO: 165477 - RNA, 22 nt, Human
cuggcaggcggcagagcccagg

SEQ ID NO: 165478 - RNA, 22 nt, Human
ggcuucccuuuccgagaggaga

SEQ ID NO: 165479 - RNA, 22 nt, Human
gcauuuauuucuuuacugcauc

SEQ ID NO: 165480 - RNA, 22 nt, Human
ugggccuccaauuccagcggga

SEQ ID NO: 165481 - RNA, 22 nt, Human
agacagagauacuauguuguca

SEQ ID NO: 165482 - RNA, 22 nt, Human
agggaaggaaaagcugucgcuu

SEQ ID NO: 165483 - RNA, 21 nt, Human
cagaaguaaggguaacuucuc

SEQ ID NO: 165484 - RNA, 22 nt, Human
uuuccuaugauauucuaugugu

SEQ ID NO: 165485 - RNA, 22 nt, Human
ugcauuguugaauauuucauag

SEQ ID NO: 165486 - RNA, 22 nt, Human
ugaagcaggcauugacugauga

SEQ ID NO: 165487 - RNA, 22 nt, Human
ucugaagaacugaguaaacaug

SEQ ID NO: 165488 - RNA, 22 nt, Human
uuugcauugcauacaaggaacu

SEQ ID NO: 165489 - RNA, 22 nt, Human
uggagcugagagccaggcuggc

SEQ ID NO: 165490 - RNA, 22 nt, Human
agccacagagagggagcugcaa

SEQ ID NO: 165491 - RNA, 22 nt, Human
uccagggaccucccugagagcu

SEQ ID NO: 165492 - RNA, 22 nt, Human
ccugggaggcagagguugcagu

SEQ ID NO: 165493 - RNA, 22 nt, Human
cacacaggaugaagcagcagaa

SEQ ID NO: 165494 - RNA, 22 nt, Human
gccuggccugaacuaggaggug

SEQ ID NO: 165495 - RNA, 22 nt, Human
gccucuggucccucaugcugug

SEQ ID NO: 165496 - RNA, 22 nt, Human
agaagccauugaagcagaccuc

SEQ ID NO: 165497 - RNA, 22 nt, Human
gagacugcauuguccaaggguu

SEQ ID NO: 165498 - RNA, 22 nt, Human
ccagggcauccucacaucgcag

SEQ ID NO: 165499 - RNA, 22 nt, Human
ccuguggcacaugcagggauuc

SEQ ID NO: 165500 - RNA, 22 nt, Human
uaguaucuuucuauauuuccca

SEQ ID NO: 165501 - RNA, 22 nt, Human
gaauuguacgcuuuacauaggu

SEQ ID NO: 165502 - RNA, 22 nt, Human
gcugccaugguccaggcuccag

SEQ ID NO: 165503 - RNA, 22 nt, Human
uuccucagaaaauacuguccaa

SEQ ID NO: 165504 - RNA, 22 nt, Human
ugaagcaggaucguuugcuuca

SEQ ID NO: 165505 - RNA, 22 nt, Human
ccagcugcgggcaucgagaguu

SEQ ID NO: 165506 - RNA, 22 nt, Human
acuuagaacaggcagaauucca

SEQ ID NO: 165507 - RNA, 22 nt, Human
uuccaggggcagcagugauggu

SEQ ID NO: 165508 - RNA, 22 nt, Human
gucuggaguggggccugagaau

SEQ ID NO: 165509 - RNA, 22 nt, Human
cccaucaggaacccaggagccc

SEQ ID NO: 165510 - RNA, 22 nt, Human
cccagcacuuugaauaugucac

SEQ ID NO: 165511 - RNA, 22 nt, Human
caaaggagguaaugggugugag

SEQ ID NO: 165512 - RNA, 22 nt, Human
cugcuggagguuggagcaugca

SEQ ID NO: 165513 - RNA, 22 nt, Human
ggcugccugugcccaggcacac

SEQ ID NO: 165514 - RNA, 22 nt, Human
uggccugguaccacauagauuu

SEQ ID NO: 165515 - RNA, 22 nt, Human
auugacaauguauuuguaucug

SEQ ID NO: 165516 - RNA, 22 nt, Human
gagcacagaaucuucccaugca

SEQ ID NO: 165517 - RNA, 20 nt, Human
ugcagggcucugcuucucuc

SEQ ID NO: 165518 - RNA, 22 nt, Human
uggccugcagaggcuguggggc

SEQ ID NO: 165519 - RNA, 22 nt, Human
ggcugccucugaugugcagacg

SEQ ID NO: 165520 - RNA, 22 nt, Human
agauaauuugaguaaauuaauu

SEQ ID NO: 165521 - RNA, 23 nt, Human
cccagcagagaugaggagggguc

SEQ ID NO: 165522 - RNA, 22 nt, Human
ucacaggguuuggaagccuccu

SEQ ID NO: 165523 - RNA, 22 nt, Human
uugacaagaaucguugccuugg

SEQ ID NO: 165524 - RNA, 22 nt, Human
uguuuaaucuauaaaauggaga

SEQ ID NO: 165525 - RNA, 22 nt, Human
ucagcugaguucuagagcacuc

SEQ ID NO: 165526 - RNA, 23 nt, Human
ugcuucucugcuugacaguucug

SEQ ID NO: 165527 - RNA, 22 nt, Human
ugacagggugauuaugagagcu

SEQ ID NO: 165528 - RNA, 22 nt, Human
caggcacuucugcugcuugucu

SEQ ID NO: 165529 - RNA, 22 nt, Human
agccucucuuuauucccagcua

SEQ ID NO: 165530 - RNA, 22 nt, Human
ugaagguggcauaggagagaug

SEQ ID NO: 165531 - RNA, 23 nt, Human
ugauuuccagugagucaguggga

SEQ ID NO: 165532 - RNA, 22 nt, Human
guccagggaaauagcgacaggg

SEQ ID NO: 165533 - RNA, 20 nt, Human
gagagcuggggaugaggcug

SEQ ID NO: 165534 - RNA, 22 nt, Human
ggcugaaguguaguggcucacu

SEQ ID NO: 165535 - RNA, 21 nt, Human
ugcugccaucaugcagagaug

SEQ ID NO: 165536 - RNA, 22 nt, Human
gccagggcucgcggucccucgu

SEQ ID NO: 165537 - RNA, 22 nt, Human
ugaaaaggguagaucccuaagu

SEQ ID NO: 165538 - RNA, 22 nt, Human
ccugggcaacauagugagaccc

SEQ ID NO: 165539 - RNA, 22 nt, Human
auguaagguucagaguauguga

SEQ ID NO: 165540 - RNA, 22 nt, Human
caaggccugccucuggcagaaa

SEQ ID NO: 165541 - RNA, 22 nt, Human
augucuuucucacagccaguuc

SEQ ID NO: 165542 - RNA, 21 nt, Human
uggagcugccacuuguccucc

SEQ ID NO: 165543 - RNA, 22 nt, Human
aggcucagcaucugauucauau

SEQ ID NO: 165544 - RNA, 22 nt, Human
ucaguuuuuaagaguuaugcga

SEQ ID NO: 165545 - RNA, 22 nt, Human
ccucugcagcagagagccagag

SEQ ID NO: 165546 - RNA, 22 nt, Human
gccucugcggggcccgagcccg

SEQ ID NO: 165547 - RNA, 22 nt, Human
ggcaccugcucaucuggacuca

SEQ ID NO: 165548 - RNA, 22 nt, Human
uccucugcuccaggcuggacuu

SEQ ID NO: 165549 - RNA, 22 nt, Human
cuucugggcauucagcugcaca

SEQ ID NO: 165550 - RNA, 22 nt, Human
uagaaguuaaaggaauacagaa

SEQ ID NO: 165551 - RNA, 22 nt, Human
uccagcagggaauuaguagucu

SEQ ID NO: 165552 - RNA, 21 nt, Human
ccuccaggagcagagcccuga

SEQ ID NO: 165553 - RNA, 22 nt, Human
gaaaaugugucaucccuacugu

SEQ ID NO: 165554 - RNA, 22 nt, Human
aucuggcuuuuaccccacggcc

SEQ ID NO: 165555 - RNA, 22 nt, Human
gcagccuguuguaccagccugu

SEQ ID NO: 165556 - RNA, 22 nt, Human
gcuggccauauauuuugcuguu

SEQ ID NO: 165557 - RNA, 22 nt, Human
cugggaggcccacguugggaag

SEQ ID NO: 165558 - RNA, 22 nt, Human
ggggcagagcauagcuccaauu

SEQ ID NO: 165559 - RNA, 22 nt, Human
cugggccagucucggccgcucu

SEQ ID NO: 165560 - RNA, 21 nt, Human
agcugggccucagccugcagu

SEQ ID NO: 165561 - RNA, 22 nt, Human
cccagaaggucgaggcugcagu

SEQ ID NO: 165562 - RNA, 22 nt, Human
cccaggaggucgaagcugcagu

SEQ ID NO: 165563 - RNA, 22 nt, Human
ugcauuguaggauguuuagcag

SEQ ID NO: 165564 - RNA, 22 nt, Human
cuggccacaacuagcccaggac

SEQ ID NO: 165565 - RNA, 22 nt, Human
cugcagaguggagccucggcug

SEQ ID NO: 165566 - RNA, 22 nt, Human
aucaaaguggaaguuuacuagg

SEQ ID NO: 165567 - RNA, 22 nt, Human
agaggcugggaaggguccccgg

SEQ ID NO: 165568 - RNA, 22 nt, Human
aguguuccacacaucuggggaa

SEQ ID NO: 165569 - RNA, 22 nt, Human
cccaggagguggagcuugcagu

SEQ ID NO: 165570 - RNA, 22 nt, Human
aucuggcuugacuuugcgacuu

SEQ ID NO: 165571 - RNA, 22 nt, Human
agaacuuaggaacaacagcuua

SEQ ID NO: 165572 - RNA, 22 nt, Human
ugccaggagagugcaugcaggg

SEQ ID NO: 165573 - RNA, 22 nt, Human
uaaggcauucucaugcugugaa

SEQ ID NO: 165574 - RNA, 22 nt, Human
ugagcccuaagggucaagcagg

SEQ ID NO: 165575 - RNA, 22 nt, Human
aguuauucauuuauucuguaca

SEQ ID NO: 165576 - RNA, 22 nt, Human
ucugucacccaggcuggagugc

SEQ ID NO: 165577 - RNA, 22 nt, Human
ggguccagcuacaucagggugg

SEQ ID NO: 165578 - RNA, 22 nt, Human
gacagggcgagacucagucuca

SEQ ID NO: 165579 - RNA, 22 nt, Human
aauccagguggcggagguugug

SEQ ID NO: 165580 - RNA, 22 nt, Human
agcuggccuucggugucacugg

SEQ ID NO: 165581 - RNA, 17 nt, Human
uuccucucacauuuuuu

SEQ ID NO: 165582 - RNA, 22 nt, Human
acaggcucucagccaguuggca

SEQ ID NO: 165583 - RNA, 22 nt, Human
ggagagcaggguccugagauac

SEQ ID NO: 165584 - RNA, 22 nt, Human
auaagguaugaaaaguaaaugg

SEQ ID NO: 165585 - RNA, 22 nt, Human
ucugagaggcagaccuuccuaa

SEQ ID NO: 165586 - RNA, 22 nt, Human
cacauguaguaagcaggcaaug

SEQ ID NO: 165587 - RNA, 22 nt, Human
cugccagcucucuggaggcucu

SEQ ID NO: 165588 - RNA, 22 nt, Human
aggggcugcuggguccgccccu

SEQ ID NO: 165589 - RNA, 19 nt, Human
agaggccucagcagcuggc

SEQ ID NO: 165590 - RNA, 22 nt, Human
gggagccaaggagagaggccuu

SEQ ID NO: 165591 - RNA, 22 nt, Human
aggcaagggggcgccaccuucc

SEQ ID NO: 165592 - RNA, 22 nt, Human
gguucacacuaagcuuaagugg

SEQ ID NO: 165593 - RNA, 22 nt, Human
acauuucuauagugcaucuguu

SEQ ID NO: 165594 - RNA, 22 nt, Human
aaugucugagucucuguauccc

SEQ ID NO: 165595 - RNA, 22 nt, Human
ccacugggcguuucuguccaau

SEQ ID NO: 165596 - RNA, 22 nt, Human
aaagaugucauacacauuaaga

SEQ ID NO: 165597 - RNA, 22 nt, Human
gugaaaucugaggcccaugaug

SEQ ID NO: 165598 - RNA, 22 nt, Human
aagccagguguuuaggccagcg

SEQ ID NO: 165599 - RNA, 17 nt, Human
ggugaguguccaggugg

SEQ ID NO: 165600 - RNA, 22 nt, Human
gccacugcacuccagcccaggc

SEQ ID NO: 165601 - RNA, 20 nt, Human
gugcauuucaccuguacugu

SEQ ID NO: 165602 - RNA, 22 nt, Human
uaugcacaguuacaagaauauc

SEQ ID NO: 165603 - RNA, 22 nt, Human
uccucagaugcucuuggacgcc

SEQ ID NO: 165604 - RNA, 22 nt, Human
ggcagcuguaagaugagugaau

SEQ ID NO: 165605 - RNA, 22 nt, Human
agcugccacagagccuggccag

SEQ ID NO: 165606 - RNA, 22 nt, Human
gcagggcagcuuagucccuguc

SEQ ID NO: 165607 - RNA, 22 nt, Human
agccuucagcaguucaggugcc

SEQ ID NO: 165608 - RNA, 22 nt, Human
acagcaggauuuggcgauguug

SEQ ID NO: 165609 - RNA, 22 nt, Human
gaagcagcugccagagaugucu

SEQ ID NO: 165610 - RNA, 22 nt, Human
uugggcuggcagagguggucuu

SEQ ID NO: 165611 - RNA, 22 nt, Human
gaaugcacucacccaucacuca

SEQ ID NO: 165612 - RNA, 22 nt, Human
auggggugagacuaggauuaaa

SEQ ID NO: 165613 - RNA, 22 nt, Human
ccagggcagggaccacgugucu

SEQ ID NO: 165614 - RNA, 22 nt, Human
gcaggcuccaggccggccccuu

SEQ ID NO: 165615 - RNA, 22 nt, Human
gcuggggucugugaggagggcu

SEQ ID NO: 165616 - RNA, 22 nt, Human
auuuauguaucuguguagauca

SEQ ID NO: 165617 - RNA, 22 nt, Human
agggccugggguagcuuacugc

SEQ ID NO: 165618 - RNA, 22 nt, Human
cagcugccccgcuggcugacca

SEQ ID NO: 165619 - RNA, 22 nt, Human
aaagauuucagaagccugugcc

SEQ ID NO: 165620 - RNA, 22 nt, Human
uggcagugccccuugaccagug

SEQ ID NO: 165621 - RNA, 22 nt, Human
gcacagccacugagugagaacc

SEQ ID NO: 165622 - RNA, 19 nt, Human
auacacauacguaaacuga

SEQ ID NO: 165623 - RNA, 21 nt, Human
aggugccaaggagaagcaggc

SEQ ID NO: 165624 - RNA, 22 nt, Human
ucccuggcagcuaagggugguc

SEQ ID NO: 165625 - RNA, 22 nt, Human
ggaggccaaagugugggcggcu

SEQ ID NO: 165626 - RNA, 22 nt, Human
gggcucagccccauugaaccag

SEQ ID NO: 165627 - RNA, 21 nt, Human
gcacagggacagaucaucaca

SEQ ID NO: 165628 - RNA, 22 nt, Human
cacugaaggaaggacuacugca

SEQ ID NO: 165629 - RNA, 22 nt, Human
uccugggcugcagggaagagca

SEQ ID NO: 165630 - RNA, 22 nt, Human
ugugccuucucaguccugcuca

SEQ ID NO: 165631 - RNA, 22 nt, Human
gaggccuggguuggaggugcau

SEQ ID NO: 165632 - RNA, 22 nt, Human
cuccuguauguugggcuucaca

SEQ ID NO: 165633 - RNA, 20 nt, Human
ugucagugccugaggcacag

SEQ ID NO: 165634 - RNA, 22 nt, Human
ucauugucuugauaugauuguc

SEQ ID NO: 165635 - RNA, 22 nt, Human
gugccagcucuccccacaucug

SEQ ID NO: 165636 - RNA, 22 nt, Human
acccugagucagacagccugac

SEQ ID NO: 165637 - RNA, 22 nt, Human
cccuccagccauggacccaggu

SEQ ID NO: 165638 - RNA, 22 nt, Human
gagaaacuuggaguuauucugg

SEQ ID NO: 165639 - RNA, 22 nt, Human
cuagagaggcagauguccugug

SEQ ID NO: 165640 - RNA, 22 nt, Human
uucaaaacagcuagauauugga

SEQ ID NO: 165641 - RNA, 22 nt, Human
uauugucuguccgggucaaagc

SEQ ID NO: 165642 - RNA, 22 nt, Human
gggaucagcaagccacugcacc

SEQ ID NO: 165643 - RNA, 22 nt, Human
cagcagagguuggaacaguucu

SEQ ID NO: 165644 - RNA, 22 nt, Human
cucagggcuugaguguccagga

SEQ ID NO: 165645 - RNA, 22 nt, Human
aggcacuggucuaccccuuagu

SEQ ID NO: 165646 - RNA, 22 nt, Human
uagcaggguaaauguagaugga

SEQ ID NO: 165647 - RNA, 22 nt, Human
ugugcuucagguugucgccacg

SEQ ID NO: 165648 - RNA, 22 nt, Human
aggugccagaugcacagcugaa

SEQ ID NO: 165649 - RNA, 22 nt, Human
aguuuuauuccaaugugcagca

SEQ ID NO: 165650 - RNA, 22 nt, Human
agaggaugguugaggaagaccu

SEQ ID NO: 165651 - RNA, 22 nt, Human
gugccugugcggacucagggaa

SEQ ID NO: 165652 - RNA, 22 nt, Human
gucucccacuuucuggccucuu

SEQ ID NO: 165653 - RNA, 22 nt, Human
ccuggagcucacugggagccgg

SEQ ID NO: 165654 - RNA, 22 nt, Human
accaggggaugguuggcacugu

SEQ ID NO: 165655 - RNA, 22 nt, Human
ggaaagaccugagauaggaaua

SEQ ID NO: 165656 - RNA, 22 nt, Human
ucuggagaacuugcaagaggau

SEQ ID NO: 165657 - RNA, 22 nt, Human
agucuucagagaaauuaacucu

SEQ ID NO: 165658 - RNA, 22 nt, Human
agccuggaggccaggagacagu

SEQ ID NO: 165659 - RNA, 22 nt, Human
ugcagaggagcuggaaggcugg

SEQ ID NO: 165660 - RNA, 22 nt, Human
aguuuuucugggaggcacugcu

SEQ ID NO: 165661 - RNA, 22 nt, Human
augaagcugaccuugucuugcu

SEQ ID NO: 165662 - RNA, 22 nt, Human
gccuggagaaaggaagguggga

SEQ ID NO: 165663 - RNA, 22 nt, Human
gucuggggaagucagggcauca

SEQ ID NO: 165664 - RNA, 22 nt, Human
aucaguuucugugaagaacaca

SEQ ID NO: 165665 - RNA, 22 nt, Human
uaugcacacauguaugcaugug

SEQ ID NO: 165666 - RNA, 17 nt, Human
ugguggcuggagucagg

SEQ ID NO: 165667 - RNA, 22 nt, Human
ggacacagauaaucacacagau

SEQ ID NO: 165668 - RNA, 22 nt, Human
ucugccuggaugauggcagggc

SEQ ID NO: 165669 - RNA, 22 nt, Human
cccagcccugaccuauuggaaa

SEQ ID NO: 165670 - RNA, 22 nt, Human
cugugcuugcggguguggagcc

SEQ ID NO: 165671 - RNA, 22 nt, Human
ugcacacacaugaaguagcaug

SEQ ID NO: 165672 - RNA, 23 nt, Human
cugucuccugggcuagguggaau

SEQ ID NO: 165673 - RNA, 22 nt, Human
uagcagcucugauucugggccc

SEQ ID NO: 165674 - RNA, 22 nt, Human
ucccuggaacagagagacaacg

SEQ ID NO: 165675 - RNA, 22 nt, Human
cacaagacuuauuuguguagaa

SEQ ID NO: 165676 - RNA, 18 nt, Human
uucacaggaaaugucuuu

SEQ ID NO: 165677 - RNA, 22 nt, Human
agcagccagagucugaacauua

SEQ ID NO: 165678 - RNA, 22 nt, Human
aauguacaaggguuccaguuuu

SEQ ID NO: 165679 - RNA, 22 nt, Human
aguuggagugaacaugagauug

SEQ ID NO: 165680 - RNA, 22 nt, Human
ucagccacuacccaccuuaaca

SEQ ID NO: 165681 - RNA, 22 nt, Human
ccagcagcuuuauuggcucucc

SEQ ID NO: 165682 - RNA, 22 nt, Human
ugccucuguugagccuuggcug

SEQ ID NO: 165683 - RNA, 21 nt, Human
ggcagccugacccccagagag

SEQ ID NO: 165684 - RNA, 22 nt, Human
ccaaagucugcauuuuaacaug

SEQ ID NO: 165685 - RNA, 22 nt, Human
uggcagagucaucacaucugga

SEQ ID NO: 165686 - RNA, 22 nt, Human
ugguaaagaaggcuagaucuga

SEQ ID NO: 165687 - RNA, 22 nt, Human
gaggccuggcugucagucccca

SEQ ID NO: 165688 - RNA, 22 nt, Human
cagaagaaaguggggagacaag

SEQ ID NO: 165689 - RNA, 22 nt, Human
aucagcugaaaaacaggcagca

SEQ ID NO: 165690 - RNA, 22 nt, Human
ucaguuuugauuccugguucuc

SEQ ID NO: 165691 - RNA, 22 nt, Human
uggagugaaguaaagaggacaa

SEQ ID NO: 165692 - RNA, 22 nt, Human
cacauuugaaggaauuagcauu

SEQ ID NO: 165693 - RNA, 20 nt, Human
cuucaggacccauccucccc

SEQ ID NO: 165694 - RNA, 22 nt, Human
gugcaugugucuuuauaguagc

SEQ ID NO: 165695 - RNA, 21 nt, Human
ggcacugagccagauggacuc

SEQ ID NO: 165696 - RNA, 22 nt, Human
ucacugcaaucucugccuucca

SEQ ID NO: 165697 - RNA, 22 nt, Human
auugaaagcacaaagaacaagu

SEQ ID NO: 165698 - RNA, 22 nt, Human
aggagccaagcagaacuaagga

SEQ ID NO: 165699 - RNA, 22 nt, Human
ucagggcaaugucccucagaag

SEQ ID NO: 165700 - RNA, 22 nt, Human
auguacaaaaugccacugaauu

SEQ ID NO: 165701 - RNA, 19 nt, Human
gagcugccuuuugaagacc

SEQ ID NO: 165702 - RNA, 22 nt, Human
cugggcugugguguggcccaaa

SEQ ID NO: 165703 - RNA, 21 nt, Human
ugggcacugagggugcugcuc

SEQ ID NO: 165704 - RNA, 20 nt, Human
ugcagcugguuucacaggga

SEQ ID NO: 165705 - RNA, 22 nt, Human
uuccuguaguugugcaauguac

SEQ ID NO: 165706 - RNA, 23 nt, Human
gggagccaggaccucgcgcccca

SEQ ID NO: 165707 - RNA, 22 nt, Human
ucuagaaauuuugccuuguauu

SEQ ID NO: 165708 - RNA, 22 nt, Human
aacaaauguguuuuguaauuaa

SEQ ID NO: 165709 - RNA, 22 nt, Human
acacaugcugauaagaauauaa

SEQ ID NO: 165710 - RNA, 22 nt, Human
gcaaggcuuugugaauuuuaaa

SEQ ID NO: 165711 - RNA, 21 nt, Human
gccuggcagguggaagggcuc

SEQ ID NO: 165712 - RNA, 22 nt, Human
ucaaaugcuucuacuccuaaga

SEQ ID NO: 165713 - RNA, 22 nt, Human
agagggcauuaacucugucuug

SEQ ID NO: 165714 - RNA, 21 nt, Human
uccucugcagugagguggccu

SEQ ID NO: 165715 - RNA, 22 nt, Human
ccacagggucagccacucugca

SEQ ID NO: 165716 - RNA, 22 nt, Human
cagcaggcagccauuucacugu

SEQ ID NO: 165717 - RNA, 22 nt, Human
agaugcugucacacacacuguu

SEQ ID NO: 165718 - RNA, 22 nt, Human
aagcaggcauuccagagacaau

SEQ ID NO: 165719 - RNA, 22 nt, Human
ucagagcuuuggagaccaggaa

SEQ ID NO: 165720 - RNA, 22 nt, Human
acagccagaggugguccugggu

SEQ ID NO: 165721 - RNA, 22 nt, Human
agccagggagguggagguugca

SEQ ID NO: 165722 - RNA, 22 nt, Human
uccuucagugucccgcucaggu

SEQ ID NO: 165723 - RNA, 22 nt, Human
ugagccagauaagggcucacgc

SEQ ID NO: 165724 - RNA, 18 nt, Human
acccucuggcuucugagc

SEQ ID NO: 165725 - RNA, 22 nt, Human
ggaggacaggggcugcagcaca

SEQ ID NO: 165726 - RNA, 18 nt, Human
agaguguucucagugaaa

SEQ ID NO: 165727 - RNA, 22 nt, Human
auuucuucaggucagaaauaga

SEQ ID NO: 165728 - RNA, 22 nt, Human
cacuacuugaaagaauuacaga

SEQ ID NO: 165729 - RNA, 22 nt, Human
cuuaacagagagaaguguugcu

SEQ ID NO: 165730 - RNA, 22 nt, Human
agcacagguacggagaugcuac

SEQ ID NO: 165731 - RNA, 22 nt, Human
ugucaugccauuuaaaauguuu

SEQ ID NO: 165732 - RNA, 21 nt, Human
ccuucucuugcuucagcuuca

SEQ ID NO: 165733 - RNA, 22 nt, Human
ccaggcugcuguugguguccgc

SEQ ID NO: 165734 - RNA, 22 nt, Human
gcucugugcaguucagggacac

SEQ ID NO: 165735 - RNA, 22 nt, Human
agccugucugucuccaaagcug

SEQ ID NO: 165736 - RNA, 22 nt, Human
cuggccagaguuggagggugug

SEQ ID NO: 165737 - RNA, 22 nt, Human
caggcacagaguuauucauuua

SEQ ID NO: 165738 - RNA, 22 nt, Human
uguuuaagcugaugagguaucg

SEQ ID NO: 165739 - RNA, 23 nt, Human
gaguguucauagcaggcucuugc

SEQ ID NO: 165740 - RNA, 22 nt, Human
uggucucugacucugaagaccc

SEQ ID NO: 165741 - RNA, 22 nt, Human
cuggcagcauuaacagagagca

SEQ ID NO: 165742 - RNA, 22 nt, Human
ccugacucuggccaggccagcu

SEQ ID NO: 165743 - RNA, 22 nt, Human
agcucccagcuccuuugagaga

SEQ ID NO: 165744 - RNA, 22 nt, Human
cacucugcgcugggcgccagcg

SEQ ID NO: 165745 - RNA, 22 nt, Human
ggcagggaggaggugaaaguga

SEQ ID NO: 165746 - RNA, 22 nt, Human
ccucuguccuggggaguggagc

SEQ ID NO: 165747 - RNA, 19 nt, Human
agacagagcucaguggguu

SEQ ID NO: 165748 - RNA, 22 nt, Human
aggccugagcagaggaguggac

SEQ ID NO: 165749 - RNA, 22 nt, Human
cuggcagcuggaggcuagaggc

SEQ ID NO: 165750 - RNA, 22 nt, Human
cugggacuuuacccuguggccc

SEQ ID NO: 165751 - RNA, 22 nt, Human
gaagagcugcucagaacaugau

SEQ ID NO: 165752 - RNA, 22 nt, Human
uuuguaaaaggaggaagcaugg

SEQ ID NO: 165753 - RNA, 22 nt, Human
ugugcuucuugcagcuccugua

SEQ ID NO: 165754 - RNA, 22 nt, Human
ugggacagugugccuugcuccu

SEQ ID NO: 165755 - RNA, 21 nt, Human
cuugaaagguagagucuacag

SEQ ID NO: 165756 - RNA, 22 nt, Human
ugccugcuaggcccugcugggu

SEQ ID NO: 165757 - RNA, 22 nt, Human
cugggaggcaccgcgucgugcu

SEQ ID NO: 165758 - RNA, 22 nt, Human
gcaaggcagcgcggaguagcua

SEQ ID NO: 165759 - RNA, 19 nt, Human
ucucacaucagcuccuagc

SEQ ID NO: 165760 - RNA, 22 nt, Human
uccauuggucucugugcccagg

SEQ ID NO: 165761 - RNA, 22 nt, Human
cacuggcaugugaggcgguggc

SEQ ID NO: 165762 - RNA, 22 nt, Human
acugugugcccugacgccaggg

SEQ ID NO: 165763 - RNA, 22 nt, Human
ucuggcucuguguccucaccca

SEQ ID NO: 165764 - RNA, 22 nt, Human
cuguccauuuucgugccuccuu

SEQ ID NO: 165765 - RNA, 22 nt, Human
gcagagcauguccucaggacag

SEQ ID NO: 165766 - RNA, 22 nt, Human
ugaaggaaagagggaacauccc

SEQ ID NO: 165767 - RNA, 22 nt, Human
agaagugccauacuguggucca

SEQ ID NO: 165768 - RNA, 22 nt, Human
acuugauuuugaaccuuucuac

SEQ ID NO: 165769 - RNA, 22 nt, Human
cccagaggugcuucagaggugc

SEQ ID NO: 165770 - RNA, 22 nt, Human
uggcuucugggacuugugagca

SEQ ID NO: 165771 - RNA, 22 nt, Human
cccagcauuucugggcugcacu

SEQ ID NO: 165772 - RNA, 21 nt, Human
uugcaccaugauaaauucaga

SEQ ID NO: 165773 - RNA, 19 nt, Human
ccucugcgcuguccugcuc

SEQ ID NO: 165774 - RNA, 22 nt, Human
uagacagauuucuuguuagaca

SEQ ID NO: 165775 - RNA, 22 nt, Human
ucugggugcccuuugcucuguu

SEQ ID NO: 165776 - RNA, 22 nt, Human
ugcagaccucccauggcugccu

SEQ ID NO: 165777 - RNA, 22 nt, Human
agggccuggaacuggagaccac

SEQ ID NO: 165778 - RNA, 22 nt, Human
caggauccuggcugcauggacg

SEQ ID NO: 165779 - RNA, 22 nt, Human
uggcaguggcucagagugcaga

SEQ ID NO: 165780 - RNA, 20 nt, Human
cugagcccccagccugcagg

SEQ ID NO: 165781 - RNA, 22 nt, Human
auuguguaauuuucagcucaua

SEQ ID NO: 165782 - RNA, 21 nt, Human
agacagagugcagucuacaua

SEQ ID NO: 165783 - RNA, 22 nt, Human
uggccuuggcagugagaagagu

SEQ ID NO: 165784 - RNA, 22 nt, Human
ugucacauaggcaaaauguuuu

SEQ ID NO: 165785 - RNA, 22 nt, Human
ugcauauuuguaugauguuuag

SEQ ID NO: 165786 - RNA, 21 nt, Human
agagagaaggccauauggucc

SEQ ID NO: 165787 - RNA, 22 nt, Human
cacagcuuguuuagugacucac

SEQ ID NO: 165788 - RNA, 22 nt, Human
ccugccuguacuagagacccag

SEQ ID NO: 165789 - RNA, 22 nt, Human
agagccagagaccuggguucac

SEQ ID NO: 165790 - RNA, 22 nt, Human
gccucugcccuccugggacugc

SEQ ID NO: 165791 - RNA, 18 nt, Human
gcaggugccacugcuguu

SEQ ID NO: 165792 - RNA, 21 nt, Human
acagaacuguauagugauaaa

SEQ ID NO: 165793 - RNA, 22 nt, Human
cagcucccuauggugaggcgac

SEQ ID NO: 165794 - RNA, 22 nt, Human
acaaagguggaccauguggcuu

SEQ ID NO: 165795 - RNA, 22 nt, Human
agagccugaggccaggaaaaug

SEQ ID NO: 165796 - RNA, 22 nt, Human
aggccuggguguucaccagaag

SEQ ID NO: 165797 - RNA, 22 nt, Human
ggagacaguauggcuuguagcu

SEQ ID NO: 165798 - RNA, 22 nt, Human
ugcugaggucaccuugcugcua

SEQ ID NO: 165799 - RNA, 20 nt, Human
aggcugggguguuuugccca

SEQ ID NO: 165800 - RNA, 22 nt, Human
uguggccuccuguuccugggua

SEQ ID NO: 165801 - RNA, 22 nt, Human
acauuucugcauguaggguaau

SEQ ID NO: 165802 - RNA, 22 nt, Human
gcugccaugccacagcacucac

SEQ ID NO: 165803 - RNA, 22 nt, Human
ccagccuggagggcaguggugg

SEQ ID NO: 165804 - RNA, 22 nt, Human
aaggcacuuuuccugagaugau

SEQ ID NO: 165805 - RNA, 19 nt, Human
ucccagagucuagagguug

SEQ ID NO: 165806 - RNA, 22 nt, Human
ucagcuggcaguucagaggcug

SEQ ID NO: 165807 - RNA, 22 nt, Human
ccugccugacagagaagguuca

SEQ ID NO: 165808 - RNA, 22 nt, Human
ggcugccugcuccuccugcacg

SEQ ID NO: 165809 - RNA, 22 nt, Human
ggcugaaacagauuucaagaca

SEQ ID NO: 165810 - RNA, 22 nt, Human
gccacguugccacccgggugac

SEQ ID NO: 165811 - RNA, 22 nt, Human
acuuugugcccaacagaaagaa

SEQ ID NO: 165812 - RNA, 22 nt, Human
ggguguccugugccaagcuggg

SEQ ID NO: 165813 - RNA, 22 nt, Human
gugcagguguuuuggcugccag

SEQ ID NO: 165814 - RNA, 22 nt, Human
acugggccuggauuggcguguc

SEQ ID NO: 165815 - RNA, 21 nt, Human
gagacagacuuucguccccug

SEQ ID NO: 165816 - RNA, 18 nt, Human
ugucauugccagggaagc

SEQ ID NO: 165817 - RNA, 22 nt, Human
gagccugaaauacaggucacug

SEQ ID NO: 165818 - RNA, 22 nt, Human
aguggcaggcggagauguagga

SEQ ID NO: 165819 - RNA, 22 nt, Human
gcugccugauuuacauagugaa

SEQ ID NO: 165820 - RNA, 22 nt, Human
guagcccaccuggggagggcga

SEQ ID NO: 165821 - RNA, 22 nt, Human
ccagggcuggugggagaugcug

SEQ ID NO: 165822 - RNA, 22 nt, Human
gaaaaaugagcugaugucaggg

SEQ ID NO: 165823 - RNA, 22 nt, Human
cugggcugcgggcgccccucca

SEQ ID NO: 165824 - RNA, 22 nt, Human
cagggccucauccucagagauu

SEQ ID NO: 165825 - RNA, 22 nt, Human
gaggccugguuugcaugagaau

SEQ ID NO: 165826 - RNA, 22 nt, Human
agaagccaauucugugugaguc

SEQ ID NO: 165827 - RNA, 22 nt, Human
ccugagagcgaguggccucaug

SEQ ID NO: 165828 - RNA, 22 nt, Human
auguuuauguugggcuauauuu

SEQ ID NO: 165829 - RNA, 20 nt, Human
auguagaugaaagcaaaggc

SEQ ID NO: 165830 - RNA, 22 nt, Human
ccucugcucugguccaugugcu

SEQ ID NO: 165831 - RNA, 22 nt, Human
uuacaaagagaaguuguagaau

SEQ ID NO: 165832 - RNA, 22 nt, Human
cagccugcccuggaagcccagc

SEQ ID NO: 165833 - RNA, 20 nt, Human
gcccacucuaauccacuguc

SEQ ID NO: 165834 - RNA, 22 nt, Human
agccaaggcagcuagagcucug

SEQ ID NO: 165835 - RNA, 22 nt, Human
auacagaaaaugaugcagaguu

SEQ ID NO: 165836 - RNA, 22 nt, Human
ugcaauaacccaguaucuguga

SEQ ID NO: 165837 - RNA, 22 nt, Human
ugagaaagugggugccuagcaa

SEQ ID NO: 165838 - RNA, 22 nt, Human
cagccagcugaauguaccauga

SEQ ID NO: 165839 - RNA, 22 nt, Human
guggcugggcuccgagcggcuu

SEQ ID NO: 165840 - RNA, 22 nt, Human
gggaaggagguggcuugaagug

SEQ ID NO: 165841 - RNA, 16 nt, Human
gagggcagaggcggaa

SEQ ID NO: 165842 - RNA, 22 nt, Human
uccugccucuccaugcuaacua

SEQ ID NO: 165843 - RNA, 18 nt, Human
aggcccuggccucgaaca

SEQ ID NO: 165844 - RNA, 22 nt, Human
ucaagagaaggggaaauagacu

SEQ ID NO: 165845 - RNA, 22 nt, Human
uaacagaauccuguuauugcca

SEQ ID NO: 165846 - RNA, 22 nt, Human
cauuuacuguugaaucccuagc

SEQ ID NO: 165847 - RNA, 22 nt, Human
ugucacaaacauacauuauaga

SEQ ID NO: 165848 - RNA, 22 nt, Human
gguucacauauugagaguauuc

SEQ ID NO: 165849 - RNA, 22 nt, Human
acacagggauauuucagguggu

SEQ ID NO: 165850 - RNA, 22 nt, Human
ucacauuuguuccucugcacuu

SEQ ID NO: 165851 - RNA, 22 nt, Human
ucagcugccccaguggccccag

SEQ ID NO: 165852 - RNA, 21 nt, Human
cccuugccugcacuccucggc

SEQ ID NO: 165853 - RNA, 22 nt, Human
uuugcuauaaaagggucacacg

SEQ ID NO: 165854 - RNA, 22 nt, Human
uauugacagagggucagaagag

SEQ ID NO: 165855 - RNA, 22 nt, Human
uuuaucuuuggaucuucagaaa

SEQ ID NO: 165856 - RNA, 22 nt, Human
uggaaggcaacggagugagcug

SEQ ID NO: 165857 - RNA, 22 nt, Human
agcagccauccuuagagaaaga

SEQ ID NO: 165858 - RNA, 21 nt, Human
agcuuguguguaucacagugu

SEQ ID NO: 165859 - RNA, 22 nt, Human
auaguggugagcugcauuuaug

SEQ ID NO: 165860 - RNA, 21 nt, Human
aggagcuguguuagcuggucg

SEQ ID NO: 165861 - RNA, 22 nt, Human
ugcauuauacuuuuagaaauuu

SEQ ID NO: 165862 - RNA, 22 nt, Human
aagcuggcaauuaucaaaacug

SEQ ID NO: 165863 - RNA, 22 nt, Human
caggcagccaggggaccugucc

SEQ ID NO: 165864 - RNA, 19 nt, Human
gggcagaauggcaucucag

SEQ ID NO: 165865 - RNA, 22 nt, Human
ucuggcucucauacucgccagu

SEQ ID NO: 165866 - RNA, 22 nt, Human
caggcagccuucucgucucaca

SEQ ID NO: 165867 - RNA, 22 nt, Human
aggcugcucugcgaagucagcu

SEQ ID NO: 165868 - RNA, 22 nt, Human
cucugggcaccaaagagcagcu

SEQ ID NO: 165869 - RNA, 22 nt, Human
uacaggaggauuaucaaaggau

SEQ ID NO: 165870 - RNA, 18 nt, Human
ucucuuuuccccucauug

SEQ ID NO: 165871 - RNA, 22 nt, Human
aaguucaaggcagguccugagg

SEQ ID NO: 165872 - RNA, 22 nt, Human
aauguuguuuuucugcaugucu

SEQ ID NO: 165873 - RNA, 23 nt, Human
cccuggagcuagucugagcagag

SEQ ID NO: 165874 - RNA, 22 nt, Human
ccacagggauaggaauggggcu

SEQ ID NO: 165875 - RNA, 20 nt, Human
gggugagauguaggagaggg

SEQ ID NO: 165876 - RNA, 22 nt, Human
aaaguguugggaagaaagugca

SEQ ID NO: 165877 - RNA, 22 nt, Human
cucucugguacauagaguuugg

SEQ ID NO: 165878 - RNA, 22 nt, Human
uuccuccacgugacaggagcca

SEQ ID NO: 165879 - RNA, 22 nt, Human
ggcuggcuggcugguagacaag

SEQ ID NO: 165880 - RNA, 22 nt, Human
gccccagccaaggugacacgaa

SEQ ID NO: 165881 - RNA, 22 nt, Human
aucugguuuggggauccuugug

SEQ ID NO: 165882 - RNA, 22 nt, Human
ucauugcaggcauuccccugcc

SEQ ID NO: 165883 - RNA, 22 nt, Human
ccuggagcaaaaaucuaaggag

SEQ ID NO: 165884 - RNA, 22 nt, Human
cugggccuggcguuccaggcug

SEQ ID NO: 165885 - RNA, 22 nt, Human
uuucuguaauuaaaagggcagg

SEQ ID NO: 165886 - RNA, 22 nt, Human
aaaugccucugcuguacacaau

SEQ ID NO: 165887 - RNA, 22 nt, Human
ggcagcugaccuagcaccaucc

SEQ ID NO: 165888 - RNA, 22 nt, Human
aaaugcaggaaauuaugcuuuu

SEQ ID NO: 165889 - RNA, 22 nt, Human
auuucauugaaguuaauucuuc

SEQ ID NO: 165890 - RNA, 22 nt, Human
cuuccucugcggcgccgggcgc

SEQ ID NO: 165891 - RNA, 22 nt, Human
cacaggagcuguggggcagugu

SEQ ID NO: 165892 - RNA, 22 nt, Human
ugacagcauaacacuggucuug

SEQ ID NO: 165893 - RNA, 22 nt, Human
gggcugcugcugccagcgacac

SEQ ID NO: 165894 - RNA, 22 nt, Human
uuggccuuguuaaggaggcccu

SEQ ID NO: 165895 - RNA, 22 nt, Human
aauuaguauugcgauucauuag

SEQ ID NO: 165896 - RNA, 22 nt, Human
ccugccugucaucgccugcgcc

SEQ ID NO: 165897 - RNA, 19 nt, Human
agcuccugggcucugggcc

SEQ ID NO: 165898 - RNA, 22 nt, Human
cuuccucacggugcaacaggaa

SEQ ID NO: 165899 - RNA, 22 nt, Human
agcuugccucuuaaucaccuca

SEQ ID NO: 165900 - RNA, 22 nt, Human
auccaaagauggaaagaacuuu

SEQ ID NO: 165901 - RNA, 21 nt, Human
uucaaagagugggcauuguca

SEQ ID NO: 165902 - RNA, 22 nt, Human
ccccagccuuccaugggaauug

SEQ ID NO: 165903 - RNA, 22 nt, Human
cauacauugcucauucaguauc

SEQ ID NO: 165904 - RNA, 22 nt, Human
ggccucagugggccgcugcagg

SEQ ID NO: 165905 - RNA, 22 nt, Human
cugccucucaggucccugagau

SEQ ID NO: 165906 - RNA, 22 nt, Human
accauguuggccaagcuggucu

SEQ ID NO: 165907 - RNA, 22 nt, Human
ccaggagccacucaggcccaca

SEQ ID NO: 165908 - RNA, 22 nt, Human
uagcuuuaccauagaagaguau

SEQ ID NO: 165909 - RNA, 22 nt, Human
ccagcuggcaggagagucaggg

SEQ ID NO: 165910 - RNA, 22 nt, Human
agaagccagcuucagcugcccg

SEQ ID NO: 165911 - RNA, 22 nt, Human
ugcagauucaaaugaaaugcaa

SEQ ID NO: 165912 - RNA, 22 nt, Human
ccugggcaggaugggcccggug

SEQ ID NO: 165913 - RNA, 20 nt, Human
agcuggagaagggcccuucc

SEQ ID NO: 165914 - RNA, 22 nt, Human
cagacccucgggugaguuggcc

SEQ ID NO: 165915 - RNA, 22 nt, Human
uuucaaauaccauaaaccuaau

SEQ ID NO: 165916 - RNA, 19 nt, Human
uagcagcugccaaaggaga

SEQ ID NO: 165917 - RNA, 22 nt, Human
cagcaggcccagaguuucaugg

SEQ ID NO: 165918 - RNA, 22 nt, Human
ugagaaccaugaaaagcuguca

SEQ ID NO: 165919 - RNA, 21 nt, Human
uggcucuguucaauauaugga

SEQ ID NO: 165920 - RNA, 22 nt, Human
gcuggugcauuagcugcaguuc

SEQ ID NO: 165921 - RNA, 22 nt, Human
gaggcugcggggaggagccugc

SEQ ID NO: 165922 - RNA, 22 nt, Human
gcagcccagguguagcucuuug

SEQ ID NO: 165923 - RNA, 22 nt, Human
ucagaggauugccucagcgagc

SEQ ID NO: 165924 - RNA, 22 nt, Human
uggccacccagcugacgccuuc

SEQ ID NO: 165925 - RNA, 22 nt, Human
ucacuugccuagcccaguucag

SEQ ID NO: 165926 - RNA, 22 nt, Human
agagugggccucugagucccag

SEQ ID NO: 165927 - RNA, 22 nt, Human
cugagggcccugaagcuuggca

SEQ ID NO: 165928 - RNA, 22 nt, Human
cagcauggggcuuggagucagc

SEQ ID NO: 165929 - RNA, 22 nt, Human
gggcaguggguggcugcagccu

SEQ ID NO: 165930 - RNA, 22 nt, Human
gggagcaggagccugccugcca

SEQ ID NO: 165931 - RNA, 22 nt, Human
aaugaacacagcccucuacuuu

SEQ ID NO: 165932 - RNA, 22 nt, Human
uggguggcacuucuggggucca

SEQ ID NO: 165933 - RNA, 22 nt, Human
gccagccuucuguggccugcaa

SEQ ID NO: 165934 - RNA, 22 nt, Human
acagaauuaaugaaaauuacaa

SEQ ID NO: 165935 - RNA, 22 nt, Human
cugagcauggccgguccauggu

SEQ ID NO: 165936 - RNA, 22 nt, Human
auggggcucugcggcugcuccc

SEQ ID NO: 165937 - RNA, 22 nt, Human
agcaucuggugagggccuaguu

SEQ ID NO: 165938 - RNA, 23 nt, Human
uggggccaagugaggaagggucu

SEQ ID NO: 165939 - RNA, 22 nt, Human
cuggcucuucagugcuugguuc

SEQ ID NO: 165940 - RNA, 22 nt, Human
gucacaggccuggaugaggggc

SEQ ID NO: 165941 - RNA, 22 nt, Human
aguuuuuccugauuuuacagaa

SEQ ID NO: 165942 - RNA, 22 nt, Human
ugucccaggcugaaguacagug

SEQ ID NO: 165943 - RNA, 22 nt, Human
ggcugagcaauuuugaugacau

SEQ ID NO: 165944 - RNA, 22 nt, Human
ccugcuucagggaugauggcac

SEQ ID NO: 165945 - RNA, 22 nt, Human
aucuggcucaccuggguaaaua

SEQ ID NO: 165946 - RNA, 22 nt, Human
caggagugagaugcgaucacuu

SEQ ID NO: 165947 - RNA, 22 nt, Human
cucagaaucugccaaguucagg

SEQ ID NO: 165948 - RNA, 22 nt, Human
gcuggccauggccugcgccauc

SEQ ID NO: 165949 - RNA, 20 nt, Human
guaaaauauggucuuugggu

SEQ ID NO: 165950 - RNA, 22 nt, Human
aaggcaggaugggaaaagauuu

SEQ ID NO: 165951 - RNA, 22 nt, Human
accugccuaucagcugccugcu

SEQ ID NO: 165952 - RNA, 22 nt, Human
ccacugucugcaggccucagca

SEQ ID NO: 165953 - RNA, 21 nt, Human
uagaaaucagcuggugccucu

SEQ ID NO: 165954 - RNA, 22 nt, Human
ggccagaaguuggaaaagagcc

SEQ ID NO: 165955 - RNA, 22 nt, Human
uuaacagauguuuauggagcau

SEQ ID NO: 165956 - RNA, 22 nt, Human
ggcuucugagugcucugcuguu

SEQ ID NO: 165957 - RNA, 22 nt, Human
agcagcucaaagccugcaagga

SEQ ID NO: 165958 - RNA, 22 nt, Human
gcugucacaaauauuucucagc

SEQ ID NO: 165959 - RNA, 22 nt, Human
uggccugccccgagauccuggc

SEQ ID NO: 165960 - RNA, 22 nt, Human
gcauuuguguucuuccuagagc

SEQ ID NO: 165961 - RNA, 22 nt, Human
acauuucucaucuaguagagua

SEQ ID NO: 165962 - RNA, 22 nt, Human
uguuccauaaguggugcuuugu

SEQ ID NO: 165963 - RNA, 23 nt, Human
uccagggauuaaugaagucaguc

SEQ ID NO: 165964 - RNA, 22 nt, Human
cauuaucucuucuauaugcuag

SEQ ID NO: 165965 - RNA, 22 nt, Human
ugucccagacauaaguggacau

SEQ ID NO: 165966 - RNA, 22 nt, Human
gcaggaugggagcuucacucug

SEQ ID NO: 165967 - RNA, 19 nt, Human
ugcuuccucaccaucuccc

SEQ ID NO: 165968 - RNA, 22 nt, Human
acagagcuguacaugugccaug

SEQ ID NO: 165969 - RNA, 22 nt, Human
uagcugucagcaaucaaguggu

SEQ ID NO: 165970 - RNA, 20 nt, Human
gagccugggaagucuaaggu

SEQ ID NO: 165971 - RNA, 22 nt, Human
aaaaucugcuuccuuuuacaga

SEQ ID NO: 165972 - RNA, 22 nt, Human
cugucagguuggucucagagcu

SEQ ID NO: 165973 - RNA, 22 nt, Human
cugugccuggggggcagagcug

SEQ ID NO: 165974 - RNA, 22 nt, Human
acagguggcauaggcaguuuga

SEQ ID NO: 165975 - RNA, 22 nt, Human
ugaagcaaacgcuucuguuccu

SEQ ID NO: 165976 - RNA, 22 nt, Human
uccuugaacagagggccugggu

SEQ ID NO: 165977 - RNA, 22 nt, Human
ugugcccauuccacuugaguac

SEQ ID NO: 165978 - RNA, 22 nt, Human
gagguauguaugcuacauucuu

SEQ ID NO: 165979 - RNA, 22 nt, Human
ucucucagaggccaggguccug

SEQ ID NO: 165980 - RNA, 20 nt, Human
gcacugaagguuccagggga

SEQ ID NO: 165981 - RNA, 22 nt, Human
uauuuccugcauggugauguaa

SEQ ID NO: 165982 - RNA, 22 nt, Human
ugccuggguccaggccaagccu

SEQ ID NO: 165983 - RNA, 22 nt, Human
accuuuuuucagaacucuaaag

SEQ ID NO: 165984 - RNA, 22 nt, Human
guuacacaggaaaacauuagca

SEQ ID NO: 165985 - RNA, 22 nt, Human
gucucagauucagacaucuaca

SEQ ID NO: 165986 - RNA, 22 nt, Human
ucaaguauaucuagucauuagg

SEQ ID NO: 165987 - RNA, 22 nt, Human
gcugucugucuucacaucucgc

SEQ ID NO: 165988 - RNA, 22 nt, Human
uggcugaauaauauucuguugu

SEQ ID NO: 165989 - RNA, 22 nt, Human
ugggcagacgggagcuugccuu

SEQ ID NO: 165990 - RNA, 22 nt, Human
cuggggcuggugaggcaggcuc

SEQ ID NO: 165991 - RNA, 23 nt, Human
ggcagcucucaucugaugacuga

SEQ ID NO: 165992 - RNA, 22 nt, Human
guuuccauggcucuguuaaugg

SEQ ID NO: 165993 - RNA, 22 nt, Human
cucaggauucucgacacucaca

SEQ ID NO: 165994 - RNA, 22 nt, Human
aaaugcacagagccuuagagau

SEQ ID NO: 165995 - RNA, 22 nt, Human
gguggccaggccagcucuggcc

SEQ ID NO: 165996 - RNA, 22 nt, Human
cagagggagcccuccaggagca

SEQ ID NO: 165997 - RNA, 22 nt, Human
uaacaucuuuagcagcucgaac

SEQ ID NO: 165998 - RNA, 22 nt, Human
auacaucucauguaagagauaa

SEQ ID NO: 165999 - RNA, 22 nt, Human
cagcuggguuuaguggggugug

SEQ ID NO: 166000 - RNA, 22 nt, Human
acacagccaggguaguaaggcu

SEQ ID NO: 166001 - RNA, 22 nt, Human
caggguggcccuguggucucau

SEQ ID NO: 166002 - RNA, 22 nt, Human
aagaagaugguuaacuuucagu

SEQ ID NO: 166003 - RNA, 22 nt, Human
ccagggucuuggagaggagugc

SEQ ID NO: 166004 - RNA, 22 nt, Human
uuuuuccaccguacuuccugag

SEQ ID NO: 166005 - RNA, 22 nt, Human
ggguccaggucuucaggcagag

SEQ ID NO: 166006 - RNA, 22 nt, Human
ggcugccucuggaagcuggaga

SEQ ID NO: 166007 - RNA, 22 nt, Human
guguuuccucacuucucugacu

SEQ ID NO: 166008 - RNA, 22 nt, Human
gccagguggcugagugacugag

SEQ ID NO: 166009 - RNA, 23 nt, Human
acagcugcaccuggccgccuggc

SEQ ID NO: 166010 - RNA, 22 nt, Human
agauguaguagugggucuuuua

SEQ ID NO: 166011 - RNA, 22 nt, Human
acugcuuuagaccuagagcucu

SEQ ID NO: 166012 - RNA, 22 nt, Human
cagagcaguaaaucuggggcac

SEQ ID NO: 166013 - RNA, 22 nt, Human
augccacugacauggacaauuu

SEQ ID NO: 166014 - RNA, 22 nt, Human
ucacagggcauuauggcuccag

SEQ ID NO: 166015 - RNA, 22 nt, Human
agucccagcucugccacuuacu

SEQ ID NO: 166016 - RNA, 21 nt, Human
uccuucaguucugcacuuucu

SEQ ID NO: 166017 - RNA, 22 nt, Human
cucaggauguacuacagaaggc

SEQ ID NO: 166018 - RNA, 22 nt, Human
caggaaagagcugccaggcagg

SEQ ID NO: 166019 - RNA, 22 nt, Human
aggagccaagauggggcaagua

SEQ ID NO: 166020 - RNA, 22 nt, Human
gcagcuggggccacacuuaggc

SEQ ID NO: 166021 - RNA, 22 nt, Human
uggcucagaugcucuuccagug

SEQ ID NO: 166022 - RNA, 22 nt, Human
ugacuucaaaggcucuacuccu

SEQ ID NO: 166023 - RNA, 22 nt, Human
uuaucauugucgcagucuaauu

SEQ ID NO: 166024 - RNA, 22 nt, Human
cugcuuuguaaaauagacauaa

SEQ ID NO: 166025 - RNA, 22 nt, Human
auggcagccuguggacagucaa

SEQ ID NO: 166026 - RNA, 22 nt, Human
ccucugggugggaggccgggcg

SEQ ID NO: 166027 - RNA, 22 nt, Human
cagaauuuuucgaauguacugu

SEQ ID NO: 166028 - RNA, 22 nt, Human
agggagcaugggugaagcaggc

SEQ ID NO: 166029 - RNA, 22 nt, Human
cauuucugauuacagaauacua

SEQ ID NO: 166030 - RNA, 22 nt, Human
ucagagaaguaagguggggugc

SEQ ID NO: 166031 - RNA, 22 nt, Human
ucugggcccuaaaccagcucua

SEQ ID NO: 166032 - RNA, 22 nt, Human
gggcagcugccaagugcaucgc

SEQ ID NO: 166033 - RNA, 22 nt, Human
agaauucuggaguugggaggaa

SEQ ID NO: 166034 - RNA, 16 nt, Human
cagaguguaaacagga

SEQ ID NO: 166035 - RNA, 22 nt, Human
aucacaggugguaggaaaagaa

SEQ ID NO: 166036 - RNA, 22 nt, Human
acccugggucauauacagugug

SEQ ID NO: 166037 - RNA, 23 nt, Human
cucccuggaguuucuggaagaug

SEQ ID NO: 166038 - RNA, 22 nt, Human
ggcgugggaaguggggcuucug

SEQ ID NO: 166039 - RNA, 21 nt, Human
ugcauaaagaaauacaaauac

SEQ ID NO: 166040 - RNA, 22 nt, Human
guuauguaucuugauugggugg

SEQ ID NO: 166041 - RNA, 20 nt, Human
ugccagggccagcagaggcu

SEQ ID NO: 166042 - RNA, 22 nt, Human
agcugcccuucucuugcccuug

SEQ ID NO: 166043 - RNA, 22 nt, Human
uggaggagaauuuauggucgaa

SEQ ID NO: 166044 - RNA, 22 nt, Human
agccuucaguaaauccacugug

SEQ ID NO: 166045 - RNA, 22 nt, Human
aaguuuaagguggaaguggugg

SEQ ID NO: 166046 - RNA, 20 nt, Human
ugcuugucaugcacucaggc

SEQ ID NO: 166047 - RNA, 22 nt, Human
auuuaucaccaguuagcugacu

SEQ ID NO: 166048 - RNA, 22 nt, Human
gcaguccucucauuggccuccu

SEQ ID NO: 166049 - RNA, 17 nt, Human
ucuuuccugccaugcuc

SEQ ID NO: 166050 - RNA, 22 nt, Human
ugcuggcucaguuugcagacuc

SEQ ID NO: 166051 - RNA, 18 nt, Human
acauuucuaugcuucugg

SEQ ID NO: 166052 - RNA, 22 nt, Human
cacuucaauuaacuucagcauu

SEQ ID NO: 166053 - RNA, 22 nt, Human
ugccucagagugggcuugcuau

SEQ ID NO: 166054 - RNA, 22 nt, Human
uuugcauuuauaaguuggugga

SEQ ID NO: 166055 - RNA, 22 nt, Human
uucuuacagcccuauuacuaaa

SEQ ID NO: 166056 - RNA, 22 nt, Human
uuuucuaacaucuaguaauuug

SEQ ID NO: 166057 - RNA, 22 nt, Human
cugggcuguaauguggcacuga

SEQ ID NO: 166058 - RNA, 22 nt, Human
agagccugcaucaggcuugggg

SEQ ID NO: 166059 - RNA, 22 nt, Human
acagaguacauucagagacuau

SEQ ID NO: 166060 - RNA, 22 nt, Human
agcagccaggaaucugcagagc

SEQ ID NO: 166061 - RNA, 22 nt, Human
agccagagagccccagguucua

SEQ ID NO: 166062 - RNA, 22 nt, Human
agggccugcaucaggagcuugg

SEQ ID NO: 166063 - RNA, 22 nt, Human
aggcacugauucucagaguuac

SEQ ID NO: 166064 - RNA, 22 nt, Human
ggcucaggacacagugguuuag

SEQ ID NO: 166065 - RNA, 19 nt, Human
ccuggcccugcugcgcggg

SEQ ID NO: 166066 - RNA, 22 nt, Human
cagcugccacaggacuuucuga

SEQ ID NO: 166067 - RNA, 21 nt, Human
ccagacuggccuaugugguag

SEQ ID NO: 166068 - RNA, 22 nt, Human
agagcugaaaaagcugacccgg

SEQ ID NO: 166069 - RNA, 22 nt, Human
uggcucaggugugagcugaaga

SEQ ID NO: 166070 - RNA, 22 nt, Human
ucagggcaggcgagcagcugcu

SEQ ID NO: 166071 - RNA, 22 nt, Human
ccagcuggucugugcucauguu

SEQ ID NO: 166072 - RNA, 22 nt, Human
aagcugccugccacgcuagaua

SEQ ID NO: 166073 - RNA, 22 nt, Human
caagagcuggguggcaagcuag

SEQ ID NO: 166074 - RNA, 22 nt, Human
gcagcugguuaaugggagaauu

SEQ ID NO: 166075 - RNA, 19 nt, Human
aggccugggguuuugcacu

SEQ ID NO: 166076 - RNA, 22 nt, Human
cagcagugugcaggugugcugg

SEQ ID NO: 166077 - RNA, 22 nt, Human
cucagaaguucagccuagagua

SEQ ID NO: 166078 - RNA, 22 nt, Human
cagagccagcaguggggacagg

SEQ ID NO: 166079 - RNA, 22 nt, Human
gcucucagguacaaagcugugu

SEQ ID NO: 166080 - RNA, 22 nt, Human
cugggcugucaauggcccucug

SEQ ID NO: 166081 - RNA, 22 nt, Human
uuccauuguuucugucuucacu

SEQ ID NO: 166082 - RNA, 22 nt, Human
aacaguaucuuuuaucagaaau

SEQ ID NO: 166083 - RNA, 22 nt, Human
agcugcucaggagagccagguc

SEQ ID NO: 166084 - RNA, 22 nt, Human
ggcugccugaggcagugagaga

SEQ ID NO: 166085 - RNA, 22 nt, Human
cugccucugguuuuggucccug

SEQ ID NO: 166086 - RNA, 22 nt, Human
cuggccuggucuggccucucca

SEQ ID NO: 166087 - RNA, 22 nt, Human
acagcuguauccccagagcuca

SEQ ID NO: 166088 - RNA, 21 nt, Human
gcaggguccuuuccauuccua

SEQ ID NO: 166089 - RNA, 22 nt, Human
acaggcugccuaccaaguauca

SEQ ID NO: 166090 - RNA, 22 nt, Human
ucuggcucggauuugucuagca

SEQ ID NO: 166091 - RNA, 22 nt, Human
cucaggcccacagcagacccac

SEQ ID NO: 166092 - RNA, 22 nt, Human
agucccagagaggucggggcca

SEQ ID NO: 166093 - RNA, 19 nt, Human
cagcaauaaugccagaugg

SEQ ID NO: 166094 - RNA, 22 nt, Human
ugucucaggggcauugaaauaa

SEQ ID NO: 166095 - RNA, 22 nt, Human
cuggcucaauuuguacugcugu

SEQ ID NO: 166096 - RNA, 22 nt, Human
gcccucagaguuccccacagug

SEQ ID NO: 166097 - RNA, 15 nt, Human
aaucuggcggcaagu

SEQ ID NO: 166098 - RNA, 22 nt, Human
ugcagccaggaaauauuugcug

SEQ ID NO: 166099 - RNA, 22 nt, Human
gcaccugggacccagaggcacc

SEQ ID NO: 166100 - RNA, 22 nt, Human
cccucugcucaggugcauaggc

SEQ ID NO: 166101 - RNA, 22 nt, Human
agccagggacgcugcaggcuac

SEQ ID NO: 166102 - RNA, 22 nt, Human
acauuucuuuucaucucuauau

SEQ ID NO: 166103 - RNA, 22 nt, Human
uauucacaaaaugagguccuca

SEQ ID NO: 166104 - RNA, 22 nt, Human
agcuggccuuagugagcaccug

SEQ ID NO: 166105 - RNA, 22 nt, Human
uaaagguaacaugaacugcuuu

SEQ ID NO: 166106 - RNA, 22 nt, Human
agacagcaugauacaugaugcu

SEQ ID NO: 166107 - RNA, 22 nt, Human
agugaaauuccuggucuuuguu

SEQ ID NO: 166108 - RNA, 22 nt, Human
ucccagaguuuccuguguccca

SEQ ID NO: 166109 - RNA, 22 nt, Human
uucuuucccagaagauauguuu

SEQ ID NO: 166110 - RNA, 22 nt, Human
guuauaaaugacugcaaaaguu

SEQ ID NO: 166111 - RNA, 22 nt, Human
aucaaaguaggcauauguuuuu

SEQ ID NO: 166112 - RNA, 22 nt, Human
agagccugaggaugucccagcu

SEQ ID NO: 166113 - RNA, 22 nt, Human
gccaccagccccaugcgcugug

SEQ ID NO: 166114 - RNA, 20 nt, Human
ugcucugucuaaaacuuccc

SEQ ID NO: 166115 - RNA, 22 nt, Human
aggccuguuggcgugggcucua

SEQ ID NO: 166116 - RNA, 22 nt, Human
agccaugcaccuuacucuugcu

SEQ ID NO: 166117 - RNA, 22 nt, Human
aauuucaaacuaauaggaacca

SEQ ID NO: 166118 - RNA, 20 nt, Human
uauuucugggcaaccauuua

SEQ ID NO: 166119 - RNA, 22 nt, Human
guacaguuuucaguguucacug

SEQ ID NO: 166120 - RNA, 22 nt, Human
acauuucuuccuaauuaucccu

SEQ ID NO: 166121 - RNA, 22 nt, Human
gcauccagucuuggcuccugga

SEQ ID NO: 166122 - RNA, 22 nt, Human
ucagaaauuuucucaguaguuc

SEQ ID NO: 166123 - RNA, 22 nt, Human
aaaucuaggcucauccuggucc

SEQ ID NO: 166124 - RNA, 22 nt, Human
uuacaugguuguuggaaaugcu

SEQ ID NO: 166125 - RNA, 22 nt, Human
caggaacacaaugagucucaaa

SEQ ID NO: 166126 - RNA, 22 nt, Human
aacagaauugcugcugccaaug

SEQ ID NO: 166127 - RNA, 22 nt, Human
guccucugacucagccuuggga

SEQ ID NO: 166128 - RNA, 22 nt, Human
agugauggagcuuccucugcua

SEQ ID NO: 166129 - RNA, 23 nt, Human
augcaguauaugucaguaguuua

SEQ ID NO: 166130 - RNA, 20 nt, Human
aggcagacaaggagucuguu

SEQ ID NO: 166131 - RNA, 23 nt, Human
agaaaagcuuggacacauggccu

SEQ ID NO: 166132 - RNA, 22 nt, Human
ccuggcuuccuggagcucacaa

SEQ ID NO: 166133 - RNA, 22 nt, Human
ggcuucucucccccagcuccac

SEQ ID NO: 166134 - RNA, 22 nt, Human
guguaauugaaauugagaacca

SEQ ID NO: 166135 - RNA, 22 nt, Human
acuuugaaacuaaaauucauua

SEQ ID NO: 166136 - RNA, 22 nt, Human
ugaagcaggaaacuucuuguuu

SEQ ID NO: 166137 - RNA, 22 nt, Human
ccacagggacuguuaaaacccu

SEQ ID NO: 166138 - RNA, 22 nt, Human
ucugcucuaguugcuuccugcc

SEQ ID NO: 166139 - RNA, 22 nt, Human
cuuccaaacccaggguaugggc

SEQ ID NO: 166140 - RNA, 22 nt, Human
ucagccucucugaguccagacc

SEQ ID NO: 166141 - RNA, 22 nt, Human
ugucaugccaccguuucccaga

SEQ ID NO: 166142 - RNA, 22 nt, Human
cccuggguucuggcugggcugc

SEQ ID NO: 166143 - RNA, 22 nt, Human
ggccagagaauaugccuuacgu

SEQ ID NO: 166144 - RNA, 22 nt, Human
cacuuaagcaguuaauuuaucu

SEQ ID NO: 166145 - RNA, 22 nt, Human
ugccaaggguaugggcaagaua

SEQ ID NO: 166146 - RNA, 22 nt, Human
gagagggccgggggccagcucc

SEQ ID NO: 166147 - RNA, 22 nt, Human
agagccaggugcugcuguuuga

SEQ ID NO: 166148 - RNA, 22 nt, Human
ggcacucagagauucaggcugu

SEQ ID NO: 166149 - RNA, 22 nt, Human
agggcagcagcuccuccuagcu

SEQ ID NO: 166150 - RNA, 22 nt, Human
uccucaggagagcuccuaugcc

SEQ ID NO: 166151 - RNA, 22 nt, Human
ucauuucuccgaccugcugucc

SEQ ID NO: 166152 - RNA, 18 nt, Human
cuuguucuucucuuggcg

SEQ ID NO: 166153 - RNA, 21 nt, Human
ugggaugggucugggaccagc

SEQ ID NO: 166154 - RNA, 22 nt, Human
uaaagguacgaagugagggauu

SEQ ID NO: 166155 - RNA, 22 nt, Human
cucuuaguuuaucuuugacaaa

SEQ ID NO: 166156 - RNA, 22 nt, Human
uuauuuauuguguaccuacugu

SEQ ID NO: 166157 - RNA, 22 nt, Human
ggcuucugguaaagaccacacc

SEQ ID NO: 166158 - RNA, 22 nt, Human
aaaaugugaucuacaaaugcaa

SEQ ID NO: 166159 - RNA, 22 nt, Human
gucucagaccacccucuuuggc

SEQ ID NO: 166160 - RNA, 22 nt, Human
uaaggcacuucaauguuuagaa

SEQ ID NO: 166161 - RNA, 22 nt, Human
uuggaaggagucaaccagcuga

SEQ ID NO: 166162 - RNA, 22 nt, Human
gcacacagccagcugagggcua

SEQ ID NO: 166163 - RNA, 22 nt, Human
acagcaagccagcuugucacug

SEQ ID NO: 166164 - RNA, 22 nt, Human
uccaguggcacuggagacuaga

SEQ ID NO: 166165 - RNA, 22 nt, Human
ggcugccagugagugcagaccg

SEQ ID NO: 166166 - RNA, 21 nt, Human
aggugcagagccagggaccag

SEQ ID NO: 166167 - RNA, 20 nt, Human
uuucagugguuugugccuag

SEQ ID NO: 166168 - RNA, 22 nt, Human
cagcccugagagaaccaucuau

SEQ ID NO: 166169 - RNA, 22 nt, Human
ccucccucuguuagagcugucu

SEQ ID NO: 166170 - RNA, 22 nt, Human
ugaaggcuguuggauggggaag

SEQ ID NO: 166171 - RNA, 22 nt, Human
caguguccucagccagcagcua

SEQ ID NO: 166172 - RNA, 22 nt, Human
gggaaggagccugcuugcuaga

SEQ ID NO: 166173 - RNA, 22 nt, Human
aacagaaaucauuuagggcucu

SEQ ID NO: 166174 - RNA, 22 nt, Human
aagcuccccgaaacccaccucu

SEQ ID NO: 166175 - RNA, 22 nt, Human
agcagcaggagccgugggguga

SEQ ID NO: 166176 - RNA, 22 nt, Human
gcagaagggaauaaggagcuuu

SEQ ID NO: 166177 - RNA, 22 nt, Human
ccaggcugccgaggaaagaaag

SEQ ID NO: 166178 - RNA, 22 nt, Human
aggcugcagaacagucaggugc

SEQ ID NO: 166179 - RNA, 22 nt, Human
cauguacauucuguagauggag

SEQ ID NO: 166180 - RNA, 22 nt, Human
uuccucuccucacaugagucac

SEQ ID NO: 166181 - RNA, 22 nt, Human
acaggcucuggggcaggauggc

SEQ ID NO: 166182 - RNA, 22 nt, Human
agacuucucaguuuuauuagua

SEQ ID NO: 166183 - RNA, 22 nt, Human
ucagagaacacagaggugaugu

SEQ ID NO: 166184 - RNA, 22 nt, Human
ucccagcagggccgaccagccu

SEQ ID NO: 166185 - RNA, 22 nt, Human
ccucugccaccucccacgaggc

SEQ ID NO: 166186 - RNA, 22 nt, Human
ggccaggagcaagccaggcucu

SEQ ID NO: 166187 - RNA, 22 nt, Human
uggggcugaggagccucacucu

SEQ ID NO: 166188 - RNA, 20 nt, Human
ggcucuggaaucuggugggc

SEQ ID NO: 166189 - RNA, 22 nt, Human
ugugcccauuacacagaggcau

SEQ ID NO: 166190 - RNA, 22 nt, Human
ucucagagcuucagaaagcacc

SEQ ID NO: 166191 - RNA, 22 nt, Human
ggcagccauacucagaccuggg

SEQ ID NO: 166192 - RNA, 22 nt, Human
cuugggagacacaagaagacau

SEQ ID NO: 166193 - RNA, 22 nt, Human
gcauuauuaauagcugcaugag

SEQ ID NO: 166194 - RNA, 22 nt, Human
auacagaagaacuauagccacu

SEQ ID NO: 166195 - RNA, 22 nt, Human
guuccaggcaagugggauagga

SEQ ID NO: 166196 - RNA, 22 nt, Human
uguauguaaaguuuguaauaga

SEQ ID NO: 166197 - RNA, 22 nt, Human
gcaggaguuaggcgucguggau

SEQ ID NO: 166198 - RNA, 22 nt, Human
gaggugggagggcagucccuaa

SEQ ID NO: 166199 - RNA, 22 nt, Human
ucuuguccuaagagcuggauuc

SEQ ID NO: 166200 - RNA, 22 nt, Human
uggaggaugccauccaggauac

SEQ ID NO: 166201 - RNA, 22 nt, Human
cagaggccuuucuacagugaua

SEQ ID NO: 166202 - RNA, 22 nt, Human
gaggggcugcccuggugucagg

SEQ ID NO: 166203 - RNA, 22 nt, Human
ggagggugcauuuuacccugug

SEQ ID NO: 166204 - RNA, 22 nt, Human
cuacccaggcuggagugcagua

SEQ ID NO: 166205 - RNA, 22 nt, Human
cagagccugcucacgucucugu

SEQ ID NO: 166206 - RNA, 18 nt, Human
uggacaggguggagaaaa

SEQ ID NO: 166207 - RNA, 22 nt, Human
gagagcuggauucuggauaggu

SEQ ID NO: 166208 - RNA, 22 nt, Human
agcugagcuaguaguuccagug

SEQ ID NO: 166209 - RNA, 23 nt, Human
ucccagccucuucucuugcauac

SEQ ID NO: 166210 - RNA, 22 nt, Human
agaggaugauuuuaaggacacu

SEQ ID NO: 166211 - RNA, 22 nt, Human
cugucccagauguucucagcac

SEQ ID NO: 166212 - RNA, 22 nt, Human
cuauuucugccuaaugaccugu

SEQ ID NO: 166213 - RNA, 22 nt, Human
agaggccaucugcucugugggg

SEQ ID NO: 166214 - RNA, 22 nt, Human
agggauguaaauucuucuucuu

SEQ ID NO: 166215 - RNA, 22 nt, Human
cugaaggagguagagugacaua

SEQ ID NO: 166216 - RNA, 22 nt, Human
cauuagaagaacaguuauauua

SEQ ID NO: 166217 - RNA, 22 nt, Human
uguuccaugucuuuguaggacu

SEQ ID NO: 166218 - RNA, 22 nt, Human
gacagcagggacauguaggaag

SEQ ID NO: 166219 - RNA, 22 nt, Human
cuguauuuucaugccuacguac

SEQ ID NO: 166220 - RNA, 22 nt, Human
acauucuagaagucuuugcaau

SEQ ID NO: 166221 - RNA, 22 nt, Human
acguguucaauuuccaucugac

SEQ ID NO: 166222 - RNA, 22 nt, Human
cugccucuauucacugaggcag

SEQ ID NO: 166223 - RNA, 22 nt, Human
cugccugugcaugcagucagaa

SEQ ID NO: 166224 - RNA, 22 nt, Human
ucuggcucuauaacuccuagcu

SEQ ID NO: 166225 - RNA, 22 nt, Human
cugcucuggcguacucggcauc

SEQ ID NO: 166226 - RNA, 22 nt, Human
uggguggaauaaaucaguucug

SEQ ID NO: 166227 - RNA, 20 nt, Human
uugcagcagugaggugaagg

SEQ ID NO: 166228 - RNA, 22 nt, Human
agcugcugagagucugccgggc

SEQ ID NO: 166229 - RNA, 22 nt, Human
cuuuggcaaugaaacacaagaa

SEQ ID NO: 166230 - RNA, 22 nt, Human
uucacauugguucuugauagcu

SEQ ID NO: 166231 - RNA, 22 nt, Human
caggccugucugcacaugaggc

SEQ ID NO: 166232 - RNA, 22 nt, Human
agugucugaaccaccggggcau

SEQ ID NO: 166233 - RNA, 22 nt, Human
cucucugggggccaugccaaga

SEQ ID NO: 166234 - RNA, 22 nt, Human
caggggcaagaaugcugucagc

SEQ ID NO: 166235 - RNA, 22 nt, Human
ucugaggcuauguucaggcuaa

SEQ ID NO: 166236 - RNA, 22 nt, Human
uggcccugaggacccagugugg

SEQ ID NO: 166237 - RNA, 22 nt, Human
cagggccuucguaaguguccgg

SEQ ID NO: 166238 - RNA, 23 nt, Human
ugggcaucuccucugugccaggc

SEQ ID NO: 166239 - RNA, 22 nt, Human
uuacaguaugaucaacuuuuca

SEQ ID NO: 166240 - RNA, 22 nt, Human
uuugacaguaauaaagcacaag

SEQ ID NO: 166241 - RNA, 22 nt, Human
ggcuggaaaagacaaagcuauu

SEQ ID NO: 166242 - RNA, 23 nt, Human
agaugaaagcuucccaucacagu

SEQ ID NO: 166243 - RNA, 22 nt, Human
aggggagcuaacaccagagccc

SEQ ID NO: 166244 - RNA, 22 nt, Human
acauuguagacuuuucauaugu

SEQ ID NO: 166245 - RNA, 22 nt, Human
uggcagcaauuagcuagagcug

SEQ ID NO: 166246 - RNA, 22 nt, Human
uggcagcagggccccuggagga

SEQ ID NO: 166247 - RNA, 22 nt, Human
acagccuguuugaucuggugcu

SEQ ID NO: 166248 - RNA, 22 nt, Human
gccagacacuccccugggcagg

SEQ ID NO: 166249 - RNA, 22 nt, Human
aagcugccagauucagucugcu

SEQ ID NO: 166250 - RNA, 22 nt, Human
uggcagagucucuccuuuccag

SEQ ID NO: 166251 - RNA, 22 nt, Human
agcuucucaggagucugaggca

SEQ ID NO: 166252 - RNA, 22 nt, Human
uggcuuccuccagagcaggagg

SEQ ID NO: 166253 - RNA, 22 nt, Human
gaaaagagaacaucugaggauc

SEQ ID NO: 166254 - RNA, 17 nt, Human
cucagaguugcuuuguc

SEQ ID NO: 166255 - RNA, 22 nt, Human
agccaggggauucaucagggac

SEQ ID NO: 166256 - RNA, 22 nt, Human
ugccucugguuaucugguaccu

SEQ ID NO: 166257 - RNA, 22 nt, Human
cacagguguaugaauaugucca

SEQ ID NO: 166258 - RNA, 22 nt, Human
acugucugcaaaacucauacuc

SEQ ID NO: 166259 - RNA, 22 nt, Human
uauuauguagaguaaggguuaa

SEQ ID NO: 166260 - RNA, 22 nt, Human
agcuggaggauaacucacuucu

SEQ ID NO: 166261 - RNA, 22 nt, Human
caguugcuacaguucaagugug

SEQ ID NO: 166262 - RNA, 22 nt, Human
ucagccugcgucauggugacac

SEQ ID NO: 166263 - RNA, 22 nt, Human
gcaggggcuacucugagcuucc

SEQ ID NO: 166264 - RNA, 22 nt, Human
agcagcugguaggaguggccac

SEQ ID NO: 166265 - RNA, 22 nt, Human
ucaugcacaugugucaccauca

SEQ ID NO: 166266 - RNA, 17 nt, Human
cuggagccaagagggcc

SEQ ID NO: 166267 - RNA, 22 nt, Human
ugccagcccaccuuggggccuc

SEQ ID NO: 166268 - RNA, 22 nt, Human
guguaucaaagcacagacuuca

SEQ ID NO: 166269 - RNA, 18 nt, Human
gagcccugagucugcaca

SEQ ID NO: 166270 - RNA, 22 nt, Human
gccacagggcagaugcgcagag

SEQ ID NO: 166271 - RNA, 22 nt, Human
ucaggugggaccugcuaggaca

SEQ ID NO: 166272 - RNA, 22 nt, Human
aauuugcaugaugagaacaaua

SEQ ID NO: 166273 - RNA, 22 nt, Human
auggaaagcuaagccauuuacc

SEQ ID NO: 166274 - RNA, 22 nt, Human
caggccuggcccccggcacacc

SEQ ID NO: 166275 - RNA, 22 nt, Human
gacaugcaacaauuuggcauuu

SEQ ID NO: 166276 - RNA, 20 nt, Human
gugccuggagaagaggcugu

SEQ ID NO: 166277 - RNA, 22 nt, Human
gagauucuguagucaggcaucu

SEQ ID NO: 166278 - RNA, 22 nt, Human
uaaauucuacaacuucaaagau

SEQ ID NO: 166279 - RNA, 22 nt, Human
ugcagaagauggucugagcacc

SEQ ID NO: 166280 - RNA, 22 nt, Human
agggcacaagacucugagcccc

SEQ ID NO: 166281 - RNA, 18 nt, Human
gcagcugacacuggaguu

SEQ ID NO: 166282 - RNA, 22 nt, Human
caggccucccggugcacacuga

SEQ ID NO: 166283 - RNA, 22 nt, Human
ucucagaguuugaaucuggagu

SEQ ID NO: 166284 - RNA, 22 nt, Human
acccagagcugggcuuggcaaa

SEQ ID NO: 166285 - RNA, 22 nt, Human
ggagcugucuguagggcacagg

SEQ ID NO: 166286 - RNA, 17 nt, Human
ggccuguguggcugcag

SEQ ID NO: 166287 - RNA, 22 nt, Human
uacauguaagacaugagacucu

SEQ ID NO: 166288 - RNA, 22 nt, Human
ggagccuguuaguugagugcuc

SEQ ID NO: 166289 - RNA, 22 nt, Human
gccaggcuguuuuuauuacugu

SEQ ID NO: 166290 - RNA, 22 nt, Human
ucccagcagagccagcaagccg

SEQ ID NO: 166291 - RNA, 22 nt, Human
ggcagcuguggacgucgucauu

SEQ ID NO: 166292 - RNA, 22 nt, Human
gcugucaguuuuacccacagac

SEQ ID NO: 166293 - RNA, 22 nt, Human
acauuucucccugcaugccugc

SEQ ID NO: 166294 - RNA, 22 nt, Human
ugccagcaguagcaguaggcca

SEQ ID NO: 166295 - RNA, 22 nt, Human
ucugagagguuaagcaauuuga

SEQ ID NO: 166296 - RNA, 22 nt, Human
ucaggcagaccaccgugggcag

SEQ ID NO: 166297 - RNA, 18 nt, Human
gcaggagauggguggggu

SEQ ID NO: 166298 - RNA, 22 nt, Human
agccuguggaucccugcacugg

SEQ ID NO: 166299 - RNA, 21 nt, Human
agucccaggggugagugaugu

SEQ ID NO: 166300 - RNA, 20 nt, Human
cacagcuugccuuuuaugac

SEQ ID NO: 166301 - RNA, 22 nt, Human
gcagcagagcuuuguccuggcu

SEQ ID NO: 166302 - RNA, 22 nt, Human
cagggccuccccggcagucuuu

SEQ ID NO: 166303 - RNA, 22 nt, Human
cacuggugacuucugagcugga

SEQ ID NO: 166304 - RNA, 22 nt, Human
cccugcagcuuuugcauaguca

SEQ ID NO: 166305 - RNA, 22 nt, Human
ccagagccggcucccucagcuu

SEQ ID NO: 166306 - RNA, 22 nt, Human
gagaggccaaaaucccugcccc

SEQ ID NO: 166307 - RNA, 22 nt, Human
uuaaacagagucugaaauguaa

SEQ ID NO: 166308 - RNA, 22 nt, Human
ugaaaucugcaugcaaaguccu

SEQ ID NO: 166309 - RNA, 22 nt, Human
gggucucucucggcuccacgcg

SEQ ID NO: 166310 - RNA, 22 nt, Human
ugucauugaggaaaacuaggug

SEQ ID NO: 166311 - RNA, 22 nt, Human
ucuuuccucugagcuccuguag

SEQ ID NO: 166312 - RNA, 23 nt, Human
ucagagaaguuguaggcugggga

SEQ ID NO: 166313 - RNA, 22 nt, Human
aggagugcaaauaguccagaga

SEQ ID NO: 166314 - RNA, 22 nt, Human
cucccagagaccaagcugagaa

SEQ ID NO: 166315 - RNA, 22 nt, Human
caggccucagagaguggcgggg

SEQ ID NO: 166316 - RNA, 22 nt, Human
agccuccaaaugucaggucccg

SEQ ID NO: 166317 - RNA, 22 nt, Human
cuguggcuuucucugccuccuu

SEQ ID NO: 166318 - RNA, 22 nt, Human
ccugggugacccgugagcgucc

SEQ ID NO: 166319 - RNA, 22 nt, Human
acacagggcugcgccugacccc

SEQ ID NO: 166320 - RNA, 22 nt, Human
uaugcacauugguuuccucauu

SEQ ID NO: 166321 - RNA, 22 nt, Human
agauacaucuugaacuucuaga

SEQ ID NO: 166322 - RNA, 22 nt, Human
auuugagaugguaaauaacuuu

SEQ ID NO: 166323 - RNA, 22 nt, Human
agagaauuuuaaaagccuugaa

SEQ ID NO: 166324 - RNA, 22 nt, Human
augcauaauguauguauugacu

SEQ ID NO: 166325 - RNA, 22 nt, Human
gccagagccggcuucacaggau

SEQ ID NO: 166326 - RNA, 22 nt, Human
gucccagggaagaaggcagcac

SEQ ID NO: 166327 - RNA, 22 nt, Human
cagcucucacacccuccuccca

SEQ ID NO: 166328 - RNA, 22 nt, Human
ucccagccacagguguagcccu

SEQ ID NO: 166329 - RNA, 22 nt, Human
ucucugggugauggcagggcac

SEQ ID NO: 166330 - RNA, 22 nt, Human
cagggccuuauccugccauuga

SEQ ID NO: 166331 - RNA, 22 nt, Human
ucuccuuuaagauuuccucagg

SEQ ID NO: 166332 - RNA, 22 nt, Human
ugggcagcagcaaagccagacu

SEQ ID NO: 166333 - RNA, 22 nt, Human
ggugcagaucuuucucuucagg

SEQ ID NO: 166334 - RNA, 17 nt, Human
uguggccuucugagcuu

SEQ ID NO: 166335 - RNA, 22 nt, Human
ugaggcucaaggucugguggag

SEQ ID NO: 166336 - RNA, 22 nt, Human
gcacugaaauuauaugcauuug

SEQ ID NO: 166337 - RNA, 22 nt, Human
uguggccuggaaggggcugcuc

SEQ ID NO: 166338 - RNA, 22 nt, Human
agauuguagaaacuguagcauu

SEQ ID NO: 166339 - RNA, 17 nt, Human
ugccagccugucccagg

SEQ ID NO: 166340 - RNA, 22 nt, Human
aggccagguuccucaaucuuga

SEQ ID NO: 166341 - RNA, 22 nt, Human
cauugcacugcagcccgggcaa

SEQ ID NO: 166342 - RNA, 22 nt, Human
ucuccuucgaggcccagcuccc

SEQ ID NO: 166343 - RNA, 20 nt, Human
acauugauuauguuuguaga

SEQ ID NO: 166344 - RNA, 22 nt, Human
gccuucugugcuccuggccuuu

SEQ ID NO: 166345 - RNA, 22 nt, Human
uaacagaaaggcucaggugcuc

SEQ ID NO: 166346 - RNA, 20 nt, Human
agcccuguuuccuggagaga

SEQ ID NO: 166347 - RNA, 22 nt, Human
ggccuugggauguggcugcagc

SEQ ID NO: 166348 - RNA, 23 nt, Human
aaaguugauuugcaguuuaagag

SEQ ID NO: 166349 - RNA, 22 nt, Human
gccaggcucucagugacugccc

SEQ ID NO: 166350 - RNA, 22 nt, Human
agcaggagcccuuaucaccagg

SEQ ID NO: 166351 - RNA, 22 nt, Human
guuugcauauuugcacaggaau

SEQ ID NO: 166352 - RNA, 22 nt, Human
uggagcaggcaucuuucucucu

SEQ ID NO: 166353 - RNA, 22 nt, Human
uccaggcuggacaugaggcggg

SEQ ID NO: 166354 - RNA, 22 nt, Human
ggcugccugaggcugaggcccg

SEQ ID NO: 166355 - RNA, 22 nt, Human
ggccucugcccucacuccuguc

SEQ ID NO: 166356 - RNA, 22 nt, Human
agcagcaugaugacagagucuc

SEQ ID NO: 166357 - RNA, 22 nt, Human
uuagaaaucaccucugaagauc

SEQ ID NO: 166358 - RNA, 22 nt, Human
gcagggcucaacaggacacccc

SEQ ID NO: 166359 - RNA, 22 nt, Human
gcaggagccaggccgagcuggu

SEQ ID NO: 166360 - RNA, 22 nt, Human
gggacuggcacagggcugggag

SEQ ID NO: 166361 - RNA, 22 nt, Human
caaggaaaacagaugaucaaca

SEQ ID NO: 166362 - RNA, 22 nt, Human
uagugaaacaguuaucaaucug

SEQ ID NO: 166363 - RNA, 22 nt, Human
aaagaaauagauggcauuuaaa

SEQ ID NO: 166364 - RNA, 22 nt, Human
cagcuucugagcaagccagggg

SEQ ID NO: 166365 - RNA, 19 nt, Human
gcaggguguugacuguccc

SEQ ID NO: 166366 - RNA, 23 nt, Human
ugccucugccucccuagucugca

SEQ ID NO: 166367 - RNA, 17 nt, Human
gcuuccugugcugggga

SEQ ID NO: 166368 - RNA, 22 nt, Human
caagcccaggauuccccaguua

SEQ ID NO: 166369 - RNA, 22 nt, Human
ugaggccaaugacccugggcag

SEQ ID NO: 166370 - RNA, 22 nt, Human
ggcauggcucggagucagaaca

SEQ ID NO: 166371 - RNA, 22 nt, Human
aauguguacaugacagauagaa

SEQ ID NO: 166372 - RNA, 22 nt, Human
agagcuggauggucaagauggc

SEQ ID NO: 166373 - RNA, 22 nt, Human
acacagggcagagagcuggcuc

SEQ ID NO: 166374 - RNA, 22 nt, Human
cagguggcuucucccuaggcca

SEQ ID NO: 166375 - RNA, 22 nt, Human
aguuuuuccguggcuacgauaa

SEQ ID NO: 166376 - RNA, 22 nt, Human
aaaaguaauugaugcaaucgua

SEQ ID NO: 166377 - RNA, 22 nt, Human
cagugcaguugguggcaggggu

SEQ ID NO: 166378 - RNA, 22 nt, Human
gccaggugcuaucccugcgcug

SEQ ID NO: 166379 - RNA, 22 nt, Human
cugggcacaggggagcagaguc

SEQ ID NO: 166380 - RNA, 22 nt, Human
cagggcaguaacgggaacaucu

SEQ ID NO: 166381 - RNA, 22 nt, Human
ugagccaggcucaagugauccu

SEQ ID NO: 166382 - RNA, 22 nt, Human
auuuuuaugacaaaccauccuc

SEQ ID NO: 166383 - RNA, 22 nt, Human
accuggcacuacaggcaccugu

SEQ ID NO: 166384 - RNA, 22 nt, Human
agccuggccugggcaggcacau

SEQ ID NO: 166385 - RNA, 22 nt, Human
ccccagcucagugcagggacau

SEQ ID NO: 166386 - RNA, 22 nt, Human
ucagagccccuccgcuguccca

SEQ ID NO: 166387 - RNA, 22 nt, Human
agugcugaagacuggcuaggga

SEQ ID NO: 166388 - RNA, 22 nt, Human
gagcuucccucugcagucccug

SEQ ID NO: 166389 - RNA, 22 nt, Human
aggcccuguuaugagccacugu

SEQ ID NO: 166390 - RNA, 21 nt, Human
uggcacugcuuagcagguucc

SEQ ID NO: 166391 - RNA, 22 nt, Human
uaaaucucacuggguauauugg

SEQ ID NO: 166392 - RNA, 22 nt, Human
gcccucucuucugcagccucca

SEQ ID NO: 166393 - RNA, 22 nt, Human
aggccuggccugggcggcauug

SEQ ID NO: 166394 - RNA, 22 nt, Human
ugccugucucugacugccauua

SEQ ID NO: 166395 - RNA, 22 nt, Human
cacagccugcugcacucaagaa

SEQ ID NO: 166396 - RNA, 22 nt, Human
auguccuuugcuucucuggucc

SEQ ID NO: 166397 - RNA, 22 nt, Human
accaucaguacuggaugcugac

SEQ ID NO: 166398 - RNA, 22 nt, Human
cuccaggggccagaagccuggc

SEQ ID NO: 166399 - RNA, 19 nt, Human
gccucugcuggggacaggc

SEQ ID NO: 166400 - RNA, 22 nt, Human
uggcacugccaaccugcuaggu

SEQ ID NO: 166401 - RNA, 23 nt, Human
ggccucuguguucugcccacaug

SEQ ID NO: 166402 - RNA, 22 nt, Human
gcauuuagcuuuaaaauauuuc

SEQ ID NO: 166403 - RNA, 22 nt, Human
caguggugaagagcaggggcuc

SEQ ID NO: 166404 - RNA, 22 nt, Human
agagcugugcuuugcaccacgu

SEQ ID NO: 166405 - RNA, 23 nt, Human
auuugagaaaguauuuuuaagac

SEQ ID NO: 166406 - RNA, 22 nt, Human
ccugugaggucaucugugguaa

SEQ ID NO: 166407 - RNA, 22 nt, Human
cugugucccaguaccuugggua

SEQ ID NO: 166408 - RNA, 22 nt, Human
aacaaauguaaaaugcagaugc

SEQ ID NO: 166409 - RNA, 22 nt, Human
cagcuggcgggcagagccgcca

SEQ ID NO: 166410 - RNA, 22 nt, Human
acguuuucagugacugugcuuc

SEQ ID NO: 166411 - RNA, 22 nt, Human
gccagagccacuuuugggugau

SEQ ID NO: 166412 - RNA, 22 nt, Human
uaggccagaggagcagcuuugg

SEQ ID NO: 166413 - RNA, 22 nt, Human
agaaugcaagauaaacuuuauu

SEQ ID NO: 166414 - RNA, 22 nt, Human
aggccugagguuccugugcuca

SEQ ID NO: 166415 - RNA, 22 nt, Human
caguaugagaguugaaucaagg

SEQ ID NO: 166416 - RNA, 22 nt, Human
cacagggccuugugugacugca

SEQ ID NO: 166417 - RNA, 22 nt, Human
aaaggucaaaaucgugacauug

SEQ ID NO: 166418 - RNA, 22 nt, Human
cugcccugcuugaugacagcga

SEQ ID NO: 166419 - RNA, 22 nt, Human
gcagcuggcccugacacgcaga

SEQ ID NO: 166420 - RNA, 22 nt, Human
ugcuuccugaggccgucuucuc

SEQ ID NO: 166421 - RNA, 22 nt, Human
agccucugcuggcccuggcacu

SEQ ID NO: 166422 - RNA, 22 nt, Human
cagcuugggucaggugccugcu

SEQ ID NO: 166423 - RNA, 22 nt, Human
cugugugcugaaaugcagugag

SEQ ID NO: 166424 - RNA, 22 nt, Human
agguggggccaaaugcuacagu

SEQ ID NO: 166425 - RNA, 17 nt, Human
cugucugcgcaugaggu

SEQ ID NO: 166426 - RNA, 22 nt, Human
cugcucuguuucuuagcugggu

SEQ ID NO: 166427 - RNA, 22 nt, Human
cugccuggagcauucugaaggu

SEQ ID NO: 166428 - RNA, 22 nt, Human
caggaaagggaugggcugccac

SEQ ID NO: 166429 - RNA, 22 nt, Human
aaaucugggucaagguggagug

SEQ ID NO: 166430 - RNA, 22 nt, Human
ugucaugcuuauguuacauacu

SEQ ID NO: 166431 - RNA, 22 nt, Human
ucauacaucuuguauaucuauc

SEQ ID NO: 166432 - RNA, 22 nt, Human
agggcaaguugagugugcgugg

SEQ ID NO: 166433 - RNA, 20 nt, Human
caaugcacacagcugcuucu

SEQ ID NO: 166434 - RNA, 22 nt, Human
gaggggcucuugggcaugaagg

SEQ ID NO: 166435 - RNA, 22 nt, Human
aguguccccuacagaggcauuc

SEQ ID NO: 166436 - RNA, 22 nt, Human
gccaggcuggucuugaacuccu

SEQ ID NO: 166437 - RNA, 22 nt, Human
gcucugugggugaguagaaucu

SEQ ID NO: 166438 - RNA, 22 nt, Human
ccuggcagucaggggaguccuu

SEQ ID NO: 166439 - RNA, 22 nt, Human
ccuggagguggagguugcagug

SEQ ID NO: 166440 - RNA, 22 nt, Human
aaagguaguacuucuagaaggg

SEQ ID NO: 166441 - RNA, 22 nt, Human
cagcaagauuuuuaaagcaagg

SEQ ID NO: 166442 - RNA, 22 nt, Human
caggggcuuaagugacagaagg

SEQ ID NO: 166443 - RNA, 22 nt, Human
gccuggugcuaugagggccagc

SEQ ID NO: 166444 - RNA, 22 nt, Human
ggcagcucaccucugguccagg

SEQ ID NO: 166445 - RNA, 22 nt, Human
gcagcugagcgugaggaagagu

SEQ ID NO: 166446 - RNA, 22 nt, Human
gcagauggugggggaggaguac

SEQ ID NO: 166447 - RNA, 22 nt, Human
gcucacuggccugaagaggacg

SEQ ID NO: 166448 - RNA, 22 nt, Human
ggccuggccuccagaugugggc

SEQ ID NO: 166449 - RNA, 22 nt, Human
ugauuuccugugcgcccuuagg

SEQ ID NO: 166450 - RNA, 22 nt, Human
ugcucugguccucccucggcgc

SEQ ID NO: 166451 - RNA, 22 nt, Human
gggccugugcacaguucuguua

SEQ ID NO: 166452 - RNA, 22 nt, Human
ggucaggggcugcucuacagag

SEQ ID NO: 166453 - RNA, 22 nt, Human
ugaaaguugcacauaagagaau

SEQ ID NO: 166454 - RNA, 22 nt, Human
guuauaaaggugauaaugguca

SEQ ID NO: 166455 - RNA, 22 nt, Human
ccaggaggcagaaguugcagug

SEQ ID NO: 166456 - RNA, 22 nt, Human
cucuggaauguuuacaugcccu

SEQ ID NO: 166457 - RNA, 22 nt, Human
uacuuccagcaaucugcauauu

SEQ ID NO: 166458 - RNA, 22 nt, Human
uucaaucauuagaaucucaggc

SEQ ID NO: 166459 - RNA, 22 nt, Human
caggaugggugucggccagcac

SEQ ID NO: 166460 - RNA, 17 nt, Human
agagagagcaugccacc

SEQ ID NO: 166461 - RNA, 23 nt, Human
ucucagaggauuccugggccuug

SEQ ID NO: 166462 - RNA, 22 nt, Human
gaggccugucgcuaggccucug

SEQ ID NO: 166463 - RNA, 22 nt, Human
gcuuucucuucacugauguuca

SEQ ID NO: 166464 - RNA, 22 nt, Human
ggagaugguggaagcuggugca

SEQ ID NO: 166465 - RNA, 22 nt, Human
agaaugcuccagagcugaaaga

SEQ ID NO: 166466 - RNA, 22 nt, Human
ugcagcagacugaguaugagaa

SEQ ID NO: 166467 - RNA, 18 nt, Human
gcagagugcgucucugug

SEQ ID NO: 166468 - RNA, 22 nt, Human
acagccagggcauugucgccga

SEQ ID NO: 166469 - RNA, 22 nt, Human
uggccugggugcugcugacauc

SEQ ID NO: 166470 - RNA, 22 nt, Human
agccacagggggugagggacaa

SEQ ID NO: 166471 - RNA, 22 nt, Human
gucauuguguggacauggagaa

SEQ ID NO: 166472 - RNA, 22 nt, Human
gagauauguuagaaagcuauug

SEQ ID NO: 166473 - RNA, 22 nt, Human
agguaaagacugcaaggagaau

SEQ ID NO: 166474 - RNA, 22 nt, Human
agcagccagugggagugauaca

SEQ ID NO: 166475 - RNA, 22 nt, Human
uauaguacauggaaucuucaua

SEQ ID NO: 166476 - RNA, 20 nt, Human
ucagccagcuaacaugggga

SEQ ID NO: 166477 - RNA, 22 nt, Human
gccugccuggagcuugagguga

SEQ ID NO: 166478 - RNA, 22 nt, Human
gacaggguacgggcuaggcaca

SEQ ID NO: 166479 - RNA, 22 nt, Human
cuggcuccaucacugggugaug

SEQ ID NO: 166480 - RNA, 22 nt, Human
aggacugggugcagagggcauc

SEQ ID NO: 166481 - RNA, 22 nt, Human
ggcccugugguuuugcaaaguc

SEQ ID NO: 166482 - RNA, 22 nt, Human
ucaguaacuuacuuauucaccu

SEQ ID NO: 166483 - RNA, 22 nt, Human
ugugcccaucccucuggagugu

SEQ ID NO: 166484 - RNA, 22 nt, Human
cucaggauuaaggaaucuaaau

SEQ ID NO: 166485 - RNA, 23 nt, Human
gaagcagaugucugaguaggcag

SEQ ID NO: 166486 - RNA, 22 nt, Human
aucuacaggauuuuacagaguu

SEQ ID NO: 166487 - RNA, 22 nt, Human
cagcugaguuacucugaggucu

SEQ ID NO: 166488 - RNA, 22 nt, Human
uccugucugucuuuggucccuu

SEQ ID NO: 166489 - RNA, 22 nt, Human
ugccaggcauauggccucuuug

SEQ ID NO: 166490 - RNA, 22 nt, Human
aaucaguuguccaaaguucaca

SEQ ID NO: 166491 - RNA, 22 nt, Human
cagagacaguuucacagggucu

SEQ ID NO: 166492 - RNA, 23 nt, Human
ucuccagugucucuucauugagu

SEQ ID NO: 166493 - RNA, 22 nt, Human
aaagaaggaccuggaggaggau

SEQ ID NO: 166494 - RNA, 22 nt, Human
ggccucugggguccugagccca

SEQ ID NO: 166495 - RNA, 22 nt, Human
cagccagggucaggcagcuucu

SEQ ID NO: 166496 - RNA, 22 nt, Human
cucacaggcaucucaucaggcu

SEQ ID NO: 166497 - RNA, 22 nt, Human
uguguuccugccuggcucuggu

SEQ ID NO: 166498 - RNA, 22 nt, Human
cccaggaggcagagcuugcagu

SEQ ID NO: 166499 - RNA, 22 nt, Human
cucaggauuuaaaggggcacuc

SEQ ID NO: 166500 - RNA, 22 nt, Human
ucagggcauacucuucaagguc

SEQ ID NO: 166501 - RNA, 21 nt, Human
uuucugucucugccacuaguu

SEQ ID NO: 166502 - RNA, 22 nt, Human
uggccugggucacaccaggguc

SEQ ID NO: 166503 - RNA, 22 nt, Human
uaguuauuauuguuacuaucag

SEQ ID NO: 166504 - RNA, 22 nt, Human
auauucacugagcauaaagcca

SEQ ID NO: 166505 - RNA, 22 nt, Human
ccuccagcugccucagucucuu

SEQ ID NO: 166506 - RNA, 22 nt, Human
aaggucauuguugcauguucuc

SEQ ID NO: 166507 - RNA, 22 nt, Human
agggaggagaauggacuccuuc

SEQ ID NO: 166508 - RNA, 22 nt, Human
ccugggagguggagguugcagu

SEQ ID NO: 166509 - RNA, 21 nt, Human
accagcaggagaucagaagga

SEQ ID NO: 166510 - RNA, 22 nt, Human
agcaccugcuuaaugugcagug

SEQ ID NO: 166511 - RNA, 22 nt, Human
auauguguauuugguuagccua

SEQ ID NO: 166512 - RNA, 22 nt, Human
ccauuguaguaucuguuuuagu

SEQ ID NO: 166513 - RNA, 22 nt, Human
auguaucaacaaauuguacagu

SEQ ID NO: 166514 - RNA, 18 nt, Human
cugaaggauccaggugua

SEQ ID NO: 166515 - RNA, 22 nt, Human
auggacagugugucuguuucca

SEQ ID NO: 166516 - RNA, 22 nt, Human
gggagccaugcuggucuucuuu

SEQ ID NO: 166517 - RNA, 19 nt, Human
uucacauuggaagaaguag

SEQ ID NO: 166518 - RNA, 18 nt, Human
aucuuuccauagcauguu

SEQ ID NO: 166519 - RNA, 22 nt, Human
accaucagucauugucaguggg

SEQ ID NO: 166520 - RNA, 22 nt, Human
gaggacagcuuagggcuuccug

SEQ ID NO: 166521 - RNA, 22 nt, Human
aaguuauaucaucucauugacg

SEQ ID NO: 166522 - RNA, 22 nt, Human
gugcuaggauuacaggcauggg

SEQ ID NO: 166523 - RNA, 22 nt, Human
agcugcucccuauccuuuccuu

SEQ ID NO: 166524 - RNA, 22 nt, Human
aaagguuaagguguucaagaaa

SEQ ID NO: 166525 - RNA, 18 nt, Human
cccagcccaccauuucuc

SEQ ID NO: 166526 - RNA, 22 nt, Human
ugccugucuuggaguccuggcc

SEQ ID NO: 166527 - RNA, 22 nt, Human
agggccugagcuggcugaccuc

SEQ ID NO: 166528 - RNA, 22 nt, Human
aaaucagucccucuuggaauuu

SEQ ID NO: 166529 - RNA, 22 nt, Human
agagcugaggauccagcugagc

SEQ ID NO: 166530 - RNA, 22 nt, Human
ggugacuggagggacccaggcc

SEQ ID NO: 166531 - RNA, 22 nt, Human
ugcugggcuagaagcugaggcc

SEQ ID NO: 166532 - RNA, 22 nt, Human
cucaggauauugggcuggagca

SEQ ID NO: 166533 - RNA, 22 nt, Human
auggcagcaaaugucuggcugg

SEQ ID NO: 166534 - RNA, 22 nt, Human
acaaaaguguaggaauuccuua

SEQ ID NO: 166535 - RNA, 22 nt, Human
ggaaggucgagcugcaucuggc

SEQ ID NO: 166536 - RNA, 22 nt, Human
ugucucugugacuccuuccgcc

SEQ ID NO: 166537 - RNA, 22 nt, Human
cuguguggccucaagccagccu

SEQ ID NO: 166538 - RNA, 22 nt, Human
gcccagcugcacccuggugggu

SEQ ID NO: 166539 - RNA, 22 nt, Human
cugggcuggagugcaauggcgc

SEQ ID NO: 166540 - RNA, 22 nt, Human
gugaggugggcuggccagagac

SEQ ID NO: 166541 - RNA, 22 nt, Human
cugcagugcaagcccagaugga

SEQ ID NO: 166542 - RNA, 22 nt, Human
uucaaugaggauagaacuggau

SEQ ID NO: 166543 - RNA, 23 nt, Human
aggaggccugaaacugaggcuga

SEQ ID NO: 166544 - RNA, 22 nt, Human
gaggcugcaggcaaugcugccc

SEQ ID NO: 166545 - RNA, 22 nt, Human
ggcagcuggccuccucgcccac

SEQ ID NO: 166546 - RNA, 22 nt, Human
aagaugauagaucugucaaugu

SEQ ID NO: 166547 - RNA, 22 nt, Human
ugggcagacauugaguuuguuc

SEQ ID NO: 166548 - RNA, 22 nt, Human
cagggcugugcccaucuucccc

SEQ ID NO: 166549 - RNA, 22 nt, Human
uuugaaaauuuaagugcuacac

SEQ ID NO: 166550 - RNA, 21 nt, Human
agguggggcugcaccucugcu

SEQ ID NO: 166551 - RNA, 19 nt, Human
uacauuuguguacacuugu

SEQ ID NO: 166552 - RNA, 22 nt, Human
ugcuggccaauggcagaggcgg

SEQ ID NO: 166553 - RNA, 22 nt, Human
caggaggaacaagagguucugg

SEQ ID NO: 166554 - RNA, 22 nt, Human
uucaagauggcugcaaauacuu

SEQ ID NO: 166555 - RNA, 22 nt, Human
gccugccuucggugcgcagcgg

SEQ ID NO: 166556 - RNA, 22 nt, Human
gcugcucuggcucugcaguguc

SEQ ID NO: 166557 - RNA, 22 nt, Human
gggcuggaggaccggccucgga

SEQ ID NO: 166558 - RNA, 22 nt, Human
uugaaaggcacaggcaccuggg

SEQ ID NO: 166559 - RNA, 22 nt, Human
aaugaugggaaggagaaaagca

SEQ ID NO: 166560 - RNA, 22 nt, Human
auuuuucucuccacuccauuaa

SEQ ID NO: 166561 - RNA, 22 nt, Human
ggaugcuggggaccaaucucug

SEQ ID NO: 166562 - RNA, 22 nt, Human
ugggcugcuuccucagcugaga

SEQ ID NO: 166563 - RNA, 22 nt, Human
gggcugcugccaccagguggau

SEQ ID NO: 166564 - RNA, 22 nt, Human
agagcuggaaucagaccucagg

SEQ ID NO: 166565 - RNA, 22 nt, Human
caggguacagaguuuucuaaac

SEQ ID NO: 166566 - RNA, 21 nt, Human
cucuggagucaagagcuucca

SEQ ID NO: 166567 - RNA, 22 nt, Human
agggcugcuauguugauucaga

SEQ ID NO: 166568 - RNA, 22 nt, Human
ucuucuuccucauuuauacaua

SEQ ID NO: 166569 - RNA, 22 nt, Human
cugggccucaaucucagaguuu

SEQ ID NO: 166570 - RNA, 22 nt, Human
gcacagaacuucucuuaguagg

SEQ ID NO: 166571 - RNA, 22 nt, Human
gaaaguuucuucauuaagaugu

SEQ ID NO: 166572 - RNA, 22 nt, Human
augccaggccccacgcugggca

SEQ ID NO: 166573 - RNA, 22 nt, Human
ucagcagaggggaaggcaucug

SEQ ID NO: 166574 - RNA, 22 nt, Human
ucuggcucauaggaaggccauu

SEQ ID NO: 166575 - RNA, 22 nt, Human
cagggccagagagggcuggcug

SEQ ID NO: 166576 - RNA, 22 nt, Human
cccagcucuuuuagcggcaucu

SEQ ID NO: 166577 - RNA, 22 nt, Human
ucagaggucccuagcaggagug

SEQ ID NO: 166578 - RNA, 22 nt, Human
uucaagaucuuccaaaggauac

SEQ ID NO: 166579 - RNA, 22 nt, Human
agggccagcacuccuggcagga

SEQ ID NO: 166580 - RNA, 22 nt, Human
guagcuuauuagggauaauagu

SEQ ID NO: 166581 - RNA, 22 nt, Human
ugcuggcuggccuggccuggac

SEQ ID NO: 166582 - RNA, 22 nt, Human
ugcaccugagaggucucugagg

SEQ ID NO: 166583 - RNA, 22 nt, Human
cagcuugcaguacuuguuuuug

SEQ ID NO: 166584 - RNA, 22 nt, Human
agauacauuguucuaagcauug

SEQ ID NO: 166585 - RNA, 22 nt, Human
caauaauauccugugcuguuug

SEQ ID NO: 166586 - RNA, 22 nt, Human
uuuccaauaaagugucauuguu

SEQ ID NO: 166587 - RNA, 19 nt, Human
uccucaggggcucacagac

SEQ ID NO: 166588 - RNA, 21 nt, Human
acaggcuuuagaaaaugacuc

SEQ ID NO: 166589 - RNA, 22 nt, Human
gaaauguguuguucauuucuaa

SEQ ID NO: 166590 - RNA, 22 nt, Human
ucugagaguagagcugccucuu

SEQ ID NO: 166591 - RNA, 22 nt, Human
ucugcagcuuuuugguggggug

SEQ ID NO: 166592 - RNA, 22 nt, Human
cccucccaggaguggccagaga

SEQ ID NO: 166593 - RNA, 22 nt, Human
accagccugucugagucguggg

SEQ ID NO: 166594 - RNA, 22 nt, Human
aaaugcacagaggccagagagg

SEQ ID NO: 166595 - RNA, 22 nt, Human
gcaggagcccuggcauguucuu

SEQ ID NO: 166596 - RNA, 22 nt, Human
gggaggcuggcucuggccacag

SEQ ID NO: 166597 - RNA, 22 nt, Human
cugucaguaggcucccaucauu

SEQ ID NO: 166598 - RNA, 22 nt, Human
gaggcugguaggaaaggaaaca

SEQ ID NO: 166599 - RNA, 22 nt, Human
cuguagcaaguuauucaauaaa

SEQ ID NO: 166600 - RNA, 22 nt, Human
ccuuggcuuaccuucugugugg

SEQ ID NO: 166601 - RNA, 22 nt, Human
aguguauucugcaugggagacu

SEQ ID NO: 166602 - RNA, 22 nt, Human
ugucuucauuccccaugaaguc

SEQ ID NO: 166603 - RNA, 22 nt, Human
ggcaucagcccgguccugggcu

SEQ ID NO: 166604 - RNA, 22 nt, Human
augcugccuccucuucagccgc

SEQ ID NO: 166605 - RNA, 22 nt, Human
accuuguuguagguacaaaaga

SEQ ID NO: 166606 - RNA, 23 nt, Human
cuguggaucuagagggggcccua

SEQ ID NO: 166607 - RNA, 22 nt, Human
gugaagaugccucaggugaccc

SEQ ID NO: 166608 - RNA, 19 nt, Human
ugcagcuguaugagcuuaa

SEQ ID NO: 166609 - RNA, 22 nt, Human
agggcacuuccucugggucccu

SEQ ID NO: 166610 - RNA, 22 nt, Human
uuaaaagaauccuguuauccuc

SEQ ID NO: 166611 - RNA, 22 nt, Human
uggcggugacggcggcgccugg

SEQ ID NO: 166612 - RNA, 22 nt, Human
agguggcagacuaacagaagga

SEQ ID NO: 166613 - RNA, 22 nt, Human
ccagguggacggcgaguacagg

SEQ ID NO: 166614 - RNA, 19 nt, Human
gcagcugugggaagagcca

SEQ ID NO: 166615 - RNA, 22 nt, Human
cagcuuuugcagacuucuugcc

SEQ ID NO: 166616 - RNA, 22 nt, Human
gcacugccugugagcccugguu

SEQ ID NO: 166617 - RNA, 22 nt, Human
ggcagguguuuuuauauuaaag

SEQ ID NO: 166618 - RNA, 22 nt, Human
caguguuuagcacagugcuugg

SEQ ID NO: 166619 - RNA, 22 nt, Human
ggcagguguggugaccagagau

SEQ ID NO: 166620 - RNA, 21 nt, Human
ucauccagguccugcuucuuc

SEQ ID NO: 166621 - RNA, 22 nt, Human
guuaaaugcagauucugacuca

SEQ ID NO: 166622 - RNA, 22 nt, Human
ugcaugcagcuggucgggcgcc

SEQ ID NO: 166623 - RNA, 18 nt, Human
uggcaugcuuugauacau

SEQ ID NO: 166624 - RNA, 22 nt, Human
uuacuguagcuugacauauguc

SEQ ID NO: 166625 - RNA, 22 nt, Human
ucuuccagauacuuccugacuu

SEQ ID NO: 166626 - RNA, 22 nt, Human
ugacauccuacaccccuggguc

SEQ ID NO: 166627 - RNA, 21 nt, Human
gcugcucgagauccagugcuu

SEQ ID NO: 166628 - RNA, 22 nt, Human
ccacuuugagaagcugaugaaa

SEQ ID NO: 166629 - RNA, 18 nt, Human
uggucacuguggauagug

SEQ ID NO: 166630 - RNA, 22 nt, Human
aacacauggcaagagcaggaaa

SEQ ID NO: 166631 - RNA, 22 nt, Human
uagugucuuccaggacauggua

SEQ ID NO: 166632 - RNA, 22 nt, Human
cuggagggcugcagcgaggcug

SEQ ID NO: 166633 - RNA, 16 nt, Human
gcagguggggcgcgca

SEQ ID NO: 166634 - RNA, 22 nt, Human
ucaccucucuggccgucuaccu

SEQ ID NO: 166635 - RNA, 22 nt, Human
uuugacuccuguguuucuggaa

SEQ ID NO: 166636 - RNA, 22 nt, Human
cucagcaacccacacacggucu

SEQ ID NO: 166637 - RNA, 22 nt, Human
agguggcuaugaggaugcaguc

SEQ ID NO: 166638 - RNA, 22 nt, Human
uguaauguuagaaacaauugcu

SEQ ID NO: 166639 - RNA, 22 nt, Human
guccuggugcuggucauugucg

SEQ ID NO: 166640 - RNA, 22 nt, Human
cacaauuuccauugagcagcag

SEQ ID NO: 166641 - RNA, 22 nt, Human
gauggcgguggccaccuccuug

SEQ ID NO: 166642 - RNA, 22 nt, Human
acugugacugugucuucugggc

SEQ ID NO: 166643 - RNA, 22 nt, Human
uaguguguggucucucccuugu

SEQ ID NO: 166644 - RNA, 22 nt, Human
guguuuugugaggccuucuuuc

SEQ ID NO: 166645 - RNA, 20 nt, Human
uucaugcagugguugcugug

SEQ ID NO: 166646 - RNA, 22 nt, Human
cagcugcucugguggucucucc

SEQ ID NO: 166647 - RNA, 22 nt, Human
gugcaggugguuggcccagccg

SEQ ID NO: 166648 - RNA, 22 nt, Human
ucaucuccauacggucucgcag

SEQ ID NO: 166649 - RNA, 22 nt, Human
uaauucuagauugacauuuuga

SEQ ID NO: 166650 - RNA, 22 nt, Human
cagggcuccccagagagccucu

SEQ ID NO: 166651 - RNA, 22 nt, Human
uaggcacugguuguggauaguu

SEQ ID NO: 166652 - RNA, 22 nt, Human
ccuguacuuguauuaaaggucc

SEQ ID NO: 166653 - RNA, 22 nt, Human
uaacuaggauuacaagcgugcg

SEQ ID NO: 166654 - RNA, 18 nt, Human
agggcugaugaguuuggg

SEQ ID NO: 166655 - RNA, 22 nt, Human
cuucuucagaggccagccucug

SEQ ID NO: 166656 - RNA, 22 nt, Human
uugcaggucuggggguccuggu

SEQ ID NO: 166657 - RNA, 22 nt, Human
aucugccuggcuccaggugagc

SEQ ID NO: 166658 - RNA, 22 nt, Human
uguccuguccuuccuggaaguc

SEQ ID NO: 166659 - RNA, 20 nt, Human
ccagguggugccuggagagg

SEQ ID NO: 166660 - RNA, 22 nt, Human
ugucaaguuguuaaguucuggg

SEQ ID NO: 166661 - RNA, 22 nt, Human
cugggugagcuggccagagggu

SEQ ID NO: 166662 - RNA, 22 nt, Human
uucaaacacugcuuugagaggg

SEQ ID NO: 166663 - RNA, 23 nt, Human
cagcugguugugggaguggcugc

SEQ ID NO: 166664 - RNA, 22 nt, Human
agguuaggaaugggagguaaug

SEQ ID NO: 166665 - RNA, 22 nt, Human
ugcugcacuuauggcucugagg

SEQ ID NO: 166666 - RNA, 17 nt, Human
uuucugcaugauuggac

SEQ ID NO: 166667 - RNA, 22 nt, Human
acaguguuacuugauaguguau

SEQ ID NO: 166668 - RNA, 22 nt, Human
gccagagggauuccuggugugu

SEQ ID NO: 166669 - RNA, 22 nt, Human
gguggcaagggcagccaguaac

SEQ ID NO: 166670 - RNA, 22 nt, Human
uuucugcagcagacucagugug

SEQ ID NO: 166671 - RNA, 22 nt, Human
uggcagugugggaggaagguac

SEQ ID NO: 166672 - RNA, 22 nt, Human
cagguuagcaacaugguuagag

SEQ ID NO: 166673 - RNA, 22 nt, Human
ccucuucagcaaaguucggccc

SEQ ID NO: 166674 - RNA, 22 nt, Human
ucucugguuaugucauuaagca

SEQ ID NO: 166675 - RNA, 22 nt, Human
gaucggguggguucugccauca

SEQ ID NO: 166676 - RNA, 22 nt, Human
ggcuggccuguguggccgccac

SEQ ID NO: 166677 - RNA, 22 nt, Human
gcagagcugguacuugagccug

SEQ ID NO: 166678 - RNA, 22 nt, Human
cuuugcagagggggugggagcu

SEQ ID NO: 166679 - RNA, 22 nt, Human
acacauggucuacuucuucuca

SEQ ID NO: 166680 - RNA, 22 nt, Human
guucuucagauuccauuucagu

SEQ ID NO: 166681 - RNA, 22 nt, Human
uucucaggaacucagugucagc

SEQ ID NO: 166682 - RNA, 22 nt, Human
aggcuguccucucuugcucagu

SEQ ID NO: 166683 - RNA, 21 nt, Human
gcuccuggugcugcguggcgc

SEQ ID NO: 166684 - RNA, 22 nt, Human
gucaucaucaggcagaugcugc

SEQ ID NO: 166685 - RNA, 22 nt, Human
ucuucaugaaauugauugcuua

SEQ ID NO: 166686 - RNA, 22 nt, Human
gcugggugauucauuuccauaa

SEQ ID NO: 166687 - RNA, 22 nt, Human
ggcaguggcuccucucuacucc

SEQ ID NO: 166688 - RNA, 22 nt, Human
cccagcugaacuugcauuccaa

SEQ ID NO: 166689 - RNA, 22 nt, Human
acuguagucuaaauauagucuu

SEQ ID NO: 166690 - RNA, 22 nt, Human
gcaguuaccuauuuuguagaaa

SEQ ID NO: 166691 - RNA, 22 nt, Human
aguguucuagcgcugugcuugu

SEQ ID NO: 166692 - RNA, 22 nt, Human
gcugcagggagcuggaaggcuc

SEQ ID NO: 166693 - RNA, 22 nt, Human
ugggugaagaggcuaugcuacu

SEQ ID NO: 166694 - RNA, 22 nt, Human
ugaguguuguaaccauaugauu

SEQ ID NO: 166695 - RNA, 22 nt, Human
ucaugcagaguagaaagggcaa

SEQ ID NO: 166696 - RNA, 22 nt, Human
uggcaugcaagaggaggcuccc

SEQ ID NO: 166697 - RNA, 22 nt, Human
ucuucaugucaugguauauuga

SEQ ID NO: 166698 - RNA, 22 nt, Human
gcaugcaggaagggcuugggga

SEQ ID NO: 166699 - RNA, 20 nt, Human
agcuggcccccgguggccug

SEQ ID NO: 166700 - RNA, 22 nt, Human
gcuggguggaucggaggcucug

SEQ ID NO: 166701 - RNA, 22 nt, Human
guccuggugccaccugcgggau

SEQ ID NO: 166702 - RNA, 22 nt, Human
cugcacagccugucugggggcc

SEQ ID NO: 166703 - RNA, 22 nt, Human
ggcuucuuagaauuugacuuac

SEQ ID NO: 166704 - RNA, 22 nt, Human
ucaugcagauaagaauaaguaa

SEQ ID NO: 166705 - RNA, 22 nt, Human
uggaagguguggcaggucuagu

SEQ ID NO: 166706 - RNA, 22 nt, Human
ggggugaagguuuucugaaagc

SEQ ID NO: 166707 - RNA, 23 nt, Human
uggcucuguggaucccucaggag

SEQ ID NO: 166708 - RNA, 21 nt, Human
gacauugagcgugucgcagug

SEQ ID NO: 166709 - RNA, 22 nt, Human
gagcaccgccuccacgaugccc

SEQ ID NO: 166710 - RNA, 22 nt, Human
uggcuccaggggacacgcagua

SEQ ID NO: 166711 - RNA, 23 nt, Human
uggcucugagcuuccugguggcc

SEQ ID NO: 166712 - RNA, 22 nt, Human
ugcccugcagacccugcagugu

SEQ ID NO: 166713 - RNA, 22 nt, Human
auggugguagaagcacuaugug

SEQ ID NO: 166714 - RNA, 22 nt, Human
ccagaacagaccugccugaccu

SEQ ID NO: 166715 - RNA, 22 nt, Human
cacuuggaggaaggccuauuca

SEQ ID NO: 166716 - RNA, 22 nt, Human
ggugaccucaccuggucccacc

SEQ ID NO: 166717 - RNA, 22 nt, Human
uuuguugguugcacuggugggu

SEQ ID NO: 166718 - RNA, 22 nt, Human
gcccagaguuugaagauacagu

SEQ ID NO: 166719 - RNA, 22 nt, Human
gugggugucaguaucuuuaacg

SEQ ID NO: 166720 - RNA, 22 nt, Human
uggcacugaagcuggaaagccu

SEQ ID NO: 166721 - RNA, 18 nt, Human
gugacugccccaaaaggc

SEQ ID NO: 166722 - RNA, 22 nt, Human
augcccugggagugcuguacca

SEQ ID NO: 166723 - RNA, 22 nt, Human
ugcagguggcagcggggcacca

SEQ ID NO: 166724 - RNA, 22 nt, Human
gacaguggagccacguugggag

SEQ ID NO: 166725 - RNA, 22 nt, Human
cucagcaacagcgacuuaaggg

SEQ ID NO: 166726 - RNA, 22 nt, Human
guucuucagcccucagguccua

SEQ ID NO: 166727 - RNA, 22 nt, Human
gccagguaugaauuacgcacga

SEQ ID NO: 166728 - RNA, 22 nt, Human
uccugcagccauuagaggucaa

SEQ ID NO: 166729 - RNA, 22 nt, Human
ugcacauggccugagugccuga

SEQ ID NO: 166730 - RNA, 22 nt, Human
aucaugcagcaacaagcaaggc

SEQ ID NO: 166731 - RNA, 22 nt, Human
augcauugaggaugacaugagu

SEQ ID NO: 166732 - RNA, 22 nt, Human
gcuguaacuuuuucauuuucaa

SEQ ID NO: 166733 - RNA, 22 nt, Human
cccacaggcaggugcaugggcu

SEQ ID NO: 166734 - RNA, 22 nt, Human
ugcauuucccauuguguggcuc

SEQ ID NO: 166735 - RNA, 19 nt, Human
ugguucuccuuccacaguc

SEQ ID NO: 166736 - RNA, 22 nt, Human
agugauguagguggauucuggc

SEQ ID NO: 166737 - RNA, 21 nt, Human
ugacaguguggcauggaaggu

SEQ ID NO: 166738 - RNA, 22 nt, Human
guuuuguucaugaacauugggu

SEQ ID NO: 166739 - RNA, 23 nt, Human
ugacacccucauugugugucgca

SEQ ID NO: 166740 - RNA, 22 nt, Human
aggacagcagugcuggcacuug

SEQ ID NO: 166741 - RNA, 22 nt, Human
ccugugguuuacucuguggcua

SEQ ID NO: 166742 - RNA, 22 nt, Human
aggcugucucaccucaggaggg

SEQ ID NO: 166743 - RNA, 22 nt, Human
ugcauuugcaauggguacacaa

SEQ ID NO: 166744 - RNA, 22 nt, Human
gaccaggagauuugagcuaggc

SEQ ID NO: 166745 - RNA, 17 nt, Human
ucuggaugucauggaag

SEQ ID NO: 166746 - RNA, 20 nt, Human
uugagcagcagugcuguguc

SEQ ID NO: 166747 - RNA, 22 nt, Human
caugugguauugugagauccac

SEQ ID NO: 166748 - RNA, 22 nt, Human
ucaugauaauacaggccuucua

SEQ ID NO: 166749 - RNA, 22 nt, Human
cugucaccucugcccuuugccc

SEQ ID NO: 166750 - RNA, 22 nt, Human
cucucuccuuagcugcagacca

SEQ ID NO: 166751 - RNA, 22 nt, Human
uugagcagaucgggcugugggg

SEQ ID NO: 166752 - RNA, 22 nt, Human
gaugggcaucaaacaugacgug

SEQ ID NO: 166753 - RNA, 22 nt, Human
ugcagcugccuagggcuggcuu

SEQ ID NO: 166754 - RNA, 17 nt, Human
ggugaguguccaggugg

SEQ ID NO: 166755 - RNA, 22 nt, Human
ucccucugcuagugcuugagcu

SEQ ID NO: 166756 - RNA, 21 nt, Human
agcauucaaaagaugccauaa

SEQ ID NO: 166757 - RNA, 22 nt, Human
cuggagaacagagcuguuuaga

SEQ ID NO: 166758 - RNA, 22 nt, Human
ccaugcagugcuggagcugauu

SEQ ID NO: 166759 - RNA, 22 nt, Human
ugugcugcucucagugacagcc

SEQ ID NO: 166760 - RNA, 22 nt, Human
gcccucugguggccgccucggc

SEQ ID NO: 166761 - RNA, 22 nt, Human
cuguaaccuccucuuuccauuc

SEQ ID NO: 166762 - RNA, 22 nt, Human
cuucaugcugauauccucgaug

SEQ ID NO: 166763 - RNA, 22 nt, Human
ggcagcugaagaggaacuuugg

SEQ ID NO: 166764 - RNA, 22 nt, Human
uauagugucucuagaucaaaga

SEQ ID NO: 166765 - RNA, 22 nt, Human
caggugggagccacagcguaca

SEQ ID NO: 166766 - RNA, 22 nt, Human
gcaucugauccaauagauauau

SEQ ID NO: 166767 - RNA, 22 nt, Human
ucuccaggcuuaaucucagcuu

SEQ ID NO: 166768 - RNA, 22 nt, Human
aguggguguagucuuccuccug

SEQ ID NO: 166769 - RNA, 22 nt, Human
uuugagugcccauguuucccag

SEQ ID NO: 166770 - RNA, 22 nt, Human
cuguuuauucucaucuaaaaug

SEQ ID NO: 166771 - RNA, 22 nt, Human
auuguauacaagcuuaauuguu

SEQ ID NO: 166772 - RNA, 22 nt, Human
cccugccuacaggguuuucuuu

SEQ ID NO: 166773 - RNA, 22 nt, Human
acucaucuuugaauuuucagua

SEQ ID NO: 166774 - RNA, 22 nt, Human
gagcagcagcugggccagguuc

SEQ ID NO: 166775 - RNA, 22 nt, Human
cauuguccucugaugccuuccc

SEQ ID NO: 166776 - RNA, 22 nt, Human
ucugggugucacuccugccugc

SEQ ID NO: 166777 - RNA, 22 nt, Human
guuguacauaugaggauaaguu

SEQ ID NO: 166778 - RNA, 22 nt, Human
gagccacaguggauugauucca

SEQ ID NO: 166779 - RNA, 23 nt, Human
ucuggcugcuccuuucaaugcuc

SEQ ID NO: 166780 - RNA, 22 nt, Human
uuuuuugucuugaagaaauggu

SEQ ID NO: 166781 - RNA, 22 nt, Human
ucuucaugucucugcuugaguc

SEQ ID NO: 166782 - RNA, 21 nt, Human
ccaugucagaugugggcugug

SEQ ID NO: 166783 - RNA, 22 nt, Human
acagacuccccagguuaucuca

SEQ ID NO: 166784 - RNA, 22 nt, Human
ggcagccuccagggcacuggug

SEQ ID NO: 166785 - RNA, 22 nt, Human
gccugaucagguccucggcaua

SEQ ID NO: 166786 - RNA, 19 nt, Human
gagcagcuuccuaucuggu

SEQ ID NO: 166787 - RNA, 22 nt, Human
uccuggguccauggcagccgaa

SEQ ID NO: 166788 - RNA, 22 nt, Human
auucaugcaggauugucuccaa

SEQ ID NO: 166789 - RNA, 22 nt, Human
uuugacucugggugcuuuuucg

SEQ ID NO: 166790 - RNA, 22 nt, Human
caggcuugaugugucuauacuu

SEQ ID NO: 166791 - RNA, 22 nt, Human
auguacauuauucgagugaugg

SEQ ID NO: 166792 - RNA, 22 nt, Human
gugcaaagcuuaacauucugca

SEQ ID NO: 166793 - RNA, 22 nt, Human
gcagcugcgaagaagucuaucu

SEQ ID NO: 166794 - RNA, 22 nt, Human
cucugcaggcacccaggguggg

SEQ ID NO: 166795 - RNA, 20 nt, Human
agugauuuguuaguacauug

SEQ ID NO: 166796 - RNA, 22 nt, Human
gcagcugccgugagcucacgcc

SEQ ID NO: 166797 - RNA, 22 nt, Human
gcaguggccacauggaggagga

SEQ ID NO: 166798 - RNA, 22 nt, Human
ucaggaugagucaucaagcugc

SEQ ID NO: 166799 - RNA, 22 nt, Human
guuaaugcaaagcagagggcaa

SEQ ID NO: 166800 - RNA, 21 nt, Human
uggagagugauuucagugugg

SEQ ID NO: 166801 - RNA, 22 nt, Human
agcaggugucacuuucacucca

SEQ ID NO: 166802 - RNA, 22 nt, Human
aguguuaaggcugguugcuaua

SEQ ID NO: 166803 - RNA, 22 nt, Human
ucucauacguuuccagguguca

SEQ ID NO: 166804 - RNA, 22 nt, Human
aagcagccagccaucaugcccg

SEQ ID NO: 166805 - RNA, 22 nt, Human
ugcagcaucuccuugugccaug

SEQ ID NO: 166806 - RNA, 22 nt, Human
cugcaucaguggauaugauggu

SEQ ID NO: 166807 - RNA, 23 nt, Human
acucugacuuaguuauagcuauu

SEQ ID NO: 166808 - RNA, 22 nt, Human
ugggcacacugaaucugcuauu

SEQ ID NO: 166809 - RNA, 22 nt, Human
auccgcuuaucucagcuggcag

SEQ ID NO: 166810 - RNA, 22 nt, Human
cuucuccgacaaccgacgccgg

SEQ ID NO: 166811 - RNA, 22 nt, Human
aaacuagguucugauuuccaag

SEQ ID NO: 166812 - RNA, 22 nt, Human
guucaaccaugauuaggaacug

SEQ ID NO: 166813 - RNA, 22 nt, Human
uucuguucccuaggaccugggg

SEQ ID NO: 166814 - RNA, 22 nt, Human
uugcaggguugacacugccugc

SEQ ID NO: 166815 - RNA, 22 nt, Human
ggcucagaaaccucuggugucu

SEQ ID NO: 166816 - RNA, 22 nt, Human
acaaagugaaaagcaucgaauu

SEQ ID NO: 166817 - RNA, 22 nt, Human
ccagcuugcuccucugcaaugg

SEQ ID NO: 166818 - RNA, 21 nt, Human
gcccacagugaggaggauccc

SEQ ID NO: 166819 - RNA, 22 nt, Human
cuugaggcugcacuccagggcc

SEQ ID NO: 166820 - RNA, 22 nt, Human
gcugcaagugcauguugcaacu

SEQ ID NO: 166821 - RNA, 22 nt, Human
cucaugucggcaggacucgccc

SEQ ID NO: 166822 - RNA, 22 nt, Human
cuaggugauccacugcucucuu

SEQ ID NO: 166823 - RNA, 22 nt, Human
acuuggucguggugcagcaugg

SEQ ID NO: 166824 - RNA, 22 nt, Human
uauaagaaacaaggcaaauuuu

SEQ ID NO: 166825 - RNA, 22 nt, Human
auccuaaagcagacagcagguu

SEQ ID NO: 166826 - RNA, 22 nt, Human
ggugcggagacuccaugaggcc

SEQ ID NO: 166827 - RNA, 18 nt, Human
auuugcaggcaugcaggc

SEQ ID NO: 166828 - RNA, 22 nt, Human
ccuugcagcauauagagucccu

SEQ ID NO: 166829 - RNA, 22 nt, Human
ugcuucucucuaggaagacgcu

SEQ ID NO: 166830 - RNA, 22 nt, Human
augacagcucuagcacacagua

SEQ ID NO: 166831 - RNA, 23 nt, Human
aguguucagcauguaguaaauac

SEQ ID NO: 166832 - RNA, 22 nt, Human
gaacugcauugugguauauguu

SEQ ID NO: 166833 - RNA, 22 nt, Human
uggcucugccccauaccccugc

SEQ ID NO: 166834 - RNA, 23 nt, Human
ugucuggauucgacugugguugg

SEQ ID NO: 166835 - RNA, 22 nt, Human
uacguuuuaaacacggagccag

SEQ ID NO: 166836 - RNA, 22 nt, Human
uacagccuggcacuacccuggg

SEQ ID NO: 166837 - RNA, 22 nt, Human
ccugguguuaucauaggucaug

SEQ ID NO: 166838 - RNA, 19 nt, Human
agcaguggagccaugccug

SEQ ID NO: 166839 - RNA, 22 nt, Human
caggguggcaggcaccauggcc

SEQ ID NO: 166840 - RNA, 21 nt, Human
cugcacugugauuuaaaaugu

SEQ ID NO: 166841 - RNA, 22 nt, Human
gcagcucucuggccugcccugg

SEQ ID NO: 166842 - RNA, 22 nt, Human
gcuucugcagagccguccugag

SEQ ID NO: 166843 - RNA, 22 nt, Human
caggucuucuucagcacuugga

SEQ ID NO: 166844 - RNA, 22 nt, Human
uuuauacuccacucugcaagcg

SEQ ID NO: 166845 - RNA, 22 nt, Human
cugauggagagugugauuuggg

SEQ ID NO: 166846 - RNA, 22 nt, Human
ugcaugguguaauucuaaugcu

SEQ ID NO: 166847 - RNA, 22 nt, Human
uaucuguagucucaugguuccu

SEQ ID NO: 166848 - RNA, 23 nt, Human
acugccugugccgaucucucuca

SEQ ID NO: 166849 - RNA, 23 nt, Human
uguguucagucaaggaucagagu

SEQ ID NO: 166850 - RNA, 22 nt, Human
ccaggaugacccccacuuuccu

SEQ ID NO: 166851 - RNA, 20 nt, Human
ggucacuguggcugcaggau

SEQ ID NO: 166852 - RNA, 22 nt, Human
acaugcauaaacuacuucuuau

SEQ ID NO: 166853 - RNA, 22 nt, Human
cgcagcugcugcucugaaacag

SEQ ID NO: 166854 - RNA, 22 nt, Human
cgcaggugccggcagauggggu

SEQ ID NO: 166855 - RNA, 22 nt, Human
gaugucuggcuaccacucgcac

SEQ ID NO: 166856 - RNA, 22 nt, Human
uuccaaguuaggcgagcuggug

SEQ ID NO: 166857 - RNA, 22 nt, Human
uggcacugucaccaaugcuguc

SEQ ID NO: 166858 - RNA, 22 nt, Human
ggugggugagcccugggagcug

SEQ ID NO: 166859 - RNA, 22 nt, Human
ccuggauucucacuggacucca

SEQ ID NO: 166860 - RNA, 22 nt, Human
ucuuauaccccuaaacugcagc

SEQ ID NO: 166861 - RNA, 22 nt, Human
gcagcuuuggagguggaacucu

SEQ ID NO: 166862 - RNA, 22 nt, Human
guucuucaggcugugcucuaga

SEQ ID NO: 166863 - RNA, 22 nt, Human
gugcagcugguggagucugggg

SEQ ID NO: 166864 - RNA, 22 nt, Human
gcugauggcuugcuggcugaca

SEQ ID NO: 166865 - RNA, 22 nt, Human
uguaaagaaagacgcagaguua

SEQ ID NO: 166866 - RNA, 22 nt, Human
gcaggccuccccugcuggagcu

SEQ ID NO: 166867 - RNA, 22 nt, Human
ugauuugaaaccuuuggcaaga

SEQ ID NO: 166868 - RNA, 22 nt, Human
gugauuucagguuuuucauacu

SEQ ID NO: 166869 - RNA, 22 nt, Human
auaggcauaacacugauguccu

SEQ ID NO: 166870 - RNA, 22 nt, Human
auuaguguuguggcuucauggc

SEQ ID NO: 166871 - RNA, 22 nt, Human
cagaccuggaaaacaggcuugc

SEQ ID NO: 166872 - RNA, 21 nt, Human
acaguacuugagaucuuuuga

SEQ ID NO: 166873 - RNA, 22 nt, Human
aauccagguggcggagguugug

SEQ ID NO: 166874 - RNA, 22 nt, Human
gguuguaguuggagguuguaua

SEQ ID NO: 166875 - RNA, 22 nt, Human
cccuuguuuuugaguacaauag

SEQ ID NO: 166876 - RNA, 22 nt, Human
ucauccugaagaaccugcuucc

SEQ ID NO: 166877 - RNA, 22 nt, Human
caugucaagacugaagauccag

SEQ ID NO: 166878 - RNA, 22 nt, Human
auuagccuguugcauuuucacu

SEQ ID NO: 166879 - RNA, 22 nt, Human
ggcugcugcccaccccugcaug

SEQ ID NO: 166880 - RNA, 22 nt, Human
ugcaugguuauauacuacuagu

SEQ ID NO: 166881 - RNA, 22 nt, Human
ggcaguggugggaggcucgcuc

SEQ ID NO: 166882 - RNA, 17 nt, Human
agcagcuggguugaucu

SEQ ID NO: 166883 - RNA, 22 nt, Human
gcauucuugguggagugcuaaa

SEQ ID NO: 166884 - RNA, 22 nt, Human
uuuggucuggaaucuucagggu

SEQ ID NO: 166885 - RNA, 22 nt, Human
ugacagugugcccggagguuag

SEQ ID NO: 166886 - RNA, 22 nt, Human
aauaguguauuuuucaaaauua

SEQ ID NO: 166887 - RNA, 22 nt, Human
acaguacucuaaugaaaagugc

SEQ ID NO: 166888 - RNA, 22 nt, Human
cuguggcuaggaagcuguggga

SEQ ID NO: 166889 - RNA, 22 nt, Human
cucaucuggcuucaguaacagu

SEQ ID NO: 166890 - RNA, 22 nt, Human
cauugcuguuaauugucucuag

SEQ ID NO: 166891 - RNA, 22 nt, Human
cugcagggcccaaggucaacgg

SEQ ID NO: 166892 - RNA, 22 nt, Hepatitis A virus
cugauuuauagauccaagguuu

SEQ ID NO: 166893 - RNA, 22 nt, Hepatitis A virus
gaacucuugcuauacaaucucu

SEQ ID NO: 166894 - RNA, 22 nt, Hepatitis A virus
aaucuuaugauugguggagaau

SEQ ID NO: 166895 - RNA, 22 nt, Hepatitis A virus
ugcaggaaaauuaaucaugguu

SEQ ID NO: 166896 - RNA, 22 nt, Hepatitis A virus
ccauuuaucaucacauugauaa

SEQ ID NO: 166897 - RNA, 22 nt, Human
auauuauucuaguaacagugau

SEQ ID NO: 166898 - RNA, 22 nt, Human
uuuaguagaaugauacagggca

SEQ ID NO: 166899 - RNA, 22 nt, Human
acuuugcagggcuugauaucca

SEQ ID NO: 166900 - RNA, 23 nt, Human
aggcagguuugggcucuucuugu

SEQ ID NO: 166901 - RNA, 22 nt, Human
ccagagaccagaacauggggau

SEQ ID NO: 166902 - RNA, 22 nt, Human
agcuggcaguaugacuggugac

SEQ ID NO: 166903 - RNA, 23 nt, Human
uggcaaagcauucuuauaacagu

SEQ ID NO: 166904 - RNA, 22 nt, Human
aucagcuuuucucaucagaaau

SEQ ID NO: 166905 - RNA, 22 nt, Human
gacagcagccacagggagaggg

SEQ ID NO: 166906 - RNA, 22 nt, Human
uugcacuaggaaaaggcagcca

SEQ ID NO: 166907 - RNA, 22 nt, Human
aaggcuuuuaacuacuguuuua

SEQ ID NO: 166908 - RNA, 19 nt, Human
uggcauuuggaggcaaccu

SEQ ID NO: 166909 - RNA, 22 nt, Human
cagacaggguuuuggucuuugg

SEQ ID NO: 166910 - RNA, 22 nt, Human
uccauacauugaaauaccauuc

SEQ ID NO: 166911 - RNA, 22 nt, Human
uuuaggcauacuuuugggagaa

SEQ ID NO: 166912 - RNA, 22 nt, Human
ucaugaacaucucaaauaacca

SEQ ID NO: 166913 - RNA, 22 nt, Human
uacagacauuuacuccacuccu

SEQ ID NO: 166914 - RNA, 22 nt, Human
uaaguccuucaccuaauccuca

SEQ ID NO: 166915 - RNA, 22 nt, Human
uucaccgugaaccgauuccuca

SEQ ID NO: 166916 - RNA, 18 nt, Human
agcaggugugcagaaugu

SEQ ID NO: 166917 - RNA, 22 nt, Human
uucaugaauggaaucaaugcuc

SEQ ID NO: 166918 - RNA, 22 nt, Human
gagcagugaugggaggacguca

SEQ ID NO: 166919 - RNA, 19 nt, Human
agguggucuaggcuggaga

SEQ ID NO: 166920 - RNA, 21 nt, Human
ggugacacguggccccgcucu

SEQ ID NO: 166921 - RNA, 22 nt, Human
gggaccuggcgagggucacaca

SEQ ID NO: 166922 - RNA, 20 nt, Human
cuguaucagguuacaaagua

SEQ ID NO: 166923 - RNA, 22 nt, Human
gagucaccacacggugcugacu

SEQ ID NO: 166924 - RNA, 22 nt, Human
cccagugugaugagguugcuaa

SEQ ID NO: 166925 - RNA, 22 nt, Human
agcagggcagguaaggaucaga

SEQ ID NO: 166926 - RNA, 22 nt, Human
cacaugaguccugccagguaug

SEQ ID NO: 166927 - RNA, 22 nt, Human
cauuucaaguaacagauugcuu

SEQ ID NO: 166928 - RNA, 22 nt, Human
uccacagaauguaagauccaca

SEQ ID NO: 166929 - RNA, 23 nt, Human
uuguccucuggaucgguuugguu

SEQ ID NO: 166930 - RNA, 22 nt, Human
gucaccucucaucacaugcuac

SEQ ID NO: 166931 - RNA, 22 nt, Human
uuauugaguuguaagagcucuu

SEQ ID NO: 166932 - RNA, 22 nt, Human
agggacccugaugacugaggag

SEQ ID NO: 166933 - RNA, 22 nt, Human
cuggcccauggugagcucuggg

SEQ ID NO: 166934 - RNA, 22 nt, Human
gaaugaaucuguaagugacaag

SEQ ID NO: 166935 - RNA, 22 nt, Human
gggggcucugacucccucagcu

SEQ ID NO: 166936 - RNA, 20 nt, Human
uguguccaucaucugggcac

SEQ ID NO: 166937 - RNA, 22 nt, Human
cuuaacauccugcauuuuucuu

SEQ ID NO: 166938 - RNA, 22 nt, Human
aguguccuccucugggagccag

SEQ ID NO: 166939 - RNA, 22 nt, Human
acuaaacugaagcaugaaaagg

SEQ ID NO: 166940 - RNA, 22 nt, Human
cagguuuagguggacgugcagg

SEQ ID NO: 166941 - RNA, 22 nt, Human
ccaugcauauaauagugccugg

SEQ ID NO: 166942 - RNA, 19 nt, Human
acagaaauuaguuauuuuc

SEQ ID NO: 166943 - RNA, 22 nt, Human
gauuucaagcccccagagauuc

SEQ ID NO: 166944 - RNA, 22 nt, Human
ggcucccaggagggccuggagg

SEQ ID NO: 166945 - RNA, 22 nt, Human
agagacaggguuuugucguguu

SEQ ID NO: 166946 - RNA, 22 nt, Human
augcacuacuuggcuuuacuga

SEQ ID NO: 166947 - RNA, 22 nt, Human
ggcagguggaaggucuccauuc

SEQ ID NO: 166948 - RNA, 22 nt, Human
gauuuacagguuagguccugua

SEQ ID NO: 166949 - RNA, 22 nt, Human
ggcaggcaccagcucagcaaua

SEQ ID NO: 166950 - RNA, 22 nt, Human
ggcuuuauuaagcaggguaagu

SEQ ID NO: 166951 - RNA, 22 nt, Human
caaauucucuuacuguuugaca

SEQ ID NO: 166952 - RNA, 22 nt, Human
cagucaccuugaggacucagac

SEQ ID NO: 166953 - RNA, 21 nt, Human
aguuugaugcaauuucugaga

SEQ ID NO: 166954 - RNA, 22 nt, Human
ugauucacagacuucacaaggc

SEQ ID NO: 166955 - RNA, 22 nt, Human
gugagcagcucaggguggucuc

SEQ ID NO: 166956 - RNA, 22 nt, Human
acauguaaaagauaaauuaaca

SEQ ID NO: 166957 - RNA, 22 nt, Human
gcuuuacugagaugacacaggg

SEQ ID NO: 166958 - RNA, 22 nt, Human
agguggcuguauucagcuguaa

SEQ ID NO: 166959 - RNA, 19 nt, Human
acuguaaggcauuuuuuuc

SEQ ID NO: 166960 - RNA, 22 nt, Human
acagcauucaauaaauaauaac

SEQ ID NO: 166961 - RNA, 22 nt, Human
ccagcuuuccugcgaguugauu

SEQ ID NO: 166962 - RNA, 22 nt, Human
uuuaucugaggaaagcagacaa

SEQ ID NO: 166963 - RNA, 22 nt, Human
cuuaggaacgcucugccuagug

SEQ ID NO: 166964 - RNA, 22 nt, Human
auuuucaucgcuagguuggccu

SEQ ID NO: 166965 - RNA, 22 nt, Human
auuccaaacuuaccccagagga

SEQ ID NO: 166966 - RNA, 22 nt, Human
ugcuggagagccuuggccaagg

SEQ ID NO: 166967 - RNA, 22 nt, Human
gaguaguugcugcagagaauac

SEQ ID NO: 166968 - RNA, 20 nt, Human
aucuucuuggccagcuugcu

SEQ ID NO: 166969 - RNA, 22 nt, Human
uggaaaaacugagacuuagaca

SEQ ID NO: 166970 - RNA, 22 nt, Human
uugcuguaguguucugauguca

SEQ ID NO: 166971 - RNA, 22 nt, Human
uauuucagacacugaucuugca

SEQ ID NO: 166972 - RNA, 22 nt, Human
cucuucaaaagucuaauccuua

SEQ ID NO: 166973 - RNA, 22 nt, Human
uggcagguuuccuccucauagu

SEQ ID NO: 166974 - RNA, 22 nt, Human
uguaaauaguuagcuugccucu

SEQ ID NO: 166975 - RNA, 22 nt, Human
gacagcaggaugugaggggaug

SEQ ID NO: 166976 - RNA, 22 nt, Human
gacaucugaggcccucagagcc

SEQ ID NO: 166977 - RNA, 22 nt, Human
uuccucagggaggcuagcagua

SEQ ID NO: 166978 - RNA, 22 nt, Human
auguauuugcuuguuauggauu

SEQ ID NO: 166979 - RNA, 20 nt, Human
acaauauguagaugaauagc

SEQ ID NO: 166980 - RNA, 22 nt, Human
uucauucuugggaucagagagu

SEQ ID NO: 166981 - RNA, 22 nt, Human
ggcuuuauuuugcaugaaugcu

SEQ ID NO: 166982 - RNA, 22 nt, Human
uaucagaaaugccuuaaauugg

SEQ ID NO: 166983 - RNA, 22 nt, Human
ucuggaucgccggcgccugggc

SEQ ID NO: 166984 - RNA, 17 nt, Human
aguguuuccuuaucauu

SEQ ID NO: 166985 - RNA, 22 nt, Human
cugaaauucugccucugcacaa

SEQ ID NO: 166986 - RNA, 22 nt, Human
uucuucuuuaucucaguauccu

SEQ ID NO: 166987 - RNA, 22 nt, Human
uaauuucaauagcuugcauaau

SEQ ID NO: 166988 - RNA, 22 nt, Human
gacuuuauaaaugagaggcgga

SEQ ID NO: 166989 - RNA, 22 nt, Human
acagagcaugcucaguguguga

SEQ ID NO: 166990 - RNA, 22 nt, Human
ugaaagcuguacaugugguaca

SEQ ID NO: 166991 - RNA, 22 nt, Human
guugggguaccuugaggcuggg

SEQ ID NO: 166992 - RNA, 19 nt, Human
uaggaauguagaauccuag

SEQ ID NO: 166993 - RNA, 22 nt, Human
ucuggguggcagugauggcgug

SEQ ID NO: 166994 - RNA, 22 nt, Human
guuuuacacaccuaugaaagac

SEQ ID NO: 166995 - RNA, 22 nt, Human
acaugugucuaagaaugaaaga

SEQ ID NO: 166996 - RNA, 22 nt, Human
cuugaaucuggcuuugccacuu

SEQ ID NO: 166997 - RNA, 22 nt, Human
uagcuuuagugaaaaauaucag

SEQ ID NO: 166998 - RNA, 22 nt, Human
gcagguguucucagaggaggcu

SEQ ID NO: 166999 - RNA, 22 nt, Human
uacagaauuagauuauuagaga

SEQ ID NO: 167000 - RNA, 22 nt, Human
ugaauaauuaugggaguccuaa

SEQ ID NO: 167001 - RNA, 22 nt, Human
gccaggcacugcucuaagcccu

SEQ ID NO: 167002 - RNA, 22 nt, Human
ccagggcauguaacuaauggug

SEQ ID NO: 167003 - RNA, 22 nt, Human
ccaaugauggugcccacgauga

SEQ ID NO: 167004 - RNA, 17 nt, Human
uauacacagacagacug

SEQ ID NO: 167005 - RNA, 22 nt, Human
agagggaaaaacucaugucauu

SEQ ID NO: 167006 - RNA, 22 nt, Human
uagggaccuuagaauuguaugu

SEQ ID NO: 167007 - RNA, 19 nt, Human
aacuggauaauggccacau

SEQ ID NO: 167008 - RNA, 22 nt, Human
auuuccaugaauucccacucau

SEQ ID NO: 167009 - RNA, 22 nt, Human
aagaaaggauauaugggaggua

SEQ ID NO: 167010 - RNA, 22 nt, Human
ucauuuguaccauuuuuuaaga

SEQ ID NO: 167011 - RNA, 22 nt, Human
uacugcauaacuggcauguggg

SEQ ID NO: 167012 - RNA, 22 nt, Human
ccagguguggggaggacucaca

SEQ ID NO: 167013 - RNA, 22 nt, Human
uguaaauaaugcauguaaauca

SEQ ID NO: 167014 - RNA, 22 nt, Human
acacauauauacauauuugugc

SEQ ID NO: 167015 - RNA, 22 nt, Human
gucuucuuuucagucugcuugu

SEQ ID NO: 167016 - RNA, 17 nt, Human
gcaagggaugggagauu

SEQ ID NO: 167017 - RNA, 22 nt, Human
auuguaacauguucagaucacu

SEQ ID NO: 167018 - RNA, 23 nt, Human
ggccauuucauuugguucaaacu

SEQ ID NO: 167019 - RNA, 22 nt, Human
uaguauuuccuguaagcuauag

SEQ ID NO: 167020 - RNA, 22 nt, Human
auuuccauagagcgucucacag

SEQ ID NO: 167021 - RNA, 22 nt, Human
cauccagggcagccauggccug

SEQ ID NO: 167022 - RNA, 22 nt, Human
aggcuagaggcuucuggcuuca

SEQ ID NO: 167023 - RNA, 22 nt, Human
ccagagaguaucauggagagua

SEQ ID NO: 167024 - RNA, 22 nt, Human
augauuucuauauaaacuuaaa

SEQ ID NO: 167025 - RNA, 22 nt, Human
cagggcauaagaugaggcugua

SEQ ID NO: 167026 - RNA, 22 nt, Human
gcagaauuuggggguaaccuuu

SEQ ID NO: 167027 - RNA, 22 nt, Human
ucaggcaggaucccagggaagg

SEQ ID NO: 167028 - RNA, 22 nt, Human
uacagaaaaacuggcauugaag

SEQ ID NO: 167029 - RNA, 20 nt, Human
uauugaguaccuacuguaua

SEQ ID NO: 167030 - RNA, 22 nt, Human
aauauaauuuuauuccuagagu

SEQ ID NO: 167031 - RNA, 22 nt, Human
cacaugugugcugaggacugug

SEQ ID NO: 167032 - RNA, 22 nt, Human
gccaggcagacaggucaucagg

SEQ ID NO: 167033 - RNA, 22 nt, Human
agauacaaaagauaagauuuag

SEQ ID NO: 167034 - RNA, 22 nt, Human
aauaucagcacuuuugugguau

SEQ ID NO: 167035 - RNA, 23 nt, Human
ugcagggcaaguuagagacccca

SEQ ID NO: 167036 - RNA, 22 nt, Human
agaauaauacugaaaugcugaa

SEQ ID NO: 167037 - RNA, 19 nt, Human
agaaucaggucaggugaca

SEQ ID NO: 167038 - RNA, 22 nt, Human
gccagggaaacugcagaccagc

SEQ ID NO: 167039 - RNA, 22 nt, Human
acacuuuacagaauguuuugau

SEQ ID NO: 167040 - RNA, 21 nt, Human
uccaaaucccauucuguaguc

SEQ ID NO: 167041 - RNA, 22 nt, Human
aggacauguuuguaucuuccuu

SEQ ID NO: 167042 - RNA, 22 nt, Human
ugacagaccacugcaacucugu

SEQ ID NO: 167043 - RNA, 22 nt, Human
gcaggugucaguccccaaggug

SEQ ID NO: 167044 - RNA, 22 nt, Human
gcagggcauagaggcacggagg

SEQ ID NO: 167045 - RNA, 22 nt, Human
aaguguuuacuuaaagucaugg

SEQ ID NO: 167046 - RNA, 22 nt, Human
cuuuuucugauguuccaugauu

SEQ ID NO: 167047 - RNA, 22 nt, Human
ucaauucaauugaacaguuacu

SEQ ID NO: 167048 - RNA, 22 nt, Human
gguuccaccuggcgagggguau

SEQ ID NO: 167049 - RNA, 22 nt, Human
auuauuucucacucacauaaua

SEQ ID NO: 167050 - RNA, 22 nt, Human
agggaccuugauggguuuggga

SEQ ID NO: 167051 - RNA, 22 nt, Human
ccagggcaacgcugucucagag

SEQ ID NO: 167052 - RNA, 22 nt, Human
gcugccacgaucucugcuguag

SEQ ID NO: 167053 - RNA, 22 nt, Human
acagguggagugguuagcaggc

SEQ ID NO: 167054 - RNA, 19 nt, Human
gguccucagcagagcaugc

SEQ ID NO: 167055 - RNA, 22 nt, Human
guuagggagggugcauaugugu

SEQ ID NO: 167056 - RNA, 22 nt, Human
acagcaggcaugaagaaauguu

SEQ ID NO: 167057 - RNA, 22 nt, Human
caaagaagagauuuacagagcu

SEQ ID NO: 167058 - RNA, 22 nt, Human
gaugaaaaaagacgagcauaua

SEQ ID NO: 167059 - RNA, 22 nt, Human
cagacugaguggauuaaacaau

SEQ ID NO: 167060 - RNA, 20 nt, Human
uuuuccagaaaguaucauug

SEQ ID NO: 167061 - RNA, 22 nt, Human
uuguccugugauuucagggccu

SEQ ID NO: 167062 - RNA, 22 nt, Human
uccaggcacgaggcccugugca

SEQ ID NO: 167063 - RNA, 22 nt, Human
ccauguguugagauuccagccu

SEQ ID NO: 167064 - RNA, 22 nt, Human
uacauguggaguuuucuaguca

SEQ ID NO: 167065 - RNA, 22 nt, Human
uaaacaucugucauguguuuau

SEQ ID NO: 167066 - RNA, 22 nt, Human
uuauuucauugauuucuaagac

SEQ ID NO: 167067 - RNA, 22 nt, Human
uuuauauauggcuggucuggau

SEQ ID NO: 167068 - RNA, 22 nt, Human
agucuucacucuucacuacuau

SEQ ID NO: 167069 - RNA, 22 nt, Human
agcugcaagauuucuuuuguau

SEQ ID NO: 167070 - RNA, 22 nt, Human
ucuguugacuccuagcagccau

SEQ ID NO: 167071 - RNA, 22 nt, Human
ugcagggauccuagcugaagag

SEQ ID NO: 167072 - RNA, 22 nt, Human
cuacauaaucuggauuugucug

SEQ ID NO: 167073 - RNA, 22 nt, Human
cagcuuuccagagaccugcccc

SEQ ID NO: 167074 - RNA, 22 nt, Human
ggguggagaggcuaaguccagu

SEQ ID NO: 167075 - RNA, 22 nt, Human
aaugggcuuuggccaguaggag

SEQ ID NO: 167076 - RNA, 22 nt, Human
cuucucucccuggcacucagac

SEQ ID NO: 167077 - RNA, 22 nt, Human
ucauuucuguugugcaucacug

SEQ ID NO: 167078 - RNA, 22 nt, Human
acacuuuaugucuagaucuggg

SEQ ID NO: 167079 - RNA, 22 nt, Human
aaagugguucuuacauccgugg

SEQ ID NO: 167080 - RNA, 18 nt, Human
acagggaugggguaagug

SEQ ID NO: 167081 - RNA, 22 nt, Human
cauuuccagcuccugcaucaug

SEQ ID NO: 167082 - RNA, 22 nt, Human
ugcaugcaugugagcaugcaua

SEQ ID NO: 167083 - RNA, 22 nt, Human
cucuuagauauggagaauuacc

SEQ ID NO: 167084 - RNA, 22 nt, Human
uccuuccugcucuaacauucag

SEQ ID NO: 167085 - RNA, 22 nt, Human
acagguuuuuguggauauaugu

SEQ ID NO: 167086 - RNA, 22 nt, Human
cuguccugaaguuuucaugaga

SEQ ID NO: 167087 - RNA, 22 nt, Human
auggaucacagugccgugggug

SEQ ID NO: 167088 - RNA, 22 nt, Human
acuuugaaacuaaaauucauua

SEQ ID NO: 167089 - RNA, 22 nt, Human
uauugcuggggugggccauguu

SEQ ID NO: 167090 - RNA, 23 nt, Human
cacagguguuucaucuucucagu

SEQ ID NO: 167091 - RNA, 22 nt, Human
uagcagaagaacaacaugaucu

SEQ ID NO: 167092 - RNA, 22 nt, Human
uaauuucacaguucaacgcaca

SEQ ID NO: 167093 - RNA, 22 nt, Human
gaucugaaucaauagaauaacu

SEQ ID NO: 167094 - RNA, 22 nt, Human
uacagacaaagugcuauagggu

SEQ ID NO: 167095 - RNA, 22 nt, Human
agaccugcagggccaggccugc

SEQ ID NO: 167096 - RNA, 22 nt, Human
aaauuugauaagccauuguuac

SEQ ID NO: 167097 - RNA, 22 nt, Human
uagauuuaagacccugaauuug

SEQ ID NO: 167098 - RNA, 22 nt, Human
uuuacuuguucugcugaauucu

SEQ ID NO: 167099 - RNA, 22 nt, Human
caaaugauacuguuuuuagucu

SEQ ID NO: 167100 - RNA, 22 nt, Human
uugcagggcaaauggucagaua

SEQ ID NO: 167101 - RNA, 22 nt, Human
uaagauguuuugguuugauaag

SEQ ID NO: 167102 - RNA, 22 nt, Human
aggcagcaauugaaaucauugu

SEQ ID NO: 167103 - RNA, 22 nt, Human
cauuugaaugagauugcuguaa

SEQ ID NO: 167104 - RNA, 22 nt, Human
uaguauagauugaagcagauca

SEQ ID NO: 167105 - RNA, 22 nt, Human
aaaguccuuuuugccaugcaag

SEQ ID NO: 167106 - RNA, 22 nt, Human
uguuuccuucugucucuuugga

SEQ ID NO: 167107 - RNA, 22 nt, Human
ucagacagucaucagagcuugu

SEQ ID NO: 167108 - RNA, 22 nt, Human
guuucauuuacaucuguaggua

SEQ ID NO: 167109 - RNA, 22 nt, Human
uccugaaauucugguugucacu

SEQ ID NO: 167110 - RNA, 22 nt, Human
uaauacagaaguguauuaaaau

SEQ ID NO: 167111 - RNA, 22 nt, Human
auucuucacaccuguuccuguu

SEQ ID NO: 167112 - RNA, 22 nt, Human
aguugacucucaagauccuguu

SEQ ID NO: 167113 - RNA, 19 nt, Human
ggcaggugugcuuaugcuu

SEQ ID NO: 167114 - RNA, 22 nt, Human
cuggaggaaucacagaaggcuu

SEQ ID NO: 167115 - RNA, 22 nt, Human
gaucugaaauagcuacugcaga

SEQ ID NO: 167116 - RNA, 22 nt, Human
uucagcaagaccaccauguacc

SEQ ID NO: 167117 - RNA, 22 nt, Human
gaaacccaaacuaagacaguag

SEQ ID NO: 167118 - RNA, 22 nt, Human
uggcauuuagaaaacaacaugu

SEQ ID NO: 167119 - RNA, 22 nt, Human
agguuuauguuuggugcaggag

SEQ ID NO: 167120 - RNA, 22 nt, Human
agcacugauuuaaacuggauuu

SEQ ID NO: 167121 - RNA, 22 nt, Human
cuggaggaccacagaagcuggu

SEQ ID NO: 167122 - RNA, 22 nt, Human
uccugucugcucacagagcugg

SEQ ID NO: 167123 - RNA, 17 nt, Human
uuucagauucacuuucu

SEQ ID NO: 167124 - RNA, 22 nt, Human
agugacuggugugaaguuaaau

SEQ ID NO: 167125 - RNA, 22 nt, Human
aaaucucacuguagucaaagug

SEQ ID NO: 167126 - RNA, 22 nt, Human
uuuaggcagcacgggcagcccu

SEQ ID NO: 167127 - RNA, 22 nt, Human
uuuguucaugccuauauucuca

SEQ ID NO: 167128 - RNA, 21 nt, Human
gcaaauguucaggaaaaaaga

SEQ ID NO: 167129 - RNA, 22 nt, Human
guaacauaguuugugcuucauc

SEQ ID NO: 167130 - RNA, 22 nt, Human
gaauuucaacaguccucaaaug

SEQ ID NO: 167131 - RNA, 22 nt, Human
uuucuucauagaccuugucuug

SEQ ID NO: 167132 - RNA, 22 nt, Human
aggugucuucagggugagacag

SEQ ID NO: 167133 - RNA, 23 nt, Human
caggugguagagaaaaauccaga

SEQ ID NO: 167134 - RNA, 22 nt, Human
uuagaaaucugcugccaugcaa

SEQ ID NO: 167135 - RNA, 22 nt, Human
gcagggacaaggcagguguucu

SEQ ID NO: 167136 - RNA, 22 nt, Human
caggugucaaaauacuaagugg

SEQ ID NO: 167137 - RNA, 21 nt, Human
uccuugcuauuuuccucagcu

SEQ ID NO: 167138 - RNA, 22 nt, Human
cccaggcagcggggucuccuug

SEQ ID NO: 167139 - RNA, 22 nt, Human
auugagcuguuuuguaggauaa

SEQ ID NO: 167140 - RNA, 21 nt, Human
aguguccuugaucuugccuug

SEQ ID NO: 167141 - RNA, 22 nt, Human
uuccaaaccucaaauaauuaau

SEQ ID NO: 167142 - RNA, 22 nt, Human
cagacaggaauucuggcguggu

SEQ ID NO: 167143 - RNA, 22 nt, Human
cagagggcucggcggccgcucc

SEQ ID NO: 167144 - RNA, 22 nt, Human
uuacacaacaucuguauuauua

SEQ ID NO: 167145 - RNA, 22 nt, Human
uccuucuccuccuugagugaca

SEQ ID NO: 167146 - RNA, 22 nt, Human
aaaagcagaucuccaaagucua

SEQ ID NO: 167147 - RNA, 22 nt, Human
ccagguguaggacaccaaggga

SEQ ID NO: 167148 - RNA, 17 nt, Human
ucuucucuuccagucuu

SEQ ID NO: 167149 - RNA, 21 nt, Human
ugcuggguuugcccaucaggc

SEQ ID NO: 167150 - RNA, 22 nt, Human
uuagcuuuagagccauuacugg

SEQ ID NO: 167151 - RNA, 22 nt, Human
ggcuuggaaaugguaaugagcu

SEQ ID NO: 167152 - RNA, 22 nt, Human
gcaaggacucccugggucauuc

SEQ ID NO: 167153 - RNA, 22 nt, Human
aaauguacgggaguagaauuag

SEQ ID NO: 167154 - RNA, 22 nt, Human
uauuucaacguaugaaaagcug

SEQ ID NO: 167155 - RNA, 22 nt, Human
cagagcaucgcgcagagagccu

SEQ ID NO: 167156 - RNA, 22 nt, Human
uagcuuuaaaaaucaucaaagc

SEQ ID NO: 167157 - RNA, 22 nt, Human
uccaggcaaaaggaacugcuug

SEQ ID NO: 167158 - RNA, 22 nt, Human
ucaccgucgggggucgcugucu

SEQ ID NO: 167159 - RNA, 22 nt, Human
cacaggugccaucucuucaugg

SEQ ID NO: 167160 - RNA, 22 nt, Human
gcuggaggcaguucagacacca

SEQ ID NO: 167161 - RNA, 22 nt, Human
cugggugaguauaggaaaggga

SEQ ID NO: 167162 - RNA, 22 nt, Human
gacuuuauucguuaacuguuaa

SEQ ID NO: 167163 - RNA, 22 nt, Human
cccaugagguggagguugcagu

SEQ ID NO: 167164 - RNA, 22 nt, Human
aucagagacaaaaccagcacuu

SEQ ID NO: 167165 - RNA, 22 nt, Human
uaauuauucuagucacauagca

SEQ ID NO: 167166 - RNA, 22 nt, Human
uuagggaaggcugcugucagcu

SEQ ID NO: 167167 - RNA, 22 nt, Human
gcauuuaaauuugaacuucaga

SEQ ID NO: 167168 - RNA, 22 nt, Human
cauuuauugaguggccacagug

SEQ ID NO: 167169 - RNA, 22 nt, Human
acagguguagcaggagcaucaa

SEQ ID NO: 167170 - RNA, 22 nt, Human
ucagugugaggucuuccacccg

SEQ ID NO: 167171 - RNA, 22 nt, Human
acaggccugagauuuugcauuu

SEQ ID NO: 167172 - RNA, 22 nt, Human
uuauugagcaacucuggggcuc

SEQ ID NO: 167173 - RNA, 22 nt, Human
uacauagugaacauuuacagag

SEQ ID NO: 167174 - RNA, 22 nt, Human
acagucauuagauacaaugucu

SEQ ID NO: 167175 - RNA, 22 nt, Human
gcaggcaggaaggacuaaguaa

SEQ ID NO: 167176 - RNA, 22 nt, Human
guaaacauuuucaucugugccc

SEQ ID NO: 167177 - RNA, 22 nt, Human
cucccaagauaaauaaggcagu

SEQ ID NO: 167178 - RNA, 22 nt, Human
ucagggcaucaucaugaauaua

SEQ ID NO: 167179 - RNA, 22 nt, Human
aaacagcuaauggccaggaaua

SEQ ID NO: 167180 - RNA, 22 nt, Human
auuucaguagaaaaucuugauu

SEQ ID NO: 167181 - RNA, 22 nt, Human
ggcauuuagauugaauuucugu

SEQ ID NO: 167182 - RNA, 22 nt, Human
gaacuuggaccugguccuuugg

SEQ ID NO: 167183 - RNA, 22 nt, Human
gcaggcagagucaauuugaucc

SEQ ID NO: 167184 - RNA, 22 nt, Human
aaagcugcccuugugaaacaag

SEQ ID NO: 167185 - RNA, 22 nt, Human
cuuuaagagaucaccaaucaca

SEQ ID NO: 167186 - RNA, 22 nt, Human
gugaauaaagggaguuuucaaa

SEQ ID NO: 167187 - RNA, 22 nt, Human
aguuuauuuuugauaagucuug

SEQ ID NO: 167188 - RNA, 22 nt, Human
uaaaaguauacuuucaaaggag

SEQ ID NO: 167189 - RNA, 22 nt, Human
ggcagggcaggaaagucaggaa

SEQ ID NO: 167190 - RNA, 22 nt, Human
auggcuuaagaaugcuuuugug

SEQ ID NO: 167191 - RNA, 22 nt, Human
ccagggcaggggcuggaguuca

SEQ ID NO: 167192 - RNA, 22 nt, Human
cuguccugauggugccacuggu

SEQ ID NO: 167193 - RNA, 22 nt, Human
cuuccaaacccaggguaugggc

SEQ ID NO: 167194 - RNA, 19 nt, Human
cuuuucaucaacagccaau

SEQ ID NO: 167195 - RNA, 23 nt, Human
uugcacauuggagcuggucuucu

SEQ ID NO: 167196 - RNA, 22 nt, Human
ucuggagggguuuagagggaca

SEQ ID NO: 167197 - RNA, 21 nt, Human
aagaaagauaauuaaggaccc

SEQ ID NO: 167198 - RNA, 22 nt, Human
ucuauacaugugcacacacauc

SEQ ID NO: 167199 - RNA, 22 nt, Human
ggauucuaacugaacagaauau

SEQ ID NO: 167200 - RNA, 20 nt, Human
gccugcagguuggaugggau

SEQ ID NO: 167201 - RNA, 22 nt, Human
aggguggcaccuggaagggaug

SEQ ID NO: 167202 - RNA, 22 nt, Human
aaagcucuuauagcagagugug

SEQ ID NO: 167203 - RNA, 22 nt, Human
cguccucagaggccauccgaaa

SEQ ID NO: 167204 - RNA, 22 nt, Human
uguggggccucgugcuagcugg

SEQ ID NO: 167205 - RNA, 22 nt, Human
ugguccugcccacgcccaucug

SEQ ID NO: 167206 - RNA, 22 nt, Human
uucacuuauagggauguuauug

SEQ ID NO: 167207 - RNA, 22 nt, Human
uguggggcugucaggcaacugg

SEQ ID NO: 167208 - RNA, 22 nt, Human
gggaccugggccagaggacagu

SEQ ID NO: 167209 - RNA, 22 nt, Human
aaaauacuguggaguguugaaa

SEQ ID NO: 167210 - RNA, 23 nt, Human
uuaggcacuuaguagggccagag

SEQ ID NO: 167211 - RNA, 22 nt, Human
ucaggaaauggcuucaugguuu

SEQ ID NO: 167212 - RNA, 19 nt, Human
gcaggcagcugggguaucc

SEQ ID NO: 167213 - RNA, 22 nt, Human
uuccugggaggcuguguacuug

SEQ ID NO: 167214 - RNA, 22 nt, Human
auuucuguggcuucauucuccu

SEQ ID NO: 167215 - RNA, 20 nt, Human
ugcagggcucugcuucucuc

SEQ ID NO: 167216 - RNA, 22 nt, Human
caguucuuauuuggccaguguc

SEQ ID NO: 167217 - RNA, 22 nt, Human
cagaugaacucuauccuguggc

SEQ ID NO: 167218 - RNA, 22 nt, Human
ucugaagagucuugcaagaaag

SEQ ID NO: 167219 - RNA, 22 nt, Human
aggaggaagggaagacaaguaa

SEQ ID NO: 167220 - RNA, 22 nt, Human
gagggcagagucuaaugaugca

SEQ ID NO: 167221 - RNA, 18 nt, Human
uggcucugccacucaccg

SEQ ID NO: 167222 - RNA, 22 nt, Human
uaugugucaaaccauucaucug

SEQ ID NO: 167223 - RNA, 22 nt, Human
aucuuucuauuucuaaaaacua

SEQ ID NO: 167224 - RNA, 22 nt, Human
caugugguucaaguacuccaca

SEQ ID NO: 167225 - RNA, 22 nt, Human
aaguguuuggggaucauuuuaa

SEQ ID NO: 167226 - RNA, 22 nt, Human
aacuugguaccaccuucugaag

SEQ ID NO: 167227 - RNA, 22 nt, Human
auauccaagaaacaauuaauuc

SEQ ID NO: 167228 - RNA, 20 nt, Human
ucuuauacagaaaacauuuu

SEQ ID NO: 167229 - RNA, 22 nt, Human
uaacauuugcugucuccuaugu

SEQ ID NO: 167230 - RNA, 22 nt, Human
ugacugaaauggcgacagugaa

SEQ ID NO: 167231 - RNA, 22 nt, Human
ccacagcugaccgcaggugagc

SEQ ID NO: 167232 - RNA, 22 nt, Human
uccaguggcaccuuggcccuca

SEQ ID NO: 167233 - RNA, 20 nt, Human
uguaacaaucuggauguugc

SEQ ID NO: 167234 - RNA, 22 nt, Human
cagggcagagggaaacuccuuu

SEQ ID NO: 167235 - RNA, 22 nt, Human
gcagacaggcccaguggaggga

SEQ ID NO: 167236 - RNA, 22 nt, Human
uccugguaggcuaugucauguc

SEQ ID NO: 167237 - RNA, 17 nt, Human
gccugcaggcccgcaga

SEQ ID NO: 167238 - RNA, 22 nt, Human
gagaaacaacacuugaugccuu

SEQ ID NO: 167239 - RNA, 22 nt, Human
auccuuagaagggagugaggac

SEQ ID NO: 167240 - RNA, 22 nt, Human
uuaaagauucugaggcugauua

SEQ ID NO: 167241 - RNA, 22 nt, Human
ggagcugagguaacagugagug

SEQ ID NO: 167242 - RNA, 16 nt, Human
ucagggcagaauggca

SEQ ID NO: 167243 - RNA, 22 nt, Human
uggcuggagcgcccuccucugc

SEQ ID NO: 167244 - RNA, 22 nt, Human
guguccugggcauuaggcuuag

SEQ ID NO: 167245 - RNA, 22 nt, Human
uaugaaaagguggccaauguag

SEQ ID NO: 167246 - RNA, 23 nt, Human
agaccugcaucugauaggcccug

SEQ ID NO: 167247 - RNA, 22 nt, Human
aaagccauuacaaaauuucaua

SEQ ID NO: 167248 - RNA, 22 nt, Human
aggcuuuaaguggccuacagcu

SEQ ID NO: 167249 - RNA, 22 nt, Human
agagaggcgaguuaccugugcu

SEQ ID NO: 167250 - RNA, 22 nt, Human
ugcuuaauagugcacugguuuc

SEQ ID NO: 167251 - RNA, 22 nt, Human
ugcaggugucuccagggcaggu

SEQ ID NO: 167252 - RNA, 22 nt, Human
auguuaaaugguuuauuauuaa

SEQ ID NO: 167253 - RNA, 22 nt, Human
cuggauuuaggacuaguccaag

SEQ ID NO: 167254 - RNA, 22 nt, Human
caugguuuauuagagcuuauuu

SEQ ID NO: 167255 - RNA, 21 nt, Human
acuguucauuugaugaacugg

SEQ ID NO: 167256 - RNA, 22 nt, Human
ucagacagaaggacuauuugaa

SEQ ID NO: 167257 - RNA, 22 nt, Human
cugggugauuccuguccaggca

SEQ ID NO: 167258 - RNA, 17 nt, Human
gggcugacaguggccuc

SEQ ID NO: 167259 - RNA, 22 nt, Human
gccaggcagccacccucugcga

SEQ ID NO: 167260 - RNA, 22 nt, Human
uggcagggugccaguugcgagu

SEQ ID NO: 167261 - RNA, 22 nt, Human
acagacuggagugagagaaaua

SEQ ID NO: 167262 - RNA, 22 nt, Human
gagguggugguggaggcauagc

SEQ ID NO: 167263 - RNA, 22 nt, Human
aucagagaaauggagggcgcuu

SEQ ID NO: 167264 - RNA, 22 nt, Human
uuauccaaacuggugaaucauu

SEQ ID NO: 167265 - RNA, 22 nt, Human
agugaggggauucaggcaaggu

SEQ ID NO: 167266 - RNA, 22 nt, Human
acaauacaggcuucuggacuua

SEQ ID NO: 167267 - RNA, 20 nt, Human
caugugucaguucucaccca

SEQ ID NO: 167268 - RNA, 22 nt, Human
uuucuucagccacuccaaacug

SEQ ID NO: 167269 - RNA, 22 nt, Human
cuuguauuaggaagaaugcuuu

SEQ ID NO: 167270 - RNA, 22 nt, Human
caaauucacaugauugcuucug

SEQ ID NO: 167271 - RNA, 22 nt, Human
uacagacaguuuuucagauauu

SEQ ID NO: 167272 - RNA, 22 nt, Human
cugcguguuugcacccugucug

SEQ ID NO: 167273 - RNA, 22 nt, Human
acagguggucuuugcuccuuuu

SEQ ID NO: 167274 - RNA, 22 nt, Human
auccuucuccagucguauuuuu

SEQ ID NO: 167275 - RNA, 22 nt, Human
cagagagcuuagugugcugcau

SEQ ID NO: 167276 - RNA, 22 nt, Human
uggagcagggcaucacugugcg

SEQ ID NO: 167277 - RNA, 22 nt, Human
cuuccugcccacuuccugcugg

SEQ ID NO: 167278 - RNA, 22 nt, Human
agauguuuuggagacacuaacc

SEQ ID NO: 167279 - RNA, 22 nt, Human
auuucccagcuuugaucaguuu

SEQ ID NO: 167280 - RNA, 22 nt, Human
uaauuucuggagggagaaagag

SEQ ID NO: 167281 - RNA, 20 nt, Human
cugcagggugagugggcgau

SEQ ID NO: 167282 - RNA, 22 nt, Human
ccuuccuugagaagcaauuccu

SEQ ID NO: 167283 - RNA, 18 nt, Human
ugagaggcuauuuuuugc

SEQ ID NO: 167284 - RNA, 22 nt, Human
uaggugguuaugucagccuaga

SEQ ID NO: 167285 - RNA, 22 nt, Human
cugaauaaagcccucgcgcgcu

SEQ ID NO: 167286 - RNA, 22 nt, Human
uuccuucuuguaaugaucugcc

SEQ ID NO: 167287 - RNA, 22 nt, Human
uucugaaagccaauucauugaa

SEQ ID NO: 167288 - RNA, 22 nt, Human
gagauuuaauuggauuaacuua

SEQ ID NO: 167289 - RNA, 22 nt, Human
acagaauugaaaguauaaucug

SEQ ID NO: 167290 - RNA, 22 nt, Human
gauuuauuuuuaaucagcaggg

SEQ ID NO: 167291 - RNA, 22 nt, Human
gaaucauuuauuuuugacagca

SEQ ID NO: 167292 - RNA, 22 nt, Human
aaugaaauguagcuuauccaua

SEQ ID NO: 167293 - RNA, 22 nt, Human
uuguccuggagguuaauagagu

SEQ ID NO: 167294 - RNA, 19 nt, Human
aagcauggugccucaccuc

SEQ ID NO: 167295 - RNA, 22 nt, Human
uacauguacaugcauagguaga

SEQ ID NO: 167296 - RNA, 23 nt, Human
augguuuaugucacacuuuugau

SEQ ID NO: 167297 - RNA, 22 nt, Human
uuaaauuauuucuagugaggug

SEQ ID NO: 167298 - RNA, 22 nt, Human
gggcaggugugcagagcuguug

SEQ ID NO: 167299 - RNA, 22 nt, Human
uuggaucagaugauaucuuugu

SEQ ID NO: 167300 - RNA, 22 nt, Human
aagguucuaagggaagccaugc

SEQ ID NO: 167301 - RNA, 22 nt, Human
ucuuuauuuuaugcuugugcaa

SEQ ID NO: 167302 - RNA, 22 nt, Human
aaauacugggcucaaaaggguu

SEQ ID NO: 167303 - RNA, 22 nt, Human
uguccucaaggagcuucagucu

SEQ ID NO: 167304 - RNA, 22 nt, Human
auuugcuugugcuaugaaaguu

SEQ ID NO: 167305 - RNA, 22 nt, Human
cauggcuuguaauaaauuuaua

SEQ ID NO: 167306 - RNA, 22 nt, Human
gucuggaaauuuaagguaugag

SEQ ID NO: 167307 - RNA, 22 nt, Human
cgacccuacagacagugcugag

SEQ ID NO: 167308 - RNA, 22 nt, Human
uugugucccuggagcuucugug

SEQ ID NO: 167309 - RNA, 22 nt, Human
aagggcuccaagagguagcugg

SEQ ID NO: 167310 - RNA, 18 nt, Human
gaggauggaaggagaugc

SEQ ID NO: 167311 - RNA, 22 nt, Human
gcaggggcuaaggacacagaga

SEQ ID NO: 167312 - RNA, 22 nt, Human
uguccuuuuucuuaggaaauau

SEQ ID NO: 167313 - RNA, 22 nt, Human
aaagcagaacugagagagcugg

SEQ ID NO: 167314 - RNA, 22 nt, Human
auuucagauucagaaauguagg

SEQ ID NO: 167315 - RNA, 22 nt, Human
aaucaagucaaccaucaugugc

SEQ ID NO: 167316 - RNA, 22 nt, Human
ggcaggcauugcaacauguaca

SEQ ID NO: 167317 - RNA, 22 nt, Human
uucacagaguuauuuuuaugcu

SEQ ID NO: 167318 - RNA, 22 nt, Human
uuauuccauuauuucacuuagg

SEQ ID NO: 167319 - RNA, 22 nt, Human
gauugcugccagcguguccgug

SEQ ID NO: 167320 - RNA, 22 nt, Human
guucuucaaagugacaacuaaa

SEQ ID NO: 167321 - RNA, 22 nt, Human
auguuacacauaggcauaaaug

SEQ ID NO: 167322 - RNA, 22 nt, Human
gagcuuuaggagaaggagguca

SEQ ID NO: 167323 - RNA, 22 nt, Human
aaaaugaugcuguaauuuggca

SEQ ID NO: 167324 - RNA, 22 nt, Human
aggcagggcugggauuagacuc

SEQ ID NO: 167325 - RNA, 22 nt, Human
ccaucagauuagcaaaauccag

SEQ ID NO: 167326 - RNA, 22 nt, Human
uucccucucacuuaaagcuugg

SEQ ID NO: 167327 - RNA, 22 nt, Human
aaagcugcccuacacggaagca

SEQ ID NO: 167328 - RNA, 22 nt, Human
uguccucacaggaaugaacuuu

SEQ ID NO: 167329 - RNA, 22 nt, Human
gcagggaccagggccagaucca

SEQ ID NO: 167330 - RNA, 22 nt, Human
uaacagaagaaaacauauugga

SEQ ID NO: 167331 - RNA, 22 nt, Human
aggauuuauuacaagccauggu

SEQ ID NO: 167332 - RNA, 22 nt, Human
aaguauuucguucugaaaaagu

SEQ ID NO: 167333 - RNA, 18 nt, Human
uuuuaauuucaggggugg

SEQ ID NO: 167334 - RNA, 22 nt, Human
acaugcuuccaaauuauguugg

SEQ ID NO: 167335 - RNA, 22 nt, Human
aauagugaacaggaacaugcuu

SEQ ID NO: 167336 - RNA, 22 nt, Human
guuggcuaugagagcuuuagug

SEQ ID NO: 167337 - RNA, 22 nt, Human
auuuccauacacccauuucuga

SEQ ID NO: 167338 - RNA, 22 nt, Human
ugguggcaauucaaagacagca

SEQ ID NO: 167339 - RNA, 22 nt, Human
ugguggggucaucgucagaugc

SEQ ID NO: 167340 - RNA, 22 nt, Human
ucagaaaagagaaaaucuuaua

SEQ ID NO: 167341 - RNA, 22 nt, Human
uaauuccaaguugagacaugca

SEQ ID NO: 167342 - RNA, 22 nt, Human
uugaaugaggaagagcacuggc

SEQ ID NO: 167343 - RNA, 22 nt, Human
uuguaaaguucuuaggaagcuc

SEQ ID NO: 167344 - RNA, 22 nt, Human
gggcagguuggcaucccgggca

SEQ ID NO: 167345 - RNA, 22 nt, Human
gcacccaggcuugggcagcaac

SEQ ID NO: 167346 - RNA, 22 nt, Human
augguuuuccucugcugcuuaa

SEQ ID NO: 167347 - RNA, 22 nt, Human
ggggugugucugacaaugguau

SEQ ID NO: 167348 - RNA, 22 nt, Human
uucaaacaaaacuguucccaua

SEQ ID NO: 167349 - RNA, 22 nt, Human
aaagugguugcugucagccucu

SEQ ID NO: 167350 - RNA, 22 nt, Human
acaguguucacuuaacaaugga

SEQ ID NO: 167351 - RNA, 22 nt, Human
cagcaaucgggugauaugcaau

SEQ ID NO: 167352 - RNA, 22 nt, Human
gugggugugauaagaccaaggg

SEQ ID NO: 167353 - RNA, 22 nt, Human
gcagaauuuucuguuuucuaga

SEQ ID NO: 167354 - RNA, 22 nt, Human
cagagcauuaaaaccagcucug

SEQ ID NO: 167355 - RNA, 22 nt, Human
uggagcugagagccaggcuggc

SEQ ID NO: 167356 - RNA, 22 nt, Human
gagugaggcuggaaucauggcu

SEQ ID NO: 167357 - RNA, 22 nt, Human
ggcagggcuugucucugugaug

SEQ ID NO: 167358 - RNA, 22 nt, Human
cuugaauccaaaugggagauga

SEQ ID NO: 167359 - RNA, 22 nt, Human
ugaccugcagucaagaggggaa

SEQ ID NO: 167360 - RNA, 22 nt, Human
ggaggauuugucaucugaagau

SEQ ID NO: 167361 - RNA, 16 nt, Human
uuuccaaagggcagcu

SEQ ID NO: 167362 - RNA, 20 nt, Human
uuaagaaaagcacauccugc

SEQ ID NO: 167363 - RNA, 22 nt, Human
auacagggacauccaguuuuuc

SEQ ID NO: 167364 - RNA, 22 nt, Human
guucacaagaguuacagacaga

SEQ ID NO: 167365 - RNA, 22 nt, Human
aaguccuucuuuauaugagagu

SEQ ID NO: 167366 - RNA, 22 nt, Human
caauuucuggaacuaauucuga

SEQ ID NO: 167367 - RNA, 22 nt, Human
ugaaacuaggccaaucaaauua

SEQ ID NO: 167368 - RNA, 22 nt, Human
auuucaacguuagauguaauag

SEQ ID NO: 167369 - RNA, 22 nt, Human
aggaccugccaggugcaaagca

SEQ ID NO: 167370 - RNA, 22 nt, Human
uguagaaauuaguaagaucaac

SEQ ID NO: 167371 - RNA, 22 nt, Human
ucugggaaccagugcggcuggg

SEQ ID NO: 167372 - RNA, 22 nt, Human
ucuaggguccacagggucagcc

SEQ ID NO: 167373 - RNA, 22 nt, Human
cagggcaguuuuacuucucucu

SEQ ID NO: 167374 - RNA, 22 nt, Human
ggagcugaguggguuuauugau

SEQ ID NO: 167375 - RNA, 22 nt, Human
gcguuaauaacauuaauaaugc

SEQ ID NO: 167376 - RNA, 22 nt, Human
aggcagguccccuggaaggcac

SEQ ID NO: 167377 - RNA, 22 nt, Human
uauuucaagaacuucuauccau

SEQ ID NO: 167378 - RNA, 22 nt, Human
gaagaauccaugcuaauuuacc

SEQ ID NO: 167379 - RNA, 22 nt, Human
aauaauaagauacuaagggagu

SEQ ID NO: 167380 - RNA, 22 nt, Human
guuuacuguuuucugauaagug

SEQ ID NO: 167381 - RNA, 22 nt, Human
uacauguggccagaaauuugag

SEQ ID NO: 167382 - RNA, 17 nt, Human
uaaagccagucaaguca

SEQ ID NO: 167383 - RNA, 21 nt, Human
auauuguagguaaagugcagg

SEQ ID NO: 167384 - RNA, 22 nt, Human
gguuucaaauuaaagucuuaag

SEQ ID NO: 167385 - RNA, 22 nt, Human
ccucaugcugcaucucugaggu

SEQ ID NO: 167386 - RNA, 22 nt, Human
acuuaaaaagaaucuuuucacg

SEQ ID NO: 167387 - RNA, 18 nt, Human
aaaaagugcucaggccua

SEQ ID NO: 167388 - RNA, 22 nt, Human
gauuuagagcaggaaugcaugg

SEQ ID NO: 167389 - RNA, 22 nt, Human
auuuauugagacuuaacaaccc

SEQ ID NO: 167390 - RNA, 22 nt, Human
gcugcuuuauaaucucggcaga

SEQ ID NO: 167391 - RNA, 22 nt, Human
ugcauguguuugccacagugag

SEQ ID NO: 167392 - RNA, 22 nt, Human
caugugucaaaugauguagcug

SEQ ID NO: 167393 - RNA, 22 nt, Human
uguccucuuccagugcuccuuc

SEQ ID NO: 167394 - RNA, 22 nt, Human
uuguauuggcaaagaacuugag

SEQ ID NO: 167395 - RNA, 22 nt, Human
gguggggccugcuccagcggcc

SEQ ID NO: 167396 - RNA, 22 nt, Human
augaaacaguguguauagcaaa

SEQ ID NO: 167397 - RNA, 22 nt, Human
uuguucaugguuguaaguuuga

SEQ ID NO: 167398 - RNA, 22 nt, Human
agggccucugacgcccccagcc

SEQ ID NO: 167399 - RNA, 22 nt, Human
caguccuuccuugccccuuggg

SEQ ID NO: 167400 - RNA, 22 nt, Human
ggaccugcauuuuaacaagauc

SEQ ID NO: 167401 - RNA, 22 nt, Human
uguacuuaugagauccuagucg

SEQ ID NO: 167402 - RNA, 22 nt, Human
aucauuacuccuguaaaauugu

SEQ ID NO: 167403 - RNA, 22 nt, Human
uacagauauagagauuuauaga

SEQ ID NO: 167404 - RNA, 22 nt, Human
ggcuccacccugcuuccagaag

SEQ ID NO: 167405 - RNA, 22 nt, Human
aauuaauggaaaguaaggaagg

SEQ ID NO: 167406 - RNA, 19 nt, Human
cgcagguggaaggagccgc

SEQ ID NO: 167407 - RNA, 22 nt, Human
ccguagcacaugcuccuggggc

SEQ ID NO: 167408 - RNA, 21 nt, Human
ugggugggcagagucucuuca

SEQ ID NO: 167409 - RNA, 22 nt, Human
guguccuuaugcauaccagagu

SEQ ID NO: 167410 - RNA, 22 nt, Human
guggaggagaggcgccuugcgg

SEQ ID NO: 167411 - RNA, 22 nt, Human
uuucuuauacuauauugucauc

SEQ ID NO: 167412 - RNA, 22 nt, Human
gaggcaggcacuguuaucagca

SEQ ID NO: 167413 - RNA, 22 nt, Human
cuguccugguacuuugagguuc

SEQ ID NO: 167414 - RNA, 22 nt, Human
uacccaggggcugagcagaggu

SEQ ID NO: 167415 - RNA, 22 nt, Human
auuucucaguguacauuauguu

SEQ ID NO: 167416 - RNA, 22 nt, Human
agagguugggucugaggugaga

SEQ ID NO: 167417 - RNA, 22 nt, Human
aaauggaucuguggaauacauu

SEQ ID NO: 167418 - RNA, 22 nt, Human
uauccuguuuugcacaauuaua

SEQ ID NO: 167419 - RNA, 17 nt, Human
aggcagguaagaguuau

SEQ ID NO: 167420 - RNA, 22 nt, Human
uauauucaaugauuaguaucag

SEQ ID NO: 167421 - RNA, 22 nt, Human
acacagauuuuacauguuaugc

SEQ ID NO: 167422 - RNA, 22 nt, Human
auucugggugacuacgugauca

SEQ ID NO: 167423 - RNA, 22 nt, Human
cagagaaagggugaauuccuuc

SEQ ID NO: 167424 - RNA, 22 nt, Human
cccuuccugggugucccggagu

SEQ ID NO: 167425 - RNA, 22 nt, Human
agugugagcuaauagcagagcc

SEQ ID NO: 167426 - RNA, 22 nt, Human
agcaggugggcaugaaagcuga

SEQ ID NO: 167427 - RNA, 20 nt, Human
gagggcucguggauggauaa

SEQ ID NO: 167428 - RNA, 18 nt, Human
agcagguggauuuauugg

SEQ ID NO: 167429 - RNA, 19 nt, Human
uugaaauuguuugauaugg

SEQ ID NO: 167430 - RNA, 21 nt, Human
agaauuaaauuggauuugugu

SEQ ID NO: 167431 - RNA, 22 nt, Human
auuaaauuggaucugcauaguu

SEQ ID NO: 167432 - RNA, 22 nt, Human
aagaugauguuguguuuucacu

SEQ ID NO: 167433 - RNA, 22 nt, Human
ccuggaucagagccagagaagc

SEQ ID NO: 167434 - RNA, 22 nt, Human
uugauacaggcucuauuucauc

SEQ ID NO: 167435 - RNA, 19 nt, Human
cuucuucuuggcagccaag

SEQ ID NO: 167436 - RNA, 22 nt, Human
uuugaaguguuauuucuaucac

SEQ ID NO: 167437 - RNA, 20 nt, Human
cuuuaguuauuaacagcacu

SEQ ID NO: 167438 - RNA, 22 nt, Human
uuuauugaacacuugcacuggc

SEQ ID NO: 167439 - RNA, 22 nt, Human
gcaggugguuaaggucccaugu

SEQ ID NO: 167440 - RNA, 22 nt, Human
aaauguaguugaaaaguuaagg

SEQ ID NO: 167441 - RNA, 20 nt, Human
gcauccagacacccagcugc

SEQ ID NO: 167442 - RNA, 19 nt, Human
ccuguucaugacucugucc

SEQ ID NO: 167443 - RNA, 22 nt, Human
ggaucugagagcaagcaggacc

SEQ ID NO: 167444 - RNA, 17 nt, Human
ucagcaaagacaaagga

SEQ ID NO: 167445 - RNA, 22 nt, Human
cuuuacuucucaaaauaaagca

SEQ ID NO: 167446 - RNA, 23 nt, Human
ugcuguggauggcagguccuugc

SEQ ID NO: 167447 - RNA, 22 nt, Human
agaggcaugaucuuauaauuua

SEQ ID NO: 167448 - RNA, 22 nt, Human
ugcagggaugcuagagguaaga

SEQ ID NO: 167449 - RNA, 19 nt, Human
cuauacagccucugaggaa

SEQ ID NO: 167450 - RNA, 22 nt, Human
auauugagaugaggauauuaac

SEQ ID NO: 167451 - RNA, 22 nt, Human
uguccuggggcgacuuggggcc

SEQ ID NO: 167452 - RNA, 22 nt, Human
cagaugagaguggccaggguuc

SEQ ID NO: 167453 - RNA, 22 nt, Human
aaguccuuuaauaucacauagu

SEQ ID NO: 167454 - RNA, 22 nt, Human
aagacaggaaaagcuccaggcc

SEQ ID NO: 167455 - RNA, 22 nt, Human
cagggcucgcucgcucgcucgc

SEQ ID NO: 167456 - RNA, 22 nt, Human
auuugcauaauagugauuugua

SEQ ID NO: 167457 - RNA, 21 nt, Human
aauuagggugccucuuauaau

SEQ ID NO: 167458 - RNA, 22 nt, Human
aacuggauuaacuggcucaaau

SEQ ID NO: 167459 - RNA, 22 nt, Human
cagugagguggauggauggccu

SEQ ID NO: 167460 - RNA, 22 nt, Human
aaauccuaauaaugcacuagug

SEQ ID NO: 167461 - RNA, 22 nt, Human
caaacuggcuaugggaaucuug

SEQ ID NO: 167462 - RNA, 22 nt, Human
gcuggcugaguucugucgucug

SEQ ID NO: 167463 - RNA, 22 nt, Human
acauguguacuuuuaaggaugu

SEQ ID NO: 167464 - RNA, 22 nt, Human
ugguggggauucccucccuggc

SEQ ID NO: 167465 - RNA, 22 nt, Human
agaaacauccugcuuuccauuu

SEQ ID NO: 167466 - RNA, 22 nt, Human
uuucuucucacccaggacagag

SEQ ID NO: 167467 - RNA, 22 nt, Human
uuauuuaaaauguagguuggga

SEQ ID NO: 167468 - RNA, 22 nt, Human
uacaugugguagggagggcagu

SEQ ID NO: 167469 - RNA, 22 nt, Human
aagggcaggcagagaucauaua

SEQ ID NO: 167470 - RNA, 22 nt, Human
agaggcucugccgccucaggua

SEQ ID NO: 167471 - RNA, 22 nt, Human
ugaugguuuuauuaauaggacc

SEQ ID NO: 167472 - RNA, 22 nt, Human
ggagagggggcucccugcuugg

SEQ ID NO: 167473 - RNA, 22 nt, Human
uguuucaugauugcugucauuu

SEQ ID NO: 167474 - RNA, 22 nt, Human
uacagagaguacagcauccaca

SEQ ID NO: 167475 - RNA, 22 nt, Human
uaggugucagguauagaauuua

SEQ ID NO: 167476 - RNA, 22 nt, Human
auggcuuuuuagacuuugguac

SEQ ID NO: 167477 - RNA, 22 nt, Human
guauacagauacuuagacgugc

SEQ ID NO: 167478 - RNA, 22 nt, Human
caauuucucgaacucuaaucca

SEQ ID NO: 167479 - RNA, 22 nt, Human
ucagacagaggagcucgugcag

SEQ ID NO: 167480 - RNA, 21 nt, Human
ucagcuuugcaacugcacauc

SEQ ID NO: 167481 - RNA, 22 nt, Human
aguggcagggcuggcugcugca

SEQ ID NO: 167482 - RNA, 22 nt, Human
uccugcagaucaaagccuuuga

SEQ ID NO: 167483 - RNA, 22 nt, Human
cuguccuguggugacagguaca

SEQ ID NO: 167484 - RNA, 21 nt, Human
gaaaagcaagggaguagaaca

SEQ ID NO: 167485 - RNA, 20 nt, Human
cauuugaaucuccauucugc

SEQ ID NO: 167486 - RNA, 22 nt, Human
uuccuaauggcaaaacauguuu

SEQ ID NO: 167487 - RNA, 22 nt, Human
caggaaaggugugucaugaugg

SEQ ID NO: 167488 - RNA, 22 nt, Human
uuaguugauguucuggagguag

SEQ ID NO: 167489 - RNA, 22 nt, Human
auggaagacagauaaggcagaa

SEQ ID NO: 167490 - RNA, 23 nt, Human
ugagcaucacaggagaaccaggc

SEQ ID NO: 167491 - RNA, 22 nt, Human
ucauuauccuaguaucuugaau

SEQ ID NO: 167492 - RNA, 22 nt, Human
cuauaauuaugcucaaaaugua

SEQ ID NO: 167493 - RNA, 22 nt, Human
accugcaggcacaggugugcgc

SEQ ID NO: 167494 - RNA, 22 nt, Human
ugcuuaauacguauuugcugga

SEQ ID NO: 167495 - RNA, 22 nt, Human
ggcagggcagcgcugauuaggg

SEQ ID NO: 167496 - RNA, 21 nt, Human
aaauggauagggcaauggaag

SEQ ID NO: 167497 - RNA, 22 nt, Human
auacagaauacuaauuccugag

SEQ ID NO: 167498 - RNA, 22 nt, Human
ucaggugggaguagaaugcuag

SEQ ID NO: 167499 - RNA, 22 nt, Human
gaucagaaucuucauuuucagu

SEQ ID NO: 167500 - RNA, 22 nt, Human
uagaauaugauuaauuuucuua

SEQ ID NO: 167501 - RNA, 22 nt, Human
uugcuguagcucauuucacucu

SEQ ID NO: 167502 - RNA, 22 nt, Human
ggacaggugugaggcuggcaca

SEQ ID NO: 167503 - RNA, 19 nt, Human
aggcaggugcagagguccc

SEQ ID NO: 167504 - RNA, 22 nt, Human
ccuggacucaggcugugggcac

SEQ ID NO: 167505 - RNA, 22 nt, Human
uuucuuuguuguuaucacauca

SEQ ID NO: 167506 - RNA, 22 nt, Human
ucagcuuucucucgccaucagg

SEQ ID NO: 167507 - RNA, 22 nt, Human
uggacaacauagugagaccuca

SEQ ID NO: 167508 - RNA, 22 nt, Human
aucuaacacuguaaacugucuu

SEQ ID NO: 167509 - RNA, 22 nt, Human
gucccauaaguagugcaacuug

SEQ ID NO: 167510 - RNA, 22 nt, Human
aggcaggugcuuaugacuugcu

SEQ ID NO: 167511 - RNA, 22 nt, Human
gguaggaguauuuugcagcagu

SEQ ID NO: 167512 - RNA, 22 nt, Human
ucacaggcuugugaacauugca

SEQ ID NO: 167513 - RNA, 20 nt, Human
aaguuuucuccaaauacagu

SEQ ID NO: 167514 - RNA, 22 nt, Human
uauuccagguuucuuguuguau

SEQ ID NO: 167515 - RNA, 22 nt, Human
cccagugucugggccugcaggg

SEQ ID NO: 167516 - RNA, 22 nt, Human
acuuggcaaguaucuauaaagu

SEQ ID NO: 167517 - RNA, 22 nt, Human
caguaucugucaguaaucaggu

SEQ ID NO: 167518 - RNA, 22 nt, Human
agcugcaacuguccuugccuug

SEQ ID NO: 167519 - RNA, 22 nt, Human
cuguccucaucugccccaaggg

SEQ ID NO: 167520 - RNA, 22 nt, Human
ggaggggucucuagcgaggaga

SEQ ID NO: 167521 - RNA, 22 nt, Human
uuguauuuggguaguauagaga

SEQ ID NO: 167522 - RNA, 22 nt, Human
acacaaugcauauuuuuccaga

SEQ ID NO: 167523 - RNA, 22 nt, Human
uguccuggagacacaagguggu

SEQ ID NO: 167524 - RNA, 22 nt, Human
guaaucucagcuacuugggagg

SEQ ID NO: 167525 - RNA, 22 nt, Human
ggguuucaugguucucacaaug

SEQ ID NO: 167526 - RNA, 22 nt, Human
ccuugcucaucccccagugccu

SEQ ID NO: 167527 - RNA, 22 nt, Human
ggcaggugcucaaaaauauuug

SEQ ID NO: 167528 - RNA, 22 nt, Human
gauuuacagcuauacccaaugg

SEQ ID NO: 167529 - RNA, 22 nt, Human
gguagggcaaaguagggcaccu

SEQ ID NO: 167530 - RNA, 22 nt, Human
ugaaauagucuaaaaaaccaga

SEQ ID NO: 167531 - RNA, 22 nt, Human
uggcagggaauacagauguuua

SEQ ID NO: 167532 - RNA, 21 nt, Human
uccugcagaaugccuuccuac

SEQ ID NO: 167533 - RNA, 19 nt, Human
cuguuauugucagagcucc

SEQ ID NO: 167534 - RNA, 22 nt, Human
cauuugcagagggugacacucu

SEQ ID NO: 167535 - RNA, 22 nt, Human
uuccuucuucauuguguuacag

SEQ ID NO: 167536 - RNA, 22 nt, Human
uggcuuuaggagcuauauaccu

SEQ ID NO: 167537 - RNA, 22 nt, Human
uuccucagagggcgcuggggaa

SEQ ID NO: 167538 - RNA, 22 nt, Human
auuuuacuuugugaauauugac

SEQ ID NO: 167539 - RNA, 22 nt, Human
auugcuuuuagugaaauuauau

SEQ ID NO: 167540 - RNA, 22 nt, Human
uucauagaucucaauuuugagg

SEQ ID NO: 167541 - RNA, 22 nt, Human
uauuaggguaaauuugacaugc

SEQ ID NO: 167542 - RNA, 22 nt, Human
uucacagagagaacucaaacca

SEQ ID NO: 167543 - RNA, 22 nt, Human
uggcuuuagguugcauguuucu

SEQ ID NO: 167544 - RNA, 19 nt, Human
gcgaggaagucacuguggc

SEQ ID NO: 167545 - RNA, 22 nt, Human
uggagcagugguccuggagaug

SEQ ID NO: 167546 - RNA, 22 nt, Human
aagaugcagcuuuacaauaagg

SEQ ID NO: 167547 - RNA, 22 nt, Human
uucccuuccucacucuacuugu

SEQ ID NO: 167548 - RNA, 22 nt, Human
aaaucauguuggcacaauaaaa

SEQ ID NO: 167549 - RNA, 22 nt, Human
gaggugucugaguggggaccug

SEQ ID NO: 167550 - RNA, 22 nt, Human
uauaaaauucucaguuuggggu

SEQ ID NO: 167551 - RNA, 18 nt, Human
uuugcaaaggaaguaugg

SEQ ID NO: 167552 - RNA, 22 nt, Human
uuggaggauaaggauauugauu

SEQ ID NO: 167553 - RNA, 22 nt, Human
gcagggcagugugucugugggg

SEQ ID NO: 167554 - RNA, 22 nt, Human
ucuuccuugccuugcuucauca

SEQ ID NO: 167555 - RNA, 22 nt, Human
ccaggccuagccccugagggua

SEQ ID NO: 167556 - RNA, 21 nt, Human
uuuagggaccaggucauaggc

SEQ ID NO: 167557 - RNA, 22 nt, Human
aguguuagugaaagguguuuau

SEQ ID NO: 167558 - RNA, 22 nt, Human
caugaaggaauaauuguuuaga

SEQ ID NO: 167559 - RNA, 22 nt, Human
ucuaggguguauaaggaagccu

SEQ ID NO: 167560 - RNA, 22 nt, Human
uucaccacagucucaucuacgc

SEQ ID NO: 167561 - RNA, 22 nt, Human
aguacaauuuaaugaagauagc

SEQ ID NO: 167562 - RNA, 22 nt, Human
aaagcagacugauuugcaucac

SEQ ID NO: 167563 - RNA, 22 nt, Human
ggagcugagcagcgauggcgga

SEQ ID NO: 167564 - RNA, 22 nt, Human
agcuucuugggcuuuacacaaa

SEQ ID NO: 167565 - RNA, 22 nt, Human
ggcauuuagagggcuuuucuga

SEQ ID NO: 167566 - RNA, 22 nt, Human
aagggcagaauagagaagaugg

SEQ ID NO: 167567 - RNA, 22 nt, Human
ggucccaggaaucuguguucua

SEQ ID NO: 167568 - RNA, 22 nt, Human
cauagaaacuugcagcaagcac

SEQ ID NO: 167569 - RNA, 22 nt, Human
ggacauuuuucuuccuacaaug

SEQ ID NO: 167570 - RNA, 22 nt, Human
cuuaaauuggaugaguuaaguu

SEQ ID NO: 167571 - RNA, 22 nt, Human
ccagguguguacagaacagcac

SEQ ID NO: 167572 - RNA, 22 nt, Human
ucuccauuuuauagauaaugaa

SEQ ID NO: 167573 - RNA, 22 nt, Human
gcugguccagggccucuguggg

SEQ ID NO: 167574 - RNA, 22 nt, Human
guuccaaagucucugagcugag

SEQ ID NO: 167575 - RNA, 22 nt, Human
uaucaagugacuaucacagaac

SEQ ID NO: 167576 - RNA, 22 nt, Human
ggaucuucagccagcaggugcc

SEQ ID NO: 167577 - RNA, 22 nt, Human
auuuguagugaagugaaaauaa

SEQ ID NO: 167578 - RNA, 22 nt, Human
cauuuauucucagauccuuguc

SEQ ID NO: 167579 - RNA, 22 nt, Human
aaugguuuucuagaacaugaaa

SEQ ID NO: 167580 - RNA, 22 nt, Human
uuucaacguguaaucuuauuua

SEQ ID NO: 167581 - RNA, 22 nt, Human
ggggcagggagguuaucgccga

SEQ ID NO: 167582 - RNA, 22 nt, Human
ucaagaaacugugcuacagagu

SEQ ID NO: 167583 - RNA, 22 nt, Human
agcugcaauucuggacauaguc

SEQ ID NO: 167584 - RNA, 22 nt, Human
uguggggcugugguguucuucu

SEQ ID NO: 167585 - RNA, 22 nt, Human
ucagcuuucuauguugcuaaac

SEQ ID NO: 167586 - RNA, 17 nt, Human
ccaggugggaggugggg

SEQ ID NO: 167587 - RNA, 22 nt, Human
caggcauagguaggauguuucu

SEQ ID NO: 167588 - RNA, 22 nt, Human
agggcucugagcuggaccaccu

SEQ ID NO: 167589 - RNA, 22 nt, Human
uuuaggcacagggaguugguuu

SEQ ID NO: 167590 - RNA, 22 nt, Human
auccauuugaaagaacagucca

SEQ ID NO: 167591 - RNA, 22 nt, Human
ugcuuuauguggcugauacuca

SEQ ID NO: 167592 - RNA, 22 nt, Human
uugcuuuaaaauggcuaagucu

SEQ ID NO: 167593 - RNA, 22 nt, Human
ucaugugucugcugcagcuguu

SEQ ID NO: 167594 - RNA, 22 nt, Human
ccagauaaggcuuuuuaaaagc

SEQ ID NO: 167595 - RNA, 22 nt, Human
uuggaacauccaggacagauau

SEQ ID NO: 167596 - RNA, 22 nt, Human
uuugucauaucacacaauuuug

SEQ ID NO: 167597 - RNA, 21 nt, Human
ugggaccuagcuuugcacagg

SEQ ID NO: 167598 - RNA, 22 nt, Human
augguuuauugcuuuaaugaaa

SEQ ID NO: 167599 - RNA, 22 nt, Human
gagugcuugcauauuuauuguc

SEQ ID NO: 167600 - RNA, 22 nt, Human
aaauauaguaaaugcauaguuc

SEQ ID NO: 167601 - RNA, 22 nt, Human
ggcaggugccuucugugcuagc

SEQ ID NO: 167602 - RNA, 22 nt, Human
ucuuuauuucugaaucccccau

SEQ ID NO: 167603 - RNA, 22 nt, Human
uagaacauaagucauucauuug

SEQ ID NO: 167604 - RNA, 22 nt, Human
ugcuuuaucugugagaaccuga

SEQ ID NO: 167605 - RNA, 22 nt, Human
uuuauuuaaagucguguguuaa

SEQ ID NO: 167606 - RNA, 22 nt, Human
cauacuuuugcccugacauucu

SEQ ID NO: 167607 - RNA, 22 nt, Human
uaguccuuuaucaaacauuuau

SEQ ID NO: 167608 - RNA, 22 nt, Human
caauuucuuguuaauucucagg

SEQ ID NO: 167609 - RNA, 22 nt, Human
uaaagccacuucauucuagucu

SEQ ID NO: 167610 - RNA, 22 nt, Human
cuuugaagauggcaaauuuaga

SEQ ID NO: 167611 - RNA, 22 nt, Human
auuucuggauuuuggaugcugc

SEQ ID NO: 167612 - RNA, 22 nt, Human
acuuucuucuacuacuuggaga

SEQ ID NO: 167613 - RNA, 22 nt, Human
aggacauguaaauggagaggga

SEQ ID NO: 167614 - RNA, 22 nt, Human
aaaaagguugauccagauuagg

SEQ ID NO: 167615 - RNA, 22 nt, Human
gauaaaauauguggccuuuagu

SEQ ID NO: 167616 - RNA, 22 nt, Human
aaaauccucuaauucuagaaua

SEQ ID NO: 167617 - RNA, 22 nt, Human
ugccuggaaggcccaugggaag

SEQ ID NO: 167618 - RNA, 22 nt, Human
uuuguaaaggccugaauuucag

SEQ ID NO: 167619 - RNA, 22 nt, Human
ucagacagauuuugacacuugc

SEQ ID NO: 167620 - RNA, 22 nt, Human
ugaaagcuuugggacaguguga

SEQ ID NO: 167621 - RNA, 19 nt, Human
ugcuuccucaccaucuccc

SEQ ID NO: 167622 - RNA, 22 nt, Human
uucagcacuguuauggauuugc

SEQ ID NO: 167623 - RNA, 22 nt, Human
uauuuccauguuagaacuaagu

SEQ ID NO: 167624 - RNA, 22 nt, Human
uugcuuuacuuugccauucguu

SEQ ID NO: 167625 - RNA, 22 nt, Human
uccagaccaugugagaggcgca

SEQ ID NO: 167626 - RNA, 22 nt, Human
ugaaaaaccucaguccgcuuua

SEQ ID NO: 167627 - RNA, 22 nt, Human
uauuugaagauucuucugaugu

SEQ ID NO: 167628 - RNA, 22 nt, Human
uguugauuaguguuuagacuua

SEQ ID NO: 167629 - RNA, 22 nt, Human
gcuggaggauggacuggaagaa

SEQ ID NO: 167630 - RNA, 22 nt, Human
uuuuucauauuccccucucugg

SEQ ID NO: 167631 - RNA, 22 nt, Human
agcagggcaaagucaggcuaac

SEQ ID NO: 167632 - RNA, 22 nt, Human
ugcugccagggcucugcccaca

SEQ ID NO: 167633 - RNA, 22 nt, Human
acagguggacacagcagcaguc

SEQ ID NO: 167634 - RNA, 22 nt, Human
ugggucuguagggcuguccaau

SEQ ID NO: 167635 - RNA, 22 nt, Human
guuuaauaauguugaauuacua

SEQ ID NO: 167636 - RNA, 22 nt, Human
ugcagggcauaggguccaguuu

SEQ ID NO: 167637 - RNA, 22 nt, Human
ugcuuuauucagucucugccau

SEQ ID NO: 167638 - RNA, 22 nt, Human
ucacuuuggauuauguaauuuc

SEQ ID NO: 167639 - RNA, 22 nt, Human
ugugucaauuuucauuccuacu

SEQ ID NO: 167640 - RNA, 22 nt, Human
acucauugaaacuuaagaucua

SEQ ID NO: 167641 - RNA, 22 nt, Human
ggauuugaauuguugaaaugau

SEQ ID NO: 167642 - RNA, 19 nt, Human
uucuaccuuacuguaggcu

SEQ ID NO: 167643 - RNA, 22 nt, Human
uggagcugguaaacagugacau

SEQ ID NO: 167644 - RNA, 22 nt, Human
cagaauguagaucaucaucaag

SEQ ID NO: 167645 - RNA, 22 nt, Human
aaaauugagagucuugugcaag

SEQ ID NO: 167646 - RNA, 21 nt, Human
acaugucuggucauuuuuagc

SEQ ID NO: 167647 - RNA, 22 nt, Human
ugcauguuaagaaaauauugag

SEQ ID NO: 167648 - RNA, 22 nt, Human
uauuuguagaauggauuaaggg

SEQ ID NO: 167649 - RNA, 22 nt, Human
uggaaugaaaaguacuucagaa

SEQ ID NO: 167650 - RNA, 22 nt, Human
uugaauaauaugcuucguucuc

SEQ ID NO: 167651 - RNA, 22 nt, Human
agccagagcagggaauuggaca

SEQ ID NO: 167652 - RNA, 22 nt, Human
uaauuuuuccacguacacuggg

SEQ ID NO: 167653 - RNA, 22 nt, Human
auccuuagguggugcaucaggg

SEQ ID NO: 167654 - RNA, 22 nt, Human
gacuuuaucuuguccuuccugc

SEQ ID NO: 167655 - RNA, 22 nt, Human
ugcucauuggcgaucugaggga

SEQ ID NO: 167656 - RNA, 22 nt, Human
cuauugaggacauaaggacucu

SEQ ID NO: 167657 - RNA, 22 nt, Human
uacccagcuccucagaagacca

SEQ ID NO: 167658 - RNA, 22 nt, Human
cagggcaguaacgggaacaucu

SEQ ID NO: 167659 - RNA, 20 nt, Human
uuccuggggaaugauagaag

SEQ ID NO: 167660 - RNA, 22 nt, Human
cagucaccauagaauaaaacau

SEQ ID NO: 167661 - RNA, 22 nt, Human
cagaucuguaguaaaagaucuc

SEQ ID NO: 167662 - RNA, 18 nt, Human
ggugagggagcuggaagc

SEQ ID NO: 167663 - RNA, 22 nt, Human
acaugcuucauauuauaaccaa

SEQ ID NO: 167664 - RNA, 22 nt, Human
cugcugccccugagcucagccu

SEQ ID NO: 167665 - RNA, 22 nt, Human
uaaagcuguucagugcagaaag

SEQ ID NO: 167666 - RNA, 22 nt, Human
aauacugucuuucacagauauu

SEQ ID NO: 167667 - RNA, 22 nt, Human
auuuccuguaggggcuugcgaa

SEQ ID NO: 167668 - RNA, 22 nt, Human
cuguguccauguucuaauuugg

SEQ ID NO: 167669 - RNA, 22 nt, Human
uuuugcuguguccuugagccgg

SEQ ID NO: 167670 - RNA, 22 nt, Human
cugggaaauggcuucgagcuca

SEQ ID NO: 167671 - RNA, 22 nt, Human
aauuuacacuucauuuggaggg

SEQ ID NO: 167672 - RNA, 22 nt, Human
uacuuuuagccuauuugauucu

SEQ ID NO: 167673 - RNA, 22 nt, Human
uacagaaguaaauaccaaaagc

SEQ ID NO: 167674 - RNA, 22 nt, Human
uugcuuuacaaaaauugauggu

SEQ ID NO: 167675 - RNA, 22 nt, Human
aguagcacaauuuugucccuaa

SEQ ID NO: 167676 - RNA, 22 nt, Human
gcagacagccagacugcacugg

SEQ ID NO: 167677 - RNA, 22 nt, Human
aguguccuugauuccuguuguu

SEQ ID NO: 167678 - RNA, 22 nt, Human
guuuauuauucaacuucauguu

SEQ ID NO: 167679 - RNA, 22 nt, Human
cagcuucugucugauuagcaag

SEQ ID NO: 167680 - RNA, 22 nt, Human
auaugagaauuggaaaauauca

SEQ ID NO: 167681 - RNA, 22 nt, Human
cuagaaauucugauucaguagg

SEQ ID NO: 167682 - RNA, 22 nt, Human
ucuguucauacagaguauagua

SEQ ID NO: 167683 - RNA, 22 nt, Human
agcuuuguggcuuugcaagacu

SEQ ID NO: 167684 - RNA, 22 nt, Human
ccagugugauuguugcaagaau

SEQ ID NO: 167685 - RNA, 22 nt, Human
ucugaaaugcaaauuugacuga

SEQ ID NO: 167686 - RNA, 22 nt, Human
ggugggugcagggggcuucuua

SEQ ID NO: 167687 - RNA, 22 nt, Human
agagggugaaugagauagaaaa

SEQ ID NO: 167688 - RNA, 23 nt, Human
gagggcucugagugcuugggcca

SEQ ID NO: 167689 - RNA, 21 nt, Human
gggaggaagcugcuucucucu

SEQ ID NO: 167690 - RNA, 22 nt, Human
uuucucagcucagcaucugggu

SEQ ID NO: 167691 - RNA, 22 nt, Human
uccugcagcugaagcucaugug

SEQ ID NO: 167692 - RNA, 22 nt, Human
ccaaagcaagucacaugaucaa

SEQ ID NO: 167693 - RNA, 22 nt, Human
uggaauaaagugcuuugaucag

SEQ ID NO: 167694 - RNA, 17 nt, Human
uguagcuucuccuucuc

SEQ ID NO: 167695 - RNA, 22 nt, Human
uucacaauaggagcaugcaaau

SEQ ID NO: 167696 - RNA, 22 nt, Human
ugagaaaagguugagaugauaa

SEQ ID NO: 167697 - RNA, 21 nt, Human
ucauguguaacuuuugaccac

SEQ ID NO: 167698 - RNA, 22 nt, Human
aaagcucuuuuccaaguauuga

SEQ ID NO: 167699 - RNA, 22 nt, Human
auuuccagacuuuuuccaggaa

SEQ ID NO: 167700 - RNA, 22 nt, Human
auuucuguuugcuacuauaagu

SEQ ID NO: 167701 - RNA, 20 nt, Human
ccuguucacugcgcaguuuc

SEQ ID NO: 167702 - RNA, 22 nt, Human
agacagacuugaaaauguucuu

SEQ ID NO: 167703 - RNA, 22 nt, Human
ucuagacacuacuaguaaccgg

SEQ ID NO: 167704 - RNA, 22 nt, Human
auagucacugccuuccauuugu

SEQ ID NO: 167705 - RNA, 22 nt, Human
acccagccacagcauugaggga

SEQ ID NO: 167706 - RNA, 22 nt, Human
uuccuagggcagagccgcuggg

SEQ ID NO: 167707 - RNA, 22 nt, Human
aucauucuaguccuuauggucu

SEQ ID NO: 167708 - RNA, 22 nt, Human
acagcaugagagaugaacauuc

SEQ ID NO: 167709 - RNA, 22 nt, Human
uaaauguauaggcacuaaaccu

SEQ ID NO: 167710 - RNA, 22 nt, Human
gaugcgggcccgcuccacugcc

SEQ ID NO: 167711 - RNA, 22 nt, Human
acaguacauaauccugagucug

SEQ ID NO: 167712 - RNA, 22 nt, Human
gcagcuuuguaaaguaugaagc

SEQ ID NO: 167713 - RNA, 22 nt, Human
acacagcaacuugcaguaugga

SEQ ID NO: 167714 - RNA, 22 nt, Human
gaaucauuggaaccacauccaa

SEQ ID NO: 167715 - RNA, 21 nt, Human
auacagaagguggcaaaguac

SEQ ID NO: 167716 - RNA, 22 nt, Human
aguguccuggggcccuaaggcc

SEQ ID NO: 167717 - RNA, 22 nt, Human
acagggcagagggcaguuggua

SEQ ID NO: 167718 - RNA, 22 nt, Human
uuugcugacuggaugcaguugg

SEQ ID NO: 167719 - RNA, 22 nt, Human
auuaggcaauucugggcaucuc

SEQ ID NO: 167720 - RNA, 22 nt, Human
auauucuuccaaaacaucauuu

SEQ ID NO: 167721 - RNA, 22 nt, Human
auucauaacggcaaaugucacc

SEQ ID NO: 167722 - RNA, 22 nt, Human
uuguacuaucaccaugucaugu

SEQ ID NO: 167723 - RNA, 21 nt, Human
aacugguucaauucaacuaga

SEQ ID NO: 167724 - RNA, 23 nt, Human
aguccuuuuuauaaaauugagga

SEQ ID NO: 167725 - RNA, 22 nt, Human
gcagacagggcuacagagguac

SEQ ID NO: 167726 - RNA, 22 nt, Human
ggcaggcagccuccauccacag

SEQ ID NO: 167727 - RNA, 18 nt, Human
uuuauauggauagagacc

SEQ ID NO: 167728 - RNA, 22 nt, Human
caaaggcaggcccccugugcag

SEQ ID NO: 167729 - RNA, 18 nt, Human
aaaggcugaauauagaag

SEQ ID NO: 167730 - RNA, 22 nt, Human
ccaggcagagggaauagcaagu

SEQ ID NO: 167731 - RNA, 22 nt, Human
agacagacuguguuugaauccu

SEQ ID NO: 167732 - RNA, 22 nt, Human
acaugauuuuuaaagagauaau

SEQ ID NO: 167733 - RNA, 22 nt, Human
ggcaggcaggagcgugcuuggg

SEQ ID NO: 167734 - RNA, 22 nt, Human
ccucccucccucuuaugguuua

SEQ ID NO: 167735 - RNA, 22 nt, Human
agcuuuauucaugauuucaggg

SEQ ID NO: 167736 - RNA, 21 nt, Human
cuggcucuguugucacccggc

SEQ ID NO: 167737 - RNA, 22 nt, Human
cagcagagcugugugggaaggg

SEQ ID NO: 167738 - RNA, 22 nt, Human
cuggauuuaauuaacuguugcu

SEQ ID NO: 167739 - RNA, 22 nt, Human
agucccagcuucccccaugcag

SEQ ID NO: 167740 - RNA, 20 nt, Human
uugcuuuaucagacaugaua

SEQ ID NO: 167741 - RNA, 22 nt, Human
uuccuucuuugugguagaaagu

SEQ ID NO: 167742 - RNA, 22 nt, Human
gagcugaagcgcuacagcaucc

SEQ ID NO: 167743 - RNA, 22 nt, Human
uaaaguuuguagcaauugauau

SEQ ID NO: 167744 - RNA, 22 nt, Human
ugacauguccaggugguccugu

SEQ ID NO: 167745 - RNA, 22 nt, Human
guacagaaugcuugguaaggca

SEQ ID NO: 167746 - RNA, 22 nt, Human
acaggugguaaaauggacuguc

SEQ ID NO: 167747 - RNA, 22 nt, Human
ccacccagaccagggaucuggg

SEQ ID NO: 167748 - RNA, 22 nt, Human
ugcuccuucccuucccagugag

SEQ ID NO: 167749 - RNA, 23 nt, Human
uuucaaauuacucugcagaugac

SEQ ID NO: 167750 - RNA, 22 nt, Human
augaauaaguaaacuccuuugg

SEQ ID NO: 167751 - RNA, 22 nt, Human
cauaauuuuuuuaagucagaac

SEQ ID NO: 167752 - RNA, 22 nt, Human
uuuggacaaguuacugguuucc

SEQ ID NO: 167753 - RNA, 22 nt, Human
auuccaaaggcuggccuggagg

SEQ ID NO: 167754 - RNA, 22 nt, Human
uguggggcagcuagccggccug

SEQ ID NO: 167755 - RNA, 22 nt, Human
cauaauuucuguaucagcacca

SEQ ID NO: 167756 - RNA, 22 nt, Human
cuguggaaaauuuguauguaau

SEQ ID NO: 167757 - RNA, 22 nt, Human
gaaugagggagauguuggugca

SEQ ID NO: 167758 - RNA, 22 nt, Human
acauguguggacaugaaucuac

SEQ ID NO: 167759 - RNA, 23 nt, Human
uggcaaggaaugggauggagacu

SEQ ID NO: 167760 - RNA, 22 nt, Human
gcagagaccccgcagugaggcc

SEQ ID NO: 167761 - RNA, 22 nt, Human
ucuucaaagaauuuuaguaauu

SEQ ID NO: 167762 - RNA, 22 nt, Human
auuauuauuguugauguuaggg

SEQ ID NO: 167763 - RNA, 22 nt, Human
cagcuuuaguaacccacugcuc

SEQ ID NO: 167764 - RNA, 21 nt, Human
cacaugugaauuacugaacug

SEQ ID NO: 167765 - RNA, 22 nt, Human
uauuccagugugaucuuuguag

SEQ ID NO: 167766 - RNA, 22 nt, Human
gaauuucaggacaacuggaagg

SEQ ID NO: 167767 - RNA, 22 nt, Human
uccaugaguuugaggaaaagag

SEQ ID NO: 167768 - RNA, 22 nt, Human
cagggcuagugacaccccaguc

SEQ ID NO: 167769 - RNA, 22 nt, Human
cacccaggacaggccagaugug

SEQ ID NO: 167770 - RNA, 23 nt, Human
uucuggguugcugugcuuggaau

SEQ ID NO: 167771 - RNA, 22 nt, Human
uuccaaaguuaguuauuagaaa

SEQ ID NO: 167772 - RNA, 22 nt, Human
ucuggcuguuuuagaugagcuc

SEQ ID NO: 167773 - RNA, 22 nt, Human
auuuacauuuauuugagaaggu

SEQ ID NO: 167774 - RNA, 22 nt, Human
agaagggaacucagagaugauu

SEQ ID NO: 167775 - RNA, 22 nt, Human
uuccuucuuccuuuaguaacca

SEQ ID NO: 167776 - RNA, 22 nt, Human
auguaaaagauuauuuuccugu

SEQ ID NO: 167777 - RNA, 22 nt, Human
uuggaggaagcucaugggggau

SEQ ID NO: 167778 - RNA, 22 nt, Human
agccauccuacuaccucagcau

SEQ ID NO: 167779 - RNA, 22 nt, Human
cauaugaaauaugaguugaaca

SEQ ID NO: 167780 - RNA, 20 nt, Human
agaaaucagaccacacacua

SEQ ID NO: 167781 - RNA, 22 nt, Human
uuccuuaguuauuugguccccu

SEQ ID NO: 167782 - RNA, 22 nt, Human
ggcaggugggaacccuccccac

SEQ ID NO: 167783 - RNA, 22 nt, Human
gcuaggaggaagaaugugaauu

SEQ ID NO: 167784 - RNA, 22 nt, Human
agugugagaugauugaggagca

SEQ ID NO: 167785 - RNA, 22 nt, Human
aauuucaaacucuugcccucag

SEQ ID NO: 167786 - RNA, 22 nt, Human
uauaaaauggcaucagcuccaa

SEQ ID NO: 167787 - RNA, 22 nt, Human
aucagaaaucuaggauucagaa

SEQ ID NO: 167788 - RNA, 22 nt, Human
gaagugaagguuacucuagauu

SEQ ID NO: 167789 - RNA, 22 nt, Human
cagggcucagaagacagaccuc

SEQ ID NO: 167790 - RNA, 22 nt, Human
aguguccucaucuguaaaauga

SEQ ID NO: 167791 - RNA, 22 nt, Human
caucagaauuacuuggggagcu

SEQ ID NO: 167792 - RNA, 22 nt, Human
uuuucauuagaaugacugagaa

SEQ ID NO: 167793 - RNA, 22 nt, Human
auauuucaugggguuccauacu

SEQ ID NO: 167794 - RNA, 22 nt, Human
gugaauaaucacccuucuggau

SEQ ID NO: 167795 - RNA, 22 nt, Human
cagugaggugcccagccugccc

SEQ ID NO: 167796 - RNA, 22 nt, Human
ucuauacugaugggauacuauu

SEQ ID NO: 167797 - RNA, 22 nt, Human
agaucaguuagauagcuugaug

SEQ ID NO: 167798 - RNA, 22 nt, Human
auaugcuugggacugauacagu

SEQ ID NO: 167799 - RNA, 22 nt, Human
gugcaaaaauaauugugguuuu

SEQ ID NO: 167800 - RNA, 22 nt, Human
acagggcagaaauguugcaucu

SEQ ID NO: 167801 - RNA, 22 nt, Human
aaaguccagagggcacacugaa

SEQ ID NO: 167802 - RNA, 22 nt, Human
uuauacauguguuuugagauga

SEQ ID NO: 167803 - RNA, 22 nt, Human
guugcugggagcagggauccug

SEQ ID NO: 167804 - RNA, 23 nt, Human
acauacauggagauaaagugaug

SEQ ID NO: 167805 - RNA, 20 nt, Human
uggcagguggccucaguucc

SEQ ID NO: 167806 - RNA, 22 nt, Human
ucucucuuuuuaaucauguaau

SEQ ID NO: 167807 - RNA, 22 nt, Human
ggacauguuccuuuucaucuuu

SEQ ID NO: 167808 - RNA, 22 nt, Human
auuuauuaccucggaguuucug

SEQ ID NO: 167809 - RNA, 22 nt, Human
ggcuuuaucaaaugagacccug

SEQ ID NO: 167810 - RNA, 22 nt, Human
uucagaaagguuaaucuggauu

SEQ ID NO: 167811 - RNA, 22 nt, Human
acauaauaggugccugaauauu

SEQ ID NO: 167812 - RNA, 22 nt, Human
cacuuuauaaaauuggugugag

SEQ ID NO: 167813 - RNA, 22 nt, Human
ugucuucaucuccaugcacaga

SEQ ID NO: 167814 - RNA, 22 nt, Human
ugcuggguagaaguauuagucu

SEQ ID NO: 167815 - RNA, 22 nt, Human
guauacauagaugaugaacaag

SEQ ID NO: 167816 - RNA, 22 nt, Human
ucuggaugaagacccagaggcu

SEQ ID NO: 167817 - RNA, 22 nt, Human
acagcaggcaugaaugacacug

SEQ ID NO: 167818 - RNA, 22 nt, Human
auaacaugaccugugcuucaca

SEQ ID NO: 167819 - RNA, 22 nt, Human
agaguggcagcaagucagguag

SEQ ID NO: 167820 - RNA, 22 nt, Human
ucugggugacccugggcaaggc

SEQ ID NO: 167821 - RNA, 22 nt, Human
uuagaaaugauuucaccucuuu

SEQ ID NO: 167822 - RNA, 22 nt, Human
ggcucccacccauagggcgagu

SEQ ID NO: 167823 - RNA, 22 nt, Human
augcuuaauacacuguuaaagg

SEQ ID NO: 167824 - RNA, 22 nt, Human
uccuggcugccgucguccugcg

SEQ ID NO: 167825 - RNA, 22 nt, Human
cagugagggcauucagugcugg

SEQ ID NO: 167826 - RNA, 22 nt, Human
guacccagaggcaugaucccag

SEQ ID NO: 167827 - RNA, 22 nt, Human
gcuggaucaaguccuucaccca

SEQ ID NO: 167828 - RNA, 22 nt, Human
auccugaagcaugaaugucaaa

SEQ ID NO: 167829 - RNA, 22 nt, Human
agcuuuauagaaaggaucagug

SEQ ID NO: 167830 - RNA, 22 nt, Human
gccugcagugagugcagaaggu

SEQ ID NO: 167831 - RNA, 22 nt, Human
auauauuuugcggucacguggc

SEQ ID NO: 167832 - RNA, 19 nt, Human
ugggugugaccaucucugc

SEQ ID NO: 167833 - RNA, 22 nt, Human
aauguuuuagauuacugcuggg

SEQ ID NO: 167834 - RNA, 22 nt, Human
caugucacuuuaacaaauuagu

SEQ ID NO: 167835 - RNA, 22 nt, Human
gcaaaaaaugcuuguugcuuag

SEQ ID NO: 167836 - RNA, 22 nt, Human
uuauucuuuaaacauauauguu

SEQ ID NO: 167837 - RNA, 22 nt, Human
cagucaccugaagacuugacca

SEQ ID NO: 167838 - RNA, 22 nt, Human
ucaggugugaacuauuuggaaa

SEQ ID NO: 167839 - RNA, 22 nt, Human
ugucaccacuggcugaaacacc

SEQ ID NO: 167840 - RNA, 22 nt, Human
aguguccuuguuauuacugcuc

SEQ ID NO: 167841 - RNA, 22 nt, Human
agcagggcucuguggagggugg

SEQ ID NO: 167842 - RNA, 22 nt, Human
uuuaauuuuccucuuccuggag

SEQ ID NO: 167843 - RNA, 22 nt, Human
aguguccuggcaaggguuucag

SEQ ID NO: 167844 - RNA, 23 nt, Human
auauggcuguuguguguuaacau

SEQ ID NO: 167845 - RNA, 22 nt, Human
guguuuuaucagacaaaguaua

SEQ ID NO: 167846 - RNA, 22 nt, Human
uccaggcaucuguauuuuuuaa

SEQ ID NO: 167847 - RNA, 20 nt, Human
gaacuugggcaaguggcuua

SEQ ID NO: 167848 - RNA, 22 nt, Human
uuuccuucccuggaugagaagu

SEQ ID NO: 167849 - RNA, 22 nt, Human
ugcacccucaucagucaaaugg

SEQ ID NO: 167850 - RNA, 22 nt, Human
ucuguucagguuucagagaacu

SEQ ID NO: 167851 - RNA, 22 nt, Human
aggaccugagaguuggaaaucc

SEQ ID NO: 167852 - RNA, 22 nt, Human
guggaggacaaaagaagccuuu

SEQ ID NO: 167853 - RNA, 22 nt, Human
uccugcaggccagaggggugag

SEQ ID NO: 167854 - RNA, 21 nt, Human
uucaauacuauuucaauaguc

SEQ ID NO: 167855 - RNA, 22 nt, Human
aauucauauggauaugcuagua

SEQ ID NO: 167856 - RNA, 22 nt, Human
gggaggaaggcuugggugagua

SEQ ID NO: 167857 - RNA, 22 nt, Human
acugaaugaggggugaucuggg

SEQ ID NO: 167858 - RNA, 22 nt, Human
ugccauuuugagauguuaauga

SEQ ID NO: 167859 - RNA, 22 nt, Human
auuccuucuauucucugugggu

SEQ ID NO: 167860 - RNA, 22 nt, Human
aguaaacaguaucuuuaguguc

SEQ ID NO: 167861 - RNA, 22 nt, Human
caggcauaaguaauguuuuaug

SEQ ID NO: 167862 - RNA, 22 nt, Human
cacugagcugauagaauuccag

SEQ ID NO: 167863 - RNA, 22 nt, Human
gcacccagggacuuggcuggcc

SEQ ID NO: 167864 - RNA, 22 nt, Human
ccugcagaaaggguccccagga

SEQ ID NO: 167865 - RNA, 22 nt, Human
accugcagcuaaagauguaggg

SEQ ID NO: 167866 - RNA, 21 nt, Human
uucuucaaagaagaaggcaca

SEQ ID NO: 167867 - RNA, 22 nt, Human
uauguacuacacuagaacauuu

SEQ ID NO: 167868 - RNA, 22 nt, Human
agcugccagcaaguuucaaaca

SEQ ID NO: 167869 - RNA, 22 nt, Human
ggcagguggacgugcuaaagcu

SEQ ID NO: 167870 - RNA, 22 nt, Human
uuuaaauucugucugccgcuua

SEQ ID NO: 167871 - RNA, 22 nt, Human
gcuuuaaugaagucacgcaaag

SEQ ID NO: 167872 - RNA, 21 nt, Human
ccuuuacaauuuugcauuccu

SEQ ID NO: 167873 - RNA, 21 nt, Human
aaaaagcuggggcaugcaugc

SEQ ID NO: 167874 - RNA, 22 nt, Human
acaacuuuucuaucauguggaa

SEQ ID NO: 167875 - RNA, 14 nt, Human
gcaggcagaucauu

SEQ ID NO: 167876 - RNA, 22 nt, Human
uucuuuucccaauauuuugcug

SEQ ID NO: 167877 - RNA, 22 nt, Human
gcagacagaugagggugcuggg

SEQ ID NO: 167878 - RNA, 21 nt, Human
cagacccucuagaggccaccu

SEQ ID NO: 167879 - RNA, 22 nt, Human
ucuguucagcugccucagggua

SEQ ID NO: 167880 - RNA, 22 nt, Human
gcuguucaagacuaggaaauuu

SEQ ID NO: 167881 - RNA, 22 nt, Human
cacuuuauauucuaagacggcc

SEQ ID NO: 167882 - RNA, 21 nt, Human
ccagcuuucccaagucccuuu

SEQ ID NO: 167883 - RNA, 22 nt, Human
aacuugguuguuggcaauuugc

SEQ ID NO: 167884 - RNA, 22 nt, Human
aggcaggugagucaaaacagac

SEQ ID NO: 167885 - RNA, 22 nt, Human
ucuggaugggaugaggcaacaa

SEQ ID NO: 167886 - RNA, 21 nt, Human
uguccuuaaugcaauguccuu

SEQ ID NO: 167887 - RNA, 22 nt, Human
uuuucagugggcaaugauguga

SEQ ID NO: 167888 - RNA, 21 nt, Human
uaaaggcuuuagaauggcaaa

SEQ ID NO: 167889 - RNA, 22 nt, Human
uuccagauguuuaaguucugcu

SEQ ID NO: 167890 - RNA, 22 nt, Human
ugcugaggagguggcugugcuu

SEQ ID NO: 167891 - RNA, 20 nt, Human
gccugcagagaaggucagag

SEQ ID NO: 167892 - RNA, 22 nt, Human
uuauagaaggagcauucacuua

SEQ ID NO: 167893 - RNA, 22 nt, Human
uucacuuaacaucauaucauga

SEQ ID NO: 167894 - RNA, 22 nt, Human
cagacagggcccugugauggua

SEQ ID NO: 167895 - RNA, 22 nt, Human
aaaaaugcugugguagcugugu

SEQ ID NO: 167896 - RNA, 22 nt, Human
auuccaguuggguucuaauaca

SEQ ID NO: 167897 - RNA, 22 nt, Human
cuggaucaugggaaagggauca

SEQ ID NO: 167898 - RNA, 22 nt, Human
agcuuuaucccuugcccaucga

SEQ ID NO: 167899 - RNA, 22 nt, Human
ucuguucauuugccucggcucu

SEQ ID NO: 167900 - RNA, 22 nt, Human
guucuucaggccauccucccag

SEQ ID NO: 167901 - RNA, 22 nt, Human
ucaauuuauguggcuauucauu

SEQ ID NO: 167902 - RNA, 22 nt, Human
cuucagaggggacucaaaguca

SEQ ID NO: 167903 - RNA, 22 nt, Human
aggagguggcaacugucgacag

SEQ ID NO: 167904 - RNA, 22 nt, Human
uuucauaaacaguagaagacua

SEQ ID NO: 167905 - RNA, 22 nt, Human
uaaucauggccucaaauuuuau

SEQ ID NO: 167906 - RNA, 20 nt, Human
uccuucugaggugaggagga

SEQ ID NO: 167907 - RNA, 22 nt, Human
uccuuuaugugaguuguuuccc

SEQ ID NO: 167908 - RNA, 22 nt, Human
ccuggaucagucacuguugcug

SEQ ID NO: 167909 - RNA, 22 nt, Human
uuguuuuuaaacaugugacuga

SEQ ID NO: 167910 - RNA, 22 nt, Human
cagggcaggacagauacauuac

SEQ ID NO: 167911 - RNA, 22 nt, Human
guucucucugcuuccaagaugg

SEQ ID NO: 167912 - RNA, 22 nt, Human
ccagggcagggaccacgugucu

SEQ ID NO: 167913 - RNA, 22 nt, Human
uuucaaagaccauuaacuauca

SEQ ID NO: 167914 - RNA, 22 nt, Human
ugcugggucagugagagcaggg

SEQ ID NO: 167915 - RNA, 22 nt, Human
uuuugagauggugucucgcucc

SEQ ID NO: 167916 - RNA, 19 nt, Human
aaggaauggcuuuaaguag

SEQ ID NO: 167917 - RNA, 22 nt, Human
aaaucucaguguucuaagcauu

SEQ ID NO: 167918 - RNA, 22 nt, Human
aaucaguguguaaaguggcugc

SEQ ID NO: 167919 - RNA, 22 nt, Human
aguguccuugagguuccuagga

SEQ ID NO: 167920 - RNA, 22 nt, Human
gacagacaggaggcauucaggg

SEQ ID NO: 167921 - RNA, 22 nt, Human
aggugggggcuguguccuugac

SEQ ID NO: 167922 - RNA, 22 nt, Human
ucugaagaacugucuagagaac

SEQ ID NO: 167923 - RNA, 22 nt, Human
agacagacauagaaauuaguaa

SEQ ID NO: 167924 - RNA, 22 nt, Human
uacuuuauuguaaaugcugaug

SEQ ID NO: 167925 - RNA, 22 nt, Human
auucucuuuguauaacaucuug

SEQ ID NO: 167926 - RNA, 22 nt, Human
cacagguguuuguuauacucag

SEQ ID NO: 167927 - RNA, 22 nt, Human
aaaguccuagcgauccacagaa

SEQ ID NO: 167928 - RNA, 22 nt, Human
uuuacuguguccaucugugacu

SEQ ID NO: 167929 - RNA, 22 nt, Human
gccagccuucuguggccugcaa

SEQ ID NO: 167930 - RNA, 22 nt, Human
ggauuuacaaguuuaacucuca

SEQ ID NO: 167931 - RNA, 22 nt, Human
ucacacauucuagguauguuga

SEQ ID NO: 167932 - RNA, 22 nt, Human
aaggcauagucuuuaaguucug

SEQ ID NO: 167933 - RNA, 22 nt, Human
ccugcagggugcugccacagau

SEQ ID NO: 167934 - RNA, 22 nt, Human
ucagagagguuaaauaucuugu

SEQ ID NO: 167935 - RNA, 22 nt, Human
auugcugguagucagugucccu

SEQ ID NO: 167936 - RNA, 22 nt, Human
auuucaguguugguuagcaagc

SEQ ID NO: 167937 - RNA, 22 nt, Human
uguaaauugaaggaaauuugug

SEQ ID NO: 167938 - RNA, 22 nt, Human
uucaacuaauguuuauuuuaug

SEQ ID NO: 167939 - RNA, 22 nt, Human
ugugaauaccuugaauucauca

SEQ ID NO: 167940 - RNA, 22 nt, Human
uuuccaugaucguuauagaacu

SEQ ID NO: 167941 - RNA, 21 nt, Human
uaaaucucuguauucuucagu

SEQ ID NO: 167942 - RNA, 22 nt, Human
uuaacagagugccuggcaugua

SEQ ID NO: 167943 - RNA, 22 nt, Human
cuugcacacauguacaugugua

SEQ ID NO: 167944 - RNA, 22 nt, Human
uuucauugucuacauaugacau

SEQ ID NO: 167945 - RNA, 22 nt, Human
uucaacucuucaagaucacauc

SEQ ID NO: 167946 - RNA, 22 nt, Human
agaaauaugcugauuagaugaa

SEQ ID NO: 167947 - RNA, 22 nt, Human
aucacaaaggguuuucucugag

SEQ ID NO: 167948 - RNA, 22 nt, Human
ugucucaucucuuaaccccacu

SEQ ID NO: 167949 - RNA, 23 nt, Human
uauuagggccaggacuggcaaau

SEQ ID NO: 167950 - RNA, 22 nt, Human
caugaaaauaacauuguuguga

SEQ ID NO: 167951 - RNA, 22 nt, Human
gggcagguaggugaaauaauga

SEQ ID NO: 167952 - RNA, 22 nt, Human
uucuucuuucccccugugguac

SEQ ID NO: 167953 - RNA, 22 nt, Human
ucuggaggcucugagggugagu

SEQ ID NO: 167954 - RNA, 22 nt, Human
caaaguccuagaacagugcuug

SEQ ID NO: 167955 - RNA, 22 nt, Human
cuucauuaaccaaaaugcaaua

SEQ ID NO: 167956 - RNA, 22 nt, Human
ccagguguaagacaugguccua

SEQ ID NO: 167957 - RNA, 22 nt, Human
aggcaggucuguaucuagucuc

SEQ ID NO: 167958 - RNA, 22 nt, Human
acccaggguagaaccucagagc

SEQ ID NO: 167959 - RNA, 22 nt, Human
caugcuuuuuucuaguauaaau

SEQ ID NO: 167960 - RNA, 22 nt, Human
auuaauuuuucugacagccaca

SEQ ID NO: 167961 - RNA, 22 nt, Human
auuuagccucauuuuugacaua

SEQ ID NO: 167962 - RNA, 22 nt, Human
uuagaaaugucacagaucugau

SEQ ID NO: 167963 - RNA, 22 nt, Human
ucagaauuuuuguuacccuuga

SEQ ID NO: 167964 - RNA, 22 nt, Human
aaaacauucugugaacucucaa

SEQ ID NO: 167965 - RNA, 22 nt, Human
uacaugaaguugucuaaacugg

SEQ ID NO: 167966 - RNA, 22 nt, Human
agaugaaaagauaagcagcaau

SEQ ID NO: 167967 - RNA, 22 nt, Human
gcuggccuugaggugucuuuau

SEQ ID NO: 167968 - RNA, 22 nt, Human
uuuacagucaccaaacuuugcu

SEQ ID NO: 167969 - RNA, 22 nt, Human
uuguuuuaucuuucuacagacu

SEQ ID NO: 167970 - RNA, 22 nt, Human
ucugggcccuaaaccagcucua

SEQ ID NO: 167971 - RNA, 22 nt, Human
acaauacuauuuucaguauccu

SEQ ID NO: 167972 - RNA, 19 nt, Human
uggcagggagaguuugaag

SEQ ID NO: 167973 - RNA, 22 nt, Human
cuugcuggugucgugccuucac

SEQ ID NO: 167974 - RNA, 22 nt, Human
auguccucaaaacugauugcag

SEQ ID NO: 167975 - RNA, 22 nt, Human
agaauuccuccucugggacacu

SEQ ID NO: 167976 - RNA, 22 nt, Human
aucagaaauugcccagcuguuu

SEQ ID NO: 167977 - RNA, 21 nt, Human
gcaugugugggacuggauccu

SEQ ID NO: 167978 - RNA, 22 nt, Human
auacagaacaagccucaccucc

SEQ ID NO: 167979 - RNA, 22 nt, Human
ccuucucccucugagaggaacc

SEQ ID NO: 167980 - RNA, 22 nt, Human
gggcagguguugucaaucuaau

SEQ ID NO: 167981 - RNA, 22 nt, Human
ugaacaugcuguugauggccug

SEQ ID NO: 167982 - RNA, 22 nt, Human
ucauuucccuccuacaaagagg

SEQ ID NO: 167983 - RNA, 22 nt, Human
uauugauaaggauggcugcaau

SEQ ID NO: 167984 - RNA, 19 nt, Human
ggcauccagaacuaccagu

SEQ ID NO: 167985 - RNA, 22 nt, Human
cugcagggcagaagggcauaga

SEQ ID NO: 167986 - RNA, 22 nt, Human
cagcuucugcuaucgaacaucu

SEQ ID NO: 167987 - RNA, 22 nt, Human
agcuggucuuaaauguguccag

SEQ ID NO: 167988 - RNA, 22 nt, Human
guuagguagaaguuuacuuuga

SEQ ID NO: 167989 - RNA, 19 nt, Human
ugcauaaauuauauacuuu

SEQ ID NO: 167990 - RNA, 22 nt, Human
agcugcaaguguugccuccuac

SEQ ID NO: 167991 - RNA, 22 nt, Human
ccuguucaauauucuuccuugu

SEQ ID NO: 167992 - RNA, 22 nt, Human
aaagcugcugugaaugguuugg

SEQ ID NO: 167993 - RNA, 22 nt, Human
uuccuucuuccaaacccaucau

SEQ ID NO: 167994 - RNA, 22 nt, Human
aaagcagagcagggcacuuaug

SEQ ID NO: 167995 - RNA, 22 nt, Human
gagaugguugcaauaguuuaaa

SEQ ID NO: 167996 - RNA, 22 nt, Human
ucauucuugaucacuaguuagu

SEQ ID NO: 167997 - RNA, 22 nt, Human
uuccuucuauucagcuccaaga

SEQ ID NO: 167998 - RNA, 22 nt, Human
uuauuucauguaaaauuuaugu

SEQ ID NO: 167999 - RNA, 22 nt, Human
ggacuccucuagaaguugaggc

SEQ ID NO: 168000 - RNA, 22 nt, Human
cuuaauuacuguccaauaugca

SEQ ID NO: 168001 - RNA, 22 nt, Human
ggcaggcacuguguuuuguguu

SEQ ID NO: 168002 - RNA, 22 nt, Human
cuagccugggauuugaacuuau

SEQ ID NO: 168003 - RNA, 22 nt, Human
uuccaggaccaggaagagggga

SEQ ID NO: 168004 - RNA, 22 nt, Human
cagggagcuggugccagccgac

SEQ ID NO: 168005 - RNA, 23 nt, Human
uccuggguuugaauucuagucuu

SEQ ID NO: 168006 - RNA, 22 nt, Human
cagaaauucccauuucagauuc

SEQ ID NO: 168007 - RNA, 22 nt, Human
accauuuaaggaaaauguauca

SEQ ID NO: 168008 - RNA, 22 nt, Human
aucuuucuccauauacaucuuu

SEQ ID NO: 168009 - RNA, 22 nt, Human
ugcuggagcccaggcggccuuu

SEQ ID NO: 168010 - RNA, 22 nt, Human
cuguggaaauaaacaaugcuaa

SEQ ID NO: 168011 - RNA, 22 nt, Human
cauuuacacacagaggugugcu

SEQ ID NO: 168012 - RNA, 22 nt, Human
cuuccuuccacaccuucagaau

SEQ ID NO: 168013 - RNA, 22 nt, Human
ggcaguggguuccccaaggcac

SEQ ID NO: 168014 - RNA, 22 nt, Human
gcauagucaguaggauucucaa

SEQ ID NO: 168015 - RNA, 22 nt, Human
aacaggcaggagaauucugccu

SEQ ID NO: 168016 - RNA, 22 nt, Human
uuuuuucagccugucugugcca

SEQ ID NO: 168017 - RNA, 22 nt, Human
aacagacauauuuuuaauaugc

SEQ ID NO: 168018 - RNA, 19 nt, Human
ucugaagaauuagagagca

SEQ ID NO: 168019 - RNA, 22 nt, Human
aaagaaaccuaucagccacaug

SEQ ID NO: 168020 - RNA, 22 nt, Human
aguauacaaauaaauguguaau

SEQ ID NO: 168021 - RNA, 22 nt, Human
uguuucauuaguacugacaaua

SEQ ID NO: 168022 - RNA, 22 nt, Human
gaugagcauuguuucauguguu

SEQ ID NO: 168023 - RNA, 22 nt, Human
uucccagaaugaauggauggag

SEQ ID NO: 168024 - RNA, 22 nt, Human
aaaucaguuggaacacaagcag

SEQ ID NO: 168025 - RNA, 22 nt, Human
agcuuuaccugccuuggggcac

SEQ ID NO: 168026 - RNA, 22 nt, Human
uggaggaaaaaaccaggcagag

SEQ ID NO: 168027 - RNA, 22 nt, Human
gucuauauauugcuugaauaau

SEQ ID NO: 168028 - RNA, 22 nt, Human
uuuacagaucuguugauuuguu

SEQ ID NO: 168029 - RNA, 19 nt, Human
uuuacucuccaaggugagu

SEQ ID NO: 168030 - RNA, 22 nt, Human
ugguuccaaucgcacuggcuca

SEQ ID NO: 168031 - RNA, 22 nt, Human
uugcugauucuguauuuaaggu

SEQ ID NO: 168032 - RNA, 22 nt, Human
uuguguccauuugagucaugug

SEQ ID NO: 168033 - RNA, 22 nt, Human
uagguauaauauuuugaagaaa

SEQ ID NO: 168034 - RNA, 22 nt, Human
gggcagguuauuggaguaggga

SEQ ID NO: 168035 - RNA, 22 nt, Human
caguguggagggagagagccug

SEQ ID NO: 168036 - RNA, 22 nt, Human
uagggacaaagagcugaggccu

SEQ ID NO: 168037 - RNA, 20 nt, Human
acuuuacugagcuguaauuc

SEQ ID NO: 168038 - RNA, 22 nt, Human
ccuuuucuauguaccagcagug

SEQ ID NO: 168039 - RNA, 22 nt, Human
cagggagcuuucccaggacccu

SEQ ID NO: 168040 - RNA, 22 nt, Human
uguaagaaucagucuuuaaugu

SEQ ID NO: 168041 - RNA, 22 nt, Human
uauggcuuuucauuccuaugug

SEQ ID NO: 168042 - RNA, 22 nt, Human
ccccugaagacaauggagaggu

SEQ ID NO: 168043 - RNA, 22 nt, Human
ucccagaagugaaauuucuaga

SEQ ID NO: 168044 - RNA, 22 nt, Human
uuuuagacuuguauguaaagcc

SEQ ID NO: 168045 - RNA, 22 nt, Human
uuuauugagcacccguugugcg

SEQ ID NO: 168046 - RNA, 22 nt, Human
ccaguguucauaauuuuacacu

SEQ ID NO: 168047 - RNA, 22 nt, Human
aauacaguaauuuugaugaguu

SEQ ID NO: 168048 - RNA, 22 nt, Human
uuucacaucagagguagauuag

SEQ ID NO: 168049 - RNA, 22 nt, Human
aacuuucagcaaguaauucugg

SEQ ID NO: 168050 - RNA, 22 nt, Human
ccuggcaggcuggggacagugc

SEQ ID NO: 168051 - RNA, 21 nt, Human
uucuggguuguuaaucugaac

SEQ ID NO: 168052 - RNA, 21 nt, Human
uauuuauuaauuuguaaggcu

SEQ ID NO: 168053 - RNA, 22 nt, Human
ucagcuuugaucucaggcaauc

SEQ ID NO: 168054 - RNA, 22 nt, Human
agcagggccugagugaccuaac

SEQ ID NO: 168055 - RNA, 22 nt, Human
uuugucuuggccucaguuuucu

SEQ ID NO: 168056 - RNA, 22 nt, Human
uuaauauguugaaauuuauuag

SEQ ID NO: 168057 - RNA, 22 nt, Human
uggcauuucaguauuuucauaa

SEQ ID NO: 168058 - RNA, 22 nt, Human
gccaggcaaauuaaggaaugca

SEQ ID NO: 168059 - RNA, 22 nt, Human
ggcuagggaucuagaccaggac

SEQ ID NO: 168060 - RNA, 18 nt, Human
gccaggcaggguggggaa

SEQ ID NO: 168061 - RNA, 22 nt, Human
uagcuuuaggcacguuugaauu

SEQ ID NO: 168062 - RNA, 18 nt, Human
ccuggaggucuucggggu

SEQ ID NO: 168063 - RNA, 22 nt, Human
gaauuguaaguaccagcaugcu

SEQ ID NO: 168064 - RNA, 22 nt, Human
ucaaaauucuagggagaauggu

SEQ ID NO: 168065 - RNA, 22 nt, Human
uguauacaggcauaagagauac

SEQ ID NO: 168066 - RNA, 22 nt, Human
aauaaaaugaacugguagaguu

SEQ ID NO: 168067 - RNA, 22 nt, Human
uccuggguucauguccuggugc

SEQ ID NO: 168068 - RNA, 22 nt, Human
auguccaggaucuauccccaga

SEQ ID NO: 168069 - RNA, 22 nt, Human
gccugcagggcccuuguggguc

SEQ ID NO: 168070 - RNA, 22 nt, Human
ucaggugucaagcagggagcug

SEQ ID NO: 168071 - RNA, 22 nt, Human
uggaaagucucuuuugacugua

SEQ ID NO: 168072 - RNA, 22 nt, Human
ucuaggguggagcugggaaucc

SEQ ID NO: 168073 - RNA, 22 nt, Human
uuuagaaguucacacauuuaaa

SEQ ID NO: 168074 - RNA, 22 nt, Human
agcacauaccagaaccacaggu

SEQ ID NO: 168075 - RNA, 22 nt, Human
cccugcagggaggauucugaag

SEQ ID NO: 168076 - RNA, 22 nt, Human
agccagaggaacuugaugacug

SEQ ID NO: 168077 - RNA, 22 nt, Human
uccaggcaaggauaauaaacau

SEQ ID NO: 168078 - RNA, 22 nt, Human
gcuggauccugauucgucuuug

SEQ ID NO: 168079 - RNA, 22 nt, Human
uaccucaaguuccaggaaagcg

SEQ ID NO: 168080 - RNA, 22 nt, Human
gagggaccccaggcuggcccuu

SEQ ID NO: 168081 - RNA, 22 nt, Human
cagguguauaaacucagugacu

SEQ ID NO: 168082 - RNA, 22 nt, Human
acagguggcuuccauuuucuaa

SEQ ID NO: 168083 - RNA, 23 nt, Human
ggagaggggugugggcaucuuua

SEQ ID NO: 168084 - RNA, 22 nt, Human
cacuuagucucaccaguucagu

SEQ ID NO: 168085 - RNA, 22 nt, Human
cuguacuaauugcuuuacaugu

SEQ ID NO: 168086 - RNA, 22 nt, Human
aucauucuauuguugagcugcc

SEQ ID NO: 168087 - RNA, 22 nt, Human
auuaaauuaaguggcuaauuua

SEQ ID NO: 168088 - RNA, 22 nt, Human
ugaacauugucacauuccuagc

SEQ ID NO: 168089 - RNA, 22 nt, Human
uggauuagguacuaugaauaua

SEQ ID NO: 168090 - RNA, 22 nt, Human
auucuucaucagagaugcacua

SEQ ID NO: 168091 - RNA, 22 nt, Human
uugaagaaagucauauauaaug

SEQ ID NO: 168092 - RNA, 22 nt, Human
uacaugugcacgugugacuuug

SEQ ID NO: 168093 - RNA, 22 nt, Human
ugcagggccaugguggcggcug

SEQ ID NO: 168094 - RNA, 15 nt, Human
gcagguggaucacuu

SEQ ID NO: 168095 - RNA, 19 nt, Human
uuugcugguucaggaaaga

SEQ ID NO: 168096 - RNA, 22 nt, Human
guuaggcaauaccucuuacacc

SEQ ID NO: 168097 - RNA, 22 nt, Human
uucaugaaaguguaucuugugg

SEQ ID NO: 168098 - RNA, 18 nt, Human
caggaauggaugggauuu

SEQ ID NO: 168099 - RNA, 22 nt, Human
uuugaaauuaagauauugucca

SEQ ID NO: 168100 - RNA, 19 nt, Human
uggaccugugcccauggcu

SEQ ID NO: 168101 - RNA, 22 nt, Human
aggcagguuggggaaaagcacu

SEQ ID NO: 168102 - RNA, 22 nt, Human
aagggcagaaagggacgcuuug

SEQ ID NO: 168103 - RNA, 22 nt, Human
ugcagggauuauguagggguug

SEQ ID NO: 168104 - RNA, 22 nt, Human
uuuauuauguacaggcacuaua

SEQ ID NO: 168105 - RNA, 22 nt, Human
auguauuucuauguagugaaga

SEQ ID NO: 168106 - RNA, 22 nt, Human
cccugcagaucuaggguccuuc

SEQ ID NO: 168107 - RNA, 22 nt, Human
gucugcccuuggcucagccaua

SEQ ID NO: 168108 - RNA, 22 nt, Human
cagacaggagacuggaucaugg

SEQ ID NO: 168109 - RNA, 22 nt, Human
ucuuuaauaucugccccagagc

SEQ ID NO: 168110 - RNA, 22 nt, Human
aagacaauuugauacuaguugc

SEQ ID NO: 168111 - RNA, 22 nt, Human
uuugcaaagugacuauuauaug

SEQ ID NO: 168112 - RNA, 22 nt, Human
gaaugaauagguguccagaugg

SEQ ID NO: 168113 - RNA, 22 nt, Human
ucuuuauuuaagucuguuguaa

SEQ ID NO: 168114 - RNA, 22 nt, Human
accacugcccauggugaaaacu

SEQ ID NO: 168115 - RNA, 22 nt, Human
uugauccaguugaaagugauga

SEQ ID NO: 168116 - RNA, 20 nt, Human
ucuggcucuuugcuccuccc

SEQ ID NO: 168117 - RNA, 20 nt, Human
ugggugagaguguuugcucu

SEQ ID NO: 168118 - RNA, 22 nt, Human
agacagaccauggcuauucaga

SEQ ID NO: 168119 - RNA, 22 nt, Human
ugcagggaaaacccaggaugcu

SEQ ID NO: 168120 - RNA, 22 nt, Human
uuugcugaauagauuguaaacu

SEQ ID NO: 168121 - RNA, 22 nt, Human
ucucuuaggagaaauucauaaa

SEQ ID NO: 168122 - RNA, 22 nt, Human
cuuuguugugccugagugcacc

SEQ ID NO: 168123 - RNA, 22 nt, Human
gaguccuugacacauaguaggu

SEQ ID NO: 168124 - RNA, 22 nt, Human
acaugucuuuuaaagucuaaua

SEQ ID NO: 168125 - RNA, 22 nt, Human
cauguaaagaauuucacacaag

SEQ ID NO: 168126 - RNA, 17 nt, Human
ccagguggaaucgugga

SEQ ID NO: 168127 - RNA, 22 nt, Human
cuggauccuucucuguguauuu

SEQ ID NO: 168128 - RNA, 22 nt, Human
caguauuuguucccuaucaaug

SEQ ID NO: 168129 - RNA, 22 nt, Human
auguucuuccaaaucuguaaca

SEQ ID NO: 168130 - RNA, 22 nt, Human
gugcaaaaguaauugugguuuu

SEQ ID NO: 168131 - RNA, 22 nt, Human
cugugggagcacaugacagaua

SEQ ID NO: 168132 - RNA, 20 nt, Human
cuguggugagcaggagagua

SEQ ID NO: 168133 - RNA, 22 nt, Human
uauuuauucauucagcaagcau

SEQ ID NO: 168134 - RNA, 22 nt, Human
ucucuucacaugcuugcuccaa

SEQ ID NO: 168135 - RNA, 16 nt, Human
uggcagguuuuuaucu

SEQ ID NO: 168136 - RNA, 22 nt, Human
uuacaguaauguauuauuuaac

SEQ ID NO: 168137 - RNA, 22 nt, Human
cagacaggcaggugagagcucc

SEQ ID NO: 168138 - RNA, 22 nt, Human
uuuuauugucaaugaagacaga

SEQ ID NO: 168139 - RNA, 20 nt, Human
gcagggcaucuuggccccca

SEQ ID NO: 168140 - RNA, 22 nt, Human
aguauucuggaauucuauguga

SEQ ID NO: 168141 - RNA, 22 nt, Human
aaucuucacagaaaaaugucug

SEQ ID NO: 168142 - RNA, 22 nt, Human
gcagcuuuagaaacaagggcug

SEQ ID NO: 168143 - RNA, 21 nt, Human
acagcauguuuguguguuugc

SEQ ID NO: 168144 - RNA, 22 nt, Human
cacagacagugucccuuuguug

SEQ ID NO: 168145 - RNA, 22 nt, Human
auguguccacaggugugagaga

SEQ ID NO: 168146 - RNA, 22 nt, Human
auucagcauucauuaugcgcca

SEQ ID NO: 168147 - RNA, 22 nt, Human
aacauuuacaaauccuucugca

SEQ ID NO: 168148 - RNA, 22 nt, Human
ucagggcagguuaacuugggug

SEQ ID NO: 168149 - RNA, 22 nt, Human
uaucaucuuguugucaugcagc

SEQ ID NO: 168150 - RNA, 22 nt, Human
uuuaauugcauuuaaagaugga

SEQ ID NO: 168151 - RNA, 22 nt, Human
uucuuacagaguuuacagagcc

SEQ ID NO: 168152 - RNA, 22 nt, Human
cuucccuuucuggugacuucuc

SEQ ID NO: 168153 - RNA, 22 nt, Human
uuccuggggggauagauuucac

SEQ ID NO: 168154 - RNA, 22 nt, Human
ucaauaaaucccucugacccug

SEQ ID NO: 168155 - RNA, 22 nt, Human
aaauguuuugcucccauguggu

SEQ ID NO: 168156 - RNA, 22 nt, Human
uuacagauggaucuagcaaaau

SEQ ID NO: 168157 - RNA, 22 nt, Human
uuugcugaauaaaugugugacu

SEQ ID NO: 168158 - RNA, 22 nt, Human
gaaagccagagagaaagggcuc

SEQ ID NO: 168159 - RNA, 22 nt, Human
cuaacuuuagcuuagauuauca

SEQ ID NO: 168160 - RNA, 22 nt, Human
auucuuauuuaaauagagucug

SEQ ID NO: 168161 - RNA, 22 nt, Human
agucaccaucuguggcagccug

SEQ ID NO: 168162 - RNA, 22 nt, Human
ggagcugaguucuucagccggg

SEQ ID NO: 168163 - RNA, 22 nt, Human
ugauuuccuaggucuggagaag

SEQ ID NO: 168164 - RNA, 22 nt, Human
cuguguccaauggccuuagcag

SEQ ID NO: 168165 - RNA, 22 nt, Human
gaaauagacacuuucuaugaau

SEQ ID NO: 168166 - RNA, 22 nt, Human
auccacagucuuagccaucaaa

SEQ ID NO: 168167 - RNA, 22 nt, Human
aauugcuuaguugcaacuaugc

SEQ ID NO: 168168 - RNA, 22 nt, Human
uggauuagugcugaaaugaugg

SEQ ID NO: 168169 - RNA, 22 nt, Human
aaggcuuucagcuaacuugauu

SEQ ID NO: 168170 - RNA, 22 nt, Human
aaugaggucauuaaugguggga

SEQ ID NO: 168171 - RNA, 22 nt, Human
gcaccugcuggaaucagucugu

SEQ ID NO: 168172 - RNA, 22 nt, Human
aaauguauugcauaggauauuu

SEQ ID NO: 168173 - RNA, 22 nt, Human
ucauguguugcacugaggaccu

SEQ ID NO: 168174 - RNA, 22 nt, Human
uaaacauuuguuauucuuguuu

SEQ ID NO: 168175 - RNA, 22 nt, Human
uuugacuccuuugugaaaagag

SEQ ID NO: 168176 - RNA, 22 nt, Human
aucuauacccaucaugauuuaa

SEQ ID NO: 168177 - RNA, 21 nt, Human
acagauuuuauaucucugcug

SEQ ID NO: 168178 - RNA, 22 nt, Human
ccaggccuggccaggggaugcc

SEQ ID NO: 168179 - RNA, 22 nt, Human
uggagcaggaaacaucuagagg

SEQ ID NO: 168180 - RNA, 22 nt, Human
ccuggaucgaugccgagggaaa

SEQ ID NO: 168181 - RNA, 22 nt, Human
ggcuuuauguuuuucauguggu

SEQ ID NO: 168182 - RNA, 22 nt, Human
ugcuggagaccugcuugcacca

SEQ ID NO: 168183 - RNA, 22 nt, Human
aguguccuuaguuagcuuuggg

SEQ ID NO: 168184 - RNA, 22 nt, Human
ucuguucacugagcaauggcaa

SEQ ID NO: 168185 - RNA, 18 nt, Human
uggaggaaucacaauggc

SEQ ID NO: 168186 - RNA, 22 nt, Human
uguccuuagggauauaaaauau

SEQ ID NO: 168187 - RNA, 22 nt, Human
cugggucuggcuacugcuuccu

SEQ ID NO: 168188 - RNA, 22 nt, Human
cucuuccuuucccuugagggug

SEQ ID NO: 168189 - RNA, 22 nt, Human
uuuccuuccuaaggugaagcaa

SEQ ID NO: 168190 - RNA, 22 nt, Human
aacaugauuuaguauaaugcag

SEQ ID NO: 168191 - RNA, 22 nt, Human
uaauuucaccguugcuagaaau

SEQ ID NO: 168192 - RNA, 22 nt, Human
aucaagaaaagugcuuucggcu

SEQ ID NO: 168193 - RNA, 22 nt, Human
ugccuggauucgguuguuguca

SEQ ID NO: 168194 - RNA, 22 nt, Human
cacccagcauuggcuaagagag

SEQ ID NO: 168195 - RNA, 22 nt, Human
cucagagaaccuaagcggagga

SEQ ID NO: 168196 - RNA, 22 nt, Human
acaggugugcggaaagcuguga

SEQ ID NO: 168197 - RNA, 22 nt, Human
uagggcuccacucccagagauu

SEQ ID NO: 168198 - RNA, 22 nt, Human
uuugaaguggaaaaggauuuaa

SEQ ID NO: 168199 - RNA, 22 nt, Human
gagcaguggugguguguuagag

SEQ ID NO: 168200 - RNA, 19 nt, Human
cugcagggaugugcagagu

SEQ ID NO: 168201 - RNA, 22 nt, Human
uacauguaauuuucauaguaag

SEQ ID NO: 168202 - RNA, 22 nt, Human
caggccucuccuuagucuggca

SEQ ID NO: 168203 - RNA, 20 nt, Human
uuuacauuuugaaacaguga

SEQ ID NO: 168204 - RNA, 22 nt, Human
guuauacauauguguuaacaaa

SEQ ID NO: 168205 - RNA, 22 nt, Human
uccuggguccugggaagcccug

SEQ ID NO: 168206 - RNA, 22 nt, Human
aggauuuauuauaugcccucau

SEQ ID NO: 168207 - RNA, 22 nt, Human
ucuuauugguaaugauggcauu

SEQ ID NO: 168208 - RNA, 20 nt, Human
uggaccugucucuuuaggga

SEQ ID NO: 168209 - RNA, 22 nt, Human
agacauauuggcuugcuuuaau

SEQ ID NO: 168210 - RNA, 22 nt, Human
auugcuuuugagcuagaauuuu

SEQ ID NO: 168211 - RNA, 22 nt, Human
aaaauuauucauggcuuuugga

SEQ ID NO: 168212 - RNA, 22 nt, Human
cuguugcuaaguagugcaggua

SEQ ID NO: 168213 - RNA, 22 nt, Human
uuacauaacgguaugaaaaaug

SEQ ID NO: 168214 - RNA, 22 nt, Human
guuuacauauuuuaauugguga

SEQ ID NO: 168215 - RNA, 20 nt, Human
cugaacacagaauaagcaca

SEQ ID NO: 168216 - RNA, 22 nt, Human
gaguccuuccagcaggcauuua

SEQ ID NO: 168217 - RNA, 22 nt, Human
ucagagagcuggugggcagagg

SEQ ID NO: 168218 - RNA, 22 nt, Human
gauguguccuuuucuccaucca

SEQ ID NO: 168219 - RNA, 22 nt, Human
uccucagagcauagcgcugucu

SEQ ID NO: 168220 - RNA, 22 nt, Human
agagguuguuagaauaguggag

SEQ ID NO: 168221 - RNA, 22 nt, Human
gcaggcagguggcaucuuguga

SEQ ID NO: 168222 - RNA, 19 nt, Human
aaggugucccaacugcguu

SEQ ID NO: 168223 - RNA, 22 nt, Human
ugcauggaggaagaugaaugca

SEQ ID NO: 168224 - RNA, 20 nt, Human
uucuuaaagaccucacuuug

SEQ ID NO: 168225 - RNA, 22 nt, Human
gaagaaucaagcaguaauuugu

SEQ ID NO: 168226 - RNA, 22 nt, Human
gcuggagguuucaccugaguuu

SEQ ID NO: 168227 - RNA, 22 nt, Human
ccaggugucaugcgugugaccc

SEQ ID NO: 168228 - RNA, 22 nt, Human
gcagggcaucccugagcgggug

SEQ ID NO: 168229 - RNA, 22 nt, Human
ucagacaggcuggacagcuugc

SEQ ID NO: 168230 - RNA, 22 nt, Human
uguguccucauguggcagagag

SEQ ID NO: 168231 - RNA, 22 nt, Human
cacuuauuaugggcuaggaacu

SEQ ID NO: 168232 - RNA, 22 nt, Human
auucuucacaaauauauagaag

SEQ ID NO: 168233 - RNA, 22 nt, Human
ggcaggcacaguaauacauguu

SEQ ID NO: 168234 - RNA, 22 nt, Human
gcguccagggaaggcccagcug

SEQ ID NO: 168235 - RNA, 22 nt, Human
ccagguggugaaagugggcccu

SEQ ID NO: 168236 - RNA, 22 nt, Human
uucauaaucaccaaaaacugga

SEQ ID NO: 168237 - RNA, 22 nt, Human
ucaguucugcuagaaaaacagu

SEQ ID NO: 168238 - RNA, 22 nt, Human
uuccagagcaguuuucagauca

SEQ ID NO: 168239 - RNA, 22 nt, Human
acuuucauuuguaauaaacuuc

SEQ ID NO: 168240 - RNA, 22 nt, Human
gaagaauccuguccucuuuagg

SEQ ID NO: 168241 - RNA, 18 nt, Human
aguccuuacgaggcuaua

SEQ ID NO: 168242 - RNA, 22 nt, Human
cagugaggaguccagggcagag

SEQ ID NO: 168243 - RNA, 22 nt, Human
ucagcuuuccugcagcuaaggg

SEQ ID NO: 168244 - RNA, 22 nt, Human
aauuagggaggacaaagguaca

SEQ ID NO: 168245 - RNA, 22 nt, Human
auggcuuugcucaaguuuagcc

SEQ ID NO: 168246 - RNA, 22 nt, Human
gcagcuuucugcaaugucaucc

SEQ ID NO: 168247 - RNA, 22 nt, Human
ggcuuuauuucacuguaccaua

SEQ ID NO: 168248 - RNA, 22 nt, Human
ugcaggugugggcaggggagca

SEQ ID NO: 168249 - RNA, 22 nt, Human
cagggcucugccuugagggaug

SEQ ID NO: 168250 - RNA, 22 nt, Human
caggcagggagcuggaaaggau

SEQ ID NO: 168251 - RNA, 20 nt, Human
ucaggcaguggggaaaggca

SEQ ID NO: 168252 - RNA, 22 nt, Human
ugggaagaguuagagacagcug

SEQ ID NO: 168253 - RNA, 22 nt, Human
gcagggcaaacccagguguuca

SEQ ID NO: 168254 - RNA, 22 nt, Human
gucugcccggccuuccuccacc

SEQ ID NO: 168255 - RNA, 22 nt, Human
ggaacuugaaaaucaagguggu

SEQ ID NO: 168256 - RNA, 22 nt, Human
aaucagaaagaucuugaugaga

SEQ ID NO: 168257 - RNA, 22 nt, Human
uuugcucaguucucuguauuuu

SEQ ID NO: 168258 - RNA, 19 nt, Human
gaacuuggccaggcacagu

SEQ ID NO: 168259 - RNA, 22 nt, Human
uuccaggaggcacugacagagg

SEQ ID NO: 168260 - RNA, 22 nt, Human
agaagcugcguuuauuuaaauc

SEQ ID NO: 168261 - RNA, 22 nt, Human
uaaguccuaacagacugggggc

SEQ ID NO: 168262 - RNA, 17 nt, Human
uuauuuuuugggcugag

SEQ ID NO: 168263 - RNA, 22 nt, Human
uauuugaagggagaaagugcca

SEQ ID NO: 168264 - RNA, 22 nt, Human
aaagaaucguguguaguuugaa

SEQ ID NO: 168265 - RNA, 22 nt, Human
ugacagacacaccuuaggaaag

SEQ ID NO: 168266 - RNA, 22 nt, Human
cucuaacacuguaaugcuuucu

SEQ ID NO: 168267 - RNA, 22 nt, Human
aaaucagugcucauuugaaagg

SEQ ID NO: 168268 - RNA, 22 nt, Human
cauuugaaauucuuagaacaaa

SEQ ID NO: 168269 - RNA, 22 nt, Human
agcugcaaguaagcuugcuccu

SEQ ID NO: 168270 - RNA, 22 nt, Human
ucccagugagaugaaacaggua

SEQ ID NO: 168271 - RNA, 22 nt, Human
uagggcucagaguccaguuucu

SEQ ID NO: 168272 - RNA, 22 nt, Human
caugcuuuucaaucuaucuuaa

SEQ ID NO: 168273 - RNA, 22 nt, Human
gggcagguguuuccaaggugag

SEQ ID NO: 168274 - RNA, 22 nt, Human
aagggcucuucuauuuauggcc

SEQ ID NO: 168275 - RNA, 18 nt, Human
acauuucuccuucugacc

SEQ ID NO: 168276 - RNA, 22 nt, Human
uauacauguuuuacauaaguga

SEQ ID NO: 168277 - RNA, 22 nt, Human
uaaggcauaaggccagaggcua

SEQ ID NO: 168278 - RNA, 22 nt, Human
ucagggacgugagcucagaguc

SEQ ID NO: 168279 - RNA, 22 nt, Human
gauccuguuagaucccauuaga

SEQ ID NO: 168280 - RNA, 20 nt, Human
acaugcaguggucauuucag

SEQ ID NO: 168281 - RNA, 22 nt, Human
uguacaauagcuauuaucucca

SEQ ID NO: 168282 - RNA, 22 nt, Human
agcaggugucacuuucacucca

SEQ ID NO: 168283 - RNA, 21 nt, Human
aagugguuuacauccagcugu

SEQ ID NO: 168284 - RNA, 22 nt, Human
aacuuaaacccacucauguaga

SEQ ID NO: 168285 - RNA, 19 nt, Human
agugcagggagcacccuca

SEQ ID NO: 168286 - RNA, 22 nt, Human
cuuuaagacucugcucuuggug

SEQ ID NO: 168287 - RNA, 22 nt, Human
auggcuuaugguaaauauuucu

SEQ ID NO: 168288 - RNA, 22 nt, Human
ccagggcaauaggaacacuuuu

SEQ ID NO: 168289 - RNA, 22 nt, Human
uggcaauguuagcaaagcauuu

SEQ ID NO: 168290 - RNA, 22 nt, Human
ugguuuaaccugucucuuauua

SEQ ID NO: 168291 - RNA, 22 nt, Human
aagggcagcugacagaugcuua

SEQ ID NO: 168292 - RNA, 22 nt, Human
gaugaaaaauugcugugucaua

SEQ ID NO: 168293 - RNA, 20 nt, Human
aacuuguucuaccuguuuca

SEQ ID NO: 168294 - RNA, 22 nt, Human
uaacagaaaggggacagaaaua

SEQ ID NO: 168295 - RNA, 20 nt, Human
cugcugcccugucagccucu

SEQ ID NO: 168296 - RNA, 22 nt, Human
caugcuuauucauucugcuaac

SEQ ID NO: 168297 - RNA, 22 nt, Human
agacaggcagggcauggaaaaa

SEQ ID NO: 168298 - RNA, 22 nt, Human
uuaauuuuaaccuguuuguguc

SEQ ID NO: 168299 - RNA, 22 nt, Human
acagaauuuaaagcucuagacu

SEQ ID NO: 168300 - RNA, 22 nt, Human
uuuauccagcagcuauucaaaa

SEQ ID NO: 168301 - RNA, 22 nt, Human
augaaauaucuugaagaaauuc

SEQ ID NO: 168302 - RNA, 20 nt, Human
cuucuucauuaacccuacug

SEQ ID NO: 168303 - RNA, 22 nt, Human
guuuuauaggugaaauauuacu

SEQ ID NO: 168304 - RNA, 22 nt, Human
aaaauugaggcucauguuaaau

SEQ ID NO: 168305 - RNA, 22 nt, Human
agcaggugacccaagcaggcug

SEQ ID NO: 168306 - RNA, 23 nt, Human
uggaauaauaagguacauuaaca

SEQ ID NO: 168307 - RNA, 17 nt, Human
uacauguguaucugauu

SEQ ID NO: 168308 - RNA, 22 nt, Human
gcuagaucucucauaaauucca

SEQ ID NO: 168309 - RNA, 22 nt, Human
accugcaguggccacuccuaau

SEQ ID NO: 168310 - RNA, 21 nt, Human
acagacaguccagagaaaaga

SEQ ID NO: 168311 - RNA, 19 nt, Human
ugcagccacgugagagacu

SEQ ID NO: 168312 - RNA, 22 nt, Human
auguguccuuguucccauucca

SEQ ID NO: 168313 - RNA, 21 nt, Human
uuccuuuuuauggcuuagugg

SEQ ID NO: 168314 - RNA, 22 nt, Human
gggccaugagagguucaucaac

SEQ ID NO: 168315 - RNA, 17 nt, Human
aaucagauuucugagga

SEQ ID NO: 168316 - RNA, 22 nt, Human
ucugagguggacgauggagccu

SEQ ID NO: 168317 - RNA, 22 nt, Human
uuucauuggcucccugaugaau

SEQ ID NO: 168318 - RNA, 22 nt, Human
auacuuuggucacuauuauugg

SEQ ID NO: 168319 - RNA, 22 nt, Human
uuaaauauuuucagcaggguca

SEQ ID NO: 168320 - RNA, 22 nt, Human
acaugcuuuucccacaauuaua

SEQ ID NO: 168321 - RNA, 22 nt, Human
ugaagaaucccagggaauuugg

SEQ ID NO: 168322 - RNA, 22 nt, Human
gggagcugagcuggaagagaau

SEQ ID NO: 168323 - RNA, 22 nt, Human
cagcuuugcaggcuggucagug

SEQ ID NO: 168324 - RNA, 22 nt, Human
gcuguucacaucuggaccauuu

SEQ ID NO: 168325 - RNA, 22 nt, Human
aauuuccaaauuucugucacac

SEQ ID NO: 168326 - RNA, 22 nt, Human
uuccaggaagauucaacaaaag

SEQ ID NO: 168327 - RNA, 19 nt, Human
aaaugugaugguacaauuc

SEQ ID NO: 168328 - RNA, 22 nt, Human
cugcaucacagcaggaggcaca

SEQ ID NO: 168329 - RNA, 22 nt, Human
aaauucuaaggucacaauguug

SEQ ID NO: 168330 - RNA, 22 nt, Human
uggcaggggaggugcuugcuua

SEQ ID NO: 168331 - RNA, 22 nt, Human
ccaggugggaggaaagcagaga

SEQ ID NO: 168332 - RNA, 22 nt, Human
ucauuuaauugguuuugcucgu

SEQ ID NO: 168333 - RNA, 22 nt, Human
cugcuuuagacaacugcuggga

SEQ ID NO: 168334 - RNA, 22 nt, Human
ccuguucaugaaacugcuuucc

SEQ ID NO: 168335 - RNA, 22 nt, Human
cuggauguaacgaagguuucac

SEQ ID NO: 168336 - RNA, 22 nt, Human
ucuauaaauuaugcagucucag

SEQ ID NO: 168337 - RNA, 20 nt, Human
uuuaggcauuacucuuuugu

SEQ ID NO: 168338 - RNA, 22 nt, Human
gaaugaaaaccuuggcucaaau

SEQ ID NO: 168339 - RNA, 22 nt, Human
cagcugcaggaacaaaaaugug

SEQ ID NO: 168340 - RNA, 22 nt, Human
aaagcuuuucaguauguucaug

SEQ ID NO: 168341 - RNA, 22 nt, Human
uccagaccauggauggcugcaa

SEQ ID NO: 168342 - RNA, 22 nt, Human
aaaugcuagggagaaacucucc

SEQ ID NO: 168343 - RNA, 22 nt, Human
cagcuuugugcaaugcagucuc

SEQ ID NO: 168344 - RNA, 21 nt, Human
caauuucaugggaagauggga

SEQ ID NO: 168345 - RNA, 22 nt, Human
cauguccuucucauugccucau

SEQ ID NO: 168346 - RNA, 22 nt, Human
cagaggcauacucccagucuug

SEQ ID NO: 168347 - RNA, 20 nt, Human
caugguggaggagcagggcc

SEQ ID NO: 168348 - RNA, 22 nt, Human
auuguuaugaaaauaagauguu

SEQ ID NO: 168349 - RNA, 22 nt, Human
uuucuguaaggacuuaaugcaa

SEQ ID NO: 168350 - RNA, 19 nt, Human
acagggcagcaauaggaua

SEQ ID NO: 168351 - RNA, 19 nt, Human
aauagauuaauuauccucu

SEQ ID NO: 168352 - RNA, 22 nt, Human
gagggaccuuuacacagacauu

SEQ ID NO: 168353 - RNA, 22 nt, Human
acaacuuuagucuggagggaaa

SEQ ID NO: 168354 - RNA, 22 nt, Human
cucuucaauagauuguugaggg

SEQ ID NO: 168355 - RNA, 17 nt, Human
auccuucuguucuuucu

SEQ ID NO: 168356 - RNA, 22 nt, Human
cagaaaucauugugaugacagg

SEQ ID NO: 168357 - RNA, 22 nt, Human
ucuuagauggcagcuagagcuc

SEQ ID NO: 168358 - RNA, 22 nt, Human
guuucuuucuauugacugaaca

SEQ ID NO: 168359 - RNA, 21 nt, Human
aucuggaaauucugccagaga

SEQ ID NO: 168360 - RNA, 21 nt, Human
uaugugucuguggaaaacuag

SEQ ID NO: 168361 - RNA, 21 nt, Human
uggacauuauggagagaguag

SEQ ID NO: 168362 - RNA, 22 nt, Human
cugggguggauggguccaaguu

SEQ ID NO: 168363 - RNA, 22 nt, Human
gguuucaacucagcuaguaagg

SEQ ID NO: 168364 - RNA, 22 nt, Human
aaguuuaacuugaauucuuucu

SEQ ID NO: 168365 - RNA, 22 nt, Human
agguggggcccaccaauuugca

SEQ ID NO: 168366 - RNA, 22 nt, Human
uggguggauuaggauaggguau

SEQ ID NO: 168367 - RNA, 22 nt, Human
gcacaauaacagccaagguuau

SEQ ID NO: 168368 - RNA, 22 nt, Human
aguauuuagcauagugguuagu

SEQ ID NO: 168369 - RNA, 22 nt, Human
cagacccugggccacagaggag

SEQ ID NO: 168370 - RNA, 17 nt, Human
gcauccaguaacaugcc

SEQ ID NO: 168371 - RNA, 22 nt, Human
cugcagggugacguugcccacc

SEQ ID NO: 168372 - RNA, 22 nt, Human
cauuucaaacaguuacagcugc

SEQ ID NO: 168373 - RNA, 22 nt, Human
auuucacaaagaacagaugcag

SEQ ID NO: 168374 - RNA, 22 nt, Human
ucccaggcuggcaggcagcagu

SEQ ID NO: 168375 - RNA, 20 nt, Human
aguuuauuccaggagaacug

SEQ ID NO: 168376 - RNA, 17 nt, Human
uaucagaauguguuuac

SEQ ID NO: 168377 - RNA, 22 nt, Human
ccagcuuuugcacuggacuggg

SEQ ID NO: 168378 - RNA, 23 nt, Human
uagggcagcugggagggacaugc

SEQ ID NO: 168379 - RNA, 22 nt, Human
caaagccauagaguagauaaga

SEQ ID NO: 168380 - RNA, 22 nt, Human
gcauguguggaggagaugugcu

SEQ ID NO: 168381 - RNA, 22 nt, Human
uuccagugacuaagcuucugcu

SEQ ID NO: 168382 - RNA, 22 nt, Human
gauguguccuaguacggguggg

SEQ ID NO: 168383 - RNA, 22 nt, Human
auaaauugugcuuuugacaucu

SEQ ID NO: 168384 - RNA, 19 nt, Human
gcagacagguccagagagg

SEQ ID NO: 168385 - RNA, 22 nt, Human
gagcagugccaaagaauuugcg

SEQ ID NO: 168386 - RNA, 22 nt, Human
aaauggauggaauugacauuua

SEQ ID NO: 168387 - RNA, 22 nt, Human
caugaaugcuggguucauguaa

SEQ ID NO: 168388 - RNA, 22 nt, Human
acucugcuguuuacucucuaua

SEQ ID NO: 168389 - RNA, 22 nt, Human
agugugagcccuggaguggugc

SEQ ID NO: 168390 - RNA, 22 nt, Human
acuauacaagauuagggauuug

SEQ ID NO: 168391 - RNA, 22 nt, Human
uuugggaauaauugcacagauu

SEQ ID NO: 168392 - RNA, 22 nt, Human
ccuguucaccauggucacgugc

SEQ ID NO: 168393 - RNA, 22 nt, Human
uuugcuugacccuugugcugaa

SEQ ID NO: 168394 - RNA, 22 nt, Human
gcagagaggaaugaagccaucc

SEQ ID NO: 168395 - RNA, 22 nt, Human
aggguggcaccacauaucauag

SEQ ID NO: 168396 - RNA, 22 nt, Human
cauaauaucuccgauuacuugc

SEQ ID NO: 168397 - RNA, 22 nt, Human
gguguccuuguccuuugguacc

SEQ ID NO: 168398 - RNA, 22 nt, Human
ccuuuguucauugccuucaguc

SEQ ID NO: 168399 - RNA, 22 nt, Human
auugcuuuucagacaaugaggc

SEQ ID NO: 168400 - RNA, 22 nt, Human
uuguguccuauaugcauguucu

SEQ ID NO: 168401 - RNA, 22 nt, Human
gauuuaaaguagaccuuuguuu

SEQ ID NO: 168402 - RNA, 22 nt, Human
cccaggcacacugaagugacau

SEQ ID NO: 168403 - RNA, 22 nt, Human
uuguuucaggaugguuuguuac

SEQ ID NO: 168404 - RNA, 20 nt, Human
agaaaaaguguggaaauuuc

SEQ ID NO: 168405 - RNA, 22 nt, Human
uuguguccugauuugacacaau

SEQ ID NO: 168406 - RNA, 22 nt, Human
aauguuuuaaaagagauugaga

SEQ ID NO: 168407 - RNA, 22 nt, Human
uaaagccaauauaccuagcaua

SEQ ID NO: 168408 - RNA, 22 nt, Human
aaauccuaccaagaaauucccu

SEQ ID NO: 168409 - RNA, 22 nt, Human
cagaguggugcaagggcagugu

SEQ ID NO: 168410 - RNA, 21 nt, Human
ucagagagucacagugaacug

SEQ ID NO: 168411 - RNA, 22 nt, Human
ucugggaacacacgucacuuca

SEQ ID NO: 168412 - RNA, 22 nt, Human
gguucaguggaauguguugacc

SEQ ID NO: 168413 - RNA, 22 nt, Human
aaaagcagaccacgcuuugugg

SEQ ID NO: 168414 - RNA, 19 nt, Human
ugguggaggccccauguuc

SEQ ID NO: 168415 - RNA, 22 nt, Human
uuucacauucagauauagacuu

SEQ ID NO: 168416 - RNA, 22 nt, Human
aaucucuuuggcucaaggaucc

SEQ ID NO: 168417 - RNA, 21 nt, Human
auuuucauuuccaggggagga

SEQ ID NO: 168418 - RNA, 22 nt, Human
ggacagaggguugacagaguau

SEQ ID NO: 168419 - RNA, 17 nt, Human
ugacagacaucaugagc

SEQ ID NO: 168420 - RNA, 22 nt, Human
aaauugcaaaaguacuuuuagg

SEQ ID NO: 168421 - RNA, 22 nt, Human
augcauaauguauguauugacu

SEQ ID NO: 168422 - RNA, 23 nt, Human
agcagggccagaauacuugcugu

SEQ ID NO: 168423 - RNA, 22 nt, Human
aucagagauuguaguaugugca

SEQ ID NO: 168424 - RNA, 22 nt, Human
gcaugcagaaaaugaacaacga

SEQ ID NO: 168425 - RNA, 22 nt, Human
uuugacucauugauuuucucug

SEQ ID NO: 168426 - RNA, 19 nt, Human
cucuuaaauugucucuugc

SEQ ID NO: 168427 - RNA, 22 nt, Human
cacuggaauucaagauacugag

SEQ ID NO: 168428 - RNA, 22 nt, Human
aguucucaagacaauuaccugu

SEQ ID NO: 168429 - RNA, 22 nt, Human
ucauuuauaaggaugcaauuaa

SEQ ID NO: 168430 - RNA, 21 nt, Human
ugggaccuauuucaacuggau

SEQ ID NO: 168431 - RNA, 22 nt, Human
uuugcuuucuguugaacagagu

SEQ ID NO: 168432 - RNA, 22 nt, Human
ccagggcaaaugagaucauagc

SEQ ID NO: 168433 - RNA, 22 nt, Human
agugucuguugaguuucaaaag

SEQ ID NO: 168434 - RNA, 22 nt, Human
uauugguauaggcauugaaacu

SEQ ID NO: 168435 - RNA, 16 nt, Human
ccuggauccccugugg

SEQ ID NO: 168436 - RNA, 22 nt, Human
ggagggagcauccccuugcuga

SEQ ID NO: 168437 - RNA, 22 nt, Human
caggcauagaagggcaagaaua

SEQ ID NO: 168438 - RNA, 19 nt, Human
agacacacuuacguggaau

SEQ ID NO: 168439 - RNA, 22 nt, Human
guauucauauuaaacauaucaa

SEQ ID NO: 168440 - RNA, 22 nt, Human
guguccugcauuggcucugccc

SEQ ID NO: 168441 - RNA, 22 nt, Human
auuucuguugcuuauaaauuac

SEQ ID NO: 168442 - RNA, 22 nt, Human
ugugugucagagucuccauggu

SEQ ID NO: 168443 - RNA, 22 nt, Human
uaauugcuuuauccuguuagaa

SEQ ID NO: 168444 - RNA, 22 nt, Human
cagauuucagcucauauauuau

SEQ ID NO: 168445 - RNA, 22 nt, Human
cacaauuuccuugcuucacuuu

SEQ ID NO: 168446 - RNA, 22 nt, Human
guccaugauucugugacacccu

SEQ ID NO: 168447 - RNA, 19 nt, Human
ugcugaaguugucagucug

SEQ ID NO: 168448 - RNA, 22 nt, Human
caguaaauuugagggaucuaau

SEQ ID NO: 168449 - RNA, 22 nt, Human
uuccaggacaagauguuucagg

SEQ ID NO: 168450 - RNA, 22 nt, Human
aaggcauacauauuguuauagg

SEQ ID NO: 168451 - RNA, 21 nt, Human
aaugcauuaacauaaagcuga

SEQ ID NO: 168452 - RNA, 22 nt, Human
auaucagacagaaagcauugac

SEQ ID NO: 168453 - RNA, 22 nt, Human
aggaggaauugacacagaagcc

SEQ ID NO: 168454 - RNA, 22 nt, Human
ugcuuuauagacaaggaaguag

SEQ ID NO: 168455 - RNA, 22 nt, Human
uuccuuagugacuucuagcuac

SEQ ID NO: 168456 - RNA, 22 nt, Human
uaccugcaaaguuccuuuugcc

SEQ ID NO: 168457 - RNA, 22 nt, Human
cugcaaaaguaauuggggcuuu

SEQ ID NO: 168458 - RNA, 22 nt, Human
uucagaaacaucaguggaugga

SEQ ID NO: 168459 - RNA, 19 nt, Human
cacuuuauuucuguuuugu

SEQ ID NO: 168460 - RNA, 22 nt, Human
guccuggugcuggucauugucg

SEQ ID NO: 168461 - RNA, 20 nt, Human
uuccuguauacaaagaguuc

SEQ ID NO: 168462 - RNA, 22 nt, Human
ucugcccucauugcugccugga

SEQ ID NO: 168463 - RNA, 22 nt, Human
uuuccagauuaagauaccacuu

SEQ ID NO: 168464 - RNA, 22 nt, Human
cuaaaugacuuccagugguuau

SEQ ID NO: 168465 - RNA, 22 nt, Human
ggaugaggaaaccacagugucc

SEQ ID NO: 168466 - RNA, 22 nt, Human
aauugcuuuaguuaccauagug

SEQ ID NO: 168467 - RNA, 22 nt, Human
accugcaggggugcucucuggg

SEQ ID NO: 168468 - RNA, 22 nt, Human
ucuguucagaauuguaacacuc

SEQ ID NO: 168469 - RNA, 22 nt, Human
uguccucaucuuuuccagaaau

SEQ ID NO: 168470 - RNA, 17 nt, Human
uguccauuugccuggag

SEQ ID NO: 168471 - RNA, 22 nt, Human
aacauacauauuucagugucca

SEQ ID NO: 168472 - RNA, 22 nt, Human
uguacaauguguuuguuggcuu

SEQ ID NO: 168473 - RNA, 22 nt, Human
ggggaccuuuccauuucugaga

SEQ ID NO: 168474 - RNA, 22 nt, Human
aagggcagccugacucacgguc

SEQ ID NO: 168475 - RNA, 23 nt, Human
cacacccaucacuaagagcuccu

SEQ ID NO: 168476 - RNA, 22 nt, Human
uauuugaaggcauacauuuuga

SEQ ID NO: 168477 - RNA, 22 nt, Human
uuuucauuuacauuagggaaga

SEQ ID NO: 168478 - RNA, 22 nt, Human
acuggauuccauugugcaaaga

SEQ ID NO: 168479 - RNA, 22 nt, Human
augcagcugugggcaagaaaug

SEQ ID NO: 168480 - RNA, 22 nt, Human
cccaggcagugcugaucccuca

SEQ ID NO: 168481 - RNA, 22 nt, Human
ggcuacuagguaccauuuagaa

SEQ ID NO: 168482 - RNA, 22 nt, Human
uccuccuuguuuugucucugcu

SEQ ID NO: 168483 - RNA, 22 nt, Human
uuauuaggaacucaggauuuuu

SEQ ID NO: 168484 - RNA, 22 nt, Human
auauuagggucucuaaauucua

SEQ ID NO: 168485 - RNA, 22 nt, Human
cuguugcucccagggagagggu

SEQ ID NO: 168486 - RNA, 22 nt, Human
cccugcagaccaaugccauaga

SEQ ID NO: 168487 - RNA, 22 nt, Human
gcugcagugagccaagaucgug

SEQ ID NO: 168488 - RNA, 22 nt, Human
acagcuggcaggggggcaugaa

SEQ ID NO: 168489 - RNA, 22 nt, Human
ugaggaauguuuugagugccga

SEQ ID NO: 168490 - RNA, 22 nt, Human
agaaaugucaggaaagaagucc

SEQ ID NO: 168491 - RNA, 22 nt, Human
gcuggauccacaaauaacuuug

SEQ ID NO: 168492 - RNA, 21 nt, Human
uauacaugugugcauacgugu

SEQ ID NO: 168493 - RNA, 22 nt, Human
ucagaauuuugguuugguuggu

SEQ ID NO: 168494 - RNA, 22 nt, Human
acagcuuuugaaaaauuacugg

SEQ ID NO: 168495 - RNA, 18 nt, Human
cuggcuuucuuauccauc

SEQ ID NO: 168496 - RNA, 18 nt, Human
cauaauuuucuuucuuua

SEQ ID NO: 168497 - RNA, 23 nt, Human
ggacaugucucuggguauuuuga

SEQ ID NO: 168498 - RNA, 22 nt, Human
cuguccuuacugcuucuggcuu

SEQ ID NO: 168499 - RNA, 22 nt, Human
gcuggcuugauaguuucugcuu

SEQ ID NO: 168500 - RNA, 22 nt, Human
cuggcuuucccuggacaacagc

SEQ ID NO: 168501 - RNA, 22 nt, Human
ugaaaucaauugcaauguuuau

SEQ ID NO: 168502 - RNA, 22 nt, Human
ucucacuuuguugcccagacuu

SEQ ID NO: 168503 - RNA, 22 nt, Human
uccaaaguguugggauuauagg

SEQ ID NO: 168504 - RNA, 19 nt, Human
aggaaggaaccugagucug

SEQ ID NO: 168505 - RNA, 22 nt, Human
ggcauccaaauaccaagaugua

SEQ ID NO: 168506 - RNA, 22 nt, Human
gcauguuuugcaacaagugacc

SEQ ID NO: 168507 - RNA, 22 nt, Human
gggcaggugaccucuuguccug

SEQ ID NO: 168508 - RNA, 21 nt, Human
gcugggucagcagguccucug

SEQ ID NO: 168509 - RNA, 19 nt, Human
aaaguuuuauucucauuug

SEQ ID NO: 168510 - RNA, 22 nt, Human
gguguccuuguugaacgaaaau

SEQ ID NO: 168511 - RNA, 22 nt, Human
uuacuucuuacaaaagaaauau

SEQ ID NO: 168512 - RNA, 22 nt, Human
uauuuccaccuauuauuuucug

SEQ ID NO: 168513 - RNA, 22 nt, Human
uuauuaaugaguacaaguuauu

SEQ ID NO: 168514 - RNA, 22 nt, Human
aaagucaucagaaccuuccaga

SEQ ID NO: 168515 - RNA, 22 nt, Human
caaauguauucucacuucaggg

SEQ ID NO: 168516 - RNA, 22 nt, Human
gaauuucauugcucugcugugu

SEQ ID NO: 168517 - RNA, 22 nt, Human
uggcagguagucagaggcgaca

SEQ ID NO: 168518 - RNA, 22 nt, Human
ggcauuaagaauaucauuaaaa

SEQ ID NO: 168519 - RNA, 22 nt, Human
gugaccauuugacauauccuug

SEQ ID NO: 168520 - RNA, 22 nt, Human
uucauguauuuaucauguaaau

SEQ ID NO: 168521 - RNA, 22 nt, Human
uuuccauguuaucuugcagacu

SEQ ID NO: 168522 - RNA, 22 nt, Human
ucuuuuaagccucuggcauagg

SEQ ID NO: 168523 - RNA, 22 nt, Human
gcagguguuuuaagacauugaa

SEQ ID NO: 168524 - RNA, 22 nt, Human
agaauuuccuaugagagauucc

SEQ ID NO: 168525 - RNA, 22 nt, Human
gauuucaaggaguuuucacagu

SEQ ID NO: 168526 - RNA, 19 nt, Human
auacagauguauccaugau

SEQ ID NO: 168527 - RNA, 22 nt, Human
agcucccauuaucuucugaaac

SEQ ID NO: 168528 - RNA, 22 nt, Human
uuuagcuucaguucuagcuucu

SEQ ID NO: 168529 - RNA, 22 nt, Human
cuugauugcuucuacgugacug

SEQ ID NO: 168530 - RNA, 22 nt, Human
uagggcagccacccaggcugcu

SEQ ID NO: 168531 - RNA, 22 nt, Human
ccuucuucuguguggcccaaga

SEQ ID NO: 168532 - RNA, 22 nt, Human
cauuguuaccaucuuuuaccua

SEQ ID NO: 168533 - RNA, 22 nt, Human
ccuggagguggagguugcagug

SEQ ID NO: 168534 - RNA, 22 nt, Human
cagggcagaaggcacucuacuc

SEQ ID NO: 168535 - RNA, 21 nt, Human
ugucagagcuuguaggacauu

SEQ ID NO: 168536 - RNA, 22 nt, Human
uggcaaaggggaccauguugaa

SEQ ID NO: 168537 - RNA, 22 nt, Human
ccagagagauugcuucuaaaga

SEQ ID NO: 168538 - RNA, 22 nt, Human
uuugacaaaggaaaaaugcaca

SEQ ID NO: 168539 - RNA, 22 nt, Human
ccugggugaugugcugcccucg

SEQ ID NO: 168540 - RNA, 22 nt, Human
auugcuggcaucagugacaaua

SEQ ID NO: 168541 - RNA, 22 nt, Human
auuauuagauucuuaauuguaa

SEQ ID NO: 168542 - RNA, 22 nt, Human
ugggaccucucuugagagagca

SEQ ID NO: 168543 - RNA, 22 nt, Human
guagcuuauuagggauaauagu

SEQ ID NO: 168544 - RNA, 22 nt, Human
gauuguaauucuacuuuccgcu

SEQ ID NO: 168545 - RNA, 22 nt, Human
gccaaaucuugcacacucuugu

SEQ ID NO: 168546 - RNA, 22 nt, Human
aagggcagcuauuaucgucauc

SEQ ID NO: 168547 - RNA, 22 nt, Human
cacccagcuuuugcauccuccg

SEQ ID NO: 168548 - RNA, 22 nt, Human
ucacagaaauaagauaguuauu

SEQ ID NO: 168549 - RNA, 22 nt, Human
cuguuuucccuggaguucagca

SEQ ID NO: 168550 - RNA, 22 nt, Human
ggcaggcagaggcugagacagg

SEQ ID NO: 168551 - RNA, 22 nt, Human
uuuuauuggagugauaccaagc

SEQ ID NO: 168552 - RNA, 16 nt, Human
caggugucagucaccu

SEQ ID NO: 168553 - RNA, 22 nt, Human
uuuccuguugccaucaagaaug

SEQ ID NO: 168554 - RNA, 22 nt, Human
agauggucuaguugaaccauau

SEQ ID NO: 168555 - RNA, 22 nt, Human
ucagacagaaagaugaguaugg

SEQ ID NO: 168556 - RNA, 22 nt, Human
uucuucuugaaacuuuagguug

SEQ ID NO: 168557 - RNA, 22 nt, Human
ugcacuacugugauacacagcc

SEQ ID NO: 168558 - RNA, 22 nt, Human
uuauuugcccauguuuagcaga

SEQ ID NO: 168559 - RNA, 22 nt, Human
uagcuuuaagaugagaugugga

SEQ ID NO: 168560 - RNA, 22 nt, Human
auuuauuaagcaucugcuaugu

SEQ ID NO: 168561 - RNA, 22 nt, Human
gcucuaauugaaaaauacugca

SEQ ID NO: 168562 - RNA, 22 nt, Human
acagcuuuguuuucccugcuga

SEQ ID NO: 168563 - RNA, 22 nt, Human
auuuccaagaaagcuuuaggau

SEQ ID NO: 168564 - RNA, 22 nt, Human
uuucacauuuaggcgugaauug

SEQ ID NO: 168565 - RNA, 22 nt, Human
aaugccaacuuggauauacauu

SEQ ID NO: 168566 - RNA, 22 nt, Human
ucagggcaagucucagaagguu

SEQ ID NO: 168567 - RNA, 20 nt, Human
cagcuuuagaucuuugauua

SEQ ID NO: 168568 - RNA, 22 nt, Human
aacaugauggggaagaacaaga

SEQ ID NO: 168569 - RNA, 22 nt, Human
ccacccagcagaggaggcaaga

SEQ ID NO: 168570 - RNA, 21 nt, Human
aaggcuggagaugcaggucug

SEQ ID NO: 168571 - RNA, 22 nt, Human
guuuauuagaguuuucugucug

SEQ ID NO: 168572 - RNA, 22 nt, Human
caaguccaggucaauuuaaagc

SEQ ID NO: 168573 - RNA, 22 nt, Human
agguggggaguauauguaauug

SEQ ID NO: 168574 - RNA, 22 nt, Human
caggcauaaucucaucuuguuu

SEQ ID NO: 168575 - RNA, 22 nt, Human
uagucaccuguugugugaugcc

SEQ ID NO: 168576 - RNA, 22 nt, Human
uuuuccagagcugucucuugca

SEQ ID NO: 168577 - RNA, 22 nt, Human
ucaaaauuuuauuucucaagga

SEQ ID NO: 168578 - RNA, 22 nt, Human
aauuaaaugacaggggaagaug

SEQ ID NO: 168579 - RNA, 22 nt, Human
gggauuuaguaggauaguauac

SEQ ID NO: 168580 - RNA, 18 nt, Human
ugcuuggagcauuuacca

SEQ ID NO: 168581 - RNA, 22 nt, Human
ucuauacacacaaagaaugcuu

SEQ ID NO: 168582 - RNA, 22 nt, Human
uagaaacaucagcuaaccaaaa

SEQ ID NO: 168583 - RNA, 22 nt, Human
cuuuaguucuaaugcauugaaa

SEQ ID NO: 168584 - RNA, 22 nt, Human
augcaugaaagaauccaagccu

SEQ ID NO: 168585 - RNA, 22 nt, Human
aggacuuagaacauuauguacu

SEQ ID NO: 168586 - RNA, 22 nt, Human
auaauucagguuuucuggcaca

SEQ ID NO: 168587 - RNA, 22 nt, Human
gcuggagguggugagaaaaggu

SEQ ID NO: 168588 - RNA, 22 nt, Human
ggagcugagaguagucccuuuu

SEQ ID NO: 168589 - RNA, 22 nt, Human
gagccucguggcggccacugcg

SEQ ID NO: 168590 - RNA, 21 nt, Human
ucuguucaaggaacuacggau

SEQ ID NO: 168591 - RNA, 22 nt, Human
ucugggaauuuauuggcacuuu

SEQ ID NO: 168592 - RNA, 22 nt, Human
aaagcuaccuuuguguucauag

SEQ ID NO: 168593 - RNA, 21 nt, Human
uaaauaauaaguugcugagau

SEQ ID NO: 168594 - RNA, 22 nt, Human
gaauaucccgcuaugcaaagua

SEQ ID NO: 168595 - RNA, 22 nt, Human
uuauuuauggcccucaccugau

SEQ ID NO: 168596 - RNA, 22 nt, Human
uaacaagucauuuuaaauuaug

SEQ ID NO: 168597 - RNA, 22 nt, Human
uaguuauauccagucuuuaaaa

SEQ ID NO: 168598 - RNA, 22 nt, Human
cuuuucaugccagcccaucaca

SEQ ID NO: 168599 - RNA, 20 nt, Human
auuucaguguuugcaauuuc

SEQ ID NO: 168600 - RNA, 22 nt, Human
gagggcucacugagaaagcagu

SEQ ID NO: 168601 - RNA, 22 nt, Human
cuuguucaguccugacuuccug

SEQ ID NO: 168602 - RNA, 22 nt, Human
caugaaaaugucaaguucugcu

SEQ ID NO: 168603 - RNA, 22 nt, Human
gaaacaugucugacaauuuacc

SEQ ID NO: 168604 - RNA, 22 nt, Human
gggugugucuuuugcuccugga

SEQ ID NO: 168605 - RNA, 22 nt, Human
guucuucagaggggaaagaacc

SEQ ID NO: 168606 - RNA, 21 nt, Human
gggugggaggacacagcaggc

SEQ ID NO: 168607 - RNA, 22 nt, Human
gccaggcaauguguuagaagcg

SEQ ID NO: 168608 - RNA, 22 nt, Human
aucuaucccaguuuaacucauu

SEQ ID NO: 168609 - RNA, 22 nt, Human
uagggcagaguccaggaugggc

SEQ ID NO: 168610 - RNA, 22 nt, Human
uuaagacauucagauauuucua

SEQ ID NO: 168611 - RNA, 22 nt, Human
aaacauguuuucugaauauuuu

SEQ ID NO: 168612 - RNA, 22 nt, Human
aguuguaagagacagauauaaa

SEQ ID NO: 168613 - RNA, 22 nt, Human
uuauuagguuuacauaaagguu

SEQ ID NO: 168614 - RNA, 22 nt, Human
aucuuccuucacuuucucccac

SEQ ID NO: 168615 - RNA, 22 nt, Human
uagcuuuaccauagaagaguau

SEQ ID NO: 168616 - RNA, 22 nt, Human
gccugcagggccugggccuacc

SEQ ID NO: 168617 - RNA, 18 nt, Human
gcuuuauuucuuggggaa

SEQ ID NO: 168618 - RNA, 20 nt, Human
ucuguucaaaucuuaguucc

SEQ ID NO: 168619 - RNA, 22 nt, Human
uauaagaaacaaggcaaauuuu

SEQ ID NO: 168620 - RNA, 22 nt, Human
uagaacacuugaccacugcucc

SEQ ID NO: 168621 - RNA, 21 nt, Human
auuuccaaauaaggucacauu

SEQ ID NO: 168622 - RNA, 22 nt, Human
ucuaugaaaagucuauucauuc

SEQ ID NO: 168623 - RNA, 22 nt, Human
auggagggugguaagacagaga

SEQ ID NO: 168624 - RNA, 22 nt, Human
cagagccucagaauccugugga

SEQ ID NO: 168625 - RNA, 22 nt, Human
agcagggcaugaauaaggguuu

SEQ ID NO: 168626 - RNA, 22 nt, Human
agacagacuuugaucuggaugu

SEQ ID NO: 168627 - RNA, 22 nt, Human
agacuucuuugugagcauuuuc

SEQ ID NO: 168628 - RNA, 22 nt, Human
auuaaaauuccaagguaugcca

SEQ ID NO: 168629 - RNA, 20 nt, Human
ugcagggccuaaaaagggaa

SEQ ID NO: 168630 - RNA, 22 nt, Human
auuguaaauagugccacaauaa

SEQ ID NO: 168631 - RNA, 22 nt, Human
acagagagguaaaauauauagu

SEQ ID NO: 168632 - RNA, 22 nt, Human
uuuaaaaaacuagucugagucu

SEQ ID NO: 168633 - RNA, 22 nt, Human
cagagcauugagggucugccaa

SEQ ID NO: 168634 - RNA, 22 nt, Human
uuagcuuucagccuuucucacc

SEQ ID NO: 168635 - RNA, 22 nt, Human
uggucugggcaaauccuucuga

SEQ ID NO: 168636 - RNA, 22 nt, Human
agaggugggagccuggucacau

SEQ ID NO: 168637 - RNA, 22 nt, Human
ugcuuucuuuagcuccugaguc

SEQ ID NO: 168638 - RNA, 22 nt, Human
caucagaacgugagcuccuugu

SEQ ID NO: 168639 - RNA, 20 nt, Human
cccagagccauagccagaca

SEQ ID NO: 168640 - RNA, 22 nt, Human
uuggaggauugcucucagccca

SEQ ID NO: 168641 - RNA, 22 nt, Human
auugcugggaggauguguguuc

SEQ ID NO: 168642 - RNA, 22 nt, Human
guauuagggccaaaggcaggaa

SEQ ID NO: 168643 - RNA, 22 nt, Human
cagggacccuacuagcucacac

SEQ ID NO: 168644 - RNA, 22 nt, Human
aagggagacaguugugugagga

SEQ ID NO: 168645 - RNA, 23 nt, Human
ugcuggcuuuuaucuggucccua

SEQ ID NO: 168646 - RNA, 22 nt, Human
aaggcucccucuucucgagugu

SEQ ID NO: 168647 - RNA, 22 nt, Human
caaguccuuagaugguucuuug

SEQ ID NO: 168648 - RNA, 22 nt, Human
uuuacaguuaagaaauguuacc

SEQ ID NO: 168649 - RNA, 22 nt, Human
guaaaauucuagcaucugaaag

SEQ ID NO: 168650 - RNA, 22 nt, Human
agcagggcugcagugugucuuu

SEQ ID NO: 168651 - RNA, 22 nt, Human
auuugaagucuucaugauuucu

SEQ ID NO: 168652 - RNA, 22 nt, Human
gaugugucccuuucaacucaga

SEQ ID NO: 168653 - RNA, 22 nt, Human
uuucagaaccgcuaaaauaaau

SEQ ID NO: 168654 - RNA, 22 nt, Human
gugaauaagaccuaaggaugaa

SEQ ID NO: 168655 - RNA, 22 nt, Human
uccaggcauuggagagauaaug

SEQ ID NO: 168656 - RNA, 22 nt, Human
ggguaccaagcugcuugggggc

SEQ ID NO: 168657 - RNA, 22 nt, Human
uaauacuuuugccuuguauuca

SEQ ID NO: 168658 - RNA, 22 nt, Human
uuaauuaugcaaaaggccccau

SEQ ID NO: 168659 - RNA, 22 nt, Human
ugcuguggcaguuuauguauag

SEQ ID NO: 168660 - RNA, 22 nt, Human
ccuguucaaugcccuggcuuca

SEQ ID NO: 168661 - RNA, 22 nt, Human
uaacagaaauuuuaguuagggg

SEQ ID NO: 168662 - RNA, 22 nt, Human
ugacagguucguuagucauguu

SEQ ID NO: 168663 - RNA, 22 nt, Human
cuaaagcucaacaggcacuauu

SEQ ID NO: 168664 - RNA, 22 nt, Human
ccugggugcccggcccuucucu

SEQ ID NO: 168665 - RNA, 22 nt, Human
uacaagucacuuccuuucuaaa

SEQ ID NO: 168666 - RNA, 22 nt, Human
gguguccugggcaggcagcuga

SEQ ID NO: 168667 - RNA, 22 nt, Human
gggacaugaagcaucggaggca

SEQ ID NO: 168668 - RNA, 22 nt, Human
agagggaucacccuguuucugg

SEQ ID NO: 168669 - RNA, 22 nt, Human
ugucuucaucucagacacaguu

SEQ ID NO: 168670 - RNA, 22 nt, Human
agaagcuuccuacauuguucuu

SEQ ID NO: 168671 - RNA, 22 nt, Human
aggggauggagcuggaaggcag

SEQ ID NO: 168672 - RNA, 21 nt, Human
agucccauccgguaagcaagc

SEQ ID NO: 168673 - RNA, 22 nt, Human
cuuuucauuguuuguacaugca

SEQ ID NO: 168674 - RNA, 17 nt, Human
gcuccuucuaacuucca

SEQ ID NO: 168675 - RNA, 22 nt, Human
ucucaagcuaguguuuauagua

SEQ ID NO: 168676 - RNA, 22 nt, Human
accucaaggaaaaucuagacag

SEQ ID NO: 168677 - RNA, 22 nt, Human
guaggcagggcuguggggagaa

SEQ ID NO: 168678 - RNA, 22 nt, Human
cuuaggcagacugcugaugcag

SEQ ID NO: 168679 - RNA, 22 nt, Human
uguccuuuuggcugucuauggu

SEQ ID NO: 168680 - RNA, 18 nt, Human
agacccucuaagggcagu

SEQ ID NO: 168681 - RNA, 22 nt, Human
uuucugcagcagacucagugug

SEQ ID NO: 168682 - RNA, 22 nt, Human
gguuucaacuaaaucaagaagg

SEQ ID NO: 168683 - RNA, 22 nt, Human
uccaugaggaccaaauucguag

SEQ ID NO: 168684 - RNA, 22 nt, Human
agcagggcaguuaaaggguccu

SEQ ID NO: 168685 - RNA, 22 nt, Human
aaggugucauuguuuauggaga

SEQ ID NO: 168686 - RNA, 22 nt, Human
ggcugaggcucaugccaucuug

SEQ ID NO: 168687 - RNA, 22 nt, Human
uuuccaaaguugccauaagcuu

SEQ ID NO: 168688 - RNA, 17 nt, Human
auuuacauugucaccga

SEQ ID NO: 168689 - RNA, 22 nt, Human
aacaugcuuugauaaauaaaag

SEQ ID NO: 168690 - RNA, 22 nt, Human
acaugauuaaaagauuuuaaag

SEQ ID NO: 168691 - RNA, 19 nt, Human
gaggugucuuuccugagua

SEQ ID NO: 168692 - RNA, 22 nt, Human
aggagcugauaaaaggggguca

SEQ ID NO: 168693 - RNA, 22 nt, Human
uauuucagcccuacuacuuggc

SEQ ID NO: 168694 - RNA, 22 nt, Human
ugaaacaaauuuggaaaaucua

SEQ ID NO: 168695 - RNA, 22 nt, Human
aaaacaguuuaggcaucacagu

SEQ ID NO: 168696 - RNA, 22 nt, Human
auuccaaacgccucgcggacuu

SEQ ID NO: 168697 - RNA, 19 nt, Human
ggacagacgcagagaucug

SEQ ID NO: 168698 - RNA, 22 nt, Human
cuggauguuuugcuaaggacuc

SEQ ID NO: 168699 - RNA, 22 nt, Human
ggcaggcagauggcugcaccaa

SEQ ID NO: 168700 - RNA, 22 nt, Human
ugacaugugcucaucuuggcua

SEQ ID NO: 168701 - RNA, 22 nt, Human
auucagcaaacauuuauuaucu

SEQ ID NO: 168702 - RNA, 22 nt, Human
cuggaguuagaguagacacuga

SEQ ID NO: 168703 - RNA, 22 nt, Human
uugcuuuacauguucugguaaa

SEQ ID NO: 168704 - RNA, 22 nt, Human
gagggcaggggucuugcacggu

SEQ ID NO: 168705 - RNA, 22 nt, Human
uggguacuccuauuaguucagu

SEQ ID NO: 168706 - RNA, 22 nt, Human
cuuagggagaaugccucugcag

SEQ ID NO: 168707 - RNA, 22 nt, Human
cccagugucuccaacaucagau

SEQ ID NO: 168708 - RNA, 22 nt, Human
uaagaaucaguagauauagauu

SEQ ID NO: 168709 - RNA, 22 nt, Human
ggcagaggaagcuggaaguggg

SEQ ID NO: 168710 - RNA, 22 nt, Human
agcuuuaugaggagaccuuagu

SEQ ID NO: 168711 - RNA, 22 nt, Human
guaaacaucgacccaacagggg

SEQ ID NO: 168712 - RNA, 22 nt, Human
cuguguccucccgcugcaccca

SEQ ID NO: 168713 - RNA, 22 nt, Human
uaucagaagacuuacaguaucg

SEQ ID NO: 168714 - RNA, 22 nt, Human
uucuaucauacuugaauacauu

SEQ ID NO: 168715 - RNA, 22 nt, Human
gauuuuauauggcauacugugg

SEQ ID NO: 168716 - RNA, 22 nt, Human
gcaugugugucacuuuccugcc

SEQ ID NO: 168717 - RNA, 22 nt, Human
ucauuuguugaacuuuagugcg

SEQ ID NO: 168718 - RNA, 22 nt, Human
uggaggaaguggacaguugugu

SEQ ID NO: 168719 - RNA, 22 nt, Human
uuccuuagcugucccuggaaau

SEQ ID NO: 168720 - RNA, 22 nt, Human
cccugcaggcucagacuggagu

SEQ ID NO: 168721 - RNA, 18 nt, Human
uagggcucuagggaguga

SEQ ID NO: 168722 - RNA, 22 nt, Human
agcucccaauugacuugaacua

SEQ ID NO: 168723 - RNA, 22 nt, Human
aucuuuauuuauugagcacuua

SEQ ID NO: 168724 - RNA, 22 nt, Human
uugaaauaucaaguuauuagug

SEQ ID NO: 168725 - RNA, 22 nt, Human
aacuauguuaauaaguuucauu

SEQ ID NO: 168726 - RNA, 22 nt, Human
cuucuucaauagcaagcgcaua

SEQ ID NO: 168727 - RNA, 22 nt, Human
aacauuguuuucccuauaucca

SEQ ID NO: 168728 - RNA, 22 nt, Human
aucacaaaggcugcuucaugau

SEQ ID NO: 168729 - RNA, 21 nt, Human
cuguggaagggaacuagaggg

SEQ ID NO: 168730 - RNA, 22 nt, Human
cuuagggaaucuuagagcugga

SEQ ID NO: 168731 - RNA, 22 nt, Human
uucuaaaaccaauucugcuucu

SEQ ID NO: 168732 - RNA, 22 nt, Human
auggaguucuuuaaauucacag

SEQ ID NO: 168733 - RNA, 22 nt, Human
gauguguccccagaggauugaa

SEQ ID NO: 168734 - RNA, 23 nt, Human
ucuauacauacugcagccucugg

SEQ ID NO: 168735 - RNA, 22 nt, Human
ugcuggaggccagaagucugag

SEQ ID NO: 168736 - RNA, 22 nt, Human
ggcaaaguuuucaucucauaac

SEQ ID NO: 168737 - RNA, 22 nt, Human
auuauuagugauguuguuacug

SEQ ID NO: 168738 - RNA, 22 nt, Human
gucaacuuuaagaugaucuuuu

SEQ ID NO: 168739 - RNA, 22 nt, Human
guuuccaaccccaccaaagugc

SEQ ID NO: 168740 - RNA, 20 nt, Human
cuucuucaguaguuuguucu

SEQ ID NO: 168741 - RNA, 22 nt, Human
ucagccagcaucagcuaagugc

SEQ ID NO: 168742 - RNA, 22 nt, Human
cuggaggagagucugaaugaca

SEQ ID NO: 168743 - RNA, 22 nt, Human
guccaugauucuguguaguaga

SEQ ID NO: 168744 - RNA, 22 nt, Human
uuucuucagagagagcuuuccc

SEQ ID NO: 168745 - RNA, 22 nt, Human
cuguuauuuuccucugaacucu

SEQ ID NO: 168746 - RNA, 22 nt, Human
agcccccucccuagugacugga

SEQ ID NO: 168747 - RNA, 22 nt, Human
cuauuagguaugugguugcuau

SEQ ID NO: 168748 - RNA, 22 nt, Human
ucuggguggugucuuccaagac

SEQ ID NO: 168749 - RNA, 22 nt, Human
uucuucagacuacugaugauug

SEQ ID NO: 168750 - RNA, 22 nt, Human
auuuacagaagcauguaauagc

SEQ ID NO: 168751 - RNA, 22 nt, Human
gaauuucaaaagccagaacggg

SEQ ID NO: 168752 - RNA, 22 nt, Human
caguccuuucaauggugaccuu

SEQ ID NO: 168753 - RNA, 22 nt, Human
auaauucaugggccuuucaccu

SEQ ID NO: 168754 - RNA, 22 nt, Human
acagaguucccacuccagaagc

SEQ ID NO: 168755 - RNA, 22 nt, Human
ggcugcaaaggaaaagugguga

SEQ ID NO: 168756 - RNA, 22 nt, Human
auuuccauguccaaaaauuagu

SEQ ID NO: 168757 - RNA, 22 nt, Human
auucuucagcaggggacacuau

SEQ ID NO: 168758 - RNA, 22 nt, Human
caaguccuaggucugauugaac

SEQ ID NO: 168759 - RNA, 22 nt, Human
cccagggaagggcuaccugagg

SEQ ID NO: 168760 - RNA, 22 nt, Human
uuuucauuuuuguagaugcaag

SEQ ID NO: 168761 - RNA, 22 nt, Human
auuccaaaaggauguuagaaug

SEQ ID NO: 168762 - RNA, 20 nt, Human
aauaaacuacugagagaugu

SEQ ID NO: 168763 - RNA, 22 nt, Human
caauagugucugcuuguuucua

SEQ ID NO: 168764 - RNA, 22 nt, Human
gcuuucuugguucugcaggggc

SEQ ID NO: 168765 - RNA, 20 nt, Human
agcaggugacggggccugcu

SEQ ID NO: 168766 - RNA, 22 nt, Human
gcugccacuuggucaugucaug

SEQ ID NO: 168767 - RNA, 21 nt, Human
uucauaaaccauucucaugca

SEQ ID NO: 168768 - RNA, 22 nt, Human
caguggugaagagcaggggcuc

SEQ ID NO: 168769 - RNA, 22 nt, Human
guuuacaugcagaaaaucaaug

SEQ ID NO: 168770 - RNA, 22 nt, Human
uagaagcaguaauagaaauagg

SEQ ID NO: 168771 - RNA, 22 nt, Human
gccuggguccacugaucaugcu

SEQ ID NO: 168772 - RNA, 22 nt, Human
cugauuccagagucuguguucu

SEQ ID NO: 168773 - RNA, 22 nt, Human
aaaucagucccucuuggaauuu

SEQ ID NO: 168774 - RNA, 22 nt, Human
cagaagagaugaaauaguauua

SEQ ID NO: 168775 - RNA, 20 nt, Human
ccagcuuucccugcagcauc

SEQ ID NO: 168776 - RNA, 22 nt, Human
uucagaaaggauaauuggaagg

SEQ ID NO: 168777 - RNA, 22 nt, Human
agguauauauucugguccuuau

SEQ ID NO: 168778 - RNA, 22 nt, Human
uuugcuuaaaguucuuucuggu

SEQ ID NO: 168779 - RNA, 22 nt, Human
uuagggacagcucuguagguga

SEQ ID NO: 168780 - RNA, 22 nt, Human
guguguccucaguaguggcaug

SEQ ID NO: 168781 - RNA, 22 nt, Human
ccagguggacuugauuugaaua

SEQ ID NO: 168782 - RNA, 17 nt, Human
uuuagaauacaauguuu

SEQ ID NO: 168783 - RNA, 22 nt, Human
acaagcaugggcuuugacauca

SEQ ID NO: 168784 - RNA, 22 nt, Human
aauuugcaugaugagaacaaua

SEQ ID NO: 168785 - RNA, 19 nt, Human
agugugagacuccaucuca

SEQ ID NO: 168786 - RNA, 22 nt, Human
aucacaaaggucucagagcaca

SEQ ID NO: 168787 - RNA, 22 nt, Human
gcacccaggccggcgacugcag

SEQ ID NO: 168788 - RNA, 22 nt, Human
uucugugaaucuuuuuucccac

SEQ ID NO: 168789 - RNA, 22 nt, Human
acauguguacauauauaugugc

SEQ ID NO: 168790 - RNA, 18 nt, Human
gguccugggccuggcuca

SEQ ID NO: 168791 - RNA, 21 nt, Human
uagggcucucugugucaggug

SEQ ID NO: 168792 - RNA, 22 nt, Human
cuccuucugaggcucuggguuc

SEQ ID NO: 168793 - RNA, 22 nt, Human
aacuuugaggucacugaauucc

SEQ ID NO: 168794 - RNA, 22 nt, Human
uacuagaaccucacaacaaucc

SEQ ID NO: 168795 - RNA, 22 nt, Human
caaggcauuguguaagcacuug

SEQ ID NO: 168796 - RNA, 22 nt, Human
uggacaugagcugagugggugu

SEQ ID NO: 168797 - RNA, 22 nt, Human
ugucaccaguuccaggaaauaa

SEQ ID NO: 168798 - RNA, 22 nt, Human
gagagaaaugugcaguuugggc

SEQ ID NO: 168799 - RNA, 22 nt, Human
cuuauacacccucuucccaggc

SEQ ID NO: 168800 - RNA, 22 nt, Human
uuuccuaagguagugauaauuu

SEQ ID NO: 168801 - RNA, 22 nt, Human
agcagggcccacuaggggagau

SEQ ID NO: 168802 - RNA, 22 nt, Human
cuucucccuggcuucugcacac

SEQ ID NO: 168803 - RNA, 22 nt, Human
acauguguggccgcuguagaca

SEQ ID NO: 168804 - RNA, 22 nt, Human
uaagaaucuauuaggaauaugu

SEQ ID NO: 168805 - RNA, 22 nt, Human
aaggaccuauauugucagagga

SEQ ID NO: 168806 - RNA, 22 nt, Human
uuuaggcaagaacucacugaga

SEQ ID NO: 168807 - RNA, 22 nt, Human
agaugguccaugcacagauaug

SEQ ID NO: 168808 - RNA, 22 nt, Human
gggacauggcuaggauuccaau

SEQ ID NO: 168809 - RNA, 19 nt, Human
ugacagagagcaggguggu

SEQ ID NO: 168810 - RNA, 22 nt, Human
cuucagaauccagaaucagaau

SEQ ID NO: 168811 - RNA, 22 nt, Human
ggaugucugucauuaugcuuuc

SEQ ID NO: 168812 - RNA, 22 nt, Human
uuagaaauauggugcugccgcc

SEQ ID NO: 168813 - RNA, 22 nt, Human
auacagaagccuguauuucugg

SEQ ID NO: 168814 - RNA, 22 nt, Human
uaauauguguuacugacuuuuu

SEQ ID NO: 168815 - RNA, 22 nt, Human
ccuuuucuggccaccaagcgcu

SEQ ID NO: 168816 - RNA, 22 nt, Human
cuagggacugggaccuuaguua

SEQ ID NO: 168817 - RNA, 22 nt, Human
uaucagaaugcagccaugugca

SEQ ID NO: 168818 - RNA, 21 nt, Human
gccugcagaccccaccaggcu

SEQ ID NO: 168819 - RNA, 22 nt, Human
ccagugcauaaucaauacagcc

SEQ ID NO: 168820 - RNA, 22 nt, Human
cccaggcacagauuaucccaau

SEQ ID NO: 168821 - RNA, 22 nt, Human
ccauuguaaagaguauacuuug

SEQ ID NO: 168822 - RNA, 22 nt, Human
aauguuuucucugugaacacau

SEQ ID NO: 168823 - RNA, 22 nt, Human
ugccuacauuccuugcuuaugg

SEQ ID NO: 168824 - RNA, 22 nt, Human
augguuuuucaaguauucagaa

SEQ ID NO: 168825 - RNA, 22 nt, Human
auuuccuguugcuuuugccacu

SEQ ID NO: 168826 - RNA, 22 nt, Human
uaaauuuacccaaggaacaugu

SEQ ID NO: 168827 - RNA, 22 nt, Human
auauaaguuaguggucauguuu

SEQ ID NO: 168828 - RNA, 22 nt, Human
agccuuguuggucugaguuugg

SEQ ID NO: 168829 - RNA, 23 nt, Human
gguuccaggaacacagccugaug

SEQ ID NO: 168830 - RNA, 22 nt, Human
uuucaaaguugggaauuguaau

SEQ ID NO: 168831 - RNA, 22 nt, Human
ccaggugugguggcauacaccu

SEQ ID NO: 168832 - RNA, 22 nt, Human
agccagagaguguuggagaugu

SEQ ID NO: 168833 - RNA, 16 nt, Human
uuuuauugugacagcc

SEQ ID NO: 168834 - RNA, 22 nt, Human
uucuauacaaagauuucucaca

SEQ ID NO: 168835 - RNA, 22 nt, Human
uuuacauguaauguuauacaaa

SEQ ID NO: 168836 - RNA, 22 nt, Human
ccacugaggcaggcaguaucua

SEQ ID NO: 168837 - RNA, 19 nt, Human
uacauacuuauucuaaaag

SEQ ID NO: 168838 - RNA, 22 nt, Human
caggaugggauguagugggccc

SEQ ID NO: 168839 - RNA, 22 nt, Human
cgcagggccgcgagcgggacca

SEQ ID NO: 168840 - RNA, 18 nt, Human
ccauguguuccuuuuggg

SEQ ID NO: 168841 - RNA, 22 nt, Human
guuucauacagauuauucaugg

SEQ ID NO: 168842 - RNA, 22 nt, Human
cagggcucccuugcaaggaggg

SEQ ID NO: 168843 - RNA, 22 nt, Human
cagcuguccuuccuggugggcg

SEQ ID NO: 168844 - RNA, 22 nt, Human
gcaugugucuccccaguggagg

SEQ ID NO: 168845 - RNA, 22 nt, Human
cuggcuugcagcucaucauaaa

SEQ ID NO: 168846 - RNA, 22 nt, Human
uuucacuagaacguucuuguuu

SEQ ID NO: 168847 - RNA, 22 nt, Human
aagggcaggcacccacccucac

SEQ ID NO: 168848 - RNA, 22 nt, Human
aaggugucucucugcuucuugg

SEQ ID NO: 168849 - RNA, 22 nt, Human
aaaaucugcuuccuuuuacaga

SEQ ID NO: 168850 - RNA, 22 nt, Human
cccaggcagugugugcaugcgu

SEQ ID NO: 168851 - RNA, 22 nt, Human
agguaaaauagauaguauuucu

SEQ ID NO: 168852 - RNA, 22 nt, Human
uugggugguggggagaguucag

SEQ ID NO: 168853 - RNA, 22 nt, Human
uuuauugucuucguggugccua

SEQ ID NO: 168854 - RNA, 22 nt, Human
auuucccaugugaaucaauugg

SEQ ID NO: 168855 - RNA, 20 nt, Human
ucccaggcugggcuccagcu

SEQ ID NO: 168856 - RNA, 22 nt, Human
uuauuccagcuaagaguccugg

SEQ ID NO: 168857 - RNA, 22 nt, Human
ugcacaaacuugugucccaggg

SEQ ID NO: 168858 - RNA, 22 nt, Human
uugcuuuagguauagaauccau

SEQ ID NO: 168859 - RNA, 22 nt, Human
uuccauaauaggcuuaagugaa

SEQ ID NO: 168860 - RNA, 22 nt, Human
uuccuucuuccagaggcugccc

SEQ ID NO: 168861 - RNA, 22 nt, Human
caauuucagugcuguggagagg

SEQ ID NO: 168862 - RNA, 22 nt, Human
gacccuguuucuacaaauaauu

SEQ ID NO: 168863 - RNA, 22 nt, Human
ggcaguggaggacccugugucu

SEQ ID NO: 168864 - RNA, 22 nt, Human
cuauuagguuggugcaaaagua

SEQ ID NO: 168865 - RNA, 22 nt, Human
gggcugacaguuuccccugaaa

SEQ ID NO: 168866 - RNA, 22 nt, Human
acauaauagcauuucuaauuug

SEQ ID NO: 168867 - RNA, 19 nt, Human
uccugcagguggcuugcag

SEQ ID NO: 168868 - RNA, 19 nt, Human
gguguccuagagauaagag

SEQ ID NO: 168869 - RNA, 22 nt, Human
gcagcuuucuacuuccuacagc

SEQ ID NO: 168870 - RNA, 22 nt, Human
agcauuuagucuuuauugcagc

SEQ ID NO: 168871 - RNA, 22 nt, Human
uacaaaaguaauuacgguuuuu

SEQ ID NO: 168872 - RNA, 22 nt, Human
auuauaugugggauagaauuua

SEQ ID NO: 168873 - RNA, 23 nt, Human
uuucuucagaagccuugcgaggc

SEQ ID NO: 168874 - RNA, 22 nt, Human
cacaugaugguggaagccauag

SEQ ID NO: 168875 - RNA, 22 nt, Human
augaaacaugcuuuguggauga

SEQ ID NO: 168876 - RNA, 22 nt, Human
agucaccagguuuuagagaccu

SEQ ID NO: 168877 - RNA, 22 nt, Human
ccagacccugcucuggggcucu

SEQ ID NO: 168878 - RNA, 19 nt, Human
uuugaauccagcugguaac

SEQ ID NO: 168879 - RNA, 22 nt, Human
agugauuugggugucagaaagu

SEQ ID NO: 168880 - RNA, 22 nt, Human
gcuuuaaugcaauuucaccuca

SEQ ID NO: 168881 - RNA, 22 nt, Human
guucuucaucauuuuagauagg

SEQ ID NO: 168882 - RNA, 22 nt, Human
uccugcagucugcacucugccu

SEQ ID NO: 168883 - RNA, 20 nt, Human
ucuaauuaaaauugucuagu

SEQ ID NO: 168884 - RNA, 22 nt, Human
gaguccuuggcaucaucaguac

SEQ ID NO: 168885 - RNA, 22 nt, Human
uuguguccucuaaucucaccac

SEQ ID NO: 168886 - RNA, 22 nt, Human
guuaauuuaguagaguccagau

SEQ ID NO: 168887 - RNA, 22 nt, Human
aauguuaauuuacugucuucau

SEQ ID NO: 168888 - RNA, 22 nt, Human
aaagugguuuaugauauuccaa

SEQ ID NO: 168889 - RNA, 22 nt, Human
auggaaugugaacaugauggca

SEQ ID NO: 168890 - RNA, 22 nt, Human
auauacugauagcugcacuucu

SEQ ID NO: 168891 - RNA, 22 nt, Human
cagaugaacuaggcugcacuug

SEQ ID NO: 168892 - RNA, 22 nt, Human
ugucagaggcucagggucucag

SEQ ID NO: 168893 - RNA, 22 nt, Human
auuucauugaaguuaauucuuc

SEQ ID NO: 168894 - RNA, 22 nt, Human
caucagaaagaguccuggacuu

SEQ ID NO: 168895 - RNA, 22 nt, Human
gcagggacaacugugcaccuga

SEQ ID NO: 168896 - RNA, 22 nt, Human
uugaaucuggguacuuguaaua

SEQ ID NO: 168897 - RNA, 22 nt, Human
acuucuaugcacagagcuugga

SEQ ID NO: 168898 - RNA, 22 nt, Human
uaugcccagcuuaaaguacaca

SEQ ID NO: 168899 - RNA, 22 nt, Human
uauuccuaagucccaacuacau

SEQ ID NO: 168900 - RNA, 22 nt, Human
ucagccaggccaggcauucaca

SEQ ID NO: 168901 - RNA, 22 nt, Human
aaaucucaggccucuauuuacu

SEQ ID NO: 168902 - RNA, 22 nt, Human
aauuucagaacccaaauuagcg

SEQ ID NO: 168903 - RNA, 22 nt, Human
ggcaggugcgcauguugcauua

SEQ ID NO: 168904 - RNA, 22 nt, Human
uguguccucaugagguuugcag

SEQ ID NO: 168905 - RNA, 22 nt, Human
aauauuuguuaguguuuuaaug

SEQ ID NO: 168906 - RNA, 22 nt, Human
ucacaugaguauuauuuuccaa

SEQ ID NO: 168907 - RNA, 23 nt, Human
uaauacugcuucagaggcuuaga

SEQ ID NO: 168908 - RNA, 22 nt, Human
gucugcccuuccucuccacgau

SEQ ID NO: 168909 - RNA, 22 nt, Human
uauugcugaugcugaagggaag

SEQ ID NO: 168910 - RNA, 22 nt, Human
agaugguugucgcaaaugaaug

SEQ ID NO: 168911 - RNA, 21 nt, Human
ugacccuucuagcagaacaca

SEQ ID NO: 168912 - RNA, 22 nt, Human
cacugaaauauuaauaucuuau

SEQ ID NO: 168913 - RNA, 22 nt, Human
caguuaaaagguaugcuaccaa

SEQ ID NO: 168914 - RNA, 22 nt, Human
uuuacucuugcuacacaacugu

SEQ ID NO: 168915 - RNA, 20 nt, Human
ucuuauugucuugaggaguu

SEQ ID NO: 168916 - RNA, 22 nt, Human
auggauuuggaugagauuacuu

SEQ ID NO: 168917 - RNA, 22 nt, Human
uucuuaacuggaaaaugucaga

SEQ ID NO: 168918 - RNA, 22 nt, Human
auguucuuucagccagugcauc

SEQ ID NO: 168919 - RNA, 22 nt, Human
cugggugugggucaagcaacca

SEQ ID NO: 168920 - RNA, 19 nt, Human
uccaggaggcugccauuga

SEQ ID NO: 168921 - RNA, 22 nt, Human
gcaacuuuagggccagcaagua

SEQ ID NO: 168922 - RNA, 22 nt, Human
uguccuggagugcuugggggaa

SEQ ID NO: 168923 - RNA, 22 nt, Human
agcaggugcguuacuucacucu

SEQ ID NO: 168924 - RNA, 22 nt, Human
auugcuaggaacagguugcacc

SEQ ID NO: 168925 - RNA, 20 nt, Human
agcuucuucugucuaauuuu

SEQ ID NO: 168926 - RNA, 22 nt, Human
gcagcuuucugggacagaaagg

SEQ ID NO: 168927 - RNA, 20 nt, Human
auucuacaagaauaagcaug

SEQ ID NO: 168928 - RNA, 22 nt, Human
cuguccagucuuuagcaagcug

SEQ ID NO: 168929 - RNA, 22 nt, Human
agggcuccuaugaugcucugcc

SEQ ID NO: 168930 - RNA, 21 nt, Human
uucuucaguuuaauauaaaau

SEQ ID NO: 168931 - RNA, 22 nt, Human
augguuuacaauguuuucaguu

SEQ ID NO: 168932 - RNA, 22 nt, Human
ucagggcauacucuucaagguc

SEQ ID NO: 168933 - RNA, 22 nt, Human
ccuguucacccuccaugcacag

SEQ ID NO: 168934 - RNA, 22 nt, Human
augugcuuuauuaaguaaaaau

SEQ ID NO: 168935 - RNA, 22 nt, Human
uacagcuaggcaaaaaugacau

SEQ ID NO: 168936 - RNA, 20 nt, Human
uuccaacucacaucucuaca

SEQ ID NO: 168937 - RNA, 22 nt, Human
aggcagggugaugauaaugauu

SEQ ID NO: 168938 - RNA, 23 nt, Human
ccacagagcugccaauuccugug

SEQ ID NO: 168939 - RNA, 22 nt, Human
ccuguucaagguauuaauuauc

SEQ ID NO: 168940 - RNA, 23 nt, Human
cuuucauugugguuucacagagc

SEQ ID NO: 168941 - RNA, 22 nt, Human
gcaugugucaucugccuuucgu

SEQ ID NO: 168942 - RNA, 22 nt, Human
auuaggcagacaacguagccgg

SEQ ID NO: 168943 - RNA, 20 nt, Human
ucagacagucgcaguucugg

SEQ ID NO: 168944 - RNA, 22 nt, Human
agcagggcuuuggcuggcuuuc

SEQ ID NO: 168945 - RNA, 22 nt, Human
ucuguucaugucuuuuuaagug

SEQ ID NO: 168946 - RNA, 22 nt, Human
ugaauaauccacagucauucau

SEQ ID NO: 168947 - RNA, 22 nt, Human
uauguguccuguuaccggcagc

SEQ ID NO: 168948 - RNA, 22 nt, Human
ucccugaaacauaauagaugcc

SEQ ID NO: 168949 - RNA, 22 nt, Human
cccugcagacgucuugaugccu

SEQ ID NO: 168950 - RNA, 22 nt, Human
uaaugucuaugggccagauaau

SEQ ID NO: 168951 - RNA, 22 nt, Human
ccccaggcagggccuaacagag

SEQ ID NO: 168952 - RNA, 22 nt, Human
uuaaaauuauggcccauuugga

SEQ ID NO: 168953 - RNA, 22 nt, Human
ggcaaagagacaugcaucgggg

SEQ ID NO: 168954 - RNA, 22 nt, Human
cucuuaaagaauguuccagcug

SEQ ID NO: 168955 - RNA, 22 nt, Human
cuuauaaaguccaucugaacaa

SEQ ID NO: 168956 - RNA, 22 nt, Human
ggcauuuauuugucucauucuu

SEQ ID NO: 168957 - RNA, 22 nt, Human
ucuggaggcaggcugccaggau

SEQ ID NO: 168958 - RNA, 22 nt, Human
ugaaugaacuaaaucauaguuc

SEQ ID NO: 168959 - RNA, 22 nt, Human
uuuuccagauuggacuuagucc

SEQ ID NO: 168960 - RNA, 22 nt, Human
cuuucacagcacaagccugccu

SEQ ID NO: 168961 - RNA, 17 nt, Human
cagugaggccuuuccuc

SEQ ID NO: 168962 - RNA, 22 nt, Human
auuucuuuucaagagggugcuu

SEQ ID NO: 168963 - RNA, 22 nt, Human
acagauuuguucuuuugggcua

SEQ ID NO: 168964 - RNA, 22 nt, Human
uauuucagucacuucuucucug

SEQ ID NO: 168965 - RNA, 22 nt, Human
ucagccaguugccccaguuagu

SEQ ID NO: 168966 - RNA, 22 nt, Human
auagauuauuugcucauuacuu

SEQ ID NO: 168967 - RNA, 18 nt, Human
ucucugaauauuuuaugu

SEQ ID NO: 168968 - RNA, 22 nt, Human
agacauguccacaaagcauuca

SEQ ID NO: 168969 - RNA, 22 nt, Human
cacagguguccaauaccugcuu

SEQ ID NO: 168970 - RNA, 22 nt, Human
cuggaaugccucccugucagag

SEQ ID NO: 168971 - RNA, 22 nt, Human
agugugucugaucacuugugag

SEQ ID NO: 168972 - RNA, 22 nt, Human
gcaggugggagccgcugccuga

SEQ ID NO: 168973 - RNA, 22 nt, Human
uguccucaggaccuggcacagu

SEQ ID NO: 168974 - RNA, 22 nt, Human
uaguucuagccagugaaaugua

SEQ ID NO: 168975 - RNA, 22 nt, Human
uuacagaaaagggguuguccuu

SEQ ID NO: 168976 - RNA, 22 nt, Human
uaauuucacugauaugaaguca

SEQ ID NO: 168977 - RNA, 19 nt, Human
uuccaaaaucaggauuuga

SEQ ID NO: 168978 - RNA, 22 nt, Human
uuuauaugugaagguuugcaga

SEQ ID NO: 168979 - RNA, 17 nt, Human
acaggcagaucaccuga

SEQ ID NO: 168980 - RNA, 22 nt, Human
guguccaucucuguaugcugcu

SEQ ID NO: 168981 - RNA, 22 nt, Human
cuaugaaaugucagauucugca

SEQ ID NO: 168982 - RNA, 22 nt, Human
uagaaacauucaguugcagucc

SEQ ID NO: 168983 - RNA, 22 nt, Human
caguguuugcuuaaguuauaug

SEQ ID NO: 168984 - RNA, 22 nt, Human
cauuuaguuauacuaaaacauu

SEQ ID NO: 168985 - RNA, 22 nt, Human
aaaaucuaaguagcgaguaagg

SEQ ID NO: 168986 - RNA, 21 nt, Human
uagcuuuaauauucccacauu

SEQ ID NO: 168987 - RNA, 22 nt, Human
ucuggcucuccagugcucuuag

SEQ ID NO: 168988 - RNA, 22 nt, Human
agauuuaaauuugcuacaauuc

SEQ ID NO: 168989 - RNA, 22 nt, Human
aguuauaugugaaaacacguau

SEQ ID NO: 168990 - RNA, 21 nt, Human
ucucuccucaagcucgacccc

SEQ ID NO: 168991 - RNA, 22 nt, Human
uuucccagagguaugaauaagu

SEQ ID NO: 168992 - RNA, 22 nt, Human
uuugguccugagcaaaacuaug

SEQ ID NO: 168993 - RNA, 22 nt, Human
auuuacugagcagcuaccaugu

SEQ ID NO: 168994 - RNA, 18 nt, Human
ugcuuuaugcuuauauaa

SEQ ID NO: 168995 - RNA, 22 nt, Human
ucuggauccuaugcacuggacu

SEQ ID NO: 168996 - RNA, 18 nt, Human
ggcggguguuuuauucac

SEQ ID NO: 168997 - RNA, 22 nt, Human
gacauaaaauggaauucuguug

SEQ ID NO: 168998 - RNA, 22 nt, Human
augcuuaacuuccuagucuaua

SEQ ID NO: 168999 - RNA, 22 nt, Human
ggcagguguuuuuauauuaaag

SEQ ID NO: 169000 - RNA, 22 nt, Human
auuugcaugcuucuauugugaa

SEQ ID NO: 169001 - RNA, 22 nt, Human
guuaggcagugugguauagcag

SEQ ID NO: 169002 - RNA, 22 nt, Human
uucagagagaccaaguggcgug

SEQ ID NO: 169003 - RNA, 22 nt, Human
aguggcagagcaggugcuggaa

SEQ ID NO: 169004 - RNA, 22 nt, Human
uucaaauuaccacauuugcuua

SEQ ID NO: 169005 - RNA, 22 nt, Human
guuucacagucugcagaauuuu

SEQ ID NO: 169006 - RNA, 22 nt, Human
uuuucauuguuacuaugagcua

SEQ ID NO: 169007 - RNA, 22 nt, Human
uuuagggaugucagaacaggga

SEQ ID NO: 169008 - RNA, 22 nt, Human
aaggugguuugauuaucccacu

SEQ ID NO: 169009 - RNA, 22 nt, Human
auuaggcagugccauuguacgg

SEQ ID NO: 169010 - RNA, 22 nt, Human
cgcagguguguuuucaggacua

SEQ ID NO: 169011 - RNA, 22 nt, Human
uuauagaacagccuccucuaga

SEQ ID NO: 169012 - RNA, 22 nt, Human
uuccuucuuuuacaccauaaau

SEQ ID NO: 169013 - RNA, 22 nt, Human
guuuauuaacugucaagugauu

SEQ ID NO: 169014 - RNA, 23 nt, Human
agcugcaagacucccugucugag

SEQ ID NO: 169015 - RNA, 22 nt, Human
gcagggcagggcaagaacuggg

SEQ ID NO: 169016 - RNA, 20 nt, Human
uuccuuaggcauuggaagaa

SEQ ID NO: 169017 - RNA, 22 nt, Human
gcugggugucacggggcucgug

SEQ ID NO: 169018 - RNA, 22 nt, Human
ggcauuuaguuuucauauucug

SEQ ID NO: 169019 - RNA, 22 nt, Human
cucuucuugucucugguuagaa

SEQ ID NO: 169020 - RNA, 22 nt, Human
uuucauggcuaggacuagagug

SEQ ID NO: 169021 - RNA, 22 nt, Human
cuugcuggaaacucucucugcc

SEQ ID NO: 169022 - RNA, 22 nt, Human
gcagguguggaguggggugagc

SEQ ID NO: 169023 - RNA, 22 nt, Human
ucagcuuugccaccagcuguaa

SEQ ID NO: 169024 - RNA, 22 nt, Human
ucagggcacaggccuguggguu

SEQ ID NO: 169025 - RNA, 22 nt, Human
uagggcucgggcacaggacagg

SEQ ID NO: 169026 - RNA, 22 nt, Human
aguuaacucauuuuauaaugcc

SEQ ID NO: 169027 - RNA, 22 nt, Human
ucagccagaggcuucuugguuu

SEQ ID NO: 169028 - RNA, 22 nt, Human
uuguacaaaggauuuggaagag

SEQ ID NO: 169029 - RNA, 22 nt, Human
cugagggucaacuugauuguau

SEQ ID NO: 169030 - RNA, 22 nt, Human
aaagccagguugugugcaggaa

SEQ ID NO: 169031 - RNA, 22 nt, Human
uaaguccuauuccaggucucuc

SEQ ID NO: 169032 - RNA, 22 nt, Human
ugcuuaaaaugaugauuauuuu

SEQ ID NO: 169033 - RNA, 22 nt, Human
gguggggccagggcuccaaccu

SEQ ID NO: 169034 - RNA, 22 nt, Human
aggcagguuggugagaagacug

SEQ ID NO: 169035 - RNA, 22 nt, Human
auguccuugagacccuccucgg

SEQ ID NO: 169036 - RNA, 22 nt, Human
uacaacauuguguugcuucaua

SEQ ID NO: 169037 - RNA, 17 nt, Human
aauugcuuguacuccca

SEQ ID NO: 169038 - RNA, 22 nt, Human
acagcaggcacacaaggauaga

SEQ ID NO: 169039 - RNA, 22 nt, Human
aaauuucuggaagugucagagu

SEQ ID NO: 169040 - RNA, 22 nt, Human
uuuauugcuggccaccuguagc

SEQ ID NO: 169041 - RNA, 22 nt, Human
ucagggcaucucuuaaguggug

SEQ ID NO: 169042 - RNA, 22 nt, Human
uugcuuuaucucuuaugccuca

SEQ ID NO: 169043 - RNA, 22 nt, Human
uguagaaagcucuucugaaauc

SEQ ID NO: 169044 - RNA, 22 nt, Human
ugaaagaaacagguauauuggg

SEQ ID NO: 169045 - RNA, 23 nt, Human
aauaucaaggugauguucccaga

SEQ ID NO: 169046 - RNA, 22 nt, Human
uuuguuagagugugggaggcug

SEQ ID NO: 169047 - RNA, 22 nt, Human
uagaaauaaaucugcagcuggg

SEQ ID NO: 169048 - RNA, 22 nt, Human
caaugucaugauuuuccauuag

SEQ ID NO: 169049 - RNA, 21 nt, Human
agggaaaaggcugagugaggg

SEQ ID NO: 169050 - RNA, 22 nt, Human
gauuucaaccuaacaguaugac

SEQ ID NO: 169051 - RNA, 22 nt, Human
accaggcagagcugggccuuaa

SEQ ID NO: 169052 - RNA, 22 nt, Human
cuguaaaacacuguaguaucug

SEQ ID NO: 169053 - RNA, 22 nt, Human
uucugggugacucacgcucccc

SEQ ID NO: 169054 - RNA, 22 nt, Human
guacagaauuaugccaugaggg

SEQ ID NO: 169055 - RNA, 22 nt, Human
cuggcuuucuguuauaaagaca

SEQ ID NO: 169056 - RNA, 22 nt, Human
agaggcaugcacagaugugcug

SEQ ID NO: 169057 - RNA, 17 nt, Human
agacagaccucugcauc

SEQ ID NO: 169058 - RNA, 22 nt, Human
gcauguguuauuucucuguggg

SEQ ID NO: 169059 - RNA, 22 nt, Human
accuuuauaugaaagaugacau

SEQ ID NO: 169060 - RNA, 22 nt, Human
cuuuaguuugugauacgaagau

SEQ ID NO: 169061 - RNA, 22 nt, Human
uuacauguaaucuaaaauaauu

SEQ ID NO: 169062 - RNA, 21 nt, Human
agacaugugaacuaaagguga

SEQ ID NO: 169063 - RNA, 22 nt, Human
uuuacagaauguugaauuuggg

SEQ ID NO: 169064 - RNA, 22 nt, Human
cugcugcccuagacccaguccu

SEQ ID NO: 169065 - RNA, 22 nt, Human
caccugcaaggagcuuucauuu

SEQ ID NO: 169066 - RNA, 21 nt, Human
cauuagggcagaagcaggaag

SEQ ID NO: 169067 - RNA, 22 nt, Human
uuaacauuguccuuagcagauu

SEQ ID NO: 169068 - RNA, 22 nt, Human
ucuucaaaaaauauccaucagu

SEQ ID NO: 169069 - RNA, 17 nt, Human
aaaauucuguaaagagg

SEQ ID NO: 169070 - RNA, 22 nt, Human
aaauuucuaagcagccacuucc

SEQ ID NO: 169071 - RNA, 20 nt, Human
ugcugggugggcagcuguaa

SEQ ID NO: 169072 - RNA, 22 nt, Human
cacccagggcugugccugccca

SEQ ID NO: 169073 - RNA, 22 nt, Human
aauugcuuuugggggcaguuac

SEQ ID NO: 169074 - RNA, 21 nt, Human
uccuccuucaaguccuggccu

SEQ ID NO: 169075 - RNA, 20 nt, Human
gagcaguggaguuuccaggg

SEQ ID NO: 169076 - RNA, 22 nt, Human
uuuuuagaauuggcugagaauu

SEQ ID NO: 169077 - RNA, 20 nt, Human
uuacuugucucagcauggag

SEQ ID NO: 169078 - RNA, 22 nt, Human
uuuuuauaacucuuuugugaca

SEQ ID NO: 169079 - RNA, 22 nt, Human
uuucacauaugguuguugauug

SEQ ID NO: 169080 - RNA, 22 nt, Human
uggcuuaagcgcaacucugucu

SEQ ID NO: 169081 - RNA, 22 nt, Human
gugaauaaaacaccugccaaga

SEQ ID NO: 169082 - RNA, 22 nt, Human
auucauuuagguauucacuuac

SEQ ID NO: 169083 - RNA, 22 nt, Human
caggccuccacuccacgcagac

SEQ ID NO: 169084 - RNA, 18 nt, Human
agcagggcauuuugccau

SEQ ID NO: 169085 - RNA, 22 nt, Human
ucuaaacagccucuuaccaacu

SEQ ID NO: 169086 - RNA, 22 nt, Human
gcauguguaugguaggaauauu

SEQ ID NO: 169087 - RNA, 21 nt, Human
auucagaaagggaauaaacuc

SEQ ID NO: 169088 - RNA, 22 nt, Human
ggguauuaaaaugaaggagaaa

SEQ ID NO: 169089 - RNA, 22 nt, Human
aaauaaguaguuuaguguugug

SEQ ID NO: 169090 - RNA, 22 nt, Human
acuguucauccuuuuugaacaa

SEQ ID NO: 169091 - RNA, 22 nt, Human
ggugggcagcucuuggcaggca

SEQ ID NO: 169092 - RNA, 22 nt, Human
ugaaaaacuuuaauccauaaag

SEQ ID NO: 169093 - RNA, 22 nt, Human
gccaggcagcugggagggugcc

SEQ ID NO: 169094 - RNA, 22 nt, Human
ggcuuggaaauugcaggacaca

SEQ ID NO: 169095 - RNA, 22 nt, Human
uggcauuuucuccuuugaguuu

SEQ ID NO: 169096 - RNA, 22 nt, Human
ucuggcucucauacucgccagu

SEQ ID NO: 169097 - RNA, 22 nt, Human
uuuccuuccagguuccuaaggc

SEQ ID NO: 169098 - RNA, 22 nt, Human
augaaauauuucagagcagagu

SEQ ID NO: 169099 - RNA, 22 nt, Human
aauuagggaaaacauuugcuuu

SEQ ID NO: 169100 - RNA, 22 nt, Human
aggcaaagaggauauuuugggg

SEQ ID NO: 169101 - RNA, 21 nt, Human
guccagagagccggcuccuga

SEQ ID NO: 169102 - RNA, 22 nt, Human
uuccaugaaagugaaauggagc

SEQ ID NO: 169103 - RNA, 22 nt, Human
ugcuggaggggaugccuucacu

SEQ ID NO: 169104 - RNA, 22 nt, Human
uuauugaaauggaagcuauaac

SEQ ID NO: 169105 - RNA, 22 nt, Human
ugcuuuauaucucucuucuuag

SEQ ID NO: 169106 - RNA, 22 nt, Human
cagaauuuuucgaauguacugu

SEQ ID NO: 169107 - RNA, 22 nt, Human
ccugucacgaugacugcacucu

SEQ ID NO: 169108 - RNA, 22 nt, Human
aauuaaauugguuuagagagga

SEQ ID NO: 169109 - RNA, 22 nt, Human
aaauguaagucuuuguuucuua

SEQ ID NO: 169110 - RNA, 22 nt, Human
uacagacagacuucccacccuc

SEQ ID NO: 169111 - RNA, 22 nt, Human
guuucaaauagguuucagcaaa

SEQ ID NO: 169112 - RNA, 22 nt, Human
ugaccuuucuuugagauuccug

SEQ ID NO: 169113 - RNA, 22 nt, Human
caguccuuggcaaguucucagu

SEQ ID NO: 169114 - RNA, 22 nt, Human
aagaucagcucccgagucugag

SEQ ID NO: 169115 - RNA, 22 nt, Human
cacagcuucccaaaguggaccu

SEQ ID NO: 169116 - RNA, 22 nt, Human
aagaaugagcucaaagaucuua

SEQ ID NO: 169117 - RNA, 22 nt, Human
aauauaaugcuguuuuaugcca

SEQ ID NO: 169118 - RNA, 22 nt, Human
cuacagaaggagaaauggguaa

SEQ ID NO: 169119 - RNA, 22 nt, Human
guccuucuuuucaucccugguu

SEQ ID NO: 169120 - RNA, 22 nt, Human
cuagaaaucucuguuuacauca

SEQ ID NO: 169121 - RNA, 22 nt, Human
acaugucuguaauuauuuuagg

SEQ ID NO: 169122 - RNA, 22 nt, Human
cccugcagagagugcuuuugug

SEQ ID NO: 169123 - RNA, 20 nt, Human
gggugugugcagggccuggu

SEQ ID NO: 169124 - RNA, 22 nt, Human
aacuuuauuguuaggggcuaaa

SEQ ID NO: 169125 - RNA, 22 nt, Human
aguccuuagaacagugccuggg

SEQ ID NO: 169126 - RNA, 22 nt, Human
ugguccuggaagguccugaggg

SEQ ID NO: 169127 - RNA, 22 nt, Human
auguccuuuguaucccuaggca

SEQ ID NO: 169128 - RNA, 22 nt, Human
uccugcagugugucuccugcac

SEQ ID NO: 169129 - RNA, 22 nt, Human
aguuuucuguucuacaauuuga

SEQ ID NO: 169130 - RNA, 22 nt, Human
ugccuugcacauaauauacauu

SEQ ID NO: 169131 - RNA, 22 nt, Human
acaugcauacacguacauaccu

SEQ ID NO: 169132 - RNA, 22 nt, Human
ccagguguagcacugcucacag

SEQ ID NO: 169133 - RNA, 23 nt, Human
augaaugaauaaggcaggaaagc

SEQ ID NO: 169134 - RNA, 22 nt, Human
ucauuuguugcuguuaccugag

SEQ ID NO: 169135 - RNA, 22 nt, Human
agcccuaaauuaucuuuauuuu

SEQ ID NO: 169136 - RNA, 22 nt, Human
ugcacuccaggcugggugacag

SEQ ID NO: 169137 - RNA, 20 nt, Human
uauuuguauuugggaaaguu

SEQ ID NO: 169138 - RNA, 22 nt, Human
agacacuguguacagaaaaaga

SEQ ID NO: 169139 - RNA, 22 nt, Human
uuuaagacuuagauuuauuggg

SEQ ID NO: 169140 - RNA, 22 nt, Human
cucagagauauagucccugcuu

SEQ ID NO: 169141 - RNA, 22 nt, Human
ugcaggugagugcaggggcuca

SEQ ID NO: 169142 - RNA, 22 nt, Human
uacaugugauaaauugauuaaa

SEQ ID NO: 169143 - RNA, 22 nt, Human
cuggaggagcauggacuggagu

SEQ ID NO: 169144 - RNA, 22 nt, Human
ucagggcagaauccaaagaauu

SEQ ID NO: 169145 - RNA, 22 nt, Human
ucagaaaauaacuguuaguuug

SEQ ID NO: 169146 - RNA, 22 nt, Human
uauuccaguucaccuuuucauc

SEQ ID NO: 169147 - RNA, 22 nt, Human
uauugcugccauuuuccaaugu

SEQ ID NO: 169148 - RNA, 22 nt, Human
uccaugcagagaacugaaguac

SEQ ID NO: 169149 - RNA, 22 nt, Human
auuuaucucuggaaacuaagca

SEQ ID NO: 169150 - RNA, 22 nt, Human
acagaaaugauguuuggcaaua

SEQ ID NO: 169151 - RNA, 22 nt, Human
uuaugcaacaggugagcagaca

SEQ ID NO: 169152 - RNA, 22 nt, Human
cagcauuuucuuaauguaggug

SEQ ID NO: 169153 - RNA, 18 nt, Human
ccagcaugccagaggcug

SEQ ID NO: 169154 - RNA, 22 nt, Human
ggaugucucccagcaccaaagu

SEQ ID NO: 169155 - RNA, 19 nt, Human
uggauuuauauucuuuauc

SEQ ID NO: 169156 - RNA, 22 nt, Human
gcaggcaggagcccaacugccu

SEQ ID NO: 169157 - RNA, 19 nt, Human
aaaagucuauucaauuaca

SEQ ID NO: 169158 - RNA, 22 nt, Human
cagagcugcuucccaguuugug

SEQ ID NO: 169159 - RNA, 22 nt, Human
acagcaugagaguagcaaaagg

SEQ ID NO: 169160 - RNA, 22 nt, Human
cagaagcagaacacuagauuua

SEQ ID NO: 169161 - RNA, 22 nt, Human
uaguuuacucaucuauaaaaug

SEQ ID NO: 169162 - RNA, 22 nt, Human
cauauucuuuaagcaaugcucu

SEQ ID NO: 169163 - RNA, 19 nt, Human
agcagguggguaagaaaau

SEQ ID NO: 169164 - RNA, 22 nt, Human
ucugggugcccuuugcucuguu

SEQ ID NO: 169165 - RNA, 22 nt, Human
acauuguauaaugauuaucaca

SEQ ID NO: 169166 - RNA, 22 nt, Human
ugcugugggauauauguucaaa

SEQ ID NO: 169167 - RNA, 22 nt, Human
aaacauuguaauuuuagcaugg

SEQ ID NO: 169168 - RNA, 22 nt, Human
guuuucaugucuauugggcaua

SEQ ID NO: 169169 - RNA, 22 nt, Human
uggcagguuucguuaaaaaugg

SEQ ID NO: 169170 - RNA, 22 nt, Human
gugggugugagugacggcgucc

SEQ ID NO: 169171 - RNA, 22 nt, Human
auuaggcauucugaaugagguc

SEQ ID NO: 169172 - RNA, 21 nt, Human
uggcaggcagcuggaagcuug

SEQ ID NO: 169173 - RNA, 22 nt, Human
cuuuccuccacucccuaggcuu

SEQ ID NO: 169174 - RNA, 22 nt, Human
uuagcuuuuaagugugcuacau

SEQ ID NO: 169175 - RNA, 22 nt, Human
auuaaauuagcaaacugugaaa

SEQ ID NO: 169176 - RNA, 19 nt, Human
ccaggccuccugggagguc

SEQ ID NO: 169177 - RNA, 22 nt, Human
ucuggaucaccacuucugccuc

SEQ ID NO: 169178 - RNA, 16 nt, Human
aauugcuucuugcugc

SEQ ID NO: 169179 - RNA, 22 nt, Human
aaaugcuacacaggaauucuca

SEQ ID NO: 169180 - RNA, 21 nt, Human
cuacuuaaguaggggauuagg

SEQ ID NO: 169181 - RNA, 22 nt, Human
gauguacuuuaaaauacuucag

SEQ ID NO: 169182 - RNA, 22 nt, Human
auuauuagacuuauaugguagu

SEQ ID NO: 169183 - RNA, 18 nt, Human
agcagguggcgucugcag

SEQ ID NO: 169184 - RNA, 22 nt, Human
ugguccugagaauccuguccuc

SEQ ID NO: 169185 - RNA, 22 nt, Human
auagauauuugaguuguuucca

SEQ ID NO: 169186 - RNA, 22 nt, Human
gcuuccaaaucuguucaaaaug

SEQ ID NO: 169187 - RNA, 22 nt, Human
acauguguuaaaauucucacca

SEQ ID NO: 169188 - RNA, 23 nt, Human
aagugguuuugaacccggacccu

SEQ ID NO: 169189 - RNA, 22 nt, Human
uuuaggcauugggugcucaagu

SEQ ID NO: 169190 - RNA, 22 nt, Human
uuugacucuugucucuuguuag

SEQ ID NO: 169191 - RNA, 22 nt, Human
auuucaggauagccuaguuuug

SEQ ID NO: 169192 - RNA, 21 nt, Human
uugcuuauggcacugcuuugc

SEQ ID NO: 169193 - RNA, 22 nt, Human
uccaggcaaagugcugggcugc

SEQ ID NO: 169194 - RNA, 22 nt, Human
ggcagguguggaguguuauuuu

SEQ ID NO: 169195 - RNA, 22 nt, Human
uacaguaccagaaaugcuaaga

SEQ ID NO: 169196 - RNA, 22 nt, Human
ucagguguguggcucuggacca

SEQ ID NO: 169197 - RNA, 22 nt, Human
gcuauacacauuucuugguagu

SEQ ID NO: 169198 - RNA, 22 nt, Human
cccaggcacauccacucuguga

SEQ ID NO: 169199 - RNA, 22 nt, Human
ucauuguauacuuuauuuauga

SEQ ID NO: 169200 - RNA, 22 nt, Human
ugcccacauggugccauggcca

SEQ ID NO: 169201 - RNA, 22 nt, Human
gucugcccuggggcaucaguuu

SEQ ID NO: 169202 - RNA, 20 nt, Human
ucagagagagggugccacuu

SEQ ID NO: 169203 - RNA, 22 nt, Human
ucugugccaucagucuccagag

SEQ ID NO: 169204 - RNA, 22 nt, Human
guuaggcaugaguguguauuaa

SEQ ID NO: 169205 - RNA, 22 nt, Human
uguguccuuucuuaagagugag

SEQ ID NO: 169206 - RNA, 19 nt, Human
uacuaaacaugcauauugg

SEQ ID NO: 169207 - RNA, 22 nt, Human
uggucuggaacuccuggcuuca

SEQ ID NO: 169208 - RNA, 22 nt, Human
agagcaauggcauccagcugau

SEQ ID NO: 169209 - RNA, 20 nt, Human
ugcuuuaugcuauacuuugu

SEQ ID NO: 169210 - RNA, 22 nt, Human
gggcugaccccaccccucacuc

SEQ ID NO: 169211 - RNA, 22 nt, Human
ugcauggacucaucagacaaga

SEQ ID NO: 169212 - RNA, 22 nt, Human
ucuucagacuccaaauguuuua

SEQ ID NO: 169213 - RNA, 21 nt, Human
acagcuggugcagggcgggga

SEQ ID NO: 169214 - RNA, 22 nt, Human
aaauugcagaugcuaaaugacu

SEQ ID NO: 169215 - RNA, 22 nt, Human
aaucauaauucaaauaagcuua

SEQ ID NO: 169216 - RNA, 22 nt, Human
uaaaaaacauuacucuguccug

SEQ ID NO: 169217 - RNA, 22 nt, Human
acagauuuuaaaugacacuccc

SEQ ID NO: 169218 - RNA, 22 nt, Human
auuauuauauagggaaaguccc

SEQ ID NO: 169219 - RNA, 22 nt, Human
ucuggcucugacacuacuguua

SEQ ID NO: 169220 - RNA, 22 nt, Human
uccaggagguagugcuuaauuu

SEQ ID NO: 169221 - RNA, 22 nt, Human
cugaaggcuaaaauggacugaa

SEQ ID NO: 169222 - RNA, 22 nt, Human
uuaauucugccuuucauguaac

SEQ ID NO: 169223 - RNA, 22 nt, Human
cucuuuccucagccacagucua

SEQ ID NO: 169224 - RNA, 22 nt, Human
gccagucugcucccacaaguuc

SEQ ID NO: 169225 - RNA, 22 nt, Human
uuacagaacugcccuaguuggc

SEQ ID NO: 169226 - RNA, 22 nt, Human
ucacagaacaauguuuaguucu

SEQ ID NO: 169227 - RNA, 22 nt, Human
aaugcuaaaacacagauuuuug

SEQ ID NO: 169228 - RNA, 22 nt, Human
ugcagggcaguuuguuucggca

SEQ ID NO: 169229 - RNA, 22 nt, Human
ucugggugcuacaaacaguauu

SEQ ID NO: 169230 - RNA, 22 nt, Human
uuuauugaauuguaacccuauu

SEQ ID NO: 169231 - RNA, 21 nt, Human
aggcucccagaaaugggcauc

SEQ ID NO: 169232 - RNA, 22 nt, Human
aggcaggugggagugauuccuu

SEQ ID NO: 169233 - RNA, 22 nt, Human
acaguguguucugggaccucca

SEQ ID NO: 169234 - RNA, 22 nt, Human
auuuccagcagcauauuugucu

SEQ ID NO: 169235 - RNA, 22 nt, Human
uacaaaugaguuguaugaacca

SEQ ID NO: 169236 - RNA, 22 nt, Human
aagucacccacaggcagcagaa

SEQ ID NO: 169237 - RNA, 23 nt, Human
uggagcugggcucagacccuggg

SEQ ID NO: 169238 - RNA, 22 nt, Human
ugggcaggugcuauuuuccaug

SEQ ID NO: 169239 - RNA, 22 nt, Human
gaaacaacuacuauugauuucu

SEQ ID NO: 169240 - RNA, 22 nt, Human
accaggcagcacuuuccuugca

SEQ ID NO: 169241 - RNA, 22 nt, Human
caauguuuuuccuuccuuaaua

SEQ ID NO: 169242 - RNA, 19 nt, Human
uccuccuuacuuccucuug

SEQ ID NO: 169243 - RNA, 22 nt, Human
gcaucuaauccaguccagcauc

SEQ ID NO: 169244 - RNA, 21 nt, Human
cacaggugggucagugaggcc

SEQ ID NO: 169245 - RNA, 18 nt, Human
gacaggugggugagacca

SEQ ID NO: 169246 - RNA, 17 nt, Human
uggucuggaagaacuga

SEQ ID NO: 169247 - RNA, 22 nt, Human
aaacaaacauagguuugaaagu

SEQ ID NO: 169248 - RNA, 20 nt, Human
uuucugugcccaggucuguu

SEQ ID NO: 169249 - RNA, 22 nt, Human
ugcaggguauccuugucucugc

SEQ ID NO: 169250 - RNA, 22 nt, Human
cuggcuuucauuucaagcacgu

SEQ ID NO: 169251 - RNA, 21 nt, Human
aaagaaucauggguaauuuca

SEQ ID NO: 169252 - RNA, 22 nt, Human
uacauaauaaggggcauggugu

SEQ ID NO: 169253 - RNA, 22 nt, Human
uuugaaugcaggacauacagaa

SEQ ID NO: 169254 - RNA, 22 nt, Human
cuacagaaacacuggacaugug

SEQ ID NO: 169255 - RNA, 22 nt, Human
ugguuugacaaugaggacuggu

SEQ ID NO: 169256 - RNA, 22 nt, Human
gacaggugugaugauuuaggcu

SEQ ID NO: 169257 - RNA, 22 nt, Human
uuccaugcaagaaguauggcuc

SEQ ID NO: 169258 - RNA, 22 nt, Human
gucauauacacugcauguaauc

SEQ ID NO: 169259 - RNA, 22 nt, Human
uuucaugaggggcaaaaucuca

SEQ ID NO: 169260 - RNA, 22 nt, Human
gaaagcagcuaagucuuaugau

SEQ ID NO: 169261 - RNA, 16 nt, Human
ugggaccuguggccaa

SEQ ID NO: 169262 - RNA, 22 nt, Human
gcaucuaaauaaacgugggagu

SEQ ID NO: 169263 - RNA, 22 nt, Human
cuacagaaaccuuuuucauaca

SEQ ID NO: 169264 - RNA, 22 nt, Human
aaagcaguauauugguaguugu

SEQ ID NO: 169265 - RNA, 21 nt, Human
uccagaaaagaggucauuagc

SEQ ID NO: 169266 - RNA, 22 nt, Human
uuuauuggauauuuacaagaua

SEQ ID NO: 169267 - RNA, 22 nt, Human
uggcaaagaugguucucaccau

SEQ ID NO: 169268 - RNA, 22 nt, Human
uuuaggcagaacauggacuuug

SEQ ID NO: 169269 - RNA, 22 nt, Human
aaagugguuucccaguucagua

SEQ ID NO: 169270 - RNA, 22 nt, Human
augaacaagagagggaagauuc

SEQ ID NO: 169271 - RNA, 22 nt, Human
caaagagcuguucagugucgcu

SEQ ID NO: 169272 - RNA, 22 nt, Human
uuccacaauguaugaauaagau

SEQ ID NO: 169273 - RNA, 22 nt, Human
aaaauucugucauuaaauugug

SEQ ID NO: 169274 - RNA, 22 nt, Human
agguggcuucuggccaggugug

SEQ ID NO: 169275 - RNA, 22 nt, Human
ccaaaauuauuacauuuguagg

SEQ ID NO: 169276 - RNA, 22 nt, Human
uauguacucaucaacuauugaa

SEQ ID NO: 169277 - RNA, 22 nt, Human
cgcaggugccggcagauggggu

SEQ ID NO: 169278 - RNA, 22 nt, Human
gauaauaagcacagcaggaugu

SEQ ID NO: 169279 - RNA, 22 nt, Human
uagguguccucguccaaagauu

SEQ ID NO: 169280 - RNA, 22 nt, Human
caagauuugccaguggccaacu

SEQ ID NO: 169281 - RNA, 22 nt, Human
aaggcauaggacaaaucaguga

SEQ ID NO: 169282 - RNA, 22 nt, Human
aaucagaaaggcuaaggaagca

SEQ ID NO: 169283 - RNA, 22 nt, Human
cagcuuuguggccuugaccucg

SEQ ID NO: 169284 - RNA, 22 nt, Human
acagcuuuucugauagauccug

SEQ ID NO: 169285 - RNA, 22 nt, Human
acccaggccugagagacaggag

SEQ ID NO: 169286 - RNA, 22 nt, Human
cauuagggucucucagcugaau

SEQ ID NO: 169287 - RNA, 22 nt, Human
aaauccuaaaaguuugacuuaa

SEQ ID NO: 169288 - RNA, 22 nt, Human
ccagagagaguacugggcucug

SEQ ID NO: 169289 - RNA, 22 nt, Human
uguccuuugggagggcacagcu

SEQ ID NO: 169290 - RNA, 22 nt, Human
agagagcaguggaucaccuagc

SEQ ID NO: 169291 - RNA, 22 nt, Human
caaaugcagauucaggaguucu

SEQ ID NO: 169292 - RNA, 22 nt, Human
gaaccauuucugaauaguuugu

SEQ ID NO: 169293 - RNA, 22 nt, Human
gugcagggcuggcaccggaggc

SEQ ID NO: 169294 - RNA, 22 nt, Human
gaggugucccugacccuuugca

SEQ ID NO: 169295 - RNA, 22 nt, Human
aauuucagaccauuugcaauua

SEQ ID NO: 169296 - RNA, 22 nt, Human
auuuccuugcaaguuucuguaa

SEQ ID NO: 169297 - RNA, 22 nt, Human
accuaaauucuggcugauuagg

SEQ ID NO: 169298 - RNA, 21 nt, Human
aguugcauaggccagccaucc

SEQ ID NO: 169299 - RNA, 21 nt, Human
ucugaugguagaugagaugug

SEQ ID NO: 169300 - RNA, 22 nt, Human
auagaaacagaggucaggcauu

SEQ ID NO: 169301 - RNA, 22 nt, Human
uauuccaacugucauagucaua

SEQ ID NO: 169302 - RNA, 22 nt, Human
ugcuguaauacuuaagguuaag

SEQ ID NO: 169303 - RNA, 22 nt, Human
aguuugaauugaaaugcagaug

SEQ ID NO: 169304 - RNA, 22 nt, Human
uauuuaauuagugauuguagag

SEQ ID NO: 169305 - RNA, 22 nt, Human
auaaguaggaaaauuugaauau

SEQ ID NO: 169306 - RNA, 22 nt, Human
cuggauguccuuccccugaagc

SEQ ID NO: 169307 - RNA, 22 nt, Human
aaaagucucucugaguaaaagu

SEQ ID NO: 169308 - RNA, 22 nt, Human
aagggcucugugcuugucccau

SEQ ID NO: 169309 - RNA, 22 nt, Human
uggaggaaucagggcuuaggcu

SEQ ID NO: 169310 - RNA, 21 nt, Human
ccugggugggaccccucuucc

SEQ ID NO: 169311 - RNA, 22 nt, Human
auguccuuuuauuuaaagcagg

SEQ ID NO: 169312 - RNA, 22 nt, Human
aucuguaauuuugaaugcaaau

SEQ ID NO: 169313 - RNA, 22 nt, Human
uacugaaaagccacaaggacca

SEQ ID NO: 169314 - RNA, 22 nt, Human
gggacaugaggccauagugauu

SEQ ID NO: 169315 - RNA, 19 nt, Human
gggaccugacuaauuggca

SEQ ID NO: 169316 - RNA, 20 nt, Human
aggaggaagaaagcacacug

SEQ ID NO: 169317 - RNA, 22 nt, Human
uuagugguaaggaugaaauuuc

SEQ ID NO: 169318 - RNA, 22 nt, Human
ugagcagagucgcuccagagug

SEQ ID NO: 169319 - RNA, 22 nt, Human
ggcagguggccaagugucuaag

SEQ ID NO: 169320 - RNA, 22 nt, Human
acaguguguuggaggagacugu

SEQ ID NO: 169321 - RNA, 21 nt, Human
uuguaaagguuuagaagaaug

SEQ ID NO: 169322 - RNA, 19 nt, Human
ccugggucugcagcauuca

SEQ ID NO: 169323 - RNA, 22 nt, Human
auucuucauacagacaaguccu

SEQ ID NO: 169324 - RNA, 22 nt, Human
uucuucaaccaucuacauaaac

SEQ ID NO: 169325 - RNA, 22 nt, Human
ugcuuaauauugugauguaaua

SEQ ID NO: 169326 - RNA, 18 nt, Human
ucuugccugcacccucuc

SEQ ID NO: 169327 - RNA, 22 nt, Human
caguccuugcucugggaugaug

SEQ ID NO: 169328 - RNA, 22 nt, Human
gugcaggggccuccccuugcug

SEQ ID NO: 169329 - RNA, 22 nt, Human
aagaguuuaugauauaacaugu

SEQ ID NO: 169330 - RNA, 17 nt, Human
cugaagaguccuggcua

SEQ ID NO: 169331 - RNA, 22 nt, Human
gccaggcaggccacgcuguguu

SEQ ID NO: 169332 - RNA, 20 nt, Human
ucauuacagugcuaagaugu

SEQ ID NO: 169333 - RNA, 22 nt, Human
gaggagggagcuggaagcucuu

SEQ ID NO: 169334 - RNA, 22 nt, Human
acuugguuguuuuaacuuggca

SEQ ID NO: 169335 - RNA, 20 nt, Human
gaaguccuguuauauccuuu

SEQ ID NO: 169336 - RNA, 17 nt, Human
ggaggcaacagacaggg

SEQ ID NO: 169337 - RNA, 22 nt, Human
ggacagacuuuacagccccggg

SEQ ID NO: 169338 - RNA, 22 nt, Human
cagcaugaugagugcaguuugg

SEQ ID NO: 169339 - RNA, 22 nt, Human
cccaggcagccugcagggaagg

SEQ ID NO: 169340 - RNA, 22 nt, Human
uggcagguuaacuuacaacugu

SEQ ID NO: 169341 - RNA, 22 nt, Human
acagauuugacugguaccuggc

SEQ ID NO: 169342 - RNA, 22 nt, Human
cuggcacucauaggccaguuca

SEQ ID NO: 169343 - RNA, 22 nt, Human
augcuuaaugaggguauauaug

SEQ ID NO: 169344 - RNA, 22 nt, Human
agcagggcucacauuaguggau

SEQ ID NO: 169345 - RNA, 22 nt, Human
guuauuagaagugaaggauugu

SEQ ID NO: 169346 - RNA, 22 nt, Human
cacccagcacagagggaggcga

SEQ ID NO: 169347 - RNA, 22 nt, Human
caauuucaucuugugcuucaau

SEQ ID NO: 169348 - RNA, 22 nt, Human
aaauaugaaugauaagaguuau

SEQ ID NO: 169349 - RNA, 22 nt, Human
cugcaaaagucauugugguuuu

SEQ ID NO: 169350 - RNA, 22 nt, Human
cagucuggaggucagcuggcuu

SEQ ID NO: 169351 - RNA, 22 nt, Human
guuuaaucagaggaauuauaga

SEQ ID NO: 169352 - RNA, 22 nt, Human
gcugcgguggcuggcgauggga

SEQ ID NO: 169353 - RNA, 20 nt, Human
uuugagaccagucugcccaa

SEQ ID NO: 169354 - RNA, 21 nt, Human
cuguccucagauguggacgag

SEQ ID NO: 169355 - RNA, 22 nt, Human
ccacagagcauuagauuucaga

SEQ ID NO: 169356 - RNA, 22 nt, Human
uaacuuuaggaauagguaaucu

SEQ ID NO: 169357 - RNA, 22 nt, Human
auguuucaccagcaaauuaccu

SEQ ID NO: 169358 - RNA, 22 nt, Human
uugcagggaaauagaaauaaac

SEQ ID NO: 169359 - RNA, 22 nt, Human
aguguccuagcaagccgguccu

SEQ ID NO: 169360 - RNA, 22 nt, Human
uacaaaguaauguauaauaucg

SEQ ID NO: 169361 - RNA, 22 nt, Human
cuuugcaauagaggcacacaug

SEQ ID NO: 169362 - RNA, 22 nt, Human
uggacauguccggccagacaau

SEQ ID NO: 169363 - RNA, 18 nt, Human
aauuuccauaugaauugc

SEQ ID NO: 169364 - RNA, 22 nt, Human
acuauacaguauguacgugcac

SEQ ID NO: 169365 - RNA, 22 nt, Human
uaaagcugaaaugauuaugaca

SEQ ID NO: 169366 - RNA, 22 nt, Human
aguugcugauucugucugugau

SEQ ID NO: 169367 - RNA, 22 nt, Human
gauugcugaagaaagugaguga

SEQ ID NO: 169368 - RNA, 23 nt, Human
agucuucauuguauuuccagacc

SEQ ID NO: 169369 - RNA, 23 nt, Human
ugcugggguaguuuguggcacag

SEQ ID NO: 169370 - RNA, 22 nt, Human
uacuaaacccucgauggaucuu

SEQ ID NO: 169371 - RNA, 22 nt, Human
gcagggcagcucacugugguuc

SEQ ID NO: 169372 - RNA, 22 nt, Human
uccaggcaaagccuuguagacg

SEQ ID NO: 169373 - RNA, 22 nt, Human
gggcuggacaucuaagguagcu

SEQ ID NO: 169374 - RNA, 19 nt, Human
uuagguauuauugcuuucc

SEQ ID NO: 169375 - RNA, 22 nt, Human
caauuucagucucagagaguuc

SEQ ID NO: 169376 - RNA, 22 nt, Human
agcuuuaucagaggagucucua

SEQ ID NO: 169377 - RNA, 22 nt, Human
ugguauuacuucuagacacaag

SEQ ID NO: 169378 - RNA, 22 nt, Human
agacagguguuuuacaacuucg

SEQ ID NO: 169379 - RNA, 22 nt, Human
agcacaauagagcaguuaaaaa

SEQ ID NO: 169380 - RNA, 22 nt, Human
guacagaaaguacccauagaag

SEQ ID NO: 169381 - RNA, 22 nt, Human
ggauuucuuccuuccucagaag

SEQ ID NO: 169382 - RNA, 22 nt, Human
uugcuuuagggcaaauauuuca

SEQ ID NO: 169383 - RNA, 22 nt, Human
cuuaauuuaagccuagaaugca

SEQ ID NO: 169384 - RNA, 22 nt, Human
uagcuuuaaugaguugguaaga

SEQ ID NO: 169385 - RNA, 22 nt, Human
agagcaucuaacacauaagccu

SEQ ID NO: 169386 - RNA, 22 nt, Human
caggagcaaggagcagugggau

SEQ ID NO: 169387 - RNA, 22 nt, Human
gauuuacagaucuaagggucac

SEQ ID NO: 169388 - RNA, 22 nt, Human
acagauuuuugguaaauaauuu

SEQ ID NO: 169389 - RNA, 22 nt, Human
cuucuuaaucccuuauauauuu

SEQ ID NO: 169390 - RNA, 22 nt, Human
ccagguguggccacauggcugg

SEQ ID NO: 169391 - RNA, 22 nt, Human
ccuggguccuggcagccuccug

SEQ ID NO: 169392 - RNA, 22 nt, Human
caaagauuuuagaauuugcaau

SEQ ID NO: 169393 - RNA, 22 nt, Human
ugacaguuaagguauacauuca

SEQ ID NO: 169394 - RNA, 21 nt, Human
uccuggcuuuaugcuaccucu

SEQ ID NO: 169395 - RNA, 22 nt, Human
uucaacuuuggagauuuaauaa

SEQ ID NO: 169396 - RNA, 22 nt, Human
uuuauccaccuuacccuguucc

SEQ ID NO: 169397 - RNA, 22 nt, Human
auuuucaugacuaccuuaaaua

SEQ ID NO: 169398 - RNA, 22 nt, Human
uuucacacaacgugaauauacu

SEQ ID NO: 169399 - RNA, 22 nt, Human
auguaaaucaagcagugcuggu

SEQ ID NO: 169400 - RNA, 22 nt, Human
uggcagggagccaccggucaug

SEQ ID NO: 169401 - RNA, 18 nt, Human
uccuaacuuagauacucc

SEQ ID NO: 169402 - RNA, 22 nt, Human
cccaggcagccccagaagcuug

SEQ ID NO: 169403 - RNA, 22 nt, Human
uacaaagucagaauaacaggug

SEQ ID NO: 169404 - RNA, 22 nt, Human
ccagagaggggaagggcuugcc

SEQ ID NO: 169405 - RNA, 22 nt, Human
uuuaggaaugugguuuuugagc

SEQ ID NO: 169406 - RNA, 22 nt, Human
ggaugagguagaugaacaaggg

SEQ ID NO: 169407 - RNA, 22 nt, Human
agcuggaggggccagcaggugu

SEQ ID NO: 169408 - RNA, 22 nt, Human
uugcuuuauuccuagcccuugu

SEQ ID NO: 169409 - RNA, 22 nt, Human
ucuguucaguugauuagacaga

SEQ ID NO: 169410 - RNA, 22 nt, Human
gagggcucaacuacuacuaggc

SEQ ID NO: 169411 - RNA, 22 nt, Human
gagcugaauugcugccauuugc

SEQ ID NO: 169412 - RNA, 22 nt, Human
uccugugucaauuccucauucu

SEQ ID NO: 169413 - RNA, 22 nt, Human
gucuucuuguuuugaaggaaau

SEQ ID NO: 169414 - RNA, 22 nt, Human
agugcuccuauggaucaguugu

SEQ ID NO: 169415 - RNA, 22 nt, Human
acugccaaugguaguuugaugg

SEQ ID NO: 169416 - RNA, 22 nt, Human
aaucagaaccuugggucauaac

SEQ ID NO: 169417 - RNA, 22 nt, Human
uucagaaaaagaccauugcaau

SEQ ID NO: 169418 - RNA, 21 nt, Human
uccagaccucccucuccuagc

SEQ ID NO: 169419 - RNA, 22 nt, Human
cguccuuugaauugaggucuuu

SEQ ID NO: 169420 - RNA, 22 nt, Human
gcaggcaguuugcuuuucccuc

SEQ ID NO: 169421 - RNA, 22 nt, Human
ucuggaggcaacuaaccuaguu

SEQ ID NO: 169422 - RNA, 22 nt, Human
auuucauacuaaggcucaaaaa

SEQ ID NO: 169423 - RNA, 22 nt, Human
uuuccagggcucuguagaagaa

SEQ ID NO: 169424 - RNA, 22 nt, Human
uucuucuucuggcugcaccugg

SEQ ID NO: 169425 - RNA, 22 nt, Human
uacuaaauaguuuaauuccuca

SEQ ID NO: 169426 - RNA, 22 nt, Human
uauaauuaguaaauggcagauu

SEQ ID NO: 169427 - RNA, 22 nt, Human
aacaaucaaguuucuaaaugac

SEQ ID NO: 169428 - RNA, 22 nt, Human
ugaccauuugaucuacauucca

SEQ ID NO: 169429 - RNA, 22 nt, Human
gcagagaguugggcugcgccag

SEQ ID NO: 169430 - RNA, 22 nt, Human
caggaaagccgagugccauagg

SEQ ID NO: 169431 - RNA, 22 nt, Human
uucuucaaaacaacacuggccu

SEQ ID NO: 169432 - RNA, 22 nt, Human
ugacauguggcuuugacccagg

SEQ ID NO: 169433 - RNA, 22 nt, Human
auacauauaugguacuuccugg

SEQ ID NO: 169434 - RNA, 22 nt, Human
cacaaaugguuguagacauuaa

SEQ ID NO: 169435 - RNA, 19 nt, Human
aggauuuauuaugugcuca

SEQ ID NO: 169436 - RNA, 22 nt, Human
agagggcaugcuugguggccug

SEQ ID NO: 169437 - RNA, 22 nt, Human
uaggugucaggccuccuccagc

SEQ ID NO: 169438 - RNA, 22 nt, Human
acaugacaccucuggcugggug

SEQ ID NO: 169439 - RNA, 22 nt, Human
ucuggguggcuucagaggccac

SEQ ID NO: 169440 - RNA, 22 nt, Human
auugaaaauauaauucuaggag

SEQ ID NO: 169441 - RNA, 22 nt, Human
cugaaugaaaucaaggacugag

SEQ ID NO: 169442 - RNA, 22 nt, Human
augcuuuauuauuuugcaggga

SEQ ID NO: 169443 - RNA, 22 nt, Human
auugcuuuuaagcaccaccuaa

SEQ ID NO: 169444 - RNA, 22 nt, Human
acagacagacagauugcauaug

SEQ ID NO: 169445 - RNA, 22 nt, Human
ucuagggugugcggcagggcua

SEQ ID NO: 169446 - RNA, 22 nt, Human
ucaaaauuaaaccaacguccag

SEQ ID NO: 169447 - RNA, 22 nt, Human
uuuguacauccuaauucugagu

SEQ ID NO: 169448 - RNA, 22 nt, Human
cuuccagguccuucuugagaag

SEQ ID NO: 169449 - RNA, 22 nt, Human
caaauguauaaauguacuuucu

SEQ ID NO: 169450 - RNA, 21 nt, Human
acagcaagccuucacaugagu

SEQ ID NO: 169451 - RNA, 22 nt, Human
ucuauugcagauggaugcccuc

SEQ ID NO: 169452 - RNA, 22 nt, Human
uucuguuuuagaaauaaguagu

SEQ ID NO: 169453 - RNA, 22 nt, Human
ggcagguguggugaccagagau

SEQ ID NO: 169454 - RNA, 22 nt, Human
auacagauguugaauguuauau

SEQ ID NO: 169455 - RNA, 23 nt, Human
acuuuauccuauaucuuuguucu

SEQ ID NO: 169456 - RNA, 22 nt, Human
acuauuagcauaucaugaaugg

SEQ ID NO: 169457 - RNA, 22 nt, Human
aucagaaaguucaucauguuug

SEQ ID NO: 169458 - RNA, 22 nt, Human
guaaacauuacugugcuguaua

SEQ ID NO: 169459 - RNA, 22 nt, Human
ccuggagggcagcccauucugg

SEQ ID NO: 169460 - RNA, 22 nt, Human
accugccagaauccaagccaca

SEQ ID NO: 169461 - RNA, 22 nt, Human
uucagaaaucgaguuucauguc

SEQ ID NO: 169462 - RNA, 22 nt, Human
guaaacaacacaaaucauuuga

SEQ ID NO: 169463 - RNA, 22 nt, Human
ggucucugaacuuccacugcgc

SEQ ID NO: 169464 - RNA, 22 nt, Human
aaggugguugcaauuaccauaa

SEQ ID NO: 169465 - RNA, 22 nt, Human
ugcuuuauuuuaaauaugccau

SEQ ID NO: 169466 - RNA, 22 nt, Human
ucuggaucccaccgccacacac

SEQ ID NO: 169467 - RNA, 22 nt, Human
ggaugucuggucuauuucaagu

SEQ ID NO: 169468 - RNA, 20 nt, Human
aaucagaaagugugagcucu

SEQ ID NO: 169469 - RNA, 22 nt, Human
uagauauaagguccuuagaaca

SEQ ID NO: 169470 - RNA, 22 nt, Human
cuacagaaaaucagccacaggc

SEQ ID NO: 169471 - RNA, 22 nt, Human
uaugcauacaaugagauauucc

SEQ ID NO: 169472 - RNA, 22 nt, Human
ucauaauacaaagaguucugca

SEQ ID NO: 169473 - RNA, 22 nt, Human
agacaucagcuugugugcaggg

SEQ ID NO: 169474 - RNA, 22 nt, Human
gagacugcauagauggccacaa

SEQ ID NO: 169475 - RNA, 22 nt, Human
ggcaggcacugugauagauucu

SEQ ID NO: 169476 - RNA, 22 nt, Human
uaaguucaagucuuggauauaa

SEQ ID NO: 169477 - RNA, 22 nt, Human
cuguugcucugaacaggucuug

SEQ ID NO: 169478 - RNA, 23 nt, Human
uaggugucuaguguccacuaugu

SEQ ID NO: 169479 - RNA, 22 nt, Human
ggaacuugcaaccucuggucac

SEQ ID NO: 169480 - RNA, 22 nt, Human
ucauguacauguaagucagaaa

SEQ ID NO: 169481 - RNA, 22 nt, Human
augguauugcaacaacugucau

SEQ ID NO: 169482 - RNA, 22 nt, Human
gacagaaggcaucuagggcacg

SEQ ID NO: 169483 - RNA, 22 nt, Human
gacaggguccaaaggcagggga

SEQ ID NO: 169484 - RNA, 22 nt, Human
uucauguaggcugcaaugcaca

SEQ ID NO: 169485 - RNA, 19 nt, Human
guugaaaguaggugagggu

SEQ ID NO: 169486 - RNA, 22 nt, Human
acuauacauaaaacauuugggu

SEQ ID NO: 169487 - RNA, 22 nt, Human
ccauguguaaauuagauaacuc

SEQ ID NO: 169488 - RNA, 22 nt, Human
guuucauucggcagcucauaag

SEQ ID NO: 169489 - RNA, 22 nt, Human
ggcuccagguuuaaggguaugu

SEQ ID NO: 169490 - RNA, 22 nt, Human
uuuucauugagcaccugaguaa

SEQ ID NO: 169491 - RNA, 22 nt, Human
ucagccagugccuugaucuugc

SEQ ID NO: 169492 - RNA, 22 nt, Human
auauuaggaguuaaauguauua

SEQ ID NO: 169493 - RNA, 22 nt, Human
aagauguaaaggcaauauaaag

SEQ ID NO: 169494 - RNA, 22 nt, Human
gaaguacaguuuuaucuagcca

SEQ ID NO: 169495 - RNA, 21 nt, Human
auacagaaggcagacucucuc

SEQ ID NO: 169496 - RNA, 22 nt, Human
uguccuuuguguaucuauagua

SEQ ID NO: 169497 - RNA, 22 nt, Human
ugucuuuagccagcagucuucu

SEQ ID NO: 169498 - RNA, 22 nt, Human
ugacagacauggaagccagagu

SEQ ID NO: 169499 - RNA, 22 nt, Human
acacugaauaauugagaguuga

SEQ ID NO: 169500 - RNA, 22 nt, Human
ucagguggcugguugcuggcua

SEQ ID NO: 169501 - RNA, 22 nt, Human
uacaaaguagaaauucaguaaa

SEQ ID NO: 169502 - RNA, 16 nt, Human
gagggcagaggcggaa

SEQ ID NO: 169503 - RNA, 22 nt, Human
ucuucuuccucauuuauacaua

SEQ ID NO: 169504 - RNA, 22 nt, Human
agggcuccaggggaccaucagu

SEQ ID NO: 169505 - RNA, 22 nt, Human
augaaaauucuaugcaggccag

SEQ ID NO: 169506 - RNA, 22 nt, Human
cuucuuucuuuugaucacaggu

SEQ ID NO: 169507 - RNA, 22 nt, Human
ucagcuuuccuugcuuuagauu

SEQ ID NO: 169508 - RNA, 22 nt, Human
uugacacagaucaauauucaac

SEQ ID NO: 169509 - RNA, 22 nt, Human
auguccagggcacacagcagug

SEQ ID NO: 169510 - RNA, 22 nt, Human
cuauuucaaggcccagauauga

SEQ ID NO: 169511 - RNA, 22 nt, Human
cccuccucaacucuggcuucca

SEQ ID NO: 169512 - RNA, 22 nt, Human
acauuccaaaaacuagcagaua

SEQ ID NO: 169513 - RNA, 22 nt, Human
aagaauucacugguagagucaa

SEQ ID NO: 169514 - RNA, 22 nt, Human
aucuaaacagguguucuuuaga

SEQ ID NO: 169515 - RNA, 18 nt, Human
aggcaggugcuaauauuu

SEQ ID NO: 169516 - RNA, 22 nt, Human
gagagggauacugaguuuuggu

SEQ ID NO: 169517 - RNA, 22 nt, Human
acuugguugcaaaugaauuauu

SEQ ID NO: 169518 - RNA, 22 nt, Human
caucagaauguuauggggggcu

SEQ ID NO: 169519 - RNA, 18 nt, Human
gcagcuuuugauucaccc

SEQ ID NO: 169520 - RNA, 20 nt, Human
gcagggcaagggauaugaaa

SEQ ID NO: 169521 - RNA, 21 nt, Human
auacagaacauugauccaaga

SEQ ID NO: 169522 - RNA, 22 nt, Human
uaaguccuaauggcagaagucu

SEQ ID NO: 169523 - RNA, 22 nt, Human
aaucuucacagagaaaauuagg

SEQ ID NO: 169524 - RNA, 23 nt, Human
ucagagagcuguugagagcugcc

SEQ ID NO: 169525 - RNA, 22 nt, Human
ccagggcagugggagaaggugc

SEQ ID NO: 169526 - RNA, 21 nt, Human
caaucaguuggcauuugagca

SEQ ID NO: 169527 - RNA, 22 nt, Human
guuuucauuacugcugugauuu

SEQ ID NO: 169528 - RNA, 22 nt, Human
ucaccagucuuucuuaccauug

SEQ ID NO: 169529 - RNA, 22 nt, Human
auacagaacucucaguuguaua

SEQ ID NO: 169530 - RNA, 22 nt, Human
ccagggcaucacauccaguguu

SEQ ID NO: 169531 - RNA, 22 nt, Human
uucuggguuuacaucugacuuc

SEQ ID NO: 169532 - RNA, 22 nt, Human
uuuaggcacagaguugagggac

SEQ ID NO: 169533 - RNA, 22 nt, Human
uaaguccuagaugauucacaga

SEQ ID NO: 169534 - RNA, 22 nt, Human
uguccuuaucuccaaacaauca

SEQ ID NO: 169535 - RNA, 22 nt, Human
uuugaacuucuccauucugaug

SEQ ID NO: 169536 - RNA, 22 nt, Human
uuccaugaagggcagccucuca

SEQ ID NO: 169537 - RNA, 22 nt, Human
ucuggcccaucuucugccacca

SEQ ID NO: 169538 - RNA, 22 nt, Human
uugcuuuagaaucugcuucugg

SEQ ID NO: 169539 - RNA, 22 nt, Human
ucugggugggcccgagaaaucu

SEQ ID NO: 169540 - RNA, 22 nt, Human
uuugacucaagccuuucuuuag

SEQ ID NO: 169541 - RNA, 22 nt, Human
cuguccuguggaccugaggacg

SEQ ID NO: 169542 - RNA, 22 nt, Human
caguaaaugcagauauagauac

SEQ ID NO: 169543 - RNA, 22 nt, Human
augcagcuucaggauuaugaug

SEQ ID NO: 169544 - RNA, 22 nt, Human
ucaauaaauagcuuggcucagc

SEQ ID NO: 169545 - RNA, 22 nt, Human
gugagggcagaacccccaggcc

SEQ ID NO: 169546 - RNA, 23 nt, Human
agaggcaggaguggcuugcccgg

SEQ ID NO: 169547 - RNA, 22 nt, Human
uugauuccuugaaauauccuug

SEQ ID NO: 169548 - RNA, 22 nt, Human
auuacagaaugcaguuccuuau

SEQ ID NO: 169549 - RNA, 22 nt, Human
aaagcagagaucauggcuugua

SEQ ID NO: 169550 - RNA, 19 nt, Human
guguccauggagcauggag

SEQ ID NO: 169551 - RNA, 22 nt, Human
uuuaaauuuguguuuagagggu

SEQ ID NO: 169552 - RNA, 22 nt, Human
gggguguggacggcugugccag

SEQ ID NO: 169553 - RNA, 22 nt, Human
uuuacagagaauguacauaaag

SEQ ID NO: 169554 - RNA, 22 nt, Human
ucagggcauguauguuucuuua

SEQ ID NO: 169555 - RNA, 22 nt, Human
aaugucaauaacuuuaucccuc

SEQ ID NO: 169556 - RNA, 22 nt, Human
ugaaugauuugggugcauucag

SEQ ID NO: 169557 - RNA, 23 nt, Human
aguacaauaaguauaauucuuuc

SEQ ID NO: 169558 - RNA, 22 nt, Human
augauugaaaaugacauugcca

SEQ ID NO: 169559 - RNA, 22 nt, Human
ugguuccaagauggcugccaca

SEQ ID NO: 169560 - RNA, 22 nt, Human
auccugugcaaugacugcaucu

SEQ ID NO: 169561 - RNA, 22 nt, Human
auccaugaucaauuuauuacua

SEQ ID NO: 169562 - RNA, 22 nt, Human
uaauuacagguccaaaacaauc

SEQ ID NO: 169563 - RNA, 22 nt, Human
acauacagaccugcagggcagc

SEQ ID NO: 169564 - RNA, 22 nt, Human
cuugaagaaauggagacaggau

SEQ ID NO: 169565 - RNA, 22 nt, Human
uggcaggguuggccaccuuacc

SEQ ID NO: 169566 - RNA, 20 nt, Human
cauauauaccuagaagugga

SEQ ID NO: 169567 - RNA, 22 nt, Human
auguguccauuaucaguucugg

SEQ ID NO: 169568 - RNA, 22 nt, Human
acacaauacagggcucaaaaua

SEQ ID NO: 169569 - RNA, 22 nt, Human
agcccggcuuccccgguugcua

SEQ ID NO: 169570 - RNA, 22 nt, Human
ucaggaaagaguuagaugauua

SEQ ID NO: 169571 - RNA, 22 nt, Human
uuugacuccacuccuaacuccu

SEQ ID NO: 169572 - RNA, 22 nt, Human
uaaauuguuuucuagaaguugu

SEQ ID NO: 169573 - RNA, 22 nt, Human
cuacagaauggagggucagaga

SEQ ID NO: 169574 - RNA, 22 nt, Human
acuguucauuuguccuguaucu

SEQ ID NO: 169575 - RNA, 22 nt, Human
aagagcauggaauggagaucca

SEQ ID NO: 169576 - RNA, 22 nt, Human
acacuuuaagcauuucacacug

SEQ ID NO: 169577 - RNA, 22 nt, Human
ucauaaaaugcuccugauauug

SEQ ID NO: 169578 - RNA, 22 nt, Human
cugugucccaguaccuugggua

SEQ ID NO: 169579 - RNA, 22 nt, Human
augguuuugaagggaggucaaa

SEQ ID NO: 169580 - RNA, 22 nt, Human
uaauaacaauuguaggacauga

SEQ ID NO: 169581 - RNA, 22 nt, Human
accaggcacucuuguggcagug

SEQ ID NO: 169582 - RNA, 22 nt, Human
caaguccuaaauguauuuguug

SEQ ID NO: 169583 - RNA, 22 nt, Human
aguucacagccauguucaugug

SEQ ID NO: 169584 - RNA, 18 nt, Human
uuccaugauuccuuucac

SEQ ID NO: 169585 - RNA, 22 nt, Human
accaggcaguauggugcugcaa

SEQ ID NO: 169586 - RNA, 22 nt, Human
caggauggucagaugcauuguc

SEQ ID NO: 169587 - RNA, 22 nt, Human
cccaggcacucuuggucauuuu

SEQ ID NO: 169588 - RNA, 22 nt, Human
uuuagauaaugcucaagcaauu

SEQ ID NO: 169589 - RNA, 22 nt, Human
uuccaugaaggagacugagaag

SEQ ID NO: 169590 - RNA, 22 nt, Human
cugcauuagucaugcuuugcag

SEQ ID NO: 169591 - RNA, 20 nt, Human
gauuacaaaaugaaaugcau

SEQ ID NO: 169592 - RNA, 22 nt, Human
uuacagaagugaaggccuuuaa

SEQ ID NO: 169593 - RNA, 20 nt, Human
uacagaaugcaauaaaaugg

SEQ ID NO: 169594 - RNA, 22 nt, Human
gcccggcagucacacacccagg

SEQ ID NO: 169595 - RNA, 21 nt, Human
gcauguguggugugcuccaca

SEQ ID NO: 169596 - RNA, 22 nt, Human
uauacagauuaacagauuuaaa

SEQ ID NO: 169597 - RNA, 19 nt, Human
uuuagcuuacguuucauug

SEQ ID NO: 169598 - RNA, 22 nt, Human
uuccagagaaaagguuuauuuc

SEQ ID NO: 169599 - RNA, 22 nt, Human
cugaauaauuuucuguuguaug

SEQ ID NO: 169600 - RNA, 22 nt, Human
uuucaaguguccugauuaaugg

SEQ ID NO: 169601 - RNA, 21 nt, Human
aguguccuuuuacugugaaua

SEQ ID NO: 169602 - RNA, 22 nt, Human
aaucuucuuucuuaacaguaca

SEQ ID NO: 169603 - RNA, 22 nt, Human
cuccaugaauuugagcuuugug

SEQ ID NO: 169604 - RNA, 22 nt, Human
aacauuuaugguagucauugca

SEQ ID NO: 169605 - RNA, 19 nt, Human
uccugaaaacuucuggaau

SEQ ID NO: 169606 - RNA, 22 nt, Human
uucugggucacccuucugcuca

SEQ ID NO: 169607 - RNA, 22 nt, Human
accauccugaaaccuucaugcu

SEQ ID NO: 169608 - RNA, 20 nt, Human
auaaaauaacugccacaaga

SEQ ID NO: 169609 - RNA, 19 nt, Human
uggcagguagugagcaguc

SEQ ID NO: 169610 - RNA, 22 nt, Human
uagaaacauauguuugagacau

SEQ ID NO: 169611 - RNA, 22 nt, Human
cccugcagccuugcaugccuuc

SEQ ID NO: 169612 - RNA, 22 nt, Human
uaggugucuuucuguccuuguu

SEQ ID NO: 169613 - RNA, 22 nt, Human
uucuucagucccacuagccaca

SEQ ID NO: 169614 - RNA, 22 nt, Human
auuuccugcaggggcugguggg

SEQ ID NO: 169615 - RNA, 22 nt, Human
auuugcuggugaauguauagcu

SEQ ID NO: 169616 - RNA, 22 nt, Human
aauucaugaguagaaucuauau

SEQ ID NO: 169617 - RNA, 22 nt, Human
uaugcacacauguaugcaugug

SEQ ID NO: 169618 - RNA, 22 nt, Human
gcugauagacugaauguuggga

SEQ ID NO: 169619 - RNA, 22 nt, Human
aauguuuugcauuaguuuucua

SEQ ID NO: 169620 - RNA, 22 nt, Human
ugucaccacauuugucaauauc

SEQ ID NO: 169621 - RNA, 22 nt, Human
ugcagggcaguggagguugagu

SEQ ID NO: 169622 - RNA, 22 nt, Human
aguuguaauaacaauaccaaaa

SEQ ID NO: 169623 - RNA, 22 nt, Human
uagggacacugcucaugaguuc

SEQ ID NO: 169624 - RNA, 22 nt, Human
agcucccagcagagcuggccac

SEQ ID NO: 169625 - RNA, 22 nt, Human
aggcaauccccugaggauacuu

SEQ ID NO: 169626 - RNA, 22 nt, Human
uaaugucaaggugauagauuug

SEQ ID NO: 169627 - RNA, 22 nt, Human
guggaaugaauagauuugcauu

SEQ ID NO: 169628 - RNA, 22 nt, Human
caggauggccccggggcugugc

SEQ ID NO: 169629 - RNA, 22 nt, Human
aaugaucuggcucaggauauca

SEQ ID NO: 169630 - RNA, 18 nt, Human
aagucaccccugcucccu

SEQ ID NO: 169631 - RNA, 22 nt, Human
auguccaguuucuacacacaua

SEQ ID NO: 169632 - RNA, 22 nt, Human
uuaguucuugggugaacuuuug

SEQ ID NO: 169633 - RNA, 22 nt, Human
aaguauaagcuauucuucauga

SEQ ID NO: 169634 - RNA, 19 nt, Human
agugugaguaauuggaguu

SEQ ID NO: 169635 - RNA, 22 nt, Human
uguauguugggucaaaguacau

SEQ ID NO: 169636 - RNA, 22 nt, Human
auucuucacuguuucagaauga

SEQ ID NO: 169637 - RNA, 17 nt, Human
uuucugcaugauuggac

SEQ ID NO: 169638 - RNA, 22 nt, Human
uagacaggaaacauuaggaugg

SEQ ID NO: 169639 - RNA, 19 nt, Human
uccaggcauccuucaggcu

SEQ ID NO: 169640 - RNA, 22 nt, Human
ucugcuucuccuacuucauggg

SEQ ID NO: 169641 - RNA, 22 nt, Human
uguuugcucugacuaucuugcg

SEQ ID NO: 169642 - RNA, 20 nt, Human
auuuggcaugaaguauugau

SEQ ID NO: 169643 - RNA, 22 nt, Human
aaaagcagagacucuggagcua

SEQ ID NO: 169644 - RNA, 22 nt, Human
cuccaggcucguccaagaucga

SEQ ID NO: 169645 - RNA, 22 nt, Human
gguuuaauggagauauuucaga

SEQ ID NO: 169646 - RNA, 22 nt, Human
ugaauaaucuuggguauuaaua

SEQ ID NO: 169647 - RNA, 22 nt, Human
uuccauacgacugaggucucgg

SEQ ID NO: 169648 - RNA, 22 nt, Human
gaaauauacaugaagucggcug

SEQ ID NO: 169649 - RNA, 22 nt, Human
guuagggaucaggaacaagagc

SEQ ID NO: 169650 - RNA, 22 nt, Human
cauuuguauguuccuccuuagg

SEQ ID NO: 169651 - RNA, 22 nt, Human
uggacauguaaaggcucaaggu

SEQ ID NO: 169652 - RNA, 22 nt, Human
uacuauaccauguaagauauga

SEQ ID NO: 169653 - RNA, 21 nt, Human
gaguccuuccaauguccucag

SEQ ID NO: 169654 - RNA, 22 nt, Human
uucagaaugugaccuuauuugg

SEQ ID NO: 169655 - RNA, 22 nt, Human
aguacaauuauauuuagauggu

SEQ ID NO: 169656 - RNA, 22 nt, Human
acuuccagcuagguucugcuaa

SEQ ID NO: 169657 - RNA, 22 nt, Human
ucugaagacauaugauauggug

SEQ ID NO: 169658 - RNA, 22 nt, Human
uaccaugucuucaauaagucua

SEQ ID NO: 169659 - RNA, 22 nt, Human
ugcaugaacggaggguaagcug

SEQ ID NO: 169660 - RNA, 22 nt, Human
caguccuuagauuuuacugcca

SEQ ID NO: 169661 - RNA, 22 nt, Human
uaugcuguggaaaauacaaaga

SEQ ID NO: 169662 - RNA, 22 nt, Human
cguccuuacagagggucacagc

SEQ ID NO: 169663 - RNA, 23 nt, Human
uaauucacauauacauugcuuca

SEQ ID NO: 169664 - RNA, 19 nt, Human
augcuuuauguuauuucuu

SEQ ID NO: 169665 - RNA, 22 nt, Human
gugcaaaaguaaaugugguuuu

SEQ ID NO: 169666 - RNA, 22 nt, Human
ccagggcaggagaaagacucac

SEQ ID NO: 169667 - RNA, 22 nt, Human
gugcaaaagcaguugugguuuu

SEQ ID NO: 169668 - RNA, 22 nt, Human
uucuggguaguaugguuaguuu

SEQ ID NO: 169669 - RNA, 22 nt, Human
uuacauguucucauacacagag

SEQ ID NO: 169670 - RNA, 22 nt, Human
cugggucuaaaaauucucagau

SEQ ID NO: 169671 - RNA, 22 nt, Human
ggcuuuauauuguuugagcaga

SEQ ID NO: 169672 - RNA, 22 nt, Human
uauggcuuuaaacaacuuaggu

SEQ ID NO: 169673 - RNA, 22 nt, Human
ugcaggugccucuugagcuugu

SEQ ID NO: 169674 - RNA, 22 nt, Human
uuacauguacugguuugacuua

SEQ ID NO: 169675 - RNA, 22 nt, Human
uuccucagcucagcgagagaga

SEQ ID NO: 169676 - RNA, 22 nt, Human
cuguuauuucugccaggugagu

SEQ ID NO: 169677 - RNA, 22 nt, Human
aagggcagcuuaaauugguagc

SEQ ID NO: 169678 - RNA, 22 nt, Human
uuugagguuagcuagcagauca

SEQ ID NO: 169679 - RNA, 22 nt, Human
ucaaaauuucagcacuagcccu

SEQ ID NO: 169680 - RNA, 22 nt, Human
gaggugucuagaucuaccagua

SEQ ID NO: 169681 - RNA, 22 nt, Human
agcuuuauauguuguuucucca

SEQ ID NO: 169682 - RNA, 22 nt, Human
ccauggcuuucuuucauuguaa

SEQ ID NO: 169683 - RNA, 17 nt, Human
uccuuucuuuaccuguu

SEQ ID NO: 169684 - RNA, 22 nt, Human
uuccuuagcagaccugguaucc

SEQ ID NO: 169685 - RNA, 22 nt, Human
agcugcaaagaucugucaguca

SEQ ID NO: 169686 - RNA, 22 nt, Human
uuauuauagauuaugcaagauu

SEQ ID NO: 169687 - RNA, 22 nt, Human
gacaggcuuugagucccagaac

SEQ ID NO: 169688 - RNA, 22 nt, Human
ucaaaggcauugccaauaagua

SEQ ID NO: 169689 - RNA, 22 nt, Human
guagaaauguaaccaggagaua

SEQ ID NO: 169690 - RNA, 22 nt, Human
aaucagaaauucuacaucacaa

SEQ ID NO: 169691 - RNA, 22 nt, Human
ucaggugugggcagagaaacca

SEQ ID NO: 169692 - RNA, 22 nt, Human
guguccugguuccuuguggcug

SEQ ID NO: 169693 - RNA, 22 nt, Human
ugguuuuagaugccuuuacugc

SEQ ID NO: 169694 - RNA, 22 nt, Human
aaaacuuucagggauacagaaa

SEQ ID NO: 169695 - RNA, 22 nt, Human
cagcuucuggcguggagccuga

SEQ ID NO: 169696 - RNA, 22 nt, Human
aacagacagaaaaaugugaucu

SEQ ID NO: 169697 - RNA, 22 nt, Human
ugccaaauugcccuauaaauga

SEQ ID NO: 169698 - RNA, 22 nt, Human
aagggcucuguugccauuucag

SEQ ID NO: 169699 - RNA, 22 nt, Human
aguugcuggcaccugugaguau

SEQ ID NO: 169700 - RNA, 22 nt, Human
ugucuuuagagucacaaaacca

SEQ ID NO: 169701 - RNA, 22 nt, Human
uguggcagcugcugcaggagcu

SEQ ID NO: 169702 - RNA, 22 nt, Human
cugggugagcuggccagagggu

SEQ ID NO: 169703 - RNA, 22 nt, Human
acacuuggagcaacacuuaugg

SEQ ID NO: 169704 - RNA, 22 nt, Human
uguacauuuagagcucaauaga

SEQ ID NO: 169705 - RNA, 22 nt, Human
cacagcauuaacugggacagcu

SEQ ID NO: 169706 - RNA, 22 nt, Human
uuuauucaucaucuguucauau

SEQ ID NO: 169707 - RNA, 22 nt, Human
agaagcuauaacaacaauuaua

SEQ ID NO: 169708 - RNA, 22 nt, Human
ucagguguguuguauuuuacca

SEQ ID NO: 169709 - RNA, 22 nt, Human
uuucucauuuagaguggcaggg

SEQ ID NO: 169710 - RNA, 22 nt, Human
uuaguacugauagggucaauca

SEQ ID NO: 169711 - RNA, 18 nt, Human
gccugcaggcacgggggu

SEQ ID NO: 169712 - RNA, 22 nt, Human
gccaggcacaguucuaggugcu

SEQ ID NO: 169713 - RNA, 22 nt, Human
acaggugugagaacaugccuug

SEQ ID NO: 169714 - RNA, 22 nt, Human
agauugaagacugguggagcug

SEQ ID NO: 169715 - RNA, 22 nt, Human
gucaaauauacuaagagguaaa

SEQ ID NO: 169716 - RNA, 20 nt, Human
uauuugaaauggccaagugu

SEQ ID NO: 169717 - RNA, 22 nt, Human
ccagcuuuuggggugacaauuu

SEQ ID NO: 169718 - RNA, 22 nt, Human
aggaaucagaauucuuagaauu

SEQ ID NO: 169719 - RNA, 22 nt, Human
aaugggauaggucuucaggaau

SEQ ID NO: 169720 - RNA, 22 nt, Human
uggcaaaguuuaucaggaauau

SEQ ID NO: 169721 - RNA, 22 nt, Human
agaauuucuggaagauugcaag

SEQ ID NO: 169722 - RNA, 22 nt, Human
auuauuaggacuacugggguug

SEQ ID NO: 169723 - RNA, 22 nt, Human
guaaugaaugaaagaaacuggg

SEQ ID NO: 169724 - RNA, 22 nt, Human
ucuuuaaugugauuguaauuau

SEQ ID NO: 169725 - RNA, 22 nt, Human
aguccugucaccucuacuuucg

SEQ ID NO: 169726 - RNA, 22 nt, Human
ugcagggacaggcucuggggau

SEQ ID NO: 169727 - RNA, 22 nt, Human
gcuuuuauugucuuuacgacga

SEQ ID NO: 169728 - RNA, 22 nt, Human
agauguuuguguuaucuccauu

SEQ ID NO: 169729 - RNA, 22 nt, Human
uuccaugacaccgagggaaguc

SEQ ID NO: 169730 - RNA, 22 nt, Human
uguaaaguuacuuuugaaagga

SEQ ID NO: 169731 - RNA, 22 nt, Human
uggcuuuacaucaaauugagua

SEQ ID NO: 169732 - RNA, 21 nt, Human
uggcagguucaaaggccuauc

SEQ ID NO: 169733 - RNA, 22 nt, Human
aaaugucuguaggggcugcagg

SEQ ID NO: 169734 - RNA, 22 nt, Human
uugaaucuauguauucagugua

SEQ ID NO: 169735 - RNA, 22 nt, Human
auuccaaagguuaaugcccauu

SEQ ID NO: 169736 - RNA, 22 nt, Human
acacauauucauauguacuuac

SEQ ID NO: 169737 - RNA, 22 nt, Human
acagagagaggcccgaggcugc

SEQ ID NO: 169738 - RNA, 22 nt, Human
cuggauccaacagaguuggguu

SEQ ID NO: 169739 - RNA, 22 nt, Human
gacaugugcugucucuuaaauu

SEQ ID NO: 169740 - RNA, 22 nt, Human
acagguguggggcugugguacu

SEQ ID NO: 169741 - RNA, 22 nt, Human
gcaggugguggggcuaugaucu

SEQ ID NO: 169742 - RNA, 22 nt, Human
guggcacaaggcuuacacagca

SEQ ID NO: 169743 - RNA, 22 nt, Human
aaggcuggcaauauauuuguua

SEQ ID NO: 169744 - RNA, 22 nt, Human
agcuuuaucacaauauuggcua

SEQ ID NO: 169745 - RNA, 22 nt, Human
acuuagauuuccuuacugggug

SEQ ID NO: 169746 - RNA, 22 nt, Human
aaucuagucuccuuaagucuuu

SEQ ID NO: 169747 - RNA, 22 nt, Human
ugagaugaauaacuccugcuaa

SEQ ID NO: 169748 - RNA, 22 nt, Human
guuucauuaccugacccaugag

SEQ ID NO: 169749 - RNA, 22 nt, Human
ugguguggggauaagcacucug

SEQ ID NO: 169750 - RNA, 22 nt, Human
caggacagugcagguccauccu

SEQ ID NO: 169751 - RNA, 22 nt, Human
uccugggucucuuccuuaguuc

SEQ ID NO: 169752 - RNA, 22 nt, Human
ccagaucuaaguccaaaguacu

SEQ ID NO: 169753 - RNA, 22 nt, Human
gagggcagugaauuuugaagcu

SEQ ID NO: 169754 - RNA, 22 nt, Human
uauugguagauggagagagaca

SEQ ID NO: 169755 - RNA, 22 nt, Human
guuccaaacaagucauaaagua

SEQ ID NO: 169756 - RNA, 22 nt, Human
uccugcaggccuguucccagua

SEQ ID NO: 169757 - RNA, 22 nt, Human
aauuucaaagcucacuggcaua

SEQ ID NO: 169758 - RNA, 22 nt, Human
ucagaauugucuggggaauguu

SEQ ID NO: 169759 - RNA, 22 nt, Human
uuauugaguuuacagcuuuaga

SEQ ID NO: 169760 - RNA, 22 nt, Human
aucagagauggcuccagugcuc

SEQ ID NO: 169761 - RNA, 22 nt, Human
ugcuagggauacaguggugaau

SEQ ID NO: 169762 - RNA, 22 nt, Human
acagcuuugggcaaugcuauga

SEQ ID NO: 169763 - RNA, 20 nt, Human
uugauucccucuaaacucgc

SEQ ID NO: 169764 - RNA, 22 nt, Human
agacgagggcccccaggacagc

SEQ ID NO: 169765 - RNA, 22 nt, Human
ucuucuucccaucccucaaaug

SEQ ID NO: 169766 - RNA, 22 nt, Human
uggugggggaggcugucuagca

SEQ ID NO: 169767 - RNA, 22 nt, Human
acccagcuggaugcauggaggc

SEQ ID NO: 169768 - RNA, 19 nt, Human
ucagggcaguccggucccc

SEQ ID NO: 169769 - RNA, 22 nt, Human
augcuacuauccuucugcuuaa

SEQ ID NO: 169770 - RNA, 22 nt, Human
ugcuggcuuuuugguccuugcu

SEQ ID NO: 169771 - RNA, 22 nt, Human
aaauuuaaggaggugcucacuu

SEQ ID NO: 169772 - RNA, 22 nt, Human
gcugggucucucccugguccug

SEQ ID NO: 169773 - RNA, 22 nt, Human
cagagcaugaauaaaaguuaca

SEQ ID NO: 169774 - RNA, 22 nt, Human
gagccuccuccuggugugccga

SEQ ID NO: 169775 - RNA, 22 nt, Human
ucuuaaagagcgcaauuugagg

SEQ ID NO: 169776 - RNA, 22 nt, Human
caguaaaagauggaaauagaau

SEQ ID NO: 169777 - RNA, 22 nt, Human
ugcuuuauugcaucaguguggg

SEQ ID NO: 169778 - RNA, 22 nt, Human
acaugcuuugcacuuacaucau

SEQ ID NO: 169779 - RNA, 22 nt, Human
caauguaucaaccagaaaguuc

SEQ ID NO: 169780 - RNA, 22 nt, Human
aagugguuugagcacagugcug

SEQ ID NO: 169781 - RNA, 22 nt, Human
ucagcaaaggaccagcacaggc

SEQ ID NO: 169782 - RNA, 20 nt, Human
aaguuacauuguauuguacc

SEQ ID NO: 169783 - RNA, 22 nt, Human
aagcaauauacugauaugauua

SEQ ID NO: 169784 - RNA, 22 nt, Human
cacaauuuccaagucauguuau

SEQ ID NO: 169785 - RNA, 22 nt, Human
augcuauacauaugacaucaca

SEQ ID NO: 169786 - RNA, 22 nt, Human
uuauugcuauggugagagggau

SEQ ID NO: 169787 - RNA, 22 nt, Human
uacuagaaauuaccuucucacu

SEQ ID NO: 169788 - RNA, 22 nt, Human
ucuguacuuccuuuaaacuuua

SEQ ID NO: 169789 - RNA, 22 nt, Human
agagccaggugcugcuguuuga

SEQ ID NO: 169790 - RNA, 22 nt, Human
uuccuggggcgacuguaucuga

SEQ ID NO: 169791 - RNA, 22 nt, Human
aaggcauaugcauagaagacag

SEQ ID NO: 169792 - RNA, 22 nt, Human
agccagucggggccaugcuggg

SEQ ID NO: 169793 - RNA, 20 nt, Human
uuucuguaaggcauuaaucu

SEQ ID NO: 169794 - RNA, 22 nt, Human
uccagacccaugacccugggga

SEQ ID NO: 169795 - RNA, 22 nt, Human
acagcauugagagcuaaauuua

SEQ ID NO: 169796 - RNA, 22 nt, Human
aaauagcagccuuuaguuaaca

SEQ ID NO: 169797 - RNA, 22 nt, Human
gcuucacacuaaaaauguuaaa

SEQ ID NO: 169798 - RNA, 22 nt, Human
uuuaggcaauagauggcagugu

SEQ ID NO: 169799 - RNA, 22 nt, Human
uguacaauggcuauaauacccu

SEQ ID NO: 169800 - RNA, 21 nt, Human
gcugcaaauucuaacaauuau

SEQ ID NO: 169801 - RNA, 22 nt, Human
agcagggcugugcuccuuccga

SEQ ID NO: 169802 - RNA, 22 nt, Human
ucagguguuagaagaaauuuca

SEQ ID NO: 169803 - RNA, 22 nt, Human
auuuggaaacaauuauauucuu

SEQ ID NO: 169804 - RNA, 22 nt, Human
uccuggauuaauagggagcugu

SEQ ID NO: 169805 - RNA, 22 nt, Human
uccuggaucuacucucaauugg

SEQ ID NO: 169806 - RNA, 22 nt, Human
ugaaugaugcaguauaaugaua

SEQ ID NO: 169807 - RNA, 18 nt, Human
uuggcuuugagaacuggu

SEQ ID NO: 169808 - RNA, 22 nt, Human
cuucauuggcuuccauagaugc

SEQ ID NO: 169809 - RNA, 22 nt, Human
caugaguucaucugcuucucuu

SEQ ID NO: 169810 - RNA, 22 nt, Human
uuucaguuuccagcuuugucau

SEQ ID NO: 169811 - RNA, 22 nt, Human
ugcaggugaaaauuaugaggau

SEQ ID NO: 169812 - RNA, 22 nt, Human
uauggcuugucuuuauaccagg

SEQ ID NO: 169813 - RNA, 22 nt, Human
agaauaaucacugaaguucaaa

SEQ ID NO: 169814 - RNA, 22 nt, Human
gacccaggcccaaggcugccag

SEQ ID NO: 169815 - RNA, 22 nt, Human
ugcuuuauuuauaaaauagcaa

SEQ ID NO: 169816 - RNA, 22 nt, Human
ugggcagguuguuauuugacau

SEQ ID NO: 169817 - RNA, 22 nt, Human
aagagagggacuuauuaaaguc

SEQ ID NO: 169818 - RNA, 22 nt, Human
ucucacagugcaggucugucuc

SEQ ID NO: 169819 - RNA, 22 nt, Human
gcagcuuucuaagcuuuauugc

SEQ ID NO: 169820 - RNA, 22 nt, Human
caggugguuccauguuucauga

SEQ ID NO: 169821 - RNA, 22 nt, Human
cuauuaggcuuccauuucaugc

SEQ ID NO: 169822 - RNA, 22 nt, Human
ugcagggcuuccucuuggaguu

SEQ ID NO: 169823 - RNA, 22 nt, Human
cagagaaagaagcccauucauu

SEQ ID NO: 169824 - RNA, 23 nt, Human
ccaaagucgaagucuaguccaga

SEQ ID NO: 169825 - RNA, 22 nt, Human
uacaugaaccuuuaugugugau

SEQ ID NO: 169826 - RNA, 22 nt, Human
ugacauguguaaucagcuccgu

SEQ ID NO: 169827 - RNA, 22 nt, Human
auucuucaucacuaccuuguga

SEQ ID NO: 169828 - RNA, 22 nt, Human
ucaaggagcccacagucuaaug

SEQ ID NO: 169829 - RNA, 22 nt, Human
uggaggaaguugcuggaaguca

SEQ ID NO: 169830 - RNA, 22 nt, Human
ggauuuccucuugacucuaaag

SEQ ID NO: 169831 - RNA, 22 nt, Human
cauguacaaaaggcaaaugccu

SEQ ID NO: 169832 - RNA, 22 nt, Human
ugcaggugcugugucaagagag

SEQ ID NO: 169833 - RNA, 22 nt, Human
ccugcaggcugcaggccaguuc

SEQ ID NO: 169834 - RNA, 22 nt, Human
gagggcucuaccaaguaacucu

SEQ ID NO: 169835 - RNA, 22 nt, Human
guacagaaggagcuuuggauuc

SEQ ID NO: 169836 - RNA, 22 nt, Human
uugcugaucugaaacguuacug

SEQ ID NO: 169837 - RNA, 22 nt, Human
acagggcauuuccucuaugugu

SEQ ID NO: 169838 - RNA, 22 nt, Human
gacucguucauaguuccaauuu

SEQ ID NO: 169839 - RNA, 22 nt, Human
uuugacucagcaaauucacagg

SEQ ID NO: 169840 - RNA, 22 nt, Human
gggagcauuucccuguguugaa

SEQ ID NO: 169841 - RNA, 22 nt, Human
caucagaauguuagagaaggga

SEQ ID NO: 169842 - RNA, 22 nt, Human
aaucagaacuucucaggguggg

SEQ ID NO: 169843 - RNA, 22 nt, Human
gcagcuuucuuuuugcaugucu

SEQ ID NO: 169844 - RNA, 22 nt, Human
caguguuucugaguuccagcuc

SEQ ID NO: 169845 - RNA, 21 nt, Human
uuuuauugaugaauggccacu

SEQ ID NO: 169846 - RNA, 17 nt, Human
uaggugguugcuggucu

SEQ ID NO: 169847 - RNA, 22 nt, Human
uuuucaguuccaucucugcucu

SEQ ID NO: 169848 - RNA, 22 nt, Human
ugcuuaaacccugaucaugugu

SEQ ID NO: 169849 - RNA, 22 nt, Human
aaaauguaaagcuugaguguag

SEQ ID NO: 169850 - RNA, 22 nt, Human
auauauuugagaauauucauga

SEQ ID NO: 169851 - RNA, 22 nt, Human
uuugaagugcaaugaggauucu

SEQ ID NO: 169852 - RNA, 22 nt, Human
uaguuaggaauagcagcgacuc

SEQ ID NO: 169853 - RNA, 22 nt, Human
gagaggcugaaaucacaggagc

SEQ ID NO: 169854 - RNA, 22 nt, Human
gcuuccuuccuuacauuggugg

SEQ ID NO: 169855 - RNA, 22 nt, Human
uuuccucugucaugacagcuga

SEQ ID NO: 169856 - RNA, 21 nt, Human
agcugcaagagcaacaucuuu

SEQ ID NO: 169857 - RNA, 22 nt, Human
agggcuccuaugccccauggac

SEQ ID NO: 169858 - RNA, 22 nt, Human
acaacauuauacauagaaagcu

SEQ ID NO: 169859 - RNA, 22 nt, Human
ccuuccagaguucagucugccc

SEQ ID NO: 169860 - RNA, 22 nt, Human
gucuggccugccagcucuggug

SEQ ID NO: 169861 - RNA, 22 nt, Human
auuuucagagacaucuggacuu

SEQ ID NO: 169862 - RNA, 22 nt, Human
gauggaaugaauggcagauaca

SEQ ID NO: 169863 - RNA, 16 nt, Human
ccagguggggcuguga

SEQ ID NO: 169864 - RNA, 22 nt, Human
gagggcagaaaauuaugcggug

SEQ ID NO: 169865 - RNA, 22 nt, Human
aaugguauuugucaagcauagu

SEQ ID NO: 169866 - RNA, 22 nt, Human
aagauucagccaaauuguucau

SEQ ID NO: 169867 - RNA, 22 nt, Human
auuuccaugaaguuuaguuaua

SEQ ID NO: 169868 - RNA, 22 nt, Human
cccaggcagucuggcucuaaag

SEQ ID NO: 169869 - RNA, 22 nt, Human
uuggaggaugcaaugagggagu

SEQ ID NO: 169870 - RNA, 22 nt, Human
ugcagggcuauaacuccauucu

SEQ ID NO: 169871 - RNA, 22 nt, Human
cagcaugaauguguucguaggg

SEQ ID NO: 169872 - RNA, 22 nt, Human
cuuugcaaacgauuaccacaug

SEQ ID NO: 169873 - RNA, 22 nt, Human
uggaaauguauuugggcaugcc

SEQ ID NO: 169874 - RNA, 22 nt, Human
cgcaccacugaauuccagccug

SEQ ID NO: 169875 - RNA, 22 nt, Human
gaagggagaagguugggugacg

SEQ ID NO: 169876 - RNA, 22 nt, Human
ucuuuccucugagcuccuguag

SEQ ID NO: 169877 - RNA, 22 nt, Human
gcaugugucccucagucugugc

SEQ ID NO: 169878 - RNA, 20 nt, Human
guauuacaggcuuagaacca

SEQ ID NO: 169879 - RNA, 23 nt, Human
uacuauaacgcugugucagcucc

SEQ ID NO: 169880 - RNA, 22 nt, Human
acauaauagguaccugaauaau

SEQ ID NO: 169881 - RNA, 22 nt, Human
gcaaggauguacugcaauagga

SEQ ID NO: 169882 - RNA, 22 nt, Human
gaucuucuagcagaaguaauuu

SEQ ID NO: 169883 - RNA, 19 nt, Human
gcaggugugaauccguaga

SEQ ID NO: 169884 - RNA, 22 nt, Human
ccagcuuuuagugggcuuauua

SEQ ID NO: 169885 - RNA, 22 nt, Human
uguccuggaaaaauggagaguu

SEQ ID NO: 169886 - RNA, 22 nt, Human
guagggacccacagucuauauu

SEQ ID NO: 169887 - RNA, 22 nt, Human
agaaaguuuugugcuauauaug

SEQ ID NO: 169888 - RNA, 22 nt, Human
aggcucagccugggccuagagc

SEQ ID NO: 169889 - RNA, 22 nt, Human
cauuuccacuucugaaaacugg

SEQ ID NO: 169890 - RNA, 22 nt, Human
agcccuaacucccaguaucuug

SEQ ID NO: 169891 - RNA, 22 nt, Human
ugcuggagugcaguggcuuaac

SEQ ID NO: 169892 - RNA, 22 nt, Human
guuaucaugcuucaucaucacu

SEQ ID NO: 169893 - RNA, 22 nt, Human
uaucauuuaacagaaucauugc

SEQ ID NO: 169894 - RNA, 22 nt, Human
aaugugaaaccgcacagaauaa

SEQ ID NO: 169895 - RNA, 22 nt, Human
acuucacacagcaaauuuaucu

SEQ ID NO: 169896 - RNA, 22 nt, Human
acuggaucuaauugguuauagu

SEQ ID NO: 169897 - RNA, 21 nt, Human
gacaggugauucagagcaggg

SEQ ID NO: 169898 - RNA, 22 nt, Human
uggcaggugccaugggcucaga

SEQ ID NO: 169899 - RNA, 22 nt, Human
auguaccucugcauuccugccu

SEQ ID NO: 169900 - RNA, 22 nt, Human
uuaugggagcaauuggggaggu

SEQ ID NO: 169901 - RNA, 22 nt, Human
gcagguggucacucauccccag

SEQ ID NO: 169902 - RNA, 22 nt, Human
gccaggcauuauuccgaucccu

SEQ ID NO: 169903 - RNA, 22 nt, Human
guuugaaugcaguaugcauuuu

SEQ ID NO: 169904 - RNA, 21 nt, Human
uagggcucuauuuuuauuuca

SEQ ID NO: 169905 - RNA, 22 nt, Human
aaggcauaugcuguguacaguu

SEQ ID NO: 169906 - RNA, 22 nt, Human
cuggcccucggaguccagcugc

SEQ ID NO: 169907 - RNA, 22 nt, Human
cagcaugaaaaguguugcuauc

SEQ ID NO: 169908 - RNA, 22 nt, Human
ugucugggagggacagggcuac

SEQ ID NO: 169909 - RNA, 20 nt, Human
auguccagugacuggaccau

SEQ ID NO: 169910 - RNA, 22 nt, Human
guuucuuuugugaucaccaacc

SEQ ID NO: 169911 - RNA, 22 nt, Human
auuuuacuacuccaauuaauga

SEQ ID NO: 169912 - RNA, 22 nt, Human
uuuuugaaggcugaugugauua

SEQ ID NO: 169913 - RNA, 22 nt, Human
uccugcagcugauaaauacagu

SEQ ID NO: 169914 - RNA, 22 nt, Human
ucuuauugugaugaugaagaac

SEQ ID NO: 169915 - RNA, 22 nt, Human
uaguccuugguaaaauucuaug

SEQ ID NO: 169916 - RNA, 22 nt, Human
ucugugcaggaagucauuauga

SEQ ID NO: 169917 - RNA, 22 nt, Human
aauugcaauuuucuuaaggucu

SEQ ID NO: 169918 - RNA, 23 nt, Human
ugguggcagaaguagcagaugac

SEQ ID NO: 169919 - RNA, 22 nt, Human
cuucuucagcacaauauugaug

SEQ ID NO: 169920 - RNA, 22 nt, Human
uuucuuagcgaugcuugauaaa

SEQ ID NO: 169921 - RNA, 22 nt, Human
ccacaggcugcugcaggucccg

SEQ ID NO: 169922 - RNA, 22 nt, Human
gaggugucaggguagucaugau

SEQ ID NO: 169923 - RNA, 22 nt, Human
cuauuacauuucuggacauuca

SEQ ID NO: 169924 - RNA, 22 nt, Human
ucuaauccuugcuaccugggug

SEQ ID NO: 169925 - RNA, 22 nt, Human
gacuuuaugaagagaugaccaa

SEQ ID NO: 169926 - RNA, 22 nt, Human
gaagucuucauucucucugaga

SEQ ID NO: 169927 - RNA, 21 nt, Human
uuucugaaggcaacaucuauc

SEQ ID NO: 169928 - RNA, 22 nt, Human
ucagggcagccuaaggcaccuc

SEQ ID NO: 169929 - RNA, 22 nt, Human
auaguuugugaaacacagcagu

SEQ ID NO: 169930 - RNA, 22 nt, Human
agggaccucuucuugcagcuga

SEQ ID NO: 169931 - RNA, 22 nt, Human
gagagacagcacacaguguggg

SEQ ID NO: 169932 - RNA, 22 nt, Human
agcagggcagcugaugcgcacg

SEQ ID NO: 169933 - RNA, 22 nt, Human
aguccuuaugugguggagagag

SEQ ID NO: 169934 - RNA, 22 nt, Human
uuuuauguuccucuuuaugcga

SEQ ID NO: 169935 - RNA, 22 nt, Human
caaauaguaugagcaaugauuc

SEQ ID NO: 169936 - RNA, 22 nt, Human
caccugccugcaggggcuccac

SEQ ID NO: 169937 - RNA, 18 nt, Human
uacuuuauucccccucca

SEQ ID NO: 169938 - RNA, 22 nt, Human
uguuucaaagaaagaaaauaua

SEQ ID NO: 169939 - RNA, 22 nt, Human
ggggcaggagcccuucuucagc

SEQ ID NO: 169940 - RNA, 22 nt, Human
uggcuuuaaaucuguauucaua

SEQ ID NO: 169941 - RNA, 20 nt, Human
cuugguggcucugggaagug

SEQ ID NO: 169942 - RNA, 22 nt, Human
ugcagggccuuguugaugugcu

SEQ ID NO: 169943 - RNA, 22 nt, Human
uucuuuucuuuaggcauugugu

SEQ ID NO: 169944 - RNA, 22 nt, Human
aagauuuauuagaugcuuaccu

SEQ ID NO: 169945 - RNA, 20 nt, Human
ugcagguguguccaagcacu

SEQ ID NO: 169946 - RNA, 22 nt, Human
cagcuucuucaguccuggagcu

SEQ ID NO: 169947 - RNA, 22 nt, Human
aggaccugacauuguguuuucu

SEQ ID NO: 169948 - RNA, 22 nt, Human
gaaauuuauuaucuacaucauu

SEQ ID NO: 169949 - RNA, 22 nt, Human
ugcaggugcugauaccuacucc

SEQ ID NO: 169950 - RNA, 22 nt, Human
acaguccuuguguggaacauua

SEQ ID NO: 169951 - RNA, 22 nt, Human
aauauugagaaccagcauguuu

SEQ ID NO: 169952 - RNA, 22 nt, Human
gggcaggugauuuuggcuccau

SEQ ID NO: 169953 - RNA, 22 nt, Human
uugauuucuuacucuuccaagg

SEQ ID NO: 169954 - RNA, 22 nt, Human
aguugcagacgcagagauguug

SEQ ID NO: 169955 - RNA, 23 nt, Human
uugcugccugagccuuccucugg

SEQ ID NO: 169956 - RNA, 22 nt, Human
auuuauuauugugguuacuucu

SEQ ID NO: 169957 - RNA, 22 nt, Human
ccugggucuggucacuaaguca

SEQ ID NO: 169958 - RNA, 22 nt, Human
uugaacauuggcaauuucauau

SEQ ID NO: 169959 - RNA, 22 nt, Human
ucauagaagcaccagaagauau

SEQ ID NO: 169960 - RNA, 23 nt, Human
acaacuuuacagauacauuuugu

SEQ ID NO: 169961 - RNA, 22 nt, Human
uuccuuaggggacagggggaua

SEQ ID NO: 169962 - RNA, 22 nt, Human
uuuacagagagagaacuggacu

SEQ ID NO: 169963 - RNA, 22 nt, Human
gcaaggaccuuugagcgugcca

SEQ ID NO: 169964 - RNA, 22 nt, Human
gcugggaagugcaagaucaagg

SEQ ID NO: 169965 - RNA, 22 nt, Human
auguucuacagauggaaagggg

SEQ ID NO: 169966 - RNA, 22 nt, Human
uuguguccuaacaucuaguuaa

SEQ ID NO: 169967 - RNA, 20 nt, Human
gaaguccuuucacucuuccc

SEQ ID NO: 169968 - RNA, 22 nt, Human
uaaagccaacacuuuacugcuc

SEQ ID NO: 169969 - RNA, 22 nt, Human
gauugcuguucccagggggcug

SEQ ID NO: 169970 - RNA, 22 nt, Human
cuuuauguucaguacaaugcuu

SEQ ID NO: 169971 - RNA, 22 nt, Human
ccagcaugagacgaugaugaag

SEQ ID NO: 169972 - RNA, 22 nt, Human
auuaucuauguagaaugauuuu

SEQ ID NO: 169973 - RNA, 22 nt, Human
agcugcaggauuauggaaugga

SEQ ID NO: 169974 - RNA, 22 nt, Human
cugaaagaauaagauguuuaca

SEQ ID NO: 169975 - RNA, 22 nt, Human
uuaaauauuauguugucugcaa

SEQ ID NO: 169976 - RNA, 22 nt, Human
acuuccuugucaggugcaucau

SEQ ID NO: 169977 - RNA, 22 nt, Human
uggaaugagcuggcuaauaacc

SEQ ID NO: 169978 - RNA, 22 nt, Human
aucauaaagugcuaucugauug

SEQ ID NO: 169979 - RNA, 22 nt, Human
ggcagguggaaguuggcagagc

SEQ ID NO: 169980 - RNA, 22 nt, Human
guucuaauuuggggcuccuuag

SEQ ID NO: 169981 - RNA, 22 nt, Human
cuggggugucucgucugccauu

SEQ ID NO: 169982 - RNA, 22 nt, Human
agcagggcuuugcagacuuggg

SEQ ID NO: 169983 - RNA, 22 nt, Human
aauguaaacagcaagagaaggg

SEQ ID NO: 169984 - RNA, 22 nt, Human
uuccauuuauucuuguccagau

SEQ ID NO: 169985 - RNA, 22 nt, Human
aggaccugacuggcuccugcuu

SEQ ID NO: 169986 - RNA, 22 nt, Human
uaucuaaaggauuuaauuuagu

SEQ ID NO: 169987 - RNA, 22 nt, Human
aagaaaucauaucauuucuugg

SEQ ID NO: 169988 - RNA, 22 nt, Human
aauguucagaggacaauauaaa

SEQ ID NO: 169989 - RNA, 22 nt, Human
aaauguuucuacuugugagcau

SEQ ID NO: 169990 - RNA, 22 nt, Human
uguuccugguuccugcaugaug

SEQ ID NO: 169991 - RNA, 22 nt, Human
cuguuguauuauucaauauuau

SEQ ID NO: 169992 - RNA, 20 nt, Human
ucauguguguccuacagaga

SEQ ID NO: 169993 - RNA, 22 nt, Human
caguuuauagcucuagcagcuu

SEQ ID NO: 169994 - RNA, 22 nt, Human
uggcagguggcacagccuggga

SEQ ID NO: 169995 - RNA, 22 nt, Human
caggacugauguuccuccagcc

SEQ ID NO: 169996 - RNA, 22 nt, Human
uuucuaggcacagugucuuccc

SEQ ID NO: 169997 - RNA, 22 nt, Human
ucaauaauggcaggauaaauuu

SEQ ID NO: 169998 - RNA, 22 nt, Human
acauguaaaaggaacaugcaug

SEQ ID NO: 169999 - RNA, 22 nt, Human
ccuuccuuucagggcuaugccu

SEQ ID NO: 170000 - RNA, 22 nt, Human
aauuccagaggaggacaguccu

SEQ ID NO: 170001 - RNA, 21 nt, Human
ccuguucacagaucuguaacu

SEQ ID NO: 170002 - RNA, 22 nt, Human
cagaauaaagguacaauugagu

SEQ ID NO: 170003 - RNA, 22 nt, Human
ggcaggugcuaagagagguaaa

SEQ ID NO: 170004 - RNA, 22 nt, Human
ucauugccauggcauuugcaga

SEQ ID NO: 170005 - RNA, 22 nt, Human
cccugcagagaccacugaccuu

SEQ ID NO: 170006 - RNA, 22 nt, Human
uguaacaauuucuuacuauugu

SEQ ID NO: 170007 - RNA, 22 nt, Human
ugcuggguguuccgcacuugac

SEQ ID NO: 170008 - RNA, 22 nt, Human
caagaugugccuaaucagaccu

SEQ ID NO: 170009 - RNA, 22 nt, Human
aaacacauuagcccuguggaaa

SEQ ID NO: 170010 - RNA, 18 nt, Human
cccagcuuagcgccccuc

SEQ ID NO: 170011 - RNA, 23 nt, Human
uuuaacuuuccaauaauucauug

SEQ ID NO: 170012 - RNA, 22 nt, Human
uaauuuuacuuccugagcaccu

SEQ ID NO: 170013 - RNA, 22 nt, Human
uuucauugagaauauaagauuu

SEQ ID NO: 170014 - RNA, 22 nt, Human
auggcauuauagcaaugguuug

SEQ ID NO: 170015 - RNA, 22 nt, Human
gguuucaaaguggacaguuagu

SEQ ID NO: 170016 - RNA, 22 nt, Human
cagcaggugucuagcaaggguc

SEQ ID NO: 170017 - RNA, 22 nt, Human
uaaacauguugacaucuuaccu

SEQ ID NO: 170018 - RNA, 23 nt, Human
aaauaggaguaucuggaucauga

SEQ ID NO: 170019 - RNA, 22 nt, Human
agauuuacugagaacugauuac

SEQ ID NO: 170020 - RNA, 22 nt, Human
ugcagguggcagcggggcacca

SEQ ID NO: 170021 - RNA, 22 nt, Human
uuuaauauucugcauucuccuu

SEQ ID NO: 170022 - RNA, 22 nt, Human
uggagcagcucuagcgggcgcc

SEQ ID NO: 170023 - RNA, 22 nt, Human
uaguaucuauuaguaacaagag

SEQ ID NO: 170024 - RNA, 22 nt, Human
ugcacacacucugcauauacuu

SEQ ID NO: 170025 - RNA, 22 nt, Human
uggaccugagccuggcccugcc

SEQ ID NO: 170026 - RNA, 22 nt, Human
uucauacucacuccaauaacug

SEQ ID NO: 170027 - RNA, 22 nt, Human
cagcaugauuggugucugguga

SEQ ID NO: 170028 - RNA, 23 nt, Human
uuuauccaacucuguaaucucuc

SEQ ID NO: 170029 - RNA, 22 nt, Human
aaacuuucauguaucucuuuca

SEQ ID NO: 170030 - RNA, 22 nt, Human
gugguaucugucucccccacug

SEQ ID NO: 170031 - RNA, 22 nt, Human
gcauguguucuugaaaggccac

SEQ ID NO: 170032 - RNA, 22 nt, Human
ugagggaguuggguguauagga

SEQ ID NO: 170033 - RNA, 23 nt, Human
uuguccugccgaucucugagaau

SEQ ID NO: 170034 - RNA, 22 nt, Human
ccagggcauccucacaucgcag

SEQ ID NO: 170035 - RNA, 22 nt, Human
uguaacaaaauaccuuggauug

SEQ ID NO: 170036 - RNA, 22 nt, Human
acagaacugggggcacagauag

SEQ ID NO: 170037 - RNA, 22 nt, Human
aggagcugugaaugggaggggu

SEQ ID NO: 170038 - RNA, 22 nt, Human
cuguggaaggccuguccugaaa

SEQ ID NO: 170039 - RNA, 22 nt, Human
uuucaaacauaucuucauuacu

SEQ ID NO: 170040 - RNA, 23 nt, Human
uguccuuuuugaggccuccuccu

SEQ ID NO: 170041 - RNA, 22 nt, Human
ccuguucagagcuaagcaucau

SEQ ID NO: 170042 - RNA, 22 nt, Human
uaaauuaugucacaugacucug

SEQ ID NO: 170043 - RNA, 22 nt, Human
ggcaggcaaugaggaugggaag

SEQ ID NO: 170044 - RNA, 22 nt, Human
ggucaaagggugagauggcagg

SEQ ID NO: 170045 - RNA, 23 nt, Human
gagauuuagcagacaaagcucuu

SEQ ID NO: 170046 - RNA, 22 nt, Human
agucaccauuuucaccugccuc

SEQ ID NO: 170047 - RNA, 20 nt, Human
aaacauucauguacaaguga

SEQ ID NO: 170048 - RNA, 22 nt, Human
cuuaauuucaaacugcuaguga

SEQ ID NO: 170049 - RNA, 22 nt, Human
uuuaaauuauaguuaaugucug

SEQ ID NO: 170050 - RNA, 22 nt, Human
uuuaauuuucugggcccagcag

SEQ ID NO: 170051 - RNA, 22 nt, Human
aggcuucugcugauauuucauu

SEQ ID NO: 170052 - RNA, 22 nt, Human
aagugguuugauucaguuuaug

SEQ ID NO: 170053 - RNA, 22 nt, Human
agcaucuggcagaaagucagaa

SEQ ID NO: 170054 - RNA, 22 nt, Human
gauagaaagguguugaaaucca

SEQ ID NO: 170055 - RNA, 22 nt, Human
gguacaaugucuuacagaccca

SEQ ID NO: 170056 - RNA, 22 nt, Human
uaauuucaaguuuagggcucua

SEQ ID NO: 170057 - RNA, 22 nt, Human
gcacccagagggcagggucucc

SEQ ID NO: 170058 - RNA, 22 nt, Human
gaggaggaaaggaguugaaaug

SEQ ID NO: 170059 - RNA, 22 nt, Human
ccagcuuuucagaaucugccug

SEQ ID NO: 170060 - RNA, 22 nt, Human
uaguuaggguucugcagagaca

SEQ ID NO: 170061 - RNA, 22 nt, Human
auuaggcauauaugcuuuuaau

SEQ ID NO: 170062 - RNA, 22 nt, Human
aaguuucaugauguaauuauug

SEQ ID NO: 170063 - RNA, 22 nt, Human
uggaauguugauaaacauaggc

SEQ ID NO: 170064 - RNA, 20 nt, Human
agguauaagaaaugugauuu

SEQ ID NO: 170065 - RNA, 22 nt, Human
auaauauaauccuacuucccau

SEQ ID NO: 170066 - RNA, 21 nt, Human
agaugaggauacugaggccua

SEQ ID NO: 170067 - RNA, 22 nt, Human
ucagaagccaccuuuuguuggg

SEQ ID NO: 170068 - RNA, 22 nt, Human
uugguggagucauuggcauaug

SEQ ID NO: 170069 - RNA, 22 nt, Human
uggcaggugaaguuguuaggga

SEQ ID NO: 170070 - RNA, 22 nt, Human
uuccaggacuggguguuugaag

SEQ ID NO: 170071 - RNA, 22 nt, Human
auccuucuaagagggacguaug

SEQ ID NO: 170072 - RNA, 22 nt, Human
ggcaggugguaaggauuucaua

SEQ ID NO: 170073 - RNA, 20 nt, Human
cacaggcuuacaguuuagau

SEQ ID NO: 170074 - RNA, 22 nt, Human
augaacaauaaaauagaucaca

SEQ ID NO: 170075 - RNA, 21 nt, Human
aagaguggcugaggaggugau

SEQ ID NO: 170076 - RNA, 22 nt, Human
aaccccgcucaggcugggugag

SEQ ID NO: 170077 - RNA, 22 nt, Human
acaaagucaaauugcagccgcc

SEQ ID NO: 170078 - RNA, 22 nt, Human
uuucuucaauugcuaacaagga

SEQ ID NO: 170079 - RNA, 23 nt, Human
gggcagguuuuuauaggcuucag

SEQ ID NO: 170080 - RNA, 22 nt, Human
cccagugucauucuaagggagg

SEQ ID NO: 170081 - RNA, 22 nt, Human
ugggccaggggccucuucugau

SEQ ID NO: 170082 - RNA, 22 nt, Human
auuugcugagcucaaagaaaag

SEQ ID NO: 170083 - RNA, 22 nt, Human
cagauuucuauuucaaauacau

SEQ ID NO: 170084 - RNA, 22 nt, Human
uugcagggucccagaggccugg

SEQ ID NO: 170085 - RNA, 22 nt, Human
auguccucggcucugugcugcu

SEQ ID NO: 170086 - RNA, 21 nt, Human
caaguccuuugccaaagugcu

SEQ ID NO: 170087 - RNA, 22 nt, Human
uaaaaugccagaccaguucacg

SEQ ID NO: 170088 - RNA, 22 nt, Human
acuggaggauuccuggaaggcg

SEQ ID NO: 170089 - RNA, 22 nt, Human
aguccuuacaccuggaaccuau

SEQ ID NO: 170090 - RNA, 22 nt, Human
agaggccggccgagcccauggg

SEQ ID NO: 170091 - RNA, 22 nt, Human
uccaauauggauaaaaggggcc

SEQ ID NO: 170092 - RNA, 22 nt, Human
cauaaaauggcuuguucuuuaa

SEQ ID NO: 170093 - RNA, 22 nt, Human
aaggugguaauagugcaggauu

SEQ ID NO: 170094 - RNA, 22 nt, Human
ccagggcaauuauuuggagggu

SEQ ID NO: 170095 - RNA, 22 nt, Human
agggcuccuccccggccuccac

SEQ ID NO: 170096 - RNA, 22 nt, Human
aaauacugucucugagagagcc

SEQ ID NO: 170097 - RNA, 22 nt, Human
cugggucugggccuccuggagu

SEQ ID NO: 170098 - RNA, 22 nt, Human
cuuucuuauaccugucagggcc

SEQ ID NO: 170099 - RNA, 22 nt, Human
aggcagggaccaguuguuuucu

SEQ ID NO: 170100 - RNA, 22 nt, Human
ggcagguggauuuucuacucua

SEQ ID NO: 170101 - RNA, 22 nt, Human
aacuugguaaauugugucagau

SEQ ID NO: 170102 - RNA, 23 nt, Human
cguguccuucagggagagugugg

SEQ ID NO: 170103 - RNA, 22 nt, Human
gccuuaauuuuuuauaaucucu

SEQ ID NO: 170104 - RNA, 19 nt, Human
cuggaauguggcuggugca

SEQ ID NO: 170105 - RNA, 22 nt, Human
aggauuuaucaggaacucucuu

SEQ ID NO: 170106 - RNA, 22 nt, Human
ugacauguaagauggaaaagcg

SEQ ID NO: 170107 - RNA, 20 nt, Human
ucuggccccuuccuguccug

SEQ ID NO: 170108 - RNA, 22 nt, Human
ggagcaguuguugagcaagcca

SEQ ID NO: 170109 - RNA, 22 nt, Human
uuuauccaguguuggaauuuuu

SEQ ID NO: 170110 - RNA, 22 nt, Human
uuggaauucaaguuguagcuua

SEQ ID NO: 170111 - RNA, 22 nt, Human
aaauggauggaaagcaauuuuu

SEQ ID NO: 170112 - RNA, 18 nt, Human
ccauggcucccuccugcc

SEQ ID NO: 170113 - RNA, 22 nt, Human
caaaaguucucacccagacaug

SEQ ID NO: 170114 - RNA, 20 nt, Human
cccaggcagagcuagcggca

SEQ ID NO: 170115 - RNA, 22 nt, Human
aucagagaaguuucacuggcau

SEQ ID NO: 170116 - RNA, 22 nt, Human
ugucuuuagaaagaagcagaca

SEQ ID NO: 170117 - RNA, 22 nt, Human
gacuuuauuuuaacggagauuc

SEQ ID NO: 170118 - RNA, 22 nt, Human
ucaacuuugaaaccauagugaa

SEQ ID NO: 170119 - RNA, 22 nt, Human
uccaugagaacccuuggagaua

SEQ ID NO: 170120 - RNA, 22 nt, Human
uccaugcagaguccaggccuca

SEQ ID NO: 170121 - RNA, 22 nt, Human
uccaugagcuagcuuuccaaag

SEQ ID NO: 170122 - RNA, 22 nt, Human
uggagcagcuaagccucugaga

SEQ ID NO: 170123 - RNA, 22 nt, Human
caggugguuguuuggauucuaa

SEQ ID NO: 170124 - RNA, 22 nt, Human
uguccuuuguucccugucucug

SEQ ID NO: 170125 - RNA, 18 nt, Human
guuaauuuugaaguucau

SEQ ID NO: 170126 - RNA, 22 nt, Human
gaaauuauugcuagagacugca

SEQ ID NO: 170127 - RNA, 22 nt, Human
accaggcagucaccguccagga

SEQ ID NO: 170128 - RNA, 22 nt, Human
gccugcaguucugugcuaggca

SEQ ID NO: 170129 - RNA, 22 nt, Human
cauuggaaugcauuugaagaga

SEQ ID NO: 170130 - RNA, 22 nt, Human
cccaggcagagagcuggugagc

SEQ ID NO: 170131 - RNA, 22 nt, Human
uuucugaagggcagcagacucu

SEQ ID NO: 170132 - RNA, 22 nt, Human
auuugguuacucaguugucuga

SEQ ID NO: 170133 - RNA, 23 nt, Human
aaauuauugcucuucaauugccu

SEQ ID NO: 170134 - RNA, 22 nt, Human
uuauuagguuauucucuguacu

SEQ ID NO: 170135 - RNA, 22 nt, Human
uccaggcacuauauauacuuuu

SEQ ID NO: 170136 - RNA, 22 nt, Human
caaacauucaaguacaagucuu

SEQ ID NO: 170137 - RNA, 22 nt, Human
agcugcaauuaaagacugugaa

SEQ ID NO: 170138 - RNA, 22 nt, Human
aguaaaauuucugcugaggaga

SEQ ID NO: 170139 - RNA, 22 nt, Human
ugcugcauuugcaguccuuuaa

SEQ ID NO: 170140 - RNA, 21 nt, Human
acagcagggcuggcaugacag

SEQ ID NO: 170141 - RNA, 23 nt, Human
acuugauuauuguugauagauuc

SEQ ID NO: 170142 - RNA, 22 nt, Human
aguuauuacucuuuaacauauu

SEQ ID NO: 170143 - RNA, 22 nt, Human
auuucucagugaaaugacaggc

SEQ ID NO: 170144 - RNA, 22 nt, Human
cgcagguguucaguaaauguau

SEQ ID NO: 170145 - RNA, 22 nt, Human
ugggcagggucucuguuaucag

SEQ ID NO: 170146 - RNA, 22 nt, Human
accucaagaauguauaacacag

SEQ ID NO: 170147 - RNA, 22 nt, Human
auguguccucuggcagguuuag

SEQ ID NO: 170148 - RNA, 22 nt, Human
ugcaggugcuacaagaacucac

SEQ ID NO: 170149 - RNA, 22 nt, Human
ucuggagggggaugccucaucc

SEQ ID NO: 170150 - RNA, 22 nt, Human
aucagcaucuuuaacaauuacc

SEQ ID NO: 170151 - RNA, 22 nt, Human
ucagaugagugcuuucagcugc

SEQ ID NO: 170152 - RNA, 22 nt, Human
uuugacuccuguguuucuggaa

SEQ ID NO: 170153 - RNA, 21 nt, Human
uuucagaccuaucuuugaagg

SEQ ID NO: 170154 - RNA, 22 nt, Human
cuggcccuucucuugcuuccug

SEQ ID NO: 170155 - RNA, 22 nt, Human
cuuuauuagauguagacuuucu

SEQ ID NO: 170156 - RNA, 22 nt, Human
gaggugucauuuaguuaaucag

SEQ ID NO: 170157 - RNA, 22 nt, Human
uugcuuuaagguaucuggagaa

SEQ ID NO: 170158 - RNA, 22 nt, Human
uggauuuauuagguuggugaaa

SEQ ID NO: 170159 - RNA, 22 nt, Human
ugcuggcugccagguucccugu

SEQ ID NO: 170160 - RNA, 22 nt, Human
uugguggaccucaucagaaccg

SEQ ID NO: 170161 - RNA, 22 nt, Human
aaggugucacugggacaggaaa

SEQ ID NO: 170162 - RNA, 20 nt, Human
uggucuggagccagugagga

SEQ ID NO: 170163 - RNA, 22 nt, Human
gacccggcuccaggcccagcag

SEQ ID NO: 170164 - RNA, 22 nt, Human
cacaauacuauuuuuaggucuu

SEQ ID NO: 170165 - RNA, 22 nt, Human
ccucugcccuuuuccuguauca

SEQ ID NO: 170166 - RNA, 19 nt, Human
gcgaggaagucacuguggu

SEQ ID NO: 170167 - RNA, 22 nt, Human
aagagcuggauggaaucuggga

SEQ ID NO: 170168 - RNA, 22 nt, Human
cuucuucccagcuucccucacc

SEQ ID NO: 170169 - RNA, 22 nt, Human
ccagguggacaaggcuuucaca

SEQ ID NO: 170170 - RNA, 22 nt, Human
uucuucaguguagcaacuguau

SEQ ID NO: 170171 - RNA, 21 nt, Human
auggauuuaaacaggccacaa

SEQ ID NO: 170172 - RNA, 22 nt, Human
aaaucaguucacguucugaggu

SEQ ID NO: 170173 - RNA, 22 nt, Human
cagaauuuaaguggauuauucu

SEQ ID NO: 170174 - RNA, 22 nt, Human
cacaggcuuccaguccccagcu

SEQ ID NO: 170175 - RNA, 22 nt, Human
uuacagaaaguuucccaugccg

SEQ ID NO: 170176 - RNA, 22 nt, Human
uuucaaagaguuguaaauuacu

SEQ ID NO: 170177 - RNA, 22 nt, Human
uuucaaauaccauaaaccuaau

SEQ ID NO: 170178 - RNA, 22 nt, Human
uucuuuuccuacacagcgauuu

SEQ ID NO: 170179 - RNA, 22 nt, Human
uuaaaauuuccccaccauguau

SEQ ID NO: 170180 - RNA, 22 nt, Human
aucagaaaggugggcaagcaga

SEQ ID NO: 170181 - RNA, 22 nt, Human
agauuugcggcuuuacuuugca

SEQ ID NO: 170182 - RNA, 22 nt, Human
caggugucuaauucucaccccc

SEQ ID NO: 170183 - RNA, 22 nt, Human
uguguacacagauaguaauggc

SEQ ID NO: 170184 - RNA, 22 nt, Human
uguuauugucgcugcacuggga

SEQ ID NO: 170185 - RNA, 22 nt, Human
uacugaaauacuaagaaguuaa

SEQ ID NO: 170186 - RNA, 22 nt, Human
ggcuuuaugcagggauagaaau

SEQ ID NO: 170187 - RNA, 22 nt, Human
uugcuuuauuuggcaugccacu

SEQ ID NO: 170188 - RNA, 22 nt, Human
guccagugacaaguagcuggcc

SEQ ID NO: 170189 - RNA, 22 nt, Human
cuaggguggauuugugcagagu

SEQ ID NO: 170190 - RNA, 22 nt, Human
uauuugaaaguguacaaaaacu

SEQ ID NO: 170191 - RNA, 22 nt, Human
uuuaagaaguuauguuauaaau

SEQ ID NO: 170192 - RNA, 23 nt, Human
gcagacagagcagacuaagacaa

SEQ ID NO: 170193 - RNA, 22 nt, Human
ccugggucccagccaggcuuug

SEQ ID NO: 170194 - RNA, 22 nt, Human
ucaguguauggagugcuggauu

SEQ ID NO: 170195 - RNA, 22 nt, Human
agggccucuaccauccaagguu

SEQ ID NO: 170196 - RNA, 22 nt, Human
uuuccuuugcccaauacauguc

SEQ ID NO: 170197 - RNA, 21 nt, Human
ccaagacucccaucuaguggu

SEQ ID NO: 170198 - RNA, 22 nt, Human
auaguuuacaaaaaugaugcau

SEQ ID NO: 170199 - RNA, 22 nt, Human
uccuggguagagaccugaugaa

SEQ ID NO: 170200 - RNA, 22 nt, Human
uagggcagagcuuguacacgau

SEQ ID NO: 170201 - RNA, 22 nt, Human
ucagcuuuugucagaaauugua

SEQ ID NO: 170202 - RNA, 22 nt, Human
gcauguguuauuuuauguauga

SEQ ID NO: 170203 - RNA, 22 nt, Human
gaccucagugaauggucaugua

SEQ ID NO: 170204 - RNA, 15 nt, Human
aaucagaaguguggc

SEQ ID NO: 170205 - RNA, 23 nt, Human
caauuucauaugauucuaccuaa

SEQ ID NO: 170206 - RNA, 22 nt, Human
gagaggagguggcuaugacagc

SEQ ID NO: 170207 - RNA, 21 nt, Human
ucagggcagugggagguuccu

SEQ ID NO: 170208 - RNA, 22 nt, Human
ucucuucuauuugagacuauuu

SEQ ID NO: 170209 - RNA, 22 nt, Human
gaggaugguaugaggcaagcaa

SEQ ID NO: 170210 - RNA, 22 nt, Human
ugcagggagcucuggggugcag

SEQ ID NO: 170211 - RNA, 22 nt, Human
ucacauuuuuuacuggacuuaa

SEQ ID NO: 170212 - RNA, 22 nt, Human
ggagaaugauauauagcucagu

SEQ ID NO: 170213 - RNA, 22 nt, Human
aaggugguuugcagacagaaua

SEQ ID NO: 170214 - RNA, 21 nt, Human
acagacagggccagugucccc

SEQ ID NO: 170215 - RNA, 19 nt, Human
ucucuacacuacauuucua

SEQ ID NO: 170216 - RNA, 22 nt, Human
aagucacagaguuggaagucag

SEQ ID NO: 170217 - RNA, 22 nt, Human
uccaaauacauuuacuguauuu

SEQ ID NO: 170218 - RNA, 22 nt, Human
uguuuuagcugacacauggagc

SEQ ID NO: 170219 - RNA, 22 nt, Human
gcagggcaggauuugaacccag

SEQ ID NO: 170220 - RNA, 22 nt, Human
ugcaacuuguuuggagagaaag

SEQ ID NO: 170221 - RNA, 22 nt, Human
gauguacuugccuuaucuaucc

SEQ ID NO: 170222 - RNA, 19 nt, Human
acaaaugauguugcacuga

SEQ ID NO: 170223 - RNA, 22 nt, Human
uguuuuucaaauauugcucugu

SEQ ID NO: 170224 - RNA, 22 nt, Human
aaagcagggaugaggcuagagg

SEQ ID NO: 170225 - RNA, 22 nt, Human
acaguaaaucaacagaauaucu

SEQ ID NO: 170226 - RNA, 22 nt, Human
uugaaaaaauugguagaggaug

SEQ ID NO: 170227 - RNA, 22 nt, Human
uugauggcugugauuuacucag

SEQ ID NO: 170228 - RNA, 22 nt, Human
cucuaacaccacagugugguuu

SEQ ID NO: 170229 - RNA, 22 nt, Human
uucuucuucauuucugacgaug

SEQ ID NO: 170230 - RNA, 22 nt, Human
uggcagggaguugcaggauuuc

SEQ ID NO: 170231 - RNA, 22 nt, Human
ggcuccaggcuccuauuucacu

SEQ ID NO: 170232 - RNA, 22 nt, Human
uguccugggucaaauccugguc

SEQ ID NO: 170233 - RNA, 22 nt, Human
ugggugggagcgcccugucugg

SEQ ID NO: 170234 - RNA, 21 nt, Human
agaaaauggcguuuuagauuu

SEQ ID NO: 170235 - RNA, 22 nt, Human
aaagcagguugcaauuacagug

SEQ ID NO: 170236 - RNA, 22 nt, Human
aaaugaaaugagugccuggagg

SEQ ID NO: 170237 - RNA, 22 nt, Human
caaagucauggggaugcagguc

SEQ ID NO: 170238 - RNA, 22 nt, Human
uggcagggccuaccccaauauc

SEQ ID NO: 170239 - RNA, 22 nt, Human
uuugcaaagaaauuauugcugu

SEQ ID NO: 170240 - RNA, 22 nt, Human
agacagacagagaauuuaaaua

SEQ ID NO: 170241 - RNA, 22 nt, Human
gcagagaggauauuauugucca

SEQ ID NO: 170242 - RNA, 22 nt, Human
uuucuucagccuucacaaccug

SEQ ID NO: 170243 - RNA, 22 nt, Human
uuugacucaguggacguacuag

SEQ ID NO: 170244 - RNA, 22 nt, Human
ugagaaugaaucuuuugcuuuc

SEQ ID NO: 170245 - RNA, 22 nt, Human
guauuagguuggugcaaaagua

SEQ ID NO: 170246 - RNA, 22 nt, Human
uaaguaaauuuauaaugugauu

SEQ ID NO: 170247 - RNA, 21 nt, Human
ggcuuuaugcucacccagccu

SEQ ID NO: 170248 - RNA, 22 nt, Human
gugcaaaaggcauugugguuuu

SEQ ID NO: 170249 - RNA, 22 nt, Human
acuguccucgaaguaccugugc

SEQ ID NO: 170250 - RNA, 22 nt, Human
acauuguuugagaauacagaug

SEQ ID NO: 170251 - RNA, 22 nt, Human
caguccuucuccauuaaggcuc

SEQ ID NO: 170252 - RNA, 22 nt, Human
acaacuuuaauggguuucagcu

SEQ ID NO: 170253 - RNA, 22 nt, Human
caagaauccuguucuugaagau

SEQ ID NO: 170254 - RNA, 22 nt, Human
gugcaaaaguaacugugguuuu

SEQ ID NO: 170255 - RNA, 22 nt, Human
accaugaucugcucugguguuu

SEQ ID NO: 170256 - RNA, 22 nt, Human
gggugggaaggcuaagggauug

SEQ ID NO: 170257 - RNA, 22 nt, Human
gggaccugaggcccugcuccac

SEQ ID NO: 170258 - RNA, 22 nt, Human
gaggcugguaggaaaggaaaca

SEQ ID NO: 170259 - RNA, 22 nt, Human
acauuuaaguuaaaaccucagu

SEQ ID NO: 170260 - RNA, 22 nt, Human
acaaagaucuugcuuuccuacu

SEQ ID NO: 170261 - RNA, 22 nt, Human
uguuugcuaggguugguauuua

SEQ ID NO: 170262 - RNA, 22 nt, Human
cacaauguauauguauaucaaa

SEQ ID NO: 170263 - RNA, 22 nt, Human
gggagcuguaagggacagguag

SEQ ID NO: 170264 - RNA, 22 nt, Human
acucuuauaguauugguuauua

SEQ ID NO: 170265 - RNA, 21 nt, Human
uaucagaagagaaagaaugau

SEQ ID NO: 170266 - RNA, 22 nt, Human
aagacuuucaaaccuauguuug

SEQ ID NO: 170267 - RNA, 22 nt, Human
aaggugguuugcuaaucccaac

SEQ ID NO: 170268 - RNA, 22 nt, Human
cuugucuugcacacgguugcca

SEQ ID NO: 170269 - RNA, 22 nt, Human
gugcauuugacgaauacucacu

SEQ ID NO: 170270 - RNA, 22 nt, Human
uggcaaagacgcuagcuaagau

SEQ ID NO: 170271 - RNA, 22 nt, Human
uuuuauugggaguccucuacug

SEQ ID NO: 170272 - RNA, 22 nt, Human
gacaggugaaacagcaagguaa

SEQ ID NO: 170273 - RNA, 23 nt, Human
auaguuuucccugguucuugcca

SEQ ID NO: 170274 - RNA, 22 nt, Human
agagcauccaucggccaggacc

SEQ ID NO: 170275 - RNA, 22 nt, Human
gacauguugaagaauauuugga

SEQ ID NO: 170276 - RNA, 22 nt, Human
uaauuauagccgcuauuuugcu

SEQ ID NO: 170277 - RNA, 22 nt, Human
cagcuauuuucucauuaaggau

SEQ ID NO: 170278 - RNA, 22 nt, Human
uucacagaauggcaaguuaugg

SEQ ID NO: 170279 - RNA, 22 nt, Human
uccugcagcucugagaagcauc

SEQ ID NO: 170280 - RNA, 18 nt, Human
gcaggcuuuuccuggguc

SEQ ID NO: 170281 - RNA, 22 nt, Human
aaaguccuugcaguuuccucuu

SEQ ID NO: 170282 - RNA, 22 nt, Human
uguccauggagaagcucagggc

SEQ ID NO: 170283 - RNA, 22 nt, Human
guuuacuguuaaccaacgaaug

SEQ ID NO: 170284 - RNA, 22 nt, Human
agggugugcuguugggucuuuc

SEQ ID NO: 170285 - RNA, 22 nt, Human
cgcaggugggcccuucauugau

SEQ ID NO: 170286 - RNA, 22 nt, Human
caugcagccugugaacaguguc

SEQ ID NO: 170287 - RNA, 21 nt, Human
ugcaccuguucacugcaguuc

SEQ ID NO: 170288 - RNA, 22 nt, Human
ggguuccuccaguuccuagagc

SEQ ID NO: 170289 - RNA, 22 nt, Human
ucaggaaaguguucucagagga

SEQ ID NO: 170290 - RNA, 22 nt, Human
auuagggcuggaugcaaggaaa

SEQ ID NO: 170291 - RNA, 22 nt, Human
uuugaauagcauaggauuacau

SEQ ID NO: 170292 - RNA, 22 nt, Human
ccaggccuuccaguacgcagaa

SEQ ID NO: 170293 - RNA, 22 nt, Human
aaauuucuugaggcucucuagc

SEQ ID NO: 170294 - RNA, 22 nt, Human
gacauuagacuaauguagcauu

SEQ ID NO: 170295 - RNA, 22 nt, Human
aggccuuaccauagcuguagca

SEQ ID NO: 170296 - RNA, 22 nt, Human
aaggccaucuacuuacggaauu

SEQ ID NO: 170297 - RNA, 22 nt, Human
uucaaguuuugccuccccaucc

SEQ ID NO: 170298 - RNA, 22 nt, Human
uuuuucugagaauaugagagga

SEQ ID NO: 170299 - RNA, 22 nt, Human
ucugggaacagccuggcugugu

SEQ ID NO: 170300 - RNA, 22 nt, Human
ggguggggccaggcaauuugca

SEQ ID NO: 170301 - RNA, 22 nt, Human
aggcaggggagcuggaagggua

SEQ ID NO: 170302 - RNA, 22 nt, Human
uuccaagaguaaauucaaauug

SEQ ID NO: 170303 - RNA, 22 nt, Human
uaaaucuccuguuuuucaucua

SEQ ID NO: 170304 - RNA, 19 nt, Human
ccaggccucuggggccugu

SEQ ID NO: 170305 - RNA, 22 nt, Human
ggauggcagacagugaguggcu

SEQ ID NO: 170306 - RNA, 22 nt, Human
ccagagagaaaauggagggcca

SEQ ID NO: 170307 - RNA, 22 nt, Human
uuuuccuucugauacuccauuu

SEQ ID NO: 170308 - RNA, 22 nt, Human
cacaaauggccguguucaaaga

SEQ ID NO: 170309 - RNA, 22 nt, Human
ucccagggcacucacccucccu

SEQ ID NO: 170310 - RNA, 22 nt, Human
aauuucaagucuugaagaagua

SEQ ID NO: 170311 - RNA, 22 nt, Human
aacaugugucuugcauuucuug

SEQ ID NO: 170312 - RNA, 22 nt, Human
ucugggugagcugccucggguc

SEQ ID NO: 170313 - RNA, 22 nt, Human
cccagugugguucuuuggagaa

SEQ ID NO: 170314 - RNA, 23 nt, Human
aaacaugcagcacaugaaugcua

SEQ ID NO: 170315 - RNA, 22 nt, Human
aauucuaaauguaauuuagaau

SEQ ID NO: 170316 - RNA, 22 nt, Human
cucuuaguaaugccaugaagca

SEQ ID NO: 170317 - RNA, 22 nt, Human
caaagcaccacaaaccagguga

SEQ ID NO: 170318 - RNA, 22 nt, Human
augcaaaauaaggcagaaacau

SEQ ID NO: 170319 - RNA, 22 nt, Human
uauauacuuucuuccuggguag

SEQ ID NO: 170320 - RNA, 22 nt, Human
uccagaauauuugggaaagaug

SEQ ID NO: 170321 - RNA, 22 nt, Human
uucaucaauguguuuaauaaug

SEQ ID NO: 170322 - RNA, 18 nt, Human
ucuguccuuccauucuuc

SEQ ID NO: 170323 - RNA, 22 nt, Human
caucagaagauggcucuggaaa

SEQ ID NO: 170324 - RNA, 22 nt, Human
acagacagaggcuccaugagga

SEQ ID NO: 170325 - RNA, 22 nt, Human
augguuuaagggagaauauuga

SEQ ID NO: 170326 - RNA, 22 nt, Human
cagcaccuguuagcauuaaaua

SEQ ID NO: 170327 - RNA, 22 nt, Human
gcccagcuuuucacuuccacac

SEQ ID NO: 170328 - RNA, 22 nt, Human
acaugauuuuaguaucauaaua

SEQ ID NO: 170329 - RNA, 22 nt, Human
uuucacauaucaacucuauccu

SEQ ID NO: 170330 - RNA, 23 nt, Human
ugguucuaggccuauaauuauau

SEQ ID NO: 170331 - RNA, 22 nt, Human
ggaggcagaauagagugugggu

SEQ ID NO: 170332 - RNA, 22 nt, Human
ccagguguucuuugucccuguu

SEQ ID NO: 170333 - RNA, 22 nt, Human
agaaguuguagguuugcauauu

SEQ ID NO: 170334 - RNA, 22 nt, Human
auuuauugaacacugacuaugu

SEQ ID NO: 170335 - RNA, 22 nt, Human
cauguuuuguguacagaauauu

SEQ ID NO: 170336 - RNA, 22 nt, Human
uuuaucuguuguacauuuaugc

SEQ ID NO: 170337 - RNA, 22 nt, Human
ucugggugaugaaaugcacugu

SEQ ID NO: 170338 - RNA, 22 nt, Human
auuuacugcuugacacauuggu

SEQ ID NO: 170339 - RNA, 22 nt, Human
cucagagaaaaggagcaagggu

SEQ ID NO: 170340 - RNA, 22 nt, Human
ucaggugggcaguggguugagc

SEQ ID NO: 170341 - RNA, 22 nt, Human
guucuucagucacaucacagaa

SEQ ID NO: 170342 - RNA, 22 nt, Human
uuccaggauagcuuucaggaau

SEQ ID NO: 170343 - RNA, 22 nt, Human
uugauaaaaugauaucuucuuu

SEQ ID NO: 170344 - RNA, 22 nt, Human
cauacuuugggauaagagugga

SEQ ID NO: 170345 - RNA, 22 nt, Human
cuagaaauacaggcacgugcca

SEQ ID NO: 170346 - RNA, 22 nt, Human
ccaugcugugacacaguaguua

SEQ ID NO: 170347 - RNA, 22 nt, Human
augauauuugcaaugugcuugc

SEQ ID NO: 170348 - RNA, 14 nt, Human
gcaggcagaucacc

SEQ ID NO: 170349 - RNA, 22 nt, Human
acaggcagagaacucagccaga

SEQ ID NO: 170350 - RNA, 22 nt, Human
auguguccugcugugucacaca

SEQ ID NO: 170351 - RNA, 22 nt, Human
uuuacagaugaggaaacugaga

SEQ ID NO: 170352 - RNA, 22 nt, Human
uuaacacuugaacucuacaugu

SEQ ID NO: 170353 - RNA, 22 nt, Human
cuguccuguagcuccaucaguc

SEQ ID NO: 170354 - RNA, 22 nt, Human
uaaguucauaagcuuauucuua

SEQ ID NO: 170355 - RNA, 22 nt, Human
agcagguggucuguugcugcug

SEQ ID NO: 170356 - RNA, 22 nt, Human
uaaguuuuaagcaaucugauaa

SEQ ID NO: 170357 - RNA, 22 nt, Human
cuuguucaguugccucuccugc

SEQ ID NO: 170358 - RNA, 22 nt, Human
uguauacaggauuacucauagc

SEQ ID NO: 170359 - RNA, 22 nt, Human
ugcagggcccuugggguugaac

SEQ ID NO: 170360 - RNA, 22 nt, Human
uccaggcaugguguaauuuugc

SEQ ID NO: 170361 - RNA, 22 nt, Human
aauucucagguaaaaguuaagu

SEQ ID NO: 170362 - RNA, 22 nt, Human
ccaugagcuucaacugacacag

SEQ ID NO: 170363 - RNA, 22 nt, Human
gacagggaaacauugaaguguc

SEQ ID NO: 170364 - RNA, 22 nt, Human
cuggauggucccaugagcagcu

SEQ ID NO: 170365 - RNA, 22 nt, Human
uauugagaacccucaggaggca

SEQ ID NO: 170366 - RNA, 22 nt, Human
ggcuggcagugugagagaggga

SEQ ID NO: 170367 - RNA, 22 nt, Human
auguuucagauacagaucaaau

SEQ ID NO: 170368 - RNA, 21 nt, Human
auccuuagcacuuagaagagu

SEQ ID NO: 170369 - RNA, 22 nt, Human
aaugcuaacauugguuuauauc

SEQ ID NO: 170370 - RNA, 22 nt, Human
agauauuuguaucuugcuauug

SEQ ID NO: 170371 - RNA, 22 nt, Human
uuguaaaugaccuuuucuaauu

SEQ ID NO: 170372 - RNA, 22 nt, Human
uuauuagcugggcuucagggug

SEQ ID NO: 170373 - RNA, 22 nt, Human
uggauuaguuaagaaauguuag

SEQ ID NO: 170374 - RNA, 22 nt, Human
aggacaguccgggguccuccac

SEQ ID NO: 170375 - RNA, 22 nt, Human
cauggcuucuaagugauaacgu

SEQ ID NO: 170376 - RNA, 22 nt, Human
uuuucuuuaaucugguggggug

SEQ ID NO: 170377 - RNA, 22 nt, Human
gaugauaacagcauuucaacug

SEQ ID NO: 170378 - RNA, 22 nt, Human
cuacauuaaauuggcuuacuua

SEQ ID NO: 170379 - RNA, 22 nt, Human
auaugcauguacgugugcacaa

SEQ ID NO: 170380 - RNA, 22 nt, Human
uauuuaucgagugucuacuaug

SEQ ID NO: 170381 - RNA, 22 nt, Human
uggauuuaguucuucacaggcc

SEQ ID NO: 170382 - RNA, 22 nt, Human
auuagauacacagauuuccacu

SEQ ID NO: 170383 - RNA, 22 nt, Human
uucucuuugacauuauucaggu

SEQ ID NO: 170384 - RNA, 22 nt, Human
ggcaggcaucaucaguugauca

SEQ ID NO: 170385 - RNA, 19 nt, Human
uuccugggguuccauugug

SEQ ID NO: 170386 - RNA, 22 nt, Human
caaguccucugguuucaaauag

SEQ ID NO: 170387 - RNA, 22 nt, Human
ugauucuauggaaggcauaagg

SEQ ID NO: 170388 - RNA, 22 nt, Human
uuuaacacuaguuucuuuaacu

SEQ ID NO: 170389 - RNA, 22 nt, Human
ugggcaggggcccugcuuccgu

SEQ ID NO: 170390 - RNA, 22 nt, Human
ucagagaguuuucacuagggug

SEQ ID NO: 170391 - RNA, 22 nt, Human
acuuucauuugugaagacugua

SEQ ID NO: 170392 - RNA, 22 nt, Human
ucagaaauacaaaacacuuacu

SEQ ID NO: 170393 - RNA, 19 nt, Human
cccagcuugaccaccugcu

SEQ ID NO: 170394 - RNA, 22 nt, Human
uucuccaacacaagcaugaugu

SEQ ID NO: 170395 - RNA, 22 nt, Human
aguguggcugcguagggcucuc

SEQ ID NO: 170396 - RNA, 22 nt, Human
cagggcucaccacugggauccu

SEQ ID NO: 170397 - RNA, 22 nt, Human
gcauguguuagagugugcaugc

SEQ ID NO: 170398 - RNA, 22 nt, Human
acuuucugcaguguuggaaaug

SEQ ID NO: 170399 - RNA, 22 nt, Human
auacagaauuugcccuuuucau

SEQ ID NO: 170400 - RNA, 22 nt, Human
gcacccagcccagggcgugaug

SEQ ID NO: 170401 - RNA, 22 nt, Human
ucagcuuuuaaaaacaagaagu

SEQ ID NO: 170402 - RNA, 22 nt, Human
uccaagcucucuaugccaugau

SEQ ID NO: 170403 - RNA, 22 nt, Human
agcagggcagcuuuuuucagaa

SEQ ID NO: 170404 - RNA, 22 nt, Human
ccagauuugagcgucuuaaacc

SEQ ID NO: 170405 - RNA, 19 nt, Human
agcauuuggaauucuacac

SEQ ID NO: 170406 - RNA, 22 nt, Human
uguaauuaaacugaagacagaa

SEQ ID NO: 170407 - RNA, 22 nt, Human
guauuagguuggugcaaaauug

SEQ ID NO: 170408 - RNA, 22 nt, Human
ugguaugaccguggugcaagca

SEQ ID NO: 170409 - RNA, 22 nt, Human
uuaaagaauagugccccuauug

SEQ ID NO: 170410 - RNA, 22 nt, Human
agaagaaaugaggccguucugc

SEQ ID NO: 170411 - RNA, 22 nt, Human
aaagaaucagaagucucaaaca

SEQ ID NO: 170412 - RNA, 22 nt, Human
ucuugccucuuccccuuuccau

SEQ ID NO: 170413 - RNA, 22 nt, Human
uggguggagaaguggaccugcu

SEQ ID NO: 170414 - RNA, 18 nt, Human
ucugagguggacgaggag

SEQ ID NO: 170415 - RNA, 22 nt, Human
uucuauugggaagugugagagu

SEQ ID NO: 170416 - RNA, 22 nt, Human
guauacaugugguaaaaugcac

SEQ ID NO: 170417 - RNA, 21 nt, Human
cuacagaagcucuccuaucca

SEQ ID NO: 170418 - RNA, 22 nt, Human
aguuuacaaaguuucacuguuc

SEQ ID NO: 170419 - RNA, 22 nt, Human
ccuguucauuuuuugacucugc

SEQ ID NO: 170420 - RNA, 22 nt, Human
ucagagaguuacacaaauuguu

SEQ ID NO: 170421 - RNA, 22 nt, Human
acauucuuaacaguuaaaaacu

SEQ ID NO: 170422 - RNA, 22 nt, Human
ugggaccugcucuuggaaugag

SEQ ID NO: 170423 - RNA, 22 nt, Human
ucuucauuuuacaggcagaccu

SEQ ID NO: 170424 - RNA, 22 nt, Human
agcagggcuguguagguaauga

SEQ ID NO: 170425 - RNA, 22 nt, Human
cuuccuucaauauaauuuuuac

SEQ ID NO: 170426 - RNA, 22 nt, Human
auucugggucugggugugauca

SEQ ID NO: 170427 - RNA, 22 nt, Human
aguccuuagaacacuguaucug

SEQ ID NO: 170428 - RNA, 20 nt, Human
ggcaggugcuguccccuccu

SEQ ID NO: 170429 - RNA, 22 nt, Human
uugaaauacugcauuguucagu

SEQ ID NO: 170430 - RNA, 22 nt, Human
ucugaagauggaggaacuuaga

SEQ ID NO: 170431 - RNA, 22 nt, Human
gcaugugucuuuauagcagcau

SEQ ID NO: 170432 - RNA, 22 nt, Human
uuugaagaccuuaucucuaaau

SEQ ID NO: 170433 - RNA, 22 nt, Human
cggcaggugugcucacucugcc

SEQ ID NO: 170434 - RNA, 22 nt, Human
uuuccuaggagauugaucacau

SEQ ID NO: 170435 - RNA, 19 nt, Human
ucuuauugagcagcugagg

SEQ ID NO: 170436 - RNA, 22 nt, Human
auuauauaggacuugcccuucc

SEQ ID NO: 170437 - RNA, 22 nt, Human
ucauuuguucaucugcucuucu

SEQ ID NO: 170438 - RNA, 22 nt, Human
ucaguaaaugagcaaaaauuuc

SEQ ID NO: 170439 - RNA, 22 nt, Human
aagcugcaugaaguugaguaga

SEQ ID NO: 170440 - RNA, 22 nt, Human
uccugggucugggugucugagg

SEQ ID NO: 170441 - RNA, 22 nt, Human
auauacaaagggcaaccucgcu

SEQ ID NO: 170442 - RNA, 22 nt, Human
aaucauucuuauuucacagcaa

SEQ ID NO: 170443 - RNA, 22 nt, Human
gguggggcccuggcacugguau

SEQ ID NO: 170444 - RNA, 22 nt, Human
gauccugugguuuuccugugca

SEQ ID NO: 170445 - RNA, 23 nt, Human
ugcuggguaucagaaucacugag

SEQ ID NO: 170446 - RNA, 22 nt, Human
auaaaaguucaagagaguacag

SEQ ID NO: 170447 - RNA, 19 nt, Human
uucauucucuuauuguugu

SEQ ID NO: 170448 - RNA, 22 nt, Human
uuccaggagccacacaggggcg

SEQ ID NO: 170449 - RNA, 22 nt, Human
auuuaugauuagccuauuguug

SEQ ID NO: 170450 - RNA, 22 nt, Human
uaaaagcucuucuguugaguua

SEQ ID NO: 170451 - RNA, 22 nt, Human
guugcacaguuccucaagcagg

SEQ ID NO: 170452 - RNA, 21 nt, Human
ucucuuucuggaagcuucccu

SEQ ID NO: 170453 - RNA, 21 nt, Human
uggaggaauaaagcacagaag

SEQ ID NO: 170454 - RNA, 22 nt, Human
ucagagagaaauaguuuuugac

SEQ ID NO: 170455 - RNA, 17 nt, Human
ucuguucaugcauaccu

SEQ ID NO: 170456 - RNA, 22 nt, Human
uguauacauuuaacuagauaga

SEQ ID NO: 170457 - RNA, 20 nt, Human
ccaggccugggccugcucua

SEQ ID NO: 170458 - RNA, 22 nt, Human
uagguggugugcgaagagcgug

SEQ ID NO: 170459 - RNA, 22 nt, Human
auccugaaaacuuacgaagugg

SEQ ID NO: 170460 - RNA, 22 nt, Human
augguuuuagaaucaggaaaaa

SEQ ID NO: 170461 - RNA, 22 nt, Human
ucugucuucaucagcaugugau

SEQ ID NO: 170462 - RNA, 22 nt, Human
aaacucuguagcuaaacauaau

SEQ ID NO: 170463 - RNA, 22 nt, Human
auugaaucugcacuaguauuuu

SEQ ID NO: 170464 - RNA, 22 nt, Human
uuggaggacuaguuaagagacc

SEQ ID NO: 170465 - RNA, 22 nt, Human
cccaggcaggagugugguggcu

SEQ ID NO: 170466 - RNA, 22 nt, Human
ucuugauuacaaauaacaucau

SEQ ID NO: 170467 - RNA, 22 nt, Human
agaugggugccuucuuucuuua

SEQ ID NO: 170468 - RNA, 22 nt, Human
agaggaauaaauuucuguagug

SEQ ID NO: 170469 - RNA, 22 nt, Human
uuccugggcucuggcuggccua

SEQ ID NO: 170470 - RNA, 22 nt, Human
cuuuccaaugcauuuccaaugu

SEQ ID NO: 170471 - RNA, 21 nt, Human
uucuucaggccaaugcucauu

SEQ ID NO: 170472 - RNA, 22 nt, Human
gguguccuacugcuugguugcu

SEQ ID NO: 170473 - RNA, 22 nt, Human
uuuuccuuucaucaggacaaag

SEQ ID NO: 170474 - RNA, 22 nt, Human
aaaaggcauggagguugauagu

SEQ ID NO: 170475 - RNA, 22 nt, Human
cucuuaaagcuuccaguuucaa

SEQ ID NO: 170476 - RNA, 22 nt, Human
ugaaagcagcaccaauaccauu

SEQ ID NO: 170477 - RNA, 22 nt, Human
cagacagaccugcaagggcaca

SEQ ID NO: 170478 - RNA, 22 nt, Human
acagacuggaggagaauaguuu

SEQ ID NO: 170479 - RNA, 22 nt, Human
acaaaugucuccucuuuuguua

SEQ ID NO: 170480 - RNA, 22 nt, Human
auucuucagaauaucuggcacu

SEQ ID NO: 170481 - RNA, 22 nt, Human
ugaucuccugaccuuguaaucc

SEQ ID NO: 170482 - RNA, 18 nt, Human
acugaagaugcaagaccu

SEQ ID NO: 170483 - RNA, 22 nt, Human
gagagcacggucuugggcaugg

SEQ ID NO: 170484 - RNA, 22 nt, Human
aacacagcuaauuucugucaau

SEQ ID NO: 170485 - RNA, 18 nt, Human
uguuuauuuuucucuuac

SEQ ID NO: 170486 - RNA, 22 nt, Human
aaauacuagaauucagaguuga

SEQ ID NO: 170487 - RNA, 22 nt, Human
aagugguugcuugugagucccc

SEQ ID NO: 170488 - RNA, 22 nt, Human
aaacagcuggucucaaauguuc

SEQ ID NO: 170489 - RNA, 22 nt, Human
uuguuuacaaguuacucagucu

SEQ ID NO: 170490 - RNA, 22 nt, Human
cauuguaagcuguugaauccuc

SEQ ID NO: 170491 - RNA, 22 nt, Human
auacuuuuaauuccuucugagu

SEQ ID NO: 170492 - RNA, 22 nt, Human
acaagaaagguaggauucaggu

SEQ ID NO: 170493 - RNA, 22 nt, Human
ugagagaguaauugagugguaa

SEQ ID NO: 170494 - RNA, 22 nt, Human
gccaggcgggucucaaacuccu

SEQ ID NO: 170495 - RNA, 22 nt, Human
uuuauugcccuguaguacagga

SEQ ID NO: 170496 - RNA, 22 nt, Human
accaggcaugauguggagcaca

SEQ ID NO: 170497 - RNA, 22 nt, Human
uuuaugaacuacagauauaacu

SEQ ID NO: 170498 - RNA, 22 nt, Human
gcuggcuggcgggugcguccuc

SEQ ID NO: 170499 - RNA, 22 nt, Human
uauugcugccaggacccuaucc

SEQ ID NO: 170500 - RNA, 22 nt, Human
guuaaagaguuuggcuuucuuc

SEQ ID NO: 170501 - RNA, 22 nt, Human
auggcuuucagauggugaaaga

SEQ ID NO: 170502 - RNA, 22 nt, Human
cagacaggguggguuucugggc

SEQ ID NO: 170503 - RNA, 22 nt, Human
ccagagaggccuuggcaagaca

SEQ ID NO: 170504 - RNA, 22 nt, Human
acauguguaagaugugauauau

SEQ ID NO: 170505 - RNA, 22 nt, Human
aggcagguguuaacccucugag

SEQ ID NO: 170506 - RNA, 22 nt, Human
gcagguggaucaccacgucagg

SEQ ID NO: 170507 - RNA, 22 nt, Human
uucacaauagcuggcaucaucu

SEQ ID NO: 170508 - RNA, 22 nt, Human
uuugcugauauuuugcugauac

SEQ ID NO: 170509 - RNA, 22 nt, Human
cuuccaaauguaaauaaguuuc

SEQ ID NO: 170510 - RNA, 22 nt, Human
caaugauugcuauuuacauaaa

SEQ ID NO: 170511 - RNA, 22 nt, Human
gccaggcagcagcgaggauggu

SEQ ID NO: 170512 - RNA, 22 nt, Human
ucaguucaguauacacuauucu

SEQ ID NO: 170513 - RNA, 22 nt, Human
guguguccaaggccacaauagc

SEQ ID NO: 170514 - RNA, 22 nt, Human
agacagguaaauagagaugcug

SEQ ID NO: 170515 - RNA, 22 nt, Human
ucugaagagaaugcugcugaac

SEQ ID NO: 170516 - RNA, 22 nt, Human
uuccaugacugaagcaggggcg

SEQ ID NO: 170517 - RNA, 22 nt, Human
ucacugggagaugugggaaggg

SEQ ID NO: 170518 - RNA, 21 nt, Human
guuuucaugauagagucugua

SEQ ID NO: 170519 - RNA, 20 nt, Human
cucuuaaauguaaaguaggc

SEQ ID NO: 170520 - RNA, 22 nt, Human
gccaggcaugggcuucugggcg

SEQ ID NO: 170521 - RNA, 22 nt, Human
ucuaaagaagaggguucugcgg

SEQ ID NO: 170522 - RNA, 22 nt, Human
ugcuuuaagagauuguuaguac

SEQ ID NO: 170523 - RNA, 22 nt, Human
ucaagaaagggcuucaccagga

SEQ ID NO: 170524 - RNA, 22 nt, Human
ugaaugauguauaauauugaga

SEQ ID NO: 170525 - RNA, 22 nt, Human
uguacaaugcugagguuugggg

SEQ ID NO: 170526 - RNA, 20 nt, Human
caccagucaugagucaauac

SEQ ID NO: 170527 - RNA, 22 nt, Human
guagaaaugguguguuucuucu

SEQ ID NO: 170528 - RNA, 22 nt, Human
uucagaaaugaauauugguauu

SEQ ID NO: 170529 - RNA, 22 nt, Human
cuaugacacaggccauuauaua

SEQ ID NO: 170530 - RNA, 22 nt, Human
auuguauaagucuauuuacaau

SEQ ID NO: 170531 - RNA, 22 nt, Human
aagcugcagacccccugucuca

SEQ ID NO: 170532 - RNA, 22 nt, Human
cauuuaaagguuguggguaaaa

SEQ ID NO: 170533 - RNA, 22 nt, Human
ucucuuaaaagauuuuaaugac

SEQ ID NO: 170534 - RNA, 22 nt, Human
aggugggguguuggauguuuau

SEQ ID NO: 170535 - RNA, 22 nt, Human
uauaauuuuagaagagauggaa

SEQ ID NO: 170536 - RNA, 21 nt, Human
uucaaagacuugaugcugacc

SEQ ID NO: 170537 - RNA, 22 nt, Human
aaguucuaauuuugcauucagg

SEQ ID NO: 170538 - RNA, 22 nt, Human
ucuucaaaugcuaguaauauca

SEQ ID NO: 170539 - RNA, 21 nt, Human
ccuucuccacagggucuccgg

SEQ ID NO: 170540 - RNA, 20 nt, Human
gcagagugugagagggugaa

SEQ ID NO: 170541 - RNA, 22 nt, Human
gggaggaaaugugcagcgaauu

SEQ ID NO: 170542 - RNA, 22 nt, Human
aucuagaacuuaaagucaguca

SEQ ID NO: 170543 - RNA, 22 nt, Human
augaauaaacaggugccucuuc

SEQ ID NO: 170544 - RNA, 22 nt, Human
gugcaaagugcauggggaaggg

SEQ ID NO: 170545 - RNA, 20 nt, Human
uagggcucauuaugaucucc

SEQ ID NO: 170546 - RNA, 22 nt, Human
uguguccucacuguaugcaagg

SEQ ID NO: 170547 - RNA, 22 nt, Human
ggcaggcaucauguggucauua

SEQ ID NO: 170548 - RNA, 22 nt, Human
guuauugagguggagucucacu

SEQ ID NO: 170549 - RNA, 17 nt, Human
uccauacaauucucucu

SEQ ID NO: 170550 - RNA, 22 nt, Human
caugaggucagggggagccggu

SEQ ID NO: 170551 - RNA, 22 nt, Human
ugaagaaucagauuggccugcg

SEQ ID NO: 170552 - RNA, 22 nt, Human
cccagcuugucugauucagccu

SEQ ID NO: 170553 - RNA, 21 nt, Human
aucauucuggaaaauucaagc

SEQ ID NO: 170554 - RNA, 22 nt, Human
agauauaauaauuuacaagugu

SEQ ID NO: 170555 - RNA, 22 nt, Human
guuauuaguaagacucgcacau

SEQ ID NO: 170556 - RNA, 22 nt, Human
ugcuuuauguuaucagaagggu

SEQ ID NO: 170557 - RNA, 22 nt, Human
agacagacaugcuaguuuucuu

SEQ ID NO: 170558 - RNA, 22 nt, Human
acccaggcugcuucucaguggc

SEQ ID NO: 170559 - RNA, 22 nt, Human
gauuuucugagccuucaaauuu

SEQ ID NO: 170560 - RNA, 22 nt, Human
uccauucuuuuuaccucucaga

SEQ ID NO: 170561 - RNA, 22 nt, Human
ucccaaggccaggcaucuagaa

SEQ ID NO: 170562 - RNA, 22 nt, Human
uucauuaauucauucagugacu

SEQ ID NO: 170563 - RNA, 22 nt, Human
gaguccuugucauaauucagug

SEQ ID NO: 170564 - RNA, 22 nt, Human
cagggcagggagcuuagaauga

SEQ ID NO: 170565 - RNA, 22 nt, Human
cuguccugaguucuuggagguc

SEQ ID NO: 170566 - RNA, 22 nt, Human
cugaggcugggcauggggucca

SEQ ID NO: 170567 - RNA, 22 nt, Human
aguauacauauauuagccuucg

SEQ ID NO: 170568 - RNA, 22 nt, Human
uacugcaugguggaguggagcu

SEQ ID NO: 170569 - RNA, 22 nt, Human
uauuuguauguguguacauaua

SEQ ID NO: 170570 - RNA, 22 nt, Human
aacuuucagaauccuaugcauu

SEQ ID NO: 170571 - RNA, 22 nt, Human
acuugguggcgaacgaggguca

SEQ ID NO: 170572 - RNA, 22 nt, Human
acucugaaugugcauguaaauc

SEQ ID NO: 170573 - RNA, 22 nt, Human
ucuuuaauauaaaggaaugaau

SEQ ID NO: 170574 - RNA, 22 nt, Human
agcagggcuccauuucacugcc

SEQ ID NO: 170575 - RNA, 22 nt, Human
uggcuuuauaaauccacugguu

SEQ ID NO: 170576 - RNA, 21 nt, Human
uuccuggggacuuccguggga

SEQ ID NO: 170577 - RNA, 22 nt, Human
gccugcagccagggaguucucu

SEQ ID NO: 170578 - RNA, 22 nt, Human
gaauuuaaggaccaagcauuuu

SEQ ID NO: 170579 - RNA, 18 nt, Human
ucauuuguuuugcaugaa

SEQ ID NO: 170580 - RNA, 22 nt, Human
uaauuucuagggacuaaggugc

SEQ ID NO: 170581 - RNA, 22 nt, Human
caauuucacuaaugaugugggg

SEQ ID NO: 170582 - RNA, 22 nt, Human
ggacaggugcaaagggcacaug

SEQ ID NO: 170583 - RNA, 22 nt, Human
uuauacaguuuauacuuagaau

SEQ ID NO: 170584 - RNA, 22 nt, Human
gacagguguguguauauuaggg

SEQ ID NO: 170585 - RNA, 18 nt, Human
uggaggaaaaaucucaug

SEQ ID NO: 170586 - RNA, 22 nt, Human
aacccgggaggcagagguugug

SEQ ID NO: 170587 - RNA, 22 nt, Human
uuccuuccuccuccaguucugg

SEQ ID NO: 170588 - RNA, 22 nt, Human
ugaggaauggcuuaauguggga

SEQ ID NO: 170589 - RNA, 22 nt, Human
acaugaaacuguugcauuagaa

SEQ ID NO: 170590 - RNA, 22 nt, Human
auuuccaguccuaaugaucugg

SEQ ID NO: 170591 - RNA, 22 nt, Human
uucagauguggcuuugucaggc

SEQ ID NO: 170592 - RNA, 20 nt, Human
gaguccuuaugggcugaggu

SEQ ID NO: 170593 - RNA, 22 nt, Human
guguaaaaacauacuauuucua

SEQ ID NO: 170594 - RNA, 22 nt, Human
gucuucuuguguugccugucuu

SEQ ID NO: 170595 - RNA, 22 nt, Human
uuuaaaauuuagaccucuccac

SEQ ID NO: 170596 - RNA, 22 nt, Human
caauauauaggaacaacuuagg

SEQ ID NO: 170597 - RNA, 22 nt, Human
cugcagggaccacaagcagguu

SEQ ID NO: 170598 - RNA, 22 nt, Human
ggugggaguggaacguggaaga

SEQ ID NO: 170599 - RNA, 22 nt, Human
ucagcuuugggggucucaggag

SEQ ID NO: 170600 - RNA, 22 nt, Human
ggcuuuugcuguguuuuccaga

SEQ ID NO: 170601 - RNA, 20 nt, Human
uaggugucuuugccagcuuu

SEQ ID NO: 170602 - RNA, 22 nt, Human
gggaccuggggacuccuuguuc

SEQ ID NO: 170603 - RNA, 20 nt, Human
cccugcagccaugggagugg

SEQ ID NO: 170604 - RNA, 22 nt, Human
ugcugggucccuugagagcuca

SEQ ID NO: 170605 - RNA, 22 nt, Human
acagagagggagugauaaaucc

SEQ ID NO: 170606 - RNA, 22 nt, Human
guccugucccccaaggcugugg

SEQ ID NO: 170607 - RNA, 22 nt, Human
uuuuauuaucuuugaaugggac

SEQ ID NO: 170608 - RNA, 22 nt, Human
aaaugucagaagcuuuacuucu

SEQ ID NO: 170609 - RNA, 22 nt, Human
ccuguucaagggaugauugacc

SEQ ID NO: 170610 - RNA, 22 nt, Human
gguccucaaucccaacaaggca

SEQ ID NO: 170611 - RNA, 22 nt, Human
uuuauacuccacucugcaagcg

SEQ ID NO: 170612 - RNA, 22 nt, Human
cuguccugucugcuuuuaauuu

SEQ ID NO: 170613 - RNA, 22 nt, Human
ggaccuggcaauuugcaucucu

SEQ ID NO: 170614 - RNA, 22 nt, Human
aaauauagcaauuaugccuacu

SEQ ID NO: 170615 - RNA, 22 nt, Human
uagaacuacaagcauuaaaagu

SEQ ID NO: 170616 - RNA, 22 nt, Human
acacuaaugagaaaggaauuaa

SEQ ID NO: 170617 - RNA, 22 nt, Human
ugcagggaaagggcacugggcu

SEQ ID NO: 170618 - RNA, 22 nt, Human
ugauguccucaugucaagcucc

SEQ ID NO: 170619 - RNA, 22 nt, Human
gguacaauggaccauaaaagcu

SEQ ID NO: 170620 - RNA, 22 nt, Human
gucacagaguuauuaauugugu

SEQ ID NO: 170621 - RNA, 23 nt, Human
uuuuaauuuggacauaagaagau

SEQ ID NO: 170622 - RNA, 22 nt, Human
ggcuuuauuaacucauccguaa

SEQ ID NO: 170623 - RNA, 20 nt, Human
cugaagaguggccugaucug

SEQ ID NO: 170624 - RNA, 22 nt, Human
gggacagacccaugggccaggu

SEQ ID NO: 170625 - RNA, 22 nt, Human
ugcuggaauaauuucauguuaa

SEQ ID NO: 170626 - RNA, 22 nt, Human
acagaggguguggaggaagacg

SEQ ID NO: 170627 - RNA, 22 nt, Human
auguaauuugcccucaaguuaa

SEQ ID NO: 170628 - RNA, 22 nt, Human
ucagagaggauuuuaauaagug

SEQ ID NO: 170629 - RNA, 22 nt, Human
cagucaccuagacagaacuuac

SEQ ID NO: 170630 - RNA, 22 nt, Human
gacuuuauuauaguggcaauag

SEQ ID NO: 170631 - RNA, 23 nt, Human
agaucugauguuaccaagaauug

SEQ ID NO: 170632 - RNA, 22 nt, Human
cccugcagaucagugagaacuu

SEQ ID NO: 170633 - RNA, 22 nt, Human
uauuuuaaagugaagggucuug

SEQ ID NO: 170634 - RNA, 22 nt, Human
auguccagaguaaagcacauuc

SEQ ID NO: 170635 - RNA, 22 nt, Human
ugcagggcacggugcgcguggg

SEQ ID NO: 170636 - RNA, 22 nt, Human
uucauagugauuguucagauag

SEQ ID NO: 170637 - RNA, 22 nt, Human
gagggaaagguuaauacaugau

SEQ ID NO: 170638 - RNA, 22 nt, Human
uacuacaaggccgaagcucuca

SEQ ID NO: 170639 - RNA, 22 nt, Human
ugaaagaagccucccuuuggag

SEQ ID NO: 170640 - RNA, 22 nt, Human
uucuuaaagaggcaaaacacag

SEQ ID NO: 170641 - RNA, 22 nt, Human
aagauuuagggccaguuuacau

SEQ ID NO: 170642 - RNA, 22 nt, Human
auugcuuuuccuuaacacaugc

SEQ ID NO: 170643 - RNA, 22 nt, Human
auugcugaacuuauaaaugaau

SEQ ID NO: 170644 - RNA, 22 nt, Human
uccaggcaagggaggagcaugg

SEQ ID NO: 170645 - RNA, 22 nt, Human
ccaguguguuaguggauuuccc

SEQ ID NO: 170646 - RNA, 22 nt, Human
uuguccugcaaccucacauggc

SEQ ID NO: 170647 - RNA, 22 nt, Human
ugaaugaauccuaacaaagaca

SEQ ID NO: 170648 - RNA, 22 nt, Human
aaguccaguuucauuugagguc

SEQ ID NO: 170649 - RNA, 23 nt, Human
ucauaaauauuagcacaguagga

SEQ ID NO: 170650 - RNA, 22 nt, Human
cagggcuccaugcagggacucc

SEQ ID NO: 170651 - RNA, 22 nt, Human
ccugcuccugcuauucuucugg

SEQ ID NO: 170652 - RNA, 22 nt, Human
auaacauuuugacaacugguga

SEQ ID NO: 170653 - RNA, 22 nt, Human
guuaaagaagaauaguuccuuu

SEQ ID NO: 170654 - RNA, 22 nt, Human
gacacuuuaggauuuaaaaguc

SEQ ID NO: 170655 - RNA, 22 nt, Human
uggcagaaagaaccaugugcaa

SEQ ID NO: 170656 - RNA, 22 nt, Human
uccucagaaaccccugugaggu

SEQ ID NO: 170657 - RNA, 22 nt, Human
ucauuuggaagccugagagugu

SEQ ID NO: 170658 - RNA, 23 nt, Human
uauuacaauuggucuuauuaaga

SEQ ID NO: 170659 - RNA, 22 nt, Human
gauuuacaaagcucucuagugu

SEQ ID NO: 170660 - RNA, 22 nt, Human
ucaugaaucguggaaugauuua

SEQ ID NO: 170661 - RNA, 21 nt, Human
cauuuacaugacagauugguu

SEQ ID NO: 170662 - RNA, 22 nt, Human
cuguccuggugcuggggauccc

SEQ ID NO: 170663 - RNA, 22 nt, Human
cuuaggcaaccaggucaaugcu

SEQ ID NO: 170664 - RNA, 22 nt, Human
gggcaggggucaguggccccaa

SEQ ID NO: 170665 - RNA, 22 nt, Human
uuguuaaaaauagauuuccagg

SEQ ID NO: 170666 - RNA, 22 nt, Human
uuagcuuuucacuugcauuauc

SEQ ID NO: 170667 - RNA, 22 nt, Human
ccuguucaaguugcagggcugg

SEQ ID NO: 170668 - RNA, 22 nt, Human
gagaagcaaucaguggccaccc

SEQ ID NO: 170669 - RNA, 22 nt, Human
acagguggcauaggcaguuuga

SEQ ID NO: 170670 - RNA, 22 nt, Human
ugcugccaagcccgugcuccug

SEQ ID NO: 170671 - RNA, 22 nt, Human
ucagguggagaccuccuuggcc

SEQ ID NO: 170672 - RNA, 22 nt, Human
cuuccugcuccccugccaauuc

SEQ ID NO: 170673 - RNA, 22 nt, Human
acauaucuuucccucuccugaa

SEQ ID NO: 170674 - RNA, 22 nt, Human
uggaccugcuggaugggcaggu

SEQ ID NO: 170675 - RNA, 23 nt, Human
aggauuuaaaggcaaugcauuuu

SEQ ID NO: 170676 - RNA, 22 nt, Human
agcugcaacaucugcuuguccc

SEQ ID NO: 170677 - RNA, 22 nt, Human
ucuguucaagacugaggugaca

SEQ ID NO: 170678 - RNA, 22 nt, Human
ugaaauaauaucuggaucaauc

SEQ ID NO: 170679 - RNA, 22 nt, Human
agugaggggcagcugagugggc

SEQ ID NO: 170680 - RNA, 22 nt, Human
uuuaggcaaauuucagaugugc

SEQ ID NO: 170681 - RNA, 22 nt, Human
uggcuuaagauuuaugcuuuua

SEQ ID NO: 170682 - RNA, 22 nt, Human
ugaccugcguaggugguuucug

SEQ ID NO: 170683 - RNA, 22 nt, Human
augauugcagcccuacagcugu

SEQ ID NO: 170684 - RNA, 22 nt, Human
aagggcagggaguuugugucua

SEQ ID NO: 170685 - RNA, 22 nt, Human
acagguguccucacagggggug

SEQ ID NO: 170686 - RNA, 22 nt, Human
cuucuuaacuguauauacuaug

SEQ ID NO: 170687 - RNA, 22 nt, Human
cucagagaaaugucacaacaau

SEQ ID NO: 170688 - RNA, 22 nt, Human
aaugauuuggcaaaggaaucca

SEQ ID NO: 170689 - RNA, 22 nt, Human
aguacaaugucugacacaguag

SEQ ID NO: 170690 - RNA, 22 nt, Human
acaggugucugcaaguuacugg

SEQ ID NO: 170691 - RNA, 22 nt, Human
auaucagaaauaguaagcagag

SEQ ID NO: 170692 - RNA, 22 nt, Human
augcauugucugguuucauuuu

SEQ ID NO: 170693 - RNA, 22 nt, Human
uugcuuuaccauuugaucucua

SEQ ID NO: 170694 - RNA, 22 nt, Human
acagugugguuugagcacuggg

SEQ ID NO: 170695 - RNA, 22 nt, Human
uucuucaaagaugucuguugga

SEQ ID NO: 170696 - RNA, 22 nt, Human
ugucaccagcugcuccucagga

SEQ ID NO: 170697 - RNA, 22 nt, Human
uuucccaguucccugcucuaua

SEQ ID NO: 170698 - RNA, 18 nt, Human
auugcuuuuguaccaacc

SEQ ID NO: 170699 - RNA, 23 nt, Human
uucuuucaagaaguucacagugc

SEQ ID NO: 170700 - RNA, 22 nt, Human
agagggugggcacgugauggau

SEQ ID NO: 170701 - RNA, 22 nt, Human
agaucugaaucucauccgagga

SEQ ID NO: 170702 - RNA, 21 nt, Human
caagccagaccaauagcagcc

SEQ ID NO: 170703 - RNA, 22 nt, Human
aauauuaucaaaagcuuuuuca

SEQ ID NO: 170704 - RNA, 22 nt, Human
auguguaugcaugcacuaagau

SEQ ID NO: 170705 - RNA, 22 nt, Human
cuuucaacuacauacaggcgau

SEQ ID NO: 170706 - RNA, 22 nt, Human
gcaaauacauguugagcaccua

SEQ ID NO: 170707 - RNA, 22 nt, Human
gcuuggccagcagccgggaugc

SEQ ID NO: 170708 - RNA, 22 nt, Human
uaagacuucauuaguaauaugg

SEQ ID NO: 170709 - RNA, 22 nt, Human
ugaaugaaugaauuaauagagu

SEQ ID NO: 170710 - RNA, 22 nt, Human
ugucaaaaugacuuuacuacag

SEQ ID NO: 170711 - RNA, 22 nt, Human
uaguccuuacuuacuagaauaa

SEQ ID NO: 170712 - RNA, 22 nt, Human
uuucucagucacaugaaccaau

SEQ ID NO: 170713 - RNA, 22 nt, Human
cuggcugggagcgagcugcuca

SEQ ID NO: 170714 - RNA, 22 nt, Human
uugcuuuauguguaugacuuga

SEQ ID NO: 170715 - RNA, 22 nt, Human
gguuucaacuucaaccucucca

SEQ ID NO: 170716 - RNA, 22 nt, Human
cucuccaggacuuuggcccaau

SEQ ID NO: 170717 - RNA, 22 nt, Human
cauggaauuuucuaggcauaaa

SEQ ID NO: 170718 - RNA, 22 nt, Human
aacacuuugggcauggccuucc

SEQ ID NO: 170719 - RNA, 22 nt, Human
uauuccaguccuauccucuuuu

SEQ ID NO: 170720 - RNA, 22 nt, Human
caaagccaggcuuucuaaugua

SEQ ID NO: 170721 - RNA, 22 nt, Human
acuguucaagcaaaugacauug

SEQ ID NO: 170722 - RNA, 22 nt, Human
cuguguccugucuccuaaggug

SEQ ID NO: 170723 - RNA, 22 nt, Human
uugcuuuaaugagauuuugcca

SEQ ID NO: 170724 - RNA, 22 nt, Human
auuaaagacagcagauggaugg

SEQ ID NO: 170725 - RNA, 22 nt, Human
aguaaaaucaccaucucuuugu

SEQ ID NO: 170726 - RNA, 21 nt, Human
auggcuuuuuuaaagcuugug

SEQ ID NO: 170727 - RNA, 22 nt, Human
acauguguuuuccuacuuauga

SEQ ID NO: 170728 - RNA, 22 nt, Human
aggaccuguagggccugcaucc

SEQ ID NO: 170729 - RNA, 22 nt, Human
caguguggcugagacagaggcu

SEQ ID NO: 170730 - RNA, 22 nt, Human
caauuucagaccuuuccuugga

SEQ ID NO: 170731 - RNA, 22 nt, Human
ugaaaagacugcaagagagcau

SEQ ID NO: 170732 - RNA, 22 nt, Human
augaguugaagcuacaagaggc

SEQ ID NO: 170733 - RNA, 22 nt, Human
cuuaauuuuuguaguagaugga

SEQ ID NO: 170734 - RNA, 15 nt, Human
gggcaggucuggggc

SEQ ID NO: 170735 - RNA, 22 nt, Human
ugcaugaacacaugugcaugua

SEQ ID NO: 170736 - RNA, 22 nt, Human
cuuucucaaugccggaaggcac

SEQ ID NO: 170737 - RNA, 20 nt, Human
aguacaauguaugauucaga

SEQ ID NO: 170738 - RNA, 22 nt, Human
cugcagggaugugaggcccguu

SEQ ID NO: 170739 - RNA, 22 nt, Human
gcuguucauagaaauggucuca

SEQ ID NO: 170740 - RNA, 22 nt, Human
cagcuuuggcccagucgggagg

SEQ ID NO: 170741 - RNA, 23 nt, Human
ucucuuucaagagcuuaaugugc

SEQ ID NO: 170742 - RNA, 22 nt, Human
agagugauucuaguuagggaau

SEQ ID NO: 170743 - RNA, 22 nt, Human
cacgguggcccacaggugcaag

SEQ ID NO: 170744 - RNA, 22 nt, Human
cauuugaauuguucugugggaa

SEQ ID NO: 170745 - RNA, 22 nt, Human
ucaauaaaauuguuuuccuauc

SEQ ID NO: 170746 - RNA, 22 nt, Human
aaauaauguuaggccuuugcuc

SEQ ID NO: 170747 - RNA, 22 nt, Human
gguguccucggauucagggcag

SEQ ID NO: 170748 - RNA, 22 nt, Human
gugaaaauaaggcugguucuug

SEQ ID NO: 170749 - RNA, 22 nt, Human
cuggcuguaacauuuugccaua

SEQ ID NO: 170750 - RNA, 22 nt, Human
aggaccauccuaagguaggcaa

SEQ ID NO: 170751 - RNA, 20 nt, Human
cagggcucugggccuggccu

SEQ ID NO: 170752 - RNA, 22 nt, Human
uaucugagaaagaagcaccaga

SEQ ID NO: 170753 - RNA, 22 nt, Human
aaggcuuuugggaauuuucaac

SEQ ID NO: 170754 - RNA, 22 nt, Human
uacauguuugguaaaugauggc

SEQ ID NO: 170755 - RNA, 19 nt, Human
uuucagacucaucuccagc

SEQ ID NO: 170756 - RNA, 22 nt, Human
cugacagaugcugcuggcagua

SEQ ID NO: 170757 - RNA, 22 nt, Human
uaagaaacauuuuuaugacagu

SEQ ID NO: 170758 - RNA, 22 nt, Human
gcagcuuuggagguggaacucu

SEQ ID NO: 170759 - RNA, 22 nt, Human
ucuguucagaagaggugaaagu

SEQ ID NO: 170760 - RNA, 22 nt, Human
gaggcauaaguagaagagauug

SEQ ID NO: 170761 - RNA, 22 nt, Human
aaguccuuauguggaggggcua

SEQ ID NO: 170762 - RNA, 22 nt, Human
uuucauugucaauaaacuguau

SEQ ID NO: 170763 - RNA, 22 nt, Human
gcaggugugcugaauuacguga

SEQ ID NO: 170764 - RNA, 23 nt, Human
gauugcuguaugcaggagcauuc

SEQ ID NO: 170765 - RNA, 22 nt, Human
auaugauuccacuauuguaugg

SEQ ID NO: 170766 - RNA, 22 nt, Human
acaacuuucuggguuaucugau

SEQ ID NO: 170767 - RNA, 22 nt, Human
uuccaugccucuauuuagaauu

SEQ ID NO: 170768 - RNA, 22 nt, Human
aaucuucuacuugacaguucuc

SEQ ID NO: 170769 - RNA, 22 nt, Human
uccaggcauguugggaagauga

SEQ ID NO: 170770 - RNA, 22 nt, Human
cuuugcaaacugucacacuuuc

SEQ ID NO: 170771 - RNA, 22 nt, Human
auuauuaggugcucucugacaa

SEQ ID NO: 170772 - RNA, 22 nt, Human
uagggcagccuuauagcuccca

SEQ ID NO: 170773 - RNA, 22 nt, Human
ugugauauuugaguauugucaa

SEQ ID NO: 170774 - RNA, 22 nt, Human
ccaggccuggaccaugccaggg

SEQ ID NO: 170775 - RNA, 22 nt, Human
acagguggcacugcuguuacuc

SEQ ID NO: 170776 - RNA, 22 nt, Human
agucaguguucuggguuguaau

SEQ ID NO: 170777 - RNA, 22 nt, Human
uuuuauugucucccaguucugg

SEQ ID NO: 170778 - RNA, 22 nt, Human
ucuggguggcugccaaucugcc

SEQ ID NO: 170779 - RNA, 22 nt, Human
guauagaaacccagaaagauag

SEQ ID NO: 170780 - RNA, 22 nt, Human
gaauauauuggugaaaauaguu

SEQ ID NO: 170781 - RNA, 21 nt, Human
agacaggucagggagagguga

SEQ ID NO: 170782 - RNA, 22 nt, Human
ugcaaaaaggcagacuggugau

SEQ ID NO: 170783 - RNA, 22 nt, Human
uuucacauaaauauuaugccua

SEQ ID NO: 170784 - RNA, 22 nt, Human
cugaauaauauuccauuaugag

SEQ ID NO: 170785 - RNA, 22 nt, Human
agaugaaaauacgugacuuuaa

SEQ ID NO: 170786 - RNA, 22 nt, Human
acuacaguacuauaucuauagg

SEQ ID NO: 170787 - RNA, 22 nt, Human
aucuacccacugaacacaauau

SEQ ID NO: 170788 - RNA, 22 nt, Human
gaucagaauuuacuuauaauug

SEQ ID NO: 170789 - RNA, 22 nt, Human
aaagauuuaagaauaauuugug

SEQ ID NO: 170790 - RNA, 22 nt, Human
ugaguacucggagugcuuugga

SEQ ID NO: 170791 - RNA, 22 nt, Human
augguuuaaagaguaugacuuu

SEQ ID NO: 170792 - RNA, 22 nt, Human
uccuggauaucaaacaaacauu

SEQ ID NO: 170793 - RNA, 22 nt, Human
uucucuuuugugaugugagaug

SEQ ID NO: 170794 - RNA, 20 nt, Human
uccaugaguuagagacuaua

SEQ ID NO: 170795 - RNA, 15 nt, Human
uuggaggauguagua

SEQ ID NO: 170796 - RNA, 22 nt, Human
caguucuuuguggggaguucuc

SEQ ID NO: 170797 - RNA, 19 nt, Human
uccagaugauauggauuac

SEQ ID NO: 170798 - RNA, 22 nt, Human
acauuucucuugaugucucuau

SEQ ID NO: 170799 - RNA, 22 nt, Human
cacaugugcaaauacugaggcu

SEQ ID NO: 170800 - RNA, 22 nt, Human
ggcuggguacagggcagugugc

SEQ ID NO: 170801 - RNA, 18 nt, Human
ucagagagcagcuuuauu

SEQ ID NO: 170802 - RNA, 22 nt, Human
uauuacaauuuacauugcacuu

SEQ ID NO: 170803 - RNA, 22 nt, Human
ccugggucuugguucaugcucu

SEQ ID NO: 170804 - RNA, 22 nt, Human
gaucagaauucuuguguguuuc

SEQ ID NO: 170805 - RNA, 22 nt, Human
uuggauuacaugaaaugcagaa

SEQ ID NO: 170806 - RNA, 22 nt, Human
cagaguggcgacccccucagcu

SEQ ID NO: 170807 - RNA, 22 nt, Human
gacauaauccuccucaccuacu

SEQ ID NO: 170808 - RNA, 22 nt, Human
cucauacauaugccauuccugc

SEQ ID NO: 170809 - RNA, 22 nt, Human
ucuuuaauuguggaagagcagc

SEQ ID NO: 170810 - RNA, 22 nt, Human
ugucuuuauauauuuggaaaau

SEQ ID NO: 170811 - RNA, 22 nt, Human
aucuuucaguuucauaccaauu

SEQ ID NO: 170812 - RNA, 22 nt, Human
gguccuuugaaagggguguguc

SEQ ID NO: 170813 - RNA, 22 nt, Human
ggggcuccagucuucacauuuu

SEQ ID NO: 170814 - RNA, 22 nt, Human
gacagacauuuccugauccaau

SEQ ID NO: 170815 - RNA, 22 nt, Human
cauuuccacucugggagucaga

SEQ ID NO: 170816 - RNA, 21 nt, Human
caugugucuuguguuacugcu

SEQ ID NO: 170817 - RNA, 22 nt, Human
ugcaggugguacuucuuuuucu

SEQ ID NO: 170818 - RNA, 22 nt, Human
uagaaacagaaaacuguaauag

SEQ ID NO: 170819 - RNA, 22 nt, Human
cuccgcagcgggccaauccgga

SEQ ID NO: 170820 - RNA, 16 nt, Human
gcagguggaucaccug

SEQ ID NO: 170821 - RNA, 22 nt, Human
ugcauuuuuaacaaggcuaauu

SEQ ID NO: 170822 - RNA, 22 nt, Human
uugcuuuauauucaagagagga

SEQ ID NO: 170823 - RNA, 22 nt, Human
uccaggcagagcaacaaaauau

SEQ ID NO: 170824 - RNA, 22 nt, Human
ccuauacagccucagcugagau

SEQ ID NO: 170825 - RNA, 22 nt, Human
agcugcaauacccuucuuccuu

SEQ ID NO: 170826 - RNA, 22 nt, Human
uagggaugaagaugguauuucu

SEQ ID NO: 170827 - RNA, 22 nt, Human
ugcuauacggagcaucuucagg

SEQ ID NO: 170828 - RNA, 22 nt, Human
uggcagggccugcucaucaucc

SEQ ID NO: 170829 - RNA, 22 nt, Human
gagggcagagacagugauucac

SEQ ID NO: 170830 - RNA, 17 nt, Human
ccuuccucaucuccuuc

SEQ ID NO: 170831 - RNA, 22 nt, Human
guguguccaggcgggagucaag

SEQ ID NO: 170832 - RNA, 22 nt, Human
gaaggcuguuucugguagugau

SEQ ID NO: 170833 - RNA, 22 nt, Human
agguggucuuaaacugcucugg

SEQ ID NO: 170834 - RNA, 21 nt, Human
guuauugaccuccaggcuggc

SEQ ID NO: 170835 - RNA, 22 nt, Human
aauucuauaggcaagcuauuuu

SEQ ID NO: 170836 - RNA, 22 nt, Human
guauuaggaaauaugaagaaag

SEQ ID NO: 170837 - RNA, 22 nt, Human
ugggcaggagagaagcuaaaga

SEQ ID NO: 170838 - RNA, 22 nt, Human
uucauguaauuccauaagguaa

SEQ ID NO: 170839 - RNA, 22 nt, Human
ucauuacaguguuuauaugucu

SEQ ID NO: 170840 - RNA, 22 nt, Human
acugaugaagaguaccacuguu

SEQ ID NO: 170841 - RNA, 22 nt, Human
agaagcuaggcuagacaaguga

SEQ ID NO: 170842 - RNA, 22 nt, Human
cauguuaaugaauuuuugcagu

SEQ ID NO: 170843 - RNA, 21 nt, Human
aguugcugcugcugcagguga

SEQ ID NO: 170844 - RNA, 22 nt, Human
auugaaaauaaggccagaaaca

SEQ ID NO: 170845 - RNA, 22 nt, Human
cuguguccauuuaucauuguca

SEQ ID NO: 170846 - RNA, 22 nt, Human
auaguguuacccuucuuaaagu

SEQ ID NO: 170847 - RNA, 22 nt, Human
ugucugggauguaauuccugcc

SEQ ID NO: 170848 - RNA, 22 nt, Human
agauaaugaaugccaugacauu

SEQ ID NO: 170849 - RNA, 22 nt, Human
aacauauaaacucuuaaguuca

SEQ ID NO: 170850 - RNA, 22 nt, Human
ugucaauauguaauaacugaau

SEQ ID NO: 170851 - RNA, 22 nt, Human
uaggauuuaggcuuuaacaucu

SEQ ID NO: 170852 - RNA, 22 nt, Human
caaaugauaccuauuacuaggc

SEQ ID NO: 170853 - RNA, 22 nt, Human
aggcucccaagcacugacccca

SEQ ID NO: 170854 - RNA, 22 nt, Human
augaaaauacugugguugauag

SEQ ID NO: 170855 - RNA, 22 nt, Human
uauccaaacauauagucucucu

SEQ ID NO: 170856 - RNA, 22 nt, Human
agcuuuaugcuuccuacaagcu

SEQ ID NO: 170857 - RNA, 22 nt, Human
uccuccuucgggacugcuugac

SEQ ID NO: 170858 - RNA, 22 nt, Human
aguaaacauuucagauuuauuu

SEQ ID NO: 170859 - RNA, 22 nt, Human
uuuauccaaggguuuuaacugu

SEQ ID NO: 170860 - RNA, 22 nt, Human
ccuucuccccucugcagggugu

SEQ ID NO: 170861 - RNA, 22 nt, Human
acuguacuuuagaaaguguagu

SEQ ID NO: 170862 - RNA, 22 nt, Human
cacaggugugugccuuaucaaa

SEQ ID NO: 170863 - RNA, 22 nt, Human
cagcuuuauuaaugauugucuu

SEQ ID NO: 170864 - RNA, 22 nt, Human
gaggccagaaugagcugaaugc

SEQ ID NO: 170865 - RNA, 22 nt, Human
uagaaacauguucuguucuguu

SEQ ID NO: 170866 - RNA, 22 nt, Human
ucagguguaucauggaguugaa

SEQ ID NO: 170867 - RNA, 22 nt, Human
ggcaggcauuagagauucccag

SEQ ID NO: 170868 - RNA, 21 nt, Human
acagugugcuucucucccucc

SEQ ID NO: 170869 - RNA, 22 nt, Human
cauagaaaguauuauggaauuu

SEQ ID NO: 170870 - RNA, 22 nt, Human
uacaguauggaaaauguauagu

SEQ ID NO: 170871 - RNA, 22 nt, Human
uacccagggcuuuucugaugca

SEQ ID NO: 170872 - RNA, 22 nt, Human
uuuagggaagaagcccauggcc

SEQ ID NO: 170873 - RNA, 22 nt, Human
gaaugaauuuuggauggugaag

SEQ ID NO: 170874 - RNA, 22 nt, Human
uuuugcuguuauaugcuauuau

SEQ ID NO: 170875 - RNA, 22 nt, Human
ucccuucuggcagcagugugag

SEQ ID NO: 170876 - RNA, 22 nt, Human
aggcaguggcugagaccagggg

SEQ ID NO: 170877 - RNA, 22 nt, Human
acagcauggauaacaaggcacu

SEQ ID NO: 170878 - RNA, 22 nt, Human
uucauaaugagguccuagaggc

SEQ ID NO: 170879 - RNA, 21 nt, Human
uaucaagauguuaugguugaa

SEQ ID NO: 170880 - RNA, 22 nt, Human
ccacagagacaggguccuugcu

SEQ ID NO: 170881 - RNA, 22 nt, Human
cuggacucugcagagaaaagua

SEQ ID NO: 170882 - RNA, 22 nt, Human
ugugaaaagcaggcuacuuucu

SEQ ID NO: 170883 - RNA, 22 nt, Human
aggauuuagauuuggaggaacu

SEQ ID NO: 170884 - RNA, 22 nt, Human
caaaugcuacuaauaggcaagu

SEQ ID NO: 170885 - RNA, 22 nt, Human
gggacccugggaggcuggcgca

SEQ ID NO: 170886 - RNA, 22 nt, Human
cuuccaaaauuuauauguugaa

SEQ ID NO: 170887 - RNA, 22 nt, Human
cuuuaguuauuuagacuacagu

SEQ ID NO: 170888 - RNA, 22 nt, Human
cguguccuuuuagcuucagguc

SEQ ID NO: 170889 - RNA, 22 nt, Human
acuuggugaagucaggugauua

SEQ ID NO: 170890 - RNA, 20 nt, Human
gccaggcacuguucucaaua

SEQ ID NO: 170891 - RNA, 21 nt, Human
gcugccaccgcgugcuccagg

SEQ ID NO: 170892 - RNA, 22 nt, Human
uugugucccugcggcugaggag

SEQ ID NO: 170893 - RNA, 22 nt, Human
augcuuaacucuguacauaguu

SEQ ID NO: 170894 - RNA, 22 nt, Human
uguccuggugcuucuugggauu

SEQ ID NO: 170895 - RNA, 22 nt, Human
ucugaagauuaccagcuaaaug

SEQ ID NO: 170896 - RNA, 22 nt, Human
uuccuuagcuccucauggccug

SEQ ID NO: 170897 - RNA, 22 nt, Human
ugcagggcuccuggcuccaauc

SEQ ID NO: 170898 - RNA, 20 nt, Human
uuucugugagaaacacuguu

SEQ ID NO: 170899 - RNA, 22 nt, Human
acagggcaaccucugggagacu

SEQ ID NO: 170900 - RNA, 22 nt, Human
ugacaggugaaauguccuuauu

SEQ ID NO: 170901 - RNA, 22 nt, Human
gaauacauuggaaaucagaaua

SEQ ID NO: 170902 - RNA, 22 nt, Human
ugccugggaucugugcccuuug

SEQ ID NO: 170903 - RNA, 22 nt, Human
ccagaauuuggaucaugauuuu

SEQ ID NO: 170904 - RNA, 22 nt, Human
gggacuuaaugcagagagggac

SEQ ID NO: 170905 - RNA, 22 nt, Human
caggcagcugacugucagauau

SEQ ID NO: 170906 - RNA, 22 nt, Human
ggcagugggaaauaagugagaa

SEQ ID NO: 170907 - RNA, 22 nt, Human
ucaaauaccagcuuuuccagaa

SEQ ID NO: 170908 - RNA, 22 nt, Human
aaacaugcauucaagaaaaucu

SEQ ID NO: 170909 - RNA, 22 nt, Human
ucuuucuuuaucaccugauaug

SEQ ID NO: 170910 - RNA, 22 nt, Human
ugcagggcuacaggacuacaac

SEQ ID NO: 170911 - RNA, 22 nt, Human
cugaggaagacagcagcugugu

SEQ ID NO: 170912 - RNA, 22 nt, Human
gcagggcacaaggacgcacagg

SEQ ID NO: 170913 - RNA, 22 nt, Human
guuagggaagcgcuguguucuu

SEQ ID NO: 170914 - RNA, 22 nt, Human
cuagugagucugaaugaguugc

SEQ ID NO: 170915 - RNA, 23 nt, Human
cccagagcacagccuccagaugc

SEQ ID NO: 170916 - RNA, 22 nt, Human
uggauuuauggagaccgaaagu

SEQ ID NO: 170917 - RNA, 19 nt, Human
ugccuggacaaaugugggg

SEQ ID NO: 170918 - RNA, 22 nt, Human
cacagguguucuugcagugaaa

SEQ ID NO: 170919 - RNA, 22 nt, Human
auaaaugccucagaaucauccc

SEQ ID NO: 170920 - RNA, 22 nt, Human
cauuaauauuguucuucuuuag

SEQ ID NO: 170921 - RNA, 22 nt, Human
uuucauugaugggugauagaaa

SEQ ID NO: 170922 - RNA, 18 nt, Human
uccugcagcuucuaugua

SEQ ID NO: 170923 - RNA, 22 nt, Human
caggugucagcagcacuguacu

SEQ ID NO: 170924 - RNA, 22 nt, Human
ccagguggcuucugcccgaugu

SEQ ID NO: 170925 - RNA, 22 nt, Human
aguauacaguaaugacauaucu

SEQ ID NO: 170926 - RNA, 22 nt, Human
auuagagguacaaaccuucacu

SEQ ID NO: 170927 - RNA, 22 nt, Human
aacauaauguggccaaagucac

SEQ ID NO: 170928 - RNA, 22 nt, Human
cacaugugggaaauggugcuua

SEQ ID NO: 170929 - RNA, 22 nt, Human
gcagcuuuguggagaggcccau

SEQ ID NO: 170930 - RNA, 22 nt, Human
aaauuauuaugccccucuauaa

SEQ ID NO: 170931 - RNA, 22 nt, Human
ccaggccuucugaggacacucu

SEQ ID NO: 170932 - RNA, 22 nt, Human
aaugaacagauacacauaggca

SEQ ID NO: 170933 - RNA, 22 nt, Human
gggaauguaaucauggaaugcu

SEQ ID NO: 170934 - RNA, 22 nt, Human
aguguccuuucuguuccagcca

SEQ ID NO: 170935 - RNA, 22 nt, Human
ucucuuaauaaguaaauacuga

SEQ ID NO: 170936 - RNA, 22 nt, Human
guguguccacacauacauacau

SEQ ID NO: 170937 - RNA, 22 nt, Human
cuuaaauuuucaucuacaagaa

SEQ ID NO: 170938 - RNA, 20 nt, Human
uuuaucugugggaguggaga

SEQ ID NO: 170939 - RNA, 22 nt, Human
gcagggcacacaagaaugauaa

SEQ ID NO: 170940 - RNA, 19 nt, Human
ccaggccuggcgucuccgc

SEQ ID NO: 170941 - RNA, 22 nt, Human
ugcuuuauaaccauuucugugg

SEQ ID NO: 170942 - RNA, 22 nt, Human
caaagucagccagcuaguaggu

SEQ ID NO: 170943 - RNA, 22 nt, Human
auuuucaucauggguuuaacau

SEQ ID NO: 170944 - RNA, 22 nt, Human
uauaauuuggggaaaguggugu

SEQ ID NO: 170945 - RNA, 17 nt, Human
cuguuaauucauuuccc

SEQ ID NO: 170946 - RNA, 23 nt, Human
uuccagaguccacaucugccacc

SEQ ID NO: 170947 - RNA, 22 nt, Human
gggucuggcaugcugagaugga

SEQ ID NO: 170948 - RNA, 22 nt, Human
uucugcaucugaauuuaaguac

SEQ ID NO: 170949 - RNA, 22 nt, Human
acacaaauuguaggauaauugc

SEQ ID NO: 170950 - RNA, 22 nt, Human
aaagcagauucugaugcaguag

SEQ ID NO: 170951 - RNA, 21 nt, Human
gauaaaaugggccuugguccu

SEQ ID NO: 170952 - RNA, 22 nt, Human
auguccagccaaccacuggauu

SEQ ID NO: 170953 - RNA, 22 nt, Human
agaaagcaucuccauuguaggu

SEQ ID NO: 170954 - RNA, 22 nt, Human
aaguaguuaguccgccugcucu

SEQ ID NO: 170955 - RNA, 22 nt, Human
auauacugaggagacuuuauau

SEQ ID NO: 170956 - RNA, 23 nt, Human
auauuagggagauuagcccucua

SEQ ID NO: 170957 - RNA, 22 nt, Human
cuuuauuguccuucuuaggugg

SEQ ID NO: 170958 - RNA, 22 nt, Human
uuuuugcugauaagcagaauuc

SEQ ID NO: 170959 - RNA, 22 nt, Human
cuguccugggggugguccuugc

SEQ ID NO: 170960 - RNA, 22 nt, Human
auucuucaccauggauaauuug

SEQ ID NO: 170961 - RNA, 21 nt, Human
aaauacagaaacuuguuuuca

SEQ ID NO: 170962 - RNA, 22 nt, Human
gggcagguacaagaugcuucuu

SEQ ID NO: 170963 - RNA, 16 nt, Human
gcaacuuugggguuga

SEQ ID NO: 170964 - RNA, 22 nt, Human
aaguuucauuguucauguaaca

SEQ ID NO: 170965 - RNA, 22 nt, Human
auuuccaugccuuagcuuaagg

SEQ ID NO: 170966 - RNA, 22 nt, Human
uuauugacugaucagagaggga

SEQ ID NO: 170967 - RNA, 22 nt, Human
aaauuguugaucuacaguaagg

SEQ ID NO: 170968 - RNA, 22 nt, Human
guguguccuguuuuaaaauagu

SEQ ID NO: 170969 - RNA, 22 nt, Human
uuucuaggucuuccauacugcc

SEQ ID NO: 170970 - RNA, 22 nt, Human
aggaggugcuguuuguccugga

SEQ ID NO: 170971 - RNA, 22 nt, Human
cacaauuuggugcuaaagaaag

SEQ ID NO: 170972 - RNA, 22 nt, Human
gucuaacaagcauuaggaaccc

SEQ ID NO: 170973 - RNA, 17 nt, Human
agacagguuauaguuga

SEQ ID NO: 170974 - RNA, 22 nt, Human
gaacuugguauuccuuuuaaca

SEQ ID NO: 170975 - RNA, 22 nt, Human
uauuuccaagcugaauccaaug

SEQ ID NO: 170976 - RNA, 22 nt, Human
ggaucugauuaauaagguggac

SEQ ID NO: 170977 - RNA, 22 nt, Human
aagacauugucauuuuauaauu

SEQ ID NO: 170978 - RNA, 22 nt, Human
aauaauuuuagcucagaguugu

SEQ ID NO: 170979 - RNA, 22 nt, Human
gauaaugaugacaaugacaacc

SEQ ID NO: 170980 - RNA, 22 nt, Human
gaauguaauagucaguagaaca

SEQ ID NO: 170981 - RNA, 22 nt, Human
aagcuuuaaggaauuuuaugga

SEQ ID NO: 170982 - RNA, 22 nt, Human
cagggcagaacauauagauagu

SEQ ID NO: 170983 - RNA, 22 nt, Human
auaaugaggauuugcauauuag

SEQ ID NO: 170984 - RNA, 22 nt, Human
aagggcucugcugucucucccc

SEQ ID NO: 170985 - RNA, 22 nt, Human
agcugccauggccugaauuuac

SEQ ID NO: 170986 - RNA, 22 nt, Human
ccugggugaaugauauucuaaa

SEQ ID NO: 170987 - RNA, 14 nt, Human
gcaggcagaucacu

SEQ ID NO: 170988 - RNA, 22 nt, Human
agcugcaaaggcacacuugggc

SEQ ID NO: 170989 - RNA, 22 nt, Human
cucugcccucgcacaucugcca

SEQ ID NO: 170990 - RNA, 22 nt, Human
gugcaggguagcgacggcagga

SEQ ID NO: 170991 - RNA, 22 nt, Human
auacagaagaccccuccgucau

SEQ ID NO: 170992 - RNA, 22 nt, Human
gguguccuuugggggcuccgag

SEQ ID NO: 170993 - RNA, 22 nt, Human
augaaugggucauuauuugauc

SEQ ID NO: 170994 - RNA, 22 nt, Human
aaagaaucuauauaucaccacc

SEQ ID NO: 170995 - RNA, 22 nt, Human
ggagaggguagggguccugccc

SEQ ID NO: 170996 - RNA, 22 nt, Human
guuagaauaaaaggucagagag

SEQ ID NO: 170997 - RNA, 22 nt, Human
uuugacucuagucauagaagug

SEQ ID NO: 170998 - RNA, 22 nt, Human
ucagguguucuccacucaguuu

SEQ ID NO: 170999 - RNA, 22 nt, Human
gagacaggauuuaaccaaagcu

SEQ ID NO: 171000 - RNA, 22 nt, Human
aggaaacuguccccucauccua

SEQ ID NO: 171001 - RNA, 22 nt, Human
aaguuacacauuuucauuguaa

SEQ ID NO: 171002 - RNA, 22 nt, Human
agacaaaugguaauuaugucua

SEQ ID NO: 171003 - RNA, 22 nt, Human
agaaagcacucugucuuuuacc

SEQ ID NO: 171004 - RNA, 21 nt, Human
auaauguacaaaaacugucuu

SEQ ID NO: 171005 - RNA, 22 nt, Human
gaucuucuauguaaugaagugu

SEQ ID NO: 171006 - RNA, 22 nt, Human
auacaaauuuauagaugcauuu

SEQ ID NO: 171007 - RNA, 22 nt, Human
acaaaaagggagaugagguaga

SEQ ID NO: 171008 - RNA, 22 nt, Human
uguuucuuuguagauauucuuu

SEQ ID NO: 171009 - RNA, 22 nt, Human
uauugguaugguaagaauugaa

SEQ ID NO: 171010 - RNA, 22 nt, Human
ucugaagagcuuuggaaguaug

SEQ ID NO: 171011 - RNA, 22 nt, Human
acacaggacagggauguguuuu

SEQ ID NO: 171012 - RNA, 22 nt, Human
cauccaggcaccacaaccagcu

SEQ ID NO: 171013 - RNA, 22 nt, Human
ggacaggugacugcccagagug

SEQ ID NO: 171014 - RNA, 22 nt, Human
agcagggccuggcacuccuggg

SEQ ID NO: 171015 - RNA, 19 nt, Human
aaggugguuugucucugua

SEQ ID NO: 171016 - RNA, 22 nt, Human
aaagcuaugaggcaugcauuuc

SEQ ID NO: 171017 - RNA, 22 nt, Human
aguaaaaauugaggugcaaaau

SEQ ID NO: 171018 - RNA, 22 nt, Human
uaauuucuucaucucugcagcu

SEQ ID NO: 171019 - RNA, 22 nt, Human
augcuuaagcucaguuauauau

SEQ ID NO: 171020 - RNA, 18 nt, Human
ucagagagaauaguaauu

SEQ ID NO: 171021 - RNA, 22 nt, Human
uugcaggguacauucuuagaau

SEQ ID NO: 171022 - RNA, 22 nt, Human
gcaggcaggcuuccuugaacug

SEQ ID NO: 171023 - RNA, 22 nt, Human
acaggcacugucaagucaugaa

SEQ ID NO: 171024 - RNA, 22 nt, Human
cuucuucauaggcaguccuguu

SEQ ID NO: 171025 - RNA, 20 nt, Human
agacaaaaugacuucaugca

SEQ ID NO: 171026 - RNA, 22 nt, Human
uagguguccauauaugugugua

SEQ ID NO: 171027 - RNA, 22 nt, Human
uuucaguguaucuuccaaaagc

SEQ ID NO: 171028 - RNA, 22 nt, Human
uaucagaaagauauuacugggg

SEQ ID NO: 171029 - RNA, 22 nt, Human
gguuucaacuuuugugaggaau

SEQ ID NO: 171030 - RNA, 22 nt, Human
aggcaguguucuucuaagggca

SEQ ID NO: 171031 - RNA, 22 nt, Human
gagcagugagugaauguugccu

SEQ ID NO: 171032 - RNA, 22 nt, Human
aagcuuuaugacuuggagacag

SEQ ID NO: 171033 - RNA, 22 nt, Human
uggcaaaggaaccuauuuuaaa

SEQ ID NO: 171034 - RNA, 21 nt, Human
agguacuaaugaaaagugauu

SEQ ID NO: 171035 - RNA, 22 nt, Human
cuauuagguaugcagccuauuu

SEQ ID NO: 171036 - RNA, 23 nt, Human
uugauuucaaaugcagagaacac

SEQ ID NO: 171037 - RNA, 22 nt, Human
guagcuauuuaugauacucaug

SEQ ID NO: 171038 - RNA, 17 nt, Human
aggccucccuccaggcc

SEQ ID NO: 171039 - RNA, 22 nt, Human
acgugcaggaucugguuggcga

SEQ ID NO: 171040 - RNA, 19 nt, Human
auuuauuguaugauuccau

SEQ ID NO: 171041 - RNA, 22 nt, Human
uuuuauugucuguauugccuau

SEQ ID NO: 171042 - RNA, 22 nt, Human
uucuucuuaauguccugggaac

SEQ ID NO: 171043 - RNA, 22 nt, Human
cagagcagggguuucccagguu

SEQ ID NO: 171044 - RNA, 22 nt, Human
aaaauuuugcccuauccuucau

SEQ ID NO: 171045 - RNA, 22 nt, Human
uuccaagagcuuuaauuguuga

SEQ ID NO: 171046 - RNA, 22 nt, Human
uagaugcuacaauuuuguacuc

SEQ ID NO: 171047 - RNA, 22 nt, Human
aacuggauuuaggaacagagaa

SEQ ID NO: 171048 - RNA, 18 nt, Human
gggcucacacaggucauc

SEQ ID NO: 171049 - RNA, 22 nt, Human
uacauguauguguuaauaucug

SEQ ID NO: 171050 - RNA, 22 nt, Human
aguucacauaucuguuuuauuu

SEQ ID NO: 171051 - RNA, 22 nt, Human
ggguguggcugcgugccaauaa

SEQ ID NO: 171052 - RNA, 22 nt, Human
uagguauacagagauuucuggg

SEQ ID NO: 171053 - RNA, 22 nt, Human
gugaauaauuuuuuaguauaag

SEQ ID NO: 171054 - RNA, 22 nt, Human
gcuguggucccucuguccucau

SEQ ID NO: 171055 - RNA, 22 nt, Human
cauguguccuagcuauucuccu

SEQ ID NO: 171056 - RNA, 22 nt, Human
ccaugagccaggcugaggaagc

SEQ ID NO: 171057 - RNA, 22 nt, Human
aaguccauucuuccagccagcu

SEQ ID NO: 171058 - RNA, 22 nt, Human
acaaggcuguuggucacaaacc

SEQ ID NO: 171059 - RNA, 22 nt, Human
auucugggcgccuauggcugca

SEQ ID NO: 171060 - RNA, 22 nt, Human
auguguccuuauaagaagaaga

SEQ ID NO: 171061 - RNA, 22 nt, Human
cugcugccggcgagccucccuu

SEQ ID NO: 171062 - RNA, 22 nt, Human
uaaagcaguguugggucggacg

SEQ ID NO: 171063 - RNA, 22 nt, Human
uauuugauagagauaaaugaua

SEQ ID NO: 171064 - RNA, 22 nt, Human
ucagagagguuggugauaagaa

SEQ ID NO: 171065 - RNA, 22 nt, Human
uuuauauguuuguacaauuaag

SEQ ID NO: 171066 - RNA, 22 nt, Human
auccagaacaccuguaucacca

SEQ ID NO: 171067 - RNA, 22 nt, Human
aaaagguuuugaguacaaauau

SEQ ID NO: 171068 - RNA, 22 nt, Human
uuuuucauugcagccucucucc

SEQ ID NO: 171069 - RNA, 22 nt, Human
uuccuuagggaaagggauaagg

SEQ ID NO: 171070 - RNA, 22 nt, Human
gcacccagccagcaucucagag

SEQ ID NO: 171071 - RNA, 22 nt, Human
auggcuuaugaauaacaguagg

SEQ ID NO: 171072 - RNA, 22 nt, Human
auuuccaugaaggcagauuuua

SEQ ID NO: 171073 - RNA, 22 nt, Human
ucuggaucuccagcacuuauca

SEQ ID NO: 171074 - RNA, 22 nt, Human
cacauaauaaauguuccugaug

SEQ ID NO: 171075 - RNA, 22 nt, Human
uaucaauacauguuaucagugu

SEQ ID NO: 171076 - RNA, 22 nt, Human
guuucuuuuaaaauauguagac

SEQ ID NO: 171077 - RNA, 22 nt, Human
cauuuauucauuugcuagggcu

SEQ ID NO: 171078 - RNA, 22 nt, Human
ggcuuaaugguucuuuuucuca

SEQ ID NO: 171079 - RNA, 22 nt, Human
aaagcugcccagcugccuguuu

SEQ ID NO: 171080 - RNA, 22 nt, Human
uguccaggucagcagcagggac

SEQ ID NO: 171081 - RNA, 22 nt, Human
uuuauccagaaucaggauuuuu

SEQ ID NO: 171082 - RNA, 22 nt, Human
ucagaaauagucuuuaaaauga

SEQ ID NO: 171083 - RNA, 22 nt, Human
ggagcugaugguagaagaauga

SEQ ID NO: 171084 - RNA, 22 nt, Human
uaguccuuuaauaguuaaugug

SEQ ID NO: 171085 - RNA, 22 nt, Human
uguuauugagguuacuuauaag

SEQ ID NO: 171086 - RNA, 22 nt, Human
acuguccauucacucauauuca

SEQ ID NO: 171087 - RNA, 22 nt, Human
acagguguugaaugaugucaca

SEQ ID NO: 171088 - RNA, 22 nt, Human
ccucuaggauguggcuggagga

SEQ ID NO: 171089 - RNA, 22 nt, Human
uuuguuuacaaaaauaagcagu

SEQ ID NO: 171090 - RNA, 22 nt, Human
agauuuacuggagucuuuggug

SEQ ID NO: 171091 - RNA, 22 nt, Human
augguuuuguccucuuugguuc

SEQ ID NO: 171092 - RNA, 22 nt, Human
auaugaaaauguuuuagcugua

SEQ ID NO: 171093 - RNA, 22 nt, Human
acagguguagguacauuugcau

SEQ ID NO: 171094 - RNA, 22 nt, Human
uggcagguacccauuggcugua

SEQ ID NO: 171095 - RNA, 22 nt, Human
cacagcauucacagaaagacau

SEQ ID NO: 171096 - RNA, 22 nt, Human
cucuggccgcagcucagcucug

SEQ ID NO: 171097 - RNA, 22 nt, Human
agcuuuauggugccucacuuga

SEQ ID NO: 171098 - RNA, 22 nt, Human
cacaggugcaagaaguugcagu

SEQ ID NO: 171099 - RNA, 22 nt, Human
cagcaugagaaaaugaaucaga

SEQ ID NO: 171100 - RNA, 22 nt, Human
auauaguuggguuucauucuac

SEQ ID NO: 171101 - RNA, 22 nt, Human
ucugggaagcugcgugccuguu

SEQ ID NO: 171102 - RNA, 23 nt, Human
gcugugcacgagccacugccugu

SEQ ID NO: 171103 - RNA, 22 nt, Human
auacagaaguuuuccacuuauu

SEQ ID NO: 171104 - RNA, 22 nt, Human
ccauaauauuaaaugcuuuugu

SEQ ID NO: 171105 - RNA, 22 nt, Human
aaucagcuaaauaaacuaguca

SEQ ID NO: 171106 - RNA, 23 nt, Human
uuacagaaaguaugcuuuuguuu

SEQ ID NO: 171107 - RNA, 22 nt, Human
cugaauaauuuuauaguugcug

SEQ ID NO: 171108 - RNA, 22 nt, Human
cauuuauugguuaggccagcag

SEQ ID NO: 171109 - RNA, 22 nt, Human
uugggacaucuggcauacaguu

SEQ ID NO: 171110 - RNA, 22 nt, Human
acacugaauguuuaagaacuug

SEQ ID NO: 171111 - RNA, 22 nt, Human
uuauugcuuuggaaaacacuca

SEQ ID NO: 171112 - RNA, 22 nt, Human
acaugaaaaauguuugcaguuu

SEQ ID NO: 171113 - RNA, 22 nt, Human
gauggcuucagucuccuugggu

SEQ ID NO: 171114 - RNA, 22 nt, Human
uuacaguuuaguccaagccaga

SEQ ID NO: 171115 - RNA, 20 nt, Human
guaaaauauggucuuugggu

SEQ ID NO: 171116 - RNA, 22 nt, Human
uuuuauugcaauaaagugugua

SEQ ID NO: 171117 - RNA, 22 nt, Human
uagaaauggagaacagauuaau

SEQ ID NO: 171118 - RNA, 22 nt, Human
acacaaguucuaaagauugcgc

SEQ ID NO: 171119 - RNA, 22 nt, Human
augcaacaaaugcuacgaaucg

SEQ ID NO: 171120 - RNA, 22 nt, Human
gggaccuggacaugugugugcu

SEQ ID NO: 171121 - RNA, 22 nt, Human
ugcuuuauucgacaucugguag

SEQ ID NO: 171122 - RNA, 22 nt, Human
gguaaaaaucacaaauacuuua

SEQ ID NO: 171123 - RNA, 22 nt, Human
ucauacacaagagcauguaaca

SEQ ID NO: 171124 - RNA, 22 nt, Human
uuuccauguuggugaaaugagg

SEQ ID NO: 171125 - RNA, 22 nt, Human
cagggcagcuuccuuuguuagg

SEQ ID NO: 171126 - RNA, 22 nt, Human
aaguccuuucucauggaggaau

SEQ ID NO: 171127 - RNA, 22 nt, Human
uccuucuggaggcuguaaagga

SEQ ID NO: 171128 - RNA, 22 nt, Human
uguacuauuaagaggccuaaau

SEQ ID NO: 171129 - RNA, 22 nt, Human
uuuauugucuaugaacugcuug

SEQ ID NO: 171130 - RNA, 22 nt, Human
cauagcuuagggguuaaacuca

SEQ ID NO: 171131 - RNA, 22 nt, Human
caguaaauuaucucaucucugu

SEQ ID NO: 171132 - RNA, 22 nt, Human
aaggaugaacauuaauacauca

SEQ ID NO: 171133 - RNA, 22 nt, Human
acuucauuguaauauuauagca

SEQ ID NO: 171134 - RNA, 22 nt, Human
guucuauuccccuuaucuguga

SEQ ID NO: 171135 - RNA, 22 nt, Human
gugcaaaagucauugugguuuu

SEQ ID NO: 171136 - RNA, 22 nt, Human
ggcaggugaucuagagucaaua

SEQ ID NO: 171137 - RNA, 22 nt, Human
cauuuguauagugcuuagacca

SEQ ID NO: 171138 - RNA, 22 nt, Human
uggcaaggcugugggggcagag

SEQ ID NO: 171139 - RNA, 22 nt, Human
aagaaaucugauauuuguuuca

SEQ ID NO: 171140 - RNA, 22 nt, Human
uuaucacuuaugagcuuuuugc

SEQ ID NO: 171141 - RNA, 22 nt, Human
ugaauagagcugcaguggacau

SEQ ID NO: 171142 - RNA, 22 nt, Human
ugugaauagugccgcaauaaac

SEQ ID NO: 171143 - RNA, 22 nt, Human
cacaggugucucuaguagcguu

SEQ ID NO: 171144 - RNA, 22 nt, Human
uuccugcagcaaggagaagcug

SEQ ID NO: 171145 - RNA, 22 nt, Human
acaugcuuguuuuucacaaccu

SEQ ID NO: 171146 - RNA, 22 nt, Human
auaucaaacgaaguuauuuuaa

SEQ ID NO: 171147 - RNA, 23 nt, Human
ucagagaggcccccugcagagau

SEQ ID NO: 171148 - RNA, 22 nt, Human
uccugcagccauuagaggucaa

SEQ ID NO: 171149 - RNA, 22 nt, Human
cccugcagagccagcccugacc

SEQ ID NO: 171150 - RNA, 22 nt, Human
cacacuuugugcuaaucuauuu

SEQ ID NO: 171151 - RNA, 22 nt, Human
guuugcaaauuguguuaaagcu

SEQ ID NO: 171152 - RNA, 22 nt, Human
uuucagaaagcaucaucaaagu

SEQ ID NO: 171153 - RNA, 22 nt, Human
aaaauuauggaguaucccaaag

SEQ ID NO: 171154 - RNA, 22 nt, Human
ugcugggucaggcaucugcaga

SEQ ID NO: 171155 - RNA, 22 nt, Human
cagcaugaucccaguugauugc

SEQ ID NO: 171156 - RNA, 22 nt, Human
uaauuuuaacugugcuguuugg

SEQ ID NO: 171157 - RNA, 22 nt, Human
cucuuagaaagaaacacacugg

SEQ ID NO: 171158 - RNA, 22 nt, Human
ccuggguccaauucuggcuugu

SEQ ID NO: 171159 - RNA, 22 nt, Human
gguguccuuagaaagcagaccu

SEQ ID NO: 171160 - RNA, 22 nt, Human
ugggaccuguuacauugaguua

SEQ ID NO: 171161 - RNA, 22 nt, Human
uggaggaaaauuacuggggucu

SEQ ID NO: 171162 - RNA, 22 nt, Human
aaauacagauuccagggucuua

SEQ ID NO: 171163 - RNA, 22 nt, Human
uaggugucuugucacuaccguu

SEQ ID NO: 171164 - RNA, 22 nt, Human
aauguaaaguugggcacaaaug

SEQ ID NO: 171165 - RNA, 22 nt, Human
uuuacuuucucaaguauauagg

SEQ ID NO: 171166 - RNA, 20 nt, Human
caauuucaucauuuccugug

SEQ ID NO: 171167 - RNA, 22 nt, Human
cuuacagagaagaaaauguagu

SEQ ID NO: 171168 - RNA, 22 nt, Human
ggcuuuauuugcagccauuguu

SEQ ID NO: 171169 - RNA, 22 nt, Human
gaauuuccucuaaaccccugag

SEQ ID NO: 171170 - RNA, 22 nt, Human
uucagaaaaaacuucaauaagu

SEQ ID NO: 171171 - RNA, 22 nt, Human
agcagguguuuguaucauaagg

SEQ ID NO: 171172 - RNA, 22 nt, Human
uauguuauuuucauacaacaga

SEQ ID NO: 171173 - RNA, 22 nt, Human
agcuuuauuaacucuccaggug

SEQ ID NO: 171174 - RNA, 22 nt, Human
uccucuggggcgugguccugga

SEQ ID NO: 171175 - RNA, 18 nt, Human
agacagacagguuugugc

SEQ ID NO: 171176 - RNA, 22 nt, Human
aggacagugguguucuggagug

SEQ ID NO: 171177 - RNA, 22 nt, Human
aggcaggucacaugcuuggcga

SEQ ID NO: 171178 - RNA, 22 nt, Human
uagcuuuaagacauggugaaug

SEQ ID NO: 171179 - RNA, 22 nt, Human
aaauucaauuaacuuucaugcu

SEQ ID NO: 171180 - RNA, 22 nt, Human
acuguucauuuggauuucucug

SEQ ID NO: 171181 - RNA, 22 nt, Human
uugcagcugcaguaaauguuca

SEQ ID NO: 171182 - RNA, 22 nt, Human
ugacauguccugagaagauggc

SEQ ID NO: 171183 - RNA, 22 nt, Human
cuuauuagugucugucugaguu

SEQ ID NO: 171184 - RNA, 18 nt, Human
agcaugagagaggcugug

SEQ ID NO: 171185 - RNA, 22 nt, Human
gccugcagcugcuuccacacac

SEQ ID NO: 171186 - RNA, 22 nt, Human
gaccuggaggauccucuucuug

SEQ ID NO: 171187 - RNA, 22 nt, Human
cacaucagggcugcuugggggu

SEQ ID NO: 171188 - RNA, 22 nt, Human
uuuccaaacccagcgagcuaca

SEQ ID NO: 171189 - RNA, 22 nt, Human
uagcuuuacaaagugcugcacc

SEQ ID NO: 171190 - RNA, 22 nt, Human
uucuuaaaacuuauggacaggu

SEQ ID NO: 171191 - RNA, 22 nt, Human
augagguuuuacugccauuuuc

SEQ ID NO: 171192 - RNA, 22 nt, Human
acuuuagaccaucuuccacagu

SEQ ID NO: 171193 - RNA, 22 nt, Human
aaaagccaagguccucuucaga

SEQ ID NO: 171194 - RNA, 22 nt, Human
gucugcccugcugaucucaccc

SEQ ID NO: 171195 - RNA, 22 nt, Human
ucugggugugguaucuuagcca

SEQ ID NO: 171196 - RNA, 19 nt, Human
uucacaauuaugaaauuag

SEQ ID NO: 171197 - RNA, 22 nt, Human
cuuuccaagaaugcagauaccu

SEQ ID NO: 171198 - RNA, 22 nt, Human
uuucagaaagcugaacauauga

SEQ ID NO: 171199 - RNA, 22 nt, Human
ugcaggugguccauuugggaac

SEQ ID NO: 171200 - RNA, 22 nt, Human
cuguguccuccccaucacuucu

SEQ ID NO: 171201 - RNA, 22 nt, Human
ucaggagcuugguagugugauu

SEQ ID NO: 171202 - RNA, 22 nt, Human
uuuuauuaguggcuagaugggg

SEQ ID NO: 171203 - RNA, 22 nt, Human
uuggaggaaagaagguugauau

SEQ ID NO: 171204 - RNA, 22 nt, Human
cuccucaaggucucaggaauaa

SEQ ID NO: 171205 - RNA, 22 nt, Human
uauuuaguuaucuuucauaaaa

SEQ ID NO: 171206 - RNA, 22 nt, Human
uguguuuugaacucaucuacug

SEQ ID NO: 171207 - RNA, 22 nt, Human
cauucauuuaugaaauaucuau

SEQ ID NO: 171208 - RNA, 22 nt, Human
uacugaaaguggucaacagugg

SEQ ID NO: 171209 - RNA, 22 nt, Human
ggguguagacacauguucaucu

SEQ ID NO: 171210 - RNA, 18 nt, Human
uacagauuauagauacau

SEQ ID NO: 171211 - RNA, 22 nt, Human
gcuguucaaaagccacaguuac

SEQ ID NO: 171212 - RNA, 22 nt, Human
auguucaaacaaguuaaugcca

SEQ ID NO: 171213 - RNA, 22 nt, Human
aagcugcagguugaauccaggu

SEQ ID NO: 171214 - RNA, 22 nt, Human
cagggcucuucaucacacagua

SEQ ID NO: 171215 - RNA, 22 nt, Human
uguguccugcagacagacucag

SEQ ID NO: 171216 - RNA, 22 nt, Human
ugcuggcugcagugcugucaaa

SEQ ID NO: 171217 - RNA, 22 nt, Human
auuagggaaacugacuugucuc

SEQ ID NO: 171218 - RNA, 22 nt, Human
cagcuuguuaccgagggagggu

SEQ ID NO: 171219 - RNA, 22 nt, Human
uagacaggagucaggcuagaau

SEQ ID NO: 171220 - RNA, 22 nt, Human
uugugucccccuuugagagcca

SEQ ID NO: 171221 - RNA, 22 nt, Human
gaguccuuuucauagcaguggg

SEQ ID NO: 171222 - RNA, 22 nt, Human
gcaggugguccccguggagugg

SEQ ID NO: 171223 - RNA, 22 nt, Human
caugcuuaugauuugcuaagcc

SEQ ID NO: 171224 - RNA, 22 nt, Human
gcaaaucaccaccuagcuggau

SEQ ID NO: 171225 - RNA, 22 nt, Human
cuuucuuucgaagacgugauua

SEQ ID NO: 171226 - RNA, 22 nt, Human
uguccuuauaagaaaaggaaau

SEQ ID NO: 171227 - RNA, 21 nt, Human
uuuucuggaguaugucuccuc

SEQ ID NO: 171228 - RNA, 22 nt, Human
gaauuucuggacccuuugagaa

SEQ ID NO: 171229 - RNA, 17 nt, Human
caauuucauagguuuug

SEQ ID NO: 171230 - RNA, 22 nt, Human
aaagagggacaggcgcagacac

SEQ ID NO: 171231 - RNA, 22 nt, Human
aaaugcauggcuguuuuaaagc

SEQ ID NO: 171232 - RNA, 21 nt, Human
gggcaggucucugaugucaac

SEQ ID NO: 171233 - RNA, 22 nt, Human
acuuuaauuaaugaacuguggc

SEQ ID NO: 171234 - RNA, 22 nt, Human
agauugaauauagagauucuug

SEQ ID NO: 171235 - RNA, 19 nt, Human
aaaauugcguauuuugagg

SEQ ID NO: 171236 - RNA, 22 nt, Human
aagccaaugagagaggccucag

SEQ ID NO: 171237 - RNA, 22 nt, Human
ugaaauagaaaaacaggcuucu

SEQ ID NO: 171238 - RNA, 22 nt, Human
aucugacuucacgcccaugcca

SEQ ID NO: 171239 - RNA, 22 nt, Human
gaguccuucuggcuggcaggau

SEQ ID NO: 171240 - RNA, 22 nt, Human
uucccaauauucugcuuuuaug

SEQ ID NO: 171241 - RNA, 22 nt, Human
guuuauaaggcccaauauuucu

SEQ ID NO: 171242 - RNA, 22 nt, Human
ggucuggccuccgggcaggugg

SEQ ID NO: 171243 - RNA, 23 nt, Human
uauggcuuacagugcuuuaggua

SEQ ID NO: 171244 - RNA, 22 nt, Human
gugaauaauauuguuuauaaaa

SEQ ID NO: 171245 - RNA, 22 nt, Human
ucuggagaggaggauguggaca

SEQ ID NO: 171246 - RNA, 22 nt, Human
guuuuauaggcuguugcuauau

SEQ ID NO: 171247 - RNA, 22 nt, Human
uccuuucccuuuccauccuggc

SEQ ID NO: 171248 - RNA, 22 nt, Human
caucacagggggcuagaagucu

SEQ ID NO: 171249 - RNA, 22 nt, Human
gugagauuugaguggggauaca

SEQ ID NO: 171250 - RNA, 22 nt, Human
uuaagauagaacccaguagucu

SEQ ID NO: 171251 - RNA, 23 nt, Human
ccaggccucucagagggugugcc

SEQ ID NO: 171252 - RNA, 22 nt, Human
aaugauugcaaacauugagaac

SEQ ID NO: 171253 - RNA, 22 nt, Human
ucuucagacccuuagcugugau

SEQ ID NO: 171254 - RNA, 22 nt, Human
gggcugaccaaugccuugcuuu

SEQ ID NO: 171255 - RNA, 22 nt, Human
uuacagaaaauguguuuuaacu

SEQ ID NO: 171256 - RNA, 22 nt, Human
aucuauacuacaaauggcuggu

SEQ ID NO: 171257 - RNA, 22 nt, Human
uuucaaauagaaucuuuccaaa

SEQ ID NO: 171258 - RNA, 22 nt, Human
uuuacagucucuauagucaaaa

SEQ ID NO: 171259 - RNA, 22 nt, Human
uuauuugugaaucauuuaucua

SEQ ID NO: 171260 - RNA, 22 nt, Human
acagggcagcaacuuugugccu

SEQ ID NO: 171261 - RNA, 22 nt, Human
uggcagggugggcuucagcccc

SEQ ID NO: 171262 - RNA, 22 nt, Human
auagacauuuugcauucaagca

SEQ ID NO: 171263 - RNA, 22 nt, Human
acaggcaggcuucggccagagc

SEQ ID NO: 171264 - RNA, 22 nt, Human
ugguccuggggaucugcaguga

SEQ ID NO: 171265 - RNA, 22 nt, Human
uuuauucugugcuacaugaaga

SEQ ID NO: 171266 - RNA, 22 nt, Human
acuguucacccagcacuagcag

SEQ ID NO: 171267 - RNA, 22 nt, Human
gguggcaguggucucugacaga

SEQ ID NO: 171268 - RNA, 22 nt, Human
ugcagguggauaucucaucaga

SEQ ID NO: 171269 - RNA, 22 nt, Human
aauacaaucaaauucacuagca

SEQ ID NO: 171270 - RNA, 22 nt, Human
cagguggucaggcagaugggcu

SEQ ID NO: 171271 - RNA, 22 nt, Human
gacagacaccugggggguugcu

SEQ ID NO: 171272 - RNA, 23 nt, Human
cagcuuucagggcuuuagggaag

SEQ ID NO: 171273 - RNA, 22 nt, Human
gugugucccuuggaaccucagc

SEQ ID NO: 171274 - RNA, 22 nt, Human
auacacuuuagaaaaacgcugc

SEQ ID NO: 171275 - RNA, 21 nt, Human
uggccaaaaccauauuauuaa

SEQ ID NO: 171276 - RNA, 22 nt, Human
ucauuuguggaagugauugugg

SEQ ID NO: 171277 - RNA, 22 nt, Human
caggcugccgugaagcaggccu

SEQ ID NO: 171278 - RNA, 20 nt, Human
agggugugggccuuagccau

SEQ ID NO: 171279 - RNA, 23 nt, Human
aucauucuccaaucuggagcagg

SEQ ID NO: 171280 - RNA, 22 nt, Human
ccagcuuucucagaggcuucua

SEQ ID NO: 171281 - RNA, 22 nt, Human
cccugcaguccuuucuuggcuc

SEQ ID NO: 171282 - RNA, 22 nt, Human
aucaaguuuucuuaguugacug

SEQ ID NO: 171283 - RNA, 19 nt, Human
uagaaagaugauggguggg

SEQ ID NO: 171284 - RNA, 22 nt, Human
uuccagugaaacaugaggugug

SEQ ID NO: 171285 - RNA, 22 nt, Human
uuagcucagaaaauuuaaacuu

SEQ ID NO: 171286 - RNA, 22 nt, Human
ggucuggauuuuaucuacugua

SEQ ID NO: 171287 - RNA, 19 nt, Human
cuggguccuguucuuuuac

SEQ ID NO: 171288 - RNA, 22 nt, Human
ccuucuucaccaguuuaccuga

SEQ ID NO: 171289 - RNA, 22 nt, Human
cuugcuucauuagugucuuagu

SEQ ID NO: 171290 - RNA, 22 nt, Human
ugcaugaaauauuuucuguagg

SEQ ID NO: 171291 - RNA, 22 nt, Human
acuugguuggucucacccuguu

SEQ ID NO: 171292 - RNA, 22 nt, Human
auuucucaucaagugccaacuc

SEQ ID NO: 171293 - RNA, 22 nt, Human
caccugcagggggagucaagag

SEQ ID NO: 171294 - RNA, 22 nt, Human
auuuccaugucgguauuuuaua

SEQ ID NO: 171295 - RNA, 22 nt, Human
cugaauaauacagacuagcuuc

SEQ ID NO: 171296 - RNA, 23 nt, Human
uccaggcacgcauuucuucuagc

SEQ ID NO: 171297 - RNA, 22 nt, Human
acaggugguagaguggaaagag

SEQ ID NO: 171298 - RNA, 22 nt, Human
uuccugcuuccuggccucacaa

SEQ ID NO: 171299 - RNA, 22 nt, Human
uacaugugaucagaaagugaaa

SEQ ID NO: 171300 - RNA, 22 nt, Human
auaucaguaucuauguauuugu

SEQ ID NO: 171301 - RNA, 22 nt, Human
ugcagucuccaccuccugggug

SEQ ID NO: 171302 - RNA, 22 nt, Human
gggaccuggucuagcacugagc

SEQ ID NO: 171303 - RNA, 17 nt, Human
aguggcaggcagauggg

SEQ ID NO: 171304 - RNA, 22 nt, Human
acagguuugucugauguaauga

SEQ ID NO: 171305 - RNA, 22 nt, Human
aagguggugaguacaguuaggu

SEQ ID NO: 171306 - RNA, 22 nt, Human
agacagugauggacaggcagac

SEQ ID NO: 171307 - RNA, 22 nt, Human
ggagcugaaccccaucgugcug

SEQ ID NO: 171308 - RNA, 22 nt, Human
ccuggauccaugaaaaggcuac

SEQ ID NO: 171309 - RNA, 22 nt, Human
gccaggguucgaauccguaugg

SEQ ID NO: 171310 - RNA, 22 nt, Human
cuuccucugccucccgugcuca

SEQ ID NO: 171311 - RNA, 22 nt, Human
cauuuacagcagacugaugaaa

SEQ ID NO: 171312 - RNA, 22 nt, Human
aaguccuuggagaauagaaagg

SEQ ID NO: 171313 - RNA, 22 nt, Human
auacauacauguaugcacauac

SEQ ID NO: 171314 - RNA, 22 nt, Human
aaucagugguucccagcccagg

SEQ ID NO: 171315 - RNA, 22 nt, Human
auuugcuucugugaaaucaagu

SEQ ID NO: 171316 - RNA, 22 nt, Human
aguguccuacagcuccugccug

SEQ ID NO: 171317 - RNA, 22 nt, Human
uuauccuggauuauauauguga

SEQ ID NO: 171318 - RNA, 22 nt, Human
ccagaauucagaaagggcauaa

SEQ ID NO: 171319 - RNA, 22 nt, Human
ccagguggugccucuguucgca

SEQ ID NO: 171320 - RNA, 22 nt, Human
gaagggaaggaaagaaccagca

SEQ ID NO: 171321 - RNA, 21 nt, Human
ugacugaggcuucuucacaca

SEQ ID NO: 171322 - RNA, 22 nt, Human
uagucaccuuuggcaccugcaa

SEQ ID NO: 171323 - RNA, 22 nt, Human
uuguauuuauauugaauagcuu

SEQ ID NO: 171324 - RNA, 22 nt, Human
ugcuuauucuuuccacaauuca

SEQ ID NO: 171325 - RNA, 22 nt, Human
auuccaaacucuuucccugucg

SEQ ID NO: 171326 - RNA, 22 nt, Human
accuugaugccuuuccaagaug

SEQ ID NO: 171327 - RNA, 21 nt, Human
agcaggugcuguuggaggaaa

SEQ ID NO: 171328 - RNA, 22 nt, Human
agucucuuuaaucacagugucu

SEQ ID NO: 171329 - RNA, 22 nt, Human
uacaggugguaaaaauauuguu

SEQ ID NO: 171330 - RNA, 22 nt, Human
uuacagaagaguaacuuggcaa

SEQ ID NO: 171331 - RNA, 22 nt, Human
uucuuguaauuuggagaaauga

SEQ ID NO: 171332 - RNA, 22 nt, Human
agggcacccucucugcaguacc

SEQ ID NO: 171333 - RNA, 22 nt, Human
gcaugcaggauagguugagcuc

SEQ ID NO: 171334 - RNA, 22 nt, Human
acaauuccacauggcaugcagg

SEQ ID NO: 171335 - RNA, 22 nt, Human
gcagggcagccacaggcccccu

SEQ ID NO: 171336 - RNA, 16 nt, Human
guuccuucccacaccu

SEQ ID NO: 171337 - RNA, 22 nt, Human
acaggcagauuaaggguaggca

SEQ ID NO: 171338 - RNA, 22 nt, Human
ggaugaggaagauuacugagaa

SEQ ID NO: 171339 - RNA, 22 nt, Human
cugcggugggcugggcuguccc

SEQ ID NO: 171340 - RNA, 22 nt, Human
augguuuaguuagggcuuuuca

SEQ ID NO: 171341 - RNA, 20 nt, Human
uccugcaguuccuaggaggg

SEQ ID NO: 171342 - RNA, 22 nt, Human
uccucagaauggauggcagggg

SEQ ID NO: 171343 - RNA, 22 nt, Human
cuuaaacugaaagcuacaagau

SEQ ID NO: 171344 - RNA, 22 nt, Human
caauuucucuuuauaucucaca

SEQ ID NO: 171345 - RNA, 22 nt, Human
ugaauaugugacuuugauuuca

SEQ ID NO: 171346 - RNA, 22 nt, Human
uauuaggguuuugaagguuugu

SEQ ID NO: 171347 - RNA, 22 nt, Human
uaaacauggcuguuucaguuau

SEQ ID NO: 171348 - RNA, 18 nt, Human
gcugggguugagcucucc

SEQ ID NO: 171349 - RNA, 22 nt, Human
ucuauuuuauacucaaaucuuc

SEQ ID NO: 171350 - RNA, 22 nt, Human
agcauauaaauggacauauuug

SEQ ID NO: 171351 - RNA, 22 nt, Human
cuuuuccacugagccucacaaa

SEQ ID NO: 171352 - RNA, 22 nt, Human
uuucaacuuguuugcuuccaua

SEQ ID NO: 171353 - RNA, 22 nt, Human
ucauuguagggcauuuagagag

SEQ ID NO: 171354 - RNA, 22 nt, Human
cugccguguuuuucauguuaaa

SEQ ID NO: 171355 - RNA, 22 nt, Human
gacaguuuuuaauccuuucaug

SEQ ID NO: 171356 - RNA, 22 nt, Human
uugaauaaaugagcagugaauu

SEQ ID NO: 171357 - RNA, 22 nt, Human
ugcguacuguuuauacaugugu

SEQ ID NO: 171358 - RNA, 19 nt, Human
ucucaauucuccccacugc

SEQ ID NO: 171359 - RNA, 22 nt, Human
ugggcuccucgucacucgcugu

SEQ ID NO: 171360 - RNA, 22 nt, Human
ugcagugguugagagcccagac

SEQ ID NO: 171361 - RNA, 22 nt, Human
auugaguaccuccagauucaua

SEQ ID NO: 171362 - RNA, 22 nt, Human
uggcaaagauuaccacaucuac

SEQ ID NO: 171363 - RNA, 22 nt, Human
auuguauaacagcauguauuuu

SEQ ID NO: 171364 - RNA, 22 nt, Human
uagggcagauucgguggaguuu

SEQ ID NO: 171365 - RNA, 22 nt, Human
cuugggaaugcuaacagaugac

SEQ ID NO: 171366 - RNA, 22 nt, Human
uccuucuguagucccugucccu

SEQ ID NO: 171367 - RNA, 22 nt, Human
cuccuuagugccucugcacgag

SEQ ID NO: 171368 - RNA, 22 nt, Human
ucauuauuuuggacuggagugu

SEQ ID NO: 171369 - RNA, 22 nt, Human
uuuauauguauugacuuugaug

SEQ ID NO: 171370 - RNA, 22 nt, Human
uuaauuuucucaucugugaaau

SEQ ID NO: 171371 - RNA, 22 nt, Human
gccugcagaacugugaggcaau

SEQ ID NO: 171372 - RNA, 22 nt, Human
auugauggcggccucuccauau

SEQ ID NO: 171373 - RNA, 22 nt, Human
aaucccagcuacucaggaaguu

SEQ ID NO: 171374 - RNA, 22 nt, Human
gcaggugggggagaaguuguga

SEQ ID NO: 171375 - RNA, 22 nt, Human
gagggaaaauaaaauugcagua

SEQ ID NO: 171376 - RNA, 19 nt, Human
uauuucaaagugccgucua

SEQ ID NO: 171377 - RNA, 22 nt, Human
auacaugugggucuaaacauau

SEQ ID NO: 171378 - RNA, 22 nt, Human
guucuaauauuuuaaaagccaa

SEQ ID NO: 171379 - RNA, 21 nt, Human
agccagucuguuuucuagugc

SEQ ID NO: 171380 - RNA, 22 nt, Human
cauggucuacaauuucauuuua

SEQ ID NO: 171381 - RNA, 18 nt, Human
uuaguauaacugccugug

SEQ ID NO: 171382 - RNA, 22 nt, Human
guauuaggagguggagccuuug

SEQ ID NO: 171383 - RNA, 22 nt, Human
gcuggaagaaugagugccucgu

SEQ ID NO: 171384 - RNA, 22 nt, Human
gagucaccacugugauagucga

SEQ ID NO: 171385 - RNA, 22 nt, Human
gagcuuuaccuuagguucuguu

SEQ ID NO: 171386 - RNA, 22 nt, Human
uguuuauucauggcuaaugaaa

SEQ ID NO: 171387 - RNA, 22 nt, Human
auuuauuaugggauuuggcuca

SEQ ID NO: 171388 - RNA, 20 nt, Human
caccacagaauuggggacag

SEQ ID NO: 171389 - RNA, 22 nt, Human
ucuuuaaucauaaccaagaugg

SEQ ID NO: 171390 - RNA, 22 nt, Human
uuucuugagcccaggaggugga

SEQ ID NO: 171391 - RNA, 22 nt, Human
gaggcuccccaugaggccccag

SEQ ID NO: 171392 - RNA, 22 nt, Human
agccagagacugugucuguaau

SEQ ID NO: 171393 - RNA, 22 nt, Human
ucgggcucgcucuccuagcgga

SEQ ID NO: 171394 - RNA, 20 nt, Human
gucugcccaggccaccacgg

SEQ ID NO: 171395 - RNA, 22 nt, Human
gacaggcuuccuaagugccaga

SEQ ID NO: 171396 - RNA, 22 nt, Human
cuggauguuuaugaaggaccca

SEQ ID NO: 171397 - RNA, 22 nt, Human
aacauguugcuuuaauaauauu

SEQ ID NO: 171398 - RNA, 22 nt, Human
gggcuccaccuagggacacugg

SEQ ID NO: 171399 - RNA, 22 nt, Human
uuuugcuuuuguaacacagugu

SEQ ID NO: 171400 - RNA, 22 nt, Human
uuucacauuuguuuuaagaagu

SEQ ID NO: 171401 - RNA, 22 nt, Human
aaguguuuauuuauaacgaucu

SEQ ID NO: 171402 - RNA, 22 nt, Human
ucuucccuaaucaccaucuuca

SEQ ID NO: 171403 - RNA, 22 nt, Human
aaugugaucgcuuuagaagcuu

SEQ ID NO: 171404 - RNA, 22 nt, Human
cagggcucccucuggcucccag

SEQ ID NO: 171405 - RNA, 22 nt, Human
ugcagggaaugcuugcagcaug

SEQ ID NO: 171406 - RNA, 22 nt, Human
cagaagaguagcugaacaaguu

SEQ ID NO: 171407 - RNA, 22 nt, Human
uuaauuacuaagcacaaugcaa

SEQ ID NO: 171408 - RNA, 22 nt, Human
guggaauguccuugaucauaag

SEQ ID NO: 171409 - RNA, 22 nt, Human
uuauccaacaugacuuaugucc

SEQ ID NO: 171410 - RNA, 20 nt, Human
uuucaguugguuaauggcau

SEQ ID NO: 171411 - RNA, 22 nt, Human
uacuuguagcagguggcauuua

SEQ ID NO: 171412 - RNA, 16 nt, Human
agcagguguauagugu

SEQ ID NO: 171413 - RNA, 22 nt, Human
agaagaggggugucccuguggc

SEQ ID NO: 171414 - RNA, 22 nt, Human
cauuguuauagcauuacacacc

SEQ ID NO: 171415 - RNA, 22 nt, Human
gaugugucuauucaacaugaaa

SEQ ID NO: 171416 - RNA, 22 nt, Human
agcagggcuugccgcuuguccu

SEQ ID NO: 171417 - RNA, 22 nt, Human
aaucagucucauuuagcaggga

SEQ ID NO: 171418 - RNA, 22 nt, Human
cuuagggaauugggaggaugcc

SEQ ID NO: 171419 - RNA, 22 nt, Human
cauuucaauacaguuuguaaau

SEQ ID NO: 171420 - RNA, 22 nt, Human
agcugcaagauaaaagugaugu

SEQ ID NO: 171421 - RNA, 22 nt, Human
gcaccugccugggacugaagau

SEQ ID NO: 171422 - RNA, 22 nt, Human
uguacaaucuuggucccuuuau

SEQ ID NO: 171423 - RNA, 22 nt, Human
agacacugaaucagagggacau

SEQ ID NO: 171424 - RNA, 21 nt, Human
aaagugguaaggauuauuuug

SEQ ID NO: 171425 - RNA, 19 nt, Human
uggugcuggccucccaugg

SEQ ID NO: 171426 - RNA, 22 nt, Human
uagggcucuggugggcucuguu

SEQ ID NO: 171427 - RNA, 22 nt, Human
uuguacaaauaggaaccucuga

SEQ ID NO: 171428 - RNA, 22 nt, Human
gggcagguggcaaagccagagg

SEQ ID NO: 171429 - RNA, 22 nt, Human
ggccuuuaagcaauugaaaaga

SEQ ID NO: 171430 - RNA, 22 nt, Human
ucaggugugugguggaaggcag

SEQ ID NO: 171431 - RNA, 22 nt, Human
agcuggagcuucaagcagguaa

SEQ ID NO: 171432 - RNA, 23 nt, Human
gagugcagaauagacaugcagug

SEQ ID NO: 171433 - RNA, 22 nt, Human
acagaauucuaguauguggcuu

SEQ ID NO: 171434 - RNA, 21 nt, Human
cuguccuggucuagaggcaca

SEQ ID NO: 171435 - RNA, 22 nt, Human
acaacuuugacccuuguucuua

SEQ ID NO: 171436 - RNA, 22 nt, Human
ugaauccagagcuauuucgucc

SEQ ID NO: 171437 - RNA, 22 nt, Human
uucauucuuugaaucugaggua

SEQ ID NO: 171438 - RNA, 22 nt, Human
ccacccagccagaugcaggaag

SEQ ID NO: 171439 - RNA, 22 nt, Human
aauguuuuauagcucaagcaau

SEQ ID NO: 171440 - RNA, 22 nt, Human
cuguccagaaagggggcaacaa

SEQ ID NO: 171441 - RNA, 22 nt, Human
ucagacaggcuucuuucucccu

SEQ ID NO: 171442 - RNA, 22 nt, Human
aagggcuccacuugaaucacac

SEQ ID NO: 171443 - RNA, 22 nt, Human
uugauuaaucccaugugaguag

SEQ ID NO: 171444 - RNA, 19 nt, Human
gcugggugggguccacagc

SEQ ID NO: 171445 - RNA, 22 nt, Human
uccuuucugucuuuacucugga

SEQ ID NO: 171446 - RNA, 22 nt, Human
uuguaagaauaugaauacaaau

SEQ ID NO: 171447 - RNA, 22 nt, Human
aguccuuaugagaugcugccuu

SEQ ID NO: 171448 - RNA, 22 nt, Human
aaacggauauaacagcaaacgc

SEQ ID NO: 171449 - RNA, 22 nt, Human
uuuaauuuuccugguaggccug

SEQ ID NO: 171450 - RNA, 22 nt, Human
uauuuagaugcauuuggauugc

SEQ ID NO: 171451 - RNA, 22 nt, Human
gaauuacaugacccugaguaga

SEQ ID NO: 171452 - RNA, 22 nt, Human
caaauuccucagaaucagaaaa

SEQ ID NO: 171453 - RNA, 22 nt, Human
ggaugucuuuacuuugggauuu

SEQ ID NO: 171454 - RNA, 22 nt, Human
gcaaacaaggacauacauccug

SEQ ID NO: 171455 - RNA, 22 nt, Human
auauuaaauggauuuugggagc

SEQ ID NO: 171456 - RNA, 22 nt, Human
uauuauuaaauggcagaauuuu

SEQ ID NO: 171457 - RNA, 22 nt, Human
auguacuaugcagucaacuguu

SEQ ID NO: 171458 - RNA, 22 nt, Human
aaauagauugcugaggcauuac

SEQ ID NO: 171459 - RNA, 22 nt, Human
ugucagagcaaugagguucagc

SEQ ID NO: 171460 - RNA, 16 nt, Human
uccaggcauaucugag

SEQ ID NO: 171461 - RNA, 22 nt, Human
aguauugugacucaaguauucu

SEQ ID NO: 171462 - RNA, 22 nt, Human
gagcaguggucugaucuucuaa

SEQ ID NO: 171463 - RNA, 22 nt, Human
uuuaacauguucaagaaacaua

SEQ ID NO: 171464 - RNA, 22 nt, Human
gaauuucagaucagagaccauu

SEQ ID NO: 171465 - RNA, 22 nt, Human
gcagggacaucuucagaucacu

SEQ ID NO: 171466 - RNA, 22 nt, Human
aaguuugcauagauuaagcauu

SEQ ID NO: 171467 - RNA, 22 nt, Human
accaugaugggaagcucagggc

SEQ ID NO: 171468 - RNA, 22 nt, Human
agauuccagaucccaaaaauga

SEQ ID NO: 171469 - RNA, 22 nt, Human
agacagacaaaauuccugccug

SEQ ID NO: 171470 - RNA, 22 nt, Human
aagggcucucugcauugaaauu

SEQ ID NO: 171471 - RNA, 22 nt, Human
uccaggcaguuuuccagguugu

SEQ ID NO: 171472 - RNA, 22 nt, Human
agcucccaggcagucaugagga

SEQ ID NO: 171473 - RNA, 22 nt, Human
guacacauauauuaaaaauugu

SEQ ID NO: 171474 - RNA, 22 nt, Human
acacuaauuaagcugcuuuacu

SEQ ID NO: 171475 - RNA, 22 nt, Human
uaugaaaauuuagcugaagcau

SEQ ID NO: 171476 - RNA, 22 nt, Human
ucaggaaacuacaguugaacua

SEQ ID NO: 171477 - RNA, 22 nt, Human
ggcuuucucacagcauggcagc

SEQ ID NO: 171478 - RNA, 22 nt, Human
aggcaugacuuuggcugaagaa

SEQ ID NO: 171479 - RNA, 22 nt, Human
aauauguuccacuuaaagcugg

SEQ ID NO: 171480 - RNA, 22 nt, Human
ugcaggugcuccgggggugccc

SEQ ID NO: 171481 - RNA, 22 nt, Human
ugagacaaaauugacagacaaa

SEQ ID NO: 171482 - RNA, 22 nt, Human
agaagggcuacacgggcucucc

SEQ ID NO: 171483 - RNA, 22 nt, Human
uguaauauuguagugacaguac

SEQ ID NO: 171484 - RNA, 22 nt, Human
uuccuuagauccuucaaucacg

SEQ ID NO: 171485 - RNA, 22 nt, Human
auaaacaguaaaugugagcagu

SEQ ID NO: 171486 - RNA, 22 nt, Human
caugugucuuuauggagccaca

SEQ ID NO: 171487 - RNA, 22 nt, Human
cagauauuaggagcucaauaau

SEQ ID NO: 171488 - RNA, 23 nt, Human
cauaaaauauuaguaugguagca

SEQ ID NO: 171489 - RNA, 22 nt, Human
ucuucaauuagauuuaccaauu

SEQ ID NO: 171490 - RNA, 22 nt, Human
acaaaagugagugugucucaga

SEQ ID NO: 171491 - RNA, 19 nt, Human
accaggcuuauggucagug

SEQ ID NO: 171492 - RNA, 20 nt, Human
auccaugagagucuggauuc

SEQ ID NO: 171493 - RNA, 22 nt, Human
uacaucauaauaauacuuagaa

SEQ ID NO: 171494 - RNA, 22 nt, Human
ccuggaggggaccaggaccagg

SEQ ID NO: 171495 - RNA, 22 nt, Human
cugcagagcagccaguccccca

SEQ ID NO: 171496 - RNA, 22 nt, Human
agucaccaggguuugcuggguu

SEQ ID NO: 171497 - RNA, 22 nt, Human
gcagggcucaacaggacacccc

SEQ ID NO: 171498 - RNA, 22 nt, Human
cagcuuuauuucacguguuugu

SEQ ID NO: 171499 - RNA, 22 nt, Human
ucuacccagagcuaugaccuga

SEQ ID NO: 171500 - RNA, 22 nt, Human
cgugagcaaaauggacacuccc

SEQ ID NO: 171501 - RNA, 20 nt, Human
agugacugggagaauggauu

SEQ ID NO: 171502 - RNA, 22 nt, Human
uuaugauuugccacagauuggu

SEQ ID NO: 171503 - RNA, 22 nt, Human
ccagguggcccugcccuacucu

SEQ ID NO: 171504 - RNA, 22 nt, Human
acuuaaaaccagacagcgucau

SEQ ID NO: 171505 - RNA, 22 nt, Human
ugacagacuuuacuucuccuau

SEQ ID NO: 171506 - RNA, 22 nt, Human
uuaaaguguuaacugaagcuua

SEQ ID NO: 171507 - RNA, 22 nt, Human
uaagaaucgauguuuauuuaga

SEQ ID NO: 171508 - RNA, 22 nt, Human
uaagagaauguuguggcuaggu

SEQ ID NO: 171509 - RNA, 22 nt, Human
ccagguggauaagguuucugga

SEQ ID NO: 171510 - RNA, 22 nt, Human
acuuaaaaacagauccagcagg

SEQ ID NO: 171511 - RNA, 23 nt, Human
uguguccuuaacuguauauacua

SEQ ID NO: 171512 - RNA, 18 nt, Human
ucagguguuuucuguaua

SEQ ID NO: 171513 - RNA, 22 nt, Human
agacaugugguauaaucagggg

SEQ ID NO: 171514 - RNA, 22 nt, Human
aaagcugcugccaaucaggcuu

SEQ ID NO: 171515 - RNA, 22 nt, Human
uucuucuucaagugcugcauuc

SEQ ID NO: 171516 - RNA, 23 nt, Human
guguguccauucgcacucuuagg

SEQ ID NO: 171517 - RNA, 22 nt, Human
uuuggacuuagccugcagaauu

SEQ ID NO: 171518 - RNA, 22 nt, Human
gggcagguggccucuuguacua

SEQ ID NO: 171519 - RNA, 22 nt, Human
uuccuucucagcccucgaggau

SEQ ID NO: 171520 - RNA, 17 nt, Human
cagcuuuaugcuacugu

SEQ ID NO: 171521 - RNA, 22 nt, Human
agacagacggcuuuauacacag

SEQ ID NO: 171522 - RNA, 22 nt, Human
uuucagauggagguuuaggaca

SEQ ID NO: 171523 - RNA, 22 nt, Human
ggaugggaacuugguagggcau

SEQ ID NO: 171524 - RNA, 22 nt, Human
auuuaagauugcguauucaugu

SEQ ID NO: 171525 - RNA, 22 nt, Human
uacacacagaggccaugggauu

SEQ ID NO: 171526 - RNA, 22 nt, Human
uccauugugauuauauacaaaa

SEQ ID NO: 171527 - RNA, 22 nt, Human
uauccaaaguuucucagaaacu

SEQ ID NO: 171528 - RNA, 22 nt, Human
gaauuuuucuggaagcaauuau

SEQ ID NO: 171529 - RNA, 22 nt, Human
aaugaaacuguauauagacugu

SEQ ID NO: 171530 - RNA, 22 nt, Human
gcagaauucuacagaugauaaa

SEQ ID NO: 171531 - RNA, 23 nt, Human
uccugcagauaagcugguugaca

SEQ ID NO: 171532 - RNA, 19 nt, Human
ucaaaggcuuuuaggagac

SEQ ID NO: 171533 - RNA, 22 nt, Human
ugcuugaacccaggaaguggag

SEQ ID NO: 171534 - RNA, 19 nt, Human
uguacauauagagcucagu

SEQ ID NO: 171535 - RNA, 22 nt, Human
agaaaauauucauugagaggcu

SEQ ID NO: 171536 - RNA, 22 nt, Human
uuuaggcauugaauuagaauag

SEQ ID NO: 171537 - RNA, 22 nt, Human
gcaggcagagagggguuuccag

SEQ ID NO: 171538 - RNA, 22 nt, Human
ccagguguuacacgaguguuaa

SEQ ID NO: 171539 - RNA, 22 nt, Human
aguguccucuauuaugacuuua

SEQ ID NO: 171540 - RNA, 22 nt, Human
aguuuacaugacguguauuuca

SEQ ID NO: 171541 - RNA, 22 nt, Human
aacaugugagcagguuuuuuau

SEQ ID NO: 171542 - RNA, 22 nt, Human
agugugagccuacaggccaaag

SEQ ID NO: 171543 - RNA, 22 nt, Human
aacaaccaaaaagaugaaugua

SEQ ID NO: 171544 - RNA, 22 nt, Human
uugcugaucugugaaucagcca

SEQ ID NO: 171545 - RNA, 22 nt, Human
ugaugagggagauuugagccca

SEQ ID NO: 171546 - RNA, 22 nt, Human
gcuguucagaugcgauucagga

SEQ ID NO: 171547 - RNA, 22 nt, Human
ccauuucacucuuccugaagga

SEQ ID NO: 171548 - RNA, 22 nt, Human
cuauagaaaauuguaucacacg

SEQ ID NO: 171549 - RNA, 22 nt, Human
caauuucaagauucuguucuuu

SEQ ID NO: 171550 - RNA, 22 nt, Human
aacccagccguguagcugccgc

SEQ ID NO: 171551 - RNA, 16 nt, Human
gcaggcagaucacaug

SEQ ID NO: 171552 - RNA, 22 nt, Human
caugcagcaggaucucauuccc

SEQ ID NO: 171553 - RNA, 22 nt, Human
ucuguccucuuugaagcugcuc

SEQ ID NO: 171554 - RNA, 23 nt, Human
uccaugagaugugggcuucuagu

SEQ ID NO: 171555 - RNA, 22 nt, Human
gcuggguccaugguccucgggu

SEQ ID NO: 171556 - RNA, 22 nt, Human
ugacccauggucugaucauagg

SEQ ID NO: 171557 - RNA, 22 nt, Human
auggcauuccaagucuucuuuu

SEQ ID NO: 171558 - RNA, 22 nt, Human
uuucuguaaguggcaaauaaug

SEQ ID NO: 171559 - RNA, 22 nt, Human
uucauacuguguuuccaaguuu

SEQ ID NO: 171560 - RNA, 22 nt, Human
cuaauuauguuguuauaaucaa

SEQ ID NO: 171561 - RNA, 22 nt, Human
ccuuccuuugcaucauuucuag

SEQ ID NO: 171562 - RNA, 22 nt, Human
caucagaauagcucuguggaua

SEQ ID NO: 171563 - RNA, 16 nt, Human
ugguggggaggacagc

SEQ ID NO: 171564 - RNA, 22 nt, Human
uaguacaguuuaaauauuaaua

SEQ ID NO: 171565 - RNA, 22 nt, Human
gccaggcauuuauugauugaau

SEQ ID NO: 171566 - RNA, 22 nt, Human
agggaagaggaccagagucucu

SEQ ID NO: 171567 - RNA, 22 nt, Human
cauuucaaaagaauugccagaa

SEQ ID NO: 171568 - RNA, 22 nt, Human
gcacaauaauucuuguuuugcu

SEQ ID NO: 171569 - RNA, 22 nt, Human
uguuugcuuacuuguaugcugc

SEQ ID NO: 171570 - RNA, 22 nt, Human
gaugugucuggcuccccugcaa

SEQ ID NO: 171571 - RNA, 22 nt, Human
aggauuuauuggugggaaguua

SEQ ID NO: 171572 - RNA, 22 nt, Human
ugcuuaaaauaguucauuuuug

SEQ ID NO: 171573 - RNA, 22 nt, Human
uucauucugcaguucucagcuc

SEQ ID NO: 171574 - RNA, 22 nt, Human
uccugcaggggcugaggaacca

SEQ ID NO: 171575 - RNA, 22 nt, Human
gugcuggcaccccucuccaguu

SEQ ID NO: 171576 - RNA, 22 nt, Human
uucaacccaaguucuccauuuu

SEQ ID NO: 171577 - RNA, 22 nt, Human
uauaaaacagaaagcacuaccu

SEQ ID NO: 171578 - RNA, 18 nt, Human
aggcaggugcuggaaguc

SEQ ID NO: 171579 - RNA, 22 nt, Human
gcagggcagcugaagcuaggug

SEQ ID NO: 171580 - RNA, 23 nt, Human
uucaaaacuggaaaaucagaugc

SEQ ID NO: 171581 - RNA, 22 nt, Human
auugcuggcccagaugcuuuag

SEQ ID NO: 171582 - RNA, 20 nt, Human
acugugaaugcugaauuagc

SEQ ID NO: 171583 - RNA, 22 nt, Human
aagauuuaccacuuuauucaag

SEQ ID NO: 171584 - RNA, 22 nt, Human
uucuguauauuguaaagacuca

SEQ ID NO: 171585 - RNA, 22 nt, Human
auccucaguguuucugacaucu

SEQ ID NO: 171586 - RNA, 21 nt, Human
ugcuuuaugggaaaaauguca

SEQ ID NO: 171587 - RNA, 21 nt, Human
uuuaauuugcauguaugacgc

SEQ ID NO: 171588 - RNA, 22 nt, Human
uguccugggaaaucccuuaggc

SEQ ID NO: 171589 - RNA, 22 nt, Human
cauuugaaccuggauguucuua

SEQ ID NO: 171590 - RNA, 22 nt, Human
aaagaaucacauccuucagcaa

SEQ ID NO: 171591 - RNA, 22 nt, Human
gacagacacaauugauccauga

SEQ ID NO: 171592 - RNA, 22 nt, Human
aaaaaccuuucauugcaaaugu

SEQ ID NO: 171593 - RNA, 22 nt, Human
uuccaugccuagaacaggauuc

SEQ ID NO: 171594 - RNA, 22 nt, Human
aaaguccugacugcaggggaug

SEQ ID NO: 171595 - RNA, 22 nt, Human
aauuucaaugcacucaugguug

SEQ ID NO: 171596 - RNA, 22 nt, Human
ucuuccucccuacagagcucag

SEQ ID NO: 171597 - RNA, 22 nt, Human
gccaggcagauaugugagcuua

SEQ ID NO: 171598 - RNA, 21 nt, Human
uauuugcugccaucuuugagg

SEQ ID NO: 171599 - RNA, 22 nt, Human
uccaugagagguaacuuuacaa

SEQ ID NO: 171600 - RNA, 22 nt, Human
ucaaguuuaauugagauguuua

SEQ ID NO: 171601 - RNA, 22 nt, Human
aagggcucgguagcaguccuga

SEQ ID NO: 171602 - RNA, 22 nt, Human
ugcuuucauugugauaggaagc

SEQ ID NO: 171603 - RNA, 22 nt, Human
uucagaauauuuguuuuacaug

SEQ ID NO: 171604 - RNA, 22 nt, Human
uuccuucugaagccuuuguguu

SEQ ID NO: 171605 - RNA, 22 nt, Human
uacauguuuacuccaagucagg

SEQ ID NO: 171606 - RNA, 22 nt, Human
gggguuaacaguauugcucaug

SEQ ID NO: 171607 - RNA, 22 nt, Human
guguccugggucucugauucuu

SEQ ID NO: 171608 - RNA, 23 nt, Human
aaucuauacuuaggcugguaaua

SEQ ID NO: 171609 - RNA, 22 nt, Human
caaauucucacccuguuugauu

SEQ ID NO: 171610 - RNA, 22 nt, Human
auaguuuuaaaaccucaggaag

SEQ ID NO: 171611 - RNA, 20 nt, Human
guguuucaugugauacaaug

SEQ ID NO: 171612 - RNA, 22 nt, Human
ccaggccugcaucugcugcgca

SEQ ID NO: 171613 - RNA, 22 nt, Human
cuggcuuuggucaugugaucau

SEQ ID NO: 171614 - RNA, 22 nt, Human
acaccauacucauguugguucc

SEQ ID NO: 171615 - RNA, 22 nt, Human
agaaucugguagaaccaaggau

SEQ ID NO: 171616 - RNA, 22 nt, Human
ugaacaacugcaaaaaucucca

SEQ ID NO: 171617 - RNA, 21 nt, Human
guagggacagagaguugguga

SEQ ID NO: 171618 - RNA, 22 nt, Human
gcaguguuguuaaaagauuaga

SEQ ID NO: 171619 - RNA, 22 nt, Human
acuuucuuaggcuguauaaaug

SEQ ID NO: 171620 - RNA, 22 nt, Human
uuuacuugauauggagcugagg

SEQ ID NO: 171621 - RNA, 22 nt, Human
gauuuccaggucauuaauaaag

SEQ ID NO: 171622 - RNA, 22 nt, Human
cagggcucgcucuugcccuucg

SEQ ID NO: 171623 - RNA, 22 nt, Human
uucagagauggaaggcagaaug

SEQ ID NO: 171624 - RNA, 22 nt, Human
gcagacagacugcagugauuuu

SEQ ID NO: 171625 - RNA, 22 nt, Human
aaccugcauguuucuaaaagca

SEQ ID NO: 171626 - RNA, 22 nt, Human
agcaggugguaggcagucagca

SEQ ID NO: 171627 - RNA, 22 nt, Human
aguccagugaacuguaaauagg

SEQ ID NO: 171628 - RNA, 22 nt, Human
ggcaggugcuugucgaaggccu

SEQ ID NO: 171629 - RNA, 22 nt, Human
uccuucuuugacaaguggcaga

SEQ ID NO: 171630 - RNA, 19 nt, Human
aaucagaaauaucgaggcc

SEQ ID NO: 171631 - RNA, 22 nt, Human
cccagcucugcagaccugcccu

SEQ ID NO: 171632 - RNA, 22 nt, Human
ucagagaguuagugucuuagcu

SEQ ID NO: 171633 - RNA, 22 nt, Human
agaaaucaauaucuauauguug

SEQ ID NO: 171634 - RNA, 22 nt, Human
ggcaggaggugaguggcgggug

SEQ ID NO: 171635 - RNA, 22 nt, Human
uuuauguuugacaaugaucugg

SEQ ID NO: 171636 - RNA, 22 nt, Human
cucuggaagugauggcagguca

SEQ ID NO: 171637 - RNA, 22 nt, Human
cuuccuccgaagaaguugcugg

SEQ ID NO: 171638 - RNA, 22 nt, Human
aaugaacauauaaagagaucuu

SEQ ID NO: 171639 - RNA, 22 nt, Human
uuguacaaguauuaugugaaca

SEQ ID NO: 171640 - RNA, 18 nt, Human
ccagguggugacagagau

SEQ ID NO: 171641 - RNA, 21 nt, Human
aagaaguuuggauuuuguccu

SEQ ID NO: 171642 - RNA, 22 nt, Human
agcuggagaauguggaugaucc

SEQ ID NO: 171643 - RNA, 22 nt, Human
ccaggugugucaccauugccca

SEQ ID NO: 171644 - RNA, 22 nt, Human
uguacaauguggccaguguuaa

SEQ ID NO: 171645 - RNA, 20 nt, Human
uuuauugagcacguacugug

SEQ ID NO: 171646 - RNA, 22 nt, Human
uuccuucuggaagcuucagggg

SEQ ID NO: 171647 - RNA, 22 nt, Human
uuccuuagccugccuuccaggg

SEQ ID NO: 171648 - RNA, 22 nt, Human
aggauuuaggagcuggcuaacg

SEQ ID NO: 171649 - RNA, 18 nt, Human
ugaggcagucagugaugg

SEQ ID NO: 171650 - RNA, 22 nt, Human
auaaagucuaccguauuaaaga

SEQ ID NO: 171651 - RNA, 22 nt, Human
cuguccuccggccaccuacagu

SEQ ID NO: 171652 - RNA, 22 nt, Human
cauuaaaauaucucaugguguu

SEQ ID NO: 171653 - RNA, 22 nt, Human
auuucaggagcaguuucagugg

SEQ ID NO: 171654 - RNA, 22 nt, Human
gugagcaggauuucauggugua

SEQ ID NO: 171655 - RNA, 22 nt, Human
uugcacuccagcccgagcaaca

SEQ ID NO: 171656 - RNA, 22 nt, Human
ccuggaggcucugggagggcag

SEQ ID NO: 171657 - RNA, 19 nt, Human
ucccaguggggagaggugu

SEQ ID NO: 171658 - RNA, 22 nt, Human
uuucuagugguuaagauuuaca

SEQ ID NO: 171659 - RNA, 22 nt, Human
cuuuaacaaaugacucuugucu

SEQ ID NO: 171660 - RNA, 22 nt, Human
uuucagaaaacuuaucaucagu

SEQ ID NO: 171661 - RNA, 22 nt, Human
agggcccuagggaaugagacau

SEQ ID NO: 171662 - RNA, 22 nt, Human
ggcaggugugagaucgaggcca

SEQ ID NO: 171663 - RNA, 22 nt, Human
uggagcaggugggaugucguga

SEQ ID NO: 171664 - RNA, 22 nt, Human
uagacauuuucucaacaucucu

SEQ ID NO: 171665 - RNA, 22 nt, Human
cucuggaauguuuacaugcccu

SEQ ID NO: 171666 - RNA, 22 nt, Human
ccaggugugauuuggcaguguc

SEQ ID NO: 171667 - RNA, 22 nt, Human
ugacagguuguguagguggcca

SEQ ID NO: 171668 - RNA, 22 nt, Human
uuuaggcagucauugaacaagu

SEQ ID NO: 171669 - RNA, 21 nt, Human
agcaggugaaccuccaguaca

SEQ ID NO: 171670 - RNA, 22 nt, Human
guaaaauagaauaacguggcua

SEQ ID NO: 171671 - RNA, 22 nt, Human
auuuuuaugacaaaccauccuc

SEQ ID NO: 171672 - RNA, 22 nt, Human
gauuuuucaguauaaaauauau

SEQ ID NO: 171673 - RNA, 22 nt, Human
gcagggcacagacagugccaag

SEQ ID NO: 171674 - RNA, 22 nt, Human
uagaaaugugauaauagcuuaa

SEQ ID NO: 171675 - RNA, 22 nt, Human
ccagguggacggcgaguacagg

SEQ ID NO: 171676 - RNA, 22 nt, Human
uguccucagauaugucuacucu

SEQ ID NO: 171677 - RNA, 22 nt, Human
cuguuauuugagaguguugaau

SEQ ID NO: 171678 - RNA, 22 nt, Human
augauguugauaaauuacuuua

SEQ ID NO: 171679 - RNA, 22 nt, Human
acuguucaaguuuuaugcugga

SEQ ID NO: 171680 - RNA, 22 nt, Human
gacagacaggugugguaggcac

SEQ ID NO: 171681 - RNA, 22 nt, Human
aacacaaagaagcugcaggauc

SEQ ID NO: 171682 - RNA, 20 nt, Human
gggugggagagucugagggu

SEQ ID NO: 171683 - RNA, 18 nt, Human
gcagguguggagaagggg

SEQ ID NO: 171684 - RNA, 22 nt, Human
uccaugcaaacaguggcuagcu

SEQ ID NO: 171685 - RNA, 22 nt, Human
uuucauaaccucaagcuacagu

SEQ ID NO: 171686 - RNA, 22 nt, Human
uauaucauggagauuaacauuc

SEQ ID NO: 171687 - RNA, 22 nt, Human
agucccuucucaaagugugcgg

SEQ ID NO: 171688 - RNA, 22 nt, Human
gaaagcacaguucugaccaugu

SEQ ID NO: 171689 - RNA, 22 nt, Human
uauuuccagcaguaagaagaca

SEQ ID NO: 171690 - RNA, 22 nt, Human
caaauaguuuuucauguauuau

SEQ ID NO: 171691 - RNA, 22 nt, Human
cauuagggccaccauaacaaaa

SEQ ID NO: 171692 - RNA, 20 nt, Human
cugcaaaaugacauuaggaa

SEQ ID NO: 171693 - RNA, 21 nt, Human
ucuuccuccacagcgugccac

SEQ ID NO: 171694 - RNA, 22 nt, Human
uuacagaaucuacucgugguga

SEQ ID NO: 171695 - RNA, 22 nt, Human
uugguccacugugaaauuggga

SEQ ID NO: 171696 - RNA, 21 nt, Human
aggcugcaugcaugagugugg

SEQ ID NO: 171697 - RNA, 22 nt, Human
ugcagggaggccccgcagcccu

SEQ ID NO: 171698 - RNA, 22 nt, Human
aaguccuugaagaaacaguucu

SEQ ID NO: 171699 - RNA, 22 nt, Human
gcuggccucaucacugacuucu

SEQ ID NO: 171700 - RNA, 22 nt, Human
acuuugaaagccuuggccccgg

SEQ ID NO: 171701 - RNA, 21 nt, Human
ucaguaaaccuaaagauugua

SEQ ID NO: 171702 - RNA, 22 nt, Human
agggcuccaggggcugggugac

SEQ ID NO: 171703 - RNA, 22 nt, Human
uuuacagucugucuagcaaugu

SEQ ID NO: 171704 - RNA, 23 nt, Human
gaaucaguggcuaacaaggaaac

SEQ ID NO: 171705 - RNA, 22 nt, Human
uucuuugcccuuaaugaaauaa

SEQ ID NO: 171706 - RNA, 22 nt, Human
cagcaugacagucugcagcaga

SEQ ID NO: 171707 - RNA, 22 nt, Human
caagcuuguuucuccugggggu

SEQ ID NO: 171708 - RNA, 22 nt, Human
cucuuccuuaagacuauaaaga

SEQ ID NO: 171709 - RNA, 22 nt, Human
uugcauuccaguccccacugug

SEQ ID NO: 171710 - RNA, 22 nt, Human
caguccuuggcuucauccgagu

SEQ ID NO: 171711 - RNA, 22 nt, Human
uccaggcagucauuaaucucua

SEQ ID NO: 171712 - RNA, 22 nt, Human
ccagagagucgaugggggacac

SEQ ID NO: 171713 - RNA, 22 nt, Human
caguccagcccccugcuaaaag

SEQ ID NO: 171714 - RNA, 22 nt, Human
aggcaggugggucacuugaguc

SEQ ID NO: 171715 - RNA, 22 nt, Human
uuauauuaguuagacuugcugu

SEQ ID NO: 171716 - RNA, 22 nt, Human
uugcagcuucgagucuaucugu

SEQ ID NO: 171717 - RNA, 22 nt, Human
uacaggugcucuacagacagga

SEQ ID NO: 171718 - RNA, 22 nt, Human
acagacagauuuugucugaugu

SEQ ID NO: 171719 - RNA, 22 nt, Human
cuguccucaacccauccuucuc

SEQ ID NO: 171720 - RNA, 22 nt, Human
uuuucagaggccuaagagguuu

SEQ ID NO: 171721 - RNA, 22 nt, Human
ugauggucaacaauuuugagug

SEQ ID NO: 171722 - RNA, 22 nt, Human
accaggcagcugggggugaugu

SEQ ID NO: 171723 - RNA, 22 nt, Human
augugucuaauuccaggagcac

SEQ ID NO: 171724 - RNA, 22 nt, Human
uauguacacacacaugcaugua

SEQ ID NO: 171725 - RNA, 22 nt, Human
ggggugggcgugcagggacacc

SEQ ID NO: 171726 - RNA, 22 nt, Human
agugugaguuacaaagugugaa

SEQ ID NO: 171727 - RNA, 22 nt, Human
auagaaauggcagcuggugcua

SEQ ID NO: 171728 - RNA, 22 nt, Human
ugcuuuaaccaucuuguuugga

SEQ ID NO: 171729 - RNA, 21 nt, Human
ugucugauguauuuuuugccu

SEQ ID NO: 171730 - RNA, 22 nt, Human
acauauauuacuaguaaagaca

SEQ ID NO: 171731 - RNA, 20 nt, Human
agguguccuguagcuugagu

SEQ ID NO: 171732 - RNA, 22 nt, Human
ucuggaugauaugugaacuuga

SEQ ID NO: 171733 - RNA, 22 nt, Human
uuucaagaacaacauucauuca

SEQ ID NO: 171734 - RNA, 22 nt, Human
uccugcagccacugcaggcaga

SEQ ID NO: 171735 - RNA, 22 nt, Human
uuuaaauuuagaagaaacacug

SEQ ID NO: 171736 - RNA, 21 nt, Human
uuugacuccucauuuuuauau

SEQ ID NO: 171737 - RNA, 22 nt, Human
accuuauuaaaaugaugaugua

SEQ ID NO: 171738 - RNA, 22 nt, Human
auagaauuugcacuaaaucugc

SEQ ID NO: 171739 - RNA, 22 nt, Human
auuaugcugguuuacacauuuu

SEQ ID NO: 171740 - RNA, 22 nt, Human
uuucauaauacuguacaugaaa

SEQ ID NO: 171741 - RNA, 22 nt, Human
uuuugagauggagucuugcucu

SEQ ID NO: 171742 - RNA, 22 nt, Human
ucugaacagaaaagaugcacaa

SEQ ID NO: 171743 - RNA, 22 nt, Human
uccaugagggacacuggaugcu

SEQ ID NO: 171744 - RNA, 22 nt, Human
cuucagagugcagaagauuggg

SEQ ID NO: 171745 - RNA, 22 nt, Human
auuuagcaaaaaaugaugaagc

SEQ ID NO: 171746 - RNA, 17 nt, Human
aaugaaugaauucuuug

SEQ ID NO: 171747 - RNA, 22 nt, Human
uuauuccauucaguucaacaag

SEQ ID NO: 171748 - RNA, 19 nt, Human
uagguguccgccggaggug

SEQ ID NO: 171749 - RNA, 22 nt, Human
cuuuacauaaggauaaaccugg

SEQ ID NO: 171750 - RNA, 22 nt, Human
ucagacagugugaucagucucu

SEQ ID NO: 171751 - RNA, 22 nt, Human
uauuuaaaauagugcuccagca

SEQ ID NO: 171752 - RNA, 22 nt, Human
aggaggaauacaauccagcagc

SEQ ID NO: 171753 - RNA, 22 nt, Human
ugcagggccuugggucuuucuu

SEQ ID NO: 171754 - RNA, 22 nt, Human
cauuuguaauacugacuugcag

SEQ ID NO: 171755 - RNA, 22 nt, Human
auaaacagaguaguugcuacug

SEQ ID NO: 171756 - RNA, 22 nt, Human
gguuauauaauucagugcuuuc

SEQ ID NO: 171757 - RNA, 22 nt, Human
agguggagaagagaugggcagu

SEQ ID NO: 171758 - RNA, 22 nt, Human
uuugacucuuagcccaggacuc

SEQ ID NO: 171759 - RNA, 16 nt, Human
agcagggcgggaagga

SEQ ID NO: 171760 - RNA, 22 nt, Human
ccugggugaaaucucuccugca

SEQ ID NO: 171761 - RNA, 22 nt, Human
uuuguguuuguacaaugcacua

SEQ ID NO: 171762 - RNA, 22 nt, Human
caguccuuaaggaaacauuugu

SEQ ID NO: 171763 - RNA, 22 nt, Human
uaggccauucuuggagcuuacu

SEQ ID NO: 171764 - RNA, 22 nt, Human
aggaccuggaucacagagaucu

SEQ ID NO: 171765 - RNA, 18 nt, Human
uggcaggggcaguacgcc

SEQ ID NO: 171766 - RNA, 22 nt, Human
cucuuaaaaacuugauauauuu

SEQ ID NO: 171767 - RNA, 22 nt, Human
uuucuauaugaggagcuaaagu

SEQ ID NO: 171768 - RNA, 19 nt, Human
gcaugcagaguaagaaggu

SEQ ID NO: 171769 - RNA, 22 nt, Human
auggcuuuccugggacaugggc

SEQ ID NO: 171770 - RNA, 22 nt, Human
aauaagauccugaagauauguu

SEQ ID NO: 171771 - RNA, 22 nt, Human
agcugcaaguccaaaggaauua

SEQ ID NO: 171772 - RNA, 22 nt, Human
agacaaguucugugggucaccu

SEQ ID NO: 171773 - RNA, 22 nt, Human
guuuuauaauugcuucauaaga

SEQ ID NO: 171774 - RNA, 22 nt, Human
ugcugccaucucaacugcccuu

SEQ ID NO: 171775 - RNA, 22 nt, Human
auuugaagaaaguuuucuagau

SEQ ID NO: 171776 - RNA, 22 nt, Human
gaaggggaguggcuagugugug

SEQ ID NO: 171777 - RNA, 22 nt, Human
aggcucaguauagcuggcaagu

SEQ ID NO: 171778 - RNA, 22 nt, Human
gacagacaaauguuuuuaacuu

SEQ ID NO: 171779 - RNA, 22 nt, Human
uuugaagucaaagauugauucc

SEQ ID NO: 171780 - RNA, 22 nt, Human
guucuucaucauuaacacucug

SEQ ID NO: 171781 - RNA, 22 nt, Human
gcagacaggauuggguuaauag

SEQ ID NO: 171782 - RNA, 22 nt, Human
cagaugaaggccugaaugucua

SEQ ID NO: 171783 - RNA, 22 nt, Human
uuucacaugguacugccuguuu

SEQ ID NO: 171784 - RNA, 22 nt, Human
uuuaggcagcagugaggaugaa

SEQ ID NO: 171785 - RNA, 22 nt, Human
ugggugagccacaggaguuguc

SEQ ID NO: 171786 - RNA, 22 nt, Human
gcuggaggaucacuugagccca

SEQ ID NO: 171787 - RNA, 22 nt, Human
uggcaggguacaccuuaacacc

SEQ ID NO: 171788 - RNA, 22 nt, Human
uuccugggacuggagcagccca

SEQ ID NO: 171789 - RNA, 23 nt, Human
uccaggcaugagcucuggaugga

SEQ ID NO: 171790 - RNA, 22 nt, Human
uccucccuguaccauuccucug

SEQ ID NO: 171791 - RNA, 22 nt, Human
agggcucccgugaggugacugc

SEQ ID NO: 171792 - RNA, 22 nt, Human
aaucagaaagaggucauguugc

SEQ ID NO: 171793 - RNA, 22 nt, Human
uaugaaacauucauacaaauaa

SEQ ID NO: 171794 - RNA, 22 nt, Human
auugcuggaugagcucuuggau

SEQ ID NO: 171795 - RNA, 22 nt, Human
aauugcuucccaagggaggucu

SEQ ID NO: 171796 - RNA, 22 nt, Human
gagguguccuagaaguauucag

SEQ ID NO: 171797 - RNA, 22 nt, Human
aagggcauugaggcugagagac

SEQ ID NO: 171798 - RNA, 21 nt, Human
auagaacaccaggcauauaua

SEQ ID NO: 171799 - RNA, 22 nt, Human
uauacagucuuuugcuauauuc

SEQ ID NO: 171800 - RNA, 22 nt, Human
uuaaggauguugugauuuauua

SEQ ID NO: 171801 - RNA, 22 nt, Human
uaagacugugagcucagagacu

SEQ ID NO: 171802 - RNA, 22 nt, Human
uguauacaauucacacuuccca

SEQ ID NO: 171803 - RNA, 22 nt, Human
uggcuauugagugaucucuaga

SEQ ID NO: 171804 - RNA, 22 nt, Human
agcugcaaccuuagcuauaggc

SEQ ID NO: 171805 - RNA, 22 nt, Human
acauguaaaaauuaagguaaga

SEQ ID NO: 171806 - RNA, 22 nt, Human
gguuuauuaaugugaacuguau

SEQ ID NO: 171807 - RNA, 22 nt, Human
auuuaaaugcuuaagaggguuu

SEQ ID NO: 171808 - RNA, 22 nt, Human
uccaggcauagaaggcacgcac

SEQ ID NO: 171809 - RNA, 22 nt, Human
gccaggcaguucaaguacacca

SEQ ID NO: 171810 - RNA, 22 nt, Human
ccaaggcaggggaucaaaguuu

SEQ ID NO: 171811 - RNA, 22 nt, Human
uuauccaagcagaagcugcaca

SEQ ID NO: 171812 - RNA, 22 nt, Human
uuucuucacaggguauugggug

SEQ ID NO: 171813 - RNA, 22 nt, Human
aagggcucccugccugaggugg

SEQ ID NO: 171814 - RNA, 22 nt, Human
uggcaaaggcgcucacaugccu

SEQ ID NO: 171815 - RNA, 22 nt, Human
ucagguggcuuggagggggacg

SEQ ID NO: 171816 - RNA, 22 nt, Human
aaauuauucucauguguuucuu

SEQ ID NO: 171817 - RNA, 22 nt, Human
agagaugaacauaaaacaagga

SEQ ID NO: 171818 - RNA, 22 nt, Human
caguuuauaugucagagcugua

SEQ ID NO: 171819 - RNA, 22 nt, Human
cauuuacacuucuaaccacaag

SEQ ID NO: 171820 - RNA, 22 nt, Human
ugcugaggcagaugucugugac

SEQ ID NO: 171821 - RNA, 22 nt, Human
guguguccucauaagauggagg

SEQ ID NO: 171822 - RNA, 22 nt, Human
uucucauggugucuuuauacau

SEQ ID NO: 171823 - RNA, 20 nt, Human
gauuucaaagcagaguggcc

SEQ ID NO: 171824 - RNA, 22 nt, Human
ugggcaggcaagugaauaccuu

SEQ ID NO: 171825 - RNA, 22 nt, Human
uuugcuuguucaagauuucugu

SEQ ID NO: 171826 - RNA, 22 nt, Human
uagcaucuguucuuucauuaaa

SEQ ID NO: 171827 - RNA, 22 nt, Human
uaugucaaaguuaagaaauagg

SEQ ID NO: 171828 - RNA, 22 nt, Human
acauaauaccuaggacaguuug

SEQ ID NO: 171829 - RNA, 22 nt, Human
agcagguggugggccagauuug

SEQ ID NO: 171830 - RNA, 21 nt, Human
uaauaauuccacuacagagua

SEQ ID NO: 171831 - RNA, 22 nt, Human
cacuugauggaagagcagaaga

SEQ ID NO: 171832 - RNA, 22 nt, Human
gggcagguggcagggucucugg

SEQ ID NO: 171833 - RNA, 22 nt, Human
caugcaugccgggcugacagag

SEQ ID NO: 171834 - RNA, 22 nt, Human
gaggugguucagguagagccca

SEQ ID NO: 171835 - RNA, 22 nt, Human
acuugguugcuucugaaaugac

SEQ ID NO: 171836 - RNA, 22 nt, Human
gagguguccucagccaacucug

SEQ ID NO: 171837 - RNA, 19 nt, Human
cuguccugguuuggucccu

SEQ ID NO: 171838 - RNA, 22 nt, Human
auauauuuacucuccuguugca

SEQ ID NO: 171839 - RNA, 22 nt, Human
uguguccuuccaguuuuuccug

SEQ ID NO: 171840 - RNA, 22 nt, Human
uuacagaacugucuugaaauuu

SEQ ID NO: 171841 - RNA, 22 nt, Human
auguccucuucugccucaggcc

SEQ ID NO: 171842 - RNA, 19 nt, Human
agcugcaaaagguggaacu

SEQ ID NO: 171843 - RNA, 22 nt, Human
aucuuucagggccauuuguauu

SEQ ID NO: 171844 - RNA, 22 nt, Human
agucaaagaugaccgaguuccu

SEQ ID NO: 171845 - RNA, 22 nt, Human
caguccuugauccaauaguggg

SEQ ID NO: 171846 - RNA, 22 nt, Human
caaucaguaaccggaucauggu

SEQ ID NO: 171847 - RNA, 22 nt, Human
ccaaaugugccuguuucaacaa

SEQ ID NO: 171848 - RNA, 22 nt, Human
cucccaagcugugcugaacugu

SEQ ID NO: 171849 - RNA, 22 nt, Human
agaauuccucuaggaucugccc

SEQ ID NO: 171850 - RNA, 22 nt, Human
ugcaggugucugggggcaacag

SEQ ID NO: 171851 - RNA, 22 nt, Human
aaggacagggaugguugauugu

SEQ ID NO: 171852 - RNA, 22 nt, Human
uuccagauuucuacacaagacc

SEQ ID NO: 171853 - RNA, 22 nt, Human
aaggugguaggcuauaucagua

SEQ ID NO: 171854 - RNA, 22 nt, Human
cuuuauauauucccaggcugcc

SEQ ID NO: 171855 - RNA, 22 nt, Human
gacccagccugguuuuuauagg

SEQ ID NO: 171856 - RNA, 22 nt, Human
ccagguggaaggucugugcucu

SEQ ID NO: 171857 - RNA, 22 nt, Human
gggucuccauguuaacaucacu

SEQ ID NO: 171858 - RNA, 22 nt, Human
cuggguguagcccaguaugagg

SEQ ID NO: 171859 - RNA, 22 nt, Human
agacagugcaagaagagcaggc

SEQ ID NO: 171860 - RNA, 19 nt, Human
ucccaggaagcaaauguca

SEQ ID NO: 171861 - RNA, 22 nt, Human
uccagcauuuuucaauagaauu

SEQ ID NO: 171862 - RNA, 22 nt, Human
ugcagguggcuccagggacugc

SEQ ID NO: 171863 - RNA, 22 nt, Human
gagcugcacuggggguggaaug

SEQ ID NO: 171864 - RNA, 22 nt, Human
gcauuauuaauagcugcaugag

SEQ ID NO: 171865 - RNA, 22 nt, Human
cugaaaauguuacacaggaaga

SEQ ID NO: 171866 - RNA, 22 nt, Human
caaaaaacacagaugucugugu

SEQ ID NO: 171867 - RNA, 22 nt, Human
uugcugggugcuauuaugaaca

SEQ ID NO: 171868 - RNA, 22 nt, Human
gggcaggugccagcucccuguc

SEQ ID NO: 171869 - RNA, 23 nt, Human
ugcuggcuuccagcugcucccuc

SEQ ID NO: 171870 - RNA, 22 nt, Human
cuggauguucuucugcaauuau

SEQ ID NO: 171871 - RNA, 22 nt, Human
cuggaggagaacuugaggaagg

SEQ ID NO: 171872 - RNA, 22 nt, Human
caggugguuugauaggauaacu

SEQ ID NO: 171873 - RNA, 22 nt, Human
gcagacagcauguugggcuauu

SEQ ID NO: 171874 - RNA, 22 nt, Human
uuccuuccauagcaaaacaugc

SEQ ID NO: 171875 - RNA, 22 nt, Human
auguauccuuauacacauuuau

SEQ ID NO: 171876 - RNA, 22 nt, Human
uacagacaaagagcaugcggua

SEQ ID NO: 171877 - RNA, 22 nt, Human
gaauguaagugggcagaagaca

SEQ ID NO: 171878 - RNA, 22 nt, Human
guacagaaggauuucuaguagu

SEQ ID NO: 171879 - RNA, 22 nt, Human
guccuuaguuacuuuucauguc

SEQ ID NO: 171880 - RNA, 22 nt, Human
gagucaccuugggucagcgaua

SEQ ID NO: 171881 - RNA, 22 nt, Human
acuggaucagaaucugauuuuu

SEQ ID NO: 171882 - RNA, 22 nt, Human
ugcagguguaaauuuucaagag

SEQ ID NO: 171883 - RNA, 22 nt, Human
auuguuaaacugaagcauuacu

SEQ ID NO: 171884 - RNA, 22 nt, Human
uucuggguaacaaggcaagaau

SEQ ID NO: 171885 - RNA, 22 nt, Human
gcuggaucauauggugguucua

SEQ ID NO: 171886 - RNA, 22 nt, Human
auccaaaccuggacaugagugg

SEQ ID NO: 171887 - RNA, 22 nt, Human
aaggugucauccaggauggugg

SEQ ID NO: 171888 - RNA, 21 nt, Human
uagggcaggcauuggaagaga

SEQ ID NO: 171889 - RNA, 23 nt, Human
uguaacaauucccagccuuugcc

SEQ ID NO: 171890 - RNA, 22 nt, Human
uccuggguuaauuaugauucac

SEQ ID NO: 171891 - RNA, 22 nt, Human
uuauugaguaucugcuuggugu

SEQ ID NO: 171892 - RNA, 22 nt, Human
uaaacauggauucugaucacag

SEQ ID NO: 171893 - RNA, 22 nt, Human
ucucucuucaacccuuaacuag

SEQ ID NO: 171894 - RNA, 22 nt, Human
uggagcugccuggcaccuacag

SEQ ID NO: 171895 - RNA, 22 nt, Human
gcaggugucuucagcaggauga

SEQ ID NO: 171896 - RNA, 22 nt, Human
agcaggugucggcgagggucuu

SEQ ID NO: 171897 - RNA, 22 nt, Human
aaucagaaucaguugacacagc

SEQ ID NO: 171898 - RNA, 22 nt, Human
cuguccugcccacccugcaggg

SEQ ID NO: 171899 - RNA, 22 nt, Human
aauaauauuugaagcuucaaag

SEQ ID NO: 171900 - RNA, 22 nt, Human
uuccuaaucacgaacauuauuu

SEQ ID NO: 171901 - RNA, 22 nt, Human
aguggcagaucucuggucugga

SEQ ID NO: 171902 - RNA, 22 nt, Human
aaagacuuggcuuaugauuugc

SEQ ID NO: 171903 - RNA, 22 nt, Human
uugcuugacuuuguguaccugu

SEQ ID NO: 171904 - RNA, 22 nt, Human
uuccugaauauaaagacacuag

SEQ ID NO: 171905 - RNA, 15 nt, Human
agacagacaguggga

SEQ ID NO: 171906 - RNA, 22 nt, Human
agccuggaauuaaggaaaugca

SEQ ID NO: 171907 - RNA, 22 nt, Human
ggagcugaggaauagcuuugau

SEQ ID NO: 171908 - RNA, 22 nt, Human
gcagggcaaugaucccgagagg

SEQ ID NO: 171909 - RNA, 22 nt, Human
ggucugcccacuacucuccauu

SEQ ID NO: 171910 - RNA, 22 nt, Human
uucacacacagcuuccuauugu

SEQ ID NO: 171911 - RNA, 22 nt, Human
uggcagguccacucacagaucu

SEQ ID NO: 171912 - RNA, 22 nt, Human
cagagggacaguaugaugaaag

SEQ ID NO: 171913 - RNA, 22 nt, Human
cuuuaguucuagaaagugaaac

SEQ ID NO: 171914 - RNA, 21 nt, Human
uucaaaaugguguguuugucu

SEQ ID NO: 171915 - RNA, 22 nt, Human
uuauuuaaugugaucugaagag

SEQ ID NO: 171916 - RNA, 22 nt, Human
auguucuuggauguuguguaua

SEQ ID NO: 171917 - RNA, 17 nt, Human
uccuggauccauggugg

SEQ ID NO: 171918 - RNA, 22 nt, Human
uuucuagucucgaucucuuaau

SEQ ID NO: 171919 - RNA, 22 nt, Human
ugcuggagcaacauuauugugc

SEQ ID NO: 171920 - RNA, 22 nt, Human
aauauaugugguauugaccagc

SEQ ID NO: 171921 - RNA, 22 nt, Human
aucagaaauugcuaccagugga

SEQ ID NO: 171922 - RNA, 23 nt, Human
ucaggugugcggacugcugaguc

SEQ ID NO: 171923 - RNA, 22 nt, Human
gcaugcaggagagaaagacggc

SEQ ID NO: 171924 - RNA, 22 nt, Human
gaaagccauagcccagcuuuac

SEQ ID NO: 171925 - RNA, 23 nt, Human
uguaacaauuucauauacaugca

SEQ ID NO: 171926 - RNA, 22 nt, Human
aguuauaaucugcuacugauau

SEQ ID NO: 171927 - RNA, 22 nt, Human
ugcaggugauucugaugcaguu

SEQ ID NO: 171928 - RNA, 22 nt, Human
gggcucucgauuagacccuggg

SEQ ID NO: 171929 - RNA, 22 nt, Human
gccugcagaggugcugcuagcu

SEQ ID NO: 171930 - RNA, 17 nt, Human
uaaguccuaguuauuuu

SEQ ID NO: 171931 - RNA, 23 nt, Human
agcuucauugaccuccgcagggg

SEQ ID NO: 171932 - RNA, 22 nt, Human
aaguccuucccaagcauguacc

SEQ ID NO: 171933 - RNA, 22 nt, Human
agguggaaauggcuuuccuagg

SEQ ID NO: 171934 - RNA, 22 nt, Human
cauucuuauauuuacucauuca

SEQ ID NO: 171935 - RNA, 22 nt, Human
cuggauuuuagaaggcuuccua

SEQ ID NO: 171936 - RNA, 22 nt, Human
aacauuggauauuuauuaaaag

SEQ ID NO: 171937 - RNA, 22 nt, Human
uggagcugacucacaccagcua

SEQ ID NO: 171938 - RNA, 22 nt, Human
uucuauugacauucacuguaac

SEQ ID NO: 171939 - RNA, 21 nt, Human
cccugcaggccagggcugagc

SEQ ID NO: 171940 - RNA, 22 nt, Human
auaguuugaaggcuguucuacu

SEQ ID NO: 171941 - RNA, 22 nt, Human
gcauguuauguaucugcccagc

SEQ ID NO: 171942 - RNA, 22 nt, Human
ugaaagcuuguuggaaauguag

SEQ ID NO: 171943 - RNA, 22 nt, Human
aauguuaauguguuugcuuaug

SEQ ID NO: 171944 - RNA, 22 nt, Human
ucugggaaugaauaagaccugu

SEQ ID NO: 171945 - RNA, 22 nt, Human
uugcuuuacggcaaggccccag

SEQ ID NO: 171946 - RNA, 22 nt, Human
auuucccuccagggaaagcuua

SEQ ID NO: 171947 - RNA, 22 nt, Human
uaggugucuuguguaugguaca

SEQ ID NO: 171948 - RNA, 22 nt, Human
uauugcuggugcuguucugaau

SEQ ID NO: 171949 - RNA, 20 nt, Human
aaugaggucccacugaggag

SEQ ID NO: 171950 - RNA, 22 nt, Human
uuuuucaugagacuagaaguca

SEQ ID NO: 171951 - RNA, 22 nt, Human
ggacaugugcaacuucuuugga

SEQ ID NO: 171952 - RNA, 22 nt, Human
cauuucaagcauugacuucuau

SEQ ID NO: 171953 - RNA, 22 nt, Human
uauuugcaacauaaaacucuga

SEQ ID NO: 171954 - RNA, 22 nt, Human
aggccuccuggcuccaggccuu

SEQ ID NO: 171955 - RNA, 22 nt, Human
ugaaucauggauaaauagcuua

SEQ ID NO: 171956 - RNA, 22 nt, Human
uauauuuaaauccagguugaaa

SEQ ID NO: 171957 - RNA, 22 nt, Human
uaagaacuucggacauguuauc

SEQ ID NO: 171958 - RNA, 22 nt, Human
gcagcuuuaaucugaauaagua

SEQ ID NO: 171959 - RNA, 21 nt, Human
caugugucauuggagagcaau

SEQ ID NO: 171960 - RNA, 22 nt, Human
uggaauguaaaccucagguggg

SEQ ID NO: 171961 - RNA, 19 nt, Human
uuugcagugguuccuuugu

SEQ ID NO: 171962 - RNA, 22 nt, Human
guuauauauaguauuucucuga

SEQ ID NO: 171963 - RNA, 20 nt, Human
agacccucuggacugggccc

SEQ ID NO: 171964 - RNA, 20 nt, Human
agcauuugaaauaugacuau

SEQ ID NO: 171965 - RNA, 22 nt, Human
uggguagaguggagggauaaga

SEQ ID NO: 171966 - RNA, 22 nt, Human
uggcaaagugacuccuuggggc

SEQ ID NO: 171967 - RNA, 22 nt, Human
ugcuggguuaccuaagccuaaa

SEQ ID NO: 171968 - RNA, 22 nt, Human
ccagagcccagggucaugcagg

SEQ ID NO: 171969 - RNA, 22 nt, Human
auucuucacauggauaggaucu

SEQ ID NO: 171970 - RNA, 22 nt, Human
uaguuucagcuccuucauccug

SEQ ID NO: 171971 - RNA, 22 nt, Human
aaagcugcuuuaaacaucuaug

SEQ ID NO: 171972 - RNA, 22 nt, Human
uuuccagagggugcucagggcg

SEQ ID NO: 171973 - RNA, 22 nt, Human
gccaggcagcaggaagccagug

SEQ ID NO: 171974 - RNA, 22 nt, Human
uugguacagaugagguauucuc

SEQ ID NO: 171975 - RNA, 22 nt, Human
uuuccauauuuaaucaaaauaa

SEQ ID NO: 171976 - RNA, 21 nt, Human
uuacagaauccaugggaaguc

SEQ ID NO: 171977 - RNA, 22 nt, Human
cccugcagagggaugggggcag

SEQ ID NO: 171978 - RNA, 22 nt, Human
agaugguccaucuauuuucuau

SEQ ID NO: 171979 - RNA, 22 nt, Human
cuuuacauccuguuucccguuu

SEQ ID NO: 171980 - RNA, 22 nt, Human
guuuauugauaaaagcuggaca

SEQ ID NO: 171981 - RNA, 21 nt, Human
ucagggcagcugcucuucaga

SEQ ID NO: 171982 - RNA, 22 nt, Human
ucuuccuugcuccuugucacuu

SEQ ID NO: 171983 - RNA, 22 nt, Human
ugcuuaauguacgugaguguac

SEQ ID NO: 171984 - RNA, 22 nt, Human
gcaaacaagcugccugaagauu

SEQ ID NO: 171985 - RNA, 22 nt, Human
aaaguccuguuugaaggaccug

SEQ ID NO: 171986 - RNA, 22 nt, Human
ucacaaaugaggaaaucgagca

SEQ ID NO: 171987 - RNA, 22 nt, Human
uagggcucagagaaguggggcc

SEQ ID NO: 171988 - RNA, 22 nt, Human
caggcagcugcgacaagagagc

SEQ ID NO: 171989 - RNA, 22 nt, Human
uuacagaaaagggcuuuaagag

SEQ ID NO: 171990 - RNA, 22 nt, Human
cagaaagcuuaggcaaguugga

SEQ ID NO: 171991 - RNA, 22 nt, Human
agugugaguaauucagggaggg

SEQ ID NO: 171992 - RNA, 22 nt, Human
uugggaaguuuaaugacagacu

SEQ ID NO: 171993 - RNA, 22 nt, Human
gucauuccuuauguugauucag

SEQ ID NO: 171994 - RNA, 22 nt, Human
acauguguaaggucucucaguc

SEQ ID NO: 171995 - RNA, 22 nt, Human
acagguguugacucacaggccc

SEQ ID NO: 171996 - RNA, 22 nt, Human
agggaccucauguaaguggauu

SEQ ID NO: 171997 - RNA, 22 nt, Human
gggugggaacaggaugccagga

SEQ ID NO: 171998 - RNA, 22 nt, Human
cuguccugaaagggagauuggg

SEQ ID NO: 171999 - RNA, 22 nt, Human
uaauuucaaauuucuuagcgug

SEQ ID NO: 172000 - RNA, 22 nt, Human
ucaaagagcuauucaguugugg

SEQ ID NO: 172001 - RNA, 21 nt, Human
uucaaaguuugccuaaagauu

SEQ ID NO: 172002 - RNA, 22 nt, Human
gguccugggaagaugcucauga

SEQ ID NO: 172003 - RNA, 22 nt, Human
caguguggugugcacagcuuag

SEQ ID NO: 172004 - RNA, 23 nt, Human
gcaugaagugcuacgucuacagc

SEQ ID NO: 172005 - RNA, 22 nt, Human
ucagacagcuugcagggaggug

SEQ ID NO: 172006 - RNA, 22 nt, Human
uguguccucagggaagcagaga

SEQ ID NO: 172007 - RNA, 22 nt, Human
ugguuuaauuuccauuuccuug

SEQ ID NO: 172008 - RNA, 22 nt, Human
acuagaaacuaauggauuauua

SEQ ID NO: 172009 - RNA, 22 nt, Human
aauugcuuaucuuguugaauag

SEQ ID NO: 172010 - RNA, 15 nt, Human
uccaggcauucauuc

SEQ ID NO: 172011 - RNA, 22 nt, Human
aaacaugagcauuucuguuuaa

SEQ ID NO: 172012 - RNA, 22 nt, Human
uuuccaaagcugaguugagcaa

SEQ ID NO: 172013 - RNA, 22 nt, Human
uugcaggguuaaaguaagguag

SEQ ID NO: 172014 - RNA, 22 nt, Human
ugguccuguguucuuccugccu

SEQ ID NO: 172015 - RNA, 18 nt, Human
caagaaucucuaaagaag

SEQ ID NO: 172016 - RNA, 22 nt, Human
aaaugucagaggaacauauuga

SEQ ID NO: 172017 - RNA, 22 nt, Human
cagaagaggacuggguagcuca

SEQ ID NO: 172018 - RNA, 22 nt, Human
caggugguuaugaggaagguga

SEQ ID NO: 172019 - RNA, 22 nt, Human
gggagcuggagcuggaagacuc

SEQ ID NO: 172020 - RNA, 22 nt, Human
agcucccagaagccagagucgg

SEQ ID NO: 172021 - RNA, 22 nt, Human
aggagugggggcgagaaguuaa

SEQ ID NO: 172022 - RNA, 22 nt, Human
gcuggaggaggaagugugaggg

SEQ ID NO: 172023 - RNA, 22 nt, Human
gcagaauugauggagaacuuaa

SEQ ID NO: 172024 - RNA, 23 nt, Human
acucaaaauuuggcauuugagga

SEQ ID NO: 172025 - RNA, 22 nt, Human
uuuccuuccaaaugcccgggag

SEQ ID NO: 172026 - RNA, 22 nt, Human
gaaguuuauuucaaucuauuca

SEQ ID NO: 172027 - RNA, 22 nt, Human
aggcuucugugagcucauacaa

SEQ ID NO: 172028 - RNA, 22 nt, Human
ggcuuuauuauguggccaugug

SEQ ID NO: 172029 - RNA, 22 nt, Human
aauuccaaguagcaucccauca

SEQ ID NO: 172030 - RNA, 22 nt, Human
uccaggcauaagccuugagugu

SEQ ID NO: 172031 - RNA, 22 nt, Human
augcuuuaaaugucuuuugcuu

SEQ ID NO: 172032 - RNA, 22 nt, Human
aguggcagguguuucguggugc

SEQ ID NO: 172033 - RNA, 22 nt, Human
aauugcuuuuauuuagggccag

SEQ ID NO: 172034 - RNA, 22 nt, Human
cagaaaaggaagagcuauguaa

SEQ ID NO: 172035 - RNA, 22 nt, Human
cucagugugaaugcucaguaaa

SEQ ID NO: 172036 - RNA, 18 nt, Human
uucuggguguuauguuua

SEQ ID NO: 172037 - RNA, 22 nt, Human
uuccuuagacagagguggucau

SEQ ID NO: 172038 - RNA, 22 nt, Human
aggcaccuugagagcaggagcu

SEQ ID NO: 172039 - RNA, 22 nt, Human
ggaaggaagugcagacuuuaaa

SEQ ID NO: 172040 - RNA, 22 nt, Human
cuuugcugagcugguuguucaa

SEQ ID NO: 172041 - RNA, 22 nt, Human
cuuuucaugagucuguuauggg

SEQ ID NO: 172042 - RNA, 22 nt, Human
cccagcuucugagggggccuug

SEQ ID NO: 172043 - RNA, 22 nt, Human
uucucuuagcuguaaagucaau

SEQ ID NO: 172044 - RNA, 22 nt, Human
aucaagaacuuauuuuggaaau

SEQ ID NO: 172045 - RNA, 22 nt, Human
cauuuguagcuauuuacuguau

SEQ ID NO: 172046 - RNA, 19 nt, Human
caugugucaauacuguacc

SEQ ID NO: 172047 - RNA, 22 nt, Human
acauucacuauguccaaacucu

SEQ ID NO: 172048 - RNA, 22 nt, Human
auagaaauguauuuuggacuag

SEQ ID NO: 172049 - RNA, 22 nt, Human
ccaggccucccuuuuccagcca

SEQ ID NO: 172050 - RNA, 22 nt, Human
uccaggcaucccccaggacaga

SEQ ID NO: 172051 - RNA, 22 nt, Human
cugcagggagaggggacagccu

SEQ ID NO: 172052 - RNA, 22 nt, Human
ucuauacaaguuucacuuugac

SEQ ID NO: 172053 - RNA, 22 nt, Human
uuuccaaaggaguaccacgcau

SEQ ID NO: 172054 - RNA, 22 nt, Human
ugucugggucaccccuccuggc

SEQ ID NO: 172055 - RNA, 20 nt, Human
uuuauuggccuuucaggaac

SEQ ID NO: 172056 - RNA, 22 nt, Human
accugcagguguuuccacacuu

SEQ ID NO: 172057 - RNA, 22 nt, Human
cccagugugccccuccugcagc

SEQ ID NO: 172058 - RNA, 22 nt, Human
uuucuguagugugguauguagg

SEQ ID NO: 172059 - RNA, 22 nt, Human
aguuugaaauguuggcaauauu

SEQ ID NO: 172060 - RNA, 22 nt, Human
uuccucaacaacuucccuacag

SEQ ID NO: 172061 - RNA, 22 nt, Human
aaauacagaguugcuuaaaagc

SEQ ID NO: 172062 - RNA, 22 nt, Human
gacagacacuguguccucacuu

SEQ ID NO: 172063 - RNA, 22 nt, Human
auuugcaaagucguaucuguga

SEQ ID NO: 172064 - RNA, 22 nt, Human
agugugaguuugguugagacuu

SEQ ID NO: 172065 - RNA, 19 nt, Human
acagcagguguggggauaa

SEQ ID NO: 172066 - RNA, 22 nt, Human
gaugugucuccguuucaaggca

SEQ ID NO: 172067 - RNA, 19 nt, Human
ugggaaaguaacauacaaa

SEQ ID NO: 172068 - RNA, 20 nt, Human
uacaauauucccacuuugcu

SEQ ID NO: 172069 - RNA, 22 nt, Human
auagaauagcauagaaaauuga

SEQ ID NO: 172070 - RNA, 21 nt, Human
agacagacugccugacccacg

SEQ ID NO: 172071 - RNA, 22 nt, Human
aagauauagauggugguauaaa

SEQ ID NO: 172072 - RNA, 22 nt, Human
cauagaaacugagacaaggauu

SEQ ID NO: 172073 - RNA, 22 nt, Human
uuccaggaagcaguuagcagcc

SEQ ID NO: 172074 - RNA, 22 nt, Human
acuagaaauuacucagaauaaa

SEQ ID NO: 172075 - RNA, 22 nt, Human
acaauauuguacccagaaguuu

SEQ ID NO: 172076 - RNA, 22 nt, Human
uaaguuuucuggaauaacuugg

SEQ ID NO: 172077 - RNA, 22 nt, Human
uucagugucaauuuuuaaauau

SEQ ID NO: 172078 - RNA, 21 nt, Human
uuguguccuucuaaagggcca

SEQ ID NO: 172079 - RNA, 22 nt, Human
uuccuugguagagagaauauuu

SEQ ID NO: 172080 - RNA, 22 nt, Human
uggcuuaauauuucauauuuaa

SEQ ID NO: 172081 - RNA, 22 nt, Human
agguggggugagcugcagacua

SEQ ID NO: 172082 - RNA, 22 nt, Human
gcaaauauucaagacuuuucca

SEQ ID NO: 172083 - RNA, 23 nt, Human
cacaggcugcgcauaagcuucuc

SEQ ID NO: 172084 - RNA, 22 nt, Human
aaacaucauaggcaugcaugau

SEQ ID NO: 172085 - RNA, 22 nt, Human
uuauucuuuucuccagaauccc

SEQ ID NO: 172086 - RNA, 22 nt, Human
uguccauggauagagcugcucg

SEQ ID NO: 172087 - RNA, 22 nt, Human
ggcaggcaggucuucauggccc

SEQ ID NO: 172088 - RNA, 22 nt, Human
cuguccugugcauugucagaug

SEQ ID NO: 172089 - RNA, 22 nt, Human
gggaggaaagagaaguggucca

SEQ ID NO: 172090 - RNA, 22 nt, Human
auuauucuuaugucaucauggc

SEQ ID NO: 172091 - RNA, 22 nt, Human
acaguguuuuagaaaagcuuga

SEQ ID NO: 172092 - RNA, 22 nt, Human
caucagaaugaauguucuggag

SEQ ID NO: 172093 - RNA, 22 nt, Human
cugcccgucccuuugcucucgc

SEQ ID NO: 172094 - RNA, 22 nt, Human
uuuaucugagcugauagauagu

SEQ ID NO: 172095 - RNA, 22 nt, Human
cuggaucaugcauugcuugucc

SEQ ID NO: 172096 - RNA, 22 nt, Human
agcugcaaagaugauuuguugu

SEQ ID NO: 172097 - RNA, 22 nt, Human
uuacuacugcuuuacuacuggg

SEQ ID NO: 172098 - RNA, 22 nt, Human
ugaagcuuuccuguggucagga

SEQ ID NO: 172099 - RNA, 22 nt, Human
acuuuugaagaauuaugcaaaa

SEQ ID NO: 172100 - RNA, 22 nt, Human
aacuuucaggcaaugaauauuu

SEQ ID NO: 172101 - RNA, 22 nt, Human
auuucucacucacaguccaugu

SEQ ID NO: 172102 - RNA, 22 nt, Human
cauauaauguuugaagaugugg

SEQ ID NO: 172103 - RNA, 22 nt, Human
ccaaaauuaagccucuuauguu

SEQ ID NO: 172104 - RNA, 22 nt, Human
guagggacuguucucaccugag

SEQ ID NO: 172105 - RNA, 22 nt, Human
uuuagggaauagaagaucugaa

SEQ ID NO: 172106 - RNA, 22 nt, Human
acccagcaugacaccugcacau

SEQ ID NO: 172107 - RNA, 23 nt, Human
uaucagugugaugaggcugcugc

SEQ ID NO: 172108 - RNA, 22 nt, Human
cuggguguuggguacugaccgu

SEQ ID NO: 172109 - RNA, 22 nt, Human
acauuuaaauaccuauguuucu

SEQ ID NO: 172110 - RNA, 22 nt, Human
acaaaauuaugaagaggccuug

SEQ ID NO: 172111 - RNA, 23 nt, Human
cagaaauaaacugguuuguagau

SEQ ID NO: 172112 - RNA, 22 nt, Human
auacagaauucacuacaguuuc

SEQ ID NO: 172113 - RNA, 22 nt, Human
uguguccugcaggugcugccug

SEQ ID NO: 172114 - RNA, 22 nt, Human
agaagucauuuauguuagauga

SEQ ID NO: 172115 - RNA, 20 nt, Human
uuucaguuaucuugaccuuc

SEQ ID NO: 172116 - RNA, 22 nt, Human
cuuguugcugaauucaggauuc

SEQ ID NO: 172117 - RNA, 22 nt, Human
aauucuuguuguuaguauauuu

SEQ ID NO: 172118 - RNA, 22 nt, Human
auucuacaacccaauaauaauu

SEQ ID NO: 172119 - RNA, 22 nt, Human
uuaauucuaguuuaacacuuag

SEQ ID NO: 172120 - RNA, 22 nt, Human
auagaagaggaaacugagguug

SEQ ID NO: 172121 - RNA, 22 nt, Human
uuggagauaucacaccuucaca

SEQ ID NO: 172122 - RNA, 22 nt, Human
uaauaucuacuucauagaguuu

SEQ ID NO: 172123 - RNA, 23 nt, Human
uggcucuguggaucccucaggag

SEQ ID NO: 172124 - RNA, 22 nt, Human
caacagucugguuuauauaaua

SEQ ID NO: 172125 - RNA, 22 nt, Human
gcacaauaauuuuuuuaagagg

SEQ ID NO: 172126 - RNA, 22 nt, Human
gcuguucacggaggaggauggg

SEQ ID NO: 172127 - RNA, 22 nt, Human
uugcuaggauucauucuauacu

SEQ ID NO: 172128 - RNA, 22 nt, Human
ggcuuuuguuucagcucugcua

SEQ ID NO: 172129 - RNA, 22 nt, Human
gaugugucuccauacaccaccc

SEQ ID NO: 172130 - RNA, 23 nt, Human
agaauuccaguuucuuaugucac

SEQ ID NO: 172131 - RNA, 22 nt, Human
aaagauaauguuuccuuauucu

SEQ ID NO: 172132 - RNA, 22 nt, Human
cuuauuagaguuguguucuguu

SEQ ID NO: 172133 - RNA, 22 nt, Human
acuuuguuuggcuauuagaguc

SEQ ID NO: 172134 - RNA, 20 nt, Human
acaauacagguugugucuga

SEQ ID NO: 172135 - RNA, 19 nt, Human
accugcaguaauaauuccu

SEQ ID NO: 172136 - RNA, 22 nt, Human
caugcauguuuacuacagugac

SEQ ID NO: 172137 - RNA, 20 nt, Human
auggaggaagggcaagagaa

SEQ ID NO: 172138 - RNA, 19 nt, Human
cacaucagcagggcugugg

SEQ ID NO: 172139 - RNA, 22 nt, Human
aaguuucaaauauaaaauuaca

SEQ ID NO: 172140 - RNA, 22 nt, Human
aauugcuugucuucuucccuac

SEQ ID NO: 172141 - RNA, 22 nt, Human
gccugcagggugaugggcugcc

SEQ ID NO: 172142 - RNA, 22 nt, Human
gguuucaaugagaagugcuugu

SEQ ID NO: 172143 - RNA, 19 nt, Human
aucugagauuauaaacaga

SEQ ID NO: 172144 - RNA, 22 nt, Human
cauuucaaugccuucaacauag

SEQ ID NO: 172145 - RNA, 22 nt, Human
uggcaaggccacaggugcaguu

SEQ ID NO: 172146 - RNA, 22 nt, Human
ccaggccucuggcugcuuaguc

SEQ ID NO: 172147 - RNA, 22 nt, Human
gccaggcagcuagcaaccccug

SEQ ID NO: 172148 - RNA, 22 nt, Human
uccuuccugcaggccaaguccu

SEQ ID NO: 172149 - RNA, 19 nt, Human
uccuucuccggccaccccg

SEQ ID NO: 172150 - RNA, 22 nt, Human
ggcaauuucaugugguuuaaac

SEQ ID NO: 172151 - RNA, 22 nt, Human
guuuuucuagaaaucuccuccu

SEQ ID NO: 172152 - RNA, 22 nt, Human
ucuguaguagguuguaguucuu

SEQ ID NO: 172153 - RNA, 22 nt, Human
uguacaaucugaugauguaugg

SEQ ID NO: 172154 - RNA, 22 nt, Human
guauuaggaggaacacaggccu

SEQ ID NO: 172155 - RNA, 22 nt, Human
ugauuuuauugaaacuucacuu

SEQ ID NO: 172156 - RNA, 21 nt, Human
augucaaaugcuuuauuuuau

SEQ ID NO: 172157 - RNA, 22 nt, Human
uggcaaauauuuuguuuuguaa

SEQ ID NO: 172158 - RNA, 22 nt, Human
caauuucugggccucacacaag

SEQ ID NO: 172159 - RNA, 22 nt, Human
uaaucuacuguuuauaugaaau

SEQ ID NO: 172160 - RNA, 22 nt, Human
agauuucucuuucccuggcuga

SEQ ID NO: 172161 - RNA, 22 nt, Human
acagaaguuggaauuagauacu

SEQ ID NO: 172162 - RNA, 22 nt, Human
ugcagggaaucuguggcuggac

SEQ ID NO: 172163 - RNA, 22 nt, Human
gcugcaggcauuuuccugggca

SEQ ID NO: 172164 - RNA, 22 nt, Human
ugucuucagcaaaugccuuucu

SEQ ID NO: 172165 - RNA, 22 nt, Human
auguccagagccggccugcuga

SEQ ID NO: 172166 - RNA, 22 nt, Human
auauaauacaaccugcuaagug

SEQ ID NO: 172167 - RNA, 22 nt, Human
ccaguacugucuccaauauucc

SEQ ID NO: 172168 - RNA, 22 nt, Human
aaacuuugguauguagcaaaac

SEQ ID NO: 172169 - RNA, 22 nt, Human
uuuaggcagcuacauacuaacu

SEQ ID NO: 172170 - RNA, 22 nt, Human
aggugggguucagucucagccg

SEQ ID NO: 172171 - RNA, 22 nt, Human
aauuugauuuucuuaaaccaua

SEQ ID NO: 172172 - RNA, 22 nt, Human
aggugagguuugggagguguca

SEQ ID NO: 172173 - RNA, 22 nt, Human
cuggaggaccccugccuggaag

SEQ ID NO: 172174 - RNA, 22 nt, Human
gccaggcaggugucggagcccu

SEQ ID NO: 172175 - RNA, 22 nt, Human
caugcagcagaauaaugacuau

SEQ ID NO: 172176 - RNA, 23 nt, Human
gaggcagcuccugcagugcccug

SEQ ID NO: 172177 - RNA, 22 nt, Human
uugugucccuguaagacaaagc

SEQ ID NO: 172178 - RNA, 22 nt, Human
gagacaggcagcuaguggguca

SEQ ID NO: 172179 - RNA, 23 nt, Human
auguuauuauuagcagucuugcc

SEQ ID NO: 172180 - RNA, 22 nt, Human
aaguccagcucuaaauaucuga

SEQ ID NO: 172181 - RNA, 22 nt, Human
caggguggaagcuguagagugg

SEQ ID NO: 172182 - RNA, 22 nt, Human
guaugcaucgacucaagucuga

SEQ ID NO: 172183 - RNA, 22 nt, Human
uguuuucauuugauguaacaaa

SEQ ID NO: 172184 - RNA, 22 nt, Human
ucaguaaaguucuuucuugcug

SEQ ID NO: 172185 - RNA, 22 nt, Human
ugucugaugauagugucucucc

SEQ ID NO: 172186 - RNA, 22 nt, Human
guuaggcauuugccuuaauuuu

SEQ ID NO: 172187 - RNA, 22 nt, Human
gccugcagcaugcuaggucuug

SEQ ID NO: 172188 - RNA, 22 nt, Human
gauccugugcauggggugaugg

SEQ ID NO: 172189 - RNA, 22 nt, Human
gcccagcuggcuuccagcacau

SEQ ID NO: 172190 - RNA, 22 nt, Human
ggagcugaugacgucaccaugg

SEQ ID NO: 172191 - RNA, 19 nt, Human
ugacagguuuuauguguuu

SEQ ID NO: 172192 - RNA, 22 nt, Human
ggugggaggacuguuugaggca

SEQ ID NO: 172193 - RNA, 22 nt, Human
uaaauaugcauguauccuuauc

SEQ ID NO: 172194 - RNA, 22 nt, Human
uguuuuaaagccauugccuuuc

SEQ ID NO: 172195 - RNA, 22 nt, Human
gaggugguuuguggugacucau

SEQ ID NO: 172196 - RNA, 22 nt, Human
uuucaaauggagucgugaaaug

SEQ ID NO: 172197 - RNA, 22 nt, Human
ugcagggaagcaaggguggcuc

SEQ ID NO: 172198 - RNA, 22 nt, Human
uuugaaucugauauggcagcau

SEQ ID NO: 172199 - RNA, 22 nt, Human
caacuuuucugugaauuuaagu

SEQ ID NO: 172200 - RNA, 22 nt, Human
agcaggugaucgcgugugcucc

SEQ ID NO: 172201 - RNA, 22 nt, Human
guauuaggugguggaauuguag

SEQ ID NO: 172202 - RNA, 22 nt, Human
cuuaaagaaauugaggagagga

SEQ ID NO: 172203 - RNA, 22 nt, Human
auugcuuuguacaugccuagca

SEQ ID NO: 172204 - RNA, 22 nt, Human
uccuuccuggggucucugcugc

SEQ ID NO: 172205 - RNA, 22 nt, Human
acaacaggguaaggcaggccau

SEQ ID NO: 172206 - RNA, 22 nt, Human
ucauacaucuguccuggagcuc

SEQ ID NO: 172207 - RNA, 22 nt, Human
uuugaagauaaauauggagaaa

SEQ ID NO: 172208 - RNA, 22 nt, Human
ccaggugucauggauaaugggu

SEQ ID NO: 172209 - RNA, 22 nt, Human
gaggugucuguuaggaauaggc

SEQ ID NO: 172210 - RNA, 22 nt, Human
agcuuuauauuuaaugaauucu

SEQ ID NO: 172211 - RNA, 22 nt, Human
uguuuacugcauucuauuugcu

SEQ ID NO: 172212 - RNA, 22 nt, Human
caauuuuuaaacuaugaaguug

SEQ ID NO: 172213 - RNA, 22 nt, Human
aaacaaacaauuaguugugugg

SEQ ID NO: 172214 - RNA, 22 nt, Human
augcacauaggccaaaucauuu

SEQ ID NO: 172215 - RNA, 22 nt, Human
ugcagggcacacgcacgggugu

SEQ ID NO: 172216 - RNA, 22 nt, Human
gacccagcuuaagucacauguu

SEQ ID NO: 172217 - RNA, 20 nt, Human
cuguggaauuuuaccaugcg

SEQ ID NO: 172218 - RNA, 22 nt, Human
gauuuuauuagcccaaacuuug

SEQ ID NO: 172219 - RNA, 22 nt, Human
uauugcugacuuguucaguguu

SEQ ID NO: 172220 - RNA, 22 nt, Human
gcugguccacucccuggaggcu

SEQ ID NO: 172221 - RNA, 22 nt, Human
uguggggcucccuggcagccug

SEQ ID NO: 172222 - RNA, 22 nt, Human
agggcuccgggccaccggccug

SEQ ID NO: 172223 - RNA, 22 nt, Human
ucauguguccuaguucauauaa

SEQ ID NO: 172224 - RNA, 22 nt, Human
uccugcagagccgcccucaggu

SEQ ID NO: 172225 - RNA, 22 nt, Human
gcuguucacauuuugggccaaa

SEQ ID NO: 172226 - RNA, 22 nt, Human
auuaauuuccaggcacugugcu

SEQ ID NO: 172227 - RNA, 18 nt, Human
cuaaacugcaccuaauga

SEQ ID NO: 172228 - RNA, 19 nt, Human
cuccucagucccagagguc

SEQ ID NO: 172229 - RNA, 22 nt, Human
auguuucaucaguaagguuuug

SEQ ID NO: 172230 - RNA, 22 nt, Human
uggcaaagaugaagcauuucgu

SEQ ID NO: 172231 - RNA, 22 nt, Human
gaauguuugacuaaagguagcu

SEQ ID NO: 172232 - RNA, 22 nt, Human
agcaaucaccaccucuauauuu

SEQ ID NO: 172233 - RNA, 22 nt, Human
ugggacacagaaaaggcagguu

SEQ ID NO: 172234 - RNA, 22 nt, Human
uauucaaaguaccuucauugcc

SEQ ID NO: 172235 - RNA, 19 nt, Human
cuuauuagagugagagcuu

SEQ ID NO: 172236 - RNA, 22 nt, Human
aauuaugauuggucuaaaccag

SEQ ID NO: 172237 - RNA, 22 nt, Human
gcauucuuuuuaggagguuccu

SEQ ID NO: 172238 - RNA, 22 nt, Human
auugcuggcugccaucuugccc

SEQ ID NO: 172239 - RNA, 22 nt, Human
uuguuauaaagacuaaauaugu

SEQ ID NO: 172240 - RNA, 22 nt, Human
gccugcagccucagagaauuuu

SEQ ID NO: 172241 - RNA, 22 nt, Human
gacaggugcuaagggaccuggc

SEQ ID NO: 172242 - RNA, 22 nt, Human
uguccuuauauuguggaagggg

SEQ ID NO: 172243 - RNA, 22 nt, Human
aggagaggcucuaacucugugu

SEQ ID NO: 172244 - RNA, 22 nt, Human
ucaggcaggaagggaggacuug

SEQ ID NO: 172245 - RNA, 22 nt, Human
ccagaucuaguguuguaaagcu

SEQ ID NO: 172246 - RNA, 22 nt, Human
gcagcuuugucacggagugucg

SEQ ID NO: 172247 - RNA, 21 nt, Human
uucugggaaaugagcuggggc

SEQ ID NO: 172248 - RNA, 22 nt, Human
gagcuuuagcugagaccugcuu

SEQ ID NO: 172249 - RNA, 20 nt, Human
cuggguggcaagcaaggggg

SEQ ID NO: 172250 - RNA, 22 nt, Human
gucccaggugggcuccaccucu

SEQ ID NO: 172251 - RNA, 22 nt, Human
ucagacagggagucagaaaaua

SEQ ID NO: 172252 - RNA, 22 nt, Human
aucuguaaaugcaaauguagcu

SEQ ID NO: 172253 - RNA, 22 nt, Human
aggcaaagcgauaccagagcua

SEQ ID NO: 172254 - RNA, 22 nt, Human
ccugccuucuaaagcgcccgcc

SEQ ID NO: 172255 - RNA, 22 nt, Human
ccugggugucaugggcagcugg

SEQ ID NO: 172256 - RNA, 17 nt, Human
cuuuuaauuuacuuccc

SEQ ID NO: 172257 - RNA, 22 nt, Human
gacaugugucugcaaguugauc

SEQ ID NO: 172258 - RNA, 22 nt, Human
ccagggcagcagaauuggggca

SEQ ID NO: 172259 - RNA, 22 nt, Human
aagggcaggugggcauuucugg

SEQ ID NO: 172260 - RNA, 19 nt, Human
auuucaagagguuuauugg

SEQ ID NO: 172261 - RNA, 22 nt, Human
uagggcaguuucauguuaucuu

SEQ ID NO: 172262 - RNA, 22 nt, Human
uuccaugagcucugaguucaca

SEQ ID NO: 172263 - RNA, 22 nt, Human
uggucugguuauuucuuaauga

SEQ ID NO: 172264 - RNA, 22 nt, Human
guuccaaagcaaaggaggugag

SEQ ID NO: 172265 - RNA, 22 nt, Human
caaaucuauauguugauauucu

SEQ ID NO: 172266 - RNA, 22 nt, Human
aaacauuugcaacucgguuugg

SEQ ID NO: 172267 - RNA, 22 nt, Human
uuuccaaaggaggaaccaguuu

SEQ ID NO: 172268 - RNA, 22 nt, Human
uggaauguuuuccuaaaucaga

SEQ ID NO: 172269 - RNA, 22 nt, Human
ccagagaggcaaaacuccuucc

SEQ ID NO: 172270 - RNA, 22 nt, Human
ugguuaaguccagaaaggaagc

SEQ ID NO: 172271 - RNA, 22 nt, Human
aguuugaaaguauugacagaag

SEQ ID NO: 172272 - RNA, 22 nt, Human
gaagcuucguggcucuucaaau

SEQ ID NO: 172273 - RNA, 22 nt, Human
auuucuguaacuuaugaaaguu

SEQ ID NO: 172274 - RNA, 18 nt, Human
auggucucauacugggag

SEQ ID NO: 172275 - RNA, 22 nt, Human
cuuucacacacauacauuugga

SEQ ID NO: 172276 - RNA, 22 nt, Human
ccuggagggcgccgcacagucc

SEQ ID NO: 172277 - RNA, 22 nt, Human
cccaggacucuucacugcagcc

SEQ ID NO: 172278 - RNA, 22 nt, Human
ugggcuccguugccuggggcag

SEQ ID NO: 172279 - RNA, 22 nt, Human
acuuccuuguacugacuccauu

SEQ ID NO: 172280 - RNA, 22 nt, Human
ggcaggcagaaaaauagaauau

SEQ ID NO: 172281 - RNA, 22 nt, Human
uuacagaaguauugagagaucc

SEQ ID NO: 172282 - RNA, 22 nt, Human
augcacaagcaagagauaaugg

SEQ ID NO: 172283 - RNA, 22 nt, Human
aaaagccaugcauaccuaagag

SEQ ID NO: 172284 - RNA, 22 nt, Human
ucuggaugaaagggcuauauau

SEQ ID NO: 172285 - RNA, 22 nt, Human
aaauaucauuuauaacuuuuaa

SEQ ID NO: 172286 - RNA, 22 nt, Human
aacaguaacgagauguccuaac

SEQ ID NO: 172287 - RNA, 22 nt, Human
cucuggaauggguguuucuaac

SEQ ID NO: 172288 - RNA, 22 nt, Human
auccaugaagguacuucucagg

SEQ ID NO: 172289 - RNA, 22 nt, Human
augaaacagugaauuagucaag

SEQ ID NO: 172290 - RNA, 22 nt, Human
ucagggcacguuucugcaaugc

SEQ ID NO: 172291 - RNA, 22 nt, Human
gcauaauauacaugcuugaucc

SEQ ID NO: 172292 - RNA, 22 nt, Human
ggggcucaguucggacagccug

SEQ ID NO: 172293 - RNA, 22 nt, Human
aaaagucuacaagcuucaacaa

SEQ ID NO: 172294 - RNA, 22 nt, Human
ugcuuauugcuuucaagacugu

SEQ ID NO: 172295 - RNA, 22 nt, Human
aagugauuucugccugcauguu

SEQ ID NO: 172296 - RNA, 22 nt, Human
aggaccuguguuuuccuugaau

SEQ ID NO: 172297 - RNA, 22 nt, Human
uucacaaaacacuauuuucugg

SEQ ID NO: 172298 - RNA, 22 nt, Human
auuugcuuuaagguauaaaagg

SEQ ID NO: 172299 - RNA, 22 nt, Human
uggcaggugcacuuuugguuuc

SEQ ID NO: 172300 - RNA, 22 nt, Human
uggcaaagacugcaaggacuuu

SEQ ID NO: 172301 - RNA, 22 nt, Human
uguuaauauacuaaaauccacu

SEQ ID NO: 172302 - RNA, 22 nt, Human
acuugguucuaacuaguguaua

SEQ ID NO: 172303 - RNA, 22 nt, Human
uuucacauuagauaugucauuu

SEQ ID NO: 172304 - RNA, 22 nt, Human
aaauacaaaaauuagccaggca

SEQ ID NO: 172305 - RNA, 21 nt, Human
caguguggugaccagggucuc

SEQ ID NO: 172306 - RNA, 22 nt, Human
cauagaaaucaggugagaaucu

SEQ ID NO: 172307 - RNA, 22 nt, Human
cacagguguaugaauaugucca

SEQ ID NO: 172308 - RNA, 22 nt, Human
guacauuuacugaugaaaagua

SEQ ID NO: 172309 - RNA, 22 nt, Human
auugggaugccggcugauaaga

SEQ ID NO: 172310 - RNA, 22 nt, Human
gaguccuuuugugccacaggga

SEQ ID NO: 172311 - RNA, 22 nt, Human
gccuggguuccaugaucuccag

SEQ ID NO: 172312 - RNA, 22 nt, Human
cuuauauuuuaggaacagacaa

SEQ ID NO: 172313 - RNA, 22 nt, Human
auggcuuuguuccaauaaaacu

SEQ ID NO: 172314 - RNA, 22 nt, Human
ggagcugaggcugaggccucac

SEQ ID NO: 172315 - RNA, 22 nt, Human
uuauugcucuauuauggccuaa

SEQ ID NO: 172316 - RNA, 22 nt, Human
ucagagaggcaauacuguuuaa

SEQ ID NO: 172317 - RNA, 22 nt, Human
agucucagcaagcauggcuagu

SEQ ID NO: 172318 - RNA, 17 nt, Human
ucuggaugucauggaag

SEQ ID NO: 172319 - RNA, 22 nt, Human
ucagagagcagaacuuuuuuac

SEQ ID NO: 172320 - RNA, 22 nt, Human
uaaagccauacugaaagccacu

SEQ ID NO: 172321 - RNA, 22 nt, Human
caguuucugagcccugucauuu

SEQ ID NO: 172322 - RNA, 22 nt, Human
agggucaacauuucauugauuc

SEQ ID NO: 172323 - RNA, 22 nt, Human
uugcuuuauucacaucuauauu

SEQ ID NO: 172324 - RNA, 22 nt, Human
aucauuucccuuuagaucacaa

SEQ ID NO: 172325 - RNA, 22 nt, Human
guuaggcaguuuucuucauucu

SEQ ID NO: 172326 - RNA, 22 nt, Human
gguggggcugcaagcaguucgg

SEQ ID NO: 172327 - RNA, 19 nt, Human
ugcagggcugcgccugggg

SEQ ID NO: 172328 - RNA, 18 nt, Human
auagaaaccuuuaaucag

SEQ ID NO: 172329 - RNA, 22 nt, Human
uucauguaguguaaugucuuca

SEQ ID NO: 172330 - RNA, 22 nt, Human
cuucacauguuggaguccuuug

SEQ ID NO: 172331 - RNA, 22 nt, Human
aaauuccagaaacucaguauau

SEQ ID NO: 172332 - RNA, 22 nt, Human
gcccaggccggagagcagugcu

SEQ ID NO: 172333 - RNA, 22 nt, Human
uagaauucauguuacuguuagc

SEQ ID NO: 172334 - RNA, 22 nt, Human
ucuucaaguuccaaagugcagg

SEQ ID NO: 172335 - RNA, 22 nt, Human
aguugacauccagagacauucu

SEQ ID NO: 172336 - RNA, 22 nt, Human
uaguuaggaaaguccagggagc

SEQ ID NO: 172337 - RNA, 22 nt, Human
ggagaggggaacuuguugcuug

SEQ ID NO: 172338 - RNA, 22 nt, Human
gacccaggguggucaccugaaa

SEQ ID NO: 172339 - RNA, 22 nt, Human
cuccucagcugggaggaguccc

SEQ ID NO: 172340 - RNA, 22 nt, Human
ucagggcacauucugcaguggc

SEQ ID NO: 172341 - RNA, 22 nt, Human
uuauacuaaaacgcauugaauu

SEQ ID NO: 172342 - RNA, 22 nt, Human
ggcugcaagacaagguugguuu

SEQ ID NO: 172343 - RNA, 22 nt, Human
cccagugugguugugaauucug

SEQ ID NO: 172344 - RNA, 22 nt, Human
ugcuuuaagacacuaaguuuga

SEQ ID NO: 172345 - RNA, 22 nt, Human
aaacuuuguagagaaugcuggc

SEQ ID NO: 172346 - RNA, 22 nt, Human
ugaaggagaauuaauaggcauu

SEQ ID NO: 172347 - RNA, 22 nt, Human
auuucaacauucucaguuguag

SEQ ID NO: 172348 - RNA, 22 nt, Human
cguggggcggguggacacuugc

SEQ ID NO: 172349 - RNA, 22 nt, Human
agacugaauaacaagcaaauaa

SEQ ID NO: 172350 - RNA, 22 nt, Human
gaagcacauggcuauagcuauu

SEQ ID NO: 172351 - RNA, 23 nt, Human
uggaccugaaccagugccucugu

SEQ ID NO: 172352 - RNA, 23 nt, Human
gcaggugguucgaacagaaguuu

SEQ ID NO: 172353 - RNA, 22 nt, Human
aguccuuugcugaacugucaca

SEQ ID NO: 172354 - RNA, 22 nt, Human
uuaaaauagccagugccccucu

SEQ ID NO: 172355 - RNA, 22 nt, Human
uguuugcuauauccuacuucau

SEQ ID NO: 172356 - RNA, 18 nt, Human
uccucucuuuccccaggg

SEQ ID NO: 172357 - RNA, 22 nt, Human
cagagccuuccuagcagacucu

SEQ ID NO: 172358 - RNA, 22 nt, Human
uguuuuaagagcgcacuuuaua

SEQ ID NO: 172359 - RNA, 22 nt, Human
uggaaugaauuuggcuuccucc

SEQ ID NO: 172360 - RNA, 22 nt, Human
ccucccuuuuggugucugcaua

SEQ ID NO: 172361 - RNA, 22 nt, Human
aaauuauuacaagcuaguuggc

SEQ ID NO: 172362 - RNA, 19 nt, Human
agggauauuuaaaaagcuc

SEQ ID NO: 172363 - RNA, 22 nt, Human
ccuuuucuacaagcaaaugugc

SEQ ID NO: 172364 - RNA, 22 nt, Human
uagggcaggggaggaaucugaa

SEQ ID NO: 172365 - RNA, 22 nt, Human
ggacagguucagcaguuuauaa

SEQ ID NO: 172366 - RNA, 18 nt, Human
uggcaggaaaugcacuuu

SEQ ID NO: 172367 - RNA, 22 nt, Human
uuccucagcuguguccuggcga

SEQ ID NO: 172368 - RNA, 22 nt, Human
gggugggguguaucggauccua

SEQ ID NO: 172369 - RNA, 22 nt, Human
uaucagaacacauguuuugcag

SEQ ID NO: 172370 - RNA, 22 nt, Human
aaucagaacuccuaccacagag

SEQ ID NO: 172371 - RNA, 22 nt, Human
aagugguuauuuugaucuagaa

SEQ ID NO: 172372 - RNA, 22 nt, Human
cccugcagccggccagcucauu

SEQ ID NO: 172373 - RNA, 22 nt, Human
cuuugcuuuacucccacugugu

SEQ ID NO: 172374 - RNA, 22 nt, Human
aagugccccaggcuguuaacau

SEQ ID NO: 172375 - RNA, 22 nt, Human
aaaauccuuagccgagugaggu

SEQ ID NO: 172376 - RNA, 22 nt, Human
ggguggggcccaggaaaucuau

SEQ ID NO: 172377 - RNA, 22 nt, Human
caguccuugcucaaagucuaca

SEQ ID NO: 172378 - RNA, 22 nt, Human
ucagggcaagauugguuaauaa

SEQ ID NO: 172379 - RNA, 22 nt, Human
uucuuauagaagcaaccauugu

SEQ ID NO: 172380 - RNA, 22 nt, Human
ucugggaaguccucugucaugc

SEQ ID NO: 172381 - RNA, 22 nt, Human
gccaaaucacagggccaaaagc

SEQ ID NO: 172382 - RNA, 22 nt, Human
ucuuucuucuuucauaguguga

SEQ ID NO: 172383 - RNA, 22 nt, Human
ccuccuucuggggccuucugcu

SEQ ID NO: 172384 - RNA, 23 nt, Human
uuuggacuugugacucuucuccu

SEQ ID NO: 172385 - RNA, 22 nt, Human
uagcagaaacuguuacagaagg

SEQ ID NO: 172386 - RNA, 22 nt, Human
cccaggcauuuucaacuuuagu

SEQ ID NO: 172387 - RNA, 22 nt, Human
uucaugugaauauauuugucuu

SEQ ID NO: 172388 - RNA, 22 nt, Human
aggauuuagcaugaaaugugaa

SEQ ID NO: 172389 - RNA, 22 nt, Human
cagggcucagggacugcagaaa

SEQ ID NO: 172390 - RNA, 22 nt, Human
guuccuuccuaucccgagagcc

SEQ ID NO: 172391 - RNA, 22 nt, Human
aaugugucauuucccacaggug

SEQ ID NO: 172392 - RNA, 19 nt, Human
ugguggaggugcaccugac

SEQ ID NO: 172393 - RNA, 22 nt, Human
auuugaaguaaguaaugaguau

SEQ ID NO: 172394 - RNA, 22 nt, Human
guccagagauggacgagcagau

SEQ ID NO: 172395 - RNA, 22 nt, Human
uuugcuuugacugucagcaagu

SEQ ID NO: 172396 - RNA, 20 nt, Human
ugaucaugugaaagucaugu

SEQ ID NO: 172397 - RNA, 19 nt, Human
ugggcagguucaguaaugg

SEQ ID NO: 172398 - RNA, 22 nt, Human
aaucaguguggugacuugucug

SEQ ID NO: 172399 - RNA, 21 nt, Human
cucugcccagggccuccugcc

SEQ ID NO: 172400 - RNA, 22 nt, Human
gcugggcucauuugugugucug

SEQ ID NO: 172401 - RNA, 22 nt, Human
ugucauaacuuagugacaaauc

SEQ ID NO: 172402 - RNA, 22 nt, Human
gccucuagggcuguugggaauu

SEQ ID NO: 172403 - RNA, 22 nt, Human
gcacccagaggucagcagugcu

SEQ ID NO: 172404 - RNA, 22 nt, Human
gagguggucgaggagggguacc

SEQ ID NO: 172405 - RNA, 22 nt, Human
agagagcauggcacagaggggu

SEQ ID NO: 172406 - RNA, 22 nt, Human
uuauuaggaaaaggucagaugu

SEQ ID NO: 172407 - RNA, 22 nt, Human
ggcaggcaggagcucugucucc

SEQ ID NO: 172408 - RNA, 22 nt, Human
acagggcagugucuugaaaaau

SEQ ID NO: 172409 - RNA, 22 nt, Human
uucucuuaucuggcauuauugg

SEQ ID NO: 172410 - RNA, 22 nt, Human
cuacccagcaccuaggcugccu

SEQ ID NO: 172411 - RNA, 23 nt, Human
acagaaaucauuuguaagguacc

SEQ ID NO: 172412 - RNA, 22 nt, Human
cagacaggaaguucagaagaaa

SEQ ID NO: 172413 - RNA, 22 nt, Human
aggcagggcucauuucuuaggc

SEQ ID NO: 172414 - RNA, 22 nt, Human
agcucccagaaggcccugcgcc

SEQ ID NO: 172415 - RNA, 22 nt, Human
gcaacuuuagaaaaaucuauaa

SEQ ID NO: 172416 - RNA, 22 nt, Human
auaugcauuuaccuggcauaua

SEQ ID NO: 172417 - RNA, 22 nt, Human
aaagucuuuauuuuguaucuuu

SEQ ID NO: 172418 - RNA, 22 nt, Human
agggcccuaaggaaggcacaca

SEQ ID NO: 172419 - RNA, 21 nt, Human
acuuuaauauacaugaggagg

SEQ ID NO: 172420 - RNA, 22 nt, Human
auaaagauuucuuuuucucuac

SEQ ID NO: 172421 - RNA, 22 nt, Human
uucaguaaaacacugcaauguc

SEQ ID NO: 172422 - RNA, 22 nt, Human
uauuccaaaaucccaaacugcc

SEQ ID NO: 172423 - RNA, 22 nt, Human
uccaggcaaagggacuagcagg

SEQ ID NO: 172424 - RNA, 21 nt, Human
accucaagcaacaaccaaggu

SEQ ID NO: 172425 - RNA, 22 nt, Human
uauugcugaggauugaggcuug

SEQ ID NO: 172426 - RNA, 22 nt, Human
ucuuccucuucugcugagaagu

SEQ ID NO: 172427 - RNA, 20 nt, Human
ggcagggcaucaacagcucu

SEQ ID NO: 172428 - RNA, 22 nt, Human
ccaggcagggcucaaggaaccu

SEQ ID NO: 172429 - RNA, 22 nt, Human
cauucauuagaauagauaugua

SEQ ID NO: 172430 - RNA, 22 nt, Human
gcugccacauuuucaggacuaa

SEQ ID NO: 172431 - RNA, 22 nt, Human
uggaccugaagaauaggaagua

SEQ ID NO: 172432 - RNA, 22 nt, Human
gagacaggccaggugguacuua

SEQ ID NO: 172433 - RNA, 22 nt, Human
caugcagcggcguuugguuuaa

SEQ ID NO: 172434 - RNA, 22 nt, Human
augggugugaaaauggucaucu

SEQ ID NO: 172435 - RNA, 22 nt, Human
gucuucaauagagccucaauuu

SEQ ID NO: 172436 - RNA, 22 nt, Human
uccaggcaugucccaagccgga

SEQ ID NO: 172437 - RNA, 22 nt, Human
ucuguucaugaaauaucuuuuu

SEQ ID NO: 172438 - RNA, 22 nt, Human
aaaaaguauuggccaugguuga

SEQ ID NO: 172439 - RNA, 19 nt, Human
auggaaaaugccagacuga

SEQ ID NO: 172440 - RNA, 22 nt, Human
aguuuacacuuuugauucuuau

SEQ ID NO: 172441 - RNA, 17 nt, Human
ccagagaguaguuagga

SEQ ID NO: 172442 - RNA, 22 nt, Human
ugaaauagacacagugcuauac

SEQ ID NO: 172443 - RNA, 22 nt, Human
uugcugggucagaagccaggag

SEQ ID NO: 172444 - RNA, 22 nt, Human
ucuggcucccagccugcucuca

SEQ ID NO: 172445 - RNA, 22 nt, Human
uugcuggggugugaaaucugau

SEQ ID NO: 172446 - RNA, 22 nt, Human
guuaggcagcccaagaugucag

SEQ ID NO: 172447 - RNA, 22 nt, Human
ugacauguauguuguuggcaug

SEQ ID NO: 172448 - RNA, 23 nt, Human
cagaccuuucuguaucaguuauc

SEQ ID NO: 172449 - RNA, 22 nt, Human
uagggcagcugcaucaggcacu

SEQ ID NO: 172450 - RNA, 22 nt, Human
auucaaauuaaguuaauucagc

SEQ ID NO: 172451 - RNA, 22 nt, Human
gcucagcacuuucuccaaccac

SEQ ID NO: 172452 - RNA, 20 nt, Human
uauuggaucuaagaaauggg

SEQ ID NO: 172453 - RNA, 22 nt, Human
gucuucuuuaaccuacuaaagc

SEQ ID NO: 172454 - RNA, 22 nt, Human
uuuuaugugcuggacuggcagu

SEQ ID NO: 172455 - RNA, 22 nt, Human
gcagggcagaaggugcugagga

SEQ ID NO: 172456 - RNA, 22 nt, Human
cugcgugucucugucucauggc

SEQ ID NO: 172457 - RNA, 22 nt, Human
auuaguaaaacauuguauaugu

SEQ ID NO: 172458 - RNA, 22 nt, Human
agcaugaaaggcgugccaacuu

SEQ ID NO: 172459 - RNA, 21 nt, Human
auucagaguaauucaucuuua

SEQ ID NO: 172460 - RNA, 22 nt, Human
uguuuuccuccugguuucugcc

SEQ ID NO: 172461 - RNA, 22 nt, Human
gauuguaaaacagaucauuauc

SEQ ID NO: 172462 - RNA, 22 nt, Human
caaugaaaauuuaaguugcagc

SEQ ID NO: 172463 - RNA, 22 nt, Human
cuacagaaucuaccucaagcca

SEQ ID NO: 172464 - RNA, 23 nt, Human
ucuguacaauugagaagagaaca

SEQ ID NO: 172465 - RNA, 19 nt, Human
ucaaaacacaaaugguuga

SEQ ID NO: 172466 - RNA, 22 nt, Human
uaaguccuggcugguuugaagc

SEQ ID NO: 172467 - RNA, 22 nt, Human
aaucagaaaauucaguggaauu

SEQ ID NO: 172468 - RNA, 22 nt, Human
uggaaugucauaccauaaaaga

SEQ ID NO: 172469 - RNA, 22 nt, Human
auucagugugagguuuucaagu

SEQ ID NO: 172470 - RNA, 22 nt, Human
agaauucauaggaaguuuccua

SEQ ID NO: 172471 - RNA, 22 nt, Human
cuaaagaagcuagcaaucuaua

SEQ ID NO: 172472 - RNA, 22 nt, Human
agcuuuauauaaaagaguacau

SEQ ID NO: 172473 - RNA, 22 nt, Human
uugcuucaguagcucuuuaaag

SEQ ID NO: 172474 - RNA, 22 nt, Human
acccagcuaacccuacccugga

SEQ ID NO: 172475 - RNA, 22 nt, Human
auuaaagaaacccagcauguga

SEQ ID NO: 172476 - RNA, 21 nt, Human
agaagggauugugguaaagau

SEQ ID NO: 172477 - RNA, 22 nt, Human
uuguguccuaagcaccagaugg

SEQ ID NO: 172478 - RNA, 22 nt, Human
ucugaagaacugaguaaacaug

SEQ ID NO: 172479 - RNA, 22 nt, Human
uuuauugacuucagugagucuu

SEQ ID NO: 172480 - RNA, 22 nt, Human
gaaauauacauugcaggaagag

SEQ ID NO: 172481 - RNA, 22 nt, Human
guagaaauagugguugacagga

SEQ ID NO: 172482 - RNA, 22 nt, Human
uucagagacagcaaccaggaca

SEQ ID NO: 172483 - RNA, 22 nt, Human
cauuugaaauaguucauucuug

SEQ ID NO: 172484 - RNA, 22 nt, Human
ccauggcucuuaccuuguuaua

SEQ ID NO: 172485 - RNA, 22 nt, Human
guuaaauucgaugauggauaaa

SEQ ID NO: 172486 - RNA, 22 nt, Human
ucuuuccuagaggcugaugagu

SEQ ID NO: 172487 - RNA, 22 nt, Human
auuccaaagacagaagcagcug

SEQ ID NO: 172488 - RNA, 22 nt, Human
auuauaaaccuuugaggguggg

SEQ ID NO: 172489 - RNA, 22 nt, Human
auugcugggaauauuuagccca

SEQ ID NO: 172490 - RNA, 22 nt, Human
acaggcagguccugucccagcu

SEQ ID NO: 172491 - RNA, 22 nt, Human
uucuucaugcuguugcugcuug

SEQ ID NO: 172492 - RNA, 22 nt, Human
auuauccagcaccaaugucaga

SEQ ID NO: 172493 - RNA, 22 nt, Human
agagggcugcugcacagugcuc

SEQ ID NO: 172494 - RNA, 22 nt, Human
cagaaaauaaaguuucuacgca

SEQ ID NO: 172495 - RNA, 22 nt, Human
ucccaggccauaaaacucagag

SEQ ID NO: 172496 - RNA, 19 nt, Human
aguguccuagucauuugcc

SEQ ID NO: 172497 - RNA, 22 nt, Human
ggucccagcugcucaagaggcu

SEQ ID NO: 172498 - RNA, 19 nt, Human
gaaguccucuaguaaauuu

SEQ ID NO: 172499 - RNA, 22 nt, Human
auuuauugagccuuuccuaugu

SEQ ID NO: 172500 - RNA, 22 nt, Human
uuuaugagcaaugcugagggga

SEQ ID NO: 172501 - RNA, 22 nt, Human
caaaagucuuccuauucucuua

SEQ ID NO: 172502 - RNA, 22 nt, Human
gguggggcccaggcaucugaug

SEQ ID NO: 172503 - RNA, 21 nt, Human
uuucucaguugugugagcagc

SEQ ID NO: 172504 - RNA, 22 nt, Human
uucagagaagcaaaggcagauu

SEQ ID NO: 172505 - RNA, 22 nt, Human
agugugaguaauugagucuguc

SEQ ID NO: 172506 - RNA, 22 nt, Human
caauuucauuaauagauauaga

SEQ ID NO: 172507 - RNA, 22 nt, Human
agcagggcuucugugccugugc

SEQ ID NO: 172508 - RNA, 22 nt, Human
uuauuggaaaagggcuguaauu

SEQ ID NO: 172509 - RNA, 22 nt, Human
aggauuuaaauccuuaaccacu

SEQ ID NO: 172510 - RNA, 22 nt, Human
cauuuacauaacaguaacgcug

SEQ ID NO: 172511 - RNA, 22 nt, Human
agagugaaguuuuugaaaguga

SEQ ID NO: 172512 - RNA, 22 nt, Human
aguccagugucaaggugccauu

SEQ ID NO: 172513 - RNA, 22 nt, Human
uuauugagcaccuacuaugugu

SEQ ID NO: 172514 - RNA, 22 nt, Human
agaagcacaccugaccucuagc

SEQ ID NO: 172515 - RNA, 22 nt, Human
cggcaggguugguuuucucuga

SEQ ID NO: 172516 - RNA, 22 nt, Human
agcaggagcugugggaagaugg

SEQ ID NO: 172517 - RNA, 22 nt, Human
ucugggaacucugucauuuccc

SEQ ID NO: 172518 - RNA, 22 nt, Human
auuuauugagagggaggggaau

SEQ ID NO: 172519 - RNA, 22 nt, Human
ugaaacacugcgauaaaauccu

SEQ ID NO: 172520 - RNA, 22 nt, Human
uacauguggagauaacugaagc

SEQ ID NO: 172521 - RNA, 22 nt, Human
acaggugggcuuaagagucggc

SEQ ID NO: 172522 - RNA, 18 nt, Human
aaguccuuccuuugcuuu

SEQ ID NO: 172523 - RNA, 22 nt, Human
agcagggcuuugucucugugaa

SEQ ID NO: 172524 - RNA, 22 nt, Human
aucugaagggaaguggaaggca

SEQ ID NO: 172525 - RNA, 23 nt, Human
gggcuccagucucugcucaguug

SEQ ID NO: 172526 - RNA, 22 nt, Human
caauuucacuaauaauauuuac

SEQ ID NO: 172527 - RNA, 22 nt, Human
auagacauagccguaauuuauu

SEQ ID NO: 172528 - RNA, 22 nt, Human
aaagcugcuuugguuucuggaa

SEQ ID NO: 172529 - RNA, 22 nt, Human
uguuccaauaaggaguugaaau

SEQ ID NO: 172530 - RNA, 22 nt, Human
agagucagcuuaugacacaguc

SEQ ID NO: 172531 - RNA, 23 nt, Human
gggaccugguaggaggugauugg

SEQ ID NO: 172532 - RNA, 22 nt, Human
uggcagggccugaaucuuauac

SEQ ID NO: 172533 - RNA, 22 nt, Human
agaguacugccucaguuaugaa

SEQ ID NO: 172534 - RNA, 22 nt, Human
auauauaaccuggauaaggcuu

SEQ ID NO: 172535 - RNA, 22 nt, Human
ugacauguuagggaaaugugau

SEQ ID NO: 172536 - RNA, 22 nt, Human
uaagaaacccaggaauuucuua

SEQ ID NO: 172537 - RNA, 22 nt, Human
uuaggaaaaucaugagagauga

SEQ ID NO: 172538 - RNA, 22 nt, Human
aaaauaacuucuacuauuugca

SEQ ID NO: 172539 - RNA, 18 nt, Human
auauguuaauuagguagg

SEQ ID NO: 172540 - RNA, 18 nt, Human
guguccuggcugcggcgc

SEQ ID NO: 172541 - RNA, 22 nt, Human
agaucugaggguccaagggagg

SEQ ID NO: 172542 - RNA, 22 nt, Human
ugcauacacaagcauacaugua

SEQ ID NO: 172543 - RNA, 22 nt, Human
ucagaauugcagggagggcagg

SEQ ID NO: 172544 - RNA, 21 nt, Human
aaaugaaugugguagugcaag

SEQ ID NO: 172545 - RNA, 22 nt, Human
cucuucuuggcccccaugaggg

SEQ ID NO: 172546 - RNA, 22 nt, Human
gacaggcugugauggccgggag

SEQ ID NO: 172547 - RNA, 22 nt, Human
uuuccuucucagggagcuucaa

SEQ ID NO: 172548 - RNA, 22 nt, Human
caacuuuaauuugggugucaga

SEQ ID NO: 172549 - RNA, 22 nt, Human
agccagaguugaaugugagucu

SEQ ID NO: 172550 - RNA, 22 nt, Human
acuuugaaucucagauaaccaa

SEQ ID NO: 172551 - RNA, 22 nt, Human
aaaguucaugguguuauagaaa

SEQ ID NO: 172552 - RNA, 22 nt, Human
acagguggggaggcugagguuc

SEQ ID NO: 172553 - RNA, 22 nt, Human
gauuucaaguaucuugggcgag

SEQ ID NO: 172554 - RNA, 22 nt, Human
guguguccucuuaacuauuaug

SEQ ID NO: 172555 - RNA, 22 nt, Human
aaucaaaaccuacagagguaau

SEQ ID NO: 172556 - RNA, 22 nt, Human
aacuuucuuggaugucucaaca

SEQ ID NO: 172557 - RNA, 22 nt, Human
acauuuaaugauccuacuguga

SEQ ID NO: 172558 - RNA, 22 nt, Human
aagaaugauuacaaagcaacga

SEQ ID NO: 172559 - RNA, 22 nt, Human
acaggccuuggcaggcauguga

SEQ ID NO: 172560 - RNA, 22 nt, Human
uuauuguagcacuuuggcagug

SEQ ID NO: 172561 - RNA, 22 nt, Human
uuauuguaggccuauuguagaa

SEQ ID NO: 172562 - RNA, 22 nt, Human
cauguuaauaugcauugaguac

SEQ ID NO: 172563 - RNA, 22 nt, Human
ccaggugugcucugcaguggau

SEQ ID NO: 172564 - RNA, 22 nt, Human
cucuucuugccugaugaggcag

SEQ ID NO: 172565 - RNA, 22 nt, Human
cagguggcuuauuagggucagu

SEQ ID NO: 172566 - RNA, 22 nt, Human
acaugcuuuaacuuauuuugau

SEQ ID NO: 172567 - RNA, 22 nt, Human
aaguccuuguauacagaaucaa

SEQ ID NO: 172568 - RNA, 22 nt, Human
aaucauaauuguauacauucau

SEQ ID NO: 172569 - RNA, 22 nt, Human
ucauaaaaauagacucuaaagu

SEQ ID NO: 172570 - RNA, 22 nt, Human
aagcugcaaggaagugugccag

SEQ ID NO: 172571 - RNA, 22 nt, Human
ugcuuuauaacuuaguuuaugg

SEQ ID NO: 172572 - RNA, 22 nt, Human
cuuaaaaucuggcaguuagcua

SEQ ID NO: 172573 - RNA, 22 nt, Human
ucccaggcuaggccucugcguu

SEQ ID NO: 172574 - RNA, 22 nt, Human
acuugccuguuacauuucuagu

SEQ ID NO: 172575 - RNA, 22 nt, Human
aguaaaauuguauuggaaaaca

SEQ ID NO: 172576 - RNA, 22 nt, Human
uaccugcagcgggaauccauua

SEQ ID NO: 172577 - RNA, 21 nt, Human
cuacagaaucgagcauucugg

SEQ ID NO: 172578 - RNA, 22 nt, Human
gaauuucacaaggugaggauaa

SEQ ID NO: 172579 - RNA, 22 nt, Human
uuauuauugugguugcauuauc

SEQ ID NO: 172580 - RNA, 22 nt, Human
cuggaggccacuguacagauug

SEQ ID NO: 172581 - RNA, 22 nt, Human
uaggugucugcucuuauuuaac

SEQ ID NO: 172582 - RNA, 22 nt, Human
uccuggcugaguucccaagucg

SEQ ID NO: 172583 - RNA, 22 nt, Human
uuuaggcaugcaguucuauuua

SEQ ID NO: 172584 - RNA, 22 nt, Human
gcagcuuugaagacuuauuugc

SEQ ID NO: 172585 - RNA, 22 nt, Human
cugggucccaauagcuuuuguu

SEQ ID NO: 172586 - RNA, 22 nt, Human
cuccaguggcaaguccgggcgg

SEQ ID NO: 172587 - RNA, 22 nt, Human
aggcuuuaauuaucuacaggag

SEQ ID NO: 172588 - RNA, 22 nt, Human
aucuuucaaucaggaaaaaucu

SEQ ID NO: 172589 - RNA, 22 nt, Human
ggaagagaauuucucucuuuuu

SEQ ID NO: 172590 - RNA, 22 nt, Human
ugguggcagcugagugucaggu

SEQ ID NO: 172591 - RNA, 22 nt, Human
cccaggcaguagaaagaagagg

SEQ ID NO: 172592 - RNA, 22 nt, Human
ccugcucccgggacgcguucac

SEQ ID NO: 172593 - RNA, 22 nt, Human
uuccaggagacuuccagaaaua

SEQ ID NO: 172594 - RNA, 22 nt, Human
acucacuuuccauucaagcacc

SEQ ID NO: 172595 - RNA, 22 nt, Human
cuauugcuaucauucugguggu

SEQ ID NO: 172596 - RNA, 22 nt, Human
gauucuuacuucuaagcaagcu

SEQ ID NO: 172597 - RNA, 22 nt, Human
auguccuuccugagaucccugu

SEQ ID NO: 172598 - RNA, 22 nt, Human
cuggaugugguaaugacuuuga

SEQ ID NO: 172599 - RNA, 22 nt, Human
augaacaaguauuugcaugagc

SEQ ID NO: 172600 - RNA, 22 nt, Human
aggcagguuacaaaaacuuuau

SEQ ID NO: 172601 - RNA, 22 nt, Human
ggcaggugcccagagagcacga

SEQ ID NO: 172602 - RNA, 22 nt, Human
uccaggcauuccagccauucca

SEQ ID NO: 172603 - RNA, 19 nt, Human
agcaaauacaucaaaauug

SEQ ID NO: 172604 - RNA, 22 nt, Human
acaguuaucuuugaaauagaga

SEQ ID NO: 172605 - RNA, 23 nt, Human
cagaaaucugaaaucuagaaaug

SEQ ID NO: 172606 - RNA, 22 nt, Human
acuuuguucuaauaguaucucu

SEQ ID NO: 172607 - RNA, 22 nt, Human
uuuugcugggguggcuagcuua

SEQ ID NO: 172608 - RNA, 22 nt, Human
uauacuuuccugcaacuuugau

SEQ ID NO: 172609 - RNA, 22 nt, Human
ccauguguugauucucugcaga

SEQ ID NO: 172610 - RNA, 22 nt, Human
ggagcugagacccaguggcuga

SEQ ID NO: 172611 - RNA, 22 nt, Human
uggcaggugccuguaaucucag

SEQ ID NO: 172612 - RNA, 22 nt, Human
uccaggcauaaugcccaguggu

SEQ ID NO: 172613 - RNA, 22 nt, Human
aacacuuucuauuauuaugguu

SEQ ID NO: 172614 - RNA, 22 nt, Human
uaaaggcuucugcagggacuga

SEQ ID NO: 172615 - RNA, 22 nt, Human
caggugguugagagcuguaggc

SEQ ID NO: 172616 - RNA, 22 nt, Human
uguccuagaguacauuccacug

SEQ ID NO: 172617 - RNA, 22 nt, Human
uguaaauaauuccuaggcuuuu

SEQ ID NO: 172618 - RNA, 22 nt, Human
augaaaacggaccagagcuauu

SEQ ID NO: 172619 - RNA, 22 nt, Human
aaugugucagcuugucgaucuu

SEQ ID NO: 172620 - RNA, 22 nt, Human
cuggaaauuggagaugauguuu

SEQ ID NO: 172621 - RNA, 19 nt, Human
ugcucuggagccagcucuc

SEQ ID NO: 172622 - RNA, 22 nt, Human
cagaaacauguauaaaguugua

SEQ ID NO: 172623 - RNA, 22 nt, Human
uauaauuuuaagugguaaauua

SEQ ID NO: 172624 - RNA, 22 nt, Human
aauacauauggaauuccauguu

SEQ ID NO: 172625 - RNA, 20 nt, Human
uccugcagucgcuagcgccc

SEQ ID NO: 172626 - RNA, 22 nt, Human
uucaacuagauuuauacaauuc

SEQ ID NO: 172627 - RNA, 22 nt, Human
gaugguccuccugcugccucuc

SEQ ID NO: 172628 - RNA, 22 nt, Human
uguguccuuuggaggaucagcg

SEQ ID NO: 172629 - RNA, 22 nt, Human
ucagcuuuggucacauugaguu

SEQ ID NO: 172630 - RNA, 22 nt, Human
acaguuugcccugacauucucc

SEQ ID NO: 172631 - RNA, 19 nt, Human
ucuucccuggcugucaguc

SEQ ID NO: 172632 - RNA, 22 nt, Human
aaauuucaagcaaaguagcuau

SEQ ID NO: 172633 - RNA, 22 nt, Human
acccagcaaagauaaacuuaug

SEQ ID NO: 172634 - RNA, 22 nt, Human
uguugcugacaagagaggagca

SEQ ID NO: 172635 - RNA, 22 nt, Human
uccaggaggccucauuuccugu

SEQ ID NO: 172636 - RNA, 22 nt, Human
uuugacucuuaaguggcucaau

SEQ ID NO: 172637 - RNA, 22 nt, Human
aggcaguguauugcuagcggcu

SEQ ID NO: 172638 - RNA, 22 nt, Human
gggcugacaccacccaggcgca

SEQ ID NO: 172639 - RNA, 22 nt, Human
uggaaauggaucugaugagucu

SEQ ID NO: 172640 - RNA, 22 nt, Human
uuaaaaucuaaagcaguugucu

SEQ ID NO: 172641 - RNA, 22 nt, Human
cucuggaauuaaggaagccugu

SEQ ID NO: 172642 - RNA, 22 nt, Human
uaaauuauguuccauguccuuu

SEQ ID NO: 172643 - RNA, 22 nt, Human
guuaauuugcagcuuucgagcu

SEQ ID NO: 172644 - RNA, 22 nt, Human
ucugggaaaugcuguuccuugu

SEQ ID NO: 172645 - RNA, 22 nt, Human
gugggguagaucuuucucagga

SEQ ID NO: 172646 - RNA, 22 nt, Human
uuuuauugguaaugauaaaagu

SEQ ID NO: 172647 - RNA, 22 nt, Human
uugcagcuucuaccacuguuuc

SEQ ID NO: 172648 - RNA, 22 nt, Human
ucugcgcccugucgccugcucc

SEQ ID NO: 172649 - RNA, 22 nt, Human
uuuauuggauggauggauggau

SEQ ID NO: 172650 - RNA, 22 nt, Human
acagaauuaucaggaaauguua

SEQ ID NO: 172651 - RNA, 20 nt, Human
gcuguucacauuauuaguag

SEQ ID NO: 172652 - RNA, 22 nt, Human
uuauuguuagugagacuguaga

SEQ ID NO: 172653 - RNA, 22 nt, Human
uguccugggccggcgacugguc

SEQ ID NO: 172654 - RNA, 22 nt, Human
ugcugggugguugcuccucccg

SEQ ID NO: 172655 - RNA, 22 nt, Human
caauauauaaugaguacuuucc

SEQ ID NO: 172656 - RNA, 22 nt, Human
uccugaggcacaauccuagaau

SEQ ID NO: 172657 - RNA, 22 nt, Human
acaaaauuguguuaaacuuuau

SEQ ID NO: 172658 - RNA, 22 nt, Human
acuuucaugguaguuguauucu

SEQ ID NO: 172659 - RNA, 22 nt, Human
cuggguggagccuggucaucug

SEQ ID NO: 172660 - RNA, 22 nt, Human
cucuggaagaauacacuuagaa

SEQ ID NO: 172661 - RNA, 22 nt, Human
guuuaagaaaauucauguuguu

SEQ ID NO: 172662 - RNA, 22 nt, Human
uucugggugccaccuaagacau

SEQ ID NO: 172663 - RNA, 22 nt, Human
uuccugaaugcuguugugcugu

SEQ ID NO: 172664 - RNA, 22 nt, Human
gcacuuuaaauguucacggaaa

SEQ ID NO: 172665 - RNA, 22 nt, Human
uguguuauugccacugaagacc

SEQ ID NO: 172666 - RNA, 22 nt, Human
auggcauuugaccgcuuugugg

SEQ ID NO: 172667 - RNA, 22 nt, Human
ucagcuuuuuggauugcccaag

SEQ ID NO: 172668 - RNA, 22 nt, Human
uaggugguuauaaauucaaggc

SEQ ID NO: 172669 - RNA, 22 nt, Human
auuaagugacuaaaguaaugcu

SEQ ID NO: 172670 - RNA, 22 nt, Human
guguccucuuauugcucuuggc

SEQ ID NO: 172671 - RNA, 22 nt, Human
uuuaucuuuaggacuuugcaga

SEQ ID NO: 172672 - RNA, 22 nt, Human
cauugaaaaacguugacugagu

SEQ ID NO: 172673 - RNA, 22 nt, Human
auauacaguuuuacaggguuuc

SEQ ID NO: 172674 - RNA, 22 nt, Human
gggcaggugcccagggccagag

SEQ ID NO: 172675 - RNA, 22 nt, Human
uuugacucaagcccucauguua

SEQ ID NO: 172676 - RNA, 22 nt, Human
cacaucagguagaccuacagag

SEQ ID NO: 172677 - RNA, 20 nt, Human
ccuuuauuauuuguaugaug

SEQ ID NO: 172678 - RNA, 17 nt, Human
uaaguuauagcagaaga

SEQ ID NO: 172679 - RNA, 22 nt, Human
uggaagcuguggcauaacugag

SEQ ID NO: 172680 - RNA, 22 nt, Human
auuugcuuucagguauaaaagg

SEQ ID NO: 172681 - RNA, 22 nt, Human
aaaucaguucucccuuucuuca

SEQ ID NO: 172682 - RNA, 22 nt, Human
uccucagaagaaccccuagauu

SEQ ID NO: 172683 - RNA, 22 nt, Human
uguacauagaucuugaaaauua

SEQ ID NO: 172684 - RNA, 22 nt, Human
aagguggugcuucugcuccucu

SEQ ID NO: 172685 - RNA, 22 nt, Human
cagguggugccuccucccuucc

SEQ ID NO: 172686 - RNA, 22 nt, Human
ugcagggccuucuagaccaugg

SEQ ID NO: 172687 - RNA, 22 nt, Human
cucuggccugcuuccucaggua

SEQ ID NO: 172688 - RNA, 22 nt, Human
augaaacacacacgcgcauacu

SEQ ID NO: 172689 - RNA, 22 nt, Human
uggcaaagaccgcaauuacuuu

SEQ ID NO: 172690 - RNA, 22 nt, Human
agauuucagaugcucggcaguu

SEQ ID NO: 172691 - RNA, 22 nt, Human
cucugaccauucccuugauuuu

SEQ ID NO: 172692 - RNA, 22 nt, Human
uacaguaagaugaaauagcaau

SEQ ID NO: 172693 - RNA, 19 nt, Human
gccugcagaaaaggcaggg

SEQ ID NO: 172694 - RNA, 22 nt, Human
ucuguccuguuuccuccugaca

SEQ ID NO: 172695 - RNA, 22 nt, Human
ucuuccuucgcccuugcuguuu

SEQ ID NO: 172696 - RNA, 22 nt, Human
ggucuggauuucugcuucuuuc

SEQ ID NO: 172697 - RNA, 22 nt, Human
uagaaacagauguuuuugaaga

SEQ ID NO: 172698 - RNA, 17 nt, Human
uccaugagacaugaaga

SEQ ID NO: 172699 - RNA, 22 nt, Human
agcagguggaaaauucuuauca

SEQ ID NO: 172700 - RNA, 22 nt, Human
auacaaagacaaaucucaaucu

SEQ ID NO: 172701 - RNA, 17 nt, Human
aaguccagaguugagca

SEQ ID NO: 172702 - RNA, 22 nt, Human
ugggacucacucuuuuggccag

SEQ ID NO: 172703 - RNA, 22 nt, Human
uguccucacacguagggaguaa

SEQ ID NO: 172704 - RNA, 23 nt, Human
acagugugguggacaaggagcag

SEQ ID NO: 172705 - RNA, 17 nt, Human
uccaggcagcaacugag

SEQ ID NO: 172706 - RNA, 22 nt, Human
cauggcuuuguucuguuagaug

SEQ ID NO: 172707 - RNA, 22 nt, Human
guacuaagucaggagaagaauu

SEQ ID NO: 172708 - RNA, 16 nt, Human
auuuccagauuaugca

SEQ ID NO: 172709 - RNA, 23 nt, Human
acuuuauugaccccaggucaguu

SEQ ID NO: 172710 - RNA, 22 nt, Human
guuucgucaggcuuauucuauc

SEQ ID NO: 172711 - RNA, 22 nt, Human
uggacaugaccucgagcgagau

SEQ ID NO: 172712 - RNA, 22 nt, Human
ugcuggaguucgacauugcaaa

SEQ ID NO: 172713 - RNA, 22 nt, Human
guaaaauugcaauuacuuuugc

SEQ ID NO: 172714 - RNA, 22 nt, Human
auucagcagccauggcuucuga

SEQ ID NO: 172715 - RNA, 22 nt, Human
caaauucucaagguuuauccca

SEQ ID NO: 172716 - RNA, 22 nt, Human
gaggcauaaaucacaguguuca

SEQ ID NO: 172717 - RNA, 22 nt, Human
ucuccucccaggcucuuccagg

SEQ ID NO: 172718 - RNA, 22 nt, Human
guagaaauauuuaucucugaga

SEQ ID NO: 172719 - RNA, 22 nt, Human
cagaagucacccucagaauaac

SEQ ID NO: 172720 - RNA, 20 nt, Human
acuguucaagggccuggugg

SEQ ID NO: 172721 - RNA, 22 nt, Human
auuccaaacagugcugcagacu

SEQ ID NO: 172722 - RNA, 22 nt, Human
uacaauacuuaaccuauuuugc

SEQ ID NO: 172723 - RNA, 22 nt, Human
ugugaauaaugccgcaauaaac

SEQ ID NO: 172724 - RNA, 22 nt, Human
aaacuucagugaaugacuuaug

SEQ ID NO: 172725 - RNA, 22 nt, Human
ugcuuagacgucaaguacagcc

SEQ ID NO: 172726 - RNA, 22 nt, Human
uucuuuucuuggcaggaguaga

SEQ ID NO: 172727 - RNA, 22 nt, Human
uggagcagaguucagcggggag

SEQ ID NO: 172728 - RNA, 22 nt, Human
ccaggccugugcaaggagggag

SEQ ID NO: 172729 - RNA, 22 nt, Human
ugcugagcgcauccggcggccg

SEQ ID NO: 172730 - RNA, 22 nt, Human
uugcagggaaacaguuuaggaa

SEQ ID NO: 172731 - RNA, 22 nt, Human
gacagguggguucucguaucug

SEQ ID NO: 172732 - RNA, 21 nt, Human
agcugcaaaaacauacaguuc

SEQ ID NO: 172733 - RNA, 22 nt, Human
gagggcuccucacauucucuau

SEQ ID NO: 172734 - RNA, 22 nt, Human
cacuuuaugggaagcaaaaauu

SEQ ID NO: 172735 - RNA, 22 nt, Human
acagguguaugaauauguucca

SEQ ID NO: 172736 - RNA, 22 nt, Human
ucagggcauggcugcacuuggc

SEQ ID NO: 172737 - RNA, 22 nt, Human
gaggugucugcuguguucaaag

SEQ ID NO: 172738 - RNA, 17 nt, Human
uucagaagcauuuuggc

SEQ ID NO: 172739 - RNA, 22 nt, Human
cacaggcugcccgcagcuggga

SEQ ID NO: 172740 - RNA, 22 nt, Human
cucuggaagaugaccuggguaa

SEQ ID NO: 172741 - RNA, 22 nt, Human
cugugucccagccaggauaaug

SEQ ID NO: 172742 - RNA, 22 nt, Human
cagacaggcuagccagacucac

SEQ ID NO: 172743 - RNA, 22 nt, Human
ugcagggcagauaugacuguag

SEQ ID NO: 172744 - RNA, 22 nt, Human
agccuauuccaggaugagcuca

SEQ ID NO: 172745 - RNA, 22 nt, Human
gcagagcacccugcagugguau

SEQ ID NO: 172746 - RNA, 22 nt, Human
uccuucucugguuuuuacugua

SEQ ID NO: 172747 - RNA, 22 nt, Human
uuuucuuaggugcuccaaguag

SEQ ID NO: 172748 - RNA, 22 nt, Human
gggcugacgaaggccaugugug

SEQ ID NO: 172749 - RNA, 22 nt, Human
auaggcuuauauaaaaacaucu

SEQ ID NO: 172750 - RNA, 22 nt, Human
ucuugcacuucaugaauauguu

SEQ ID NO: 172751 - RNA, 22 nt, Human
uacaugugcuauuuguuuugua

SEQ ID NO: 172752 - RNA, 22 nt, Human
uaucagaacacagccacagcca

SEQ ID NO: 172753 - RNA, 22 nt, Human
agacaacaucacuaaagcugag

SEQ ID NO: 172754 - RNA, 22 nt, Human
uuccaggaacagaugaagguug

SEQ ID NO: 172755 - RNA, 22 nt, Human
auuucucaguuccuacuguuua

SEQ ID NO: 172756 - RNA, 22 nt, Human
gggcagguacuggguggugagc

SEQ ID NO: 172757 - RNA, 22 nt, Human
ccagggcacuuaggcccagccc

SEQ ID NO: 172758 - RNA, 20 nt, Human
ccagagaguagguuagugau

SEQ ID NO: 172759 - RNA, 22 nt, Human
augaauaaaacauuuuaaucag

SEQ ID NO: 172760 - RNA, 16 nt, Human
ucaggugugacuuuuu

SEQ ID NO: 172761 - RNA, 21 nt, Human
cauuucaaagagcuggaaauc

SEQ ID NO: 172762 - RNA, 22 nt, Human
ucaaaggcgguccaggaauaaa

SEQ ID NO: 172763 - RNA, 22 nt, Human
gggugacauuaggaagauagac

SEQ ID NO: 172764 - RNA, 22 nt, Human
acauguguauagccuguauaga

SEQ ID NO: 172765 - RNA, 22 nt, Human
uucuggauaugggagagggagc

SEQ ID NO: 172766 - RNA, 22 nt, Human
agagggcuuugauucucaguuc

SEQ ID NO: 172767 - RNA, 22 nt, Human
agucacccuccaacucuccacu

SEQ ID NO: 172768 - RNA, 22 nt, Human
uguucaaaugaucuucuuaaau

SEQ ID NO: 172769 - RNA, 22 nt, Human
ggaccugcucucccaguucucu

SEQ ID NO: 172770 - RNA, 22 nt, Human
ucuuaguuguuugcugucuaac

SEQ ID NO: 172771 - RNA, 22 nt, Human
uaaagcuguuagaguaguaaga

SEQ ID NO: 172772 - RNA, 22 nt, Human
cgucacuucuuagucuauuuuc

SEQ ID NO: 172773 - RNA, 22 nt, Human
cagugggacaugggcacugggc

SEQ ID NO: 172774 - RNA, 22 nt, Human
aaaagcaguuuauagucaguug

SEQ ID NO: 172775 - RNA, 22 nt, Human
ccuggaucuaaggaagcuggga

SEQ ID NO: 172776 - RNA, 22 nt, Human
auauacaggugguauguguaaa

SEQ ID NO: 172777 - RNA, 22 nt, Human
uauuuaaaauaagccccagugg

SEQ ID NO: 172778 - RNA, 22 nt, Human
gugaacuauuggguaucauaaa

SEQ ID NO: 172779 - RNA, 22 nt, Human
augcuuuagugucaaguuuggg

SEQ ID NO: 172780 - RNA, 22 nt, Human
acagaaauaacuuuuuauguuu

SEQ ID NO: 172781 - RNA, 22 nt, Human
cagggcaguaccgcccucuggc

SEQ ID NO: 172782 - RNA, 22 nt, Human
agugugagggguucuuugauau

SEQ ID NO: 172783 - RNA, 19 nt, Human
guccaguguuuuccaguca

SEQ ID NO: 172784 - RNA, 22 nt, Human
aggcugagcuggcccuugaaau

SEQ ID NO: 172785 - RNA, 22 nt, Human
cucccuucaggagaggcucaca

SEQ ID NO: 172786 - RNA, 22 nt, Human
auaugagagaggaaagauuuua

SEQ ID NO: 172787 - RNA, 22 nt, Human
auacaacagaaaaugauuauuc

SEQ ID NO: 172788 - RNA, 22 nt, Human
uuccaaacugccaauucagaag

SEQ ID NO: 172789 - RNA, 22 nt, Human
agugugagugcucauguccauc

SEQ ID NO: 172790 - RNA, 22 nt, Human
cuuaaagaugucaaggcuguuu

SEQ ID NO: 172791 - RNA, 22 nt, Human
caauuucaaugaggccacaggg

SEQ ID NO: 172792 - RNA, 22 nt, Human
caaauacuggguaaguuaauuu

SEQ ID NO: 172793 - RNA, 22 nt, Human
aaacaucaauugcaucucccaa

SEQ ID NO: 172794 - RNA, 22 nt, Human
cugcaggguuuuucaaggacaa

SEQ ID NO: 172795 - RNA, 22 nt, Human
ucagaauuagagcucuucuuga

SEQ ID NO: 172796 - RNA, 22 nt, Human
auuuggcaacauuaauugaauc

SEQ ID NO: 172797 - RNA, 22 nt, Human
aauguuguuuuucugcaugucu

SEQ ID NO: 172798 - RNA, 15 nt, Human
gcauguguaauaggc

SEQ ID NO: 172799 - RNA, 22 nt, Human
aagcuguucucuaaguuucaug

SEQ ID NO: 172800 - RNA, 22 nt, Human
gagcugcagcggcugacgcaac

SEQ ID NO: 172801 - RNA, 22 nt, Human
gcagacagaagcuaaguagaca

SEQ ID NO: 172802 - RNA, 22 nt, Human
auugguauguauucugaaaacu

SEQ ID NO: 172803 - RNA, 22 nt, Human
cagauuuagaguggggcuugga

SEQ ID NO: 172804 - RNA, 22 nt, Human
uaggugucuguccugggcugug

SEQ ID NO: 172805 - RNA, 22 nt, Human
gauagaaagagugguucuuuuu

SEQ ID NO: 172806 - RNA, 22 nt, Human
ucaaaauuagugaccaaaggca

SEQ ID NO: 172807 - RNA, 22 nt, Human
ucauguguguuucauguaugga

SEQ ID NO: 172808 - RNA, 22 nt, Human
ggucaaagugaggagucagguu

SEQ ID NO: 172809 - RNA, 22 nt, Human
uuucuauugaucuaauaaacau

SEQ ID NO: 172810 - RNA, 22 nt, Human
augagagguuucgucagaggaa

SEQ ID NO: 172811 - RNA, 22 nt, Human
ugaauagauuuuuaacauauaa

SEQ ID NO: 172812 - RNA, 22 nt, Human
uuuauuguguugaaacugaauu

SEQ ID NO: 172813 - RNA, 22 nt, Human
aaucagaacgcucgaucuucgg

SEQ ID NO: 172814 - RNA, 22 nt, Human
caaauucagaaaauugguagag

SEQ ID NO: 172815 - RNA, 22 nt, Human
ugcuggguggacuuggcucuca

SEQ ID NO: 172816 - RNA, 22 nt, Human
uuuagggaaauugaggguuaag

SEQ ID NO: 172817 - RNA, 22 nt, Human
ugcugagggagggguuuuccag

SEQ ID NO: 172818 - RNA, 22 nt, Human
cacaaugugguuugucaucuuu

SEQ ID NO: 172819 - RNA, 20 nt, Human
agaagucagcucagaaguga

SEQ ID NO: 172820 - RNA, 19 nt, Human
uccauaaugaagauagagg

SEQ ID NO: 172821 - RNA, 22 nt, Human
acauguaacauauauguagcau

SEQ ID NO: 172822 - RNA, 22 nt, Human
agcuuuaugggagcuuagauaa

SEQ ID NO: 172823 - RNA, 22 nt, Human
uggcagguggagacagcagagc

SEQ ID NO: 172824 - RNA, 22 nt, Human
ugggcuccaauuuguccuuuca

SEQ ID NO: 172825 - RNA, 19 nt, Human
gcaggcaguggcauucgga

SEQ ID NO: 172826 - RNA, 22 nt, Human
caaaaacugcaauuacuuuuac

SEQ ID NO: 172827 - RNA, 22 nt, Human
uugaaucucuugaaucucuguu

SEQ ID NO: 172828 - RNA, 22 nt, Human
gcaggcagucaucuuucauauu

SEQ ID NO: 172829 - RNA, 22 nt, Human
cuuucuuuguccaccaacaaug

SEQ ID NO: 172830 - RNA, 22 nt, Human
cccagcuugcgggcggcaggag

SEQ ID NO: 172831 - RNA, 22 nt, Human
ucagggcacugucaccugauau

SEQ ID NO: 172832 - RNA, 22 nt, Human
uauuccuauuucuaaacauaug

SEQ ID NO: 172833 - RNA, 22 nt, Human
cagagacuggagugcaguggcg

SEQ ID NO: 172834 - RNA, 22 nt, Human
ccagcuuuaucaagucugagcu

SEQ ID NO: 172835 - RNA, 22 nt, Human
caugaaggaccauuucacgguc

SEQ ID NO: 172836 - RNA, 22 nt, Human
uacagauauuguacaguuauag

SEQ ID NO: 172837 - RNA, 22 nt, Human
uguacaaugccgagacuaacuc

SEQ ID NO: 172838 - RNA, 23 nt, Human
caggacaugggaggaaguauggc

SEQ ID NO: 172839 - RNA, 22 nt, Human
auccuucuccaaaacuggcucc

SEQ ID NO: 172840 - RNA, 22 nt, Human
cuucuucaguugcauguauugg

SEQ ID NO: 172841 - RNA, 22 nt, Human
gugcaguggcagauccuagcuc

SEQ ID NO: 172842 - RNA, 22 nt, Human
aauacaguagguaauaguucau

SEQ ID NO: 172843 - RNA, 22 nt, Human
acaaguaccaaaugcucaagua

SEQ ID NO: 172844 - RNA, 22 nt, Human
uggaauguaaacucugugaggg

SEQ ID NO: 172845 - RNA, 22 nt, Human
uuaagacaguguauuuguuuuc

SEQ ID NO: 172846 - RNA, 21 nt, Human
ucugggugcuaguguuugcuu

SEQ ID NO: 172847 - RNA, 22 nt, Human
aaggugucaaacuagaagaugu

SEQ ID NO: 172848 - RNA, 22 nt, Human
uccugcaguuacaucccagcca

SEQ ID NO: 172849 - RNA, 22 nt, Human
augcuucagugcuaccuucaaa

SEQ ID NO: 172850 - RNA, 22 nt, Human
uacaagaaauuucugcauauau

SEQ ID NO: 172851 - RNA, 22 nt, Human
ucuaaacacuaagucuugaugc

SEQ ID NO: 172852 - RNA, 22 nt, Human
guagggacuuguuuuacuagua

SEQ ID NO: 172853 - RNA, 22 nt, Human
cuguucacacacuuguacucuc

SEQ ID NO: 172854 - RNA, 22 nt, Human
uuuccaaaaguuuguucugugc

SEQ ID NO: 172855 - RNA, 22 nt, Human
ugcuguguaaaaggugauugaa

SEQ ID NO: 172856 - RNA, 22 nt, Human
uaguuuguagaaaucuagaaau

SEQ ID NO: 172857 - RNA, 22 nt, Human
uggaggcaggggauacagguca

SEQ ID NO: 172858 - RNA, 22 nt, Human
caggacauugauccauuggcac

SEQ ID NO: 172859 - RNA, 22 nt, Human
aauuuagauugauaaacaugga

SEQ ID NO: 172860 - RNA, 22 nt, Human
guagaaauuccauuuacuuuga

SEQ ID NO: 172861 - RNA, 22 nt, Human
uucugggacaucuggacaguuu

SEQ ID NO: 172862 - RNA, 22 nt, Human
guacagaaauggggccccaggu

SEQ ID NO: 172863 - RNA, 22 nt, Human
agaaaucaugucuuauuucuau

SEQ ID NO: 172864 - RNA, 22 nt, Human
agacaucauguuacagauuaag

SEQ ID NO: 172865 - RNA, 21 nt, Human
ucuuuucucagcuuugugguu

SEQ ID NO: 172866 - RNA, 22 nt, Human
ugcauaaacuucucugguguga

SEQ ID NO: 172867 - RNA, 22 nt, Human
ucuuuaauucagcaugaugcgg

SEQ ID NO: 172868 - RNA, 22 nt, Human
ggaccugaacauaaaacgaggc

SEQ ID NO: 172869 - RNA, 22 nt, Human
cagguggucaggcaaggacacg

SEQ ID NO: 172870 - RNA, 22 nt, Human
cgcgguggcggccuccagcgcc

SEQ ID NO: 172871 - RNA, 22 nt, Human
ccagcuuuagguugccugccag

SEQ ID NO: 172872 - RNA, 22 nt, Human
agcagguggccuccugucuguc

SEQ ID NO: 172873 - RNA, 22 nt, Human
acaaauauuuacugaauccacu

SEQ ID NO: 172874 - RNA, 22 nt, Human
cacaugugcaguuacaugaauu

SEQ ID NO: 172875 - RNA, 22 nt, Human
uaaaacuuaacuauccagauua

SEQ ID NO: 172876 - RNA, 22 nt, Human
gccagguggcugagcagcugca

SEQ ID NO: 172877 - RNA, 22 nt, Human
auaaagucauuaugaagaucua

SEQ ID NO: 172878 - RNA, 21 nt, Human
ggguguggaaauuacauccug

SEQ ID NO: 172879 - RNA, 22 nt, Human
gcauggcugguguccugaggga

SEQ ID NO: 172880 - RNA, 22 nt, Human
aaaguccuguuaacuguuaaca

SEQ ID NO: 172881 - RNA, 22 nt, Human
uucuuguauauaaaaaucauuu

SEQ ID NO: 172882 - RNA, 22 nt, Human
guucuucaguaaaauuaaaugu

SEQ ID NO: 172883 - RNA, 22 nt, Human
uucuucaauuuuccauauacug

SEQ ID NO: 172884 - RNA, 22 nt, Human
ucagggcaggcgagcagcugcu

SEQ ID NO: 172885 - RNA, 22 nt, Human
aaggcauauauucuaaacagga

SEQ ID NO: 172886 - RNA, 22 nt, Human
auuagggaaggauuuggccuga

SEQ ID NO: 172887 - RNA, 22 nt, Human
gauaaaauucuuauuuuacccg

SEQ ID NO: 172888 - RNA, 22 nt, Human
uaaaauagcaugugcagugaaa

SEQ ID NO: 172889 - RNA, 23 nt, Human
guaggaauuuucacuuccucuug

SEQ ID NO: 172890 - RNA, 22 nt, Human
acaggugugggcugggcucuga

SEQ ID NO: 172891 - RNA, 22 nt, Human
agcagggcugcggccccaccac

SEQ ID NO: 172892 - RNA, 22 nt, Human
agggcuacugccugccuucagg

SEQ ID NO: 172893 - RNA, 22 nt, Human
cuggauguccagguagaaguuu

SEQ ID NO: 172894 - RNA, 22 nt, Human
cgcaggugaaagaggcugggca

SEQ ID NO: 172895 - RNA, 22 nt, Human
agaggaauaugggugcacuaga

SEQ ID NO: 172896 - RNA, 22 nt, Human
aucagagaccggucaagucaug

SEQ ID NO: 172897 - RNA, 22 nt, Human
uuauuagggugguuuauguucu

SEQ ID NO: 172898 - RNA, 23 nt, Human
uugcuugagcccaggaaguggag

SEQ ID NO: 172899 - RNA, 22 nt, Human
uauuuaaaaagaggccagcugg

SEQ ID NO: 172900 - RNA, 22 nt, Human
aucugcuugaaugagcaacagg

SEQ ID NO: 172901 - RNA, 22 nt, Human
cugaggcuuggaggggucuggu

SEQ ID NO: 172902 - RNA, 22 nt, Human
uuggaggauggaguuagcaucu

SEQ ID NO: 172903 - RNA, 22 nt, Human
gacagacagggguucuccugga

SEQ ID NO: 172904 - RNA, 22 nt, Human
acagacagacagagaacuauuc

SEQ ID NO: 172905 - RNA, 22 nt, Human
gugccaaaagcuauaauuuggu

SEQ ID NO: 172906 - RNA, 21 nt, Human
uuugcugaagauuuuaggcug

SEQ ID NO: 172907 - RNA, 22 nt, Human
ucagucuucccuccagugcaac

SEQ ID NO: 172908 - RNA, 18 nt, Human
agaugaaagcaaaugaca

SEQ ID NO: 172909 - RNA, 22 nt, Human
acagcaggaagcuggagggaaa

SEQ ID NO: 172910 - RNA, 22 nt, Human
ggcaggugaccuggccucccag

SEQ ID NO: 172911 - RNA, 22 nt, Human
cacagguggcuccaaguuagag

SEQ ID NO: 172912 - RNA, 21 nt, Human
cagugagguccccagccuagg

SEQ ID NO: 172913 - RNA, 18 nt, Human
ggacaucaucaggugcuu

SEQ ID NO: 172914 - RNA, 22 nt, Human
cuggguccugcucucccuaaga

SEQ ID NO: 172915 - RNA, 22 nt, Human
ucagccaggccaccuucagcuu

SEQ ID NO: 172916 - RNA, 22 nt, Human
gcuggccugggcagccugucgg

SEQ ID NO: 172917 - RNA, 22 nt, Human
uggauuuaccacagggccacag

SEQ ID NO: 172918 - RNA, 22 nt, Human
uugggcagggaaaggacaggca

SEQ ID NO: 172919 - RNA, 22 nt, Human
caagaaucaacauuauuuagug

SEQ ID NO: 172920 - RNA, 22 nt, Human
ucuggagaacuugcaagaggau

SEQ ID NO: 172921 - RNA, 22 nt, Human
uuaauuuuuauguauagugugu

SEQ ID NO: 172922 - RNA, 22 nt, Human
cagauacuguaaaauuucagua

SEQ ID NO: 172923 - RNA, 22 nt, Human
gagagcugggcuuugggugaag

SEQ ID NO: 172924 - RNA, 22 nt, Human
aaggugguuguaggcuggucug

SEQ ID NO: 172925 - RNA, 22 nt, Human
uuccuuaguugacugucuuagu

SEQ ID NO: 172926 - RNA, 22 nt, Human
cuggaggaauaauggcaucuug

SEQ ID NO: 172927 - RNA, 22 nt, Human
uuuccauguguacuggccagaa

SEQ ID NO: 172928 - RNA, 22 nt, Human
augcugaauugaugcgagggag

SEQ ID NO: 172929 - RNA, 22 nt, Human
uauauguagucagucagaguaa

SEQ ID NO: 172930 - RNA, 22 nt, Human
uuucugcauuguccucuugguu

SEQ ID NO: 172931 - RNA, 22 nt, Human
cagacagggguaaccuuccuca

SEQ ID NO: 172932 - RNA, 23 nt, Human
uugggaaauaguuaagacaugag

SEQ ID NO: 172933 - RNA, 22 nt, Human
ugauguucuguauaucauauag

SEQ ID NO: 172934 - RNA, 22 nt, Human
ucuuuauugcuacugguuuguc

SEQ ID NO: 172935 - RNA, 22 nt, Human
ccuuuaauuuacaauguuaauu

SEQ ID NO: 172936 - RNA, 22 nt, Human
uauguauagagucuuuuaaauu

SEQ ID NO: 172937 - RNA, 22 nt, Human
uagggcucugcucaucaguugu

SEQ ID NO: 172938 - RNA, 22 nt, Human
uccaggcagcccuuccugacuc

SEQ ID NO: 172939 - RNA, 22 nt, Human
aaaagucugcuuucuauuauca

SEQ ID NO: 172940 - RNA, 22 nt, Human
aagauuauuuaagacaggaacc

SEQ ID NO: 172941 - RNA, 22 nt, Human
ucuguucaucaucuggacacau

SEQ ID NO: 172942 - RNA, 19 nt, Human
ccauuguaaagaaaaaugu

SEQ ID NO: 172943 - RNA, 22 nt, Human
acagguggcagaagcauuuacu

SEQ ID NO: 172944 - RNA, 22 nt, Human
gacagacaggagcucacaggca

SEQ ID NO: 172945 - RNA, 20 nt, Human
ucccaggcuccacccuagac

SEQ ID NO: 172946 - RNA, 22 nt, Human
uagggcaguuauaacauuagug

SEQ ID NO: 172947 - RNA, 22 nt, Human
acacauuucucuuuuuguaagu

SEQ ID NO: 172948 - RNA, 22 nt, Human
gcaggugggggucggugcaucu

SEQ ID NO: 172949 - RNA, 22 nt, Human
uaauauauuucugcuaagcuca

SEQ ID NO: 172950 - RNA, 22 nt, Human
ucuggcuccugaguccaugcuc

SEQ ID NO: 172951 - RNA, 22 nt, Human
aaugaaugaaccacauauaaca

SEQ ID NO: 172952 - RNA, 22 nt, Human
agcaggugccagguguacccgc

SEQ ID NO: 172953 - RNA, 22 nt, Human
agguacaaaagaguauaugaga

SEQ ID NO: 172954 - RNA, 22 nt, Human
uucagagagaaaccagugggaa

SEQ ID NO: 172955 - RNA, 22 nt, Human
agcagggcagugcuucagcucu

SEQ ID NO: 172956 - RNA, 22 nt, Human
acuguucauauucuuagaaauu

SEQ ID NO: 172957 - RNA, 22 nt, Human
ccauguguucaauaagggaguu

SEQ ID NO: 172958 - RNA, 22 nt, Human
gccgugcgugcgcaggugcugu

SEQ ID NO: 172959 - RNA, 21 nt, Human
agaauaaugguaucauuugcu

SEQ ID NO: 172960 - RNA, 22 nt, Human
auucuucaaagagugucaaagu

SEQ ID NO: 172961 - RNA, 22 nt, Human
agauggucuucauaaguuuuaa

SEQ ID NO: 172962 - RNA, 19 nt, Human
uccugcagaccagaccugu

SEQ ID NO: 172963 - RNA, 22 nt, Human
gccuuaauuuaugucuaacaua

SEQ ID NO: 172964 - RNA, 22 nt, Human
cuguccugcaguugggggcagg

SEQ ID NO: 172965 - RNA, 22 nt, Human
auccaaacauguaccacacuaa

SEQ ID NO: 172966 - RNA, 22 nt, Human
auagcuuucuuaaauauauaaa

SEQ ID NO: 172967 - RNA, 22 nt, Human
guguccauguuguucaggguga

SEQ ID NO: 172968 - RNA, 22 nt, Human
uacagguggaucacuaguauag

SEQ ID NO: 172969 - RNA, 22 nt, Human
agaugaaagauuuuuauagaga

SEQ ID NO: 172970 - RNA, 22 nt, Human
agucugcuuccuggagaacuca

SEQ ID NO: 172971 - RNA, 21 nt, Human
caaagccaggcaacucucucc

SEQ ID NO: 172972 - RNA, 22 nt, Human
gaguccuuaauacacuggugga

SEQ ID NO: 172973 - RNA, 22 nt, Human
cucagcaacccuagaacauuug

SEQ ID NO: 172974 - RNA, 22 nt, Human
uauuucagggagaauaaauuug

SEQ ID NO: 172975 - RNA, 22 nt, Human
uuucacaacugcuuauuugaga

SEQ ID NO: 172976 - RNA, 22 nt, Human
ugggcuccuugggagcaaguga

SEQ ID NO: 172977 - RNA, 21 nt, Human
uccaaaaaggagcguccuucu

SEQ ID NO: 172978 - RNA, 22 nt, Human
ggaccugcccuggcucagaugc

SEQ ID NO: 172979 - RNA, 22 nt, Human
cauggaaugguugaaugacgaa

SEQ ID NO: 172980 - RNA, 22 nt, Human
ugguggggcuuuccuucugcuu

SEQ ID NO: 172981 - RNA, 22 nt, Human
uuccagaauugggagccuugag

SEQ ID NO: 172982 - RNA, 17 nt, Human
cacaggugugguuugag

SEQ ID NO: 172983 - RNA, 20 nt, Human
gcaggcagggaaugggggug

SEQ ID NO: 172984 - RNA, 22 nt, Human
cccugcagcauucucuaacugg

SEQ ID NO: 172985 - RNA, 17 nt, Human
ugaaacaccaagacugu

SEQ ID NO: 172986 - RNA, 21 nt, Human
ucuauucauuacaguuauuug

SEQ ID NO: 172987 - RNA, 22 nt, Human
uugauacauuuuuaggauaaac

SEQ ID NO: 172988 - RNA, 22 nt, Human
ucuuccaagguugcacacuauc

SEQ ID NO: 172989 - RNA, 22 nt, Human
agucauaugacccuucacaaac

SEQ ID NO: 172990 - RNA, 22 nt, Human
auaguuuucuaugcacuguuau

SEQ ID NO: 172991 - RNA, 23 nt, Human
uuuauauuccuaaugucuugagc

SEQ ID NO: 172992 - RNA, 22 nt, Human
aauugcuugaugacuaguaauu

SEQ ID NO: 172993 - RNA, 22 nt, Human
auugugcaaauauuaucuguag

SEQ ID NO: 172994 - RNA, 22 nt, Human
agcuuguuagaaauguagacuc

SEQ ID NO: 172995 - RNA, 22 nt, Human
gccaggcauucuagaaguagug

SEQ ID NO: 172996 - RNA, 22 nt, Human
ucagcuuucucagaggccuaac

SEQ ID NO: 172997 - RNA, 22 nt, Human
gccucaagacauuuuuaauugc

SEQ ID NO: 172998 - RNA, 22 nt, Human
gagcuuuaagggauaaaaugau

SEQ ID NO: 172999 - RNA, 22 nt, Human
agacaugucaccaauucuuacu

SEQ ID NO: 173000 - RNA, 22 nt, Human
uuuuugcuaauccccagccacu

SEQ ID NO: 173001 - RNA, 21 nt, Human
gggcuuuuuauuuagcacugu

SEQ ID NO: 173002 - RNA, 22 nt, Human
agucacaguuccuacccaguaa

SEQ ID NO: 173003 - RNA, 22 nt, Human
gagauggagucuuuuucuguca

SEQ ID NO: 173004 - RNA, 22 nt, Human
ugucaacacaccuaucucaauu

SEQ ID NO: 173005 - RNA, 22 nt, Human
gaauuucagagguaacaucauc

SEQ ID NO: 173006 - RNA, 22 nt, Human
uguauacaugucugugugcaca

SEQ ID NO: 173007 - RNA, 23 nt, Human
agcuuugugaaagcagacauggg

SEQ ID NO: 173008 - RNA, 22 nt, Human
aaccugcaguuuuuauucugag

SEQ ID NO: 173009 - RNA, 22 nt, Human
ccagagagaaauggauuugagu

SEQ ID NO: 173010 - RNA, 22 nt, Human
uguuuagcauaaagauuuucca

SEQ ID NO: 173011 - RNA, 22 nt, Human
ugguggagccuaggcuaagucu

SEQ ID NO: 173012 - RNA, 22 nt, Human
gaugagguaagaauguaacacc

SEQ ID NO: 173013 - RNA, 22 nt, Human
auguucuuguucaaaugucagu

SEQ ID NO: 173014 - RNA, 22 nt, Human
ucauagaaugaguuaaugaacu

SEQ ID NO: 173015 - RNA, 22 nt, Human
aaauuagucgguuuaggaauuu

SEQ ID NO: 173016 - RNA, 22 nt, Human
ucagacagagaaguacaaugag

SEQ ID NO: 173017 - RNA, 22 nt, Human
uaggugucuaacaauaagugua

SEQ ID NO: 173018 - RNA, 14 nt, Human
gcaggcagaccacc

SEQ ID NO: 173019 - RNA, 23 nt, Human
auguauuuaaauuucagugauga

SEQ ID NO: 173020 - RNA, 22 nt, Human
uaaagccacgcuggaaaucagg

SEQ ID NO: 173021 - RNA, 22 nt, Human
cagugagggaagaucucagcac

SEQ ID NO: 173022 - RNA, 22 nt, Human
ugggccaggucugugucagcug

SEQ ID NO: 173023 - RNA, 22 nt, Human
cuggaggaaaacaacugcagac

SEQ ID NO: 173024 - RNA, 22 nt, Human
uuaguuguaaaauggaauuugu

SEQ ID NO: 173025 - RNA, 20 nt, Human
augugucuguaaacaacucu

SEQ ID NO: 173026 - RNA, 22 nt, Human
aguuuucacacucaccaaaagg

SEQ ID NO: 173027 - RNA, 19 nt, Human
ggcauccacgaaugcagag

SEQ ID NO: 173028 - RNA, 22 nt, Human
uuugacuccagagcccauuuuu

SEQ ID NO: 173029 - RNA, 22 nt, Human
acuauacagaagaggauaggaa

SEQ ID NO: 173030 - RNA, 22 nt, Human
acuuccuuuugggaaacuguuu

SEQ ID NO: 173031 - RNA, 20 nt, Human
gacaggugcuaaagaggggc

SEQ ID NO: 173032 - RNA, 19 nt, Human
ggaagagaggaaaggugga

SEQ ID NO: 173033 - RNA, 22 nt, Human
uguugcuguaugaauaggaagg

SEQ ID NO: 173034 - RNA, 18 nt, Human
ugaaacaagaauggugca

SEQ ID NO: 173035 - RNA, 22 nt, Human
uacauguguucuguuucaaguu

SEQ ID NO: 173036 - RNA, 22 nt, Human
cgcaggugaacuguucugcagu

SEQ ID NO: 173037 - RNA, 22 nt, Human
uaauuucuaauucauuuucagu

SEQ ID NO: 173038 - RNA, 22 nt, Human
aagagcaucaaugacucgcagu

SEQ ID NO: 173039 - RNA, 22 nt, Human
ucuguucagaaauggaagugcc

SEQ ID NO: 173040 - RNA, 22 nt, Human
caguguuuguauagaauaugca

SEQ ID NO: 173041 - RNA, 20 nt, Human
ugcagguguuggagaaggua

SEQ ID NO: 173042 - RNA, 22 nt, Human
gguguccucacuauagcaaguc

SEQ ID NO: 173043 - RNA, 22 nt, Human
ccagagagggcgccaccuggag

SEQ ID NO: 173044 - RNA, 22 nt, Human
gcuuccucccugcugcucacua

SEQ ID NO: 173045 - RNA, 17 nt, Human
cccaugagcccacuccc

SEQ ID NO: 173046 - RNA, 22 nt, Human
uaaaugucuguuaacaugaaug

SEQ ID NO: 173047 - RNA, 22 nt, Human
gcaggcagccacgauucccuug

SEQ ID NO: 173048 - RNA, 22 nt, Human
cuggaugucuuggggacuccug

SEQ ID NO: 173049 - RNA, 22 nt, Human
uuccugggauuauugucaagca

SEQ ID NO: 173050 - RNA, 22 nt, Human
ugcauaauacguuuccuauaac

SEQ ID NO: 173051 - RNA, 22 nt, Human
cuguccuggccgcccuugugag

SEQ ID NO: 173052 - RNA, 22 nt, Human
gugcauuuaggucacaugaugu

SEQ ID NO: 173053 - RNA, 22 nt, Human
acagcuuuucaauucugcugag

SEQ ID NO: 173054 - RNA, 22 nt, Human
ggcauuuaucuaauauaguuua

SEQ ID NO: 173055 - RNA, 22 nt, Human
caguguuuaaucauugugaauu

SEQ ID NO: 173056 - RNA, 22 nt, Human
acuuccagugucugcugcuagc

SEQ ID NO: 173057 - RNA, 22 nt, Human
uucauacuaaaguguaagaugu

SEQ ID NO: 173058 - RNA, 21 nt, Human
ugacagguauuuaucuggaaa

SEQ ID NO: 173059 - RNA, 22 nt, Human
aggcagguagaaggaucuuuau

SEQ ID NO: 173060 - RNA, 22 nt, Human
ggucucuguugccuccaucaag

SEQ ID NO: 173061 - RNA, 22 nt, Human
aucagaaaaacauaauguuauu

SEQ ID NO: 173062 - RNA, 22 nt, Human
caguccuucauuccuccuuuga

SEQ ID NO: 173063 - RNA, 22 nt, Human
uuccuggguugugcauuguaca

SEQ ID NO: 173064 - RNA, 22 nt, Human
ugcacuuuaaaaaauggugaug

SEQ ID NO: 173065 - RNA, 22 nt, Human
guccuucaagaguccccuacug

SEQ ID NO: 173066 - RNA, 22 nt, Human
gaguccuuuucucuguccacug

SEQ ID NO: 173067 - RNA, 22 nt, Human
agggaagaaucacugggauguu

SEQ ID NO: 173068 - RNA, 22 nt, Human
aggcagguguuaccucugguuu

SEQ ID NO: 173069 - RNA, 22 nt, Human
auaaaacuuggguaugaucccu

SEQ ID NO: 173070 - RNA, 22 nt, Human
gcuucuauuauuuggagcugag

SEQ ID NO: 173071 - RNA, 22 nt, Human
ugcugccaauuucuggucuuga

SEQ ID NO: 173072 - RNA, 22 nt, Human
uugaaguuguaguucagugaag

SEQ ID NO: 173073 - RNA, 22 nt, Human
uucaugugauaaaugugugacu

SEQ ID NO: 173074 - RNA, 22 nt, Human
aaaucucaauuugaauuguagc

SEQ ID NO: 173075 - RNA, 20 nt, Human
cuguccugaucuuuucagaa

SEQ ID NO: 173076 - RNA, 19 nt, Human
uuugacuccucauuuuuau

SEQ ID NO: 173077 - RNA, 22 nt, Human
cagggcucccugcagccucugu

SEQ ID NO: 173078 - RNA, 17 nt, Human
gagccacccugugcgag

SEQ ID NO: 173079 - RNA, 21 nt, Human
uccugcaggaggccugagagg

SEQ ID NO: 173080 - RNA, 22 nt, Human
uuggaucauggaaugucugcuu

SEQ ID NO: 173081 - RNA, 22 nt, Human
accagcugcugauugcuaaaug

SEQ ID NO: 173082 - RNA, 22 nt, Human
uauugauaugcagaacugacuu

SEQ ID NO: 173083 - RNA, 22 nt, Human
cugcaaaauuguucuuugcucc

SEQ ID NO: 173084 - RNA, 22 nt, Human
caaguccuuuucuuggcucagg

SEQ ID NO: 173085 - RNA, 22 nt, Human
uuucagacaggacuucauaugu

SEQ ID NO: 173086 - RNA, 22 nt, Human
ggcaggugaguucauuaucugc

SEQ ID NO: 173087 - RNA, 21 nt, Human
agcaacucugacuagaugagg

SEQ ID NO: 173088 - RNA, 22 nt, Human
uuucuagggcucuugucuucug

SEQ ID NO: 173089 - RNA, 22 nt, Human
ccugcagggaaucgaggcagaa

SEQ ID NO: 173090 - RNA, 22 nt, Human
cacauaauacauguuccacuua

SEQ ID NO: 173091 - RNA, 22 nt, Human
aacaaagucguugccuagaaga

SEQ ID NO: 173092 - RNA, 22 nt, Human
cuuaauuuaaaauaguucaggc

SEQ ID NO: 173093 - RNA, 22 nt, Human
uggagaauuuugucaccagaca

SEQ ID NO: 173094 - RNA, 22 nt, Human
caauuucaauacaaaauacauu

SEQ ID NO: 173095 - RNA, 22 nt, Human
auucuucacauaagugcuguac

SEQ ID NO: 173096 - RNA, 22 nt, Human
ucaggaaagaguaauguauaca

SEQ ID NO: 173097 - RNA, 22 nt, Human
cucuacucuuaacacagcuagg

SEQ ID NO: 173098 - RNA, 22 nt, Human
agaucuauuagcaaacugccau

SEQ ID NO: 173099 - RNA, 17 nt, Human
acagcagggaaguguug

SEQ ID NO: 173100 - RNA, 22 nt, Human
ugugaauacagcaugugcuucu

SEQ ID NO: 173101 - RNA, 17 nt, Human
aaggaaugucagaaguu

SEQ ID NO: 173102 - RNA, 19 nt, Human
uggcucuguuucucuggag

SEQ ID NO: 173103 - RNA, 22 nt, Human
ugggcuccggcggccucaggcu

SEQ ID NO: 173104 - RNA, 22 nt, Human
uugacacaguuuucucauuaag

SEQ ID NO: 173105 - RNA, 22 nt, Human
uaguuuacuguucacuuugccc

SEQ ID NO: 173106 - RNA, 21 nt, Human
uccuuccuugagguccuuucc

SEQ ID NO: 173107 - RNA, 22 nt, Human
aaaguggucaccuucucauuuc

SEQ ID NO: 173108 - RNA, 22 nt, Human
ccacagaaaauaaagcacgauu

SEQ ID NO: 173109 - RNA, 20 nt, Human
uggccuuuaaauaguauucc

SEQ ID NO: 173110 - RNA, 22 nt, Human
ggguggcacugauaaugagacg

SEQ ID NO: 173111 - RNA, 22 nt, Human
uuauuuuaccuuccucugagcu

SEQ ID NO: 173112 - RNA, 22 nt, Human
ugcagguggacacgggagacgg

SEQ ID NO: 173113 - RNA, 22 nt, Human
cagaguguuucuuugggugggu

SEQ ID NO: 173114 - RNA, 21 nt, Human
gggugggguuccagccuuuuc

SEQ ID NO: 173115 - RNA, 23 nt, Human
uuuuccagaaucgacucuguaga

SEQ ID NO: 173116 - RNA, 22 nt, Human
ucagggcaaaagggaaaccauu

SEQ ID NO: 173117 - RNA, 20 nt, Human
ggggcagguuuuuauggcua

SEQ ID NO: 173118 - RNA, 21 nt, Human
acuguucaucuguucagaagc

SEQ ID NO: 173119 - RNA, 22 nt, Human
aggcaggcccucuggaaaggua

SEQ ID NO: 173120 - RNA, 22 nt, Human
auucuuaauugccaugcuguau

SEQ ID NO: 173121 - RNA, 22 nt, Human
uggcuggagagggucccaugag

SEQ ID NO: 173122 - RNA, 22 nt, Human
ggggugugaguagagcugggga

SEQ ID NO: 173123 - RNA, 22 nt, Human
aacaguaaagacagaauuuauc

SEQ ID NO: 173124 - RNA, 22 nt, Human
uucauauaaauggaaucagaau

SEQ ID NO: 173125 - RNA, 22 nt, Human
cugggugaauuugaaggaaagg

SEQ ID NO: 173126 - RNA, 22 nt, Human
cugcaucaguggauaugauggu

SEQ ID NO: 173127 - RNA, 22 nt, Human
ucagagaguccuggucauuugc

SEQ ID NO: 173128 - RNA, 22 nt, Human
ucagacagggcuucucaaacuu

SEQ ID NO: 173129 - RNA, 22 nt, Human
auguguuuguaccuuuaaauau

SEQ ID NO: 173130 - RNA, 22 nt, Human
uugcuguaaguaucuuucuacc

SEQ ID NO: 173131 - RNA, 22 nt, Human
uucuucuugucugcccucacau

SEQ ID NO: 173132 - RNA, 23 nt, Human
uguuuuucauucacaugggcugu

SEQ ID NO: 173133 - RNA, 22 nt, Human
aaugaaaauuggacccuagaac

SEQ ID NO: 173134 - RNA, 21 nt, Human
agguggucugcagcagcugaa

SEQ ID NO: 173135 - RNA, 22 nt, Human
uauagacaagcguaacaagaag

SEQ ID NO: 173136 - RNA, 22 nt, Human
caaauagugucacauugugagg

SEQ ID NO: 173137 - RNA, 22 nt, Human
cagaaucagcccuugcuauuaa

SEQ ID NO: 173138 - RNA, 22 nt, Human
cagauaaaggcuuacuaguagu

SEQ ID NO: 173139 - RNA, 22 nt, Human
uuauucagucugucuagggagu

SEQ ID NO: 173140 - RNA, 22 nt, Human
uucugggugcaacucuguucug

SEQ ID NO: 173141 - RNA, 22 nt, Human
aguaccaugcuuccugacuggu

SEQ ID NO: 173142 - RNA, 22 nt, Human
cuguccuggagggcauaggacg

SEQ ID NO: 173143 - RNA, 22 nt, Human
caacuuugugugaccuagauag

SEQ ID NO: 173144 - RNA, 22 nt, Human
uuggaggaaauugcuuuugugg

SEQ ID NO: 173145 - RNA, 22 nt, Human
agauggucugguuauuuuuagu

SEQ ID NO: 173146 - RNA, 22 nt, Human
aaucuucauuuugacaagauuc

SEQ ID NO: 173147 - RNA, 22 nt, Human
uguucagagacagaaauucuaa

SEQ ID NO: 173148 - RNA, 18 nt, Human
ugaccugcgcuucacggu

SEQ ID NO: 173149 - RNA, 22 nt, Human
uucugugauugacauguggcuu

SEQ ID NO: 173150 - RNA, 22 nt, Human
ggacauuugcaccuaccucagc

SEQ ID NO: 173151 - RNA, 22 nt, Human
uggcaggguggcaacuuuuggu

SEQ ID NO: 173152 - RNA, 22 nt, Human
auguaacacccacuuuuauagc

SEQ ID NO: 173153 - RNA, 22 nt, Human
uacauguauguguacgugcaug

SEQ ID NO: 173154 - RNA, 22 nt, Human
cucuucuugcuagacugagugc

SEQ ID NO: 173155 - RNA, 22 nt, Human
aagaacuuccuaauauauuuuc

SEQ ID NO: 173156 - RNA, 19 nt, Human
guucaaacacugauucagc

SEQ ID NO: 173157 - RNA, 17 nt, Human
gaauuucuuggucaaaa

SEQ ID NO: 173158 - RNA, 22 nt, Human
ugucccuggagcuucugucccc

SEQ ID NO: 173159 - RNA, 22 nt, Human
gguguccuacagggccgcaggc

SEQ ID NO: 173160 - RNA, 20 nt, Human
gagggcaggcacccauuuca

SEQ ID NO: 173161 - RNA, 22 nt, Human
cagaggcugccagccaugugca

SEQ ID NO: 173162 - RNA, 22 nt, Human
cuccuucuccucgggaggccag

SEQ ID NO: 173163 - RNA, 23 nt, Human
uuaagacuggcugaacuuaguag

SEQ ID NO: 173164 - RNA, 18 nt, Human
gaaagccaugcagcagug

SEQ ID NO: 173165 - RNA, 22 nt, Human
ucuuaaaccacaaaauucagag

SEQ ID NO: 173166 - RNA, 22 nt, Human
augcuuuaaacuauaaauccac

SEQ ID NO: 173167 - RNA, 17 nt, Human
ggcaggugcggggccgc

SEQ ID NO: 173168 - RNA, 22 nt, Human
gaagccucaacaucucugcguc

SEQ ID NO: 173169 - RNA, 21 nt, Human
agcuuacauuaccauuguugc

SEQ ID NO: 173170 - RNA, 22 nt, Human
uaaucugaagaaacaggacuug

SEQ ID NO: 173171 - RNA, 22 nt, Human
acuguucacuagugaggguuga

SEQ ID NO: 173172 - RNA, 22 nt, Human
caggaaagaaaugagaacacca

SEQ ID NO: 173173 - RNA, 22 nt, Human
cagcuuauucaguaagcacaua

SEQ ID NO: 173174 - RNA, 22 nt, Human
cagggccagcgcccaggcccag

SEQ ID NO: 173175 - RNA, 22 nt, Human
aaugggauaauuguucauggga

SEQ ID NO: 173176 - RNA, 22 nt, Human
gcaggcaguuauuuaguagaau

SEQ ID NO: 173177 - RNA, 20 nt, Human
uccaggcagacagcuauggg

SEQ ID NO: 173178 - RNA, 22 nt, Human
gggaccugcgccacucacuguc

SEQ ID NO: 173179 - RNA, 22 nt, Human
aaguguauauaugacuuauaaa

SEQ ID NO: 173180 - RNA, 22 nt, Human
cuugaaucuucugaguauuugc

SEQ ID NO: 173181 - RNA, 22 nt, Human
gcagguguggguggcugccagg

SEQ ID NO: 173182 - RNA, 22 nt, Human
uccuguuuaucugugugacucg

SEQ ID NO: 173183 - RNA, 22 nt, Human
cugcaaaaguaauugcagguuu

SEQ ID NO: 173184 - RNA, 22 nt, Human
aggauuuauuccagaaaugcaa

SEQ ID NO: 173185 - RNA, 22 nt, Human
acagccaggaggaacucaguga

SEQ ID NO: 173186 - RNA, 22 nt, Human
acugugagugauuuccuucugg

SEQ ID NO: 173187 - RNA, 22 nt, Human
aggaggaaaaaggccacagcaa

SEQ ID NO: 173188 - RNA, 22 nt, Human
ccaggugucuguggccagcccu

SEQ ID NO: 173189 - RNA, 22 nt, Human
uucauaguguuuccuuccagug

SEQ ID NO: 173190 - RNA, 22 nt, Human
ucuucacaggagccugccugcc

SEQ ID NO: 173191 - RNA, 22 nt, Human
cuggguguucacccgaggcgcu

SEQ ID NO: 173192 - RNA, 22 nt, Human
gauugcugugcgccccaggugu

SEQ ID NO: 173193 - RNA, 22 nt, Human
uuugcaaauauguguuucuauu

SEQ ID NO: 173194 - RNA, 22 nt, Human
acuguccuggagcucacacucu

SEQ ID NO: 173195 - RNA, 22 nt, Human
aaguaaauaucuguuuauagca

SEQ ID NO: 173196 - RNA, 22 nt, Human
ugucuggggaacugugcaucca

SEQ ID NO: 173197 - RNA, 22 nt, Human
acuugguugaugucauaagguu

SEQ ID NO: 173198 - RNA, 18 nt, Human
cuuuaugugcagagcuuu

SEQ ID NO: 173199 - RNA, 22 nt, Human
accaugaugcauccuuaaggaa

SEQ ID NO: 173200 - RNA, 22 nt, Human
auacacauguguaugugcaugc

SEQ ID NO: 173201 - RNA, 22 nt, Human
cagcuuuagagaaaacauauuu

SEQ ID NO: 173202 - RNA, 22 nt, Human
acaacaaagacacuugaaauga

SEQ ID NO: 173203 - RNA, 22 nt, Human
cagggcaggaugcugugauuau

SEQ ID NO: 173204 - RNA, 22 nt, Human
gaaaacuaacggaaaaguuagg

SEQ ID NO: 173205 - RNA, 22 nt, Human
agaauuucaaauggaaguuuua

SEQ ID NO: 173206 - RNA, 22 nt, Human
aggcagguuuacucuuauuugg

SEQ ID NO: 173207 - RNA, 22 nt, Human
ccauggcuuuugagucucaaga

SEQ ID NO: 173208 - RNA, 22 nt, Human
ugcaguggaaagacucagacuu

SEQ ID NO: 173209 - RNA, 21 nt, Human
uuauugagacauuuguggaaa

SEQ ID NO: 173210 - RNA, 22 nt, Human
acagugugugcuuucccuuacg

SEQ ID NO: 173211 - RNA, 22 nt, Human
aaauugaaugauuaagugguga

SEQ ID NO: 173212 - RNA, 23 nt, Human
ugacagaccuucccagacaguca

SEQ ID NO: 173213 - RNA, 22 nt, Human
agccauucauugugcucucaga

SEQ ID NO: 173214 - RNA, 22 nt, Human
gcaugcaguaaaauucagcaac

SEQ ID NO: 173215 - RNA, 22 nt, Human
uacauaauugucuuuguccuca

SEQ ID NO: 173216 - RNA, 17 nt, Human
ugcuuaauuuugacugg

SEQ ID NO: 173217 - RNA, 22 nt, Human
uggcauuugggcuggcuuuucu

SEQ ID NO: 173218 - RNA, 18 nt, Human
uggcagguccagcugugg

SEQ ID NO: 173219 - RNA, 22 nt, Human
gccuaauaacuagcuguguaac

SEQ ID NO: 173220 - RNA, 22 nt, Human
gugugucccuccucuccugagu

SEQ ID NO: 173221 - RNA, 22 nt, Human
accaggcacuccugaggucuga

SEQ ID NO: 173222 - RNA, 22 nt, Human
aacauuucagcaaauaagaaca

SEQ ID NO: 173223 - RNA, 22 nt, Human
cugugucccccucagccaggug

SEQ ID NO: 173224 - RNA, 22 nt, Human
guuccaaauuuggaucuuuagg

SEQ ID NO: 173225 - RNA, 20 nt, Human
cugaagagacuggaggggca

SEQ ID NO: 173226 - RNA, 22 nt, Human
uguuucugucuguuuucuacau

SEQ ID NO: 173227 - RNA, 22 nt, Human
uuaacauacaucaugaacaaug

SEQ ID NO: 173228 - RNA, 22 nt, Human
uguccuuuacugauugcuucug

SEQ ID NO: 173229 - RNA, 20 nt, Human
uuugcgaggccaaggcgggc

SEQ ID NO: 173230 - RNA, 22 nt, Human
auucagcaaugagcuuggauuu

SEQ ID NO: 173231 - RNA, 20 nt, Human
ccuucuccagcuuguucuug

SEQ ID NO: 173232 - RNA, 22 nt, Human
aguuacagugaccauuuauuua

SEQ ID NO: 173233 - RNA, 22 nt, Human
ccacaagaugcaaacucuaaca

SEQ ID NO: 173234 - RNA, 22 nt, Human
aaagcagucacuccagugugau

SEQ ID NO: 173235 - RNA, 21 nt, Human
agccugcaauguagguaccgg

SEQ ID NO: 173236 - RNA, 22 nt, Human
uuguaaagcugauuagaaagcc

SEQ ID NO: 173237 - RNA, 22 nt, Human
gucacuuuacacuccuacuaaa

SEQ ID NO: 173238 - RNA, 22 nt, Human
ucucuucauagugacacccauc

SEQ ID NO: 173239 - RNA, 22 nt, Human
aaacuuuguucgucugaugugg

SEQ ID NO: 173240 - RNA, 22 nt, Human
cagagcauaauugacaugaggu

SEQ ID NO: 173241 - RNA, 22 nt, Human
agagggcugccucagucagcua

SEQ ID NO: 173242 - RNA, 22 nt, Human
cagaacagacuuaacagggcug

SEQ ID NO: 173243 - RNA, 22 nt, Human
gagggcuccacacgggcccagc

SEQ ID NO: 173244 - RNA, 22 nt, Human
uagucaccucuuuaaauguccu

SEQ ID NO: 173245 - RNA, 22 nt, Human
ccagcuuucugggugguuucug

SEQ ID NO: 173246 - RNA, 22 nt, Human
acauuuuaauaugcuuagugug

SEQ ID NO: 173247 - RNA, 22 nt, Human
uuccuuucccucacagccucgg

SEQ ID NO: 173248 - RNA, 22 nt, Human
aacuuuguguguuuaauauggc

SEQ ID NO: 173249 - RNA, 22 nt, Human
cccaguuucaacuuuccagugg

SEQ ID NO: 173250 - RNA, 22 nt, Human
ucacagaagaugcuggauguug

SEQ ID NO: 173251 - RNA, 22 nt, Human
auuaauauacacuguuagcaug

SEQ ID NO: 173252 - RNA, 18 nt, Human
uuucacaaccuccagagg

SEQ ID NO: 173253 - RNA, 17 nt, Human
ggcaggugacagacacc

SEQ ID NO: 173254 - RNA, 21 nt, Human
auacacauacacauaaaugug

SEQ ID NO: 173255 - RNA, 22 nt, Human
ugagcauuggaucaaaugacuu

SEQ ID NO: 173256 - RNA, 21 nt, Human
gcuauacagaauggccagagg

SEQ ID NO: 173257 - RNA, 22 nt, Human
agaaggaagccaggagggugca

SEQ ID NO: 173258 - RNA, 22 nt, Human
uuuuaccugaaccacacaguau

SEQ ID NO: 173259 - RNA, 22 nt, Human
ucagaauucagagggagugggg

SEQ ID NO: 173260 - RNA, 22 nt, Human
accaggcaacugugaaugggcu

SEQ ID NO: 173261 - RNA, 22 nt, Human
ugcuggcuggagugccucugga

SEQ ID NO: 173262 - RNA, 22 nt, Human
aaggcuuuaugugaccaaaaga

SEQ ID NO: 173263 - RNA, 22 nt, Human
uauuagggaacugcaagacuaa

SEQ ID NO: 173264 - RNA, 22 nt, Human
uuaaauuuuagaaacagacucu

SEQ ID NO: 173265 - RNA, 22 nt, Human
aguguccucaggcuuuguuccu

SEQ ID NO: 173266 - RNA, 22 nt, Human
gauuguaauuuucaagagguaa

SEQ ID NO: 173267 - RNA, 22 nt, Human
ugcuggagaucauuaauguuca

SEQ ID NO: 173268 - RNA, 22 nt, Human
auguaauaggguaacauaacau

SEQ ID NO: 173269 - RNA, 22 nt, Human
aaaucaguuaagaugaggccau

SEQ ID NO: 173270 - RNA, 22 nt, Human
ugguaucguguuggcacucagu

SEQ ID NO: 173271 - RNA, 22 nt, Human
ucuguucauaguaguguauaug

SEQ ID NO: 173272 - RNA, 22 nt, Human
uugcugaugguauuaugcuagu

SEQ ID NO: 173273 - RNA, 22 nt, Human
cacccaggcagguggcugagaa

SEQ ID NO: 173274 - RNA, 22 nt, Human
caggugucggucaggcgguuuu

SEQ ID NO: 173275 - RNA, 22 nt, Human
uuccuucuccagaacuucuagg

SEQ ID NO: 173276 - RNA, 22 nt, Human
uacccagcccaugccuaccuca

SEQ ID NO: 173277 - RNA, 22 nt, Human
gagucaccuuggccgcuguccc

SEQ ID NO: 173278 - RNA, 22 nt, Human
gaggcuggcagaaaagcacagg

SEQ ID NO: 173279 - RNA, 22 nt, Human
auaugaaaagaagucaccauug

SEQ ID NO: 173280 - RNA, 22 nt, Human
ucuggcuccacaccucacugca

SEQ ID NO: 173281 - RNA, 22 nt, Human
uaguccuugcugggcacagagu

SEQ ID NO: 173282 - RNA, 22 nt, Human
gcugggucucuggguguaacaa

SEQ ID NO: 173283 - RNA, 22 nt, Human
guuuucugauuagcaaaucuga

SEQ ID NO: 173284 - RNA, 22 nt, Human
agaccuggauuccaauccuacc

SEQ ID NO: 173285 - RNA, 22 nt, Human
aaugguuugauggacaaaauga

SEQ ID NO: 173286 - RNA, 20 nt, Human
gauguguccucagcaguggu

SEQ ID NO: 173287 - RNA, 22 nt, Human
agaauuguucuguagcuuggcu

SEQ ID NO: 173288 - RNA, 22 nt, Human
cagacagggaccucgcuccaga

SEQ ID NO: 173289 - RNA, 22 nt, Human
uuacagaaagguugugggauag

SEQ ID NO: 173290 - RNA, 22 nt, Human
uugaaagacuucuccugugaaa

SEQ ID NO: 173291 - RNA, 23 nt, Human
cauuucaacgaauuuuccuucug

SEQ ID NO: 173292 - RNA, 22 nt, Human
cagggcucaggaaaucagacgu

SEQ ID NO: 173293 - RNA, 22 nt, Human
ugguggggccagacuucagcuc

SEQ ID NO: 173294 - RNA, 22 nt, Human
guccugguuuucacagaccuuu

SEQ ID NO: 173295 - RNA, 22 nt, Human
uuuccaagacuccaguucuccc

SEQ ID NO: 173296 - RNA, 22 nt, Human
uaucagaaggcacauggagucu

SEQ ID NO: 173297 - RNA, 22 nt, Human
agauuuccuaugguaauuauag

SEQ ID NO: 173298 - RNA, 22 nt, Human
gacauaauaaucugaccuagau

SEQ ID NO: 173299 - RNA, 22 nt, Human
uguuuaauaauucuaugauagu

SEQ ID NO: 173300 - RNA, 22 nt, Human
cuacauaaauauuuaugugucu

SEQ ID NO: 173301 - RNA, 22 nt, Human
gguuacauggaagaaauauaau

SEQ ID NO: 173302 - RNA, 22 nt, Human
uucagaaagguaaauggauuuc

SEQ ID NO: 173303 - RNA, 22 nt, Human
cacccagcagcacuuaagacua

SEQ ID NO: 173304 - RNA, 22 nt, Human
aaacuuuggauugugauugugc

SEQ ID NO: 173305 - RNA, 22 nt, Human
uagguggugggauaugagcauc

SEQ ID NO: 173306 - RNA, 22 nt, Human
gauuucaaagguucugcaugcc

SEQ ID NO: 173307 - RNA, 22 nt, Human
acaaauguggacauggauaaug

SEQ ID NO: 173308 - RNA, 22 nt, Human
acagaugauuuuuaugaaaaca

SEQ ID NO: 173309 - RNA, 20 nt, Human
uuucacagucccuguuuccu

SEQ ID NO: 173310 - RNA, 22 nt, Human
aauggcuggguuucauuuugua

SEQ ID NO: 173311 - RNA, 22 nt, Human
ucagggacugcagagggaagcu

SEQ ID NO: 173312 - RNA, 22 nt, Human
gauaucauaucagacaaccucu

SEQ ID NO: 173313 - RNA, 22 nt, Human
guccaaauuuuucacauguaga

SEQ ID NO: 173314 - RNA, 22 nt, Human
aaauccuaaugacaaguuuagu

SEQ ID NO: 173315 - RNA, 22 nt, Human
ggagagguguauucaguggguc

SEQ ID NO: 173316 - RNA, 22 nt, Human
uuguuucaaauauuucagaaua

SEQ ID NO: 173317 - RNA, 22 nt, Human
uaaaguuuggcagacaauaaca

SEQ ID NO: 173318 - RNA, 19 nt, Human
gcaucagagcagaaggggu

SEQ ID NO: 173319 - RNA, 22 nt, Human
cauacuuucuuuuucacgcaua

SEQ ID NO: 173320 - RNA, 22 nt, Human
auuucacaucuaucucagauuu

SEQ ID NO: 173321 - RNA, 21 nt, Human
ucauuugugaucugauuucca

SEQ ID NO: 173322 - RNA, 22 nt, Human
agucaaaugaguaaauauauaa

SEQ ID NO: 173323 - RNA, 22 nt, Human
uuauuauuccccaagucauuau

SEQ ID NO: 173324 - RNA, 22 nt, Human
uuagacaagggcuccuuaaaag

SEQ ID NO: 173325 - RNA, 22 nt, Human
ucagguguggaccgaggucaga

SEQ ID NO: 173326 - RNA, 22 nt, Human
ccuguucacgguguguuguuag

SEQ ID NO: 173327 - RNA, 22 nt, Human
cauuucaauuauuugcucuucu

SEQ ID NO: 173328 - RNA, 22 nt, Human
aguuauuucaguaacauaauag

SEQ ID NO: 173329 - RNA, 22 nt, Human
ucccugggcuucuccagacuug

SEQ ID NO: 173330 - RNA, 22 nt, Human
agguguccaauccugguuggau

SEQ ID NO: 173331 - RNA, 22 nt, Human
ggggcaggagguguucucuuuu

SEQ ID NO: 173332 - RNA, 22 nt, Human
ggagcugaaggggugggcucag

SEQ ID NO: 173333 - RNA, 22 nt, Human
uuccuucuagcccaaguauugg

SEQ ID NO: 173334 - RNA, 20 nt, Human
cguguccuuggcgggagagc

SEQ ID NO: 173335 - RNA, 22 nt, Human
uagcuuuaauaagcugcugaau

SEQ ID NO: 173336 - RNA, 22 nt, Human
ucucccucauuccugcuuccau

SEQ ID NO: 173337 - RNA, 22 nt, Human
gcagguggggcugcuaccagaa

SEQ ID NO: 173338 - RNA, 22 nt, Human
ugaucugagagcagaucaccau

SEQ ID NO: 173339 - RNA, 22 nt, Human
auuugaauggcuuaacacaacg

SEQ ID NO: 173340 - RNA, 22 nt, Human
ugcauaaagugccauaguauua

SEQ ID NO: 173341 - RNA, 22 nt, Human
gcagguggugggggagccguuc

SEQ ID NO: 173342 - RNA, 22 nt, Human
uuucagauuaucucaacuuugg

SEQ ID NO: 173343 - RNA, 22 nt, Human
aaagaaggaugggagaaauccu

SEQ ID NO: 173344 - RNA, 22 nt, Human
ucagguguuuaaggauagugau

SEQ ID NO: 173345 - RNA, 22 nt, Human
ucuuuucuccagaccugggauc

SEQ ID NO: 173346 - RNA, 22 nt, Human
aaaacauguccauacagaaacu

SEQ ID NO: 173347 - RNA, 18 nt, Human
ucauagaagugaaucaga

SEQ ID NO: 173348 - RNA, 17 nt, Human
ugguggcuggagucagg

SEQ ID NO: 173349 - RNA, 22 nt, Human
uuacauuuugggguaaggauaa

SEQ ID NO: 173350 - RNA, 22 nt, Human
cagaucaagcuguauggucaga

SEQ ID NO: 173351 - RNA, 22 nt, Human
uuuauuagugcuuguaucacug

SEQ ID NO: 173352 - RNA, 22 nt, Human
cacauaauugaacgugaugagu

SEQ ID NO: 173353 - RNA, 22 nt, Human
ugggcaggauaauaucucaugu

SEQ ID NO: 173354 - RNA, 22 nt, Human
uaguuaacucuugguaauaggu

SEQ ID NO: 173355 - RNA, 22 nt, Human
ggcaggcacugugcuaggcgcu

SEQ ID NO: 173356 - RNA, 22 nt, Human
agacaaauggaguaugagcaac

SEQ ID NO: 173357 - RNA, 22 nt, Human
gacuaugugaagugugaauagg

SEQ ID NO: 173358 - RNA, 21 nt, Human
gcaaguacuaucaucauuauc

SEQ ID NO: 173359 - RNA, 22 nt, Human
ucagccaguuuguuuauuccgg

SEQ ID NO: 173360 - RNA, 22 nt, Human
cccugcaggggaccugcagccu

SEQ ID NO: 173361 - RNA, 22 nt, Human
aaaaauugcugagaacggaauu

SEQ ID NO: 173362 - RNA, 22 nt, Human
gacaggugagaugaggaacacc

SEQ ID NO: 173363 - RNA, 22 nt, Human
accucaagugauccacucaccu

SEQ ID NO: 173364 - RNA, 22 nt, Human
ucuucuccaguucauccuacca

SEQ ID NO: 173365 - RNA, 21 nt, Human
gccugcaguuuugaagcccuu

SEQ ID NO: 173366 - RNA, 22 nt, Human
aggcagugagaaauagcaagau

SEQ ID NO: 173367 - RNA, 22 nt, Human
gccugcagauauauaggauggu

SEQ ID NO: 173368 - RNA, 22 nt, Human
cauuauugccagccauacugaa

SEQ ID NO: 173369 - RNA, 22 nt, Human
ucucugaagauauuuauuauua

SEQ ID NO: 173370 - RNA, 22 nt, Human
uuaguuauacuacugaauggag

SEQ ID NO: 173371 - RNA, 22 nt, Human
uuugcaguagacaucuuauuuu

SEQ ID NO: 173372 - RNA, 22 nt, Human
ugucccugccugcccacucugu

SEQ ID NO: 173373 - RNA, 22 nt, Human
uguguccucuuaccucugaccc

SEQ ID NO: 173374 - RNA, 22 nt, Human
acagucuacuugagcuuguaua

SEQ ID NO: 173375 - RNA, 22 nt, Human
auuacaguaacagcuacaaugc

SEQ ID NO: 173376 - RNA, 22 nt, Human
auauaauuguucugaaguguuu

SEQ ID NO: 173377 - RNA, 22 nt, Human
ggcuacuagacuuugauacuag

SEQ ID NO: 173378 - RNA, 22 nt, Human
aagcuuuaugaucucucagcua

SEQ ID NO: 173379 - RNA, 20 nt, Human
ccagcauguacacaugugga

SEQ ID NO: 173380 - RNA, 22 nt, Human
auucagcaguuccugcuucagu

SEQ ID NO: 173381 - RNA, 22 nt, Human
gcuuuauuuugugagggauuac

SEQ ID NO: 173382 - RNA, 22 nt, Human
guggaggaagggauucagacca

SEQ ID NO: 173383 - RNA, 22 nt, Human
auuccuucuuugagaauaagca

SEQ ID NO: 173384 - RNA, 22 nt, Human
uggcauuugcucccuuguguuc

SEQ ID NO: 173385 - RNA, 22 nt, Human
gauuuauugucccuguccugcu

SEQ ID NO: 173386 - RNA, 22 nt, Human
ugacaggugauugugaacuaag

SEQ ID NO: 173387 - RNA, 22 nt, Human
gcaccugcuggggcugaugaga

SEQ ID NO: 173388 - RNA, 22 nt, Human
ugacagacuacugccucuauug

SEQ ID NO: 173389 - RNA, 22 nt, Human
acagggcagagaggcaggcuug

SEQ ID NO: 173390 - RNA, 22 nt, Human
uacuaucucuucuaacuucaga

SEQ ID NO: 173391 - RNA, 22 nt, Human
uaauguaaacacagagacagaa

SEQ ID NO: 173392 - RNA, 22 nt, Human
uuauucugcacuuuuaaaauau

SEQ ID NO: 173393 - RNA, 22 nt, Human
gaaugaauucagcacauggaau

SEQ ID NO: 173394 - RNA, 22 nt, Human
ugacagacagcuucucauuuua

SEQ ID NO: 173395 - RNA, 22 nt, Human
cuuucccuuagccccauucuau

SEQ ID NO: 173396 - RNA, 22 nt, Human
augguuuacugaucuuuuuggu

SEQ ID NO: 173397 - RNA, 22 nt, Human
cauuuacauuuaagguuaauau

SEQ ID NO: 173398 - RNA, 22 nt, Human
cuucucccugggggcucuuuau

SEQ ID NO: 173399 - RNA, 19 nt, Human
gcagagugggguggagggu

SEQ ID NO: 173400 - RNA, 22 nt, Human
ugcuggaggauuaaacaaguca

SEQ ID NO: 173401 - RNA, 22 nt, Human
aguccuuugggaaaaaugacua

SEQ ID NO: 173402 - RNA, 22 nt, Human
ccagggcagccaacccagaugc

SEQ ID NO: 173403 - RNA, 22 nt, Human
uuugaauaaucacugggcauua

SEQ ID NO: 173404 - RNA, 22 nt, Human
gcaggugucuucauggaacucu

SEQ ID NO: 173405 - RNA, 22 nt, Human
gagggcucugucuggaagggaa

SEQ ID NO: 173406 - RNA, 23 nt, Human
cccugcagucagggugagauggu

SEQ ID NO: 173407 - RNA, 22 nt, Human
acugaagaacgcaucagugguu

SEQ ID NO: 173408 - RNA, 21 nt, Human
ucagguggcagaguguuuaug

SEQ ID NO: 173409 - RNA, 22 nt, Human
gcuuuaaugcuucguggggcca

SEQ ID NO: 173410 - RNA, 22 nt, Human
uuccaggaaaacaguuggaagu

SEQ ID NO: 173411 - RNA, 22 nt, Human
cagugagggcccccuuccaggu

SEQ ID NO: 173412 - RNA, 22 nt, Human
gguguccuugcagaaggcggcg

SEQ ID NO: 173413 - RNA, 22 nt, Human
acagcuuuuaugggaccagcca

SEQ ID NO: 173414 - RNA, 22 nt, Human
uggcaaaguaauuggguuucuc

SEQ ID NO: 173415 - RNA, 22 nt, Human
gaaugaaagauuugcauucuau

SEQ ID NO: 173416 - RNA, 21 nt, Human
aagugguuuagguuaccgggg

SEQ ID NO: 173417 - RNA, 22 nt, Human
ugcagggaauccagucuagggu

SEQ ID NO: 173418 - RNA, 22 nt, Human
aaagugguuuuucagacuuuga

SEQ ID NO: 173419 - RNA, 22 nt, Human
auauugagauaagaacugacau

SEQ ID NO: 173420 - RNA, 22 nt, Human
uaaguccuagcuuugguaggaa

SEQ ID NO: 173421 - RNA, 22 nt, Human
ucuuagcacagcuauauaaguu

SEQ ID NO: 173422 - RNA, 22 nt, Human
ucaggugggcguuccggugcgg

SEQ ID NO: 173423 - RNA, 22 nt, Human
uugcugggcucuucaacacaca

SEQ ID NO: 173424 - RNA, 22 nt, Human
gggugggaucuguggagccuca

SEQ ID NO: 173425 - RNA, 22 nt, Human
gcuuuuggccagauggggaaac

SEQ ID NO: 173426 - RNA, 22 nt, Human
uuugcaauuugugcugcaaaug

SEQ ID NO: 173427 - RNA, 22 nt, Human
ggaccugccagaacucaggcua

SEQ ID NO: 173428 - RNA, 20 nt, Human
uugaagaggauauaucgcuc

SEQ ID NO: 173429 - RNA, 22 nt, Human
acagaaagauaggcacaagguc

SEQ ID NO: 173430 - RNA, 22 nt, Human
acuggaggggaaaaugguagua

SEQ ID NO: 173431 - RNA, 22 nt, Human
uuuaggcagaagcccugcugau

SEQ ID NO: 173432 - RNA, 22 nt, Human
aagagcauauuaauaguggaga

SEQ ID NO: 173433 - RNA, 22 nt, Human
uguccuuuaugaaaugguguuu

SEQ ID NO: 173434 - RNA, 22 nt, Human
cuaaaauuaucaagauaauucc

SEQ ID NO: 173435 - RNA, 22 nt, Human
cugcaggggcuggaguuggcuu

SEQ ID NO: 173436 - RNA, 22 nt, Human
uuuauugacccaaagcgagagu

SEQ ID NO: 173437 - RNA, 22 nt, Human
gaauuucagggucugguaggaa

SEQ ID NO: 173438 - RNA, 22 nt, Human
auucacuggcagacagaacuca

SEQ ID NO: 173439 - RNA, 22 nt, Human
cucagcaagauuaagcagcuug

SEQ ID NO: 173440 - RNA, 22 nt, Human
cagaucuagagcuuuuccaucu

SEQ ID NO: 173441 - RNA, 22 nt, Human
uaacaauaguguuugcuaguca

SEQ ID NO: 173442 - RNA, 22 nt, Human
cauuuguaguaucuguuuauau

SEQ ID NO: 173443 - RNA, 22 nt, Human
ucaggagcugcacugggcccac

SEQ ID NO: 173444 - RNA, 22 nt, Human
aggcaacuguuugauaauguug

SEQ ID NO: 173445 - RNA, 22 nt, Human
gccaggcauguccucugcagaa

SEQ ID NO: 173446 - RNA, 22 nt, Human
acaugcauaggagaagucuuua

SEQ ID NO: 173447 - RNA, 22 nt, Human
ucaucaguuuagaaaaaauaug

SEQ ID NO: 173448 - RNA, 22 nt, Human
ucagaauucuacaauagaucag

SEQ ID NO: 173449 - RNA, 21 nt, Human
cagcuucuucugugaccuggu

SEQ ID NO: 173450 - RNA, 22 nt, Human
aucuaacagcaacaccagaaua

SEQ ID NO: 173451 - RNA, 22 nt, Human
auuaaacugagcaaauuaacau

SEQ ID NO: 173452 - RNA, 22 nt, Human
uauaauuuaucaugucacaguu

SEQ ID NO: 173453 - RNA, 22 nt, Human
acuguacugaaaaguaagcaag

SEQ ID NO: 173454 - RNA, 22 nt, Human
aguaaaauuaauggaucagaag

SEQ ID NO: 173455 - RNA, 22 nt, Human
cuguucauggaaaaauaguugg

SEQ ID NO: 173456 - RNA, 22 nt, Human
aaucaagaaaaugaggauucuu

SEQ ID NO: 173457 - RNA, 18 nt, Human
ucccuucucccuugccuc

SEQ ID NO: 173458 - RNA, 20 nt, Human
aggguggcaaguuagugaca

SEQ ID NO: 173459 - RNA, 22 nt, Human
aagcagacagagaauggguuug

SEQ ID NO: 173460 - RNA, 22 nt, Human
cagggcucaucugugugaccag

SEQ ID NO: 173461 - RNA, 22 nt, Human
aauucuugguccuaguguauaa

SEQ ID NO: 173462 - RNA, 22 nt, Human
auuuauuaugggauuuggcaca

SEQ ID NO: 173463 - RNA, 22 nt, Human
cuggaggcaguugccccaguca

SEQ ID NO: 173464 - RNA, 22 nt, Human
acuuucaugcucugagcacugg

SEQ ID NO: 173465 - RNA, 22 nt, Human
ugcaaaaagagcgaggagcccu

SEQ ID NO: 173466 - RNA, 22 nt, Human
ggcaggcaguguggugugaaac

SEQ ID NO: 173467 - RNA, 22 nt, Human
ugcuuuaaauaugaauuagcau

SEQ ID NO: 173468 - RNA, 22 nt, Human
uaucagaaacucuggggcaggg

SEQ ID NO: 173469 - RNA, 22 nt, Human
uuucacauguggaaugccaggu

SEQ ID NO: 173470 - RNA, 22 nt, Human
ucucaguguguuuucucucaga

SEQ ID NO: 173471 - RNA, 21 nt, Human
aggaggaacccguggcugggc

SEQ ID NO: 173472 - RNA, 22 nt, Human
ucagggcaaagggcagaguuug

SEQ ID NO: 173473 - RNA, 22 nt, Human
ucuuucaaugagcauucuuucc

SEQ ID NO: 173474 - RNA, 21 nt, Human
agaagcuagucacuaaaucca

SEQ ID NO: 173475 - RNA, 22 nt, Human
cucuaauccuuugucccugggu

SEQ ID NO: 173476 - RNA, 22 nt, Human
cagggcaguuugugccuaugag

SEQ ID NO: 173477 - RNA, 22 nt, Human
uacuuugaagacaauaucugga

SEQ ID NO: 173478 - RNA, 22 nt, Human
ugcauugauagaaaaacaugga

SEQ ID NO: 173479 - RNA, 22 nt, Human
ugaagaauaaaugguugagacu

SEQ ID NO: 173480 - RNA, 14 nt, Human
gcagguggaucacu

SEQ ID NO: 173481 - RNA, 22 nt, Human
ggcaggugagagcucuuugaaa

SEQ ID NO: 173482 - RNA, 22 nt, Human
guucuucaggcugugcucuaga

SEQ ID NO: 173483 - RNA, 22 nt, Human
uuaauuacaaaacacauagguu

SEQ ID NO: 173484 - RNA, 22 nt, Human
ucagguguauugaugucuguga

SEQ ID NO: 173485 - RNA, 22 nt, Human
caggauggagggagggcuguua

SEQ ID NO: 173486 - RNA, 22 nt, Human
ugcagggcccucauuccugucc

SEQ ID NO: 173487 - RNA, 22 nt, Human
ucugggaacugagcuccccuag

SEQ ID NO: 173488 - RNA, 21 nt, Human
aagagcuggaucaaggauaag

SEQ ID NO: 173489 - RNA, 22 nt, Human
aucuuguuaaaaugcagaaacu

SEQ ID NO: 173490 - RNA, 22 nt, Human
uacagagauacucuagaucaaa

SEQ ID NO: 173491 - RNA, 22 nt, Human
cauuuauucaugaucuguagcu

SEQ ID NO: 173492 - RNA, 22 nt, Human
uaucacaucaauguuuuaaaau

SEQ ID NO: 173493 - RNA, 23 nt, Human
agagcaucaugaugcuaagucug

SEQ ID NO: 173494 - RNA, 22 nt, Human
uuucuacagcuggugcaacuuu

SEQ ID NO: 173495 - RNA, 22 nt, Human
cauguuaaaauauacauucuga

SEQ ID NO: 173496 - RNA, 22 nt, Human
uuaagucaauaucaaucucagc

SEQ ID NO: 173497 - RNA, 22 nt, Human
uccuggcucugcugccuccuag

SEQ ID NO: 173498 - RNA, 20 nt, Human
uguaggaaggacccugucug

SEQ ID NO: 173499 - RNA, 22 nt, Human
uaauuauuaugacaacaauugc

SEQ ID NO: 173500 - RNA, 22 nt, Human
uuacagaaggaacacuacucag

SEQ ID NO: 173501 - RNA, 22 nt, Human
ggcaggcaagucugcucuguga

SEQ ID NO: 173502 - RNA, 22 nt, Human
ucuuuaauguacuuucuuucac

SEQ ID NO: 173503 - RNA, 22 nt, Human
cccaggcaucccauuaaggagc

SEQ ID NO: 173504 - RNA, 22 nt, Human
caugcaggaggaaaaagcagcu

SEQ ID NO: 173505 - RNA, 22 nt, Human
cagggcucuuccggagcaggga

SEQ ID NO: 173506 - RNA, 22 nt, Human
aucauguguaauuucaagcuac

SEQ ID NO: 173507 - RNA, 22 nt, Human
uuugaacaggaguaucuauagu

SEQ ID NO: 173508 - RNA, 22 nt, Human
auguuauuaaaguacagauucu

SEQ ID NO: 173509 - RNA, 22 nt, Human
caggauggucuucauuuggcuc

SEQ ID NO: 173510 - RNA, 22 nt, Human
agaagugagugugacucagcag

SEQ ID NO: 173511 - RNA, 22 nt, Human
gggaacagagugccagacugac

SEQ ID NO: 173512 - RNA, 22 nt, Human
ccuguucauuuguauuugucuu

SEQ ID NO: 173513 - RNA, 22 nt, Human
uuccuuaguguuagauucugug

SEQ ID NO: 173514 - RNA, 22 nt, Human
uuugacucuugcccaguuuggc

SEQ ID NO: 173515 - RNA, 22 nt, Human
aagugcuguuucugaugaaugc

SEQ ID NO: 173516 - RNA, 22 nt, Human
gguggggcuaggaccucaggau

SEQ ID NO: 173517 - RNA, 22 nt, Human
ggcaggugaggcaugugccugg

SEQ ID NO: 173518 - RNA, 22 nt, Human
aauuuacaggugcacucgccau

SEQ ID NO: 173519 - RNA, 22 nt, Human
gaauugcuaauccaagugacug

SEQ ID NO: 173520 - RNA, 22 nt, Human
caguauuuauggcuugaguauu

SEQ ID NO: 173521 - RNA, 22 nt, Human
uuaaugauaccuauguuaauuu

SEQ ID NO: 173522 - RNA, 22 nt, Human
ccagacaggaacacacaucucc

SEQ ID NO: 173523 - RNA, 22 nt, Human
gaagaaucugaggacagucauu

SEQ ID NO: 173524 - RNA, 22 nt, Human
ugucagagcaaggccaggccag

SEQ ID NO: 173525 - RNA, 18 nt, Human
aucuuuccauagcauguu

SEQ ID NO: 173526 - RNA, 22 nt, Human
uuuguacauauauaaaaucugu

SEQ ID NO: 173527 - RNA, 22 nt, Human
uauaaaugcacuuuugaaauau

SEQ ID NO: 173528 - RNA, 21 nt, Human
ugaaagaaggugcagucugaa

SEQ ID NO: 173529 - RNA, 20 nt, Human
ccagguggugccuggagagg

SEQ ID NO: 173530 - RNA, 22 nt, Human
ugcuuuauggauuuguguccug

SEQ ID NO: 173531 - RNA, 22 nt, Human
uccaggcaaaaaccaacuacag

SEQ ID NO: 173532 - RNA, 22 nt, Human
guucuucacauuucauugagga

SEQ ID NO: 173533 - RNA, 22 nt, Human
cugcccucgggcccucccauag

SEQ ID NO: 173534 - RNA, 22 nt, Human
uucauucuuauuugugaucugg

SEQ ID NO: 173535 - RNA, 22 nt, Human
ugcugauuuugccuacugaucc

SEQ ID NO: 173536 - RNA, 22 nt, Human
uuugacucccaaacugugauuu

SEQ ID NO: 173537 - RNA, 22 nt, Human
acugcacuucacccugggugac

SEQ ID NO: 173538 - RNA, 22 nt, Human
aguaaacauuuucauauuuucu

SEQ ID NO: 173539 - RNA, 23 nt, Human
acagggcauugcuggccucgagg

SEQ ID NO: 173540 - RNA, 22 nt, Human
gaagcacauggcugugagcaac

SEQ ID NO: 173541 - RNA, 22 nt, Human
aacagacaacuccuguggcuca

SEQ ID NO: 173542 - RNA, 22 nt, Human
cuucuuccugcugcagccucca

SEQ ID NO: 173543 - RNA, 18 nt, Human
gcacuucacccagcuagu

SEQ ID NO: 173544 - RNA, 22 nt, Human
ugaucauuaucaaacuggucau

SEQ ID NO: 173545 - RNA, 22 nt, Human
ugacuucaagguucagcaccuu

SEQ ID NO: 173546 - RNA, 22 nt, Human
uucauuccuucccuaagcaacu

SEQ ID NO: 173547 - RNA, 22 nt, Human
uucccaguuagucauuuuuaca

SEQ ID NO: 173548 - RNA, 21 nt, Human
acucaggagacuaacuauguc

SEQ ID NO: 173549 - RNA, 22 nt, Human
cccaugagaccugguuuaaggc

SEQ ID NO: 173550 - RNA, 22 nt, Human
gucugcccucacaugcacucuu

SEQ ID NO: 173551 - RNA, 22 nt, Human
ggcuuuaugcacagcagauggu

SEQ ID NO: 173552 - RNA, 22 nt, Human
gggcagggguagcauuccaagu

SEQ ID NO: 173553 - RNA, 22 nt, Human
aguuggagugaacaugagauug

SEQ ID NO: 173554 - RNA, 22 nt, Human
ggcaggcaaggcagccugguga

SEQ ID NO: 173555 - RNA, 22 nt, Human
uggauuuaauggaugaggggca

SEQ ID NO: 173556 - RNA, 22 nt, Human
ugcuggaggaguuuacuguggc

SEQ ID NO: 173557 - RNA, 22 nt, Human
cacauacuuguguguacauaug

SEQ ID NO: 173558 - RNA, 22 nt, Human
uauacagauggaaagauacaca

SEQ ID NO: 173559 - RNA, 22 nt, Human
auacacauauguguguauaugu

SEQ ID NO: 173560 - RNA, 22 nt, Human
gaaggcaucacagaggcugugg

SEQ ID NO: 173561 - RNA, 22 nt, Human
cuuccuucugaagcauagaagc

SEQ ID NO: 173562 - RNA, 22 nt, Human
aauugcuuugaagaagggagcg

SEQ ID NO: 173563 - RNA, 22 nt, Human
accuuauuuugaaauagauugu

SEQ ID NO: 173564 - RNA, 22 nt, Human
guucuuaagaccacaauaaaaa

SEQ ID NO: 173565 - RNA, 22 nt, Human
ucuuccucaugaauucucguau

SEQ ID NO: 173566 - RNA, 22 nt, Human
ucccacaggagccugaguccca

SEQ ID NO: 173567 - RNA, 22 nt, Human
uuggaggaugucggcauauuua

SEQ ID NO: 173568 - RNA, 20 nt, Human
cugcaggguuagaggcucca

SEQ ID NO: 173569 - RNA, 22 nt, Human
cauauaaauacaacauguguua

SEQ ID NO: 173570 - RNA, 22 nt, Human
acuuagauaacaaaccuguggu

SEQ ID NO: 173571 - RNA, 22 nt, Human
uuccuuucccuugcuucugugc

SEQ ID NO: 173572 - RNA, 22 nt, Human
ugcaggugacaccacucuuccu

SEQ ID NO: 173573 - RNA, 22 nt, Human
cucagcaacccacacacggucu

SEQ ID NO: 173574 - RNA, 22 nt, Human
cagaaagaccugauuggcaguu

SEQ ID NO: 173575 - RNA, 22 nt, Human
aaguccuuaggaagcagucguu

SEQ ID NO: 173576 - RNA, 22 nt, Human
agggacuugaugucagggagau

SEQ ID NO: 173577 - RNA, 22 nt, Human
augacaggaggcagcugggcag

SEQ ID NO: 173578 - RNA, 22 nt, Human
uuccuucuggaggcuccagggg

SEQ ID NO: 173579 - RNA, 22 nt, Human
ggcaggugacggggaugaguau

SEQ ID NO: 173580 - RNA, 22 nt, Human
uauugguaggacucagcugaga

SEQ ID NO: 173581 - RNA, 22 nt, Human
guuauugagacauagaguuaug

SEQ ID NO: 173582 - RNA, 22 nt, Human
ggcagggaguggagacucccua

SEQ ID NO: 173583 - RNA, 19 nt, Human
agcugcagaccagaagugc

SEQ ID NO: 173584 - RNA, 22 nt, Human
uuuaauuuguauuucuagaggg

SEQ ID NO: 173585 - RNA, 22 nt, Human
gagauuuagagagacuuaaaca

SEQ ID NO: 173586 - RNA, 22 nt, Human
aauuccaaauguuuucaaucca

SEQ ID NO: 173587 - RNA, 22 nt, Human
aauuuccagaccccauccacag

SEQ ID NO: 173588 - RNA, 22 nt, Human
cagcuugugcaaagguccuggg

SEQ ID NO: 173589 - RNA, 22 nt, Human
ucuguucagacacuuuacaugu

SEQ ID NO: 173590 - RNA, 22 nt, Human
cagcuuuaccaauauuuggaaa

SEQ ID NO: 173591 - RNA, 22 nt, Human
accugcagcugagaaaaugacu

SEQ ID NO: 173592 - RNA, 22 nt, Human
gauuuucauuugcacucuagaa

SEQ ID NO: 173593 - RNA, 22 nt, Human
cacauguguauaugugaggggg

SEQ ID NO: 173594 - RNA, 22 nt, Human
ccugggugacagagugagaccu

SEQ ID NO: 173595 - RNA, 22 nt, Human
gguccuuugccaucucuccacc

SEQ ID NO: 173596 - RNA, 22 nt, Human
aacaucuacuaagugccaggca

SEQ ID NO: 173597 - RNA, 22 nt, Human
aauuucaaguggcaucuuugau

SEQ ID NO: 173598 - RNA, 22 nt, Human
ucugucccugagagcucaggag

SEQ ID NO: 173599 - RNA, 22 nt, Human
ccagggcagcgccccuccacgc

SEQ ID NO: 173600 - RNA, 22 nt, Human
uuuccaaauaaggucacacuca

SEQ ID NO: 173601 - RNA, 22 nt, Human
aagauauagauaaaacuaugca

SEQ ID NO: 173602 - RNA, 22 nt, Human
aaucagaauuuauugaaucuuu

SEQ ID NO: 173603 - RNA, 22 nt, Human
aaaggcuggggacugaggaagg

SEQ ID NO: 173604 - RNA, 22 nt, Human
auuaguaguaguuagcagccuc

SEQ ID NO: 173605 - RNA, 22 nt, Human
caggcauaucuacauuauccaa

SEQ ID NO: 173606 - RNA, 22 nt, Human
aaagcaugauuagauagaugau

SEQ ID NO: 173607 - RNA, 22 nt, Human
ucuucuccagugcuucugcaca

SEQ ID NO: 173608 - RNA, 22 nt, Human
ugggaccugcuccuggaaugag

SEQ ID NO: 173609 - RNA, 20 nt, Human
uauuuacaacuuagagccuc

SEQ ID NO: 173610 - RNA, 22 nt, Human
uugcuuauagagaguuucauac

SEQ ID NO: 173611 - RNA, 20 nt, Human
ugcugagguugacaugccca

SEQ ID NO: 173612 - RNA, 22 nt, Human
auaaaauuugcuacuguuaaau

SEQ ID NO: 173613 - RNA, 22 nt, Human
uucagcaaauggacuguucagg

SEQ ID NO: 173614 - RNA, 22 nt, Human
uggcagguuggccuuugguuca

SEQ ID NO: 173615 - RNA, 22 nt, Human
cagggcucgcugccagcuucag

SEQ ID NO: 173616 - RNA, 22 nt, Human
cagcaaagguagaagcacagga

SEQ ID NO: 173617 - RNA, 22 nt, Human
cccagcuugcaaauggguugcu

SEQ ID NO: 173618 - RNA, 22 nt, Human
agcagggcacuggaaggcacug

SEQ ID NO: 173619 - RNA, 22 nt, Human
cuuucauucuuagauauuagug

SEQ ID NO: 173620 - RNA, 22 nt, Human
aaugcauauguaggcaagcagu

SEQ ID NO: 173621 - RNA, 22 nt, Human
uuccucucaacaugccugccgg

SEQ ID NO: 173622 - RNA, 22 nt, Human
uugcugauuuccccuugagugu

SEQ ID NO: 173623 - RNA, 22 nt, Human
agagcacggccaccauuuacaa

SEQ ID NO: 173624 - RNA, 22 nt, Human
ugggaaagacucaggacaggag

SEQ ID NO: 173625 - RNA, 22 nt, Human
cugggcugauuuagucacguuu

SEQ ID NO: 173626 - RNA, 22 nt, Human
auagauacuggguauggagaug

SEQ ID NO: 173627 - RNA, 23 nt, Human
uccuccuuuugcuugugcuuccc

SEQ ID NO: 173628 - RNA, 22 nt, Human
acagaauuugcuugggcaaugg

SEQ ID NO: 173629 - RNA, 22 nt, Human
acagcuuuaucucagggaucag

SEQ ID NO: 173630 - RNA, 22 nt, Human
ucuuccuucuuugaugacaagg

SEQ ID NO: 173631 - RNA, 22 nt, Human
caacuuuaugauugguuuguca

SEQ ID NO: 173632 - RNA, 22 nt, Human
auccuucuucugcuagugucua

SEQ ID NO: 173633 - RNA, 22 nt, Human
ugcuuaaacauacuauuuauau

SEQ ID NO: 173634 - RNA, 22 nt, Human
ugcagggcuaagucagagccug

SEQ ID NO: 173635 - RNA, 23 nt, Human
uccuuugucuuugcauagauggu

SEQ ID NO: 173636 - RNA, 22 nt, Human
aauaucaguauauuguaucagu

SEQ ID NO: 173637 - RNA, 22 nt, Human
aauuucuccaagaaugcuuaga

SEQ ID NO: 173638 - RNA, 22 nt, Human
gaugugucauuuggucaucugc

SEQ ID NO: 173639 - RNA, 23 nt, Human
uuaaacuucagugcagaacacuc

SEQ ID NO: 173640 - RNA, 22 nt, Human
uuuacagauguggaaagugagc

SEQ ID NO: 173641 - RNA, 20 nt, Human
uugcugggaccuuuuucaac

SEQ ID NO: 173642 - RNA, 22 nt, Human
ccagcuuucauaucaugaggua

SEQ ID NO: 173643 - RNA, 22 nt, Human
cuucuauucacuggucacaguu

SEQ ID NO: 173644 - RNA, 22 nt, Human
gaucuucucuuuaguagaaaca

SEQ ID NO: 173645 - RNA, 22 nt, Human
guagggacaauauguuauuaga

SEQ ID NO: 173646 - RNA, 22 nt, Human
aguggggccggugaggccgagg

SEQ ID NO: 173647 - RNA, 22 nt, Human
auccuucuaccuaggacuauuu

SEQ ID NO: 173648 - RNA, 22 nt, Human
caucagaacaaaucgguuaaga

SEQ ID NO: 173649 - RNA, 22 nt, Human
cuccagugagcgcggggcaugg

SEQ ID NO: 173650 - RNA, 22 nt, Human
acuucaugcagaagagagcugu

SEQ ID NO: 173651 - RNA, 22 nt, Human
ucuggguguagggccuggcaac

SEQ ID NO: 173652 - RNA, 22 nt, Human
aaugauuuccccuacacagaag

SEQ ID NO: 173653 - RNA, 22 nt, Human
aaggugguucgcugguacccag

SEQ ID NO: 173654 - RNA, 22 nt, Human
cacaaaugugcagaaaugugag

SEQ ID NO: 173655 - RNA, 22 nt, Human
ggguaggaugguagaagggacc

SEQ ID NO: 173656 - RNA, 20 nt, Human
uuucuggguacucucccucu

SEQ ID NO: 173657 - RNA, 22 nt, Human
gaauugcuaaccaauucaaaau

SEQ ID NO: 173658 - RNA, 22 nt, Human
aauuaugagguagauaucacau

SEQ ID NO: 173659 - RNA, 22 nt, Human
agacccucuccaugcccacugc

SEQ ID NO: 173660 - RNA, 22 nt, Human
aaauacuguagauaauagaguu

SEQ ID NO: 173661 - RNA, 22 nt, Human
cuacagaauucaacaaaugguu

SEQ ID NO: 173662 - RNA, 22 nt, Human
aucaguuaguuacugcuaagau

SEQ ID NO: 173663 - RNA, 22 nt, Human
uaguauaauuguucuggaauca

SEQ ID NO: 173664 - RNA, 22 nt, Human
uucuucuuuccuauaauuaauu

SEQ ID NO: 173665 - RNA, 22 nt, Human
gggaccuggcaccuuugcucug

SEQ ID NO: 173666 - RNA, 22 nt, Human
uguccuuacaaggucccuuucg

SEQ ID NO: 173667 - RNA, 22 nt, Human
uauuucuaagagauaucuguac

SEQ ID NO: 173668 - RNA, 22 nt, Human
auucuucauaccuacugagguu

SEQ ID NO: 173669 - RNA, 22 nt, Human
uggcucugugucucccagcagc

SEQ ID NO: 173670 - RNA, 22 nt, Human
agauggucuuuugaguaaugaa

SEQ ID NO: 173671 - RNA, 22 nt, Human
aagaaacaaccacugcucuccu

SEQ ID NO: 173672 - RNA, 22 nt, Human
uccaggaggguuuucugccuuc

SEQ ID NO: 173673 - RNA, 20 nt, Human
agguggcucuuccugggcuu

SEQ ID NO: 173674 - RNA, 20 nt, Human
ggcaggcaggagguuuccag

SEQ ID NO: 173675 - RNA, 22 nt, Human
gccugcaggcuguaguuuguga

SEQ ID NO: 173676 - RNA, 22 nt, Human
cauuguuaauugguaucuuaca

SEQ ID NO: 173677 - RNA, 22 nt, Human
gucauaaagcuuguugcauuua

SEQ ID NO: 173678 - RNA, 22 nt, Human
uuauagugggcccaacauggcg

SEQ ID NO: 173679 - RNA, 22 nt, Human
cacaggugcuccucggggagcu

SEQ ID NO: 173680 - RNA, 20 nt, Human
aggauuuacuacuaccugcu

SEQ ID NO: 173681 - RNA, 22 nt, Human
auuaaauuggacgcugggggaa

SEQ ID NO: 173682 - RNA, 17 nt, Human
uguuuucauucauugcu

SEQ ID NO: 173683 - RNA, 21 nt, Human
agaauucuuaaguauucuaau

SEQ ID NO: 173684 - RNA, 22 nt, Human
ucugauaacucuggccccaggc

SEQ ID NO: 173685 - RNA, 22 nt, Human
cucagccaugggguggaucagc

SEQ ID NO: 173686 - RNA, 22 nt, Human
cuccagauguauacuuuccaag

SEQ ID NO: 173687 - RNA, 22 nt, Human
cauuuaagagaaauauuuaguu

SEQ ID NO: 173688 - RNA, 22 nt, Human
gcuucuaucccuccacugcacu

SEQ ID NO: 173689 - RNA, 22 nt, Human
uguccuuuuccccaaauucacu

SEQ ID NO: 173690 - RNA, 22 nt, Human
ugcuuuauuggaaccucauccu

SEQ ID NO: 173691 - RNA, 22 nt, Human
uucugggagagaaagggccuug

SEQ ID NO: 173692 - RNA, 22 nt, Human
uccaaaaaacguuugaauaguu

SEQ ID NO: 173693 - RNA, 22 nt, Human
ccagggcacguugggacaguac

SEQ ID NO: 173694 - RNA, 22 nt, Human
cugcaggggccucgagcacagg

SEQ ID NO: 173695 - RNA, 22 nt, Human
agcagguguuagggauccaaug

SEQ ID NO: 173696 - RNA, 22 nt, Human
aguuuguaaguucauuaugagu

SEQ ID NO: 173697 - RNA, 22 nt, Human
uggcuuuacugucauucuuaug

SEQ ID NO: 173698 - RNA, 22 nt, Human
aauugcuuguuuucggucauaa

SEQ ID NO: 173699 - RNA, 22 nt, Human
uccuggguagccuguccaagau

SEQ ID NO: 173700 - RNA, 22 nt, Human
guuuauuggguauuguggagcc

SEQ ID NO: 173701 - RNA, 22 nt, Human
uuauuccauagaagucaaggaa

SEQ ID NO: 173702 - RNA, 22 nt, Human
uuucuuuuccaauaucccuacu

SEQ ID NO: 173703 - RNA, 22 nt, Human
ccaauacacuuuauagaagaaa

SEQ ID NO: 173704 - RNA, 22 nt, Human
ugagggagcacacacugaagug

SEQ ID NO: 173705 - RNA, 22 nt, Human
ucugcaugaugaacaaaugagc

SEQ ID NO: 173706 - RNA, 22 nt, Human
agccaacuaauuaaacaacuuu

SEQ ID NO: 173707 - RNA, 19 nt, Human
guagggacagugguucuga

SEQ ID NO: 173708 - RNA, 22 nt, Human
acaguuaaauauuucuacuggg

SEQ ID NO: 173709 - RNA, 22 nt, Human
cagacagguagggacagaacau

SEQ ID NO: 173710 - RNA, 21 nt, Human
cuggaggcagguggugccagg

SEQ ID NO: 173711 - RNA, 22 nt, Human
gccugcagacguguuuuccuca

SEQ ID NO: 173712 - RNA, 21 nt, Human
gauuugcagaaacuagacagg

SEQ ID NO: 173713 - RNA, 22 nt, Human
ggcaggugcaccugagccaucu

SEQ ID NO: 173714 - RNA, 22 nt, Human
cauggauugaauauaaauuaga

SEQ ID NO: 173715 - RNA, 22 nt, Human
gcuuccagacgaucauguaaga

SEQ ID NO: 173716 - RNA, 22 nt, Human
uaugugucucaguugugauuga

SEQ ID NO: 173717 - RNA, 22 nt, Human
uccugcagcauccgucgucugu

SEQ ID NO: 173718 - RNA, 22 nt, Human
cagagacauucaguaaauuauc

SEQ ID NO: 173719 - RNA, 22 nt, Human
aauaauuuccagccaacuggaa

SEQ ID NO: 173720 - RNA, 22 nt, Human
augagguuuugauuggcacagg

SEQ ID NO: 173721 - RNA, 22 nt, Human
uuuaagagcuaguaugucauuu

SEQ ID NO: 173722 - RNA, 17 nt, Human
uguuuucugcuaccuuu

SEQ ID NO: 173723 - RNA, 22 nt, Human
uccugcagguggaugauucucu

SEQ ID NO: 173724 - RNA, 22 nt, Human
uuauacauguuuauaagguuga

SEQ ID NO: 173725 - RNA, 22 nt, Human
acuuuguuuucaugaaacagcu

SEQ ID NO: 173726 - RNA, 22 nt, Human
uuuccuuccauguugggcaaaa

SEQ ID NO: 173727 - RNA, 22 nt, Human
gacugaaggucucagcauguga

SEQ ID NO: 173728 - RNA, 22 nt, Human
ucagcauguucuuaggucacag

SEQ ID NO: 173729 - RNA, 22 nt, Human
gcuguucagggcacucaugggc

SEQ ID NO: 173730 - RNA, 22 nt, Human
uucucagugaaguuuagaacau

SEQ ID NO: 173731 - RNA, 22 nt, Human
aaagcugccaaggagaauacua

SEQ ID NO: 173732 - RNA, 22 nt, Human
gcagggcagcuuagucccuguc

SEQ ID NO: 173733 - RNA, 22 nt, Human
cucccagguuccgacgccucuu

SEQ ID NO: 173734 - RNA, 22 nt, Human
uggcaauuuuaggugguuuagu

SEQ ID NO: 173735 - RNA, 22 nt, Human
gggucccuggaauuacuugaca

SEQ ID NO: 173736 - RNA, 22 nt, Human
gcagggcaugggcccugucugc

SEQ ID NO: 173737 - RNA, 22 nt, Human
caucagaaccaguggggacauu

SEQ ID NO: 173738 - RNA, 22 nt, Human
aauucuauguucuugaguaaga

SEQ ID NO: 173739 - RNA, 22 nt, Human
aaaguucauugaugacugaggu

SEQ ID NO: 173740 - RNA, 22 nt, Human
aggcugcagaacagucaggugc

SEQ ID NO: 173741 - RNA, 22 nt, Human
uugcuuuaacuaguaaaugggg

SEQ ID NO: 173742 - RNA, 22 nt, Human
uauugaggaucuccugcuaauu

SEQ ID NO: 173743 - RNA, 22 nt, Human
auauaggcuaacaacuauugag

SEQ ID NO: 173744 - RNA, 20 nt, Human
uugaagagucagguagggcc

SEQ ID NO: 173745 - RNA, 22 nt, Human
cuuuacagaauaagaauacugg

SEQ ID NO: 173746 - RNA, 22 nt, Human
uuuccucuuugugacacagcug

SEQ ID NO: 173747 - RNA, 22 nt, Human
ucugggaagcugguccuguucu

SEQ ID NO: 173748 - RNA, 22 nt, Human
ucacauaaauuauacaauuuca

SEQ ID NO: 173749 - RNA, 22 nt, Human
gggaccugaggagggguuucag

SEQ ID NO: 173750 - RNA, 17 nt, Human
uuauugcuauaagcuga

SEQ ID NO: 173751 - RNA, 22 nt, Human
aaagccuuugucucaggcucug

SEQ ID NO: 173752 - RNA, 22 nt, Human
cagggcacggagaagucacccc

SEQ ID NO: 173753 - RNA, 22 nt, Human
uuugaagacauauuguuacaua

SEQ ID NO: 173754 - RNA, 22 nt, Human
ccagguguuuggccugcaugau

SEQ ID NO: 173755 - RNA, 22 nt, Human
ucgcuugaacccaggaagugga

SEQ ID NO: 173756 - RNA, 22 nt, Human
acagugugaugggccugccuga

SEQ ID NO: 173757 - RNA, 22 nt, Human
gcuauacagcaggagaauggaa

SEQ ID NO: 173758 - RNA, 22 nt, Human
ugcuggcuacauuauugcuguc

SEQ ID NO: 173759 - RNA, 22 nt, Human
gugauuuagauguugaaaguga

SEQ ID NO: 173760 - RNA, 22 nt, Human
uguguccugugcaaggggauga

SEQ ID NO: 173761 - RNA, 22 nt, Human
cuguacaaguccuucaucaggg

SEQ ID NO: 173762 - RNA, 22 nt, Human
cuaaucaucuuucucuuaaagc

SEQ ID NO: 173763 - RNA, 22 nt, Human
auuugcuuaucuccacaguugu

SEQ ID NO: 173764 - RNA, 22 nt, Human
uauuaaagggaaguuaugcaug

SEQ ID NO: 173765 - RNA, 22 nt, Human
uguuuacuuaaauguuuucaua

SEQ ID NO: 173766 - RNA, 22 nt, Human
cagacaggguccuguccgucac

SEQ ID NO: 173767 - RNA, 22 nt, Human
cugaaugagggauucugagggc

SEQ ID NO: 173768 - RNA, 22 nt, Human
uccuccuuguuuuccuguuuac

SEQ ID NO: 173769 - RNA, 20 nt, Human
aagggcagagggaacagacu

SEQ ID NO: 173770 - RNA, 22 nt, Human
cagcaggauuugaaaggaagag

SEQ ID NO: 173771 - RNA, 22 nt, Human
ucuaaacaguuucacucuuaau

SEQ ID NO: 173772 - RNA, 22 nt, Human
aaugauuggcacuagauacaca

SEQ ID NO: 173773 - RNA, 22 nt, Human
ucuggcccuauggcauguaccu

SEQ ID NO: 173774 - RNA, 22 nt, Human
uaauuauuugaagacauuagag

SEQ ID NO: 173775 - RNA, 16 nt, Human
aaggaaugucauucug

SEQ ID NO: 173776 - RNA, 22 nt, Human
aggaccugcuaaugugccaagu

SEQ ID NO: 173777 - RNA, 22 nt, Human
uauucugugugauauguaaaug

SEQ ID NO: 173778 - RNA, 22 nt, Human
ccagacaggggcuguuccugcu

SEQ ID NO: 173779 - RNA, 22 nt, Human
uuucaaagucaauaucauuacc

SEQ ID NO: 173780 - RNA, 22 nt, Human
ccauggcucuagagauugaaaa

SEQ ID NO: 173781 - RNA, 22 nt, Human
aaaaaucuaugacugcuucucc

SEQ ID NO: 173782 - RNA, 22 nt, Human
uuccuuagggucagccagaucu

SEQ ID NO: 173783 - RNA, 22 nt, Human
cuguguccuuuaaaaaagacac

SEQ ID NO: 173784 - RNA, 22 nt, Human
ugaaguaacuguccaggaucca

SEQ ID NO: 173785 - RNA, 22 nt, Human
uucuuuuggacucaaagagaac

SEQ ID NO: 173786 - RNA, 22 nt, Human
caaauguaaauucuuuugaagc

SEQ ID NO: 173787 - RNA, 22 nt, Human
ucagcuuugcaaguuagaaaau

SEQ ID NO: 173788 - RNA, 18 nt, Human
aaauuagauggaccugug

SEQ ID NO: 173789 - RNA, 19 nt, Human
uccuucagucagaucuggg

SEQ ID NO: 173790 - RNA, 22 nt, Human
agugugagauuaaaccgaauca

SEQ ID NO: 173791 - RNA, 22 nt, Human
aaaguggucugcaucccuucug

SEQ ID NO: 173792 - RNA, 22 nt, Human
gaggugucaucaggcagcucug

SEQ ID NO: 173793 - RNA, 22 nt, Human
cuggaagcuuguuugccagucu

SEQ ID NO: 173794 - RNA, 19 nt, Human
aucugccuguuaucacaua

SEQ ID NO: 173795 - RNA, 22 nt, Human
cccugcagaaccacagacaaac

SEQ ID NO: 173796 - RNA, 22 nt, Human
uuccucagcacaaagccaagau

SEQ ID NO: 173797 - RNA, 22 nt, Human
auuucuuucuggccacgguuuu

SEQ ID NO: 173798 - RNA, 22 nt, Human
uugcaacaucugaacauuuauc

SEQ ID NO: 173799 - RNA, 22 nt, Human
agcugcaagaagaggucccuga

SEQ ID NO: 173800 - RNA, 22 nt, Human
uuauuuaggagaaggaacccug

SEQ ID NO: 173801 - RNA, 22 nt, Human
guguccugagugaggccuggcc

SEQ ID NO: 173802 - RNA, 22 nt, Human
caguccuuucugaaauccuaua

SEQ ID NO: 173803 - RNA, 22 nt, Human
uugggcucaggaguuugagacc

SEQ ID NO: 173804 - RNA, 22 nt, Human
auugaaaaaugacuauugcuua

SEQ ID NO: 173805 - RNA, 22 nt, Human
uccagaccuagggcaccccagu

SEQ ID NO: 173806 - RNA, 22 nt, Human
gugcauuugugcaugcacaugu

SEQ ID NO: 173807 - RNA, 22 nt, Human
agaugguuuugucuuuaugauu

SEQ ID NO: 173808 - RNA, 22 nt, Human
acaaugaacacacaaggaauuc

SEQ ID NO: 173809 - RNA, 19 nt, Human
cuguugcuggggcucucuu

SEQ ID NO: 173810 - RNA, 22 nt, Human
cuuuaugguaaguauagaugac

SEQ ID NO: 173811 - RNA, 22 nt, Human
auggcauuugaaucugucuuuu

SEQ ID NO: 173812 - RNA, 20 nt, Human
auguccucagccacugcccu

SEQ ID NO: 173813 - RNA, 22 nt, Human
cuggcuuuaacccuacaaaccu

SEQ ID NO: 173814 - RNA, 22 nt, Human
acagauuuauugaagcugcugc

SEQ ID NO: 173815 - RNA, 22 nt, Human
caauuucagguggauagguuuu

SEQ ID NO: 173816 - RNA, 22 nt, Human
guucuucagauuccauuucagu

SEQ ID NO: 173817 - RNA, 22 nt, Human
aagaauuaucugaaagcugugu

SEQ ID NO: 173818 - RNA, 22 nt, Human
ccaggccucaccugcccaccua

SEQ ID NO: 173819 - RNA, 22 nt, Human
uuuaacuuaaucugcuugauga

SEQ ID NO: 173820 - RNA, 22 nt, Human
ccagacaguuccuugagguuca

SEQ ID NO: 173821 - RNA, 19 nt, Human
auucagcauucugcacuuc

SEQ ID NO: 173822 - RNA, 22 nt, Human
uaugugucugucgugcauaaau

SEQ ID NO: 173823 - RNA, 22 nt, Human
uuucaguuuaugucuugaauua

SEQ ID NO: 173824 - RNA, 22 nt, Human
ugauugacuuuagaauagcacu

SEQ ID NO: 173825 - RNA, 22 nt, Human
uccucuccauauuuucugauuu

SEQ ID NO: 173826 - RNA, 22 nt, Human
ugguuccacuaaccugagagcc

SEQ ID NO: 173827 - RNA, 22 nt, Human
aaucagaauuuguccccugagu

SEQ ID NO: 173828 - RNA, 22 nt, Human
cuucuucauguauugauagucu

SEQ ID NO: 173829 - RNA, 22 nt, Human
agcauaaaggcacuagaaagag

SEQ ID NO: 173830 - RNA, 22 nt, Human
guagggacaugccauuaucuca

SEQ ID NO: 173831 - RNA, 20 nt, Human
aaaggaauauaugaaguaua

SEQ ID NO: 173832 - RNA, 22 nt, Human
uccuggguggcucugcccggcu

SEQ ID NO: 173833 - RNA, 22 nt, Human
aggaccuguaccucagcaucua

SEQ ID NO: 173834 - RNA, 21 nt, Human
agcagguguaaaggaggaaau

SEQ ID NO: 173835 - RNA, 22 nt, Human
aauuucaauuacuuuugcacca

SEQ ID NO: 173836 - RNA, 22 nt, Human
cuuccagagauccaugaauacc

SEQ ID NO: 173837 - RNA, 22 nt, Human
uauacagaaagaauucaagucu

SEQ ID NO: 173838 - RNA, 22 nt, Human
aauucacaaaaguuagauccau

SEQ ID NO: 173839 - RNA, 22 nt, Human
auuaaauuuucacuaggcuccc

SEQ ID NO: 173840 - RNA, 22 nt, Human
uuugaauaucacaaacuuucaa

SEQ ID NO: 173841 - RNA, 22 nt, Human
ucucugaaggggagcuguuuaa

SEQ ID NO: 173842 - RNA, 22 nt, Human
ugacccuuagugaacauuagaa

SEQ ID NO: 173843 - RNA, 22 nt, Human
ugcuacuacuugucaacgguca

SEQ ID NO: 173844 - RNA, 22 nt, Human
uuacagaaaggaaggacugacu

SEQ ID NO: 173845 - RNA, 14 nt, Human
agcugcaagcaucc

SEQ ID NO: 173846 - RNA, 22 nt, Human
cuauacagagcauccuuaacuu

SEQ ID NO: 173847 - RNA, 22 nt, Human
agaaauguugaauacacaaaau

SEQ ID NO: 173848 - RNA, 15 nt, Human
cuccaugauuuugca

SEQ ID NO: 173849 - RNA, 20 nt, Human
ggcaggaccccaguggcauc

SEQ ID NO: 173850 - RNA, 22 nt, Human
uccugcagagucccacugauuu

SEQ ID NO: 173851 - RNA, 22 nt, Human
cuacauaaauuuaucacagacu

SEQ ID NO: 173852 - RNA, 22 nt, Human
uuucaaaccuacuuguauguuu

SEQ ID NO: 173853 - RNA, 22 nt, Human
gccugggugagggucuccuuca

SEQ ID NO: 173854 - RNA, 22 nt, Human
aaacuucauggauaauauaaag

SEQ ID NO: 173855 - RNA, 22 nt, Human
aggcagguguugggagacacca

SEQ ID NO: 173856 - RNA, 22 nt, Human
aauuucagagguagagauucua

SEQ ID NO: 173857 - RNA, 22 nt, Human
gcaggugguggcgcgcgcccug

SEQ ID NO: 173858 - RNA, 22 nt, Human
uauuauugcaaguauauaaagu

SEQ ID NO: 173859 - RNA, 23 nt, Human
ugcugcccacucuuccagcccuc

SEQ ID NO: 173860 - RNA, 22 nt, Human
ucuucacaugaccuucaugucu

SEQ ID NO: 173861 - RNA, 22 nt, Human
uuugacauggaauaacucauuu

SEQ ID NO: 173862 - RNA, 22 nt, Human
aggcagaccaugaaucaugacc

SEQ ID NO: 173863 - RNA, 22 nt, Human
auugcagauucuucucagggag

SEQ ID NO: 173864 - RNA, 22 nt, Human
ugauagagcacuaaguagugua

SEQ ID NO: 173865 - RNA, 22 nt, Human
ucaucaguguccuuaucacuua

SEQ ID NO: 173866 - RNA, 21 nt, Human
ucuuccugcuccacacucccc

SEQ ID NO: 173867 - RNA, 22 nt, Human
uagggcucugagaguucagccu

SEQ ID NO: 173868 - RNA, 22 nt, Human
ugaaugauacagaauuauguag

SEQ ID NO: 173869 - RNA, 22 nt, Human
auauaugcauguguacuuaugu

SEQ ID NO: 173870 - RNA, 22 nt, Human
gcuggaucccugugggaguggu

SEQ ID NO: 173871 - RNA, 22 nt, Human
agcuuguuaaggaugcauauua

SEQ ID NO: 173872 - RNA, 22 nt, Human
gcagggcaguaagagcuagagu

SEQ ID NO: 173873 - RNA, 22 nt, Human
gcacccaguuugucucaggguu

SEQ ID NO: 173874 - RNA, 22 nt, Human
cccuuccuccucgccugucaga

SEQ ID NO: 173875 - RNA, 22 nt, Human
uaggugguugucugcuuuccua

SEQ ID NO: 173876 - RNA, 22 nt, Human
acagguguagaaaacagauuau

SEQ ID NO: 173877 - RNA, 22 nt, Human
uuuacuucugcauuuccccuag

SEQ ID NO: 173878 - RNA, 22 nt, Human
uauugcugaaaugcugaguuca

SEQ ID NO: 173879 - RNA, 22 nt, Human
acauuuauauaacucacuagga

SEQ ID NO: 173880 - RNA, 22 nt, Human
acagggcagagugaaaugcuau

SEQ ID NO: 173881 - RNA, 22 nt, Human
auucagcaaacauuuauugugu

SEQ ID NO: 173882 - RNA, 22 nt, Human
gaucauuugcaggaaacauuaa

SEQ ID NO: 173883 - RNA, 22 nt, Human
uuagaaaugcacccaagaccua

SEQ ID NO: 173884 - RNA, 22 nt, Human
ugggcagggagcuggaaccaca

SEQ ID NO: 173885 - RNA, 22 nt, Human
gcugccacucugagcuugcuuc

SEQ ID NO: 173886 - RNA, 22 nt, Human
gaacuguaguuaauacuacaca

SEQ ID NO: 173887 - RNA, 22 nt, Human
uuaccuaaaauagcucaauuua

SEQ ID NO: 173888 - RNA, 22 nt, Human
gaggggaugcagagaggcuuau

SEQ ID NO: 173889 - RNA, 22 nt, Human
cacccagccuucacacaggagu

SEQ ID NO: 173890 - RNA, 22 nt, Human
uuguaaauaguaguaagaugcc

SEQ ID NO: 173891 - RNA, 22 nt, Human
uagcuuuagaaauauucucaga

SEQ ID NO: 173892 - RNA, 22 nt, Human
agcucugacauugauucucagc

SEQ ID NO: 173893 - RNA, 22 nt, Human
aaagcugcuaugaacauucuau

SEQ ID NO: 173894 - RNA, 20 nt, Human
aaaaucucccagaaacuuau

SEQ ID NO: 173895 - RNA, 20 nt, Human
aggaggaaaaaaugacgagc

SEQ ID NO: 173896 - RNA, 22 nt, Human
gcaugcagucaaccaguaaggg

SEQ ID NO: 173897 - RNA, 22 nt, Human
uccugcaggcuugaguccucag

SEQ ID NO: 173898 - RNA, 22 nt, Human
ggggaccuaggcucugucucuu

SEQ ID NO: 173899 - RNA, 22 nt, Human
ucucucagggggaaggcugaag

SEQ ID NO: 173900 - RNA, 22 nt, Human
agacagacguagugugagagua

SEQ ID NO: 173901 - RNA, 19 nt, Human
aauacaguguuauagaauu

SEQ ID NO: 173902 - RNA, 22 nt, Human
gacagaggagaagaugcugugg

SEQ ID NO: 173903 - RNA, 22 nt, Human
uacacacaugcauuugccuuau

SEQ ID NO: 173904 - RNA, 22 nt, Human
ucaauguaauaaaauacucuau

SEQ ID NO: 173905 - RNA, 22 nt, Human
ccugggucuccuccugcuggcu

SEQ ID NO: 173906 - RNA, 22 nt, Human
aagggcucugggcuacgcacug

SEQ ID NO: 173907 - RNA, 22 nt, Human
acagcuuuguguuaaugggaag

SEQ ID NO: 173908 - RNA, 22 nt, Human
acuuagauuccugguaccuccg

SEQ ID NO: 173909 - RNA, 22 nt, Human
uuauucagauuggcuacaggau

SEQ ID NO: 173910 - RNA, 22 nt, Human
uguacauagaaaggauacagcu

SEQ ID NO: 173911 - RNA, 22 nt, Human
ucuggcuggcagugauggugug

SEQ ID NO: 173912 - RNA, 22 nt, Human
gaauaaucaugaaauucaguga

SEQ ID NO: 173913 - RNA, 22 nt, Human
cagaucuguuugccagaucagc

SEQ ID NO: 173914 - RNA, 22 nt, Human
acagcaugucuaguuaaauacu

SEQ ID NO: 173915 - RNA, 22 nt, Human
auccuuaguuaagaacaggagu

SEQ ID NO: 173916 - RNA, 22 nt, Human
gaauacaugauacaugaacugc

SEQ ID NO: 173917 - RNA, 22 nt, Human
ccuacaggaaauuguaucaaaa

SEQ ID NO: 173918 - RNA, 20 nt, Human
uacuggauuagggcucaccc

SEQ ID NO: 173919 - RNA, 22 nt, Human
uuuagggacaagggucuggggu

SEQ ID NO: 173920 - RNA, 22 nt, Human
agaaaugcucaggucaacuuaa

SEQ ID NO: 173921 - RNA, 22 nt, Human
aagagcaucuauuucacagugg

SEQ ID NO: 173922 - RNA, 22 nt, Human
uguacaaugccagggaacacca

SEQ ID NO: 173923 - RNA, 22 nt, Human
ugcugagaucugccaguagaug

SEQ ID NO: 173924 - RNA, 22 nt, Human
uggcaagggauuguggagaacu

SEQ ID NO: 173925 - RNA, 19 nt, Human
guuaggcaggguggggagu

SEQ ID NO: 173926 - RNA, 22 nt, Human
agugucugccuauuuuucaagc

SEQ ID NO: 173927 - RNA, 22 nt, Human
cuguugcugagguucaaggguc

SEQ ID NO: 173928 - RNA, 22 nt, Human
uucacauuucauaccacagcuu

SEQ ID NO: 173929 - RNA, 22 nt, Human
guuacucuugagaggcugaggu

SEQ ID NO: 173930 - RNA, 22 nt, Human
cuuccucccggcccaugcucug

SEQ ID NO: 173931 - RNA, 20 nt, Human
gagucacagaagaagcugaa

SEQ ID NO: 173932 - RNA, 22 nt, Human
aggaggaaggcuucauuagguu

SEQ ID NO: 173933 - RNA, 22 nt, Human
acauguggaggaggcgagggua

SEQ ID NO: 173934 - RNA, 22 nt, Human
cuggauguaaagggugaagaaa

SEQ ID NO: 173935 - RNA, 22 nt, Human
cuuuaauuaggaaguauaauga

SEQ ID NO: 173936 - RNA, 22 nt, Human
ugaggccagugacauauauuaa

SEQ ID NO: 173937 - RNA, 22 nt, Human
ugaaauaggaaacagauguuuc

SEQ ID NO: 173938 - RNA, 22 nt, Human
ugaaacaagauccacagacuug

SEQ ID NO: 173939 - RNA, 22 nt, Human
cagcuuuaggacucauaauaaa

SEQ ID NO: 173940 - RNA, 22 nt, Human
uucacaguggcugugccauuug

SEQ ID NO: 173941 - RNA, 22 nt, Human
ugcuuccugaggccgucuucuc

SEQ ID NO: 173942 - RNA, 22 nt, Human
ugcagggccuugggaugugucc

SEQ ID NO: 173943 - RNA, 22 nt, Human
uuccuucucuguggggaaggca

SEQ ID NO: 173944 - RNA, 22 nt, Human
ugugcauguauugauuuguacc

SEQ ID NO: 173945 - RNA, 22 nt, Human
auuucaaggcuauuaauauaaa

SEQ ID NO: 173946 - RNA, 22 nt, Human
gcugggucagaaucucccugug

SEQ ID NO: 173947 - RNA, 22 nt, Human
uugaagaaauuauuuuauauag

SEQ ID NO: 173948 - RNA, 23 nt, Human
uuucaacuccugccauuauuucu

SEQ ID NO: 173949 - RNA, 22 nt, Human
auuugcuggugaaauagugaca

SEQ ID NO: 173950 - RNA, 22 nt, Human
auuacaagaugcauccauauuu

SEQ ID NO: 173951 - RNA, 22 nt, Human
uccuucugaaaaaugcacacga

SEQ ID NO: 173952 - RNA, 22 nt, Human
auugcugaaaguauuuuaugac

SEQ ID NO: 173953 - RNA, 22 nt, Human
aaagcagagguugcagugagcu

SEQ ID NO: 173954 - RNA, 22 nt, Human
cagugaggcucugcugagcggu

SEQ ID NO: 173955 - RNA, 22 nt, Human
auuccuucuaaaacgcugcccu

SEQ ID NO: 173956 - RNA, 22 nt, Human
cccagugucaccaacaggacac

SEQ ID NO: 173957 - RNA, 22 nt, Human
gacaggcuucaugauggcagga

SEQ ID NO: 173958 - RNA, 22 nt, Human
uguucuucuagauugccuuuua

SEQ ID NO: 173959 - RNA, 22 nt, Human
cagaggcucagauggcccuggc

SEQ ID NO: 173960 - RNA, 22 nt, Human
ccuuccuuuuacugucuccgga

SEQ ID NO: 173961 - RNA, 20 nt, Human
cccaguguccagccuugcca

SEQ ID NO: 173962 - RNA, 22 nt, Human
ccaggugugccagcagggacug

SEQ ID NO: 173963 - RNA, 22 nt, Human
aguacaacauuagaguaucuua

SEQ ID NO: 173964 - RNA, 22 nt, Human
uuguuucauggggauguuuauu

SEQ ID NO: 173965 - RNA, 22 nt, Human
cagaagcaaguagugauucuuu

SEQ ID NO: 173966 - RNA, 22 nt, Human
ucagggaccccucugaguggag

SEQ ID NO: 173967 - RNA, 22 nt, Human
acaacauucuuaaauacacuga

SEQ ID NO: 173968 - RNA, 22 nt, Human
gauggcuucacuuacauggcug

SEQ ID NO: 173969 - RNA, 22 nt, Human
acuugaauuauauuucuagaga

SEQ ID NO: 173970 - RNA, 22 nt, Human
aauacuuaugugaccucauuuu

SEQ ID NO: 173971 - RNA, 22 nt, Human
ugggccaggcaugugaucagca

SEQ ID NO: 173972 - RNA, 22 nt, Human
ugggcuccagcaccugugcucu

SEQ ID NO: 173973 - RNA, 22 nt, Human
aaaucaguuguuauauuaaaga

SEQ ID NO: 173974 - RNA, 22 nt, Human
aucuagauuagguauaagagcu

SEQ ID NO: 173975 - RNA, 22 nt, Human
cagaaauaaacuucucacaucg

SEQ ID NO: 173976 - RNA, 22 nt, Human
uuuauuuggcauccagggagaa

SEQ ID NO: 173977 - RNA, 22 nt, Human
uaaaggcuuuuacaggagugca

SEQ ID NO: 173978 - RNA, 22 nt, Human
caaaugauagagccgauuauca

SEQ ID NO: 173979 - RNA, 22 nt, Human
uccaggcaggguuaaggguccu

SEQ ID NO: 173980 - RNA, 22 nt, Human
ccauucuuucagugucucaugu

SEQ ID NO: 173981 - RNA, 22 nt, Human
ugcaaaaauugcuggaaucuuu

SEQ ID NO: 173982 - RNA, 22 nt, Human
cuggguguagauggaaguuugg

SEQ ID NO: 173983 - RNA, 22 nt, Human
acuuuacucuucauaugugaca

SEQ ID NO: 173984 - RNA, 22 nt, Human
ugcaggugguccuuccucugcu

SEQ ID NO: 173985 - RNA, 22 nt, Human
ucuguucaguuguaccuucccc

SEQ ID NO: 173986 - RNA, 22 nt, Human
ugcuuuaaaauggacuguuuug

SEQ ID NO: 173987 - RNA, 22 nt, Human
caauuuuuguacuuauaguacu

SEQ ID NO: 173988 - RNA, 22 nt, Human
gaacuugggagaagggagugug

SEQ ID NO: 173989 - RNA, 22 nt, Human
uuuaaugauagcuguuucacau

SEQ ID NO: 173990 - RNA, 22 nt, Human
uacuuucuuucccaagaggugg

SEQ ID NO: 173991 - RNA, 19 nt, Human
gacaggacgaagggaaguu

SEQ ID NO: 173992 - RNA, 22 nt, Human
uuuccaaagguggcaggaacaa

SEQ ID NO: 173993 - RNA, 22 nt, Human
uuuccaaaaugaaucuaaugca

SEQ ID NO: 173994 - RNA, 22 nt, Human
agcaggugagcacagccaggcu

SEQ ID NO: 173995 - RNA, 22 nt, Human
ucagguggccaaaugggagcgc

SEQ ID NO: 173996 - RNA, 22 nt, Human
agcucccagcuccuuugagaga

SEQ ID NO: 173997 - RNA, 22 nt, Human
uuauugagaccguaagucaggu

SEQ ID NO: 173998 - RNA, 22 nt, Human
gaauuucauuuguuuccuacca

SEQ ID NO: 173999 - RNA, 22 nt, Human
cuucuucaucuguaaaacuugg
